United States Patent 8,119,385 (NUCLEIC ACIDS AND PROTEINS AND METHODS FOR MAKING AND USING THEM) - sequence listing, part 4

SEQ ID NO: 15651 - DNA, 327 bp, Unknown
  Obtained from environmental sample
  misc_feature (1)..(327): n is a, c, g, or t
atgatgtggatgctgcgactgccaagcaacggtgacctcttttttgcagtgttaacaccaatatcttatgaaaatgaaattaaagtaagcactcagtttccaatttcagatgaagaaaaaattgcgactataaaaggttataagatattacgagaaaaaattaaaaattatccagaaataaattttattgacctatcaaggatatttgatacacctgaaaattatttagataatatgcattatagttatcaaggaaaagtaaaatatgttaatgatttaacaaatcacatgaatacaatttcaaatttcaaagatttagataagtaa

SEQ ID NO: 15652 - protein, 108 aa, Unknown
  Obtained from environmental sample
  misc_feature (1)..(108): Xaa is any amino acid
MMWMLRLPSNGDLFFAVLTPISYENEIKVSTQFPISDEEKIATIKGYKILREKIKNYPEINFIDLSRIFDTPENYLDNMHYSYQGKVKYVNDLTNHMNTISNFKDLDK

SEQ ID NO: 15653 - DNA, 639 bp, Unknown
  Obtained from environmental sample
  misc_feature (1)..(639): n is a, c, g, or t
atgaaaaatatatttataaacagtaccatttttataatctcaacgataattatgttacttatagttgaaggagttttaagaattaaaaactctgatatgaaaaattacaatatagagatgtggcattatgcaaaagagttgaaagttattagtaataatccaaaactaggacatgaacataaaatctcttctcatgctgttttacaatcggttaagattcgtacaaataactatggcttacgcggtgaagatattacaatagaaaaagaggttccaaggagaatccttatattaggaagttctgcgacattgggatggggagttgatgaaaaccagactatggctcacgttcttggtgaaaagctaggtaaagaggtggaagtcttaaatgctggcatagggaactataatacgctaagatatgtagaactttttttatcaaaactcaaggtattaaaaccaacagatattattattcactactttctcaatgatactgaagatttaaaacctgcagattcaaattggtttttacaacatagtcaacttgcagtagtaatatggaataaattttatatgataaaaaacagagagaactcacttgaggattattaccaagagatatataccaagagagta

SEQ ID NO: 15654 - protein, 213 aa, Unknown
  Obtained from environmental sample
  misc_feature (1)..(213): Xaa is any amino acid
MKNIFINSTIFIISTIIMLLIVEGVLRIKNSDMKNYNIEMWHYAKELKVISNNPKLGHEHKISSHAVLQSVKIRTNNYGLRGEDITIEKEVPRRILILGSSATLGWGVDENQTMAHVLGEKLGKEVEVLNAGIGNYNTLRYVELFLSKLKVLKPTDIIIHYFLNDTEDLKPADSNWFLQHSQLAVVIWNKFYMIKNRENSLEDYYQEIYTKRV

SEQ ID NO: 15655 - DNA, 828 bp, Unknown
  Obtained from environmental sample
  misc_feature (1)..(828): n is a, c, g, or t
atgcttcgtctgcagctctctgaaaaagaaattgccagccgacaggcaaatgatctgtttggaaaatatgaacgacttagtaattcccccggtggaggtggtatctcggccaagcagttacaggaaaaaaagaccgagttcaaccgagttgacacagagtataagcagatgctgtcccgtattgatgacatggaactcactttttccagacaatacttgagcaacaatcaaaaaattgaacaactcaatatgcaacttattcagtcgaaacttgaatatgataagaaaaaagccttcataacccaatccgcaagagagatggaaatcaaatttcttgctgcccaggaggcctacgaagccgcttccagaattgatttttccgaccttgacgagaataactttctggttatccgctcacctgttacaggtgaaatttcaacactttcctatcgtcaacccggtgaaaaagtaagcccagccactcctctggtaactatctcagaacagaacagtggtaaaattgttaccctctctatcatggataaagacaggggcttattaaaagttggccaacaggccaaactgaaattcctcgcattcccgtatcaacgatttggttttttagcgggaaaaattgaatatttatccaatagtgccaagttgactcaggatggcaggtccctctacnagggaaaggtccacctgacaaaagattattatatggcaaatggtaaaaaactaccggtccgttttggcatgactgcaaatgtagaaatagttattcagcaaaagaaggtaatcgattttgcccttgcccccctttcgtaa

SEQ ID NO: 15656 - protein, 275 aa, Unknown
  Obtained from environmental sample
  misc_feature (1)..(275): Xaa is any amino acid
MLRLQLSEKEIASRQANDLFGKYERLSNSPGGGGISAKQLQEKKTEFNRVDTEYKQMLSRIDDMELTFSRQYLSNNQKIEQLNMQLIQSKLEYDKKKAFITQSAREMEIKFLAAQEAYEAASRIDFSDLDENNFLVIRSPVTGEISTLSYRQPGEKVSPATPLVTISEQNSGKIVTLSIMDKDRGLLKVGQQAKLKFLAFPYQRFGFLAGKIEYLSNSAKLTQDGRSLYXGKVHLTKDYYMANGKKLPVRFGMTANVEIVIQQKKVIDFALAPLS

SEQ ID NO: 15657 - DNA, 891 bp, Unknown
  Obtained from environmental sample
  misc_feature (1)..(891): n is a, c, g, or t
ttgggaagaatttgtccacaagatgtattatgtgagggtgattgtacgctcaatgatactcatggtgctattactattggtgcagttgaaacacatattagtgaaacaggatttgaacaaggtttcaaaccaaaatttgctagtgaaaaaataggaaaaaaagtagcagttgtaggaagtggaccagctggtattagtgtggctacttttcttttaagagcaggtattgatgtagatatgtttgaaagagctagtagagctggtggtcttttaacttatggaattccaggatttaaacttgataagtttagagtacaaagaagaattgattggttagttgaagctggtatgaatctttatacagattgtgaaattggaaaagataaatcatttgaagaattagagaaaaattacgatgctgtatttataggaataggtgcaacaaaagggaagaaaactggaatttcaggagaagataacgaaaatgtatatcttgctatggagtttttaacaggaatccaaaaaagaaattttgaagaggaaaatacaaattttatagatgtaaaagataagaatgtagttgtaataggtggtggagatactgctatggactgtgtaagaacatctataagagagggagcaacaaccgttaaatgtctttatagaagagatgaggctaatatgcctggaagtaaaaaagaggttgtaaactcaaaagaagagggtgtggagtttgtatttaatgtgagtccaaaatctattgagtcaaatggtgtaatagttgaacaaacaacaatgagtgaagctgatgaatcaggaagacaaagtgtgaaattagtgcaaaatagtgattatttagaagaagccaaaaattataatactttgccctag

SEQ ID NO: 15658 - protein, 296 aa, Unknown
  Obtained from environmental sample
  DOMAIN (54)...(294): Pyridine nucleotide-disulphide oxidoreductase
  misc_feature (1)..(296): Xaa is any amino acid
MGRICPQDVLCEGDCTLNDTHGAITIGAVETHISETGFEQGFKPKFASEKIGKKVAVVGSGPAGISVATFLLRAGIDVDMFERASRAGGLLTYGIPGFKLDKFRVQRRIDWLVEAGMNLYTDCEIGKDKSFEELEKNYDAVFIGIGATKGKKTGISGEDNENVYLAMEFLTGIQKRNFEEENTNFIDVKDKNVVVIGGGDTAMDCVRTSIREGATTVKCLYRRDEANMPGSKKEVVNSKEEGVEFVFNVSPKSIESNGVIVEQTTMSEADESGRQSVKLVQNSDYLEEAKNYNTLP

SEQ ID NO: 15659 - DNA, 444 bp, Unknown
  Obtained from environmental sample
  misc_feature (1)..(444): n is a, c, g, or t
gtgtataaatttatcaccgctttgatttccctctttttactaacaacacatagttatgccttagatattacccctatagatggaggtcataatttacgcatacctgttatcaaacctgtttctggtgggtttaaagggaattgcattccctttgagaaagtatcctttacttataatctcatgcctcattttcaaaatagcaaagacccatctaatacatcttcaataacatttgcagtgcgtgattcaaaacgtagggaaacaaaaaacataattacccttcaagatgggacatcggcaatacgactacgcgtaaaaacagcagcacaaggtagggttttagtattagagtatgtagacaataaaaaggtgcgtgcttcagctcaagcgccttcactaccctttacttggaaagaagcaaagttaaagtggtcaaaccaatga

SEQ ID NO: 15660 - protein, 147 aa, Unknown
  Obtained from environmental sample
  SIGNAL (1)...(20)
  misc_feature (1)..(147): Xaa is any amino acid
MYKFITALISLFLLTTHSYALDITPIDGGHNLRIPVIKPVSGGFKGNCIPFEKVSFTYNLMPHFQNSKDPSNTSSITFAVRDSKRRETKNIITLQDGTSAIRLRVKTAAQGRVLVLEYVDNKKVRASAQAPSLPFTWKEAKLKWSNQ

SEQ ID NO: 15661 - DNA, 732 bp, Unknown
  Obtained from environmental sample
  misc_feature (1)..(732): n is a, c, g, or t
atgtttttttccaataaagctaaagatgaagaatgtgagttacttaagtccaaagttcatgaacttgaggaaaaactcaaacaagttgaattaaacaataaaattgaaattgaaaagttagtatctaagtatgatagcaaggttgctagtttagagaacgaaaaagttaatctagaaagaatagctgcattttctacaacagagggtattgttgctatagattctaacaaaaatctcttttttatgaatgatagggctaaagaaaatattaaaaatacaaatagtctaatggatgtaatctctcaagagggtgaacggattatcatagaagattgtgaagctaaattagagtataaaaaatatgataatttaacaattgcttcactagtgaaaacatcaattcatgataatgctgatgatggattacttcataagcataaccaaaatatcaatgtttctttaacaaatacacaaagtgtgtatcaagagttattagttgaacttgatagtatggcaaaagaatctaaagagacagcaaatggttctaatgaaggtttgtcattaactaaaaatattgttaaggatactgaaaacttgaacaatcaaattgtaactgaaaatgagattgtaaataatttagtacaaaaaaatgatgatatagctcaagctatcgttgttattgaccaaatttgcattccaacaaaaattctttcattaaatgctgcttgttga

SEQ ID NO: 15662 - protein, 243 aa, Unknown
  Obtained from environmental sample
  misc_feature (1)..(243): Xaa is any amino acid
MFFSNKAKDEECELLKSKVHELEEKLKQVELNNKIEIEKLVSKYDSKVASLENEKVNLERIAAFSTTEGIVAIDSNKNLFFMNDRAKENIKNTNSLMDVISQEGERIIIEDCEAKLEYKKYDNLTIASLVKTSIHDNADDGLLHKHNQNINVSLTNTQSVYQELLVELDSMAKESKETANGSNEGLSLTKNIVKDTENLNNQIVTENEIVNNLVQKNDDIAQAIVVIDQICIPTKILSLNAAC

SEQ ID NO: 15663 - DNA, 324 bp, Unknown
  Obtained from environmental sample
  misc_feature (1)..(324): n is a, c, g, or t
ttggaaccaattatacctaaaataaaaactcaaaatactgagctcgtgatcactgcgaatcttccatacctcgatgaatcctggtacgatgaatcaccgtcaatcaaatacgaaccaaagtcagcattagtagcaaaagaaaaagggacagcactctatcgtgaactactagaacaaatagataaaacaaaatcatctgccatagtaatgatggagatagacccacggcaggtagatgatatgaaaaaactattgcacggaagatcatatgaaatcaaaaaagatctaagcaataacgatcgactcatcatcctctcaatataa

SEQ ID NO: 15664 - protein, 107 aa, Unknown
  Obtained from environmental sample
  misc_feature (1)..(107): Xaa is any amino acid
MEPIIPKIKTQNTELVITANLPYLDESWYDESPSIKYEPKSALVAKEKGTALYRELLEQIDKTKSSAIVMMEIDPRQVDDMKKLLHGRSYEIKKDLSNNDRLIILSI

SEQ ID NO: 15665 - DNA, 639 bp, Unknown
  Obtained from environmental sample
  misc_feature (1)..(639): n is a, c, g, or t
gtgtatttgaggcaaacttataagttttataatagacaattacctattgataataatgtgatatataatcctttcccattaaaattaaaagaattggaaacaaatataaatattaacaataatgtagttaaaatatttatgcctgcaaattatttagaaaataaaggtcataaattagtttttcaagctttagataatatatcaagagaagacataaaagtatatttagctggtagtggttcatttgatattcagacaaatagtttaaaagataaattgataaaagacaataagcttgtcgagttaggttttattgacgatattgataaatattatcaaatttctgactatgtattatcgttttcacaaaatgaaggtttacctagaactgttgtggagggacttatgcgggggtgtcatattattacttcaaactatgaagttagttttgaaattaaaaaattactattaaatcaaaatgtttatacaatcttaccaagagaaagtcatagtttggagatatgtttaagggatttaaaacaggttaatcataaagaggttgattcaaatattaaacaagttttttcactagaaaattatgttagtgctgtatataattattatatacagatgttgtaa

SEQ ID NO: 15666 - protein, 212 aa, Unknown
  Obtained from environmental sample
  DOMAIN (29)...(193): Glycosyl transferases group 1
  misc_feature (1)..(212): Xaa is any amino acid
MYLRQTYKFYNRQLPIDNNVIYNPFPLKLKELETNININNNVVKIFMPANYLENKGHKLVFQALDNISREDIKVYLAGSGSFDIQTNSLKDKLIKDNKLVELGFIDDIDKYYQISDYVLSFSQNEGLPRTVVEGLMRGCHIITSNYEVSFEIKKLLLNQNVYTILPRESHSLEICLRDLKQVNHKEVDSNIKQVFSLENYVSAVYNYYIQML

SEQ ID NO: 15667 - DNA, 507 bp, Unknown
  Obtained from environmental sample
  misc_feature (1)..(507): n is a, c, g, or t
atgaaaaatatattatttgtagatactggatttgaatatggaggcggtactaaaagttttctttatttattagaagggttgctacaatattctaaagagtataatttttatgtattttttgaacatgactatttaataaacaatgataaaacgattaatcagtatttaaaaactttaaatgttactgttatagaaaataatttttattataaaaaaatatcaaaaataaaaaaagaactttatagattagtttctaaaaaatttctttataaaaaagaaattcaatataaaatagattttgctgaagaagttttacaatctaatcattatgatttaatacatttaaataaccattttggaacaaatttagaatatattattggtgcaaataatttaaaaataccagtagtccaacatttaagaaagaattctttattatctcattatcagttaaaattattaaaaggtcttagttttagaactattagtgtatctgaggcaacttaa

SEQ ID NO: 15668 - protein, 168 aa, Unknown
  Obtained from environmental sample
  misc_feature (1)..(168): Xaa is any amino acid
MKNILFVDTGFEYGGGTKSFLYLLEGLLQYSKEYNFYVFFEHDYLINNDKTINQYLKTLNVTVIENNFYYKKISKIKKELYRLVSKKFLYKKEIQYKIDFAEEVLQSNHYDLIHLNNHFGTNLEYIIGANNLKIPVVQHLRKNSLLSHYQLKLLKGLSFRTISVSEAT

SEQ ID NO: 15669 - DNA, 666 bp, Unknown
  Obtained from environmental sample
  misc_feature (1)..(666): n is a, c, g, or t
atgagacatattaagaaaaagaaattgtgtcaagattttgaaaatttcattaaggataataaattagacaaataccttgataaatatattgaagatagttctttgaaagcatctccttggaggaaatttactaatgagactgatggaggaacgaaggtaaaaagaaaattagcaaatcatttatataaagaacagaaaggactttgtatatattgtcagcaaagcttttttggagcactaatcaataggcgtttatctgaattttcgcatattgaacatatcaagccaaaagcaaaaaaaaggtatcctgaaaatacttttaatcaaaataatttaacactttcttgcaatggatttaattgtaatattttggaaaatgaaaatgaaaaagagttttgtggacataataaagatcaaaaatttgataaaaatttattcttaaatcctattgaagttgtagatatcgaaaaatattttgaatataaaataaatggagaaattcaaatttccgatgaattaggtgatgataaaaaaaaaagatcagaatatatgatagaaattttagatttgaataatgaacaactaattgatatgagaagactaaattatattgaaatagcagaaaatcacgaaaatgaaattgatgaatttcttgatgaaatgtag

SEQ ID NO: 15670 - protein, 221 aa, Unknown
  Obtained from environmental sample
  misc_feature (1)..(221): Xaa is any amino acid
MRHIKKKKLCQDFENFIKDNKLDKYLDKYIEDSSLKASPWRKFTNETDGGTKVKRKLANHLYKEQKGLCIYCQQSFFGALINRRLSEFSHIEHIKPKAKKRYPENTFNQNNLTLSCNGFNCNILENENEKEFCGHNKDQKFDKNLFLNPIEVVDIEKYFEYKINGEIQISDELGDDKKKRSEYMIEILDLNNEQLIDMRRLNYIEIAENHENEIDEFLDEM

SEQ ID NO: 15671 - DNA, 756 bp, Unknown
  Obtained from environmental sample
  misc_feature (1)..(756): n is a, c, g, or t
gtgaaacttcaagttgaagcattaagagaacaagagcaaatgatgatacaacaagcaaaattagcagagatgggtgatatgcttagtgatatttcgcatcaatggaaacaacctcttacaattttatcaatgcagttagaaaatatgcagttggatatggaagatatggggattaataataaacttataaacgaatatttcacagaaagttttactcttataaaacatatgtccactacagtagaagattttaaaaacttttatagacaagatactgaaaaaagaacatttaatatatacaaagcaatagaagatgttgtaaatattgaaaaaagtgtattctataaatataccataaaaaatgagattattagtgatacaatagatatagatttttttggattttatggacaatttaaacaagttgttctaagcttaacaaataatgcaattgatcaaattgttgaaaaatatgaagaggggtctttacaaaaaggtgaaggtaaaataagttttacaataatcaaagatgcaaatacaataagtattacaataagtgataacgcaggagggatagaaaaaagtattcttaacaaaatatttataccttattttacaactaaagaaacaaaaggtggttctggaattggtttatacatggctaaaacaattatagaaaaaaatttcaatggaatactaagtgtaaaaaacaatcagtttggtgctgattttagtataaatttagatacgaagtaa

SEQ ID NO: 15672 - protein, 251 aa, Unknown
  Obtained from environmental sample
  DOMAIN (23)...(93): His Kinase A (phosphoacceptor) domain
  misc_feature (1)..(251): Xaa is any amino acid
MKLQVEALREQEQMMIQQAKLAEMGDMLSDISHQWKQPLTILSMQLENMQLDMEDMGINNKLINEYFTESFTLIKHMSTTVEDFKNFYRQDTEKRTFNIYKAIEDVVNIEKSVFYKYTIKNEIISDTIDIDFFGFYGQFKQVVLSLTNNAIDQIVEKYEEGSLQKGEGKISFTIIKDANTISITISDNAGGIEKSILNKIFIPYFTTKETKGGSGIGLYMAKTIIEKNFNGILSVKNNQFGADFSINLDTK

SEQ ID NO: 15673 - DNA, 306 bp, Unknown
  Obtained from environmental sample
  misc_feature (1)..(306): n is a, c, g, or t
ttgtgttttccccgaatttcactgaccaaaacttccctattaaatttagttccaattttnaggcttggtacaatagcgcctgaaattatgcctacccttaaacaacagagcaccttgtttcatcaaatcaatatcaaggtgaccggaaaaagaaaaaagaaggggcgcgcaaaaagggtggtttttttcgccaaaggcgaacagataaatgtactctttaatttttggcgcgttgataatactgaattttttgtctacggtttcaacctttataacccttatatcgttgggcaaattttgatttaa

SEQ ID NO: 15674 - protein, 101 aa, Unknown
  Obtained from environmental sample
  misc_feature (1)..(101): Xaa is any amino acid
MCFPRISLTKTSLLNLVPIXRLGTIAPEIMPTLKQQSTLFHQINIKVTGKRKKKGRAKRVVFFAKGEQINVLFNFWRVDNTEFFVYGFNLYNPYIVGQILI

SEQ ID NO: 15675 - DNA, 345 bp, Unknown
  Obtained from environmental sample
  misc_feature (1)..(345): n is a, c, g, or t
atggaattacaaattttagacaatactgctcccatttatgcaaaccttaaaaagtaccaatatcacggttctgtntatggtgtgattccttctaaaagaggatttttaaagcctgttggagaatggaacaaggaagaagtaattgttaagggttcaaaaattacagtaatcttgaatggcataacaataaccgatggtgatattaagaaagccagtttaaatggtactttagatcataaaaaccatcctggactacaacgtaaaaaaggtcatattgcctttttaggacatggatcacttgtttggttccgcaacattagaataaaaaatctaagcaataattaa

SEQ ID NO: 15676 - protein, 114 aa, Unknown
  Obtained from environmental sample
  misc_feature (1)..(114): Xaa is any amino acid
MELQILDNTAPIYANLKKYQYHGSVYGVIPSKRGFLKPVGEWNKEEVIVKGSKITVILNGITITDGDIKKASLNGTLDHKNHPGLQRKKGHIAFLGHGSLVWFRNIRIKNLSNN

SEQ ID NO: 15677 - DNA, 324 bp, Unknown
  Obtained from environmental sample
  misc_feature (1)..(324): n is a, c, g, or t
ttggctatatggccagtagttgataaagcttccggaattattgatggagaatattttgcgaacggaattaaattgggacagaatttcccaaatcccggaattaattcaacaataattgaatatgaattagaaaaagctggagatgttgaaattgaaattcttgaccaaagtggaaaaagagttattaaactaaatgaaggaaataaaacaaaaggaaaacattccacaacagttgatttatctaaactttctaatggtatttattattactcattgaaagccgggaagaacagacttaccaagaaaatgacaataactaaataa

SEQ ID NO: 15678 - protein, 107 aa, Unknown
  Obtained from environmental sample
  misc_feature (1)..(107): Xaa is any amino acid
MAIWPVVDKASGIIDGEYFANGIKLGQNFPNPGINSTIIEYELEKAGDVEIEILDQSGKRVIKLNEGNKTKGKHSTTVDLSKLSNGIYYYSLKAGKNRLTKKMTITK

SEQ ID NO: 15679 - DNA, 432 bp, Unknown
  Obtained from environmental sample
  misc_feature (1)..(432): n is a, c, g, or t
atgaagaagtataaaatgaatataaatggcgataattacgaagccaagattctagattacaaaggtacgcaagtaaatgttgaagtaaatggaattgaatatttggttgaattggaattggaaaagccaagtagagttgaattagtaagaccgacaaaatcatcaccaaatctgaatatctctggcagtaaaccgaaagtaagacagattgctattcctggtacagtagtttcaccaataccagggttagttcttaatatcctggtaaaagagggagatgaggttaatgaaggcgatccgatcttaattctggaagctatgaagatggaatcagaaattgcttcaacaacttccggtattgttaaaaaaatcttagtcaaagagggtgcttctgtacatgaagatgatccattgatagaaatcggagtttaa

SEQ ID NO: 15680 - protein, 143 aa, Unknown
  Obtained from environmental sample
  DOMAIN (74)...(141): Biotin-requiring enzyme
  misc_feature (1)..(143): Xaa is any amino acid
MKKYKMNINGDNYEAKILDYKGTQVNVEVNGIEYLVELELEKPSRVELVRPTKSSPNLNISGSKPKVRQIAIPGTVVSPIPGLVLNILVKEGDEVNEGDPILILEAMKMESEIASTTSGIVKKILVKEGASVHEDDPLIEIGV

SEQ ID NO: 15681 - DNA, 837 bp, Unknown
  Obtained from environmental sample
  misc_feature (1)..(837): n is a, c, g, or t
gtgaatttcaaaaagctttcacaatgtgtacttttttcttcagaagtttggaatcaaaaagatttttttaatcaaacttttccatatatagaaattagtgagatagatttaatttctgggaaaattcataatgttaaacaaattaatattttagaagctccaagtagagcaaaaatgatagtacgaaatcaagatattttaatttcaaccacaagaccaaacagaggtgcaatttcattaattgattcggataatattcttatcgcttcaactggttttgctgtcattagaaattgttctgagcaaatatctaaaaaatatctttttatcgttcttaaaatggattttattttaaaacaatttgaacaaagaagtagcggaggaaattatccagctattacattagaagaattatcgaatataattattcctattccatcaagagatgttcaaaatcaaattattttaaagatggaacaagcctacaaacaaaaagaacaaaaagaaaaagaggctcaaaataaattagattgcattgataagtatcttttaaaagaacttgaaatacagccatttagtgatgaaaaagagactttgaaagatagagtattttttagaaaatttagcgagttaagtggggataggttggatgccccctcaaatcattctacattgtcatttgacaaatctaactttgatttagttcactttaaaaattttgttgagattgatcctagtataactataaaaaacatcgattttgatactatcgcttcatttttacctatggaaaaaatttcagacatctatgcaagtgccaactttgaacgaagttag

SEQ ID NO: 15682 - protein, 278 aa, Unknown
  Obtained from environmental sample
  DOMAIN (1)...(163): Type I restriction modification DNA specificity domain
  misc_feature (1)..(278): Xaa is any amino acid
MNFKKLSQCVLFSSEVWNQKDFFNQTFPYIEISEIDLISGKIHNVKQINILEAPSRAKMIVRNQDILISTTRPNRGAISLIDSDNILIASTGFAVIRNCSEQISKKYLFIVLKMDFILKQFEQRSSGGNYPAITLEELSNIIIPIPSRDVQNQIILKMEQAYKQKEQKEKEAQNKLDCIDKYLLKELEIQPFSDEKETLKDRVFFRKFSELSGDRLDAPSNHSTLSFDKSNFDLVHFKNFVEIDPSITIKNIDFDTIASFLPMEKISDIYASANFERS

SEQ ID NO: 15683 - DNA, 579 bp, Unknown
  Obtained from environmental sample
  misc_feature (1)..(579): n is a, c, g, or t
ttgagaaaattgaagatattatctaataaagatttttatgaaaaatctataaaagagtttggtgtatctgcaaaaggggtacactggaatagcaaatttacccaatataaaagatttgagatacttactaagtgtataaaaaaaagtatccaaaactcctctatagtagatgttgggtgtggttttggtgagtactataattatctttcacacaaccataaattacctcaaaaatatgtaggtatagattgtgaagaaaagatgatagatgtatgtaatattcgctttccaaatgaagagtttatggtacaaaatgtactagacgataaactattagatgcagattattatatctgtagtggggctatgaatatcttaacttttgatgaggtagagatatttattaagagatgttttgaagcttcaaataaaggttttgtatttaattatcttaaaaatgtaacttttaatgatataaaacaataccatattgaagagatttgtaaaagatatactcaaaatattattctaaaagatgggtatttagataatgattttactatctttatggtaaaatga

SEQ ID NO: 15684 - protein, 192 aa, Unknown
  Obtained from environmental sample
  misc_feature (1)..(192): Xaa is any amino acid
MRKLKILSNKDFYEKSIKEFGVSAKGVHWNSKFTQYKRFEILTKCIKKSIQNSSIVDVGCGFGEYYNYLSHNHKLPQKYVGIDCEEKMIDVCNIRFPNEEFMVQNVLDDKLLDADYYICSGAMNILTFDEVEIFIKRCFEASNKGFVFNYLKNVTFNDIKQYHIEEICKRYTQNIILKDGYLDNDFTIFMVK

SEQ ID NO: 15685 - DNA, 735 bp, Unknown
  Obtained from environmental sample
  misc_feature (1)..(735): n is a, c, g, or t
ttggactcgaatgtaaatgatataacattagttgtaaatttaatcaaagatattgcagagcaaacaaatctactcgcactaaatgctgcaattgaagcagcaagagcaggtgaacatggacgcggatttgcagttgtagcagatgaagtaagaaagctggcagagagaactcaaaaagcaacaggagaaataagtgtaactattcaaaatcttcaacagcagtcaagtagtatctctgaaaattcaacagagatgaattcaatagcaaatcaaactagcgatactatgaataacttttctaagactatgaacaattttacaagtgatttaacttatacatccgagttgtctaacaaaagtagtttttctttatttttatcaaactataaaattcatcatattctatttaaatcaaagatatactcatccgttgcaaattcaaaaacagatgatgatcttaaagaagactataaaaactgtggatttggaatatggtattacggtactggaactaaactattttctaataactctacatttaaagaaattgaatttcatcatataaagcttcataaacttatgaatgaagtatatacatctaaaaatgtctcaaaagaaacaactatgaaaaagtttcaagattcagaggaacactcaaataaattttttgatttactagataaactatctgaagaagttggtgcaaacatagaaatgagtgatgttttagcataa

SEQ ID NO: 15686 - protein, 244 aa, Unknown
  Obtained from environmental sample
  DOMAIN (1)...(141): Methyl-accepting chemotaxis protein (MCP) signaling domain
  misc_feature (1)..(244): Xaa is any amino acid
MDSNVNDITLVVNLIKDIAEQTNLLALNAAIEAARAGEHGRGFAVVADEVRKLAERTQKATGEISVTIQNLQQQSSSISENSTEMNSIANQTSDTMNNFSKTMNNFTSDLTYTSELSNKSSFSLFLSNYKIHHILFKSKIYSSVANSKTDDDLKEDYKNCGFGIWYYGTGTKLFSNNSTFKEIEFHHIKLHKLMNEVYTSKNVSKETTMKKFQDSEEHSNKFFDLLDKLSEEVGANIEMSDVLA

SEQ ID NO: 15687 - DNA, 819 bp, Unknown
  Obtained from environmental sample
  misc_feature (1)..(819): n is a, c, g, or t
ttgctaatagctattgtctcattgtttttgccatcaacatctgaaatagctaaaaatgtttttattagtgcagatatacatgcaacaaaaaattatttagaagagcaaagtcagtctaaattgctgtttaattttttggatgatgaagcagatgttgcgtacgatgtaaatgatgttgatgatggtgtggatgtaacagtgaatttaaaactgaattacgggtttaatcctatttcaaaattttacggattgtttgatcaggatgagttgaaagaattaactaccaatgagcttgaaagaataaaaacggaagtggaaaaactcccaaaaattcataaagtaaacgtgcataccaaaactattgacaaacctatttggtttttatctattagagataccgtagctcagaaggagatgaataacattcatgggaaatcttatgagaaaattaatagctacatcgattctgctaatttagaaaaaataatgtcgcccattaccatttatcattcttggacggatactattgttgatattgaaataggcatgcctattaacaaagaaatagttgtttttgaaaacaaaataaaactaaacaaaattgatgagggaacttatgttacagctacacactatggtgcttacgacagattgccagaaacctattttggtattaatgaatggatgaggaaaaataaagtaacagttattggtgctccttgngaaatgtatattacagatcctgcaaaagaaaccaatccgcaaaaatgggaaacaagtattaattttcctatagaacaaattaaaaaacaagagtaa

SEQ ID NO: 15688 - protein, 272 aa, Unknown
  Obtained from environmental sample
  DOMAIN (114)...(266): Bacterial transcription activator, effector binding domain
  misc_feature (1)..(272): Xaa is any amino acid
MLIAIVSLFLPSTSEIAKNVFISADIHATKNYLEEQSQSKLLFNFLDDEADVAYDVNDVDDGVDVTVNLKLNYGFNPISKFYGLFDQDELKELTTNELERIKTEVEKLPKIHKVNVHTKTIDKPIWFLSIRDTVAQKEMNNIHGKSYEKINSYIDSANLEKIMSPITIYHSWTDTIVDIEIGMPINKEIVVFENKIKLNKIDEGTYVTATHYGAYDRLPETYFGINEWMRKNKVTVIGAPXEMYITDPAKETNPQKWETSINFPIEQIKKQE

SEQ ID NO: 15689 - DNA, 300 bp, Unknown
  Obtained from environmental sample
  misc_feature (1)..(300): n is a, c, g, or t
ttgttcgcaacacatgatattccagcaccggatagaataattaaaatgcacttattttcaaaccatacagattggtttttttgtgagtataatccagcggtaaaaaacctatttggaatggtggttataaagaacgattttaaaaacgcaagatggggctattttaccatgccagaattggaagaaatttcttataaaataatggagattcgatggaacaaaatatttatccccagggcggtaaaaaatttaaaaccgttgattgttaaatttaataaaaaagtaagaatttattcttag

SEQ ID NO: 15690 - protein, 99 aa, Unknown
  Obtained from environmental sample
  misc_feature (1)..(99): Xaa is any amino acid
MFATHDIPAPDRIIKMHLFSNHTDWFFCEYNPAVKNLFGMVVIKNDFKNARWGYFTMPELEEISYKIMEIRWNKIFIPRAVKNLKPLIVKFNKKVRIYS

SEQ ID NO: 15691 - DNA, 822 bp, Unknown
  Obtained from environmental sample
  misc_feature (1)..(822): n is a, c, g, or t
atgttacctacagttgaagagatttgtaccaaagatatagtaactattggtataaatcgtaccctagaagaagctgttaaagtgatgacaaaaagaaatgtaagaagtatccttgttgttagtaatagttctcaagagtattttatacttacagtaaatgacactatctcttacagaatcaataatataccactaaaagcaaaactttgtgacttacccctcaaagaagctaaacaaattgatgcaaaaattaatattttagagataataaatcaagagaatgaagtatatgaatatatggttgtagtttttgaaaataaactcatcggaattatctctcaaacagatataatcaataatattgaccctcaaattttaatgcaaaaacaaagtgtaggaaatttaatcttacaatataccgcgatgactatataccaagatgaatcagctttaaatgctattaaaataatggaaacaaaacatattgactcacttttagttgtagatgatacacaaaaccctattggtatttttactacaaaagattttcttactattattagtaataattctaatttaaaactccctataaaagagtatatgagtacccctttagagacagtacctacaaatattacaatagcagatgctataaggtttattcaaaagaaacattttaaaagaatagttataacagatacaaaaggaaaagtttctggtgttantacacaaactgaacttttacgattgcttaacaataaatggatagagataattagacaaagaggtactgagctttcaattataaataaaaaacttata

SEQ ID NO: 15692 - protein, 274 aa, Unknown
  Obtained from environmental sample
  DOMAIN (7)...(60): CBS domain
  misc_feature (1)..(274): Xaa is any amino acid
MLPTVEEICTKDIVTIGINRTLEEAVKVMTKRNVRSILVVSNSSQEYFILTVNDTISYRINNIPLKAKLCDLPLKEAKQIDAKINILEIINQENEVYEYMVVVFENKLIGIISQTDIINNIDPQILMQKQSVGNLILQYTAMTIYQDESALNAIKIMETKHIDSLLVVDDTQNPIGIFTTKDFLTIISNNSNLKLPIKEYMSTPLETVPTNITIADAIRFIQKKHFKRIVITDTKGKVSGVXTQTELLRLLNNKWIEIIRQRGTELSIINKKLI

SEQ ID NO: 15693 - DNA, 330 bp, Unknown
  Obtained from environmental sample
  misc_feature (1)..(330): n is a, c, g, or t
gtggaaaaaaataaagaatctcttactcaaaaacaaaaaaagtgtaatcaacatataaaaattatgcagtatgcattgtcttatgttacaaaagaatttgagaagggatattttcatcaaaatgatttaataggtgctaaagcacaactatttttaattgaaaatagatcaccaaatatatttgcacaaaatattaatgaagcacaaaaagcatacgatacagaatataatttagcacaaaaaaataattgtgatatagataagtttacagtatctcctatccaaaaagttaaaaatacaataaaaactttatcaaagggtcaaaaatga

SEQ ID NO: 15694 - protein, 109 aa, Unknown
  Obtained from environmental sample
  misc_feature (1)..(109): Xaa is any amino acid
MEKNKESLTQKQKKCNQHIKIMQYALSYVTKEFEKGYFHQNDLIGAKAQLFLIENRSPNIFAQNINEAQKAYDTEYNLAQKNNCDIDKFTVSPIQKVKNTIKTLSKGQK

SEQ ID NO: 15695 - DNA, 906 bp, Unknown
  Obtained from environmental sample
  misc_feature (1)..(906): n is a, c, g, or t
atggattttccaacagcctataaatacagaaacaagatctcagatttaaaaaatcagcaacttgagcttgattatacaaagcaaatgaaagatataatgcttcttacaaggagtatttgtttgaagctagtttatacaaattctctaaataaagtactaattagccgccatagtaatgcggtatctattgcagatgcatataaatcaaaatatgatattggtgagactaatattttggaatataataaggcacaaatgggtttgataagtatttccaacaaactggaattaaataaaattgaacgtgtttccttattgtatgatttggctgggttaaatggtggaattcctttgaattttgacgattatatctttgaagaatctgatatccctgttgattttgatcaatggtacattgaatcagaacaaaataacccagttttaaattggttgaagcaggaaatagaagttgccatgtttactgagaagtataatagagccatgagcttgcctaaacttgaagctggttatatgagtgaaaaactagttggtgagcaatttcagggggttattataggcttatcaattcccttatgggaaaataaaaatacagttaaatacgctaaagaaaatactctggcctataaggatataaatgttgacacaaagattttgttttataataatttaaaaactttgcatacaaaagcggtattattacaaaaaaatgccactgattttagtgagcaattagcattgctaaatagtaccgatttattattaaaagcgctaagtatgggtgaaatatcactaatagagtatttttatgaaatctccatgtattacgatagccatgacaatttgatggatatggagttagaagtaaatcaaacgattgcggagtta

SEQ ID NO: 15696 - protein, 302 aa, Unknown
  Obtained from environmental sample
  misc_feature (1)..(302): Xaa is any amino acid
MDFPTAYKYRNKISDLKNQQLELDYTKQMKDIMLLTRSICLKLVYTNSLNKVLISRHSNAVSIADAYKSKYDIGETNILEYNKAQMGLISISNKLELNKIERVSLLYDLAGLNGGIPLNFDDYIFEESDIPVDFDQWYIESEQNNPVLNWLKQEIEVAMFTEKYNRAMSLPKLEAGYMSEKLVGEQFQGVIIGLSIPLWENKNTVKYAKENTLAYKDINVDTKILFYNNLKTLHTKAVLLQKNATDFSEQLALLNSTDLLLKALSMGEISLIEYFYEISMYYDSHDNLMDMELEVNQTIAEL

SEQ ID NO: 15697 - DNA, 486 bp, Unknown
  Obtained from environmental sample
  misc_feature (1)..(486): n is a, c, g, or t
atgatttccattaaaactgcgattgcaatcatattagtgattgtagctactaataatattactggccaaacaaataaaactacgatgactgataacaccgataaaactgaagaacaatggattgaagaattgggtgtagaaaagtatcgtattctccgtcaatgtggaactgaagcaccattcacaggcaaatattatcaacataaggaagaaggtagttatcattgttctggatgtggagctaagctatttacatcagatacaaagtatgattcagggtctggctggccaagtttttataatgctatcgacaaaaaagcgataaaggaaattaaagataatagccttggcatgataagaacagaaattaaatgtgcttcatgtgatggccatcttggtcatgtatttcctgatggcccgggtccaacaggactacgctattgcgtaaattctgtatctctagaattcgaaggaaaagacgagtaa

SEQ ID NO: 15698 - protein, 161 aa, Unknown
  Obtained from environmental sample
  SIGNAL (1)...(18)
  DOMAIN (37)...(159): SelR domain
  misc_feature (1)..(161): Xaa is any amino acid
MISIKTAIAIILVIVATNNITGQTNKTTMTDNTDKTEEQWIEELGVEKYRILRQCGTEAPFTGKYYQHKEEGSYHCSGCGAKLFTSDTKYDSGSGWPSFYNAIDKKAIKEIKDNSLGMIRTEIKCASCDGHLGHVFPDGPGPTGLRYCVNSVSLEFEGKDE

SEQ ID NO: 15699 - DNA, 465 bp, Unknown
  Obtained from environmental sample
  misc_feature (1)..(465): n is a, c, g, or t
ttgaacagggcaactctcactgcaaatattattagagataaagtttattcaaaaaactttgaacttctcaatacatctacaagaattacatttacatttggtatagttgaaattcaagatgagacgattattccttatcataaacttcacatggcgattaaagagataagacaaattagtaaaaattctatcggttactaccatgaaaattcatccatgatagagaatcaaaaagctattcaagattggtcacaaaagattaaaattgcacttgatttggatttgattgaacctttttaccaaccaatatatgatatgaaaaaggggaaaatcgttaaacatgagtgtttagtacggattttagacaagggtgatgttattgctcctataaactttttaaaagctgctcaaaattccaggtttttatctaatataactaaaaggggtatagataaagcattttga

SEQ ID NO: 15700 - protein, 154 aa, Unknown
  Obtained from environmental sample
  misc_feature (1)..(154): Xaa is any amino acid
MNRATLTANIIRDKVYSKNFELLNTSTRITFTFGIVEIQDETIIPYHKLHMAIKEIRQISKNSIGYYHENSSMIENQKAIQDWSQKIKIALDLDLIEPFYQPIYDMKKGKIVKHECLVRILDKGDVIAPINFLKAAQNSRFLSNITKRGIDKAF

SEQ ID NO: 15701 - DNA, 588 bp, Unknown
  Obtained from environmental sample
  misc_feature (1)..(588): n is a, c, g, or t
ttgggacagaaaataataattatgaaaaaagctatcttgtttactatcgctgtaattttatctgctgcctctctggcagcagataaaatgttatatcaaaataatttcaaaacctctttatcaaaaaatacgcttattggtagattgaaatatgaattacgttcaattgaccctaaaacaggaaaagctttgacttttcttcgtaatgacagtttaaataaaggtgcatcatctgtattaacaggatctttatctaaaactaaacgattttctggaaatatacaatttagtgctttattacgaattggcagtattcagccaaacggcaaacaacaagtttccagtaaaaatacaattcgtttacaagatgccagtgggaaaaagtattttgatttgattttctcaactaaacgctataataataaatgcactatcagtttttccaacagtagtaaactacgcgcggtacttgtaaactttcctcttaacaattattttaaaataaacatcttatttaatgaacgcaaaggagtatggaaaggcatagttanaaaaggtgaaattaaatatttgatactgactggataa

SEQ ID NO: 15702 - protein, 195 aa, Unknown
  Obtained from environmental sample
  misc_feature (1)..(195): Xaa is any amino acid
MGQKIIIMKKAILFTIAVILSAASLAADKMLYQNNFKTSLSKNTLIGRLKYELRSIDPKTGKALTFLRNDSLNKGASSVLTGSLSKTKRFSGNIQFSALLRIGSIQPNGKQQVSSKNTIRLQDASGKKYFDLIFSTKRYNNKCTISFSNSSKLRAVLVNFPLNNYFKINILFNERKGVWKGIVXKGEIKYLILTG

SEQ ID NO: 15703 - DNA, 486 bp, Unknown
  Obtained from environmental sample
  misc_feature (1)..(486): n is a, c, g, or t
ttgaaaaaaaatcttgaacaaaatcttacaaaaattgatttaataagattaaaaaataaagatgaaaatagctttttttataaatttaaaatgggagaaaatctaaaatttcaagcactattagatcaacaaccactagcaaatgcaaaagtaaaaataaaacttcaaagtggttgggaaaaaacttctcttacaaatgataaaggggaagtggaacttactatcataagagattattttccagcatggaataaatttgaaaaaagatttaaacaagagttactaataacactagagcatgaaatagataatacaaaatatacactcacttatcctgcatctttttatccaaattcaagtgattatgaatcatatgcctatggattattcttaattacattaacgcttttaatatcaggtttggttatttatagatttagaaaaaacagaacaaaaccttttagtgaggtaaagtttgatgagtaa

SEQ ID NO: 15704 - protein, 161 aa, Unknown
  Obtained from environmental sample
  misc_feature (1)..(161): Xaa is any amino acid
MKKNLEQNLTKIDLIRLKNKDENSFFYKFKMGENLKFQALLDQQPLANAKVKIKLQSGWEKTSLTNDKGEVELTIIRDYFPAWNKFEKRFKQELLITLEHEIDNTKYTLTYPASFYPNSSDYESYAYGLFLITLTLLISGLVIYRFRKNRTKPFSEVKFDE

SEQ ID NO: 15705 - DNA, 846 bp, Unknown
  Obtained from environmental sample
  misc_feature (1)..(846): n is a, c, g, or t
atgggcttaaagaacaaaatagcagatgaatttatctggaataaaactgcagagttttttggtttgacttcttatgcgggtggatttgcttttctttatgctgttatttttagtgtattttttgctacttttggaatctatatcgcttctaaaatattaaaaaaagaatatagttctacttttactaatttaggtgttgcttttattccattgtttatctttgcttcacttggacatactttagaaacattttttatcaaagattatgtaacaattgtagatggatttgctcaaggatttggcttcagtgttgaagtgaaagcactagcaaaaagaggtgatggatggctacactattttggactatttaaatggataggtgtgatatggtcatttattcttttatataaacggatgaaacttattgatgccacaaaacttcgtaaaatatttggatacttttttgcttcactaatgatacttttttatataggattaaatatctatacaggatatgtgttttcaaaatatggtgcaaaaagtagaggtggacactcccatggtagtcatggtgggaaagcaatgttccaaacagttccttttaaacaagcaactctactacaagcaggagaaaataaaacaagtggtgttgtgtgcggtatgaatctaccaatgttttataaaacaaatcatagtgctacacttgatgggaaagtaagacaatattgttctattcattgtttagtggaagatttacgaatcaaaaaacttcctcttgaaaatatgcaagttgtaaatgtgactagcttaaaatttatctctgtaaaaaatggcttttttatgtag

SEQ ID NO: 15706 - protein, 281 aa, Unknown
  Obtained from environmental sample
  misc_feature (1)..(281): Xaa is any amino acid
MGLKNKIADEFIWNKTAEFFGLTSYAGGFAFLYAVIFSVFFATFGIYIASKILKKEYSSTFTNLGVAFIPLFIFASLGHTLETFFIKDYVTIVDGFAQGFGFSVEVKALAKRGDGWLHYFGLFKWIGVIWSFILLYKRMKLIDATKLRKIFGYFFASLMILFYIGLNIYTGYVFSKYGAKSRGGHSHGSHGGKAMFQTVPFKQATLLQAGENKTSGVVCGMNLPMFYKTNHSATLDGKVRQYCSIHCLVEDLRIKKLPLENMQVVNVTSLKFISVKNGFFM

SEQ ID NO: 15707 - DNA, 666 bp, Unknown
  Obtained from environmental sample
  misc_feature (1)..(666): n is a, c, g, or t
ttgaatttaattgtattaggagaatattttatgaaaattagaattttggttgtactatttttattatgttcattgagtctggttcctacgacccgaaaaatgcttgaagatctgctgcccccccaatctcttgctgtagataaagacaagatatactttacttcaggtatcaatgtgtctgtgttttctttgcccgatataaaattggttaagcattttggcaagaagggtgagggacctggtgaatttctgcctttaagtgatgagcggcccttattgctggatgtagaatcagatggcataagggtgacaagcttgaggaagttttctttttttacaaaggatggtttgtttgttaaggaattaaaagcccaaaatggtttctctcataagcctctcgggaaaaactacattgccttaaggtttgctcagatagacaaagtgtttcatacaattgtctctgtgtatgataagaatttcagcgtcattaaggatctacataaaaaaaaagggtggtttcagcagggaaagagtattgacccaaccgcagtcaagccacctctcttttatgcgcataaaggtcttgcttttactgaaaacggaaatggcaatattgatatatttgatgaaagtggcaaaaaaatagctcaaccaagtagattctga

SEQ ID NO: 15708 - protein, 221 aa, Unknown
  Obtained from environmental sample
  misc_feature (1)..(221): Xaa is any amino acid
MNLIVLGEYFMKIRILVVLFLLCSLSLVPTTRKMLEDLLPPQSLAVDKDKIYFTSGINVSVFSLPDIKLVKHFGKKGEGPGEFLPLSDERPLLLDVESDGIRVTSLRKFSFFTKDGLFVKELKAQNGFSHKPLGKNYIALRFAQIDKVFHTIVSVYDKNFSVIKDLHKKKGWFQQGKSIDPTAVKPPLFYAHKGLAFTENGNGNIDIFDESGKKIAQPSRF

SEQ ID NO: 15709 - DNA, 900 bp, Unknown
  Obtained from environmental sample
  misc_feature (1)..(900): n is a, c, g, or t
ttgctatcaaaactaaaaaaatatcaaaaaccatctccaaaaacattagattcgatagctactgatctaaagcactttaaagagtattgtaatagtgaaaatattgattatttatcagctccaagaaaagtgctaagaccaacatacctttataggagtcacctacaacagctatttcgagatggaagaatatccccaaataccatcaagagaagaatgagtgccgttgttggattttacgaatatctcatagatatggaaggaatagagtttaaatttcctttatgggaaagtggtattacctctataaaatatcaagacaatcaaggatttaagcaatctaaacaagtaaaaactaaagatgtttcaagggttgtatccacttcaaatccagatctgtttgatgatgcaatagttgatggtggacgactacatccgttacctaatgaccaacaattagcactagtaaaagcattaaaagcaattagtaatattgaaatgactttaggatttttaatcgcacttacaacaggagctagaatccaaacagtatttacactaagaaaaaagcattttgaaagacctttaaaagatggggaaattgaagttaaaatcaaggttggatatggaactgactgcgatacaaaattcaataaaatacatactctagtctttccatcgtgggtttatcaaaaagtgagaatatatctaaactctccacgatataaaaaaagagaagagaaagctacgcatatatttgatgaacaaaacatgcaatatttgtttcttancaataggggaacaccattttatgcagctcatgatgatccgtatagacatttatttaaagaagtaccaaacggtgcaacagtaaagacaatttattctttacctcactaa

SEQ ID NO: 15710 - protein, 299 aa, Unknown
  Obtained from environmental sample
  misc_feature (1)..(299): Xaa is any amino acid
MLSKLKKYQKPSPKTLDSIATDLKHFKEYCNSENIDYLSAPRKVLRPTYLYRSHLQQLFRDGRISPNTIKRRMSAVVGFYEYLIDMEGIEFKFPLWESGITSIKYQDNQGFKQSKQVKTKDVSRVVSTSNPDLFDDAIVDGGRLHPLPNDQQLALVKALKAISNIEMTLGFLIALTTGARIQTVFTLRKKHFERPLKDGEIEVKIKVGYGTDCDTKFNKIHTLVFPSWVYQKVRIYLNSPRYKKREEKATHIFDEQNMQYLFLXNRGTPFYAAHDDPYRHLFKEVPNGATVKTIYSLPH

SEQ ID NO: 15711 - DNA, 849 bp, Unknown
  Obtained from environmental sample
  misc_feature (1)..(849): n is a, c, g, or t
gtgcggtacatatttttcaaagcatatacattgtttttaaaaagcaagataggggacggttcaataaaaaatcaaactgcctcaatgaaacaagcagatatacgcaatatgctacatatcatttataacgatcaagaaaaccaaatcggtagtagtgcaagtttaataccaagaactaaacaacgaacatctaagaccaaaaaaagctcgtcaacagatcaaaaatatcattatcaattctattatgatttttttcatcaggtaggtgattttatacttgaaaataagcaatttccaataaaactaaaacttgtaaataaagagatttggtgtcttccttcaaaatctatgttctttaatcatgaagataaaattttcccctatggcttcaattacttagatggtactgtcaaagaagtagatgtacttgctaaagaaagagattgtagtttaaaacacgcaaaaatgatgatcaataactttagtaatactctggacaaggtaaataagcatcgttctcaaaagagactgtatctagcaacatatgctttaaaagcattttacatgttatttttagccaatacagggatgaatgattccacagctgcaactttaaagtggaatagtagctattctatcgaaaaacaaagacacaagtttcgcaacataaaatatcgtgcaggtaataaaattgtagaatttgaaataggaagtggttttgttaaggattttaaaaagtttttggagcttagaagttatgttttaggtgaaaaaacatttgaatatttgttttttgtgggaagtggaaataatgtaagcttatctcctcgccactcgagccgattctga

SEQ ID NO: 15712 - protein, 282 aa, Unknown
  Obtained from environmental sample
  misc_feature (1)..(282): Xaa is any amino acid
MRYIFFKAYTLFLKSKIGDGSIKNQTASMKQADIRNMLHIIYNDQENQIGSSASLIPRTKQRTSKTKKSSSTDQKYHYQFYYDFFHQVGDFILENKQFPIKLKLVNKEIWCLPSKSMFFNHEDKIFPYGFNYLDGTVKEVDVLAKERDCSLKHAKMMINNFSNTLDKVNKHRSQKRLYLATYALKAFYMLFLANTGMNDSTAATLKWNSSYSIEKQRHKFRNIKYRAGNKIVEFEIGSGFVKDFKKFLELRSYVLGEKTFEYLFFVGSGNNVSLSPRHSSRF

SEQ ID NO: 15713 - DNA, 687 bp, Unknown
  Obtained from environmental sample
  misc_feature (1)..(687): n is a, c, g, or t
ttgttntnnnggatgatggctcagaaccacactgacctcttttttacatataaaaatagatatatatattttggaaaacttcaaccacttacacaaattgcatcagatatacgaatgtttgagcttgataagtacaatttaaaatctgttttagttgcaagtaaagcaaagtttatagatgattattggcatattaagagagctaacttaatcactaaacctgaagatattgactttaagagtgaaggaataagcataatcgatgaagagaatatccagattttaaaaggttttaaacctaaaattttagatcaagtctatgaaggtaaagtgaacttctctatcattgatgccatagatgcactaaagcttctaaatgatcaaaatatcaacactgatagaataaaaagtgctctatttaaaatttttgtttatccactgtttgttcctagtatggttattattattttcttctttgtacctgtatcacaaagatttttaaatgtctcactttttagctttggcgccctattagcaactcttcttatttggggtgttttatttaccatgatagagctttcaaacactaaagtagtatctcctgaagttggtattgcacttcctgtattagtgctaatgaccatctcgattctcctctggagaacacagcacaaaaagagctcataa

SEQ ID NO: 15714 - protein, 228 aa, Unknown
  Obtained from environmental sample
  misc_feature (1)..(228): Xaa is any amino acid
MXXXMMAQNHTDLFFTYKNRYIYFGKLQPLTQIASDIRMFELDKYNLKSVLVASKAKFIDDYWHIKRANLITKPEDIDFKSEGISIIDEENIQILKGFKPKILDQVYEGKVNFSIIDAIDALKLLNDQNINTDRIKSALFKIFVYPLFVPSMVIIIFFFVPVSQRFLNVSLFSFGALLATLLIWGVLFTMIELSNTKVVSPEVGIALPVLVLMTISILLWRTQHKKSS

SEQ ID NO: 15715 - DNA, 561 bp, Unknown
  Obtained from environmental sample
  misc_feature (1)..(561): n is a, c, g, or t
atgttaaaaaaaaaggcagttgctggttatgtacaaaaggagtttttatcagttttaaaagatatgggttataacttaaattatacaaatcctgatgaagtcctgctatcaattaaaaatgatttttgctcagatgaattcgcagatatgatcggttttttactctccggtgcaaaattaacgggtatgcatgagacaacgatatattctaaaaactctaaacgctatcctggggtaggagctatgcttaagatgcttgaatttgcaacttctgctagctacgcagttgtaggaaaaccaagccgtaacttctataacagagcactgcagatcataaagaagcaagatgaaaacttagaatttgaagatattacaattataagcgatgatgtaaaaggtgatctagtaggggcaaaagagctcaacatgaaaacagtatttgtactaagcgggaaatataaaagagcagatgagatcataccttttttaactcctgaagagtcacctgaacatgtatatgaagatattaatgaatttctagtaaaaggaactgccttatga

SEQ ID NO: 15716 - protein, 186 aa, Unknown
  Obtained from environmental sample
  misc_feature (1)..(186): Xaa is any amino acid
MLKKKAVAGYVQKEFLSVLKDMGYNLNYTNPDEVLLSIKNDFCSDEFADMIGFLLSGAKLTGMHETTIYSKNSKRYPGVGAMLKMLEFATSASYAVVGKPSRNFYNRALQIIKKQDENLEFEDITIISDDVKGDLVGAKELNMKTVFVLSGKYKRADEIIPFLTPEESPEHVYEDINEFLVKGTAL

SEQ ID NO: 15717 - DNA, 675 bp, Unknown
  Obtained from environmental sample
  misc_feature (1)..(675): n is a, c, g, or t
ttgnnnnngggttatggccggactaattccagtactaatgatgtaagttttactataaaacaaggggaaaaagtagctattctaggacgaataggttcaggtaaaagtactattacaaaactacttctaaaactttatgagcctcaaagtggttctattttaatagatggcattgatataaaacagttagatccagcggatttgagaaaaagtataggatatattcctcaagatatccatcttttttcaggaactatcaaagaaaatattcttaataactatagatattatacagatgaagagataatagaagtctctaaaataggtggtgtagatgattttgtaaaaactcatcctttaggatatgacatgccaattggagaacgaggtgttgggctttcaggtggacaaaaacaaactgtaggaatcgcaagatccttgctgtgtggtgcaaatacattactttttgatgaacctacaaatgcaatggatcaaacaacagaaacacagactattcaaagattgaagtctgctgttgaagataaaacattattattagtaacacaaaaaatgagtactttagaactatgtaatcgtattatagttttcaatcatggagttaaaatcatggatggacaaaaagatgaaatcatcaaacagttggcagcaaaatga

SEQ ID NO: 15718 - protein, 224 aa, Unknown
  Obtained from environmental sample
  DOMAIN (22)...(206): ABC transporter
  misc_feature (1)..(224): Xaa is any amino acid
MXXGYGRTNSSTNDVSFTIKQGEKVAILGRIGSGKSTITKLLLKLYEPQSGSILIDGIDIKQLDPADLRKSIGYIPQDIHLFSGTIKENILNNYRYYTDEEIIEVSKIGGVDDFVKTHPLGYDMPIGERGVGLSGGQKQTVGIARSLLCGANTLLFDEPTNAMDQTTETQTIQRLKSAVEDKTLLLVTQKMSTLELCNRIIVFNHGVKIMDGQKDEIIKQLAAK

SEQ ID NO: 15719 - DNA, 819 bp, Unknown
  Obtained from environmental sample
  misc_feature (1)..(819): n is a, c, g, or t
atgaacaactcaaaacaaaagaaaaattccttggaagatgcaaaatcaaaaaaatcttatctgcaaaaatctttaaaaatgatacgaaaagagattgatatgactgcacctatggtgnaaagaggaattgcatcacaagttgatcttctaagacttgaaaaagaggaaaacaatgcacttgatgagtttaaaagtgctgaattttctatcataagacttcaatctgaaataaatgaaatcttacataaaatagaagaaacaaaactctcttttaaagcaaaagcaaaagagcaattaaatgaagcaactgctgagtataaaagagcaataagcaattcaaaagccctagaagaccaagtaacaagaactatagttaaagctccaagagatggagtagttcaaaaactttttgtccatacaattgggggtgttgtaaaaccaggtgatgaccttattgaaatagttccaacaaatgaaaaacttctagtaaatgcaaaaataaagccctcagatatagcctttatctacccatcacaaaaagctatagtaaaattttcagcctacgatttctctatctatggtgggcttgaaggtgaagttgtaagtattagtcctgatactataaaagacaaagatgaaaagacttattatatagtacgaattcaaacacaaaaaagtaaactaaagcaatcaaaagatatgaaaatcattccaggtatgacagcacaagtagatattcttacagggaaaaaaagtatcttaagttatattctaaaaccaatacttaaaactaaacaatacgcttttggggatagatag

SEQ ID NO: 15720 - protein, 272 aa, Unknown
  Obtained from environmental sample
  misc_feature (1)..(272): Xaa is any amino acid
MNNSKQKKNSLEDAKSKKSYLQKSLKMIRKEIDMTAPMVXRGIASQVDLLRLEKEENNALDEFKSAEFSIIRLQSEINEILHKIEETKLSFKAKAKEQLNEATAEYKRAISNSKALEDQVTRTIVKAPRDGVVQKLFVHTIGGVVKPGDDLIEIVPTNEKLLVNAKIKPSDIAFIYPSQKAIVKFSAYDFSIYGGLEGEVVSISPDTIKDKDEKTYYIVRIQTQKSKLKQSKDMKIIPGMTAQVDILTGKKSILSYILKPILKTKQYAFGDR

SEQ ID NO: 15721 - DNA, 870 bp, Unknown
  Obtained from environmental sample
  misc_feature (1)..(870): n is a, c, g, or t
ttgttacaagcaataaaaagtttaagaaagaagaacaagataagtaaagttcaagaggacgacctacatagcaacatattaattgaatgcttacctattttccctaaagaaaaatttatagcgcataacggttataaaatattattacaatgcgaaataaaatctattaatgaaacattaatagatgaaacatggcaagaattaatatttgaatgttacaaaatcgacaacatatcagatagatcatttgtattatccgaggtatctaataagctaccagaaaggttacatttagaaaggcaaaagctttttgaggattcaatttctcttgttgacagtttatcttcaaacattgaaaaagctaatcgatataaagttgtatgtgaaaattataaaaatttcgacaaatcaattataaaagaacacctaaaaaaagcatttgttttatgcaacaacagggacaacattaataatactacaagattagaaataattgacatgattaactcatatggtgaaagtttctcttcttcgcttgtgaatatgcttgacgatgaccctgcaagaaaagagttgatcagtaaaaacataaaacaaagaaagactgatgaagaaataaagaaaaaatttcaaaacaacaacgacatttcagctgataaaaaagataaagaactatctgatcttctatggcaacaattaggaataataaattcaaatagtggccatatccctaagacttttgatattaaaaaatatactaattctattggccctgctgatattgatgatttatataaaaaattaagttactacatacactccaacttacttaataaacccttctttaaaaaatataaatggaaaaaataa

SEQ ID NO: 15722 - protein, 289 aa, Unknown
  Obtained from environmental sample
  misc_feature (1)..(289): Xaa is any amino acid
MLQAIKSLRKKNKISKVQEDDLHSNILIECLPIFPKEKFIAHNGYKILLQCEIKSINETLIDETWQELIFECYKIDNISDRSFVLSEVSNKLPERLHLERQKLFEDSISLVDSLSSNIEKANRYKVVCENYKNFDKSIIKEHLKKAFVLCNNRDNINNTTRLEIIDMINSYGESFSSSLVNMLDDDPARKELISKNIKQRKTDEEIKKKFQNNNDISADKKDKELSDLLWQQLGIINSNSGHIPKTFDIKKYTNSIGPADIDDLYKKLSYYIHSNLLNKPFFKKYKWKK

SEQ ID NO: 15723 - DNA, 861 bp, Unknown
  Obtained from environmental sample
  misc_feature (1)..(861): n is a, c, g, or t
ttgtttttcaagggggatgatcttgttatagagagttatagttatcttggatggcgtccattaagtaagaaaatgactataacaaaaactgaggggatgttagtaaaaactatagatgatcgtcccgcttttgagatatatgaaaaatattangggcttccaaaagatgaaaacttttttttaaatgttttggagttccctcttttaatgcagcgtgaggggaaagctttagcaagggttcctgtatttgttgatgaaaagggagctatacagtttgtagcagatatccatgaaggggaagtatttcagatagggtatggagatccaagcctgatcatctctgattcttcaaaaatgcacactcttatccaaaactctggggctcaagcagtctttttatatacttgtgggtgtagacgttttttgatgcaagatgaggtggaacttgaaactgctccatttgaaaagtttgctcctacttttggattttatacttatggggagttttttggcacactttgtgatatagaactattaaattctactatggtagttgtaggttttaaagagggaaaagagatagataaaggttccatccctcttagtcaaaaaaatgagatggttcgttcaaatgatccctatttacaccaacatagtagaattatttctagattggtacattttgttcagtctgttaccaatgaagtggttgagaaaaatgaaaagctagaagtggcaaataaacaattatcacaccttcttgatgagagaaaagatcttctcaaagagatacagcatagagtaaaaaataattttcactctattcttggggttctttctttagaaaagatgnaaaaataa

SEQ ID NO: 15724 - protein, 286 aa, Unknown
  Obtained from environmental sample
  misc_feature (1)..(286): Xaa is any amino acid
MFFKGDDLVIESYSYLGWRPLSKKMTITKTEGMLVKTIDDRPAFEIYEKYXGLPKDENFFLNVLEFPLLMQREGKALARVPVFVDEKGAIQFVADIHEGEVFQIGYGDPSLIISDSSKMHTLIQNSGAQAVFLYTCGCRRFLMQDEVELETAPFEKFAPTFGFYTYGEFFGTLCDIELLNSTMVVVGFKEGKEIDKGSIPLSQKNEMVRSNDPYLHQHSRIISRLVHFVQSVTNEVVEKNEKLEVANKQLSHLLDERKDLLKEIQHRVKNNFHSILGVLSLEKMXK

SEQ ID NO: 15725 - DNA, 639 bp, Unknown
  Obtained from environmental sample
  misc_feature (1)..(639): n is a, c, g, or t
atggattccctttcacttgtttcacagttttatcctgttaatataaatgcaagagtggaagttgcgaaatgggacaatctaagtctgattggtaccgcaactgttgagatgtccaatactacagataaaataaatcgtgatatgcaggttgctcttaaattgataagggaaactacaaaaaaaattgaaacttctgttacttactattccaagggaaatgcagaggaaataatttcaattaatgatattaccagtagaataattgagtgttctaaaggactaaccggatccagtaaaattctatcaggtactctaaattccttttcggtatattcaaatacatttttttctcttctggatgattcagtacttgatattgaaagtttaaataaaataacaagtttaattagcaatattcgtaaaactcttgataattcaggaaaaactgtagaactccagaagaataagattctttctgaacttggtctggaaaaatgggaagtaaagaacagcaggctggaagaaattattaataaattcaccatatatacacataagcaaacagcagaagatatagcgggtattacggtagtaaagaaagtagaagccggtgaagctggtgagctaacacttttttag

SEQ ID NO: 15726 - protein, 212 aa, Unknown
  Obtained from environmental sample
  misc_feature (1)..(212): Xaa is any amino acid
MDSLSLVSQFYPVNINARVEVAKWDNLSLIGTATVEMSNTTDKINRDMQVALKLIRETTKKIETSVTYYSKGNAEEIISINDITSRIIECSKGLTGSSKILSGTLNSFSVYSNTFFSLLDDSVLDIESLNKITSLISNIRKTLDNSGKTVELQKNKILSELGLEKWEVKNSRLEEIINKFTIYTHKQTAEDIAGITVVKKVEAGEAGELTLF

SEQ ID NO: 15727 - DNA, 654 bp, Unknown
  Obtained from environmental sample
  misc_feature (1)..(654): n is a, c, g, or t
ttggatgaaaacaaagatcaatcttatgtattgtggggactttctcaagaaagtttagcaagaactattttccctcttggcggaatggacaaaccaactattcgccaaatggcgtttgatagagggtataaagaattagcaaagaaaaatgaaagttttgaaatttgttttgttcctgataatgattacagaggcttccttaaaagaagaatagatggtttagaagaaaaagtagatggtggagattttttagatactgaaggcaatgtaattggaaaacataaaggctatcctttttatactattggtcagcgaaaaggcctagagcttgcttttggcgaccctcgttatgttataaaaattgatgctaccaacaaccaagtggtgttgggtacaaaagaagatttgaagaaaaaagaggtttttgtacgtaatccaaacatcataaaatatgagcaaattagcaatgaaatggaagctcttagtaaaattcgttataaagacaaaggaaagttaagtaatctagttcctttggaagatggcagaataaaaatagagttttttgaagatgtacaaggcgtagctccagggcaatcagctgttttttatgatggaaacgaccttataggtggtggttttattgataacaattaa

SEQ ID NO: 15728 - protein, 217 aa, Unknown
  Obtained from environmental sample
  DOMAIN (1)...(214): tRNA methyl transferase
  misc_feature (1)..(217): Xaa is any amino acid
MDENKDQSYVLWGLSQESLARTIFPLGGMDKPTIRQMAFDRGYKELAKKNESFEICFVPDNDYRGFLKRRIDGLEEKVDGGDFLDTEGNVIGKHKGYPFYTIGQRKGLELAFGDPRYVIKIDATNNQVVLGTKEDLKKKEVFVRNPNIIKYEQISNEMEALSKIRYKDKGKLSNLVPLEDGRIKIEFFEDVQGVAPGQSAVFYDGNDLIGGGFIDNN

SEQ ID NO: 15729 - DNA, 303 bp, Unknown
  Obtained from environmental sample
  misc_feature (1)..(303): n is a, c, g, or t
gtgaactccattaaaaggactattaacactgttatggagataaactcattctgtgataagatagctttggttgtaaacagatataacaataagaatctacataaatataaacaatctatcagcatgctcaaaggtttacaaaaagatatcttttacattagagagtctgaagcgtatgcaaatgcaattcatacaggtgaaactataactcagcagtacaataaaaataattttagcaaacatacattcaaaaatgtatttgatgaatatgagttgctgctaaattatgtaaaggcagcataa

SEQ ID NO: 15730 - protein, 100 aa, Unknown
  Obtained from environmental sample
  misc_feature (1)..(100): Xaa is any amino acid
MNSIKRTINTVMEINSFCDKIALVVNRYNNKNLHKYKQSISMLKGLQKDIFYIRESEAYANAIHTGETITQQYNKNNFSKHTFKNVFDEYELLLNYVKAA

SEQ ID NO: 15731 - DNA, 717 bp, Unknown
  Obtained from environmental sample
  misc_feature (1)..(717): n is a, c, g, or t
ttggctggtatcacttcacttataagaagtgataaaaaaattaaattttatgcttctaaactggttatttcagcaacagcaaaaaagctctcagctctgttagattttgatgagaaagagttttacaatttggtagatacacatgaactaaagatagataagtggaataacatagatgggttagaggttaaaccttatttgtctccacatccagtagaaacgactatatttgtgtttagagcattatatggtgctggctataagagttatggacattttgcagatataattgatctcaatatactaaaaggtatgatcgtagaaaatagtgatgaaataggaatttcaaaagagttttataatcaagtgatagtgaactatatgcaaactttagatttgaaaaagattgatataggcgggggtatgattcatgggaatactaaagactttgtagatgataaaacatctaaaatagttttagcacacaattcccaagagctaactcaagaagaaaaaaagataggtagcggatcgctgtttggtatgagtgatatcttaattccatcgaagaacaattatgatctaggactaatatatagatatattaaattaaattttccacatcttagtcgtgaccaaatcaatatttttctaaattttaatcttgttgaatttaatccagaaagcattatcataagagaaaatgagaatatttaa

SEQ ID NO: 15732 - protein, 238 aa, Unknown
  Obtained from environmental sample
  misc_feature (1)..(238): Xaa is any amino acid
MAGITSLIRSDKKIKFYASKLVISATAKKLSALLDFDEKEFYNLVDTHELKIDKWNNIDGLEVKPYLSPHPVETTIFVFRALYGAGYKSYGHFADIIDLNILKGMIVENSDEIGISKEFYNQVIVNYMQTLDLKKIDIGGGMIHGNTKDFVDDKTSKIVLAHNSQELTQEEKKIGSGSLFGMSDILIPSKNNYDLGLIYRYIKLNFPHLSRDQINIFLNFNLVEFNPESIIIRENENI

SEQ ID NO: 15733 - DNA, 498 bp, Unknown
  Obtained from environmental sample
  misc_feature (1)..(498): n is a, c, g, or t
atgccacgaatcgatagtgaaaaattttatacttcagctataaatatgcacggggtaaccgctaaaggtgtaaactggaactcaaaagaatctcagcacatcagatttaatatcatcttaaaaatgcttccgaaagacctctcatcacttaccttagtagatgctggttgtggttttggagacttgtacctttatactgaaaaaaagaagagtactcctaaaaaatatattggtatagatgctgtgattgatatgtactccatagcatctgaacgaactggttgtgaaataattatcgctgatatttgtaaagatgaactccatcgtgcttcttactatgtttgcagtggtgctatgaacgtactaaatacttttgaaacacatctttttatgcgcaattgttacgaagcatctgagaaaggatttattttcaatatcctacatggaaccaaggagagtgagactttacactacctaacaacatccaaaatagacgta

SEQ ID NO: 15734 - protein, 166 aa, Unknown
  Obtained from environmental sample
  misc_feature (1)..(166): Xaa is any amino acid
MPRIDSEKFYTSAINMHGVTAKGVNWNSKESQHIRFNIILKMLPKDLSSLTLVDAGCGFGDLYLYTEKKKSTPKKYIGIDAVIDMYSIASERTGCEIIIADICKDELHRASYYVCSGAMNVLNTFETHLFMRNCYEASEKGFIFNILHGTKESETLHYLTTSKIDV

SEQ ID NO: 15735 - DNA, 312 bp, Unknown
  Obtained from environmental sample
  misc_feature (1)..(312): n is a, c, g, or t
ttgatttataaaaaccgcatcagcttctgcccgtccgttttcttgaatttgggtaatggtcacggtacatgtgatggtgtcattaaaatagaccggacctataaatttaaaattcattcccgttgcaagccagcccacctgaccgccaaactcgcaaatcattcctccgatgagcaacccatggcagatctggtccttgaatcccttttcatctgtccaccttgtatcataatgaaccggattataatcacgggtcaaatcaccgaaagccatggtctctttttttgtaaacctgcgggtataggtaaatga

SEQ ID NO: 15736 - protein, 103 aa, Unknown
  Obtained from environmental sample
  misc_feature (1)..(103): Xaa is any amino acid
MIYKNRISFCPSVFLNLGNGHGTCDGVIKIDRTYKFKIHSRCKPAHLTAKLANHSSDEQPMADLVLESLFICPPCIIMNRIIITGQITESHGLFFCKPAGIGK

SEQ ID NO: 15737 - DNA, 894 bp, Unknown
  Obtained from environmental sample
  misc_feature (1)..(894): n is a, c, g, or t
ttggtanaccatgacagattggctcagggcagggcttatatctgttttgatgaagaactcgattatgggaaaacccaggcagatatggatattagccggatcagtgaggattttatccgcttgaccgggaaaaaattaacggaacaaaagctgttgaccctgaaattgctggctaaagttcagggcggtcccgttcccacattaggcggtctgctcatggccggcagggaaaatcccctggaatatgcccgtataaaatgtgcccggttcaggggagatgatctgggggaatttatagaccagaaagaatttgatggccctttgtattcccaagtggaaagcaccatggcctttgcccaggtgtatatccctaaggccggaaaagtgaaggatgtccagcgggttgacacctatgccgttccccttgaggcggtgagggaagccgtggttaattcagtggtgcacagggattacagcatttctggatccgacataaaatttgctgtttttgataaccggattgaaatcacatctccaggggccctacccaaatccctggtccttgacgatattatcagtggtcggtctgaaatcagaaaccgggtgattgccggatttttcaggcagattaattttattgagcaatgnggaaccggaatcgggaagatcattgccctgtgcctggaaaataatttgaagccgcctcaatttattgaaagcgggttgtttttcaaggtggttctttttagcgaaaagagcgctaagaaaacttcccagaaaacttcccagaaaacttcccagaaaacttcccagaaaacttccccaaaaaacttcccagaaaacttcccagaaaatcttggccctgctggaaaaaggatggccagtttgacataa

SEQ ID NO: 15738 - protein, 297 aa, Unknown
  Obtained from environmental sample
  misc_feature (1)..(297): Xaa is any amino acid
MVXHDRLAQGRAYICFDEELDYGKTQADMDISRISEDFIRLTGKKLTEQKLLTLKLLAKVQGGPVPTLGGLLMAGRENPLEYARIKCARFRGDDLGEFIDQKEFDGPLYSQVESTMAFAQVYIPKAGKVKDVQRVDTYAVPLEAVREAVVNSVVHRDYSISGSDIKFAVFDNRIEITSPGALPKSLVLDDIISGRSEIRNRVIAGFFRQINFIEQXGTGIGKIIALCLENNLKPPQFIESGLFFKVVLFSEKSAKKTSQKTSQKTSQKTSQKTSPKNFPENFPENLGPAGKRMASLT

SEQ ID NO: 15739 - DNA, 642 bp, Unknown
  Obtained from environmental sample
  misc_feature (1)..(642): n is a, c, g, or t
gtgaaattgaaaaaattgtgttttattttcttaataccaatttttatgtggagtcaaaacttaaatgagctagttgaactttcattaaaaaatagattggttgattcttataattatgaattagagtcattaaaaaatgagtttgaaagtgtgaaaagtggatatctaccaaaagttgatgttggggcaagttattctcaaacaaataaagaaacagcaaatgttgcaaatgaagggtcaaccacctatgcaacagcaagttttattttatatgatggtgggaaaagaagtgatactttcaaaagctatgattcaaatattaaaagtacagaagaagctattcaagccaataaaaataagattgctttaaatgtagtgaactactattttagttatttatctcttctttcaagcaaagaagcaaaagaaaaagagatagaacaattaaatgcacaatataatagattaaaaaaatatttagatgttggaactacaactgaagatgaattagaaaaaataatctatagagttgaaagtgcaaatgtaagtttacatgaaatagagttacaattacaaacaatagtgcacaatcttaattatattactggcgttgatgtaagcattggaagtggttctttatta

SEQ ID NO: 15740 - protein, 214 aa, Unknown
  Obtained from environmental sample
  DOMAIN (21)...(203): Outer membrane efflux protein
  misc_feature (1)..(214): Xaa is any amino acid
MKLKKLCFIFLIPIFMWSQNLNELVELSLKNRLVDSYNYELESLKNEFESVKSGYLPKVDVGASYSQTNKETANVANEGSTTYATASFILYDGGKRSDTFKSYDSNIKSTEEAIQANKNKIALNVVNYYFSYLSLLSSKEAKEKEIEQLNAQYNRLKKYLDVGTTTEDELEKIIYRVESANVSLHEIELQLQTIVHNLNYITGVDVSIGSGSLL

SEQ ID NO: 15741 - DNA, 516 bp, Unknown
  Obtained from environmental sample
  misc_feature (1)..(516): n is a, c, g, or t
atgagagcatatattgtagaaaaaatagaagataaaaaatttacatcaggaataaaagatattgaggttccagagatttcagaaaatgaagttttaataaaagcaacttattcatcattaaactataaagatgcattaagttcagttggaaatccaggagttacaagaaatttcccacatgtaacaggtattgatgttgcaggagtaattgaaaaatcaaactcagataaattttctgtaggagaaaaagttttagttactggatatgatatgggaatgaacacagatggtggtcatcaagaatttgtaaaagtaccagattcatgggtagttaaaattccagaaactataagtgatagagagattatgatttatggaactgctggattaacagcagcattaagtgttaatgaattacttaataatggtatcacaaaaggtaatattttagtaacaggtgcaactggtggtgttggaagcatagccataagtatattacataaacttnggatttaa

SEQ ID NO: 15742 - protein, 171 aa, Unknown
  Obtained from environmental sample
  misc_feature (1)..(171): Xaa is any amino acid
MRAYIVEKIEDKKFTSGIKDIEVPEISENEVLIKATYSSLNYKDALSSVGNPGVTRNFPHVTGIDVAGVIEKSNSDKFSVGEKVLVTGYDMGMNTDGGHQEFVKVPDSWVVKIPETISDREIMIYGTAGLTAALSVNELLNNGITKGNILVTGATGGVGSIAISILHKLXI

SEQ ID NO: 15743 - DNA, 372 bp, Unknown
  Obtained from environmental sample
  misc_feature (1)..(372): n is a, c, g, or t
atgcaaggtgatgcttgtaatttaaaagatatatatactgcatatgacttgattttttgctcaaacttgattgatagattatattatcctcaaaaatttttagatgatgttccaaatagagtaaataaagatggacttttagtattattaagcccttatacatggctagaagcatatactccaaaacaaaattggttaggtggatatgttagagataataaagaggtaaaaacattagatactttaaaagaaaaccttagtgatagatttgaacttctagatactattgatgttccttttgtgataaaagagactgcaagaaaacaccaatacactatatctcaaatgagtatttggaaaaagatcaaataa

SEQ ID NO: 15744 - protein, 123 aa, Unknown
  Obtained from environmental sample
  misc_feature (1)..(123): Xaa is any amino acid
MQGDACNLKDIYTAYDLIFCSNLIDRLYYPQKFLDDVPNRVNKDGLLVLLSPYTWLEAYTPKQNWLGGYVRDNKEVKTLDTLKENLSDRFELLDTIDVPFVIKETARKHQYTISQMSIWKKIK

SEQ ID NO: 15745 - DNA, 390 bp, Unknown
  Obtained from environmental sample
  misc_feature (1)..(390): n is a, c, g, or t
atgagttatttgatagtaatatatttatgtctattttgttatgttgtatttagtttgtattttatatatacgcaaagaaaaaaaataaaaatatacaaagataactttcaagataaaagtttcataaataatatagatagtgatacacttaaaatggatgcaataaatgaattattagagaatataacacaccaatggataaagccattattgataataaatgatatagttcgtatgccagacttaaaaaatattgtaaaccaaaaagagattgataatataaaaagtcgctgtgaaatattgaatactaatataaaatatctttcaagtatttcaggtaactttcattttgaaaaaaaacatacttttataaaatggtgttatatctag

SEQ ID NO: 15746 - protein, 129 aa, Unknown
  Obtained from environmental sample
  misc_feature (1)..(129): Xaa is any amino acid
MSYLIVIYLCLFCYVVFSLYFIYTQRKKIKIYKDNFQDKSFINNIDSDTLKMDAINELLENITHQWIKPLLIINDIVRMPDLKNIVNQKEIDNIKSRCEILNTNIKYLSSISGNFHFEKKHTFIKWCYI

SEQ ID NO: 15747 - DNA, 885 bp, Unknown
  Obtained from environmental sample
  misc_feature (1)..(885): n is a, c, g, or t
ttgatgcaagatgaggtggaacttgaaactgctccatttgaaaagtttgctcctacttttggattttatacttatggggagttttttggcacactttgtgatatagaactattaaattctactatggtagttgtaggttttaaagagggaaaagagatagataaaggttccatccctcttagtcaaaaaaatgagatggttcgttcaaatgatccctatttacaccaacatagtagaattatttctagattggtacattttgttcagtctgttaccaatgaagtggttgagaaaaatgaaaagctagaagtggcaaataaacaattatcacaccttcttgatgagagaaaagatcttctcaaagagatacagcatagagtaaaaaataattttcactctattcttggggttctttctttagaaaagatgaaaaataaagaggtaaactctcaatatgatgaagctataaatcgtatagttacaatgtctcaaattcatcaagagttatatcagtcttcaaatataggttatgtagatacgaaggagtatctcttatcaattattcaaaaggtttcctctatttttagtagtattgaacttcaaacaaatattgaaaaccatcaagtggactttaacacagccaccgttttaggaactctaatcaatgagcttataacaaactcttttaaacataatatcgaacaaatctcattaacaattaccataacatttcaaaggtcaatgataaatatctctttatatactgtgacgatgggaaaaggtttgatccttctaatgcacaaaaggggtttaggtcttagcttaataacaaagtttgcaaataaactttcagatgtaaattttaaactattagaaaggagataa

SEQ ID NO: 15748 - protein, 294 aa, Unknown
  Obtained from environmental sample
  DOMAIN (122)...(200): Histidine kinase
  misc_feature (1)..(294): Xaa is any amino acid
MMQDEVELETAPFEKFAPTFGFYTYGEFFGTLCDIELLNSTMVVVGFKEGKEIDKGSIPLSQKNEMVRSNDPYLHQHSRIISRLVHFVQSVTNEVVEKNEKLEVANKQLSHLLDERKDLLKEIQHRVKNNFHSILGVLSLEKMKNKEVNSQYDEAINRIVTMSQIHQELYQSSNIGYVDTKEYLLSIIQKVSSIFSSIELQTNIENHQVDFNTATVLGTLINELITNSFKHNIEQISLTITITFQRSMINISLYTVTMGKGLILLMHKRGLGLSLITKFANKLSDVNFKLLERR

SEQ ID NO: 15749 - DNA, 366 bp, Unknown
  Obtained from environmental sample
  misc_feature (1)..(366): n is a, c, g, or t
atggaaatagaaaaactaatagaagaaaaaaacttaaaattgacctctgctagaaaagagcttttagagatactttttttggcaactaaacctctgagttatgaagatataaaatcaaaaataagcatggacaaagccaccttttatagaaatgtactgaaatttgaagaagagtccataatcagtagttttgaatcgaatgataaaaagagatattatgagattcaaaactctccacactcacactttatatgtaatgtatgtaactgtgtagagtgtttagatggagttgaacccatcaagttagagggctataaaattttagatatgatctttaaaggtatctgtaaaaagtgtaatctttaa

SEQ ID NO: 15750 - protein, 121 aa, Unknown
  Obtained from environmental sample
  DOMAIN (9)...(113): Ferric uptake regulator family
  misc_feature (1)..(121): Xaa is any amino acid
MEIEKLIEEKNLKLTSARKELLEILFLATKPLSYEDIKSKISMDKATFYRNVLKFEEESIISSFESNDKKRYYEIQNSPHSHFICNVCNCVECLDGVEPIKLEGYKILDMIFKGICKKCNL

SEQ ID NO: 15751 - DNA, 906 bp, Unknown
  Obtained from environmental sample
  misc_feature (1)..(906): n is a, c, g, or t
gtgttaaaaaatacatttcttcaccgtattttacaagataaatatccaaatcaaaagttattagctactccaactgttaaagaagctgtagaagctgttgcgtctgggaaagcagatgctgtaatagataatttggcaacggtagagtattataaaaatagtggatggctaggaaacttaaaaacattaaagatggaccaagtagcacatatccctcaaaatacgggtgcatattttggaattgctaaagataattatctcttaaagtcaattttagagaaagcaaactcctctttatcttttaatgagcttctttcattacaaaaaaagtggttaaatgttaagtctgaaaatactattcaatggaatgatgaagaactagcatatcttaaacaaaaaaaagaactcaaatattgtatcaatccaaattggttaccatttgaaaaaatagagaatgaacaacatattggtatgacatctcaatatataaaagagtttgaaaagaacttacctatctcaatgaagatatataaaacgcaagagtggacagatacaatagaatctgctaaaaatagaaaatgtgattttgtaacaattatgatggatacaaatgagagaagaaaagagtttagcttcacacaaaatattatggatatacctttagttatcgcaactaaacaaaataaaccttttataaatgatatttcagatgtgttatctgaaacttttgctattgtaaaaggttttgcatatatagaggtattaaagaaacaataccccagtattaaaatagttgaagtaaaagatatttacgatggactttcaaaagtaaataaaagggagtgtatatggatgtattggtgtattaccagtaaattgggtataacattcaaaaacattttttag

SEQ ID NO: 15752 - protein, 301 aa, Unknown
  Obtained from environmental sample
  misc_feature (1)..(301): Xaa is any amino acid
MLKNTFLHRILQDKYPNQKLLATPTVKEAVEAVASGKADAVIDNLATVEYYKNSGWLGNLKTLKMDQVAHIPQNTGAYFGIAKDNYLLKSILEKANSSLSFNELLSLQKKWLNVKSENTIQWNDEELAYLKQKKELKYCINPNWLPFEKIENEQHIGMTSQYIKEFEKNLPISMKIYKTQEWTDTIESAKNRKCDFVTIMMDTNERRKEFSFTQNIMDIPLVIATKQNKPFINDISDVLSETFAIVKGFAYIEVLKKQYPSIKIVEVKDIYDGLSKVNKRECIWMYWCITSKLGITFKNIF

SEQ ID NO: 15753 - DNA, 363 bp, Unknown
  Obtained from environmental sample
  misc_feature (1)..(363): n is a, c, g, or t
atgccaatagcaaaatatttaaatacaactgttttatctcaaacaaatgatataaaaagtttaattgagtatttaacgattttacaaactaaagcattcctaaatcacatcataaatttaactgcaaaagcattgagctatgagataacgaacctctcagatactgcaaaccctgaagatgtaaaaagttatttgtctcaaataagtaaaaatgctatagattttcgtacacaaatagatctatggtttcaaacaagctcaagagattggcagcagaaaaaaaatgtaaatgattactacataggcttagagcagagactaaaatctaaacttgcaaactctagcatctattttaaacagtag

SEQ ID NO: 15754 - protein, 120 aa, Unknown
  Obtained from environmental sample
  misc_feature (1)..(120): Xaa is any amino acid
MPIAKYLNTTVLSQTNDIKSLIEYLTILQTKAFLNHIINLTAKALSYEITNLSDTANPEDVKSYLSQISKNAIDFRTQIDLWFQTSSRDWQQKKNVNDYYIGLEQRLKSKLANSSIYFKQ

SEQ ID NO: 15755 - DNA, 537 bp, Unknown
  Obtained from environmental sample
  misc_feature (1)..(537): n is a, c, g, or t
atgagtgaactctttgattttacccttataagtggtgatcaaaaagttaaaatgagtcaactctcaagcggtaaaatagagtttgatagacttaaaaatgtagcttccataaaccatgataatcgagagattaaaatcatacacaatggtaaaaagttcaacagaagacacttgaatcttagaacctctactatctcagtacatccgacatatgtcgttgtagatgagtttacaaaagagatttcacctgacacttacgaaataagtgccggcaaatttccaataaaaaatggcgtattatttcagcttttttataaaggaaagtggtacggtgtaattttaggagatagtgataagttggtagtagattacttttcaaattttgagcttgatcctaaagagagttatagtgccatcactaaagcatcttctagttatccagatgaattaaagcatcttaaagctaagtggcaagagttggctttactctcttgtgagaaaaaaactatgatcagattatggagatttatgaggtag

SEQ ID NO: 15756 - protein, 178 aa, Unknown
  Obtained from environmental sample
  misc_feature (1)..(178): Xaa is any amino acid
MSELFDFTLISGDQKVKMSQLSSGKIEFDRLKNVASINHDNREIKIIHNGKKFNRRHLNLRTSTISVHPTYVVVDEFTKEISPDTYEISAGKFPIKNGVLFQLFYKGKWYGVILGDSDKLVVDYFSNFELDPKESYSAITKASSSYPDELKHLKAKWQELALLSCEKKTMIRLWRFMR

SEQ ID NO: 15757 - DNA, 597 bp, Unknown
  Obtained from environmental sample
  misc_feature (1)..(597): n is a, c, g, or t
atgcatcttgaccttattatcggtctgcctggcgagtcaatagagagttttggaaaaaacttgaatcaactctgctcaattgcgagcagtgagattcagctgggtgttttaaaaaaactatctggtacaacgctagatcgtcatgacaaagaacatggcatgatctactcaaacaagccaccgtatgagattttatcaaacactcaaataagctataagcagatgcagatcatgaaacgttttgcaagattttgggatcttttttataatagcggaaattttaaaaatggtattaaattactttttaaggatggagaggtttataaaaatttctactcattttcactttggatatatgctcagacaaactctacatggaaaatttcacttgatcgtttaaatgaactgctttttagctactttttagatgagatgaaactagaaaaaaatgaagtggctcanatattactaaaagatttcatgagtgtaggtggtagaaaaatacccaaatttttaagagactactctgatgtgagaagttctccaagagatcttgagaactcaaaatctacaaagagacaaaaagcaagagaatag

SEQ ID NO: 15758 - protein, 198 aa, Unknown
  Obtained from environmental sample
  misc_feature (1)..(198): Xaa is any amino acid
MHLDLIIGLPGESIESFGKNLNQLCSIASSEIQLGVLKKLSGTTLDRHDKEHGMIYSNKPPYEILSNTQISYKQMQIMKRFARFWDLFYNSGNFKNGIKLLFKDGEVYKNFYSFSLWIYAQTNSTWKISLDRLNELLFSYFLDEMKLEKNEVAXILLKDFMSVGGRKIPKFLRDYSDVRSSPRDLENSKSTKRQKARE

SEQ ID NO: 15759 - DNA, 408 bp, Unknown
  Obtained from environmental sample
  misc_feature (1)..(408): n is a, c, g, or t
atgcagaatacagtaatagatacaaatgtattattgtcagcaatgtattcaaataaaggtgctagttataaattattgtcaataattgatagtgataaatttacagttaatatttcaacaacattgatttatgaatatgaagagatattaaagttgaaatcaaaccttgaaataaaatatgttgattcaattttaaactatatttgtctcattggtaaaaagaataaaatcttttatctttggagaccaaaattaaaagattcagatgatgattttttattagaacttgctgttacatcaagttccataatagttacactaaatggaaaagactttaagccagcaagtgaatttaatataaaagttatgacaccaaaagaatttttacaatacataggagagatataa

SEQ ID NO: 15760 - protein, 135 aa, Unknown
  Obtained from environmental sample
  DOMAIN (4)...(125): PIN domain
  misc_feature (1)..(135): Xaa is any amino acid
MQNTVIDTNVLLSAMYSNKGASYKLLSIIDSDKFTVNISTTLIYEYEEILKLKSNLEIKYVDSILNYICLIGKKNKIFYLWRPKLKDSDDDFLLELAVTSSSIIVTLNGKDFKPASEFNIKVMTPKEFLQYIGEI

SEQ ID NO: 15761 - DNA, 768 bp, Unknown
  Obtained from environmental sample
  misc_feature (1)..(768): n is a, c, g, or t
gtgccacatattgaaaaaatattatataaatttgtcccagatcctacaacttcattttatatgttaaaacaaaaacaattggatttaggtggattaactccaatacaagttgatagacaaattgatgaacaatttaaatcaaattttaacatctatgaaaaacaaagttttggttactcttatgtgggtttaaatttaaaaagtgataagtttaaagatttgaaagtaagagaagcgattagtttagctattgatagacaacagatggcagatatcttgtattttggtcatgcttctgtttgtacgggaccttttttaaaagggagtattgcatataatgaaaatgtaaaacctattgtacaaaataaactaaaagcaaaacaactattagaagaagttggatatacaaaagaaaatcctttttcatttacagttatcacaagtgcaggtagttcaactggggttaatgtagctcaaataatgcaacatcaattaaaacagattggtgtagagatgaaaatacgagtgatggaatggcaagcttttttaaatacagtggttcatccaagaaattttgaagcagttattttggcttggaatttatctttaacacctgatgctagatctatttggcatagcaatagtaataaaaaaggtggatttaattttgtgggatatcaaaatagtgaagtagataaacttatagaacaagcagaaagaaccatagataaaaaagagtttgggcagatttataaaaaaaatttataa

SEQ ID NO: 15762 - protein, 255 aa, Unknown
  Obtained from environmental sample
  misc_feature (1)..(255): Xaa is any amino acid
MPHIEKILYKFVPDPTTSFYMLKQKQLDLGGLTPIQVDRQIDEQFKSNFNIYEKQSFGYSYVGLNLKSDKFKDLKVREAISLAIDRQQMADILYFGHASVCTGPFLKGSIAYNENVKPIVQNKLKAKQLLEEVGYTKENPFSFTVITSAGSSTGVNVAQIMQHQLKQIGVEMKIRVMEWQAFLNTVVHPRNFEAVILAWNLSLTPDARSIWHSNSNKKGGFNFVGYQNSEVDKLIEQAERTIDKKEFGQIYKKNL

SEQ ID NO: 15763 - DNA, 846 bp, Unknown
  Obtained from environmental sample
  misc_feature (1)..(846): n is a, c, g, or t
atgggacaacttctaaaacggctaaacagatcaaattttatcctcaataacattaatgactcagttattttactaaaaccaaatagtggaaagattattgatgcaaatgagagagctgaagctattttgggatacacacatgaagagttacttactaaaaatattgatgatattaagaagagtatctctgatgatgaatataacaactggcaagataatatatccaaattaaaattaacgcactatataacaaataaggcactctctataaaaaaagatggctcatatctgcctgtcgaatctaacttaacctatttaaataatgaaaatgaggagattgttgtatcagtcggtcgtgatatctccattcaggttgcccaagaagagcagttgcaaaaacaacacaacgaaatgagacgtcttaatgatcttattagtgaaagtgttctctatactactgctgatacagatggaaacattacatatatatctaaagcatttgaaaaattcactgggtactgccagaaagaggttttgggtaaaaatcacaatatttttaaacacaaagatactcatagagagttttttgaaaatatgtggtctgttttaagtgaagataagcagtttagaggtgaactaaagaacaggaaaaaagatggaagttcatactgggcaaaactgacaattgatcccatctttgatgaagatggtacgaaaatagggtatgcctcttatagagaagatatcaccgaccaaaaaaaagtgaagtatatctcatctcacgatcaattgacaaaactacttaatagatttggaactcgtcaaacatctacaagtaaaatttaa

SEQ ID NO: 15764 - protein, 281 aa, Unknown
  Obtained from environmental sample
  DOMAIN (136)...(201): PAS domain
  misc_feature (1)..(281): Xaa is any amino acid
MGQLLKRLNRSNFILNNINDSVILLKPNSGKIIDANERAEAILGYTHEELLTKNIDDIKKSISDDEYNNWQDNISKLKLTHYITNKALSIKKDGSYLPVESNLTYLNNENEEIVVSVGRDISIQVAQEEQLQKQHNEMRRLNDLISESVLYTTADTDGNITYISKAFEKFTGYCQKEVLGKNHNIFKHKDTHREFFENMWSVLSEDKQFRGELKNRKKDGSSYWAKLTIDPIFDEDGTKIGYASYREDITDQKKVKYISSHDQLTKLLNRFGTRQTSTSKI

SEQ ID NO: 15765 - DNA, 435 bp, Unknown
  Obtained from environmental sample
  misc_feature (1)..(435): n is a, c, g, or t
atgaaattccataaatcattattactactactgttattgtcttttattgtttcctgtattccacagagaaagactatttatatgagagatgtgagtggaaaaaaaagttatatcaacctttatacaaaggcttttgaggttacagaagcttatacaattcaacctcgagattatgtttatattcgagttcttactcctgatgaagctgttgcaagtctgtataaccttgatgcaggtcaaatgaatatgagcaatatgggaaacccagctaacatgaagtttcagagttatcaggttagtgatgagggtgatattgattttccatatgttggacagattaaggttattgatttgactctaaaagaagttaaagcaaaaatgcaagatatactgaaaaatcatatcgatacgttacgctcaagtcaatanccctga

SEQ ID NO: 15766 - protein, 144 aa, Unknown
  Obtained from environmental sample
  SIGNAL (1)...(18)
  misc_feature (1)..(144): Xaa is any amino acid
MKFHKSLLLLLLLSFIVSCIPQRKTIYMRDVSGKKSYINLYTKAFEVTEAYTIQPRDYVYIRVLTPDEAVASLYNLDAGQMNMSNMGNPANMKFQSYQVSDEGDIDFPYVGQIKVIDLTLKEVKAKMQDILKNHIDTLRSSQXP

SEQ ID NO: 15767 - DNA, 486 bp, Unknown
  Obtained from environmental sample
  misc_feature (1)..(486): n is a, c, g, or t
atgggagagattgtagcaagtggtgataatattatgcaaggctactatagggatgatgaagaaacgcagtctgttttaagaaatggaagtttgtatactggagatttgggaagagtagatgaggatggctttatttttctggaaagcagaaaaaaagagattataaaagtaggagggaagcgtgtaagtcctaaggaaattgaagaagtcattttatcagttgccgaagttatcgattgtatagtagagagtgtttatgatgatctattgggagaagctataaaggcgagtattgtattaaacaagtcaagtaatcaaaaaaagataaaagaagagattataaaattatgccataataaactgctaacatataaaatacccaagttttggagtattgaaaagaatttaaacctcagtttaacgggtaagaaaataaagaaccagtctaaaggtcaaacttatacgataaaatatgaaattccataa

SEQ ID NO: 15768 - protein, 161 aa, Unknown
  Obtained from environmental sample
  misc_feature (1)..(161): Xaa is any amino acid
MGEIVASGDNIMQGYYRDDEETQSVLRNGSLYTGDLGRVDEDGFIFLESRKKEIIKVGGKRVSPKEIEEVILSVAEVIDCIVESVYDDLLGEAIKASIVLNKSSNQKKIKEEIIKLCHNKLLTYKIPKFWSIEKNLNLSLTGKKIKNQSKGQTYTIKYEIP

SEQ ID NO: 15769 - DNA, 330 bp, Unknown
  Obtained from environmental sample
  misc_feature (1)..(330): n is a, c, g, or t
atgcagggagaattgatgtctagtattgatgataatgtaaaagtatctttgagtgaaaaacaaaagcagataataaaaaaccatctcaatgataatggaaaactatcatgtataaaagcttttaaagttgctaggttaattgatgttgagccttttgcaatatctgcaattacaaaaagtcttaatattaggattacagattgtgaacttggggtatttgggaatttagagttctcaaataaagatgagaatatttataatgatttagtacaacagtatgaaaaagaaaagaaactctcgagccgatctgatacctggnnnnnnccataa

SEQ ID NO: 15770 - protein, 109 aa, Unknown
  Obtained from environmental sample
  misc_feature (1)..(109): Xaa is any amino acid
MQGELMSSIDDNVKVSLSEKQKQIIKNHLNDNGKLSCIKAFKVARLIDVEPFAISAITKSLNIRITDCELGVFGNLEFSNKDENIYNDLVQQYEKEKKLSSRSDTWXXP

SEQ ID NO: 15771 - DNA, 645 bp, Unknown
  Obtained from environmental sample
  misc_feature (1)..(645): n is a, c, g, or t
atgatacaacttttagacagtaaccttcacttcatagaccccaaagatgcagatataagtggaattgtcgccgttggaggtgatcttagcagtgagaggcttcttcttgcttacagaagcggcatttttccatggtactctgaaaatgatcctattctctggcactctccaaatccgcgttttattttagaactagatgaattcaaactgagcagatcactgaaaaagagcatgaaacattttgaggtgcactttaacagagattttgagagtgtcataagagagtgtgcctccataaaaagagttggacaaaacggcgcttggctgcttgatgagatggtgaatgcctacataaaattgcacaatttaggacatgccatgagcgtggagagctaccagaatggagaacttgtcggtggactttacggggttgttgtaggtaaaatcttttgtggtgagtccatgttcagccatgtaagtgacgcctccaaagtcgcttttgcttcgcttgttcaaaagttaaaagatgaaaagtttgagttaatcgatgcacaggtatatacagatcatctctcttctcttggagcaaaagagatcagccgagataaatttttagacagactatacaaatttagggataaataa

SEQ ID NO: 15772 - protein, 214 aa, Unknown
  Obtained from environmental sample
  DOMAIN (30)...(201): Leucyl/phenylalanyl-tRNA protein transferase
  misc_feature (1)..(214): Xaa is any amino acid
MIQLLDSNLHFIDPKDADISGIVAVGGDLSSERLLLAYRSGIFPWYSENDPILWHSPNPRFILELDEFKLSRSLKKSMKHFEVHFNRDFESVIRECASIKRVGQNGAWLLDEMVNAYIKLHNLGHAMSVESYQNGELVGGLYGVVVGKIFCGESMFSHVSDASKVAFASLVQKLKDEKFELIDAQVYTDHLSSLGAKEISRDKFLDRLYKFRDK

SEQ ID NO: 15773 - DNA, 348 bp, Unknown; identical to SEQ ID NO: 10289
  Obtained from environmental sample
  misc_feature (1)..(348): n is a, c, g, or t

SEQ ID NO: 15774 - protein, 115 aa, Unknown; identical to SEQ ID NO: 10290
  Obtained from environmental sample
  DOMAIN (1)...(115): Protein of unknown function (DUF1291)
  misc_feature (1)..(115): Xaa is any amino acid

SEQ ID NO: 15775 - DNA, 633 bp, Unknown
  Obtained from environmental sample
  misc_feature (1)..(633): n is a, c, g, or t
atgattcaagataactgcacaaaaaaaaggataaagcctcgacttttaagagatgtaaaaacagaagcgttgcttgtattttcaagaactgcactagaaaggttttttggaagagttgataacaatgaatggcaaccaattgttggaacagatgatgaaacaatctatatatacgatacattaagaaagttaaaagaccaacttcaagagtgtgtagtaaatgtagattatttacttaatctagtgcaaaatgctaaaaaacatccagagttgagatctttagcaaaatttgaagaacctcttattacatactacgatgttttagcaaaaaaagtagaagtagatattccaacaaatcaaacatggtggataccagaacttgttgtagtttgtactcttagtcattgggttttagaaaatgaaagatcaacagtattgtatccatttcttaaagatgttgattacacaacattgattgaaaaatttgaattatatggtaaaaatttagatggtgaaaaaaaagatattgtgataaatatgcataaaattgcagttgaacttataggaaagctagaaaaaacaaaatataaagtaaacaaaactagagtttcaaaaactagaaagaaaaaataa

SEQ ID NO: 15776 - protein, 210 aa, Unknown
  Obtained from environmental sample
  misc_feature (1)..(210): Xaa is any amino acid
MIQDNCTKKRIKPRLLRDVKTEALLVFSRTALERFFGRVDNNEWQPIVGTDDETIYIYDTLRKLKDQLQECVVNVDYLLNLVQNAKKHPELRSLAKFEEPLITYYDVLAKKVEVDIPTNQTWWIPELVVVCTLSHWVLENERSTVLYPFLKDVDYTTLIEKFELYGKNLDGEKKDIVINMHKIAVELIGKLEKTKYKVNKTRVSKTRKKK

SEQ ID NO: 15777 - DNA, 714 bp, Unknown
  Obtained from environmental sample
  misc_feature (1)..(714): n is a, c, g, or t
atgataaaaatcataacaagtggaataaaagggaatataggaaaatcatttaataaaaactataatttaatcccttatgataaaaattccagtatgaatggtaatatatttttacaccttgcttctaagaggtttggaacagcaaatgactatattgagtcaaatattttatatttaacagaatgtattgaatattgtaaactaaataatataaaaaattttgtgtttttctctgcaatgagtgtttatggagatataaatagggaaaatgttaatgaaaacacttttttcaataatcccaatttatatggaatatccaaactttttggtgaacaactattaaaagaaagtaacttgaatgttttaattataagagcaccaatggttctaacaaataatcaggatattggtatattaaatagagttcgtaaagagttattattaaataatgatattcatataactaattatgataaagttttcaataattttatccatgctaatgatttactaaactttattgtatcttataaatttagtactatctgtgaagtatttaatatagctgttgataaaacacacaccttatatgagataatattatatatgaaaaactttctttcttcagattccagattaataaaagatgataaaaaaactaatttttttaatatagatatatcaaaatttagcaatgtaatattcaaactatga

SEQ ID NO: 15778 - protein, 237 aa, Unknown
  Obtained from environmental sample
  misc_feature (1)..(237): Xaa is any amino acid
MIKIITSGIKGNIGKSFNKNYNLIPYDKNSSMNGNIFLHLASKRFGTANDYIESNILYLTECIEYCKLNNIKNFVFFSAMSVYGDINRENVNENTFFNNPNLYGISKLFGEQLLKESNLNVLIIRAPMVLTNNQDIGILNRVRKELLLNNDIHITNYDKVFNNFIHANDLLNFIVSYKFSTICEVFNIAVDKTHTLYEIILYMKNFLSSDSRLIKDDKKTNFFNIDISKFSNVIFKL

SEQ ID NO: 15779 - DNA, 510 bp, Unknown
  Obtained from environmental sample
  misc_feature (1)..(510): n is a, c, g, or t
ttgttctcaacacataaagtatatggtataaataattccccatttatagaagaaactagtgatattataaccccttgtaaatatggtttaagtaaacttgtagcagagaagattttagaaaacaatgctgtaatattacggttacctgcattaattgcaaaaggctctaatggttggatatataaaactatacaaagtttaaatttaaataaaagtattattgtgtataattcaatattcaacaatatattacacttgagagacttagcagagtttatagagataggatataacaagaatattaagaacgaaatttttctattatctgctaatgataaagtacaaagtaaagatattgtaatatatatgaaagaaaagcttaattcaacatctaatatttcggtaactgagacaaaatcatattatttttttaataaaaaaatgaatgagatttataatcctatgaatgtttatgaaactattgatttatttttaaaggacttaaattga

SEQ ID NO: 15780 - protein, 169 aa, Unknown
  Obtained from environmental sample
  misc_feature (1)..(169): Xaa is any amino acid
MFSTHKVYGINNSPFIEETSDIITPCKYGLSKLVAEKILENNAVILRLPALIAKGSNGWIYKTIQSLNLNKSIIVYNSIFNNILHLRDLAEFIEIGYNKNIKNEIFLLSANDKVQSKDIVIYMKEKLNSTSNISVTETKSYYFFNKKMNEIYNPMNVYETIDLFLKDLN

SEQ ID NO: 15781 - DNA, 723 bp, Unknown
  Obtained from environmental sample
  misc_feature (1)..(723): n is a, c, g, or t
atgacatcaaatccagaaatcactaacgatcttacaaaatttttccactttttaacgggcttttctaaaaagggaaaactagactctctatatatgtcacctgctcaaatcaaaccaaaagttttatctatgattcaaaatgaagctagatgtggtaaaaaaggtcacataattgcaaaagttaactctcttgttgatgatgatgttatacgcgcactatacaaagcatctcaagcaggtgttaagatagagcttatcgtaaggggaatctgctgtataaaaccagggattgaaggtataagtgaaaatattagagttatatctattataggtcaatatttagagcatgcacgtatattctactttaaaaatgagagtacgaatatgtatatatccagtgctgactggatgcctagaaacttagtgagaagaatagagctattaactggtattgaagataaagagttatctaataaactacttcaaatgatgcaactgcagtgttcagataatgttttagcgcatgaacttcagagtgatggctcatacataaaagtaaaaaatgatcatccggctataaataatcaaaaaattattgaagaagcctggtatcaaaagtgcaaaaaagcggtaaaaaaaagaagcctcctggattatgcacaaacaactttgcaacaggaattactgaagggaatccataaagaaggatttttgaatttttaa

SEQ ID NO: 15782 - protein, 240 aa, Unknown
  Obtained from environmental sample
  DOMAIN (1)...(205): Polyphosphate kinase
  misc_feature (1)..(240): Xaa is any amino acid
MTSNPEITNDLTKFFHFLTGFSKKGKLDSLYMSPAQIKPKVLSMIQNEARCGKKGHIIAKVNSLVDDDVIRALYKASQAGVKIELIVRGICCIKPGIEGISENIRVISIIGQYLEHARIFYFKNESTNMYISSADWMPRNLVRRIELLTGIEDKELSNKLLQMMQLQCSDNVLAHELQSDGSYIKVKNDHPAINNQKIIEEAWYQKCKKAVKKRSLLDYAQTTLQQELLKGIHKEGFLNF

SEQ ID NO: 15783 - DNA, 681 bp, Unknown
  Obtained from environmental sample
  misc_feature (1)..(681): n is a, c, g, or t
atgaaaatagcagtattgggtgcagggattagtggactgggcagtgcttacttattaagtgctaaatatgaagttgatttatatgaaaaaagcgataggtttggtggacatgcgaggacaactcaagttagtgaaggtgaaaatgagtttggagttgatactggctttttagtatttaatcatgaaacttaccctcttcttacaaaactatttaaagaacttgacgtaaaaatagagaattcagatatgagttttggtttttgggatacaaagtcaaaccttgcatataatggtgaatcattagctggaatgttttttcaaaaaaagaatcttttttctccaacacattataaaatgattattgatatattaaattttaataaaaaagcaaataatgatttagagataaattctcctgatttaaataaaacattaggtgaatatatctccacttaccgtaaagcttttaaagaaagataccttataccaatgggttcatcaatttggtcaacaccaagtaataaaatgcatgaattccctgctcgcacttttataaacttctttaaaaaccatggactacttggagttgacactcatcatcaatggttaacagtatcaaatggaagtattaactatgtaaataagatttataaaaaagatatctggaaaaaacaattttaa

SEQ ID NO: 15784 - protein, 226 aa, Unknown
  Obtained from environmental sample
  SIGNAL (1)...(20)
  misc_feature (1)..(226): Xaa is any amino acid
MKIAVLGAGISGLGSAYLLSAKYEVDLYEKSDRFGGHARTTQVSEGENEFGVDTGFLVFNHETYPLLTKLFKELDVKIENSDMSFGFWDTKSNLAYNGESLAGMFFQKKNLFSPTHYKMIIDILNFNKKANNDLEINSPDLNKTLGEYISTYRKAFKERYLIPMGSSIWSTPSNKMHEFPARTFINFFKNHGLLGVDTHHQWLTVSNGSINYVNKIYKKDIWKKQF

SEQ ID NO: 15785 - DNA, 894 bp, Unknown
  Obtained from environmental sample
  misc_feature (1)..(894): n is a, c, g, or t
ttgtataaggaagtagcaatcatagcaccaacagcatcagggaaaacagctctttctataaagttagctcataagacaaattctgtgatactttcacttgatagtttatccgtgtataaagagatagacatagcttctgcaaaaccaactgttgatgagagagatggtattgtacactttggtattgatagagtatatccaaatgaaaagtttgatgtggttgagtttatagatgagtacaataaagcaaaaaaatatgcacaacaagaggggaaaaaccttattattgttggtggtacaagtttctatttgaagtctttatgtgaagggctttcaaaagttcctacaatctcagataaaacaaaaaatatcgttaaaaatgaactttctaacataacaaaaagttatgagtacttgctaagtattgataagaactatatgagtaaaattgataaaaatgataagtatagaatagaaaaagcattggaaatttattatgagacagatttatctcctagtgagttttttcaacaaaacaagccagaacctactataaaagatttacaaatttttcaaatagatacggaagttgagcttttaagaaaaaggataactcaaagaacaaaatcgatgatagaaaaaggaattatagatgaggtgatatatttagaaaaaaaatatacaagagcaccaaattgtatgaaatctataggaattatcgaggtgttagaatatctagatgggaaaatagataaaacaaaacttgaagagcttatctctatacatacagcacaactagctaaaaggcaaagaacttttaacaaatcacaattcacaaatatcacaaaagataacctagaaaatttagaaaatcttatcctaaaagcattttag

SEQ ID NO: 15786 - protein, 297 aa, Unknown
  Obtained from environmental sample
  DOMAIN (36)...(284): IPP transferase
  misc_feature (1)..(297): Xaa is any amino acid
MYKEVAIIAPTASGKTALSIKLAHKTNSVILSLDSLSVYKEIDIASAKPTVDERDGIVHFGIDRVYPNEKFDVVEFIDEYNKAKKYAQQEGKNLIIVGGTSFYLKSLCEGLSKVPTISDKTKNIVKNELSNITKSYEYLLSIDKNYMSKIDKNDKYRIEKALEIYYETDLSPSEFFQQNKPEPTIKDLQIFQIDTEVELLRKRITQRTKSMIEKGIIDEVIYLEKKYTRAPNCMKSIGIIEVLEYLDGKIDKTKLEELISIHTAQLAKRQRTFNKSQFTNITKDNLENLENLILKAF

SEQ ID NO: 15787 - DNA, 738 bp, Unknown
  Obtained from environmental sample
  misc_feature (1)..(738): n is a, c, g, or t
ttggaagcacgaggatcagaatcggctcgagagtggggattatttaatagtaggtctaacagtgatgaaatcagtcataaaggcgtaaaccaagatgttaggctagagtcaattgaagcaacaagttatgtagatgaagcatttatattagagagtacaccattagagtatattaaagacttcaaacctgatattgttgtaaaaggaaaagaacacgagagtagagaaaatattgagttagatattttaagttcttatggcggtaagctactttttagttcaggtgagattgctttttcatcaatggatttacttcaaaaagagtttttatcgtttaactcaaagcctcaacattcacaagaatatatatctagacataagttagatttctcaaacttaaaagaaataattgaaagtttttcaaaactaaatgttttagttgttggtgatactattgtagatgaatatatcacttgtgaacctttaggaatgtcacaagaagatccaacaatagttgtaagtccacttgcctacaataagtttataggtggagctgcaatagtagcatctcatgcaaaaacattaggtgcaaatgtgaaatttgtttcggttgtaggtgatgataaaaataaagactttgttaaatctgggcttgagaatctagatattgatacttctttattttgtgattcgtctagacctacaactttaaaacaaagggtttcgtgcaaaatataa

SEQ ID NO: 15788 - protein, 245 aa, Unknown
  Obtained from environmental sample
  misc_feature (1)..(245): Xaa is any amino acid
MEARGSESAREWGLFNSRSNSDEISHKGVNQDVRLESIEATSYVDEAFILESTPLEYIKDFKPDIVVKGKEHESRENIELDILSSYGGKLLFSSGEIAFSSMDLLQKEFLSFNSKPQHSQEYISRHKLDFSNLKEIIESFSKLNVLVVGDTIVDEYITCEPLGMSQEDPTIVVSPLAYNKFIGGAAIVASHAKTLGANVKFVSVVGDDKNKDFVKSGLENLDIDTSLFCDSSRPTTLKQRVSCKI

SEQ ID NO: 15789 - DNA, 531 bp, Unknown
  Obtained from environmental sample
  misc_feature (1)..(531): n is a, c, g, or t
atgaaaaaaaaggaagaacaaggaattgatattgaaattgatgaattgacaaactcaattaagaatatagtttctggcgatagctttcagacagaaatttcaattgtcaggaaagctgacctaaagacaattaccaaaaagaataattggcaatttgattggaaatatgaattaaaacaacccgaacgggatatttataaattgaccattgttaataatcagtccattatccaaggacttgtaagtttagaaataagatttgaccatgtttatatgcatttagttgaaagtgctccatttaacaaaggaaaagaaaaggtttattctggagttcctgggaatttggtagcatttgcttgtaaattatcatttcagcgtggacatgaaggaaatgtcgcttttatttcaaaaactcagcttgttcaacattatgaagaaagcttaggagctgttcatgttggtggaaggttaatgataattgaaacgaactcggctgcgaaattaattaatagatatttttctaacctttaa

SEQ ID NO: 15790 - protein, 176 aa, Unknown
  Obtained from environmental sample
  misc_feature (1)..(176): Xaa is any amino acid
MKKKEEQGIDIEIDELTNSIKNIVSGDSFQTEISIVRKADLKTITKKNNWQFDWKYELKQPERDIYKLTIVNNQSIIQGLVSLEIRFDHVYMHLVESAPFNKGKEKVYSGVPGNLVAFACKLSFQRGHEGNVAFISKTQLVQHYEESLGAVHVGGRLMIIETNSAAKLINRYFSNL

SEQ ID NO: 15791 - DNA, 306 bp, Unknown
  Obtained from environmental sample
  misc_feature (1)..(306): n is a, c, g, or t
atgaatattaatacagctacaatattaaatctcatctctccgacaacaaatcctgcaatgaaagagaaaatagaaagtttaagtgtaaatggtaaaattaatcttgaaaacatctccaaagataaaggtatacaaactttacttagtggtttatttaaagatattgccacaggggcacagtcaaaagaaaatatagcatcacttttacaaaataataaacaaaactttagttttaaaaatctctctgaagatataaaaactcttataaagtttattcaaacagattcaacaactaacagtaaatag

SEQ ID NO: 15792 - protein, 101 aa, Unknown
  Obtained from environmental sample
  misc_feature (1)..(101): Xaa is any amino acid
MNINTATILNLISPTTNPAMKEKIESLSVNGKINLENISKDKGIQTLLSGLFKDIATGAQSKENIASLLQNNKQNFSFKNLSEDIKTLIKFIQTDSTTNSK

SEQ ID NO: 15793 - DNA, 795 bp, Unknown
  Obtained from environmental sample
  misc_feature (1)..(795): n is a, c, g, or t
ttgatggctcgagatattgaatatttaagagagatggctgatgaagaattattttatcaaataattttaactcataattttgatttttttagaacaattcagagtagagttttaggtggaagtagttacagtaactcttttatggctaagaaaacttcttcatcaattgaattattaaaagctggacccaatcaaactaacaatccttttaaagattggaaaaataaattagatacagacaataatatgttgatttctattattccttttgttagaaatctttcagagtacttaggtaattctattattgaaaatgaattaacaaagttacttcatatgaaaatagatactaaaaatattaagataagtgatttggaaatattggtaaaaacaattttgacggatattcaagtatcttttcctaatccttcaaaaaaagtatttgatttaataattgagcaagctgaacagataataataccacctatagttgaagaggttgaattagaaaaaaaagtagttttatcaattgcaattagattaaaagcagaagaatttatgataaatacaattaatgatccttggacaaatactataactaaatttcagacaggaaaacttgttaaaagaatcaaagataattctttagtaagtaatgaaaaattaaaagtattagagttagtaaatttaattacacccgaaaatatacatttgaattcatttatgtatgaaccaattttagatatgtcanaatctcatttaattgctttatataatgatgtaaaagatttataa

SEQ ID NO: 15794 - protein, 264 aa, Unknown
  Obtained from environmental sample
  misc_feature (1)..(264): Xaa is any amino acid
MMARDIEYLREMADEELFYQIILTHNFDFFRTIQSRVLGGSSYSNSFMAKKTSSSIELLKAGPNQTNNPFKDWKNKLDTDNNMLISIIPFVRNLSEYLGNSIIENELTKLLHMKIDTKNIKISDLEILVKTILTDIQVSFPNPSKKVFDLIIEQAEQIIIPPIVEEVELEKKVVLSIAIRLKAEEFMINTINDPWTNTITKFQTGKLVKRIKDNSLVSNEKLKVLELVNLITPENIHLNSFMYEPILDMSXSHLIALYNDVKDL

SEQ ID NO: 15795 - DNA, 309 bp, Unknown
  Obtained from environmental sample
  misc_feature (1)..(309): n is a, c, g, or t
atgagttatgagttaatgaaacgttataataagtctaagcatatagaaagtataaaagttaaaaactttaaatttgagtatctattttcaaaaaattggaaaaaagaggaagatataccttatgtattaagaacacatttattggattcttattattgtttacctgaacgaccagatatggcttttacttttttgtggaaatgtattaataatacatatagtacttatcaaagaaaaacttcaagtgaaattataactggagacgctaagttacttgaaaatatgagtaaagggatagtgaaaagttaa

SEQ ID NO: 15796 - protein, 102 aa, Unknown
  Obtained from environmental sample
  misc_feature (1)..(102): Xaa is any amino acid
MSYELMKRYNKSKHIESIKVKNFKFEYLFSKNWKKEEDIPYVLRTHLLDSYYCLPERPDMAFTFLWKCINNTYSTYQRKTSSEIITGDAKLLENMSKGIVKS

SEQ ID NO: 15797 - DNA, 531 bp, Unknown
  Obtained from environmental sample
  misc_feature (1)..(531): n is a, c, g, or t
atgcaaaattacaagaaaattttaagagagtttaatagtaaggatatatttaatattcaattattattttgggatgatatagaagaactattaaaagaagaaagaaattttaatatttttcatagatattatgaagagttttttgttgataatcaaacattaggacattctattgggaagttaattaatttagagttaggaataggtaattctagagatacgcattatgatttgatgattggcaaaattccacaatataaaaaagaaaaaaaaactagtgtagattattatcaagatacatattttattattaatttccatgaaagaaaaatggatacatttcctttaccatgttttgatagtgatttagaacaagtcttttttcttccatttgatcgatttagaataacaaaatggataaatagtattaagaatcttgataaatttatttattcaaatgaagatagtttagaaacttatattacaaaagaagaatatacaaaatatttggaggcaatgaatgagttatga

SEQ ID NO: 15798 - protein, 176 aa, Unknown
  Obtained from environmental sample
  misc_feature (1)..(176): Xaa is any amino acid
MQNYKKILREFNSKDIFNIQLLFWDDIEELLKEERNFNIFHRYYEEFFVDNQTLGHSIGKLINLELGIGNSRDTHYDLMIGKIPQYKKEKKTSVDYYQDTYFIINFHERKMDTFPLPCFDSDLEQVFFLPFDRFRITKWINSIKNLDKFIYSNEDSLETYITKEEYTKYLEAMNEL

SEQ ID NO: 15799 - DNA, 315 bp, Unknown
  Obtained from environmental sample
  misc_feature (1)..(315): n is a, c, g, or t
atgtcaataggaaatggagttagaaatgcacaagaagagtataaaaatgatattcatcttatgtgtaaaatgttagagcgaacaaaaaaagaggattcaactttagattatggcttgtttgctttttatttagacatatctaatagtgctagaaaagatgcaaaaaagagattagaagagataatcaaatcttttgatgagattgttaattcatatgaaaatttaaaatcaagtttcaaaggaggcgatataaaaaaattagaaaaaatcggcgaatggtgcattggttgttacatcatagaacatacattataa

SEQ ID NO: 15800 - protein, 104 aa, Unknown
  Obtained from environmental sample
  misc_feature (1)..(104): Xaa is any amino acid
MSIGNGVRNAQEEYKNDIHLMCKMLERTKKEDSTLDYGLFAFYLDISNSARKDAKKRLEEIIKSFDEIVNSYENLKSSFKGGDIKKLEKIGEWCIGCYIIEHTL

SEQ ID NO: 15801 - DNA, 354 bp, Unknown
  Obtained from environmental sample
  misc_feature (1)..(354): n is a, c, g, or t
ttggggtttttaaaaaaaatttcaaccccaaccccaattttttcgatttcaaaacggcatttccaccctaaaaaccaatttttcaaccccaaaaagctgaccctatttctgaccagtttttttaatttcatggaaaaggaggaatcattggcgtataccccagaactaagccaataccacagtggtatacttaggcggatcgcttgggtatgtaaaatgccaatgacaaaaacgatggtaaatatttttgatcaccttggaggtaccttggataaaggcaaaatttgcaatgcctgcaaagataaatccatatgtaaaacctgtgcgtttaatctcaaagaagttcaattctaa

SEQ ID NO: 15802 - protein, 117 aa, Unknown
  Obtained from environmental sample
  misc_feature (1)..(117): Xaa is any amino acid
MGFLKKISTPTPIFSISKRHFHPKNQFFNPKKLTLFLTSFFNFMEKEESLAYTPELSQYHSGILRRIAWVCKMPMTKTMVNIFDHLGGTLDKGKICNACKDKSICKTCAFNLKEVQF

SEQ ID NO: 15803 - DNA, 741 bp, Unknown
  Obtained from environmental sample
  misc_feature (1)..(741): n is a, c, g, or t
atgaatttaaatttaacaacaaaaaaaatccaaatagatatagagatactatttgtaaaaaataaaaaaataaaaacagataaagagattttagaactccttgactttaaaggggaagaggaagagtctattttactaccagagttaaagaaactttatgtgggtttacctcaaagtgatgatgaaagtataaaaattgctgttgcgacggcgattaaaaaactaaaaggtacaaattataaatcagcttcaattaaatgtaaagagagtttatcagcttttatagagggatttgaactaggaaactatagttttaaaaaatataaatctaaaaaagaggaaaaagaagagattaacatctatattgaagtaagtgagataacaaaagaggtacaaaatgaatttgagaaatttgtttctgtgtgtacttctgtaaatatggctagagattttgtaaatacagcaccagatgatttttatccatcagttatggctcaagaagctattaaaattgctacaaataatgaattagagtgtaaaattcttgatgaagactatttagaagaaaatgggatgggtgcaatgttagccgtaggtcgtgctagccgtcataagtctaaacttatccatcttacctataaaccaaagaaaaaatctaagaagaaaattgttttaattggaaaaggtcttacttacgatagtggtggattgagtttaaaacccaagntgattttatggtga

SEQ ID NO: 15804 - protein, 246 aa, Unknown
  Obtained from environmental sample
  DOMAIN (14)...(112): Cytosol aminopeptidase family, N-terminal domain
  misc_feature (1)..(246): Xaa is any amino acid
MNLNLTTKKIQIDIEILFVKNKKIKTDKEILELLDFKGEEEESILLPELKKLYVGLPQSDDESIKIAVATAIKKLKGTNYKSASIKCKESLSAFIEGFELGNYSFKKYKSKKEEKEEINIYIEVSEITKEVQNEFEKFVSVCTSVNMARDFVNTAPDDFYPSVMAQEAIKIATNNELECKILDEDYLEENGMGAMLAVGRASRHKSKLIHLTYKPKKKSKKKIVLIGKGLTYDSGGLSLKPKXILW

SEQ ID NO: 15805 - DNA, 816 bp, Unknown
  Obtained from environmental sample
  misc_feature (1)..(816): n is a, c, g, or t
atgcaaaatatatttttagaagtaaatagtctggatagacgttgttatgaagagtttgaactaagcgaagacattttgatggaaaatgctgcaaaatccatagcagaacacatcaaaaagaaatttgacaaaggaagtagagttctcatcgttgcaggttctggtaacaacggagctgatgggattacactcgctcgtattttacatggtgactttagtgtcggtctatatattccaaatgctctgaaatctcctatctcatctttacagattaaacgtgcaaattcagtaggtattgagatcataactaagattgaagtgtgtgatgttttagttgatgcactctttggaagtggactttcacgcaaaatagataaatctacagcagaaattattaataaaatgaactccattgattcttataaaattgcttgtgatgtaccctcaggaataagagcagacggcttggtcagtgagcatacattcaaagcagatatcacgctcactatgggaggattaaaactttcactctatggggatatggcaaaagattatgttggagagatagaagtctgcgatcttggtatatcaagagaaatttatgagataaaaagcactatttcacttctagataagagtgatctgactctgccacatagagtaaaaaagtccacccacaaaggtgaatttggtcacttaagtgttatctgcggaagaaaaatcggtgctagtgtcatagccagcaggtgcggctttacgctttggagtcggcttggttactctcataagccatggaaatgtacatataccctatga

SEQ ID NO: 15806 - protein, 271 aa, Unknown
  Obtained from environmental sample
  DOMAIN (19)...(176): YjeF-related protein N-terminus
  misc_feature (1)..(271): Xaa is any amino acid
MQNIFLEVNSLDRRCYEEFELSEDILMENAAKSIAEHIKKKFDKGSRVLIVAGSGNNGADGITLARILHGDFSVGLYIPNALKSPISSLQIKRANSVGIEIITKIEVCDVLVDALFGSGLSRKIDKSTAEIINKMNSIDSYKIACDVPSGIRADGLVSEHTFKADITLTMGGLKLSLYGDMAKDYVGEIEVCDLGISREIYEIKSTISLLDKSDLTLPHRVKKSTHKGEFGHLSVICGRKIGASVIASRCGFTLWSRLGYSHKPWKCTYTL

SEQ ID NO: 15807 - DNA, 483 bp, Unknown
  Obtained from environmental sample
  misc_feature (1)..(483): n is a, c, g, or t
atgccaagtgtgttttttagaaaatcatttttggatgaaatagggtattttgacgaaagtagttttactttaacagctgcagatagtgaattggttcaaagagctctattacttggaagatctgcttttatacctaaagttatatcatcatatagggtatggtctggaagtttaacaaacaatactatcgcttcaaaacattggctagatgaaattgacatatggacaagtaaaattactaaacttgcaaatgctacattaacaaaaaaacaaaatatttttaattggagtagatataaagatgagatatatgcaagaaatcttttaggaggattaagcaatctttacaatttaaaaaattaccataaattatttcattattattcagaagctagataccctaaaaatgcatttttaaagactaaattaagaatttggaagatattgatactatctaaattaaagactctaaatgttaattaa

SEQ ID NO: 15808 - protein, 160 aa, Unknown
  Obtained from environmental sample
  misc_feature (1)..(160): Xaa is any amino acid
MPSVFFRKSFLDEIGYFDESSFTLTAADSELVQRALLLGRSAFIPKVISSYRVWSGSLTNNTIASKHWLDEIDIWTSKITKLANATLTKKQNIFNWSRYKDEIYARNLLGGLSNLYNLKNYHKLFHYYSEARYPKNAFLKTKLRIWKILILSKLKTLNVN

SEQ ID NO: 15809 - DNA, 888 bp, Unknown
  Obtained from environmental sample
  misc_feature (1)..(888): n is a, c, g, or t
atgacagatcggctcggtttaaaaattcctgatgttctcaaaagggattccggaactatagttgcttcagaggaaaaatatttaatatgttttgatgatcagacggtttcttgtttatggggcaaagattgttcttttatggggaagatagttcaaattgataaaattggagaattctcagatagtttatcgtttaaatttgaatttgagcatatacttgatactcgtaaaagggtgaaagagggcgttaatattggtaaatctgatgaatcagaaatgattgttcttggatattcacatgaaagtcctcttatgggttctgttattttaaatgaaattgttaataactataaaaacataaaatttaaatgggaaaaggaagatattgtttctaagaaaaaatatattaagtcagctcttgatgaaatgattgcagatcttgatgagaagagtcagaagatgatcatttttcaacaaacagaaaatacattgcttccagaaatagaaattccagaacttttaaaaaagcaggaaattttgaaagtgcagattgaggaattaatatttaaaagaaagataattgcaggagcaatggaggatattaacaagaatgttgattctcctatagcaattccatttgcttttgaagagatttcaactcaagaagcattgacggcacataacgagctcatattgaaaaaaaacagcgtatctcaacaagtcaccaaagagcatccaatgtatgtcgctattgaaaaggaagtaaaagaaagtgacagtgctttaaaaagaatgcttgaagatacaattaaacagtatgatcgtggtattaagatgattcaggatcttcttgcaaagatatcaatgggacaggaaaatattccctga

SEQ ID NO: 15810 - protein, 295 aa, Unknown
  Obtained from environmental sample
  misc_feature (1)..(295): Xaa is any amino acid
MTDRLGLKIPDVLKRDSGTIVASEEKYLICFDDQTVSCLWGKDCSFMGKIVQIDKIGEFSDSLSFKFEFEHILDTRKRVKEGVNIGKSDESEMIVLGYSHESPLMGSVILNEIVNNYKNIKFKWEKEDIVSKKKYIKSALDEMIADLDEKSQKMIIFQQTENTLLPEIEIPELLKKQEILKVQIEELIFKRKIIAGAMEDINKNVDSPIAIPFAFEEISTQEALTAHNELILKKNSVSQQVTKEHPMYVAIEKEVKESDSALKRMLEDTIKQYDRGIKMIQDLLAKISMGQENIP

SEQ ID NO: 15811 - DNA, 732 bp, Unknown
  Obtained from environmental sample
  misc_feature (1)..(732): n is a, c, g, or t
ttgaagatcccgatgaaaggaagcgcacattttagttttgggaatacgatccacaatacgcttcaagaattttatgaaaaagtccaagagctgaatgctgcaaaacaggattcactcttcggtatgccagtcgcgacgaaagcaaaagtagacaatggtatcaaagtaccgagtgaaaaagacctactcaagatgtatgaaggcaaatggatcggggactggtacaagaataaacaacaacgtgaaaaatattatgagaatgggaaagaaatattgaagaccttttatgctgcgcaagaaggcaagtggacgatcccggtatctatcgagggatggttcaagatcaaagtaggggaatacatcgtccatggtcgtatggatcgtatcgatcagcgagaagacggcacactcgagatcatcgactataagaccggtactgcaaaagaaaaactcacgacagatgacaagcaacagcttctgatttattatgcagcagcagacacactccctgaatacaaaaacatcggtcccgtcggacagctgacattttattatgtgaattctgatacgaagttgtcattcgaaggaaagcaaaaagacgtggacaaactcaaagaaaaaatactcgatacgatcaataatattcacaaaggtgacttcactgccaccccgaatcctttcacttgtaagtattgtgatttcaaggatatttgtgagtttaggaaactttaa

SEQ ID NO: 15812 - protein, 243 aa, Unknown
  Obtained from environmental sample
  misc_feature (1)..(243): Xaa is any amino acid
MKIPMKGSAHFSFGNTIHNTLQEFYEKVQELNAAKQDSLFGMPVATKAKVDNGIKVPSEKDLLKMYEGKWIGDWYKNKQQREKYYENGKEILKTFYAAQEGKWTIPVSIEGWFKIKVGEYIVHGRMDRIDQREDGTLEIIDYKTGTAKEKLTTDDKQQLLIYYAAADTLPEYKNIGPVGQLTFYYVNSDTKLSFEGKQKDVDKLKEKILDTINNIHKGDFTATPNPFTCKYCDFKDICEFRKL

SEQ ID NO: 15813 - DNA, 897 bp, Unknown
  Obtained from environmental sample
  misc_feature (1)..(897): n is a, c, g, or t
ttgcggattcttatgaagcctttatatgagaagctcagagtcataagcgtggaagccaaccttgtaaaacaggaaaacatcacccaggctttagtctacacggcaaaggtcgagaagtttaacaatggcgaatggacagaaagcacagatcttgaagaaacacagaagctgcagctaaactggcacttcataaaaaacaatgacgacttagacacagagatcttaacggatcaactcaccgatgatgacatagaagtagacggacttactatgacggtgaatgtccaagatgacaatatcttacagttcggacatgctcactgtttcgtcaactctgctgagcaagaagaagggcatgccctgactgaactcaagcgtcagcttgatgtgcaagaggtacttggtgacaatgtactaagcattaacacagacaaggtaaactaccgaattgagctcaacattgacaatccgacagcagatgagatcaaagaattaacagttgagattcttgaaaaagacagcgaaggaaagacagtgactaaagaagctagcgtaaaagaagaccttagcatcgagcatagtttcaaagaagggcatacccttgtagaggtcagagccaaggtctatccaaaagagcatcctgacaacagtgccgaaggcatcagttatcttagaactgtacttgaaggtgaagtagcaaacatctccattggtacacaagaaaagccatacagcagaacaatctctacagaagaagagttcctcatcaaagtacaagcaggactgcctgaaggtgaggcccttggtatcacagtagatgtctttgctaaagaagagaataagaagaagaccatggaactcgaagagttcttacaaaccatagactcagccatctga

SEQ ID NO: 15814 - protein, 298 aa, Unknown
  Obtained from environmental sample
  misc_feature (1)..(298): Xaa is any amino acid
MRILMKPLYEKLRVISVEANLVKQENITQALVYTAKVEKFNNGEWTESTDLEETQKLQLNWHFIKNNDDLDTEILTDQLTDDDIEVDGLTMTVNVQDDNILQFGHAHCFVNSAEQEEGHALTELKRQLDVQEVLGDNVLSINTDKVNYRIELNIDNPTADEIKELTVEILEKDSEGKTVTKEASVKEDLSIEHSFKEGHTLVEVRAKVYPKEHPDNSAEGISYLRTVLEGEVANISIGTQEKPYSRTISTEEEFLIKVQAGLPEGEALGITVDVFAKEENKKKTMELEEFLQTIDSAI

SEQ ID NO: 15815 - DNA, 714 bp, Unknown
  Obtained from environmental sample
  misc_feature (1)..(714): n is a, c, g, or t
atgaattttaaaagttttttattagttttgggtagtatatttttaggaatattaattttattgaatttgaatacaactatatttgtatattcagatgctctgaaatatgaagattctgtatttaaggttgataaatatttaaatgaaggttttgataataaagataattttttaaaaaaagaatctttaaatttaaaaattaaatctaatgattctaaaaattcaaaacttacaagatttgtttctagaaaaaatttagttttagatatttctagtgagttatctacttattattcttgtgaagaagctataatattaaatatagatttaagaggtggtcttgtaaatcatggaggtcattataattatggttggtatgtttttgattctaataattcttttgcattaaagaaatcgaattatcaagatttaaaaaaaatatcaacatctcaagatttaaaaattaatgctaggtctgttggaagtggtagctttaatattaaattaatagttaaagaattagaaacaggtattgttatagaacatgtttttgaagaacctatttttgttgaagcttgtttagctaatcctgtttgtttaggtgatgttgaaaatggttctggaaattatacttttgatccaattgttatttgtaatggtgaaagatttaatgatgttagaaataatgtagataaatattatttatttaggtga

SEQ ID NO: 15816 - protein, 237 aa, Unknown
  Obtained from environmental sample
  misc_feature (1)..(237): Xaa is any amino acid
MNFKSFLLVLGSIFLGILILLNLNTTIFVYSDALKYEDSVFKVDKYLNEGFDNKDNFLKKESLNLKIKSNDSKNSKLTRFVSRKNLVLDISSELSTYYSCEEAIILNIDLRGGLVNHGGHYNYGWYVFDSNNSFALKKSNYQDLKKISTSQDLKINARSVGSGSFNIKLIVKELETGIVIEHVFEEPIFVEACLANPVCLGDVENGSGNYTFDPIVICNGERFNDVRNNVDKYYLFR

SEQ ID NO: 15817 - DNA, 516 bp, Unknown
  Obtained from environmental sample
  misc_feature (1)..(516): n is a, c, g, or t
atgttgtatacttatgctaatcaaggtatttataatcaaaaattatatgatttaataaaagatatgaagttacctaaaggttataagattacttttaaagatgaacatgttttttttgatggttataaattagaaggtaagtggacaaaatctaaaattgtatctttaagttataataataaagaaattggtattatgcatcctagatttgtagaaatacctaattctaaagaattttgtgtttctataaattttattcaaggtataaaatcaaatgaaggtaaacatcctaaagagtggtattctaaattagtcttgccattaatcactagtgtttatgaaatagaccctaaattaaaaattatttattctgattctgaggtttttaaaataaaagatttaaaagataaaatttctaaatttaaaaatcattctgagaattttaaagttttattggaaaaattacttttagaaaaaagagaattggaatcaatgatatatgaaaaagngtgttga

SEQ ID NO: 15818 - protein, 171 aa, Unknown
  Obtained from environmental sample
  misc_feature (1)..(171): Xaa is any amino acid
MLYTYANQGIYNQKLYDLIKDMKLPKGYKITFKDEHVFFDGYKLEGKWTKSKIVSLSYNNKEIGIMHPRFVEIPNSKEFCVSINFIQGIKSNEGKHPKEWYSKLVLPLITSVYEIDPKLKIIYSDSEVFKIKDLKDKISKFKNHSENFKVLLEKLLLEKRELESMIYEKXC

SEQ ID NO: 15819 - DNA, 840 bp, Unknown
  Obtained from environmental sample
  misc_feature (1)..(840): n is a, c, g, or t
ttgggaataaattttaaagaacttgccgaaaaatatcaaacaccgtattatgtgtatgattttgactatattacaaaacagtatcaagaattaaaaggtgcttttaaagctagaaaatctttgatatcgtatgcggtaaaagcaaattcaaatttaagtgttgtaaaacatcttggagatcaaggtagtggcgcagattgtgtgagtattggtgaagttaaacgagcattaaaagctgggattccaaaatataagattatattttctggtgttgggaagattgataatgagattagagaagctttacaacttgatattttgatgataaatgttgagagtgaagcagaactaaaaagagttgatatcatagccaaagaacttaaggtagaagctagaatatctatacgagtaaatccaaatgtagatccaaaaacccatccatatatttcaactggactccatgagaataaatttggtgtagatatcaatactgcaaaaagaatgtatatctttgctaaacaaagtgaaaacttagaccctctaggtatccactgtcacatagggagtcagcttacagagttagcacctatcaaagaagctgtaaatatcgttgcagatttagttagaaatataaaatctgcactaaaaattgagttaaagttttttgatgttggtggtggacttggtattgtctatgatgatgagaagcttatagatacttacgaatatgctcaaactgtattagatgctctttttggactggatatcacggtagtgtgtgaaccaggaagatttatcgttggaaatagcaggtgtatttgttacgaaagttttatatga

SEQ ID NO: 15820 - protein, 279 aa, Unknown
  Obtained from environmental sample
  DOMAIN (20)...(269): Pyridoxal-dependent decarboxylase, pyridoxal binding domain
  misc_feature (1)..(279): Xaa is any amino acid
MGINFKELAEKYQTPYYVYDFDYITKQYQELKGAFKARKSLISYAVKANSNLSVVKHLGDQGSGADCVSIGEVKRALKAGIPKYKIIFSGVGKIDNEIREALQLDILMINVESEAELKRVDIIAKELKVEARISIRVNPNVDPKTHPYISTGLHENKFGVDINTAKRMYIFAKQSENLDPLGIHCHIGSQLTELAPIKEAVNIVADLVRNIKSALKIELKFFDVGGGLGIVYDDEKLIDTYEYAQTVLDALFGLDITVVCEPGRFIVGNSRCICYESFI

SEQ ID NO: 15821 - DNA, 489 bp, Unknown
  Obtained from environmental sample
  misc_feature (1)..(489): n is a, c, g, or t
gtgaattatgatttttctaataccatattagatggaaaaatagctccttacaaagtatttgaaaaagataatgtgaaaattggtgtttttggtgttggagtagaattagctggtttggtagataaaaaaatgtatgcagaaacacaatataataatccgataattgcagccaataatacggcagaacatttaaaacataatgaaaattgtcatataattatatgtctttcgcatttgggttatgattacaaaagcaataaagtttctgataatgtattggctaaagaaactaaaaatatagacttaattattggcggacatacacatacgtttttagaaaggccaacaagtataaaaaataaagaaaataaaatcactttaattaatcaagttggttgggcgggactttatttaggtaggatagacttttatatcaaccctttaaataaggggcttgcttcaaataatgatagaataggcgttatctaa

SEQ ID NO: 15822 - protein, 162 aa, Unknown
  Obtained from environmental sample
  misc_feature (1)..(162): Xaa is any amino acid
MNYDFSNTILDGKIAPYKVFEKDNVKIGVFGVGVELAGLVDKKMYAETQYNNPIIAANNTAEHLKHNENCHIIICLSHLGYDYKSNKVSDNVLAKETKNIDLIIGGHTHTFLERPTSIKNKENKITLINQVGWAGLYLGRIDFYINPLNKGLASNNDRIGVI

SEQ ID NO: 15823 - DNA, 636 bp, Unknown
  Obtained from environmental sample
  misc_feature (1)..(636): n is a, c, g, or t
atgaatattctattgattgatgatgacgcagcaacacgtgaaagcttggccgatttttttcaaaagaagggataccttttcgttcaagcttccaatggcagaatcgcaattgatattgcccggcaacacccgataagtattatcatttcttcccaggaaatgcgggatatggacggcattgagttgtaccggaatattcgagaggaacaaaaagacaattatatttattgtatcatgctggcaaaagaaaatgaaaaagagagaagacttacagggtatcttcagggagtggactcatatattaccaatcctcctgatcttgaggaactggaagcactggtccaggtaggaatgcggattgccggtttcagtcccattcagcccgttatcaacgaaccggaacgaacaaaaatcatacccggacaaaatgggaatgcaaaaggggttgaaaaaaaattacccatggaaacctccccattgcagatcaaaagaaagatattcgcaatcatgatattagcaattatgacattctttttgccaagaattgcccctggagcgaaagttaaattacaaaaagaaatggctggccaaaagtttttttctttttcaaaaaaaaggaaaaaggttttggggtaa

SEQ ID NO: 15824 - protein, 211 aa, Unknown
  Obtained from environmental sample
  DOMAIN (1)...(122): Response regulator receiver domain
  misc_feature (1)..(211): Xaa is any amino acid
MNILLIDDDAATRESLADFFQKKGYLFVQASNGRIAIDIARQHPISIIISSQEMRDMDGIELYRNIREEQKDNYIYCIMLAKENEKERRLTGYLQGVDSYITNPPDLEELEALVQVGMRIAGFSPIQPVINEPERTKIIPGQNGNAKGVEKKLPMETSPLQIKRKIFAIMILAIMTFFLPRIAPGAKVKLQKEMAGQKFFSFSKKRKKVLG

SEQ ID NO: 15825 - DNA, 684 bp, Unknown
  Obtained from environmental sample
  misc_feature (1)..(684): n is a, c, g, or t
ttgcttaacgaacaatatttatctcaaaatatctctctcataaaggccaaagaaaaggcagaggaaagtgataagttaaaatcatcttttcttgctaatatgagtcatgaaattcgcacaccaatgaatggaattataggtttttccgatctattgaaaacaccagggctttcaggcaaaaagcaacatgaatacataaaaattattgaaaatggcggaaaacgcctgcttaatattatctcagagataattgatatttcaaaaattgaatctggtcaaatggaagttcaaatccgtaaaacgaatattattgaacttcttgaggaaacatttcatctttttaagaaagaagccaatagtaaaaaaataattttatcccttaaaaacacctccccaaataaacaagaaattataaatactgatagagaaaagttatattcaattttaactaatcttgtaaaaaatgctattaaatataccgaccagggaagtatagaatatggttataatagaaaaggtaatttgttggaattctatgttaaagattctggtatcggcattcaatcaaacagacatgaagtcatattcgaaagatttattccagctgatatagcagatatacaagcacgccaaggggctggattaggtttatccctttcaaaagcttttgtagaaaatgtttag

SEQ ID NO: 15826 - protein, 227 aa, Unknown
  Obtained from environmental sample
  DOMAIN (140)...(227): Histidine kinase-, DNA gyrase B-, and HSP90-like ATPase
  misc_feature (1)..(227): Xaa is any amino acid
MLNEQYLSQNISLIKAKEKAEESDKLKSSFLANMSHEIRTPMNGIIGFSDLLKTPGLSGKKQHEYIKIIENGGKRLLNIISEIIDISKIESGQMEVQIRKTNIIELLEETFHLFKKEANSKKIILSLKNTSPNKQEIINTDREKLYSILTNLVKNAIKYTDQGSIEYGYNRKGNLLEFYVKDSGIGIQSNRHEVIFERFIPADIADIQARQGAGLGLSLSKAFVENV

SEQ ID NO: 15827 - DNA, 705 bp, Unknown
  Obtained from environmental sample
  misc_feature (1)..(705): n is a, c, g, or t
atgtattcaagtaaaaagcaaatcataggagaaatacaaaacaaattaaaggagatttcatttgcattagataaagaagacgacgataatgggattggtttatttagtggtaaaatgggaattgtactatttaattttcattatgccaaatataaaaacagtcaaaaaatatatgacaaggcctataataacttttctaatataattgatgacctaaatacaaaatattcaacttatacatttgctaatggtatagcaggaattggaactgtcataaatcatctcgaaagtaataattttgttgattttgattctgaagaagtactaatttatattgataattttttatattctaaaatgattagagattttaattctggtaattacgattatctgcatggagcccttggaattgctttatattttatatcaagaaaggattcaaaaagaaaatcagaatatttaaatagaattatccaagaaattgaaaataatgtaataaaagataaaaacgggttaaaagtattatttaccaataatatgaataatctaaagagctataatattagcctttcacacggcttatcaagtctaataattgttttaagcaaaatacatcaacaaagtattaatcctaaacaaaccaaatccttacttgagaagacggtcaattatttacttcaacaaaaattaccaaaagngtga

SEQ ID NO: 15828 - protein, 234 aa, Unknown
  Obtained from environmental sample
  misc_feature (1)..(234): Xaa is any amino acid
MYSSKKQIIGEIQNKLKEISFALDKEDDDNGIGLFSGKMGIVLFNFHYAKYKNSQKIYDKAYNNFSNIIDDLNTKYSTYTFANGIAGIGTVINHLESNNFVDFDSEEVLIYIDNFLYSKMIRDFNSGNYDYLHGALGIALYFISRKDSKRKSEYLNRIIQEIENNVIKDKNGLKVLFTNNMNNLKSYNISLSHGLSSLIIVLSKIHQQSINPKQTKSLLEKTVNYLLQQKLPKX

SEQ ID NO: 15829 - DNA, 417 bp, Unknown
  Obtained from environmental sample
  misc_feature (1)..(417): n is a, c, g, or t
atgtatgaacaaatgcaaaatgtattcttcagaattgatagtaatatatttgtggttgataacttaaaaaataggcttattctttttgatgatgattgtaaaatgattgagattaaagatattattattcaagaagaaaccaatataattaatgatgtatttcaaaaaaaaggaactcaaatatggaaatatccattaatagttgaccagtttagtaataaattatttttagcagtgctgaataaacaaaaaacagacttagttaattttgatgttgaaaaaggaagtttaagttttgttacaacactaccacacatatttccaaaaaaaatattggttaacaaaggtgacgtttactatttatatcaaaaaacaagttctgtgcgtaattttggactgtttagaacaaaactttag

SEQ ID NO: 15830 - protein, 138 aa, Unknown
  Obtained from environmental sample
  misc_feature (1)..(138): Xaa is any amino acid
MYEQMQNVFFRIDSNIFVVDNLKNRLILFDDDCKMIEIKDIIIQEETNIINDVFQKKGTQIWKYPLIVDQFSNKLFLAVLNKQKTDLVNFDVEKGSLSFVTTLPHIFPKKILVNKGDVYYLYQKTSSVRNFGLFRTKL

SEQ ID NO: 15831 - DNA, 870 bp, Unknown
  Obtained from environmental sample
  misc_feature (1)..(870): n is a, c, g, or t
ttgttnnngccgatgatggctcggatattttatacagaagatgaattattgaaaatcaaaaaagatttaattgtgttggctaaattgagtattggttctgaaatatcattgattaataaatcatcattattaacaggaggtgaagtgactagaatatctaatccagatgataagaaaaaggaggttgatattgtaagtataaatacttctatggatttaaaagtatttcaagataagagagagacagacaagtatattaagaaaatcaataaattttatatagatagcaataggatgaattctgcaataaaaatatttggacaaatggtggagtattttaaagacgatattgaattgtataaatggtttgctggtgagcttattgaattgagtgaggatgtggacaagagtatatttgatgatatttttaactcaaccggagtatttaaaaaagaatatgctaggaaggtttccgaattttcagatattgaattaaagaatgccattaatgaggaagataagaaggaaacaataaccaatatattagatatatttaggttgataaataaacgtaggggaaaagaaaaaatgagtgcaccaactttattaaagtatttaggggctttaaaaaaatatggaaaagaatttgcagaattaaatttaatgtatgttgggattttagataaaacaagtgatattaaaaagatagaatcaaaaattgaaaaatatttaaatccacttttaaagcactatttaaagaagaacataacaaaactatattattattctaatggagattttgagaaaataaatanatcattgaatatagtgagatgtttggtattgagtattttgaggcaattactttaa

SEQ ID NO: 15832 - protein, 289 aa, Unknown
  Obtained from environmental sample
  misc_feature (1)..(289): Xaa is any amino acid
MXXPMMARIFYTEDELLKIKKDLIVLAKLSIGSEISLINKSSLLTGGEVTRISNPDDKKKEVDIVSINTSMDLKVFQDKRETDKYIKKINKFYIDSNRMNSAIKIFGQMVEYFKDDIELYKWFAGELIELSEDVDKSIFDDIFNSTGVFKKEYARKVSEFSDIELKNAINEEDKKETITNILDIFRLINKRRGKEKMSAPTLLKYLGALKKYGKEFAELNLMYVGILDKTSDIKKIESKIEKYLNPLLKHYLKKNITKLYYYSNGDFEKINXSLNIVRCLVLSILRQLL

SEQ ID NO: 15833 - DNA, 489 bp, Unknown
  Obtained from environmental sample
  misc_feature (1)..(489): n is a, c, g, or t
atgttagatattactatgccggaattagatggttttgaagtagcgaagattgttaggcaaaatcatcctgagattaaaattttagcacttaccatgcatagcgaagaatcttacattacaaaaatgatagatgttggtgttcatggatatgtattaaaagattctaatttagaagatttgtcaacagctattaaaactattttagagggtaagccttattatagtagcgatgtatctgctattatgataaacagtttaatgaataaagataaaaagaaagaaaacaacgaattagaaaatcttacagagagagaaattcaaattatcaatttaattaccgaaggttttaaaagcagtgaaatcgcagatcaactaaagttatctaccagaaccattgaggtgcacagaagaaatttaatgaaaaaattagatgttaaaaatacagcagaactagttagttttgtattgaagagtaaattaattttatag

SEQ ID NO: 15834 - protein, 162 aa, Unknown
  Obtained from environmental sample
  DOMAIN (1)...(72): Response regulator receiver domain
  misc_feature (1)..(162): Xaa is any amino acid
MLDITMPELDGFEVAKIVRQNHPEIKILALTMHSEESYITKMIDVGVHGYVLKDSNLEDLSTAIKTILEGKPYYSSDVSAIMINSLMNKDKKKENNELENLTEREIQIINLITEGFKSSEIADQLKLSTRTIEVHRRNLMKKLDVKNTAELVSFVLKSKLIL

SEQ ID NO: 15835 - DNA, 822 bp, Unknown
  Obtained from environmental sample
  misc_feature (1)..(822): n is a, c, g, or t
atgaaaaaatctaccccatttaaaaatatcaaagtacatgtgcatacaaaagataataagtcttttgtaagaagttggaaacttgataagtttggtgacgatttaagttcatttagagatagtgtagtaaaagtaaatcagacacaaactgctgtaaatacttttgaagttggaaatgctggtttatcattgcgttcagttgcatgtgtaacagatgatgatggaacacacttaggttctttagagtttatgcaaggtcttaactctgttgcaaaaagttttgataaatcaaaagatggctttttactccttatggatgataagtttttaagaggtgagtccactaacaaatttaaaaactatgtaatctcacaaaaatttataaataaagattttttagcagatgcaaacaaaattaatatgcaactactattaaaagataaaatatatatcacaaataaatatttctatacttatgtagatgtaaaagatttcaatgaccaaaaattaggaatcgcactagttgcttcacctatgtctaaagtagcccatgcaattgaagcttcccaagagatgattaatgttgcacttactattattgtattacttgtattatttatcctgattgcattaatgattcttttaaaaagaatcattagtacccctttaaaaagttttgaagatggactattaggatttttcaaatatctaaacaaggagacaacttctgtacaagagcttacaaaacactcaaatgatgagattgggatcatggtcaatggtatcaatgaaaaatatttgaaaaaccaaggaatattttag

SEQ ID NO: 15836 - protein, 273 aa, Unknown
  Obtained from environmental sample
  misc_feature (1)..(273): Xaa is any amino acid
MKKSTPFKNIKVHVHTKDNKSFVRSWKLDKFGDDLSSFRDSVVKVNQTQTAVNTFEVGNAGLSLRSVACVTDDDGTHLGSLEFMQGLNSVAKSFDKSKDGFLLLMDDKFLRGESTNKFKNYVISQKFINKDFLADANKINMQLLLKDKIYITNKYFYTYVDVKDFNDQKLGIALVASPMSKVAHAIEASQEMINVALTIIVLLVLFILIALMILLKRIISTPLKSFEDGLLGFFKYLNKETTSVQELTKHSNDEIGIMVNGINEKYLKNQGIF

SEQ ID NO: 15837 - DNA, 696 bp, Unknown
  Obtained from environmental sample
  misc_feature (1)..(696): n is a, c, g, or t
atgacaatagcatttttggatagaaaaactttaggtaatgatgtaagtttagaacaatttaatgaacttggaaaagttattatttatgaaactacaaccccagaacaaactcttcaaagagttcaaaatgtagatatcgttgtaacaaataaagtagtaatagataaaaatattatggaaaatagtaatataaaacttgtctgtattgcagcaactgggatgaataatattgatttaaaatttgcagaacaaaaaagtattgaagttaaaaatgtggtcggatattcaacatctagcgtagtacaactcacattatcattcgtattacagtttgtacagaaaattgacttttatgacaaatttggaaagtgtgactggagatatagtgatatatttacaaatttaagtaagccattttatgagcttgaaaataaaaaatgggggattatagggcttggtactattggtcttggcgttgcaaaagtagctgatgcctttggctgtgatgtacaatacttttctacaagtggtaaaaacaaaaatggacaatataaacaagtatctttagatgaactattacaaacatctgatattatatctatccattgtgctttaaatgagcaaacactcaatctactgaatagttctaatcttacagtgataaaaaatnggtggagttttagtaaatctaggtag

SEQ ID NO: 15838 - protein, 231 aa, Unknown
  Obtained from environmental sample
  DOMAIN (100)...(227): D-isomer specific 2-hydroxyacid dehydrogenase, NAD binding domain
  misc_feature (1)..(231): Xaa is any amino acid
MTIAFLDRKTLGNDVSLEQFNELGKVIIYETTTPEQTLQRVQNVDIVVTNKVVIDKNIMENSNIKLVCIAATGMNNIDLKFAEQKSIEVKNVVGYSTSSVVQLTLSFVLQFVQKIDFYDKFGKCDWRYSDIFTNLSKPFYELENKKWGIIGLGTIGLGVAKVADAFGCDVQYFSTSGKNKNGQYKQVSLDELLQTSDIISIHCALNEQTLNLLNSSNLTVIKNXWSFSKSR

SEQ ID NO: 15839 - DNA, 648 bp, Unknown
  Obtained from environmental sample
  misc_feature (1)..(648): n is a, c, g, or t
atggaaaaaaatgaaaatatagaacggataatagagggtatagttgataaaaaagtagatggtaaaaaaagtaaaataccagcaaaacttgacttttaccaaagtgcgacaggattaattcttgctatatttgtcaagtttcatcttatatttgtatcatcaattttaatcagtaaagattttatgcacagtgttgataagtttttatcaggaagtgcaattattgagggtggtcatccagcttttgttgttggctcggcttttatattatttattatattagttattcatgctctcatggcagtacgaaaatttccaaattcatatagacaatatagaaacttcacatctcatactcaaatgtttccacacggcgataccaaattgtggggaatacaaattgtaacaggatttatactttttttctttgtttctatgcatctgtaccaaatgatgagtgaaccatcaaacataggaccatatttaagttctgatagaatttggagtgatagtgcttgggtaatgtatattattttacttatagctgttgaacttcatgcaacaattggattgtatagattagttgtaaagtgggggtggtttgcaaataaaagttataaagctactagagaaaaacttaactcatag

SEQ ID NO: 15840 - protein, 215 aa, Unknown
  Obtained from environmental sample
  DOMAIN (8)...(213): Fumarate reductase respiratory complex, transmembrane subunit
  misc_feature (1)..(215): Xaa is any amino acid
MEKNENIERIIEGIVDKKVDGKKSKIPAKLDFYQSATGLILAIFVKFHLIFVSSILISKDFMHSVDKFLSGSAIIEGGHPAFVVGSAFILFIILVIHALMAVRKFPNSYRQYRNFTSHTQMFPHGDTKLWGIQIVTGFILFFFVSMHLYQMMSEPSNIGPYLSSDRIWSDSAWVMYIILLIAVELHATIGLYRLVVKWGWFANKSYKATREKLNS

SEQ ID NO: 15841 - DNA, 336 bp, Unknown
  Obtained from environmental sample
  misc_feature (1)..(336): n is a, c, g, or t
atgaaaatggtggtgatattattttcaaaacaagagatattaaatatggaccacaggagatgcaaaatgaaaataaatagtcttatcctagtagtgtttgttgtaacttttactggatgtattaacctaactaaagaggtaccagcatactcaacatatactcttaatgtagataatagtaaacaaatncataaacacagtacaaatattaaacttgagataaaagaaccccaagcacttcatagtatcaattctaaatatatatcatactctacaaaaaactatactagtgaaaattatgcattaagtaaatggagtgacaacccatcaaaatga

SEQ ID NO: 15842 - protein, 111 aa, Unknown
  Obtained from environmental sample
  misc_feature (1)..(111): Xaa is any amino acid
MKMVVILFSKQEILNMDHRRCKMKINSLILVVFVVTFTGCINLTKEVPAYSTYTLNVDNSKQXHKHSTNIKLEIKEPQALHSINSKYISYSTKNYTSENYALSKWSDNPSK

SEQ ID NO: 15843 - DNA, 954 bp, Unknown
  Obtained from environmental sample
  misc_feature (1)..(954): n is a, c, g, or t
ttggnangcacaatgatcagatcggctcgagaaactgcacaaaaaatgcaagatgatagtttagtatatgaagcagatattgatagagctaacaaaacattaaaactatcacaaaaaattgaagtagtatcaaatgatgataaacgactctctggtgaggctaaagaggagcaaaatgattgggaaaaagaaaatggtgtagaggggaaacttataaaccctgaaaactttttaccaatagatgaagcaaaagagatagaccctgacctagagataggagactttttaaattatgatttagaatttgaatctatggggagaaatgccgcaactattttatttagtaacttagaatataaacttcaaagatttatagaagataatttatacaataaatacaatgaccaagttggagatacaatcacaagtgttgtaacaagagttgatcaaaatgacaacacttttatagaaataggtgaagtaaaaggtattcttccacgaaaaaatagaattaaaggggagtcatttaaagttggagattctttaaaagctgttgtaaaaagcgtaaatattgataaacaacatggtcttgtggtagaagtttcaagaactagccctaaatttctagaaagtttactgactttagaagtaccagaacttcacgataaaaaaataacaatagaaaatacagcaagaatccctggaagtcgagctaaaattgcactatctacaaatgaagcaaatattgatcctattggtgcaattgttggggttaaaggtgtaagaattaatgctgttagtcaacaattaaatggtgaaaatatagatggtattgaatatactccaatcaaagagatgtttgtaagccgagcactaagtccagctattgttaaaaatgtaaaaatagaagttggtgctggtgaaaaaagggaagataaagctattgtaaccatt

SEQ ID NO: 15844 - protein, 318 aa, Unknown
  Obtained from environmental sample
  misc_feature (1)..(318): Xaa is any amino acid
MXXTMIRSARETAQKMQDDSLVYEADIDRANKTLKLSQKIEVVSNDDKRLSGEAKEEQNDWEKENGVEGKLINPENFLPIDEAKEIDPDLEIGDFLNYDLEFESMGRNAATILFSNLEYKLQRFIEDNLYNKYNDQVGDTITSVVTRVDQNDNTFIEIGEVKGILPRKNRIKGESFKVGDSLKAVVKSVNIDKQHGLVVEVSRTSPKFLESLLTLEVPELHDKKITIENTARIPGSRAKIALSTNEANIDPIGAIVGVKGVRINAVSQQLNGENIDGIEYTPIKEMFVSRALSPAIVKNVKIEVGAGEKREDKAIVTI

SEQ ID NO: 15845 - DNA, 639 bp, Unknown
  Obtained from environmental sample
  misc_feature (1)..(639): n is a, c, g, or t
atgaaagtaaacaataaaatatatcattttatttttaacaaaatgagaactcttcgagtagtacttagtgataaaaagattgtaaaaactctagcttatgataaaaatggtttcatagttcaagatagtaatccctctttaaaagttgacttctcttatgctggtgggcttatagaaacaaatagcaaattacttttttttgtagagggtgtatatgacacaaaaaatggtttctgggtaacaagaataaaaaatgatgatgttatagataatcttaagctactttcaaaacttcctaaaaatgaagtatatctttgctctgatacacttgacacttattatcatagctatctttgtacaaacggcagttgcggtggtttttatgctattgactatatgaattattttaatggaagaggtaccatgtctgataactcaaaatattttcatccaaaaaggtgtgaactcattcatctagaaaattctatatatgaccaaaataaatttagcacatgtgtagagaataaaattcaatcaaagaggataaaaatgtttgatgcccttagtcataattgtcatcatgaagtggaagagattataaatagttgtaaaaaaatatcaaaaagagaggaaatttaa

SEQ ID NO: 15846 - protein, 212 aa, Unknown
  Obtained from environmental sample
  misc_feature (1)..(212): Xaa is any amino acid
MKVNNKIYHFIFNKMRTLRVVLSDKKIVKTLAYDKNGFIVQDSNPSLKVDFSYAGGLIETNSKLLFFVEGVYDTKNGFWVTRIKNDDVIDNLKLLSKLPKNEVYLCSDTLDTYYHSYLCTNGSCGGFYAIDYMNYFNGRGTMSDNSKYFHPKRCELIHLENSIYDQNKFSTCVENKIQSKRIKMFDALSHNCHHEVEEIINSCKKISKREEI

SEQ ID NO: 15847 - DNA, 960 bp, Unknown
  Obtained from environmental sample
  misc_feature (1)..(960): n is a, c, g, or t
ttgtattctaaaagcaaacaagatgtaattgttattaacgattcagacacattagaaaacaatatgttgactattaccaaatctcaatntgaatcatcaacatgggagttaggaaagatggaaaaagttgaatttaataccatggtaaaagcaaatggtatgtntgatgttcctccgcaaaataaagctaccgttagtgcttattttgctggttatgtaaaaagcataacacttttacctggtgatgttgtaaaaaaaggacaggtattatttacactagaaaatcctgaatatgttcaaattcaacaagactttttagaagccaaatcaaaattaaactatttaaaggctgattatgaaagacaaaaagcattattggctgacaatgtgacctcaaaaaagaattttcttaaagcagaatcggaatacaaggtaacacaagcgcagtatcaatcgttgcaaaaaagattaagcctcatgaatataaaccctaatacactatctggagaatcaatcacctcaatcattagtgttttatctccaatttcaggaaacatcacctctattgaagcttctaaaggtatgtttttaaatccttctgatattgctttaaccgttacaaatggcgatcatttacatttagaattaaaaatatttgaaaaagacctgccattagtgaaagaaggacaacctataaaaattcatcttcaaggagacagtaatacaacttacgatggcgaagttcatttaatcaacagatctattaacgcacaagatagaaccattgatattcatggtgatttagttaatgaagacgatgcgaaactttttgctcctggcatgtacatagaaacagatattttaacttcaagcaatcagtttgatgcattgccaaccgaagcgtgttgtaaatatttgaaaatgctcacttgcctgagcgatcaaacgnnnannaaataa

SEQ ID NO: 15848 - protein, 319 aa, Unknown
  Obtained from environmental sample
  misc_feature (1)..(319): Xaa is any amino acid
MYSKSKQDVIVINDSDTLENNMLTITKSQXESSTWELGKMEKVEFNTMVKANGMXDVPPQNKATVSAYFAGYVKSITLLPGDVVKKGQVLFTLENPEYVQIQQDFLEAKSKLNYLKADYERQKALLADNVTSKKNFLKAESEYKVTQAQYQSLQKRLSLMNINPNTLSGESITSIISVLSPISGNITSIEASKGMFLNPSDIALTVTNGDHLHLELKIFEKDLPLVKEGQPIKIHLQGDSNTTYDGEVHLINRSINAQDRTIDIHGDLVNEDDAKLFAPGMYIETDILTSSNQFDALPTEACCKYLKMLTCLSDQTXXK

SEQ ID NO: 15849 - DNA, 684 bp, Unknown
  Obtained from environmental sample
  misc_feature (1)..(684): n is a, c, g, or t
atgagtggtggtaaaaatagaaaaaatctgaaactattttattggacaaacactcatactaatttcctgttccaaaaaaaagacttttttaaaaaaataaaacttgcatctgatgttaaatttaaagacttaaaacaacggtacaaatacgctaaagaccgcatagccatagagcgatatgctcatataaaacnccttatgagtcagtaccctactcttgcttctcaaataggatttaaacaaatcagcatttctacatataattcaagtgatgaatttagacttttaagagaacttgatgatgagtacaataatttaaaatctacaatcagcttctacatacttagcgacggaaactcaagactatacacaaaagggataagagatgctatacaacatgaaggattaaataccttacgaaagacaaaagacaataacactcttaaacttctcatcagctcaaaaactactgactcacaaaagtacagtttcatggtaagcagtaacttagtgaaattcactctatttgatgccaataagaatcagatactttttagacaacatacttttataggtaaatctagaaagagtcatcaagatgcgaagcttcaaaccgcacttaatcaaaaagcaaaaataaggcaactaggcatatttgactttattggtcttcaaagtaagtag

SEQ ID NO: 15850 - protein, 227 aa, Unknown
  Obtained from environmental sample
  misc_feature (1)..(227): Xaa is any amino acid
MSGGKNRKNLKLFYWTNTHTNFLFQKKDFFKKIKLASDVKFKDLKQRYKYAKDRIAIERYAHIKXLMSQYPTLASQIGFKQISISTYNSSDEFRLLRELDDEYNNLKSTISFYILSDGNSRLYTKGIRDAIQHEGLNTLRKTKDNNTLKLLISSKTTDSQKYSFMVSSNLVKFTLFDANKNQILFRQHTFIGKSRKSHQDAKLQTALNQKAKIRQLGIFDFIGLQSK

SEQ ID NO: 15851 - DNA, 822 bp, Unknown
  Obtained from environmental sample
  misc_feature (1)..(822): n is a, c, g, or t
ttgtttacccaagattttaaaggcttaatcattcatccaaattttaagggaattgaacttattgaagaggacgaagcttctgtgatatttaaaatgggttcagccgaaatttgggaggatatggttgaatacaccgtgaacaaaggttggtccggaatagaaaatttggccgcaattccgggtaatgttggtgctgccccagttcaaaatattggagcttatggggttgagcttaaagacgttttcttatctttaactgcggtaaatttactagatggatcaatcaaaatatttgagaaggacgattgtgaatttgaatacagaaatagtgtttttaagtcaaagttcaaaaataaatatttaataatatctgtaagtatttgcttaaaaaagaatgcaaaacctcaaataagttacgaggctttaagctcttttttgaaggaagaaaatttaattcctacactcaaaaacatatatcaatctatcgttcagattagagattctaaattaccagacccagaaatacttggcaatgcaggtagcttttttaagaatcctgtgattactgtcgaaaaatttgaagagttgaaattactatttcctaatataaaatcctatcctcaggccgaaggtaatcagaagatagctgctggctggttggttgaaagttgtggttggaaaggtaagaagtgtcaggngattggggttcatgaaaaacaagctctggttcttgtaaattatggagtgggtgaaggatctcangttgcccgacttgcagaattaatattaaaaagtgtgaagaagatttggaatattactgga

SEQ ID NO: 15852 - protein, 274 aa, Unknown
  Obtained from environmental sample
  DOMAIN (155)...(274): UDP-N-acetylenolpyruvoylglucosamine reductase, C-terminal domain
  misc_feature (1)..(274): Xaa is any amino acid
MFTQDFKGLIIHPNFKGIELIEEDEASVIFKMGSAEIWEDMVEYTVNKGWSGIENLAAIPGNVGAAPVQNIGAYGVELKDVFLSLTAVNLLDGSIKIFEKDDCEFEYRNSVFKSKFKNKYLIISVSICLKKNAKPQISYEALSSFLKEENLIPTLKNIYQSIVQIRDSKLPDPEILGNAGSFFKNPVITVEKFEELKLLFPNIKSYPQAEGNQKIAAGWLVESCGWKGKKCQXIGVHEKQALVLVNYGVGEGSXVARLAELILKSVKKIWNITG

SEQ ID NO: 15853 - DNA, 576 bp, Unknown
  Obtained from environmental sample
  misc_feature (1)..(576): n is a, c, g, or t
atgtttatctacgataaagaacaagatgcttatatatgccctaataataaattaatatcaagaacttcctctttaaatcaatcatatgcacgtactatgcatatgtatagaagctcacaaacagattgtttatcttgtccaataaaaagtaaatgcttaggtgaaaaaacaaaacagaaacagacacaaagatgggagcatcaagagttacttgatgaatacaatcataagatgcagacagatgaatccaaagcaattattaaaaaacgaggttcaatagttgaacatccatttggaacaatcaagagaagtttaggttgggatcactttttagttagaggtaaaaagaaagtagctggtgaaaatgctcttatcatgtttacctataattttaaacgcttgctaaatctcatagggatagctctgtttaaaaaactgatgatagctgtaaaagatgctgatctgagtaagataagagaagaaatagctctttatattgctagttttaggctttatatagaaatattatttcaaaatagttttatggtacaatctaagcgcaataattgcctctaa

SEQ ID NO: 15854 - protein, 191 aa, Unknown
  Obtained from environmental sample
  misc_feature (1)..(191): Xaa is any amino acid
MFIYDKEQDAYICPNNKLISRTSSLNQSYARTMHMYRSSQTDCLSCPIKSKCLGEKTKQKQTQRWEHQELLDEYNHKMQTDESKAIIKKRGSIVEHPFGTIKRSLGWDHFLVRGKKKVAGENALIMFTYNFKRLLNLIGIALFKKLMIAVKDADLSKIREEIALYIASFRLYIEILFQNSFMVQSKRNNCL

SEQ ID NO: 15855 - DNA, 507 bp, Unknown
  Obtained from environmental sample
  misc_feature (1)..(507): n is a, c, g, or t
atgaaaaaattaaaacttatattaggaagtgtactaagcattgttgcttttacatttattatggactcttgtggggacccacaaagaagtatgtctggaaattatgaatacgaaacagagtgcatgggagttgaaatggatggttctcaaacagtaaaagcttggggcatgggtagaaacagagaagatgctgttgaacaagcgaagaaaaacggtgttagagatgtactatttaaaggcattactaatggcagacaagactgtaaccctaaacctgtaatttttgaagtaaatgctcaagaaaagtatgaagactattttaatgccttctttgctgaccaaggagcatacttagaatttattacaggagaagacggttctgatatgcatttttctgtagttcagggtagaaaaaaatatgcagaccaagtaacttacggtgttatcattagagttcaaagagctaagttaaaagatagaatgatagcagataaaataattaaataa

SEQ ID NO: 15856 - protein, 168 aa, Unknown
  Obtained from environmental sample
  SIGNAL (1)...(18)
  misc_feature (1)..(168): Xaa is any amino acid
MKKLKLILGSVLSIVAFTFIMDSCGDPQRSMSGNYEYETECMGVEMDGSQTVKAWGMGRNREDAVEQAKKNGVRDVLFKGITNGRQDCNPKPVIFEVNAQEKYEDYFNAFFADQGAYLEFITGEDGSDMHFSVVQGRKKYADQVTYGVIIRVQRAKLKDRMIADKIIK

SEQ ID NO: 15857 - DNA, 567 bp, Unknown
  Obtained from environmental sample
  misc_feature (1)..(567): n is a, c, g, or t
atgcaatggaatgactctatagaagctactttttatatggatatgtggatggactccacctctatagattcagctaaaaagataatatttgataattccgatttatttcaattaaaactattaggatacgaaaaaacaagagctttaatatcaggcttgggttcaaatgccgaaagtgaagaaatgattattgaaaacgccaccttaaaatctatcaactctgtttataataaactccaaagaaaatttgaaccttttagaacaaaaacgccattagttagcattgatccattgggagctaaaattggtttaaaagaaggtttagaaggaggagataaatatgaagttttagaacaagtatttgatgcagaggggagagttacttacaaaagaaaaggagttataaaagtggataaaaaaaatatttggaataataaatataatataggcgaagaaccattagatgaagaaggaaacccaatagaaattgaaaatgatattgaatttacttactttaaaggaggtaagggattttatcctggaatgttaataagacaaatcaattaa

SEQ ID NO: 15858 - protein, 188 aa, Unknown
  Obtained from environmental sample
  misc_feature (1)..(188): Xaa is any amino acid
MQWNDSIEATFYMDMWMDSTSIDSAKKIIFDNSDLFQLKLLGYEKTRALISGLGSNAESEEMIIENATLKSINSVYNKLQRKFEPFRTKTPLVSIDPLGAKIGLKEGLEGGDKYEVLEQVFDAEGRVTYKRKGVIKVDKKNIWNNKYNIGEEPLDEEGNPIEIENDIEFTYFKGGKGFYPGMLIRQIN

SEQ ID NO: 15859 - DNA, 549 bp, Unknown
  Obtained from environmental sample
  misc_feature (1)..(549): n is a, c, g, or t
gtgaatatgaatagatcgtctatcataaatattttcagagggtggcgtttgtcaccctctgtttttgttcttgctattcttgtgctttttctcggttgcagcagcacacaaattaatagacagacggctccggtgggtttttatgagctgtgtttttacttttcgaagttaccggaaaacacagatgataaagatcttcttgaagtagcagagatctacagagaaacaattgaaaattcaggacacagtgtcttgaaaaagaatgtttctcanagttctgcctgttattttactgatagtcttccaaaatttgatccagttacaattaaggcaaaaagcaatatcgcccagtatcttctaaatgctttctttaataaagacaacgcctcgctttatgctgtaactgagaacagaaagtctgcagtaaagaagttcgataagatcagtgcagatcataagctcccgatctacatgaagatcaaaaatggactttatcttactggtcaagacagtaaaatgctctatgctgcaagataccttgagatgctg

SEQ ID NO: 15860 - protein, 183 aa, Unknown
  Obtained from environmental sample
  misc_feature (1)..(183): Xaa is any amino acid
MNMNRSSIINIFRGWRLSPSVFVLAILVLFLGCSSTQINRQTAPVGFYELCFYFSKLPENTDDKDLLEVAEIYRETIENSGHSVLKKNVSXSSACYFTDSLPKFDPVTIKAKSNIAQYLLNAFFNKDNASLYAVTENRKSAVKKFDKISADHKLPIYMKIKNGLYLTGQDSKMLYAARYLEML

SEQ ID NO: 15861 - DNA, 924 bp, Unknown
  Obtained from environmental sample
  misc_feature (1)..(924): n is a, c, g, or t
ttgcgattatggctcggagacattatttactaccggaccagaaatttgggaacaacagaaggaaaaattactcattttgtggtaggagtaggtacaggaggaacagtttcgggagtagggaagtttttaaaagagaaaaaccctaacattaaaatttggggaatagatacttacggttctgtgtttaagaaataccacgaaacaggaatttttgatgagaatgagatttatccatacatcaccgaaggaattggtgaagatattttacctaaaaacgtggattttagcgtaattgataagtttgaaaaagtaaccgataaagatgcagcagtttatcaaagaaaattagccaaagaagaaggaatttttgttggaaactcagcaggaagtgctataaaaggcgtgttgcaactaaaagatgaattgaaaaaagatgatgtagtggtgattttattccacgaccatggtagccgttatgttggtaaaatgtttaatgatgattggatgagagacagaggctttttggatgaagaaaaaaccaatgccttagatttaattgcagaccataaaggtaaacatttagttactgtaactaccgatactccagcttctcaggcaattattttgatgaatcaatatgccatttctcaagttccagttgttgaagatggtaagtttgtgggttcattaacagataatcagttgttcgcaaaattattagacaatccggaactgaaacaattgcctgtaaaaaatattatggaaaacccatttccaatggtagatgagttaacagatattattactgttttcaaacattttcagcgaggagcaaaagctgttattgtgagttatgataaggataaacaccatattattactnncacagacatgataaaggctattgattcttgtagtaattag

SEQ ID NO: 15862 - protein, 307 aa, Unknown
  Obtained from environmental sample
  DOMAIN (2)...(155): Pyridoxal-phosphate dependent enzyme
  misc_feature (1)..(307): Xaa is any amino acid
MRLWLGDIIYYRTRNLGTTEGKITHFVVGVGTGGTVSGVGKFLKEKNPNIKIWGIDTYGSVFKKYHETGIFDENEIYPYITEGIGEDILPKNVDFSVIDKFEKVTDKDAAVYQRKLAKEEGIFVGNSAGSAIKGVLQLKDELKKDDVVVILFHDHGSRYVGKMFNDDWMRDRGFLDEEKTNALDLIADHKGKHLVTVTTDTPASQAIILMNQYAISQVPVVEDGKFVGSLTDNQLFAKLLDNPELKQLPVKNIMENPFPMVDELTDIITVFKHFQRGAKAVIVSYDKDKHHIITXTDMIKAIDSCSN

SEQ ID NO: 15863 - DNA, 825 bp, Unknown
  Obtained from environmental sample
  misc_feature (1)..(825): n is a, c, g, or t
ttgcaagttatgttagatagggatttggcaattttatatgaggtagagaatagagctttaaaacaagcagttagaagaaatttggataaatttcctcatgactttatgttcaaacttagtgatagtgagatagaaaatatggtgtcacaaaatgtgataccatctaaaagttatcttggaggtagtatcccttttgcttttacagaacaaggtgtatcaatgctctcatcagttctcaaaagtaaaacagctactgcaataagtataagtatatttagagcttttgtaaaaatgagaaaatttatattatccaaccatgacctttttcaaaaaatagaaacgattgaaaaaagacaaataggttatgagattaaaagtgatgagaaatttgagaaactatttgaagccatagaacaaaaagagataaaaacctcttatggtatattttacgatgggcagatgtttgatgcttatatctttatatctgatttgataagaggtgccaaatcaaagattgtacttatagataattatattgatgataatgtgctaacactttttagtaaaaatcaaaatatcgatgtaacgatttatactcattctgtatctaaacagttgaaattagacgtagaaaaatataattctcaatacaaaactataacaatcaaaagttttaaagattcccatgatagatttatgatagttgataatatggaaatttatcatataggagcaagcttaaaagatttaggcaaaaaatggtttgcattttctaagataggtatagagccattagatatattagataaatttacacgtgtatag

SEQ ID NO: 15864 - protein, 274 aa, Unknown
  Obtained from environmental sample
  misc_feature (1)..(274): Xaa is any amino acid
MQVMLDRDLAILYEVENRALKQAVRRNLDKFPHDFMFKLSDSEIENMVSQNVIPSKSYLGGSIPFAFTEQGVSMLSSVLKSKTATAISISIFRAFVKMRKFILSNHDLFQKIETIEKRQIGYEIKSDEKFEKLFEAIEQKEIKTSYGIFYDGQMFDAYIFISDLIRGAKSKIVLIDNYIDDNVLTLFSKNQNIDVTIYTHSVSKQLKLDVEKYNSQYKTITIKSFKDSHDRFMIVDNMEIYHIGASLKDLGKKWFAFSKIGIEPLDILDKFTRV

SEQ ID NO: 15865 - DNA, 633 bp, Unknown
  Obtained from environmental sample
  misc_feature (1)..(633): n is a, c, g, or t
atgtctataaatagtataagaaacctagtagaaattgcaaatgaaaaaacaccatcaaaaattgcacttatagataagtttggaaagcttacttatagtgaagtatatgaacaagtaaataagctagcacactatatcacaactttagagcttgaaaaaggtgctagaataggtatctattcaaataaaaacaaccaaaaagttatctctatcttggctgtgttatcaactgattatgtacttgttccaattacaaagttactcaaagcagagcaagtagaatatatcatcaaagattgtgatattagttgtatgataactgatgagcaaaaactcaaaactctcaaagagacatcatatagtggaaaaattatcacagtggaaagttgtgatgaggagatagtatcttttaaagagatttataaatgttatagtagtagttatgattgtagtatcaaagggcatgataatgctgctatcacatatagttttgcagggagtggtttcccaaaaggtgtagttatctctcataaaaacttaatagatagtgcaagagttgtttataattatcttgagataaaagaggatgatgtattaagtggattgttgtcatttagttttgactatgggtaa

SEQ ID NO: 15866 - protein, 210 aa, Unknown
  Obtained from environmental sample
  misc_feature (1)..(210): Xaa is any amino acid
MSINSIRNLVEIANEKTPSKIALIDKFGKLTYSEVYEQVNKLAHYITTLELEKGARIGIYSNKNNQKVISILAVLSTDYVLVPITKLLKAEQVEYIIKDCDISCMITDEQKLKTLKETSYSGKIITVESCDEEIVSFKEIYKCYSSSYDCSIKGHDNAAITYSFAGSGFPKGVVISHKNLIDSARVVYNYLEIKEDDVLSGLLSFSFDYG

SEQ ID NO: 15867 - DNA, 672 bp, Unknown
  Obtained from environmental sample
  misc_feature (1)..(672): n is a, c, g, or t
ttgtctttactattcagaaaagcggactacttttctactccatcaaatcctttctttgaagagaagaaagtaaattctggcaagcagattggagcaattaaattagactacaataaatctcttgccatttttgaagttgagtggaatgataaaaatttaagacctacatggttctggtgggagccagaaggaaacaatctatcaactcaatggcgtacaacaccacttatgtatgattggaacaaagatgatttaatggatttgataatgctagaccatgaaggatatttagcattttttgaacgcattaagaaagatggagaacttaagctattagagggcaaacgtattttttacaatgaaaaaaatgaaccattgcagcttaatataaaagaagctggcggaagtggtagaagaaaacttactattgtagattgggatttagatggcaaattagatcttttgataaatagtaaaaatgttagtttttttaagaatattagttctgaagttgataaggttgtattcaaagatatgggaatggtttgtgaacaaattctggcaggtcatacaacaagtccaacaattgtggattggaatcagaacggaattcctgatctattgataggcgctgaagatggctatttttattatctaaaaaatccgaattaa

SEQ ID NO: 15868 - protein, 223 aa, Unknown
  Obtained from environmental sample
  DOMAIN (190)...(219): FG-GAP repeat
  misc_feature (1)..(223): Xaa is any amino acid
MSLLFRKADYFSTPSNPFFEEKKVNSGKQIGAIKLDYNKSLAIFEVEWNDKNLRPTWFWWEPEGNNLSTQWRTTPLMYDWNKDDLMDLIMLDHEGYLAFFERIKKDGELKLLEGKRIFYNEKNEPLQLNIKEAGGSGRRKLTIVDWDLDGKLDLLINSKNVSFFKNISSEVDKVVFKDMGMVCEQILAGHTTSPTIVDWNQNGIPDLLIGAEDGYFYYLKNPN

SEQ ID NO: 15869 - DNA, 315 bp, Unknown
  Obtained from environmental sample
  misc_feature (1)..(315): n is a, c, g, or t
atgaaaaaaatgaaccctggcagcttatataaaagaagcctgccggaagtggtagaagaaaactttcctattgtagattgggatttagatggcaaattagatcttntgataaatagtaaaaatgttagtttttttaagaatattagttctgaagttgataaggttgtattcaaagatatgggaatggtttgtgaacaaattctggcaggtcatacaacaagtccaacaattgtggatttgaatcagaacggaattcctgatctattgataggcgctgaagatggctatttttattatctaaaaaatccgaattaa

SEQ ID NO: 15870 - protein, 104 aa, Unknown
  Obtained from environmental sample
  DOMAIN (71)...(100): FG-GAP repeat
  misc_feature (1)..(104): Xaa is any amino acid
MKKMNPGSLYKRSLPEVVEENFPIVDWDLDGKLDLXINSKNVSFFKNISSEVDKVVFKDMGMVCEQILAGHTTSPTIVDLNQNGIPDLLIGAEDGYFYYLKNPN

SEQ ID NO: 15871 - DNA, 558 bp, Unknown
  Obtained from environmental sample
  misc_feature (1)..(558): n is a, c, g, or t
ttgtttaaaaatgttttagtagccaaagatggagtagaagggttagccttatataacaataataaaatagatttaatcataactgatattaaaatgccaaatatggatggtattgagctagttaaagctataagaaaagaagatacagaaattaaaatcataattatatcagcgcacactgatgtagattttttactacaaagtatccctttgaaccttatagagtatgttgtaaaaccacttaatgaaacaaaaatatctaatatcttacaaaaatttttagaaggtaaagataataaagactttcaatatagtaaagataaatgtgaagtgattacaaatggtacaactcatattttaagtataaaagagaatgtttttttagataaacttataaatgaaaatcgtatcatttcatatgatgaaatagaggaagatatctgggaagataagcaaatgagtcaaaatgcattacgggtatttatcaaaaacttaagaaaaaaacttccagagaattttataaaaaatattccgaattttggttactcaaaaatatag

SEQ ID NO: 15872 - protein, 185 aa, Unknown
  Obtained from environmental sample
  DOMAIN (115)...(184): Transcriptional regulatory protein, C terminal
  misc_feature (1)..(185): Xaa is any amino acid
MFKNVLVAKDGVEGLALYNNNKIDLIITDIKMPNMDGIELVKAIRKEDTEIKIIIISAHTDVDFLLQSIPLNLIEYVVKPLNETKISNILQKFLEGKDNKDFQYSKDKCEVITNGTTHILSIKENVFLDKLINENRIISYDEIEEDIWEDKQMSQNALRVFIKNLRKKLPENFIKNIPNFGYSKI

SEQ ID NO: 15873 - DNA, 642 bp, Unknown
  Obtained from environmental sample
  misc_feature (1)..(642): n is a, c, g, or t
atgatttttttctttatttttgttatcttatttacatttagtgttgctggtgtttttgagtattcatatttaaatagatatggttttattattgcatctgccatagagataattatcttttcactgatgcttacaaacagatataacgtgatgaataaagatatacaaatatacttggaaaatgaggttaaaaatagaacagagagtttaacaactgtaaacaaagagttaaaaactttaattacagatagagaacttctcttaaaagagctttatcatagagtaaaaaataattttcatcttgttattggtcttctttggattgagtcagataccataaaagatcagaaaataaagaacacttttttaaatatcattacaagaataaaatcaatttcaacgatacatcagtacctctatgagagtaaaatattatctacgatcgatactgaaaactatatcaataaaattattgaagagacaaaaatagcatatagcagcaaatcagttatttttagtggaaatattcaacacattgagatagatatggattctgccatgtcactcggttttattataaatgaacttttaactaattcaattaaacacaatgaaaaaaatgaacacttattatatatttga

SEQ ID NO: 15874 - protein, 213 aa, Unknown
  Obtained from environmental sample
  SIGNAL (1)...(16)
  DOMAIN (90)...(171): Histidine kinase
  misc_feature (1)..(213): Xaa is any amino acid
MIFFFIFVILFTFSVAGVFEYSYLNRYGFIIASAIEIIIFSLMLTNRYNVMNKDIQIYLENEVKNRTESLTTVNKELKTLITDRELLLKELYHRVKNNFHLVIGLLWIESDTIKDQKIKNTFLNIITRIKSISTIHQYLYESKILSTIDTENYINKIIEETKIAYSSKSVIFSGNIQHIEIDMDSAMSLGFIINELLTNSIKHNEKNEHLLYI

SEQ ID NO: 15875 - DNA, 699 bp, Unknown
  Obtained from environmental sample
  misc_feature (1)..(699): n is a, c, g, or t
atgaataagaaaacatttaatttattgatagtagaagatgaaataataagttctcattatttatcaagattacttatctctatcggctatataaatatttatgaagcagatggttcagattcagcacttcaaattattaaaaatgtaaagattgatttagtctttatggatataaatattaatggttctaaagacgggattcaaaccgcaatcatgctaaatgataattattttatacccatcatatatactacagcttataaagactctattaccattgaagaagcaagcggtacaaatatttttggttatttgataaaaccttttgaaaaaagtgatattgaagcatctttgggagtggctttttcaagactaatacatattcaacagacccagccaattccaagcagtaactcctctagagatttaatcgatttagganatagttatatatacgactttgagagtaaaacactttatataaaaaaaagagtcataaatcttacaaaaaaagagcttatgtttttagatatattgtgcacaaatattaatcaaaatatatcctatggagttatcaaagagtttatctggaatactaaagatatctcctactcaaccatacgtgacgtactttatagacttaagaaaaaagtagaaaaattaatattcaaagggtatccggatttggctatatcttaa

SEQ ID NO: 15876 - protein, 232 aa, Unknown
  Obtained from environmental sample
  DOMAIN (162)...(231): Transcriptional regulatory protein, C terminal
  misc_feature (1)..(232): Xaa is any amino acid
MNKKTFNLLIVEDEIISSHYLSRLLISIGYINIYEADGSDSALQIIKNVKIDLVFMDININGSKDGIQTAIMLNDNYFIPIIYTTAYKDSITIEEASGTNIFGYLIKPFEKSDIEASLGVAFSRLIHIQQTQPIPSSNSSRDLIDLGXSYIYDFESKTLYIKKRVINLTKKELMFLDILCTNINQNISYGVIKEFIWNTKDISYSTIRDVLYRLKKKVEKLIFKGYPDLAIS

SEQ ID NO: 15877 - DNA, 441 bp, Unknown
  Obtained from environmental sample
  misc_feature (1)..(441): n is a, c, g, or t
gtggaagatattcagtatcttgactttattagacccaaactatggattgatgaatcaaattcatttaatccaacagaatatattgaccaacacaatcatataggattaagtacttcaaatgatataaaaattgatattcttgccgatccaaattcaacagaaggttttatggataatacaaaagcgatatttccttttgatatttatgttgagtcaattgaaaatatcttagcaaagaaaatcacttttagaaaaaaagataataaagcaagagatatatttgatatagcaacagcaatatcaaaagataactttatcataaaaaatatgatagagacgcataaagttacactagatgatattttgatactgcaagattctcttaaaaatttaaatctaaagaagtatgctattgagattgaaatggttgaacccatttaa

SEQ ID NO: 15878 - protein, 146 aa, Unknown
  Obtained from environmental sample
  misc_feature (1)..(146): Xaa is any amino acid
MEDIQYLDFIRPKLWIDESNSFNPTEYIDQHNHIGLSTSNDIKIDILADPNSTEGFMDNTKAIFPFDIYVESIENILAKKITFRKKDNKARDIFDIATAISKDNFIIKNMIETHKVTLDDILILQDSLKNLNLKKYAIEIEMVEPI

SEQ ID NO: 15879 - DNA, 864 bp, Unknown
  Obtained from environmental sample
  misc_feature (1)..(864): n is a, c, g, or t
gtgaaatcaatttttggattttttattatgattacatcactattcggctcaacagaaataaaagttgcatcatacaatgtagaaaatctatttgatctaaaattaaatgggggtgagtatgccgagtacacaccaaacacctcatggcagtggaacaaagataactacagaaaaaagttaaaaaatatatcaaaagtgatatctgatatgaatccagatatcatagcccttcaagaagtggagtctgcaactgctctaaaagatctaaaagatgaactaggacgtgcaggatgttattttaaatatagtgcaatagctgcaaaaaacactactgtcaaagttgcaattcttagtaaataccagatctcttactctaaagatatcagtgtaacgtctagcagaagaaatagatctattttagagacaaaaatagatattaataatcatccgctatatgtttttacaaatcactggaaagcaaaatcagggccggagagcagacgaatagtatcagcaaaggctcttaaaaaaaggttaaatgagattgggcatgaaaatgagataatcctactcggtgatttcaactcacactatgaagagaacattacctttataagaagtagaaaacataacgatacagatggaataacaggcataaatgatattcttaagacatctccaaaatatcaaaacgaatcagatagctactacaatttatggtatgacctagcccaagataatagatggactcataaattcagaggtaaaaaagaggcgattgatagcataattatctcaaaaggggttaatggatggaaaaaatatagagtacgtaaagggcagttttataaattgctccactga

SEQ ID NO: 15880 - protein, 287 aa, Unknown
  Obtained from environmental sample
  DOMAIN (20)...(282): Endonuclease/Exonuclease/phosphatase family
  misc_feature (1)..(287): Xaa is any amino acid
MKSIFGFFIMITSLFGSTEIKVASYNVENLFDLKLNGGEYAEYTPNTSWQWNKDNYRKKLKNISKVISDMNPDIIALQEVESATALKDLKDELGRAGCYFKYSAIAAKNTTVKVAILSKYQISYSKDISVTSSRRNRSILETKIDINNHPLYVFTNHWKAKSGPESRRIVSAKALKKRLNEIGHENEIILLGDFNSHYEENITFIRSRKHNDTDGITGINDILKTSPKYQNESDSYYNLWYDLAQDNRWTHKFRGKKEAIDSIIISKGVNGWKKYRVRKGQFYKLLH

SEQ ID NO: 15881 - DNA, 378 bp, Unknown
  Obtained from environmental sample
  misc_feature (1)..(378): n is a, c, g, or t
ttggggggtggttcacttttaatcgcaaaaggatactcttttcttactccaaggaaaaaagtattgttttttatattaaaaagagccaatcaaataaaaaaattaaaaataaaaggtggtaatcgatatggtgggggtttgattagtgatacttttttagagcgtcagggactgttttttgataacgaacttttaataaaagagtcagattcaagtagacgtttagggttatcagtatcagataaacttgttagcgttaatttgaaaaatgtaagctcatatagcgatatcagagaagttcttagtggagcaaaggaagaagttaaacttctgtttgaacgagatggttttatgttttttattattttaaaaatataa

SEQ ID NO: 15882 - protein, 125 aa, Unknown
  Obtained from environmental sample
  misc_feature (1)..(125): Xaa is any amino acid
MGGGSLLIAKGYSFLTPRKKVLFFILKRANQIKKLKIKGGNRYGGGLISDTFLERQGLFFDNELLIKESDSSRRLGLSVSDKLVSVNLKNVSSYSDIREVLSGAKEEVKLLFERDGFMFFIILKI

SEQ ID NO: 15883 - DNA, 534 bp, Unknown
  Obtained from environmental sample
  misc_feature (1)..(534): n is a, c, g, or t
atgaataaaacaacagtaaactttatatttattatatatgtgacaatattgtctatttttataacaggttgtgatgaaaaatttaaagtagttgaaaaaaaaactaaaatagatgaccacttttatccaataaaagattacaaactaatagaaactaataaaattaatagtgtttacgttccagtttattcacatatatatacatctgaagataaatatgaagcaatgggaattactttaagtattagaaatacagatttcaactttaatcttatattaaaagatatatcttattacgatacaaagggtaatttagttgaaacatatttagataaaccccatatattaaagccaatgtcttccatagatattactgtagaacttatagatatgagaggaggttctggtgctaattttatagtaaaatattcaaatcaagatgagatttcagaaccaataattcaagctgtcatgttgaatagctcttctactaagtattttgcatttgtaactaatggacaactattgaaataa

SEQ ID NO: 15884 - protein, 177 aa, Unknown
  Obtained from environmental sample
  misc_feature (1)..(177): Xaa is any amino acid
MNKTTVNFIFIIYVTILSIFITGCDEKFKVVEKKTKIDDHFYPIKDYKLIETNKINSVYVPVYSHIYTSEDKYEAMGITLSIRNTDFNFNLILKDISYYDTKGNLVETYLDKPHILKPMSSIDITVELIDMRGGSGANFIVKYSNQDEISEPIIQAVMLNSSSTKYFAFVTNGQLLK

SEQ ID NO: 15885 - DNA, 933 bp, Unknown
  Obtained from environmental sample
  misc_feature (1)..(933): n is a, c, g, or t
ttggagggacttggtatagaagaaggaggtacttttcaagtaaaatatccatcctctagaggttataatgccaaatattttaatgttgcttctaatagaaaaaggtattttggtggaaattttcctgaccctaaagagataataactgatgacactaatattagaagtataaataatgtattatcttttataaaagaaccaaactataacttagaagaaattattcaagatcctaattatgattttaaaatgaaatcaaaagatataatggatcatcattatattatggaaattgcagatttcgaatggaaaaaagcacaaagacaaaagcaagacaaaggatatatgggaagaatgtcatttcctgaaaactttgaaaagccatcaagaacagtaatggcaactatgtcttgctcgtcaagagaatccatgatttatccttataaacaaaaagaagataggtacagactaccaacagtcagagagattgcttgtcttatgagttaccctttggattatagattttacgggaagagtaaaagtattaaatacaaacttgttggaaactctgtacctccaaaaatgtcttttgcaattgctaatgcaatatcaattgcaaataatttaaaaacacttaataaatatcaaccaattgagtttgacgatagccaggaagattttaaaaatttaaatggagatatttttcatattaatatagaaaaagaaaaaagacccatagcgaaatttaaatatcacattccgtatttaattataaatgcttttagagttgagttaactaataaatattctgattttgagaatttacagttcaaatggaatgttgagattcacaaaagtcaaggacaaaatgcaaaaacatatattccaaaaactgacttgaaaactattaaagaagagcacaaaactatgtaa

SEQ ID NO: 15886 - protein, 310 aa, Unknown
  Obtained from environmental sample
  misc_feature (1)..(310): Xaa is any amino acid
MEGLGIEEGGTFQVKYPSSRGYNAKYFNVASNRKRYFGGNFPDPKEIITDDTNIRSINNVLSFIKEPNYNLEEIIQDPNYDFKMKSKDIMDHHYIMEIADFEWKKAQRQKQDKGYMGRMSFPENFEKPSRTVMATMSCSSRESMIYPYKQKEDRYRLPTVREIACLMSYPLDYRFYGKSKSIKYKLVGNSVPPKMSFAIANAISIANNLKTLNKYQPIEFDDSQEDFKNLNGDIFHINIEKEKRPIAKFKYHIPYLIINAFRVELTNKYSDFENLQFKWNVEIHKSQGQNAKTYIPKTDLKTIKEEHKTM

SEQ ID NO: 15887 - DNA, 873 bp, Unknown
  Obtained from environmental sample
  misc_feature (1)..(873): n is a, c, g, or t
atggagaattataccgcaaaaatattagttgtaagatacagttccattggtgatattgtacttacaactcctataataaggtgtttaaaacagcagttggatggcaatgtagaaattcactatttaactaaaaaaagctatagctctttattagaaaataatccttacatcactaaagtacataccattgaaaaaaataatagtgaaatagttgaagttcttaaaaaagaacaatttgactatattattgatttgcataaaaaccttcgctctaaaggtatttccagaaaattgggtacactgcgttttactttcgataagttaaatgtaaaaaaatggttactgaccaattttaaaataaacacattgcccgatattcatattgttgataggtattttgaagcagtaaaacctttaggtgttgagaatgatggtaaaggcttagatttttttcttgctgaaaatgataaagtaactaatcttccagaaacacataacaatggatatgttaccattgctattggagctcaatttgcaaccaaatgtttacccacaaataaattggtggagttgtgtaatttaattcaacaacctataattttagctggaggaaaagaagatgaactaaaagccaatgagattataagtcattcttctaataaaaacatatacaatgcttgtggaaagtattctattaatcagtctgcatttattgtaaaaaatagccaaatactcattactcacgatactggtttgatgcatattggagcagccttgggagtaatattattccatttggggaatactgttcctgctttggggatgtacccttacctgccaaatgaaaaatatgtaatttatagaaaacaataa

SEQ ID NO: 15888 - protein, 290 aa, Unknown
  Obtained from environmental sample
  DOMAIN (67)...(285): Glycosyltransferase family 9 (heptosyltransferase)
  misc_feature (1)..(290): Xaa is any amino acid
MENYTAKILVVRYSSIGDIVLTTPIIRCLKQQLDGNVEIHYLTKKSYSSLLENNPYITKVHTIEKNNSEIVEVLKKEQFDYIIDLHKNLRSKGISRKLGTLRFTFDKLNVKKWLLTNFKINTLPDIHIVDRYFEAVKPLGVENDGKGLDFFLAENDKVTNLPETHNNGYVTIAIGAQFATKCLPTNKLVELCNLIQQPIILAGGKEDELKANEIISHSSNKNIYNACGKYSINQSAFIVKNSQILITHDTGLMHIGAALGVILFHLGNTVPALGMYPYLPNEKYVIYRKQ

SEQ ID NO: 15889 - DNA, 432 bp, Unknown
  Obtained from environmental sample
  misc_feature (1)..(432): n is a, c, g, or t
ttggtggagttgtgtaatttaattcaacaacctataattttagctggaggaaaagaagatgaactaaaagccaatgagattataagtcattcttctaataaaaacatatacaatgcttgtggaaagtattctattaatcagtctgcatttattgtaaaaaatagccaaatactcattactcacgatactggtttgatgcatattggagcagccttgggagtaaatattatttccatttggggaaatactgttcctgcttttgggatgtacccttacctgccaaatgaaaaatatgtaattatagaaaacaataaccttaactgccgaccatgttctaaaataggctatgatgcttgtccgaaaaaacactttaaatgcatgaatgacttaagcatgaaagaagtagtggatgagttaggtaataggcgttag

SEQ ID NO: 15890 - protein, 143 aa, Unknown
  Obtained from environmental sample
  misc_feature (1)..(143): Xaa is any amino acid
MVELCNLIQQPIILAGGKEDELKANEIISHSSNKNIYNACGKYSINQSAFIVKNSQILITHDTGLMHIGAALGVNIISIWGNTVPAFGMYPYLPNEKYVIIENNNLNCRPCSKIGYDACPKKHFKCMNDLSMKEVVDELGNRR

SEQ ID NO: 15891 - DNA, 360 bp, Unknown
  Obtained from environmental sample
  misc_feature (1)..(360): n is a, c, g, or t
atggcactcatcgatctactaggtatacacaagaactattctgcgcagaagatccttatcgacaccaacttcaaccttgacgaaggcgaacgcgtcgttatcgtcggtaagaacggctcgngaaaatcgaccctgatgaagatcgtcagcggagcccttgactttgatgatggtgagcgcataacgcgtcaaggacttgagatcaagatgctcgaccaggtccccaagttcaaagtcggcgcgacggtaagagaagcggtcgaagacggactggggccattaaaaaaggcgagtgtccgttttgatgagctctctatcgcgcttggcgaagactacgagaacgaggagcttctcaaaaag

SEQ ID NO: 15892 - protein, 120 aa, Unknown
  Obtained from environmental sample
  misc_feature (1)..(120): Xaa is any amino acid
MALIDLLGIHKNYSAQKILIDTNFNLDEGERVVIVGKNGSXKSTLMKIVSGALDFDDGERITRQGLEIKMLDQVPKFKVGATVREAVEDGLGPLKKASVRFDELSIALGEDYENEELLKK

SEQ ID NO: 15893 - DNA, 696 bp, Unknown
  Obtained from environmental sample
  misc_feature (1)..(696): n is a, c, g, or t
atgagcaaacaatacgaacatatttttttcgatttagacagaaccctttggcattttgatgaaaactctaaaaatgtactgaatgaaatctttgtaaaatttgagttagctcgttatatcaataatgttgatgagtttattaagtcctacgaaatcattaatgataatctttggcgacaatacagtaaaagtagaatagataaagaaaaacttcgctcagaaaggttttaccaaaccctacttaaatatggtgcagatgaaaatgatattgccatacaaataggcgattattacattaaccattctccacaacaaactgctttattgccacacactattgaaaccttagattatttaaaagacaaatatgtgttgcatattattactaacggttttgaggaggttcagctaataaaactcagtaaatctggtataatggattactttaatcagcttattttttctgagaaagtgggcgttaaaaagccacatcctttaatttttaaaagagccataaaaaatgccaatgcccatattagcaattccattatgataggggatgattattatgccgatatttatggagctacaagagcaggtatggacagtatttacttcaactttaacaatcgtccgcaccaacacaaggttaataatgaaataaattgtttaagcgagttgacagggttgctttaa

SEQ ID NO: 15894 - protein, 231 aa, Unknown
  Obtained from environmental sample
  DOMAIN (5)...(209): haloacid dehalogenase-like hydrolase
  misc_feature (1)..(231): Xaa is any amino acid
MSKQYEHIFFDLDRTLWHFDENSKNVLNEIFVKFELARYINNVDEFIKSYEIINDNLWRQYSKSRIDKEKLRSERFYQTLLKYGADENDIAIQIGDYYINHSPQQTALLPHTIETLDYLKDKYVLHIITNGFEEVQLIKLSKSGIMDYFNQLIFSEKVGVKKPHPLIFKRAIKNANAHISNSIMIGDDYYADIYGATRAGMDSIYFNFNNRPHQHKVNNEINCLSELTGLL

SEQ ID NO: 15895 - DNA, 582 bp, Unknown
  Obtained from environmental sample
  misc_feature (1)..(582): n is a, c, g, or t
atggatgcaaatttctcatcaaaggtaaaagatgttatctcttatagtaaagaagaagctctaagattaggccacgactatataggagtcgaacatttgttgttaggaattattcgcgaaggcaacgggttggcagtaaaaattcttgaatcattgggcgtaaactcaaaagatttgagagcacaaattgaactttcaactaaagcaggatcaggaattcctagtcaaatgctaaatattccattggtaaaacaagctgaaaaagtattaaaaataacttatttggaagctaaattgtttaaaagtaatgttattggtacagaacatttgttattatccatcttaaaagatcaagataatgttgctacacaaacactacaacagtttgatgttaattacgataaagtaaaagaagaaattatgatattaaactcgtcagaagattttaacccaaaatcagaattcccgggagcttcatctgatgacgatgacgacagcgngaaaggttttatgggcggaggcggaggtccttcaaaggttcagaaagcaaatcaaaaacacagtattagatnattttggtag

SEQ ID NO: 15896 - protein, 193 aa, Unknown
  Obtained from environmental sample
  DOMAIN (93)...(145): Clp amino terminal domain
  misc_feature (1)..(193): Xaa is any amino acid
MDANFSSKVKDVISYSKEEALRLGHDYIGVEHLLLGIIREGNGLAVKILESLGVNSKDLRAQIELSTKAGSGIPSQMLNIPLVKQAEKVLKITYLEAKLFKSNVIGTEHLLLSILKDQDNVATQTLQQFDVNYDKVKEEIMILNSSEDFNPKSEFPGASSDDDDDSXKGFMGGGGGPSKVQKANQKHSIRXFW

SEQ ID NO: 15897 - DNA, 387 bp, Unknown
  Obtained from environmental sample
  misc_feature (1)..(387): n is a, c, g, or t
atgaaaaataaaattgaagctgttaaagcatttcatacagcatttaaattaggacatagagaaacgccaaaagcagatttaggaaaagaaaaaaatttgttacgctttaatttaatgaaagaagaaaatgaagaatattttgaagcggcaaatcgtgatgatttggttgaagtagccgatgcattgggagacatgctctatattttatgtggaacgattatagagcatggtatgcagcataaaattgaagaagtatttgaagaaattcaacgcagtaatatgagtaaactaggagaggatggagagcctatatatcgtgaagacggaaaagtattaaaaggccccaattattttaaacccaatattgcaaacattttagataaataa

SEQ ID NO: 15898 - protein, 128 aa, Unknown
  Obtained from environmental sample
  misc_feature (1)..(128): Xaa is any amino acid
MKNKIEAVKAFHTAFKLGHRETPKADLGKEKNLLRFNLMKEENEEYFEAANRDDLVEVADALGDMLYILCGTIIEHGMQHKIEEVFEEIQRSNMSKLGEDGEPIYREDGKVLKGPNYFKPNIANILDK

SEQ ID NO: 15899 - DNA, 825 bp, Unknown
  Obtained from environmental sample
  misc_feature (1)..(825): n is a, c, g, or t
atgggctttataactgcatctaaagtagggtatgaggcagatgatattatagcttcacttgcaactgatggaagggacttagggttaaatgtgcgtattgtaagtcatgataaagacttgtatcaacttattggtgagggtatatttatgtttgatcctataaaaaagaaaataataagcagtgatgattgttttaaaaaatatggagtatatcccaatcaatttatagattaccaatccttacttggagatagtgcagataatgtaccaggagtaaaaggtgtaggggctaaaacagcggaagctttaatacaacaatttaatgacttggataatatctataaaaatattgaaaatatagaaaaacctagatggcaaaaactattgctagagagtaaagagatggcttatattagtaaacagcttgttactttacatcatgatgcacattgtttaaatagttttggagatttagaaaaaattgagctaccaaaagagaatccgattttaaaaatagcagatacgcttattgaatacgatatgcataggattatagataaagtgcataaagatggattaaactacaaaacaactgtccctaaaggatatgatacaagtaaaatagaacaaccaaaagagaaagttttagattgtgagtatattttattaaatgattatactaaaatgtttgatattattaaaaatatacctgctaactctttagtggcatttgatactgaaacaacagccttagatactaatgaagcaaatattgtaggtttctctttttgttttgaaagtactaaagcttattattaccaatga

SEQ ID NO: 15900 - protein, 274 aa, Unknown
  Obtained from environmental sample
  DOMAIN (70)...(170): 5'-3' exonuclease, C-terminal SAM fold
  misc_feature (1)..(274): Xaa is any amino acid
MGFITASKVGYEADDIIASLATDGRDLGLNVRIVSHDKDLYQLIGEGIFMFDPIKKKIISSDDCFKKYGVYPNQFIDYQSLLGDSADNVPGVKGVGAKTAEALIQQFNDLDNIYKNIENIEKPRWQKLLLESKEMAYISKQLVTLHHDAHCLNSFGDLEKIELPKENPILKIADTLIEYDMHRIIDKVHKDGLNYKTTVPKGYDTSKIEQPKEKVLDCEYILLNDYTKMFDIIKNIPANSLVAFDTETTALDTNEANIVGFSFCFESTKAYYYQ

SEQ ID NO: 15901 - DNA, 597 bp, Unknown
  Obtained from environmental sample
  misc_feature (1)..(597): n is a, c, g, or t
ttgtggggtggacctggtacttgtggcttgctagccattagaaaaagtttaattaatgaaaaagaatccccaacttttgcaggtgggggaacagttgcgtttgtttcaaaagatgaacatatctttaatagtgatatagagataagagaagatgcaggaacacctgctattttacaactcataaaagcctcttttgcatatcaattaagagatgagatagggataaaaagaattcaagaaagaaaagaagaactctttaaagtattaaaagatggattagccatgttaaaggggtacaccatctatggacaaaatgaaaatcacagaagtgttgggattttggctattaattttcatggtgttaccccgtatgaattatgtgaaaaattatcacaaaagtttggaatacaaacgagagcaggatgcagttgtgctggtccttatggtcacgacctatttggtattaataaaaaaaataaaacagatgaaaaaccaagctggttaagaataagtgtaaattacacacatagtatagaaagtattgaatacttactttttgcactgaaagaatcaataaaagaattaaaggaaaaataa

SEQ ID NO: 15902 - protein, 198 aa, Unknown
  Obtained from environmental sample
  misc_feature (1)..(198): Xaa is any amino acid
MWGGPGTCGLLAIRKSLINEKESPTFAGGGTVAFVSKDEHIFNSDIEIREDAGTPAILQLIKASFAYQLRDEIGIKRIQERKEELFKVLKDGLAMLKGYTIYGQNENHRSVGILAINFHGVTPYELCEKLSQKFGIQTRAGCSCAGPYGHDLFGINKKNKTDEKPSWLRISVNYTHSIESIEYLLFALKESIKELKEK

SEQ ID NO: 15903 - DNA, 804 bp, Unknown
  Obtained from environmental sample
  misc_feature (1)..(804): n is a, c, g, or t
gtgataaagtggaaaattacttgggtagaaggatcatcaaaaaaaatatttaataggaaaaatgaacatattggatatcttggagtcaatgtagatattacaaatcgtaaaaaagctgaacaagatttaaaaattgccaaagaaaaagccgaagaaagcgaccaattaaaaacagaatttattaataatatgtcgcatgaaatccgcacacctatgaatggtattttaggattttcacaattattaaataaaccaaataagtccgaagaaaaaagaaaatattatgttagtattattcaaaacagcggaaatcagctgatgcgaattattgatgatattctggaaatatcaagattaggaacaaaacaagtaaaagtgattgaaaatgaaatctgtttaaatgatatgctattgggattattttcaattttcgagataaaagcgaaagaaagtaaaatacctttatttttcaaaaaaggacttacgaataatgacagtcaaatatttaccgatgaaaccaagttaaataaaatactcagcaacttacttgaaaatgctttaaaatttacaaatgaaggttttattgaatttggctatcatatcgtacagacacgccatggcgtgtctcaacctcaaattgaaatatatgtaaaagatactggaataggaattgctcatgataaacaaaaaacaatctttgaacgattttcacaagaagaaaaagaattatccaaaaaagttggaggattaggactgggattatccattgcacaagaaaacgctgaattacttggaggaaaataa

SEQ ID NO: 15904 - protein, 267 aa, Unknown
  Obtained from environmental sample
  DOMAIN (170)...(267): Histidine kinase-, DNA gyrase B-, and HSP90-like ATPase
  misc_feature (1)..(267): Xaa is any amino acid
MIKWKITWVEGSSKKIFNRKNEHIGYLGVNVDITNRKKAEQDLKIAKEKAEESDQLKTEFINNMSHEIRTPMNGILGFSQLLNKPNKSEEKRKYYVSIIQNSGNQLMRIIDDILEISRLGTKQVKVIENEICLNDMLLGLFSIFEIKAKESKIPLFFKKGLTNNDSQIFTDETKLNKILSNLLENALKFTNEGFIEFGYHIVQTRHGVSQPQIEIYVKDTGIGIAHDKQKTIFERFSQEEKELSKKVGGLGLGLSIAQENAELLGGK

SEQ ID NO: 15905 - DNA, 309 bp, Unknown
  Obtained from environmental sample
  misc_feature (1)..(309): n is a, c, g, or t
ttgaaggcgaagaaagtcgaaattgatagtaaatacatatatgtaagcaactttataaaaagcatccaaatcccatttgaggaaattaaaagtgtgtcagaaatcgaaatatctagcccaagacctatatttattgaatttaaaagtaaaactgaatttggaaaaaaaatagtctttttagggtatatagagatatttctgttttttgcaactcatcctgctgtcaaagacataaaaaatcaaataaaaaaaactcgcaaaacacaaattgacaacaacttaacaaaacgattatatttggaccattag

SEQ ID NO: 15906 - protein, 102 aa, Unknown
  Obtained from environmental sample
  misc_feature (1)..(102): Xaa is any amino acid
MKAKKVEIDSKYIYVSNFIKSIQIPFEEIKSVSEIEISSPRPIFIEFKSKTEFGKKIVFLGYIEIFLFFATHPAVKDIKNQIKKTRKTQIDNNLTKRLYLDH

SEQ ID NO: 15907 - DNA, 750 bp, Unknown
  Obtained from environmental sample
  misc_feature (1)..(750): n is a, c, g, or t
ttgtctttgaaaaaatatatttttatactaacttttttatttatctcaaatctgtttgccaatacaaacttagtgatcgatgataataaaaacatctacgataattttgaaatcttatatttaaaagatgaaacttcacttctcaaaatagatgaaatatcgaaaagagagttttcactcactactaaaaataagtttacgttgggttatacaaaaggtagtgcatggtttaaattatctatcgataacagaagtttgaataaaaattttatactatcattaaacgagagtttttatgaagtagctaatatttactattttgatggaatgtggaaaaaaaagcaaaatagtgcttttatgctcattgaagaaagagagataaaacataataacctctcttttaatatagatctcgaaccaaatcaaaaacaaattttctatattgagcttaaagctaaatatgcctattttggaaatatctccatttataagaagagtgattttcatttttcccatgaacttgctattaacagcatctttgtctttatttttggtattttcgtaattgttattttatttaatctatttttatatattcaagtaaaagaaaaaatatatatttactatgtcggatatagttttttcaaccttatttatctcataaaaataagtggttttttagtctatgtcggactccaaaagttcatatatgatttacagttatctgctgcatttatgatcggattttaa

SEQ ID NO: 15908 - protein, 249 aa, Unknown
  Obtained from environmental sample
  SIGNAL (1)...(20)
  misc_feature (1)..(249): Xaa is any amino acid
MSLKKYIFILTFLFISNLFANTNLVIDDNKNIYDNFEILYLKDETSLLKIDEISKREFSLTTKNKFTLGYTKGSAWFKLSIDNRSLNKNFILSLNESFYEVANIYYFDGMWKKKQNSAFMLIEEREIKHNNLSFNIDLEPNQKQIFYIELKAKYAYFGNISIYKKSDFHFSHELAINSIFVFIFGIFVIVILFNLFLYIQVKEKIYIYYVGYSFFNLIYLIKISGFLVYVGLQKFIYDLQLSAAFMIGF

SEQ ID NO: 15909 - DNA, 351 bp, Unknown
  Obtained from environmental sample
  misc_feature (1)..(351): n is a, c, g, or t
gtgaaacaaaaactactaaaaataacactcctaacaactcttctaacatctgctatagccatagcagatgaaggaaacactttcgtaggagtaagtgcaggttacacaaacctaaacgtaaaacaagaagataaaacaggtgctatcatcttaggtaatgaacttgaagagaacggctataacataaaaatagaagctggatataactatagtgagaaagtagctataactattaactaccaaagagtaatacttgatgatacttaccaaaataacttctttataggctcagagtataaactacaacaacaaaagagcttactccatnatcgagccaatagtccacgataa

SEQ ID NO: 15910 - protein, 116 aa, Unknown
  Obtained from environmental sample
  SIGNAL (1)...(20)
  misc_feature (1)..(116): Xaa is any amino acid
MKQKLLKITLLTTLLTSAIAIADEGNTFVGVSAGYTNLNVKQEDKTGAIILGNELEENGYNIKIEAGYNYSEKVAITINYQRVILDDTYQNNFFIGSEYKLQQQKSLLHXRANSPR

SEQ ID NO: 15911 - DNA, 621 bp, Unknown
  Obtained from environmental sample
  misc_feature (1)..(621): n is a, c, g, or t
atgatattaaaatttccagatagattgttagactctcttgaaaagggtcatatgataattgacgataagtttattgtctcttattggaatagatggttggcaataaatacgcaaatttcaaaagagcagattatcggtaaaagtttaaaagatttttatcctgaactaaactacaacgttttacaaagaaaaatcaaaacagcacttagactcaaaactccatctttttatgatccaaacagtagcacaaaatttattcctattaaccgcaataaagttacaacatcttctcttacatatatgcaacaacaagtgacaatatctccatatatgagagaagaagatacagtaatgatctccatatatgatatcagtgaacttcatgaaacaaaaataagtttagaacgtgaaatagataaagtaaactatctgaatgaagttttagaatctgatcaagagataattgaccaaaatattatgacaatgaaaacttcagtagatggaactatagttgatgttagtacactattttgtaactttttcgagtataaaaaagatgatcttataggtaaacaagcatctttgttaaaaagatggcaacctcccagataccatatataa

SEQ ID NO: 15912 - protein, 206 aa, Unknown
  Obtained from environmental sample
  DOMAIN (4)...(66): PAS domain
  misc_feature (1)..(206): Xaa is any amino acid
MILKFPDRLLDSLEKGHMIIDDKFIVSYWNRWLAINTQISKEQIIGKSLKDFYPELNYNVLQRKIKTALRLKTPSFYDPNSSTKFIPINRNKVTTSSLTYMQQQVTISPYMREEDTVMISIYDISELHETKISLEREIDKVNYLNEVLESDQEIIDQNIMTMKTSVDGTIVDVSTLFCNFFEYKKDDLIGKQASLLKRWQPPRYHI

SEQ ID NO: 15913 - DNA, 309 bp, Unknown
  Obtained from environmental sample
  misc_feature (1)..(309): n is a, c, g, or t
atggatataaaatcattatataaattaaatgtggtagctgttgatgatgaggagatgatacttaaacatttggataatcatatctcaaggtattgtaataagtttgaaaaatttacaagtacaattgaagcatatgaatatatatctacttctacagttgatattgttataagtgatataagaatgccattaatgaatggaatagaattctcaaaaaaagtcaaagattataagaaagatataattgttattttgctttcggcttctaatgatgctgactacttaatggaagctattaatgtggagtga

SEQ ID NO: 15914 - protein, 102 aa, Unknown
  Obtained from environmental sample
  DOMAIN (9)...(102): Response regulator receiver domain
  misc_feature (1)..(102): Xaa is any amino acid
MDIKSLYKLNVVAVDDEEMILKHLDNHISRYCNKFEKFTSTIEAYEYISTSTVDIVISDIRMPLMNGIEFSKKVKDYKKDIIVILLSASNDADYLMEAINVE

SEQ ID NO: 15915 - DNA, 504 bp, Unknown
  Obtained from environmental sample
  misc_feature (1)..(504): n is a, c, g, or t
atgatgaaagatattaatgaacatgaaataatttcattgtatgagtatgcaaaacaaagaggtattcaaatacgatttatagagtatatggaaaatgaaaatgctacatcatatttaaaaactttaccaagtaaatatgttttagaagaaatatcaaaaaaacatctcatagacgagatagaaaaaaaagaaagttctgctgcaaaactatacaaagatgagagtggttttgtgtttggtatcattgaaccttatgatgatagtttttgtaaaagttgtaatagaatacgccttagtgctgagggagatttaatcccttgtttgtattttgaagattcgttaaatataaaaagtgctataaaatctgatgaaagattagaagaagttttaaaaacagttgtaaaaaataaaccagaaaaaaataagtggtcatataatacaaataataatatagatacaacttctgaagtctccagtagagctttttattttacgggagggtga

SEQ ID NO: 15916 - protein, 167 aa, Unknown
  Obtained from environmental sample
  DOMAIN (22)...(143): Molybdenum Cofactor Synthesis C
  misc_feature (1)..(167): Xaa is any amino acid
MMKDINEHEIISLYEYAKQRGIQIRFIEYMENENATSYLKTLPSKYVLEEISKKHLIDEIEKKESSAAKLYKDESGFVFGIIEPYDDSFCKSCNRIRLSAEGDLIPCLYFEDSLNIKSAIKSDERLEEVLKTVVKNKPEKNKWSYNTNNNIDTTSEVSSRAFYFTGG

SEQ ID NO: 15917 - DNA, 465 bp, Unknown
  Obtained from environmental sample
  misc_feature (1)..(465): n is a, c, g, or t
atgattattagaaaataccagccaggtgaagagtttatcctccatgaggtttttgtcagttcagttcatgaaaatgcccaaggatattataacaaacagcagcttgatgcctgggctccaactaattttgatgaggaaatctggatagaacgcctcaaaggaataagcccctttgtaatcctggtaaataatgaaattatgggatatgccgatctgcaggataatgggtatattgatcacttcttcatcagaggtggagaggcacaaaaaggttatggtacaaatttgatggagaaaattttagctgaggccaaaagaagcaacattaaaaaaataacctcgaacgctagcttagcagcacagaagtttttcctgaagcatggctttgagattgtaaaaaaacagatagtaattatcaagggaattgaactggaaaacaccttagtcaaaaaattgtgttgctaa

SEQ ID NO: 15918 - protein, 154 aa, Unknown
  Obtained from environmental sample
  DOMAIN (58)...(130): Acetyltransferase (GNAT) family
  misc_feature (1)..(154): Xaa is any amino acid
MIIRKYQPGEEFILHEVFVSSVHENAQGYYNKQQLDAWAPTNFDEEIWIERLKGISPFVILVNNEIMGYADLQDNGYIDHFFIRGGEAQKGYGTNLMEKILAEAKRSNIKKITSNASLAAQKFFLKHGFEIVKKQIVIIKGIELENTLVKKLCC

SEQ ID NO: 15919 - DNA, 597 bp, Unknown
  Obtained from environmental sample
  misc_feature (1)..(597): n is a, c, g, or t
atgttagtaaggaaaattaaatgtccagtttgtggtgcaaacaaagtaaatgaaattagtacttcatatatttattgtgattattgtggtagcttgatgggttacgacattgaaatgttgcaaggtgaggctaaggatattttttctgtgcagaatttatcaaaaccattacaaaaaaggtttttagaaattaatcaacaacttgcaggaataattaaagcaaaagacaaagaaaaatttatcgatttacaattgcaaattactgaaattgagtttgatttgtatcaaaaaagattttctccaaaaataaaacagccatcatatcggaacaaatatttggattattataaattgtattggacagaaaaattagaaaaaggttattttgaaaaaaatgctgaaacacaagaatttttccaaaaaattagttcaaaagtgaaaacgaaatatgttaatggacaaaatataacaacttttgacgatgaatttgtagaatatttagatttagctaaaggttttgtcgaaaaatctatcgatgaaactatgaaaatggattgtatggtgtactatcctgaggaaaaacaggagtgcaaatga

SEQ ID NO: 15920 - protein, 198 aa, Unknown
  Obtained from environmental sample
  misc_feature (1)..(198): Xaa is any amino acid
MLVRKIKCPVCGANKVNEISTSYIYCDYCGSLMGYDIEMLQGEAKDIFSVQNLSKPLQKRFLEINQQLAGIIKAKDKEKFIDLQLQITEIEFDLYQKRFSPKIKQPSYRNKYLDYYKLYWTEKLEKGYFEKNAETQEFFQKISSKVKTKYVNGQNITTFDDEFVEYLDLAKGFVEKSIDETMKMDCMVYYPEEKQECK

SEQ ID NO: 15921 - DNA, 750 bp, Unknown
  Obtained from environmental sample
  misc_feature (1)..(750): n is a, c, g, or t
atgcagagtgtgcttctaaagcagtttgaaaatacggctactaaagatcaaaaaaaagctgttaacaaaagtagtgaagttctaaaagaggttaaattttatgaacagaagcttaaaaacagtgattttgataattttgattctgttacttggtttaatttaatgacagagtatattaattcattaaaaatagttggagatcagctctctcaagaggttgattctcttgtcacaaaacgtattgatgattctatatttgatctggttttatggttcatatttatgaatattgttatgataattaccatattgataacatatatctttaaagagagtagtttagaacagattcataactttactaatgcgatgcgtcatttagcaaaaggagatagaagtttgagaatcaaaccgcttttgattgatgatgaaatttctgaaatgattgatgcatatgaaattagcagacaaaaacttctaaaagctgatatttttgcaaaactctatttaaataaaaaagatatagagataaagcataaagagagagaaaatgtacagttggagaagatagcttttatcgatcctttgacaggagttttgaatagacgtaaatttgaagagttagccacattggagattgcacgttcatctcgttataaacatgagctctcttttttaatgcttgatattgatcattttaaagcaattaacgataattacgggcattcatttggcgatggagtgctttaa

SEQ ID NO: 15922 - protein, 249 aa, Unknown
  Obtained from environmental sample
  DOMAIN (91)...(161): HAMP domain
  misc_feature (1)..(249): Xaa is any amino acid
MQSVLLKQFENTATKDQKKAVNKSSEVLKEVKFYEQKLKNSDFDNFDSVTWFNLMTEYINSLKIVGDQLSQEVDSLVTKRIDDSIFDLVLWFIFMNIVMIITILITYIFKESSLEQIHNFTNAMRHLAKGDRSLRIKPLLIDDEISEMIDAYEISRQKLLKADIFAKLYLNKKDIEIKHKERENVQLEKIAFIDPLTGVLNRRKFEELATLEIARSSRYKHELSFLMLDIDHFKAINDNYGHSFGDGVL

SEQ ID NO: 15923 - DNA, 645 bp, Unknown
  Obtained from environmental sample
  misc_feature (1)..(645): n is a, c, g, or t
ttggttgaaaatctaaaaattgaatactcaaatatgaatactcaaatgcagcatatagatactgctaatttaaaattacaagttaaggaagatatatattattcaaaacattgtcctacttgtaactcagaaattgaaaaagaggtggaagtctttaaaatagcaaaacaaaaaatattaagtgaaaaaacttttttacacaatgtgaatcgagatattttagaagaaaaaatacaaaaattaaaagaaaaattagagactgaaaaagcatcattacaagctttaagtaaagaacttattcaattaaagcaggattcaaaagaagtaacaacaattaaagaaaaagaacaactgctttatgaaataaaaggaatgattaaaaaaaatattcaaacgataattgagtatgaagaaaaatcatctaatgatgctcaaatagaagctctacaacaagaattggaaatattagaaaaagaactagttaaaatagatataaaaaagaaaaaacaagaagcagaattgtatataggcaaatactctactgatatgcttaaaacattgccttttgataaaagtgattatggtgatccaaatttgaaatttgatataaaaggatgtgacagcttatcaacaatctacaaataa

SEQ ID NO: 15924 - protein, 214 aa, Unknown
  Obtained from environmental sample
  misc_feature (1)..(214): Xaa is any amino acid
MVENLKIEYSNMNTQMQHIDTANLKLQVKEDIYYSKHCPTCNSEIEKEVEVFKIAKQKILSEKTFLHNVNRDILEEKIQKLKEKLETEKASLQALSKELIQLKQDSKEVTTIKEKEQLLYEIKGMIKKNIQTIIEYEEKSSNDAQIEALQQELEILEKELVKIDIKKKKQEAELYIGKYSTDMLKTLPFDKSDYGDPNLKFDIKGCDSLSTIYK

SEQ ID NO: 15925 - DNA, 462 bp, Unknown
  Obtained from environmental sample
  misc_feature (1)..(462): n is a, c, g, or t
atgaatttagctaaagcaatttattataactcaatagctcctgaaaatattagccaattagttttgaatattattaaaggttttgaagatgcaaaaataagaaatcttaattattttgatttatttattgtcattcctttttatagttacagaccagcacaagagcaatttaaaagaatagtgtttaatcaagtaaattcatttcaaagagatatagaaagaaatccagatattttttcaaactttagttttcaatatgaaaaaagtatcaaacatatgaagctaggtattttgtatgccttagataagggattaataataatggatgagaatatggatattaaaatagatactaaatttaaaagtgataataaaattatttttaatatgggaaaggttttttcaacaaaatcaacagcaagtttatataatttttttgaggtggatataaatgttatttag

SEQ ID NO: 15926 - protein, 153 aa, Unknown
  Obtained from environmental sample
  misc_feature (1)..(153): Xaa is any amino acid
MNLAKAIYYNSIAPENISQLVLNIIKGFEDAKIRNLNYFDLFIVIPFYSYRPAQEQFKRIVFNQVNSFQRDIERNPDIFSNFSFQYEKSIKHMKLGILYALDKGLIIMDENMDIKIDTKFKSDNKIIFNMGKVFSTKSTASLYNFFEVDINVI

SEQ ID NO: 15927 - DNA, 372 bp, Unknown
  Obtained from environmental sample
  misc_feature (1)..(372): n is a, c, g, or t
gtgtttatagataaaggttgtactgcttgtcatactgacataggtattggtggtactatgcaaccattccaaatccatgcaaactattcttatgcaaaaggtgacttcaaagggaataaagatggtatggtaaaaactccaacattaagaaatattgaagaaacagctccatattttcataatggaaatgtatggtctttaaaagatgcggttaaagagatgggttctactcaattaggtatcaatatatctgataaagagagtgagcaaattgtaacattcttaaaatctcttacagggaaaaaaccaacgattatatatccagttttaccaacactatctgataaaactcctaaacctcaattcgactag

SEQ ID NO: 15928 - protein, 123 aa, Unknown
  Obtained from environmental sample
  misc_feature (1)..(123): Xaa is any amino acid
MFIDKGCTACHTDIGIGGTMQPFQIHANYSYAKGDFKGNKDGMVKTPTLRNIEETAPYFHNGNVWSLKDAVKEMGSTQLGINISDKESEQIVTFLKSLTGKKPTIIYPVLPTLSDKTPKPQFD

SEQ ID NO: 15929 - DNA, 564 bp, Unknown
  Obtained from environmental sample
  misc_feature (1)..(564): n is a, c, g, or t
ttggctcgggatgatatcattgatgttttgaaaaataataaacttaatttgaccaaagggcatcccatacaaacctatgctgacgaagctactgcattggaagtgcttttaataaaaatggaaaaacagctaaagcataagtcttttaaaaatgaatggatagagctgtacgtgatagcaatgggaaattcaaaggggggggggatgatgcaggatcccactcacatccgtagtcttagtggttcgcaaaaattgcttacatggatgaatgaaaatcaaatgatttcaataaaggaagaaaaaaccgataaggaatatcaaaatgattttggagtaaatgcagattcaattatagctcctttgtttaagaaatatctttttctaaaagaatttctagtttcgttgaatcccgaattcaaacagttaaataaccccattgtttttaataccactggaaatatctataccctcgaaatgatagcaaaaagaggtggcatagaagtagatgaattgattaagaaaatcttatcagaaatagaactaaatcaagacaaaactaaatga

SEQ ID NO: 15930 - protein, 187 aa, Unknown
  Obtained from environmental sample
  misc_feature (1)..(187): Xaa is any amino acid
MARDDIIDVLKNNKLNLTKGHPIQTYADEATALEVLLIKMEKQLKHKSFKNEWIELYVIAMGNSKGGGMMQDPTHIRSLSGSQKLLTWMNENQMISIKEEKTDKEYQNDFGVNADSIIAPLFKKYLFLKEFLVSLNPEFKQLNNPIVFNTTGNIYTLEMIAKRGGIEVDELIKKILSEIELNQDKTK

SEQ ID NO: 15931 - DNA, 384 bp, Unknown
  Obtained from environmental sample
  misc_feature (1)..(384): n is a, c, g, or t
atgatacctattagattaataaaaactaaaaaaactatttataaactttataacgaagtgggctttatcaatcaatttgattgtaatgataatataccaaccattgatgaggtaaatgctttgatcacatggattgaaactgagctttatgaacaggtcacaagagttaaagaggctgatataggttttttatttcaagatatattacgaggtatggtattaattagttcagaaataaagactgataaacatgtatataacgatattaccctttactgtaatctagaggcaatccatgtaggtcatacaggttggtcaactagccccattcacaaaccatataataaaaaggctaagagattttttaggggagttatttattag

SEQ ID NO: 15932 - protein, 127 aa, Unknown
  Obtained from environmental sample
  misc_feature (1)..(127): Xaa is any amino acid
MIPIRLIKTKKTIYKLYNEVGFINQFDCNDNIPTIDEVNALITWIETELYEQVTRVKEADIGFLFQDILRGMVLISSEIKTDKHVYNDITLYCNLEAIHVGHTGWSTSPIHKPYNKKAKRFFRGVIY

SEQ ID NO: 15933 - DNA, 465 bp, Unknown; identical to SEQ ID NO: 14783
  Obtained from environmental sample
  misc_feature (1)..(465): n is a, c, g, or t

SEQ ID NO: 15934 - protein, 154 aa, Unknown; identical to SEQ ID NO: 14784
  Obtained from environmental sample
  DOMAIN (1)...(86): RNA pseudouridylate synthase
  misc_feature (1)..(154): Xaa is any amino acid

SEQ ID NO: 15935 - DNA, 468 bp, Unknown; identical to SEQ ID NO: 14165
  Obtained from environmental sample
  misc_feature (1)..(468): n is a, c, g, or t

SEQ ID NO: 15936 - protein, 155 aa, Unknown; identical to SEQ ID NO: 14166
  Obtained from environmental sample
  misc_feature (1)..(155): Xaa is any amino acid

SEQ ID NO: 15937 - DNA, 696 bp, Unknown
  Obtained from environmental sample
  misc_feature (1)..(696): n is a, c, g, or t
ttggaaatatcgttatctgaagataaaattggtgtaattataggcatggaaggaatagctcaattagaagatactattcacctaagagagttatattctaagggagtaagacatgcatcactaacatggaatgaagaaaacaaatatgctagtggtctagataacttgaatactaaaggattaacggataaaggaaaagaattattagctgtaatggaagaattaggaatgttagttgatttagctcatttaaatgaaaaatcgttctttgatgtggttaacaacaccacagctcctataattgtttctcatgggaatactaaagcgatttgcaatcataggagaaactatacagatgaacaattaatggcaattaaaaatagtaatggagtaatcggaatttgtggtattggggatttcattgctaaagaagttgagtttcaaaatgtagaaacattagttaaacatatagatcacgctgtaaaaacaattgggatagatcatgttgggcttggttttgacttttgctactatctaggagatgaatctaaggataatggtgtagaagggttattgactatcgctgatgtacctaatatatttacagaattgaaaagaataggatatagtaaaaaaagtatagaaaagataaaacacttaaattttgaaagagtaatcaaagaaatattaaaataa

SEQ ID NO: 15938 - protein, 231 aa, Unknown
  Obtained from environmental sample
  DOMAIN (1)...(228): Membrane dipeptidase (Peptidase family M19)
  misc_feature (1)..(231): Xaa is any amino acid
MEISLSEDKIGVIIGMEGIAQLEDTIHLRELYSKGVRHASLTWNEENKYASGLDNLNTKGLTDKGKELLAVMEELGMLVDLAHLNEKSFFDVVNNTTAPIIVSHGNTKAICNHRRNYTDEQLMAIKNSNGVIGICGIGDFIAKEVEFQNVETLVKHIDHAVKTIGIDHVGLGFDFCYYLGDESKDNGVEGLLTIADVPNIFTELKRIGYSKKSIEKIKHLNFERVIKEILK

SEQ ID NO: 15939 - DNA, 966 bp, Unknown
  Obtained from environmental sample
  misc_feature (1)..(966): n is a, c, g, or t
atgatcagattcggctcgagtggtactcataatgataaccctcacttttctgaaatggtgagggttatacaagaaaatagaatcaatgtatatctaccacctgaagagttgaaagatgactttatcgatattttaaaaaatctaaatgcaaatattgctctttccttcttatattctaaaatatttcctaaaaaaataatatcaattttcaaagatgagatgtttaatatccatccatcagctcttcccaaatacagaggagcacaaccattatattggcaaataagaaatggtgaaagaaaaagtgctttatctattcataaaattagtgaaaaaattgatagtggtgatattgttgggaggatagattttgatatagaaaaagaagatacgataggttctttgttaaataagatagttatgattgttccacaattgattgtagagttttgtgctaacttagaaacagatactcttaaatacaaaaaacaagatcaatccgaatattatgaaaacccaggagatacagattttaagatagattggaaaaaagatactacttttgaaatttctcaaaaggcaaaatcatcaaatccaatctacggtggtatagatgcagttataaaagatatttttatcaaagttttagaagtaacacctgtagataatcaaacttatggagtaaaggagggtgtaataattttaatagacgaaaaagatggactagtagtcgcagcaaaaaataacactgctattagattagatgttgtttccactaaggatggagtatttagtggatactcttttgcaaacccccaaaaccattttccggtgaacaatttaaaaactgttaaggagaaaaaatggcggccgatccttatatcggaaacatatcacctatgggaatttacttataatcccaaggggaagggcctttatttcccggaaccccttctcccaatttag

SEQ ID NO: 15940 - protein, 321 aa, Unknown
  Obtained from environmental sample
  DOMAIN (4)...(151): Formyl transferase
  misc_feature (1)..(321): Xaa is any amino acid
MIRFGSSGTHNDNPHFSEMVRVIQENRINVYLPPEELKDDFIDILKNLNANIALSFLYSKIFPKKIISIFKDEMFNIHPSALPKYRGAQPLYWQIRNGERKSALSIHKISEKIDSGDIVGRIDFDIEKEDTIGSLLNKIVMIVPQLIVEFCANLETDTLKYKKQDQSEYYENPGDTDFKIDWKKDTTFEISQKAKSSNPIYGGIDAVIKDIFIKVLEVTPVDNQTYGVKEGVIILIDEKDGLVVAAKNNTAIRLDVVSTKDGVFSGYSFANPQNHFPVNNLKTVKEKKWRPILISETYHLWEFTYNPKGKGLYFPEPLLPI

SEQ ID NO: 15941 - DNA, 780 bp, Unknown
  Obtained from environmental sample
  misc_feature (1)..(780): n is a, c, g, or t
ttgctgcctccgatttaccatccctttacaacaacttataacctcattcagcaatttcagcggttcaaagcaaaaactggaaattcaggtaatgtacacatcaagttttacaattttggttgctttggattgtccggctcaagatattggcttgcagaagaattaatttctttatcagaaaataatattccacgacatgaacacgaaaactcaaacccagaactcagtaagctaagtattatagcaccttcggtacgcgattcgtcaatatgcccacccaaaaaaggtgtggttacaatttacatggctgcttccattgataaatatgacaactggaaaaccaaaaaaggagaaaatggagaaattatacgtactaaagactactatgaacttaaagaaaaaattgctcaacaactttttagcagaattgaacgtgagctatcaccaaatctaaaaaaacacatcctcttttacgaaacagcaagtcggtatacttataacagatacaccgataattaccaaggaacaatgatggggcaacgacccggaaaaatcaacatgcaaaacaaagtagcatcacatattactgaaattgaaaacttacttgtgggcggacagtgggctgaattaggaggtggcataccaatagcaacgcgctcagccatgaataccatgttaattatcctacgtaaaaaaaacaaacccatgttcaaattattggcaaaatattttgatggcaaactgaagctggaaattttaaatacaaaattgaagtactag

SEQ ID NO: 15942 - protein, 259 aa, Unknown
  Obtained from environmental sample
  misc_feature (1)..(259): Xaa is any amino acid
MLPPIYHPFTTTYNLIQQFQRFKAKTGNSGNVHIKFYNFGCFGLSGSRYWLAEELISLSENNIPRHEHENSNPELSKLSIIAPSVRDSSICPPKKGVVTIYMAASIDKYDNWKTKKGENGEIIRTKDYYELKEKIAQQLFSRIERELSPNLKKHILFYETASRYTYNRYTDNYQGTMMGQRPGKINMQNKVASHITEIENLLVGGQWAELGGGIPIATRSAMNTMLIILRKKNKPMFKLLAKYFDGKLKLEILNTKLKY

SEQ ID NO: 15943 - DNA, 801 bp, Unknown
  Obtained from environmental sample
  misc_feature (1)..(801): n is a, c, g, or t
ttgaagagattgagtaaataccttaactttataatattatttgttttactagtaattttttttgctagtgatctccctaaacatatctcaacacaaatcacaagtattctccctgctggtgaaaataaaggacttttaagggagtttgaaaaacttaatacaaacaaacaactttttatagcttataaaggggaagataaaaacactttaaatagcttaaaaaaagtggtaaaccaacttttagaacataaaaatatacacccaataacaaattcaagtatcaataaagagtatgaaaaaaaatattactatttacttcataagtttgatgagaaaaaatacaattcattgaacataaaagaagaacttacaaatatacatcaaaaaataatcacatcaccttttagtttttcactcaatacagttgatccactcaatatttttgaaaaaaacaccaaacaaaaatcaccctacataaaaatagaaaactatggatatatgactatcttacaacttgacaaaagtattaataattttgataaatataaagatgtttatgatttcgttcaaaatataaaacaaacagatgcaaatatagaggcattttccactttattttattttgtggaaaatcaagaaaaaattaaaagtgatgtaaatattatcatcactttagctttgagtgttttatttattttatatattgttgttcttcgaaatttcaaacttttaatacacactattacaacactcagttcctctgtgttatttgcacttattataagtgctactgagccataa

SEQ ID NO: 15944 - protein, 266 aa, Unknown
  Obtained from environmental sample
  misc_feature (1)..(266): Xaa is any amino acid
MKRLSKYLNFIILFVLLVIFFASDLPKHISTQITSILPAGENKGLLREFEKLNTNKQLFIAYKGEDKNTLNSLKKVVNQLLEHKNIHPITNSSINKEYEKKYYYLLHKFDEKKYNSLNIKEELTNIHQKIITSPFSFSLNTVDPLNIFEKNTKQKSPYIKIENYGYMTILQLDKSINNFDKYKDVYDFVQNIKQTDANIEAFSTLFYFVENQEKIKSDVNIIITLALSVLFILYIVVLRNFKLLIHTITTLSSSVLFALIISATEP

SEQ ID NO: 15945 - DNA, 321 bp, Unknown
  Obtained from environmental sample
  misc_feature (1)..(321): n is a, c, g, or t
ttgtttgtattaagtttttcaaactcccttaaaagtcctttattttcaccagcagggagaatacttgtgatttgtgttgagatatgtttagggagatcactagcaaaaaaaattactagtaaaacaaataatattataaagttaaggtatttactcaatctcttcaatagttatcctatcttgattcaaaaatttatttttagatatttgagtttatcattatttttctcatattccatattttctaatacagaagagagatactcatttggtaaaagagttggtattttatcattttttttggatgcgaagtttccataa

SEQ ID NO: 15946 - protein, 106 aa, Unknown
  Obtained from environmental sample
  misc_feature (1)..(106): Xaa is any amino acid
MFVLSFSNSLKSPLFSPAGRILVICVEICLGRSLAKKITSKTNNIIKLRYLLNLFNSYPILIQKFIFRYLSLSLFFSYSIFSNTEERYSFGKRVGILSFFLDAKFP

SEQ ID NO: 15947 - DNA, 990 bp, Unknown
  Obtained from environmental sample
  misc_feature (1)..(990): n is a, c, g, or t
gtgtatggggcaaaaatctctaaaggtcaggttatcgcagatggtccatctatggacaacggtgagttagcaattggagtaaatgcaacagtggcatttatgccatggaatggttataactacgaagatgctattatcctttctcaaaaacttattaaagaagatgcttttacttctgttcatatctatgaaaaagaggttgaggcaagagaattaaaacatggtaatgaagagattactagagatttaccaggtgttaagtctgaaaatcttgatcatttagatgagtcaggtattgttaaaatagggactcacttaaagccaggtatgattatggttggtaaagttacaccaaaaggtgaaattaaaccaactcctgaagagagactattaagagcaatttttggtgaaaaagcaggacatgttataaataaatctatgtactgttcagcttctatggaaggtgttgttgtagatgttaaagtattcactaaaaaagggtacgaaaaagatgagagagcagttgctacaattgaagctgaaaaaacaggtttagatattgaacatcatgataagttgatgatgttagatagagaagaaaacttaaaaatcaatgatattatctctaaaagtgttttagaaaaagatgtagagattaatgataaagtttttaaaaaaggtgaaaaattaacactagaagatttagaaaatgttaatagatttgcaatgaaaaaagttatctcatcttttggtaaagaggttgcaaaagcatataatgatgtaaaagatcactttattaaagagaaaacaattttaagagaaaatcctgaagagaaaatatctattttagagcatgatgatatcttaccaatggtggtatcaaacaagttaaagtatatatcgcaactaaaagaaaaaatcaaggtgggtgataaaagggctggaccacctggtattaaaggtattgttttcaatatccgaccccaagta

SEQ ID NO: 15948 - protein, 330 aa, Unknown
  Obtained from environmental sample
  DOMAIN (1)...(256): RNA polymerase Rpb2, domain 6
  misc_feature (1)..(330): Xaa is any amino acid
MYGAKISKGQVIADGPSMDNGELAIGVNATVAFMPWNGYNYEDAIILSQKLIKEDAFTSVHIYEKEVEARELKHGNEEITRDLPGVKSENLDHLDESGIVKIGTHLKPGMIMVGKVTPKGEIKPTPEERLLRAIFGEKAGHVINKSMYCSASMEGVVVDVKVFTKKGYEKDERAVATIEAEKTGLDIEHHDKLMMLDREENLKINDIISKSVLEKDVEINDKVFKKGEKLTLEDLENVNRFAMKKVISSFGKEVAKAYNDVKDHFIKEKTILRENPEEKISILEHDDILPMVVSNKLKYISQLKEKIKVGDKRAGPPGIKGIVFNIRPQV

SEQ ID NO: 15949 - DNA, 435 bp, Unknown
  Obtained from environmental sample
  misc_feature (1)..(435): n is a, c, g, or t
atgaccactaaaaataagagagctttttcacttatagagataatatttgtaatagctgttatctctataattttagttgtagctattcctaaaatgaatggtatctttgaaagtgcaaacacaactaaaataaaaagtgagattctccttattagagaagctttaaataactataaaaacaaaatgatactcaaagggtcaaccgctactttagactcacttgaggataatgacaaatacctttttaataaaatactacaaagtccaatcccagcaactaaccatatcaaagttggtgcttggagcaaaatatcagctacaacttataaagtctatgttgaagatggtaatagtgtagagtttatatacgatagtgatgattatagttttgagtgtgatgaagataatctactttgtcaagagttaacgcaataa

SEQ ID NO: 15950 - protein, 144 aa, Unknown
  Obtained from environmental sample
  misc_feature (1)..(144): Xaa is any amino acid
MTTKNKRAFSLIEIIFVIAVISIILVVAIPKMNGIFESANTTKIKSEILLIREALNNYKNKMILKGSTATLDSLEDNDKYLFNKILQSPIPATNHIKVGAWSKISATTYKVYVEDGNSVEFIYDSDDYSFECDEDNLLCQELTQ

SEQ ID NO: 15951 - DNA, 558 bp, Unknown
  Obtained from environmental sample
  misc_feature (1)..(558): n is a, c, g, or t
ttgaaaaatgtacttgatggtgttgatgaagccctaaaagttggttttaaagttaaagtaaatatggttcctatgaagagtcttaatgctgatgaaataattgatgttcttgagtattgtaaagaacgtaatatgactataagatttatagaatatatggaaaatgaatttgctgctaaagagataaaaggtcttaagtcagatgagcttttagaaattttaggtgctaagtatgagtttagtgatgatggttttgatggttcatcaccatctcattactatactatgacggatggttacagatttggaatcattgaaccatatgcagatgacttttgtaaacagtgtaaccgtatacgacttacagcagaaggtaatcttatcccatgtctttattttgatgaatctatgagtatagcaaaagcaatcaaagatggcgacatcaatgctgcggcagaagtacttagggaagttgttagaacgaaacctgagaaaaatagatggggcggagaagatagtgaagtctctacacgtgtcttttatgaaactggtggctga

SEQ ID NO: 15952 - protein, 185 aa, Unknown
  Obtained from environmental sample
  DOMAIN (45)...(168): Molybdenum Cofactor Synthesis C
  misc_feature (1)..(185): Xaa is any amino acid
MKNVLDGVDEALKVGFKVKVNMVPMKSLNADEIIDVLEYCKERNMTIRFIEYMENEFAAKEIKGLKSDELLEILGAKYEFSDDGFDGSSPSHYYTMTDGYRFGIIEPYADDFCKQCNRIRLTAEGNLIPCLYFDESMSIAKAIKDGDINAAAEVLREVVRTKPEKNRWGGEDSEVSTRVFYETGG

SEQ ID NO: 15953 - DNA, 741 bp, Unknown
  Obtained from environmental sample
  misc_feature (1)..(741): n is a, c, g, or t
atgaaagaaaagtttgaatatcaatataaaaactgtttattgaagtttgaggctgagaataaaattccaaatgataaattttcatatttaagacttagcttggaaggtgcagtttgtacaactgacaaagaacacttagttgtgcgttataatgtaatgggagaaggttataataaaaaagaaggatatcttatatatgtatacgctcctattaaaaaattaccagacggagaaattgcatacgaagttaaaaaagacacattatttgatgttgacacaagactagtgctaaataaagaataccttcttgagggtaattttatcttcaatgcaatattaaagaacaataatacaggaaaagcaagaaattggcatagtggaagctatgaagtcgctattgacaatagaaatatgagagatttctacatgatagaagattgtaaaaagaatagtattgatactaaaactttacttactagcgaaacagagattttttattgtgctaacaacttaatgaaaaatgatacagtaaaatgtgtttatgaagattttaatccaataacatacaatgaaagaatagtatttaataaagaaaatagaaagtgtgaagttcttattcctcggcaaaataaaaaatcttatcccttaaaaataaaactactgaaaaaaggtcaaacggagacaataaattttggagtatacacacttaaatatacatatttttttgagcctttaaactaa

SEQ ID NO: 15954 - protein, 246 aa, Unknown
  Obtained from environmental sample
  misc_feature (1)..(246): Xaa is any amino acid
MKEKFEYQYKNCLLKFEAENKIPNDKFSYLRLSLEGAVCTTDKEHLVVRYNVMGEGYNKKEGYLIYVYAPIKKLPDGEIAYEVKKDTLFDVDTRLVLNKEYLLEGNFIFNAILKNNNTGKARNWHSGSYEVAIDNRNMRDFYMIEDCKKNSIDTKTLLTSETEIFYCANNLMKNDTVKCVYEDFNPITYNERIVFNKENRKCEVLIPRQNKKSYPLKIKLLKKGQTETINFGVYTLKYTYFFEPLN

SEQ ID NO: 15955 - DNA, 663 bp, Unknown
  Obtained from environmental sample
  misc_feature (1)..(663): n is a, c, g, or t
atgaagattctattttttatctatatttttttacacctgcttcatgcagatacaaaaaaaatttatttttatacaacagacattaatataaataatttcaaatcactaaaaattaattttgatacatatttgagcaaatatggacattatgaatttcagccatttaacaataaagagacatttgaaacccagctaaaaaatagaaactctgtcgttattttatcaagttggcactatcttgaaattgcaaaaaaatataatttagaagctacattggtagcccaaaaaaaagcctctatagtagatactaaaatattagttggcaaaaaagatatcaaacttcaaggtttagtaacctccgcatacaacaaagagtacacaaatgagttgttaacctccctaacaaaagaggatattaataacctatctatccttatagttccaaaagagattgatgctcttatgagtgttggctttggaatgagtaagtttgcgcttgtttcaaaagagagcttcactcttttagaagagattaatccatttttagcaaaaagtttaaaaatctacagcgaatcagatccaaagtatagaatggtgttagcaccatatgatatagatatccaaaaagcaaacttatctctatcatccaagagatgggattga

SEQ ID NO: 15956 - protein, 220 aa, Unknown
  Obtained from environmental sample
  misc_feature (1)..(220): Xaa is any amino acid
MKILFFIYIFLHLLHADTKKIYFYTTDININNFKSLKINFDTYLSKYGHYEFQPFNNKETFETQLKNRNSVVILSSWHYLEIAKKYNLEATLVAQKKASIVDTKILVGKKDIKLQGLVTSAYNKEYTNELLTSLTKEDINNLSILIVPKEIDALMSVGFGMSKFALVSKESFTLLEEINPFLAKSLKIYSESDPKYRMVLAPYDIDIQKANLSLSSKRWD

SEQ ID NO: 15957 - DNA, 756 bp, Unknown
  Obtained from environmental sample
  misc_feature (1)..(756): n is a, c, g, or t
atgttaaatagaacaaaacttataaatgataccatatataaacatattgagtgtagtgaattcgagagccttttacttcaaacaaagatagtcaacagacttttttttgtaacacaaaatgccctagcctattttgcttatccatcaatcaatactaaaagatatatccatagtttaggaactatgcatatgagtggtcatatgtttaagaatgctatattaaatacaaaagaaaatgtaaaatatgactttttaaaaaaactcaaaaaatctataaaattaataataaaagaaaacaaactagatttaactataaaagatattgataatttaagtgataaaacactatatgagtttatgattcctttaaaatcaaatggtttcaaggatatctatttagtaacattacaggctctaagaatcgttggactacttcacgatgtgggacattttccattttcacatcaagtggaatatgctatggaaaagctttatgatattttacaagagagtacaacacataacaaaaaagagaaagagtttttaaacttttatgagagtgtaacaaagaactcaactttggtcttacatgaagctataggggaaaaactagtaaaattactttttgaacatgagatgcaacaatttgtcacaaatgagaaagacaaaaactacacacaacttatttatctcattgttaaaaatattctcaatgagaaagatgacggtatctttgaatatggtggttttacataa

SEQ ID NO: 15958 - protein, 251 aa, Unknown
  Obtained from environmental sample
  misc_feature (1)..(251): Xaa is any amino acid
MLNRTKLINDTIYKHIECSEFESLLLQTKIVNRLFFVTQNALAYFAYPSINTKRYIHSLGTMHMSGHMFKNAILNTKENVKYDFLKKLKKSIKLIIKENKLDLTIKDIDNLSDKTLYEFMIPLKSNGFKDIYLVTLQALRIVGLLHDVGHFPFSHQVEYAMEKLYDILQESTTHNKKEKEFLNFYESVTKNSTLVLHEAIGEKLVKLLFEHEMQQFVTNEKDKNYTQLIYLIVKNILNEKDDGIFEYGGFT

SEQ ID NO: 15959 - DNA, 951 bp, Unknown
  Obtained from environmental sample
  misc_feature (1)..(951): n is a, c, g, or t
ttgggactactttcccgatgtggggacattttcccattttcacatcaaagtggaatatgctatggaaaaagctttatgatattttttcaggagagtacaacacataacaaaaaggagaaagagtttttaaatttttatgagagtgtaacaaagaactcaactttggtcttacatgaagctataggggaaaaactagtaaaattactttttgaacatgagatgcaacaatttgtcacaaatgagaaagacaaaaactacacacaacttatttatctcattgttaaaaatattctcaatgagaaagatgacggtatctttgattatggtgttttacataaatttatagatggtactgttgatgctgatagacttgattatataaacagagatatgttagcaagtggatatattggtggtagtatagattttatacggattgcaaaaagagcaatccttgttgagcataaaaaacaatttaaaatctctttttttgatagtgagcttatagatatcgaacatatgatagagatgcgatttaacctttataaaaagattatttataaccataaaatatcggtcatagactcattgctagaaaatgtaatactctatctcgccaaaaaatatcttaaatcaacacaagaagaggatactcaagttaactctatctctatgttgtggaaatttttagatgaagaaaatagtgaaaaaagactcgatatcataagtcaactagatgaaaactggattataactttatttaaaaaagagtattttagtttaaaatataaagagaattacaacttcaaagataaaaaatatctctcctcttttgaggagatactctttgggaaaaagttttataatagtgcttggagaaatcttaatgatttgtatagtttacttgaatttaccgatatacaaagatacaagttagagaaagtttggtag

SEQ ID NO: 15960 - protein, 316 aa, Unknown
  Obtained from environmental sample
  misc_feature (1)..(316): Xaa is any amino acid
MGLLSRCGDIFPFSHQSGICYGKSFMIFFQESTTHNKKEKEFLNFYESVTKNSTLVLHEAIGEKLVKLLFEHEMQQFVTNEKDKNYTQLIYLIVKNILNEKDDGIFDYGVLHKFIDGTVDADRLDYINRDMLASGYIGGSIDFIRIAKRAILVEHKKQFKISFFDSELIDIEHMIEMRFNLYKKIIYNHKISVIDSLLENVILYLAKKYLKSTQEEDTQVNSISMLWKFLDEENSEKRLDIISQLDENWIITLFKKEYFSLKYKENYNFKDKKYLSSFEEILFGKKFYNSAWRNLNDLYSLLEFTDIQRYKLEKVW

SEQ ID NO: 15961 - DNA, 447 bp, Unknown
  Obtained from environmental sample
  misc_feature (1)..(447): n is a, c, g, or t
atggctcagatagaaatctctcataagggagaactcctcttggagaaatttatgatgtattgccgcttttttaattatctggcaattcttaaaataaaaggaaaagacctcgaaaaagcatttaaaagaagtgtcagtcaagcttcaaaaggaattcatcagggcgctttcccttatctttccggaatgaagttcgacattaaagatggcaaggctgaaaacttcagaattgtaaaagacgggcttgaattcccagtggaacctgaaaaggattatctttttgcgacagattcctacattgcgcagggtggaaacggatattacgaatttcacaatgttagtaaaattgaaatgacacagtttgtcgtaagtgatgtctttgctgaatattgtgaggaaaagaagacgttatcaaaacctgagatcagtcatccggccttaaattag

SEQ ID NO: 15962 - protein, 148 aa, Unknown
  Obtained from environmental sample
  misc_feature (1)..(148): Xaa is any amino acid
MAQIEISHKGELLLEKFMMYCRFFNYLAILKIKGKDLEKAFKRSVSQASKGIHQGAFPYLSGMKFDIKDGKAENFRIVKDGLEFPVEPEKDYLFATDSYIAQGGNGYYEFHNVSKIEMTQFVVSDVFAEYCEEKKTLSKPEISHPALN

SEQ ID NO: 15963 - DNA, 939 bp, Unknown
  Obtained from environmental sample
  misc_feature (1)..(939): n is a, c, g, or t
ttgttcccatggggagactgtggctttaaacctatttttgaaaagtttagtaaagaggatataaatttatcagttattactaatactggatttgaacaaggtttaaagctgacagataatgtacgatatttaccttttgaattgtttttacctttttggataacaaaacaaaaaatactagtagtgatggaagcggagctttggtatatgttgtttttagttgcaaagagtaaaggggctaaaacaattttacttaatgcaagaataagtgataagtcttatagctcttataaaaagttttcatttttgtataaacatatttttaaacatatagataagatttttgcacaaagccaaacggataaacaaagacttgaagagcttggtggaaaaaatattgaggtagtgggaaatataaagttagcaaatcttccaaaaattacaaaagagttagaaaaaccaaatggtataattataactgcaggaagtacccactttagcgaagaggaacttatcttaaactcttgggataaaagtatgggaaaacttatagttgtcccacgacatccagagagatttgatgaggtgtataatttaatagaaacagagtataaaaatagtgatgtaacctatcatcgatattctcaaaaagaggatctctctagtgatattgttttagttgatgctatgggacagcttaataatatctatgctataagtgatgtggtaattttaggtggtggttttattaaaagcgcagggggacataatcccattgagcctgctttttttggtacaatactcataagtggaaaaactatttttaatcaaaaatcactttntgagtgtgtaaatgattattatttaatagaaaatgaagagttacaaaccactcctgaaaatataaaagatttaaaaaaatcagtttaccaaaagtag

SEQ ID NO: 15964 - protein, 312 aa, Unknown
  Obtained from environmental sample
  DOMAIN (8)...(153): 3-Deoxy-D-manno-octulosonic-acid transferase (kdotransferase)
  misc_feature (1)..(312): Xaa is any amino acid
MFPWGDCGFKPIFEKFSKEDINLSVITNTGFEQGLKLTDNVRYLPFELFLPFWITKQKILVVMEAELWYMLFLVAKSKGAKTILLNARISDKSYSSYKKFSFLYKHIFKHIDKIFAQSQTDKQRLEELGGKNIEVVGNIKLANLPKITKELEKPNGIIITAGSTHFSEEELILNSWDKSMGKLIVVPRHPERFDEVYNLIETEYKNSDVTYHRYSQKEDLSSDIVLVDAMGQLNNIYAISDVVILGGGFIKSAGGHNPIEPAFFGTILISGKTIFNQKSLXECVNDYYLIENEELQTTPENIKDLKKSVYQK

SEQ ID NO: 15965 - DNA, 660 bp, Unknown
  Obtained from environmental sample
  misc_feature (1)..(660): n is a, c, g, or t
atggataatacaaatcaatatctaccaatagataaaattattatagaacataacaataattttttatttaatttatatacgaaaagcacaaaagatgaagaggctagattagtatatgaaaatggcgttgatttatcaataaatgacgctaaaaatcttcttgactatccttttttatatgttgaaaaagagaaaaaaggcgtttatcaggattattataaaaattacatagaacaaaagattatacctaagaatatgaaatctttttatgaagatgtaagtaaaaatataaatagtttatttgataatccagaatcaatagaaaatgtaaaagaggcaaaagtagttgtaacagatatggtaaatactattcttcaagatgattttaaagttgaatcatttgtatcaatattatctagtgattattatacccatactcattcattaaatgtaagtgtatattccttatgtatagggaaacatatggggatggataaaaaacttttagaagaactaggaatttcagctttactccatgacttaggaaagactaaaattaatccagaaattattaataaaaatggaaaactaacagaccaagagtttaaagaagtacagaatcatccattttatggatggttattagcaaaaaaaatgtga

SEQ ID NO: 15966 - protein, 219 aa, Unknown
  Obtained from environmental sample
  misc_feature (1)..(219): Xaa is any amino acid
MDNTNQYLPIDKIIIEHNNNFLFNLYTKSTKDEEARLVYENGVDLSINDAKNLLDYPFLYVEKEKKGVYQDYYKNYIEQKIIPKNMKSFYEDVSKNINSLFDNPESIENVKEAKVVVTDMVNTILQDDFKVESFVSILSSDYYTHTHSLNVSVYSLCIGKHMGMDKKLLEELGISALLHDLGKTKINPEIINKNGKLTDQEFKEVQNHPFYGWLLAKKM

SEQ ID NO: 15967 - DNA, 615 bp, Unknown
  Obtained from environmental sample
  misc_feature (1)..(615): n is a, c, g, or t
atggaacaatcagcttttgcattaaaagaaacagcatttcatgaacttatgtctttacgaataagagaaatactccttgtctgtagtcattatgataagtttatgcttgatgaagacggcagaatagatgaacagctttttcaggaatatatggctctcagtctccattacccccccagaatgacacaggcttcaactgcagaagagaccaaaaaagcacttgaaaataaatattttgatttagttatattaatgcttagtgtcggagaagataatcttgtagatttagcagaaggaataaaaagtaaatacccttcaaaacctataattctgcttacccccctttctactcgtgaaaccatgaaaagaataaaaatgaaggattcaagttcaatcgactatattttctcatggcagggaaatacaaatattatgcttgcaatggttaaacttctggaagacaggatgaatgttgatccggatgtaaacaatgtaggggttcaggccataattctggtagaagattctgtacgatactattccagttatcttccagttatctatgaaacccttttcaaaacaggcaagaagccttatgaaagaaggtttaaatga

SEQ ID NO: 15968 - protein, 204 aa, Unknown
  Obtained from environmental sample
  misc_feature (1)..(204): Xaa is any amino acid
MEQSAFALKETAFHELMSLRIREILLVCSHYDKFMLDEDGRIDEQLFQEYMALSLHYPPRMTQASTAEETKKALENKYFDLVILMLSVGEDNLVDLAEGIKSKYPSKPIILLTPLSTRETMKRIKMKDSSSIDYIFSWQGNTNIMLAMVKLLEDRMNVDPDVNNVGVQAIILVEDSVRYYSSYLPVIYETLFKTGKKPYERRFK

SEQ ID NO: 15969 - DNA, 861 bp, Unknown
  Obtained from environmental sample
  misc_feature (1)..(861): n is a, c, g, or t
atggtattagcgagagttgcaaatcctgattctaagagcggtagcgtagatatgctctcctcaaaatttggggttaacctaaatctaaaaactgtgtatcgcatgatggatatgatagatgacaagcaagtcaaaaaattaaataaactaatcttaacacagactaaatcactcctcaatgatacaatagatgtaatttactttgatgctactaccctttactttgagagttttacagaggatatagataaccaagaagatataaacgaagcaatcagaaagaatggatactctaaagatggaaagtttaaccaacctcaagttgtattggcactacttgtaactaagcaaggcttacctgtaggatataaagcatttagtggagataccttttatggtcacactatcataccttcactcaaagaggtagaggatgagtttaaagtagataagattgtatatgtagcagatgcgggtatgtttaataaaaagaacttagaggagtttgataaaaataaagacatgacctatatcgtaggtgctaaaataaaaacaatgtcaaaagtatttaaagagcagatattaaaaacagatgattttacagagattaacgatgatactaaagtaaaaacacttgattataatggtaaaaagttgcttatatcatactctaaaaaaagagcaaaaaaagataaacatgatagagaaaaagctattgctaaactcaaaaagagattagaagaatcaaagtctgtaaaatcttcattatctaataaatggatacaagaagtatctgcagctttgaaagtagtgataaaaacagatcatgtgattttatcatttaccctttacccaagataa

SEQ ID NO: 15970 - protein, 286 aa, Unknown
  Obtained from environmental sample
  misc_feature (1)..(286): Xaa is any amino acid
MVLARVANPDSKSGSVDMLSSKFGVNLNLKTVYRMMDMIDDKQVKKLNKLILTQTKSLLNDTIDVIYFDATTLYFESFTEDIDNQEDINEAIRKNGYSKDGKFNQPQVVLALLVTKQGLPVGYKAFSGDTFYGHTIIPSLKEVEDEFKVDKIVYVADAGMFNKKNLEEFDKNKDMTYIVGAKIKTMSKVFKEQILKTDDFTEINDDTKVKTLDYNGKKLLISYSKKRAKKDKHDREKAIAKLKKRLEESKSVKSSLSNKWIQEVSAALKVVIKTDHVILSFTLYPR

SEQ ID NO: 15971 - DNA, 975 bp, Unknown
  Obtained from environmental sample
  misc_feature (1)..(975): n is a, c, g, or t
ttgatggctcgaggaaagatttcttggcgcctgggtaaacattttagtcagaatttagacggttttgatgttgtatttcgttctccaggttggcctttttttgatccagagatagcgaaagcaaagaaatttggtactctagtaacaaatccaatgagatatttttttgaaatatgtccgtcgcatcgaattataggtgtgaccggaactaagggaaaaggaacaactgctagtttgatatatgctattatcaaaaagagtagacgcagagtttggttgggagggaacattggagtggctccgttttcgtttttttcaaaaattaaaaaaacagattatgtggttttggaattatctagctttcaattagaagacgcagtcgctagcccacatattgcagtgattactaatttttccagagaacatcaaaaagcagccgatcctttgaatccaaattatcacaaatcaatgattagttattggaacgcaaagtcaaatatttttagatggcaaaaattaggtgatagattatttgtaaatagtaaactagagaaaagaaatttcgaagaaggaaattctaaggttgttttttttggtaaatcatttttaaaaacaaaattgcccggtaaccataacaaagaaaatattgcagccgctgtggatgtggctcggtttataaatatttctgaaggagagattgaaaaagctgttggtgagtttagaggactagaacataggattgagatagttcgtgagtataatggtgttaggtattttaatgatagctttgctactattccagagtcaactattattgctataagatcatttaagagttcaataattttgattgcgggaggctctgacaaagagtcaaattttgctagcttagctaaaaacataaagaaaaaagtaaagtttgtagttttaattaaaggcgagggatcaaagaaacttggagatccgttgaaataa

SEQ ID NO: 15972 - protein, 324 aa, Unknown
  Obtained from environmental sample
  DOMAIN (243)...(318): Mur ligase family, glutamate ligase domain
  misc_feature (1)..(324): Xaa is any amino acid
MMARGKISWRLGKHFSQNLDGFDVVFRSPGWPFFDPEIAKAKKFGTLVTNPMRYFFEICPSHRIIGVTGTKGKGTTASLIYAIIKKSRRRVWLGGNIGVAPFSFFSKIKKTDYVVLELSSFQLEDAVASPHIAVITNFSREHQKAADPLNPNYHKSMISYWNAKSNIFRWQKLGDRLFVNSKLEKRNFEEGNSKVVFFGKSFLKTKLPGNHNKENIAAAVDVARFINISEGEIEKAVGEFRGLEHRIEIVREYNGVRYFNDSFATIPESTIIAIRSFKSSIILIAGGSDKESNFASLAKNIKKKVKFVVLIKGEGSKKLGDPLK

SEQ ID NO: 15973 - DNA, 390 bp, Unknown
  Obtained from environmental sample
  misc_feature (1)..(390): n is a, c, g, or t
atggctcggtggttttatgagaacgagctatctattaaaacaactgcaaaaacacaatcaaatatagaaaaaactgtgaatacaaaaattgacataactcaagagcaactagatatcataaaagatattttaaaagcacatttacctcaaaatgcaaaaatttgggtatttggtagccgagcaaaaaaaacagctcgtacctactccgatattgacattgccctagaaaaaacaaacaaaaaaccattcacactaaaagaacaagtaaccctagaaaccgccttcgaagaatccctactaccctacaaagtagatgtagttgatttaaacaacattagcgatagctttcgagggataattgaaaaagatagagttctgttgtctttgtga

SEQ ID NO: 15974 - protein, 129 aa, Unknown
  Obtained from environmental sample
  DOMAIN (33)...(127): Nucleotidyltransferase domain
  misc_feature (1)..(129): Xaa is any amino acid
MARWFYENELSIKTTAKTQSNIEKTVNTKIDITQEQLDIIKDILKAHLPQNAKIWVFGSRAKKTARTYSDIDIALEKTNKKPFTLKEQVTLETAFEESLLPYKVDVVDLNNISDSFRGIIEKDRVLLSL

SEQ ID NO: 15975 - DNA, 354 bp, Unknown
  Obtained from environmental sample
  misc_feature (1)..(354): n is a, c, g, or t
atggcaagaactatactggaaagtgtttgtaagcatatattagatgaactaaatattccatacaatggaaataaagttgagttgcatgaactatatcaaaaaacagcatttgaattaaacttatcaccatcacaacatacagagactgtttttaaacaaattctaggaagctgttctggaattgttagtggtcttggtgctttaagaaataagcttggtgatgctcatggacaaggacgttcacccgtcaaaccagctattcgtcatgctgaacttgctgttaatttatctggttctatggctgtttttttaatagagacatataagcataaagttaataaaaaaaccgattaa

SEQ ID NO: 15976 - protein, 117 aa, Unknown
  Obtained from environmental sample
  misc_feature (1)..(117): Xaa is any amino acid
MARTILESVCKHILDELNIPYNGNKVELHELYQKTAFELNLSPSQHTETVFKQILGSCSGIVSGLGALRNKLGDAHGQGRSPVKPAIRHAELAVNLSGSMAVFLIETYKHKVNKKTD

SEQ ID NO: 15977 - DNA, 576 bp, Unknown
  Obtained from environmental sample
  misc_feature (1)..(576): n is a, c, g, or t
ttggatggtactacagatgggaaacatctcataaagtttatgattgttgataccggaattggtattaacaaagaaaaaatgccgaaactttttaagaagttttcacaaattgatgtatcaacaacaaaacaatatggtggaacgggtttaggccttgccatatcgaagaaattaacagaaatgatgtcgggtgaaattggagttgaaagcgaaattggtaaaggatcaacattctggtttacggcgcttatatccccttcaaacataaattcagaaaatgatattcaggaggaatggaattatcattttgaatatagaaaaggattgaaagtgcttctggccgaagataatgtcattaaccaaaaaattgctatttttaatttaaatcaattgggatttaagaccattgtttcaccaaatggctatgatgctgttaataaatttaaagatgattcatttgatcttattctgatggatattcaaatgccagtaatgaatggttatgatgcttccatggaaatccgtcgtattgaagaaaatacacccggaaaacatccaataccaataattgcataa

SEQ ID NO: 15978 - protein, 191 aa, Unknown
  Obtained from environmental sample
  DOMAIN (109)...(185): Response regulator receiver domain
  misc_feature (1)..(191): Xaa is any amino acid
MDGTTDGKHLIKFMIVDTGIGINKEKMPKLFKKFSQIDVSTTKQYGGTGLGLAISKKLTEMMSGEIGVESEIGKGSTFWFTALISPSNINSENDIQEEWNYHFEYRKGLKVLLAEDNVINQKIAIFNLNQLGFKTIVSPNGYDAVNKFKDDSFDLILMDIQMPVMNGYDASMEIRRIEENTPGKHPIPIIA

SEQ ID NO: 15979 - DNA, 783 bp, Unknown
  Obtained from environmental sample
  misc_feature (1)..(783): n is a, c, g, or t
atggatagagaatcttttaaagagctttgggatacagtaaaatcaaaaaaaccatggacgggtattgtaacaaatatggcaaaagatgggagttcttatgttgttgatacaacagttattcctatacttgatgttgatggagatattgtagagtttattgcagtaagacatgacataacggatttcgagaaaacaaaagagcagttgcaaaatattaataaagtgatgaaaaataaagttgatgaactgtatagcgtaacatcttcactagaagaaaaagctacaagagatgaactcactggactttataatagagcaaaatttgaagagatattttcttatgagataaataaagcgaaacactataataatcaattgagtgttatactctttgatattgatcactttaaaaatatcaatgatacttatgggcatcaagctggagatgtgactttaaaagagctttcaagtttaattacaaaaaatattaaaacaagtgatatatttgctagatggggtggagaagagtttattatacttttaccagatacaaatagagatggagcaatgcaatttgcccaaaaattacgaaaaataataaaagaaaataaattttcagatatagaatatatgacagctagttttggagtagcacaatttgaagaatacgaagataagcttactttatttgaaaaagttgataaagcattatatatagcaaaaaataatggtagagatagggtagaacaaagtctttttaattggtgtgcattaaaaaaataa

SEQ ID NO: 15980 - protein, 260 aa, Unknown
  Obtained from environmental sample
  DOMAIN (20)...(62): PAC motif
  misc_feature (1)..(260): Xaa is any amino acid
MDRESFKELWDTVKSKKPWTGIVTNMAKDGSSYVVDTTVIPILDVDGDIVEFIAVRHDITDFEKTKEQLQNINKVMKNKVDELYSVTSSLEEKATRDELTGLYNRAKFEEIFSYEINKAKHYNNQLSVILFDIDHFKNINDTYGHQAGDVTLKELSSLITKNIKTSDIFARWGGEEFIILLPDTNRDGAMQFAQKLRKIIKENKFSDIEYMTASFGVAQFEEYEDKLTLFEKVDKALYIAKNNGRDRVEQSLFNWCALKK

SEQ ID NO: 15981 - DNA, 537 bp, Unknown
  Obtained from environmental sample
  misc_feature (1)..(537): n is a, c, g, or t
atggatgaattaaaagtaacacccttgaatccatggcataagaatgctggcgcaaacatggctgactttggcgggtttgaaatgcccttatggtatgaatcagggattaaaaatgaacatctttccgttcttaaatcagccggtatttttgataccagccacatgtcgtgtatcaatgtcaatgggaccgactcctttgagctgatacaattttgttttacaagggatatcacaacgctgcagcagggaagatgcggctatggtgcatttctggattcaaagggccattgtatagatgatgccattgtgtataaatttggcgaaaccagtttcatgatttgtgtcaatgccggtatgggcgcccgtattgcagggcacctttcagataacaaaggtgattttcaggttaaaatagaggatttgtctganaaaatcgccaaaatggatatccagggaaaaaattctgccaggattctttccaggatcatcaaaacccctgaaaaggtgtttgataaaatgccttatttttccctttaa

SEQ ID NO: 15982 - protein, 178 aa, Unknown
  Obtained from environmental sample
  misc_feature (1)..(178): Xaa is any amino acid
MDELKVTPLNPWHKNAGANMADFGGFEMPLWYESGIKNEHLSVLKSAGIFDTSHMSCINVNGTDSFELIQFCFTRDITTLQQGRCGYGAFLDSKGHCIDDAIVYKFGETSFMICVNAGMGARIAGHLSDNKGDFQVKIEDLSXKIAKMDIQGKNSARILSRIIKTPEKVFDKMPYFSL

SEQ ID NO: 15983 - DNA, 504 bp, Unknown
  Obtained from environmental sample
  misc_feature (1)..(504): n is a, c, g, or t
atggccggagcatggtatttgctcctggccacaacaagaaataaaactcccataattgcaataccttggacagagtttcatataaaaacaaaaaaggagatttttatgaaagagatcaatgaactgaatctgcctgaagatttaaagtacacagatgaccatgagtggaccggacagaatggcgatattgtcaccattggagcaaatgactatgcccaggaccagctgggtgaaattgtttttgttgaagttcccgaagtcggtgataccttttccaagggagatgaatttggtaatattgagtctgtaaaggcagtttctgaattatatatccctgtttcaggggaggttgtggaagtgaatgaagcattggaagatgcccctgaacttattaaccagtcctgttatgataaaggatggatcatcaaagttaaacttgatgatgtttcagaaatggatacccttatggataaagcagcataccttgaaatgctgaaaggataa

SEQ ID NO: 15984 - protein, 167 aa, Unknown
  Obtained from environmental sample
  DOMAIN (48)...(167): Glycine cleavage H-protein
  misc_feature (1)..(167): Xaa is any amino acid
MAGAWYLLLATTRNKTPIIAIPWTEFHIKTKKEIFMKEINELNLPEDLKYTDDHEWTGQNGDIVTIGANDYAQDQLGEIVFVEVPEVGDTFSKGDEFGNIESVKAVSELYIPVSGEVVEVNEALEDAPELINQSCYDKGWIIKVKLDDVSEMDTLMDKAAYLEMLKG

SEQ ID NO: 15985 - DNA, 564 bp, Unknown
  Obtained from environmental sample
  misc_feature (1)..(564): n is a, c, g, or t
atgagagaccgagttacaaaatttttgactcttacaaaagagctttctatatcactgtttatagttttgtccataacattaggatcactgtatcagttacctccattctcatatattattgactttggtgattatataagtgaagagtgggaagttaaatatggaacacctccatataatcatgcagaacttgacacgatagagatattttgtaaaaaattgagacttgattatcaagatgcactatcaaaattaaagagtagtaatatctcattgaatgagagtgacacacttttagatatcgcaactcataataaaattagtcctaaaaaaatatacaatcttttagttgataaaagcactcatacagctacctttaaaggcagtggcatgggtaataaaacagttgcacaagtgtgtgaaatcagagggcttgatttgaaaagtgtactattgaaactgaaaactcaagggattgaagtagataaaagtgataagtttaaaaacattgctgaaaaaaataacatgaatccgaaggcattattagatttaatagaaaaatag

SEQ ID NO: 15986 - protein, 187 aa, Unknown
  Obtained from environmental sample
  misc_feature (1)..(187): Xaa is any amino acid
MRDRVTKFLTLTKELSISLFIVLSITLGSLYQLPPFSYIIDFGDYISEEWEVKYGTPPYNHAELDTIEIFCKKLRLDYQDALSKLKSSNISLNESDTLLDIATHNKISPKKIYNLLVDKSTHTATFKGSGMGNKTVAQVCEIRGLDLKSVLLKLKTQGIEVDKSDKFKNIAEKNNMNPKALLDLIEK

SEQ ID NO: 15987 - DNA, 564 bp, Unknown
  Obtained from environmental sample
  misc_feature (1)..(564): n is a, c, g, or t
atgttttcgatgtatgatgatgatggattaaattttagaagtactatagataatctttatacagtacatgaagttgctgctagtaaaagaattaaaaatgatacaaatgatgatagaaataatacaaacaacaagtttgatactttttacaaaggtaaaataaaccaagaagccaaaaacaaatataaacaaatagcgaatttagatacaaaaattgaaatatttcatgttgaacaagttatgtcccatacggctattattattaatgataataaaactattggtgaatgttttgagatgatgcaagaaaatgaagtacaacagcttctcattcaagctgataatttcaatcatctcaaaggaatggtaacaaaacatgatattttaaactatcttatgaacaatattgaaactaanaatatcaatcatactccaatatcccaaattacaaaanataaaattatcactacagatcctatatctgatataagaagagtagcaaaaagtatgatagattttaatcccaatgccatccctgtagtagatggggaggaaatattttag

SEQ ID NO: 15988 - protein, 187 aa, Unknown
  Obtained from environmental sample
  DOMAIN (79)...(133): CBS domain
  misc_feature (1)..(187): Xaa is any amino acid
MFSMYDDDGLNFRSTIDNLYTVHEVAASKRIKNDTNDDRNNTNNKFDTFYKGKINQEAKNKYKQIANLDTKIEIFHVEQVMSHTAIIINDNKTIGECFEMMQENEVQQLLIQADNFNHLKGMVTKHDILNYLMNNIETXNINHTPISQITKXKIITTDPISDIRRVAKSMIDFNPNAIPVVDGEEIF

SEQ ID NO: 15989 - DNA, 651 bp, Unknown
  Obtained from environmental sample
  misc_feature (1)..(651): n is a, c, g, or t
ttgagtgattatcttgaacttatcgtttacaaagatattgtggatagatacaatattaccaatagaagtttactaaaaagtttaaataaatattgttttacaaatattgctacactagtgagttttacaaaactttataatgagtttaaatctcaagggtttaaactaagtaaagatacaatctttaactatttatctcatttagaagatgcctatgcaatctttaccttacctatatatagaaactctgtaaaagaggaacaaagaaatcccaaaaaggtttatgctattgataacggctttaaaaagatatatgactatgcaatagataaagatataagtaaactatatgaaaatatcgtttacttacatttgcgaaggcaaactaaggacttgtattattttaaacaaaaccatgaagtagatttttatgcaagaattgaggggaaagagtatcttgtanatgtgagttatataattgataatgagaaaaccagaaaaagagaacttgatggtcttcttgaagctatggattacttttatctagatgagtcatatcttattactaaagatgaagagagtgaggttttgatagaggataaaaaatccatatcatccctttgtataatatctattgaaagagagatttaa

SEQ ID NO: 15990 - protein, 216 aa, Unknown
  Obtained from environmental sample
  misc_feature (1)..(216): Xaa is any amino acid
MSDYLELIVYKDIVDRYNITNRSLLKSLNKYCFTNIATLVSFTKLYNEFKSQGFKLSKDTIFNYLSHLEDAYAIFTLPIYRNSVKEEQRNPKKVYAIDNGFKKIYDYAIDKDISKLYENIVYLHLRRQTKDLYYFKQNHEVDFYARIEGKEYLVXVSYIIDNEKTRKRELDGLLEAMDYFYLDESYLITKDEESEVLIEDKKSISSLCIISIEREI

SEQ ID NO: 15991 - DNA, 846 bp, Unknown
  Obtained from environmental sample
  misc_feature (1)..(846): n is a, c, g, or t
atgaaacgagcacatacaggtgattatagtgcgagaattgatgaatttaatagtggtgaagcaaaaaatgtttcacattggataaatgagcatatgagtaaattgcaaaaaagtttagtaactattgaagataaaattgatatattcctaactgcacataaatcagaaactgtggaagaccctatgatggatgttcaaaatacagttgcaagactagcagatatttataagtttagaaaaacaatagaacatgatgaaagtattagtgatgtttataaaagaattgcaacggtacttgaggataaatttaaactagatgattttaatttcctagaagctgacactacaaataaaaaagttgaagttgtttatgttcataaagcactccaatgtgacccattagctaaaggatgtagagctgatagaacaaatacattagtagactcttgtcaattcaaaaaagtatgtagtgcaaataacgaggaaaatacttatctatgtatcccttattctatatctaatgatatggattttgttataactataaatacgcaatcaagagaggaaaatgaaaaattaagagaaaaattaccttttatacaagattatgtagatgctgctaaacctgaaattgtaagtaaaaaacttatgcaaattcttgaaaaanatgctagcaccgatccttttactgggatatttaatagaaaatatttagaaagatatattgatggttctttatatagtggtatatataaaaatgtaccgtgtggactgatgatgggtgatatagatttctttaaacttatnatgataattatggacctgatattggagatatgcaattaa

SEQ ID NO: 15992 - protein, 281 aa, Unknown
  Obtained from environmental sample
  misc_feature (1)..(281): Xaa is any amino acid
MKRAHTGDYSARIDEFNSGEAKNVSHWINEHMSKLQKSLVTIEDKIDIFLTAHKSETVEDPMMDVQNTVARLADIYKFRKTIEHDESISDVYKRIATVLEDKFKLDDFNFLEADTTNKKVEVVYVHKALQCDPLAKGCRADRTNTLVDSCQFKKVCSANNEENTYLCIPYSISNDMDFVITINTQSREENEKLREKLPFIQDYVDAAKPEIVSKKLMQILEKXASTDPFTGIFNRKYLERYIDGSLYSGIYKNVPCGLMMGDIDFFKLXMIIMDLILEICN

SEQ ID NO: 15993 - DNA, 621 bp, Unknown
  Obtained from environmental sample
  misc_feature (1)..(621): n is a, c, g, or t
gtgctaaaagcaaatatagatttagaagcttcttacagaatcaatgaagaaataagaaaagatgctagaaaacttttcaaaataaaaagaaaagagcttatagatttagtcaatgaaatcattttagaatataagacacacaaaaatatcaataaaaatttaattatagttattgatgatttagaaaaaaaagacgatattgacgagctatttttacaagacatgtctctgttaaatgacctaaatatagttaaaataattactatgcctatttatttacatagaaatgaaaactttccaagtgcgcatataagagaatttggattaaaattaaaaaattataataatactgaaaatataaatgacaaaaaacttttagaagaggttatatcaaaaagattagaagataaagatttaatcacaaaagatgctataaatttagcaataaattatagtggtgctaatttacgacagcttataagacttattaatataggagcagaaaaagtccttagtaatgaaggttccataattaatgaaaaagacataaaagacgctatagaaagaatccaaagagattactcttcaaaagtaatgagcatgaaaactttttttaattaa

SEQ ID NO: 15994 - protein, 206 aa, Unknown
  Obtained from environmental sample
  misc_feature (1)..(206): Xaa is any amino acid
MLKANIDLEASYRINEEIRKDARKLFKIKRKELIDLVNEIILEYKTHKNINKNLIIVIDDLEKKDDIDELFLQDMSLLNDLNIVKIITMPIYLHRNENFPSAHIREFGLKLKNYNNTENINDKKLLEEVISKRLEDKDLITKDAINLAINYSGANLRQLIRLINIGAEKVLSNEGSIINEKDIKDAIERIQRDYSSKVMSMKTFFN

SEQ ID NO: 15995 - DNA, 576 bp, Unknown
  Obtained from environmental sample
  misc_feature (1)..(576): n is a, c, g, or t
ttgttgaaactaaactttattgttatgctaaaaaaaataggtcttgcattgtttgctattttcgtaattattcaattttttagaattgataaaaccaatcctgaagttattgctgaaaatgattttttatatgtcgttggagcttctgatgatgttgctcaaattattaaaacttcttgttatgattgtcattctaacactacccaatatccttggtatagtaatgttgctcctatttcttggtggctaaaagaccatattaatgaagcaagaaaagaacttaatttttctgaatgggaaacttttgaacataagcgtaaactaaaaaaactaaaagaagctgccgaagagttagaggaaaaagaaatgcctttaacatcttatacggttactcatggcgatgctaaattatccgaccaacaaagagaattactaatcaattggtttaaagaaacattaacttattttgaagaaggagaaactactgctgaagaagaaccgaaaagtgaccttaccttggataatggcaaaaaatggattgctaatgttgaaactattggacgtattataacatga

SEQ ID NO: 15996 - protein, 191 aa, Unknown
  Obtained from environmental sample
  misc_feature (1)..(191): Xaa is any amino acid
MLKLNFIVMLKKIGLALFAIFVIIQFFRIDKTNPEVIAENDFLYVVGASDDVAQIIKTSCYDCHSNTTQYPWYSNVAPISWWLKDHINEARKELNFSEWETFEHKRKLKKLKEAAEELEEKEMPLTSYTVTHGDAKLSDQQRELLINWFKETLTYFEEGETTAEEEPKSDLTLDNGKKWIANVETIGRIIT

SEQ ID NO: 15997 - DNA, 501 bp, Unknown
  Obtained from environmental sample
  misc_feature (1)..(501): n is a, c, g, or t
ttgttagcacaagatttaaatctaaaattttcgatttcggcatgcaatagagaaaaaagagccaatgaaactaacggagtggattattactttttgagtacagcggaatttcaaaacaaaatagacaataacgagtttgtagaatgggaagaagtttatcaagatcaatattatggtactttaaaatctgaaattactagaatttgggaagaagggcataatgtaatttttgatgtggatgtagaaggtgggttgagtttaagtaaatattttggtgagaatgcattaaccattttcattcaggcaccaagtatagaagagttagaaaaaaggctaagaagtagaggaagtgaaacagaagaaaaaattcaaaagagactgaaaaaggcaactcaagaaatgagttactctaagtggttcgatgtaattattgtaaatgataatttggaaaaagcccagaaagaaacactcaatattgtaaattcttttttaacgaaataa

SEQ ID NO: 15998 - protein, 166 aa, Unknown
  Obtained from environmental sample
  DOMAIN (16)...(122): Guanylate kinase
  misc_feature (1)..(166): Xaa is any amino acid
MLAQDLNLKFSISACNREKRANETNGVDYYFLSTAEFQNKIDNNEFVEWEEVYQDQYYGTLKSEITRIWEEGHNVIFDVDVEGGLSLSKYFGENALTIFIQAPSIEELEKRLRSRGSETEEKIQKRLKKATQEMSYSKWFDVIIVNDNLEKAQKETLNIVNSFLTK

SEQ ID NO: 15999 - DNA, 303 bp, Unknown
  Obtained from environmental sample
  misc_feature (1)..(303): n is a, c, g, or t
gtggcctcacaaacaaaaacaggttttgttcagaagctaaaactgcataaaccaagctcattcatggagatcagtccaaatgatgcaaaaaagtatggtttaaatgatgaagatgatgtgaaaatcagctcaaaaagaggatcactaattacaaaagtaattgtaagtgaaaatattatagatggtgttatctttgttccaatcacagaaaaaaagatcaactacctaacaaacgatctgttagaccctctctcatatcaaccagattataaccacagtgccgtgaaagttgagaaagtttga

SEQ ID NO: 16000 - protein, 100 aa, Unknown
  Obtained from environmental sample
  DOMAIN (3)...(94): Molydopterin dinucleotide binding domain
  misc_feature (1)..(100): Xaa is any amino acid
MASQTKTGFVQKLKLHKPSSFMEISPNDAKKYGLNDEDDVKISSKRGSLITKVIVSENIIDGVIFVPITEKKINYLTNDLLDPLSYQPDYNHSAVKVEKV

SEQ ID NO: 16001 - DNA, 420 bp, Unknown
  Obtained from environmental sample
  misc_feature (1)..(420): n is a, c, g, or t
atggtagatatgaatattttttcaaaaaatatattaattgtattgatcttcttgggtattacatttttcataatacttggaaatagatattataaaaatgagagtgaacaaatacggctagaatttcaacaagatgtgcaagataaagttctatcaatagatagagagacctctttgaattatgagttattatactcaataaagggtctatttgacagttcagacagtgtaagctcttcagaatttagtacattggcaatttccctattaaacagacataatgatatacaagcactagagtggataccaaaagtagagcataaagatagagtgtattatggaaatgagccaaanaaaatatattctgattttgagtttacgaaaaaagattctcagggtttatgcaaaaaagagaagtaa

SEQ ID NO: 16002 - protein, 139 aa, Unknown
  Obtained from environmental sample
  misc_feature (1)..(139): Xaa is any amino acid
MVDMNIFSKNILIVLIFLGITFFIILGNRYYKNESEQIRLEFQQDVQDKVLSIDRETSLNYELLYSIKGLFDSSDSVSSSEFSTLAISLLNRHNDIQALEWIPKVEHKDRVYYGNEPXKIYSDFEFTKKDSQGLCKKEK

SEQ ID NO: 16003 - DNA, 357 bp, Unknown
  Obtained from environmental sample
  misc_feature (1)..(357): n is a, c, g, or t
gtgaaaaagaaacaccatattagaaaattaaattattatcaggatttttcagaaatattttcaaaaaaaggtatgtttgaattatggtttgctaaaattgataattttcaatatttaaaaaattataaaaagaaatatgatgaggaactcaataataatgaattattgttagaaaaacttcatagtaatggttttaataaagatagaattataaataaaaaaatagaatcagataatttattacactcatataaaaaaaatattatattagctaccaaattaaccacaaaatatccagaaggaaaaattattgcatctggagcaataattaaatatgataatgaaatattcttttga

SEQ ID NO: 16004 - protein, 118 aa, Unknown
  Obtained from environmental sample
  misc_feature (1)..(118): Xaa is any amino acid
MKKKHHIRKLNYYQDFSEIFSKKGMFELWFAKIDNFQYLKNYKKKYDEELNNNELLLEKLHSNGFNKDRIINKKIESDNLLHSYKKNIILATKLTTKYPEGKIIASGAIIKYDNEIFF

SEQ ID NO: 16005 - DNA, 669 bp, Unknown
  Obtained from environmental sample
  misc_feature (1)..(669): n is a, c, g, or t
atgttgaagaacttaaaaaacatactattctttttgttttttcttattttttgcttgaaccaaactcaagctcaaaaccgtgaggatgaaaaaaatcaaattatagaaacaagggtagaatatttgtcagaaacagatgaaaatcctgatgctgattatactacaatttttgatcaactttcatttttttacgacaagccactaaacctcaacagagctgattttgatgatttaagttctctcgacttacttaatgatattcaaattaataacctactcgcccacatagaaaaaaatggcaaattaatgactctagaggagttacaaactattgaaggttttgatatggaaagcattaagctaattttaccctttgtaaaagttagtgccgatatcaatactgctcaacttacttttaaagaacttttaaaaaatggtaacaaccaatattttgttagggtagaaaaggtgttggaagagaaaaaaggctatagtccagctaccgactctgctcttgctgcaagtcctaactctcgttatttaggttctaatgagcgaatttttaatcgttatcgttataaatacggtaaccatgttagtattggctttactgctgaaaaagatccaggagaaggaattttttacaggcactcaaaaaaatggttttga

SEQ ID NO: 16006 - protein, 222 aa, Unknown
  Obtained from environmental sample
  SIGNAL (1)...(20)
  misc_feature (1)..(222): Xaa is any amino acid
MLKNLKNILFFLFFLIFCLNQTQAQNREDEKNQIIETRVEYLSETDENPDADYTTIFDQLSFFYDKPLNLNRADFDDLSSLDLLNDIQINNLLAHIEKNGKLMTLEELQTIEGFDMESIKLILPFVKVSADINTAQLTFKELLKNGNNQYFVRVEKVLEEKKGYSPATDSALAASPNSRYLGSNERIFNRYRYKYGNHVSIGFTAEKDPGEGIFYRHSKKWF

SEQ ID NO: 16007 - DNA, 459 bp, Unknown
  Obtained from environmental sample
  misc_feature (1)..(459): n is a, c, g, or t
atgcaacttgctgtaattgaatttgccagaaatgtttgtagctggaaaaatgcccattctactgaatttaataaaagaaccaaatatccagttatctctcttttagaagagcaaaagaaaattaaaaatcttggtggctctatgagacttggtagttataagtgtgcaattaaaaaaggaacaaatggatttaaagcttatggtaaaacttcagtttctgaaagacatagacatagatatgagtttaactcccaattcaaaagtgaaatgcaaaaaaaaggactggttatctctggaacttctcctgataaaacgctagtagaaatgattgaaattaaaaatcacccatggtttgtagctgtacaatctcatcctgaatttcattcaaaaccagataaggcacatccgctttttaaagattttattaaagcatctataaatataaaaaaatcgaggtga

SEQ ID NO: 16008 - protein, 152 aa, Unknown
  Obtained from environmental sample
  DOMAIN (1)...(144): Glutamine amidotransferase class-I
  misc_feature (1)..(152): Xaa is any amino acid
MQLAVIEFARNVCSWKNAHSTEFNKRTKYPVISLLEEQKKIKNLGGSMRLGSYKCAIKKGTNGFKAYGKTSVSERHRHRYEFNSQFKSEMQKKGLVISGTSPDKTLVEMIEIKNHPWFVAVQSHPEFHSKPDKAHPLFKDFIKASINIKKSR

SEQ ID NO: 16009 - DNA, 624 bp, Unknown
  Obtained from environmental sample
  misc_feature (1)..(624): n is a, c, g, or t
atggagcagattgagaactttataaaagatattacacatgaacttaatacccctataactgcactgaagttaactacttctagagctttaaaaaagggtgtttattctccaaatactctaaaaaatatatcaattagtacaaatcaactttatgacatctatacatctctgacatatttgaattttaaacaagaatttaatgatatcgaggtggatttagctgatattttgaatgaatcgattgaatactattcacaattggcatcatctaaaggtatagagattatctcaaatattgatagcaaaagatttattatagaccatgtaaaagcgaaacttctgttttcaaatttgataagcaatgccataaaatactcatatccaaattcaaagatagagatagagttgaaaaattctatttttaaagtactagattacggcataggaatcgcagcggataagcaagagtttatctttaaaagatttcatagagagagtagctatggaggaggctttggaatagggttagacattgtcaaaaatatttgtgatgagtacggtattaaaattgaagtaaaatcaaaagttgagtgcggaagtacatttagtctgctctttaattaa

SEQ ID NO: 16010 - protein, 207 aa, Unknown
  Obtained from environmental sample
  DOMAIN (3)...(66): His Kinase A (phosphoacceptor) domain
  misc_feature (1)..(207): Xaa is any amino acid
MEQIENFIKDITHELNTPITALKLTTSRALKKGVYSPNTLKNISISTNQLYDIYTSLTYLNFKQEFNDIEVDLADILNESIEYYSQLASSKGIEIISNIDSKRFIIDHVKAKLLFSNLISNAIKYSYPNSKIEIELKNSIFKVLDYGIGIAADKQEFIFKRFHRESSYGGGFGIGLDIVKNICDEYGIKIEVKSKVECGSTFSLLFN

SEQ ID NO: 16011 - DNA, 789 bp, Unknown
  Obtained from environmental sample
  misc_feature (1)..(789): n is a, c, g, or t
atgaacatagacaaacgaatattaaattttttagtaataataggactatcttttgtaactttttggtggactttttttatatttcatttagactttgatataactttagttctaagtgttattactttgcgaagtttatcttcattttttatatttaaagactattcactctcttggagtaaggctactcagaaaacatttttgattaaaagttttgtttatattgtcccttttattttgtatgcaccatattatcatggagagtttcgattcgcttttttagcaagtgagttatttctttatatattttctatcaattttttaatgtatttttattattttgtaataaatagaaaccgaaccacaaaaacaaaacaagttgtaatctatggtgctggtaaagctggtgtaaaacttgatgaagagtttagaaatagtgaatatagggtaaaatattttgtagatgatgatactataatacagggaagaagtatagatggtattaaaattatttctagagatgagttaaaaaacagtatagagaatagaaaactagatttacttgttattgcaataccaagtgcaaaaacagagaatataaatactatttatgatgatttacataattattttaaagatgtacagatactcccatctttagaggatattctaagagataaagatttttcacagcaggaaaaacatatctcagtcgcagatttattggcacgacacccaaaagatttagataagacaaagatatcccaatttattccaataaagttgttt

SEQ ID NO: 16012 - protein, 263 aa, Unknown
  Obtained from environmental sample
  misc_feature (1)..(263): Xaa is any amino acid
MNIDKRILNFLVIIGLSFVTFWWTFFIFHLDFDITLVLSVITLRSLSSFFIFKDYSLSWSKATQKTFLIKSFVYIVPFILYAPYYHGEFRFAFLASELFLYIFSINFLMYFYYFVINRNRTTKTKQVVIYGAGKAGVKLDEEFRNSEYRVKYFVDDDTIIQGRSIDGIKIISRDELKNSIENRKLDLLVIAIPSAKTENINTIYDDLHNYFKDVQILPSLEDILRDKDFSQQEKHISVADLLARHPKDLDKTKISQFIPIKLF

SEQ ID NO: 16013 - DNA, 774 bp, Unknown
  Obtained from environmental sample
  misc_feature (1)..(774): n is a, c, g, or t
ttggcacgacacccaaaagatttagataagacaaagatatcccaatttatttcaaataaagttgtnttagttacaggagctgggggaagtatagggagtgagattgtaagacaatgtttattttttaaagcttctaaaataatattactagaccatagtgaatttaatttgtaccaaatagaacaagagatacaacatttaacaacaattgatattatccctattatgcaatcagttgtaaacaaagaagatttggaaaaaacatttgaaaaatatacgccagatatagttatacacgcagcagcatataaacatgtgccattagtagaacataatatcaaagaatcaatagttaataatataataggaactaaaaatacaatagattgtgctattaagtataatgtggaaaaatttttattgatttcaaccgataaagcagttcgtcctacaaatgttatgggtactacaaagcgtatttgtgagttgtatttacaaaatgtagattcaaaagatacgcaagttgttgcagtgcgatttggtaatgttttaggttcaagtggaagtgtaatacctaaatttagaactcaaatagaagcaggaggtcctataacagtaactcataaagatattacacgatattttatgcttatacctgaagcttgtgaacttgtccttcaagcagcttcaatagggaatagtggtgagatatttatccttgatatgggtaaacctattaaaatagttgatttagcacaaaaaatgatgaattaa

SEQ ID NO: 16014 - protein, 257 aa, Unknown
  Obtained from environmental sample
  DOMAIN (22)...(254): NAD dependent epimerase/dehydratase family
  misc_feature (1)..(257): Xaa is any amino acid
MARHPKDLDKTKISQFISNKVVLVTGAGGSIGSEIVRQCLFFKASKIILLDHSEFNLYQIEQEIQHLTTIDIIPIMQSVVNKEDLEKTFEKYTPDIVIHAAAYKHVPLVEHNIKESIVNNIIGTKNTIDCAIKYNVEKFLLISTDKAVRPTNVMGTTKRICELYLQNVDSKDTQVVAVRFGNVLGSSGSVIPKFRTQIEAGGPITVTHKDITRYFMLIPEACELVLQAASIGNSGEIFILDMGKPIKIVDLAQKMMN

SEQ ID NO: 16015 - DNA, 618 bp, Unknown
  Obtained from environmental sample
  misc_feature (1)..(618): n is a, c, g, or t
atgattattatagcaatttctgcccttatagcaactaccataatagctgctattgttatgtatatgctaggtatgtttgatccagagcctatagaaaaaccaaaagatacaaatagtacagaagaaataaaaaacaatgtagatatagttcaatatgaagctgtaaaaaaagttgattttaaaatgagtgatattaacattcaaagactcaacaataaacttgaactactaacaaaatatcaagtacttacacaagaagaactagaggcacaggctcaagaggaaaaacaaagaataatacaacttaaaaaagaacaactacttatagagtttgcaaaacagaataaagaagaacctctagtaatagaagaaaaagaaactatccctgtaactaatgtcccacaagaaaaaatagaacaacaaacacctcctgctgaagaggtaagcactcctactcttatagaggaaaataaagtacaatctattgaagttaaaaatagtcctatgatagaacataacagtaaattaaaatttgttttagcaaatagtttaaaatataaattatttaaagaattagtattacaaacaaattctactcaagctagaatctcaatatga

SEQ ID NO: 16016 - protein, 205 aa, Unknown
  Obtained from environmental sample
  SIGNAL (1)...(16)
  misc_feature (1)..(205): Xaa is any amino acid
MIIIAISALIATTIIAAIVMYMLGMFDPEPIEKPKDTNSTEEIKNNVDIVQYEAVKKVDFKMSDINIQRLNNKLELLTKYQVLTQEELEAQAQEEKQRIIQLKKEQLLIEFAKQNKEEPLVIEEKETIPVTNVPQEKIEQQTPPAEEVSTPTLIEENKVQSIEVKNSPMIEHNSKLKFVLANSLKYKLFKELVLQTNSTQARISI

SEQ ID NO: 16017 - DNA, 573 bp, Unknown
  Obtained from environmental sample
  misc_feature (1)..(573): n is a, c, g, or t
atgaaaatcattcccaaaaataaaaaactttttattaaattatttaccaaagataaatatgatacgccacttgaaataaaatacagatttatattgtcgggaacagaagaatacaaagaattgccattgaaaaaaatccgtgacacaaaaaatgaaattcttttccgtgcagatgcagaacttaatgacaatgaaaaatatccattcattttgaaagcctcaaagtcctccacttttactgcagcgggaaaaagattctccggtatcagtttccaattcaaaccggaacaaaaaatcccttgggcaatggaaatagaaatgtccttcccattaaacgtcagaaactgggagctctttgttcaggacctgaatacaaaaaggaaatcctcaataataaataaagactggacgggaacagctggngcaaactggcagggagcacgttctcctctggaatttattttttcgaatgacagaataatctggggacgcataagcagcttgaacgaaatgttctggtcaaaagccgatttgaatacgattcgacacccgtattcacttataaatccccct

SEQ ID NO: 16018 - protein, 191 aa, Unknown
  Obtained from environmental sample
  misc_feature (1)..(191): Xaa is any amino acid
MKIIPKNKKLFIKLFTKDKYDTPLEIKYRFILSGTEEYKELPLKKIRDTKNEILFRADAELNDNEKYPFILKASKSSTFTAAGKRFSGISFQFKPEQKIPWAMEIEMSFPLNVRNWELFVQDLNTKRKSSIINKDWTGTAGANWQGARSPLEFIFSNDRIIWGRISSLNEMFWSKADLNTIRHPYSLINPP

SEQ ID NO: 16019 - DNA, 780 bp, Unknown
  Obtained from environmental sample
  misc_feature (1)..(780): n is a, c, g, or t
ttgtatccggcttccacctctcaacagggtccctcttttacagacacccggatggataatcagaagcccgatggctcggtactgacgctttgttacttccatctgtctgtaatatcgccgagactggaagtgcagaagtttttcatagataaccttaaaggtctgaaaaaggactgtgagttcgatggcctatggctcgactcttacaataatttccctttcatgtctctggactattcaataaatcacggagtttcgacatgtaaagctggaatcaatatggtaagggaattccagaaaatagggcttaaggtaataaatgaaggcttttcgccttttggtgcaagaggtgacggtgattcaatacgttatatgaatgaagaagacatggcctccgaaacatcgctattcacctcctggaacaacgtaaaaaaaacagtcccggatcattatttccgtttcttggcgaacaaagcgccgctgacactgccgattgaatatattccggtgataaacagaaaaatgatcgcggacttcaaccggatatataacaccatcgaatccatgatggaaaaaaggataactctagacaatggaaaaggcgttctttgggaaaacgctaaaaacggtataaaaatattttttgctttcaaagacttctacttcaagcacgacaaaaatattgtaattacaaaccttgcgtcgggaaaaatccagaatacggacaaagatttttccgttgaaaaatttgccgtctataaaatagaagtaaaggtttag

SEQ ID NO: 16020 - protein, 259 aa, Unknown
  Obtained from environmental sample
  misc_feature (1)..(259): Xaa is any amino acid
MYPASTSQQGPSFTDTRMDNQKPDGSVLTLCYFHLSVISPRLEVQKFFIDNLKGLKKDCEFDGLWLDSYNNFPFMSLDYSINHGVSTCKAGINMVREFQKIGLKVINEGFSPFGARGDGDSIRYMNEEDMASETSLFTSWNNVKKTVPDHYFRFLANKAPLTLPIEYIPVINRKMIADFNRIYNTIESMMEKRITLDNGKGVLWENAKNGIKIFFAFKDFYFKHDKNIVITNLASGKIQNTDKDFSVEKFAVYKIEVKV

SEQ ID NO: 16021 - DNA, 495 bp, Unknown
  Obtained from environmental sample
  misc_feature (1)..(495): n is a, c, g, or t
ttggattgcaccacttccaggatttttcttcctatttgcatttggtatattacaagctttcattttcatgatgcttacttatgtatatatctctggttcagttatgatggcagaggaagaccactagtagagatacaagtgctcacagaaaaaaaattagaaaaggaggcttttaaaaagcctcctttttttatctcttatcttattactgaccctaaagaatatgggaatacagtaaaaaatttcgaaaaaaattttatacaagctcttacttctcataaagttgatatggtatgttttagagacaaaacaacaccaaacactcaagagctaatacactcttttaaaaccattgcaaaagagtttaaaatagataaaatcatcattaatagtaatattgaacaagctctaaatatacaacttgatggtatacatttaacatcacaacaatttgatacaatcccctatgctaaacaaaaaatctttatacaataa

SEQ ID NO: 16022 - protein, 164 aa, Unknown
  Obtained from environmental sample
  misc_feature (1)..(164): Xaa is any amino acid
MDCTTSRIFLPICIWYITSFHFHDAYLCIYLWFSYDGRGRPLVEIQVLTEKKLEKEAFKKPPFFISYLITDPKEYGNTVKNFEKNFIQALTSHKVDMVCFRDKTTPNTQELIHSFKTIAKEFKIDKIIINSNIEQALNIQLDGIHLTSQQFDTIPYAKQKIFIQ

SEQ ID NO: 16023 - DNA, 756 bp, Unknown
  Obtained from environmental sample
  misc_feature (1)..(756): n is a, c, g, or t
ttggaagatcatgatttttttgcaaaagttttacctgttttgaaaaaatctatcgaagattattctgaaaatgataataatgaagattggtttcctttgttgagtcatagagatgagacattgatttctcgatttaaggcattattttatgctccacttatgcacattggtaaactcaccgaatttgattctaaacaaaattgtctaaaaaatgtcattggcaaaagctatcaaagtagcacattaacgcaatttctctgcggtcttgaacgtgtagacgctggaaatcatatgcttgaactactaattcccctggacaccggtactgtttgctatattgatggacatatgattgctttttggagcaaagaatccatgcataaagggaaaataaccatgcttgggcgaattatgagcggctcgaatgcgttggtagcacacgatgataaggggcgagccatctatattgaataccacccgcctgatattcatatgaccagtgttattttggattattgtaaacatattcgagactccgcaggaattgagctatttattattgacagagaggtcaattctttggaggttgctctggaatttgaccgtaatggtctgggtttgatgtccatgttgngtaaaacgcaatataaatccctgtctgattgggagtacctcaatataggggtacaaaaagatacgggtaaatttactcaggacagtggctggatgaaaaaaaacgcaggcagatccagactt

SEQ ID NO: 16024 - protein, 252 aa, Unknown
  Obtained from environmental sample
  misc_feature (1)..(252): Xaa is any amino acid
MEDHDFFAKVLPVLKKSIEDYSENDNNEDWFPLLSHRDETLISRFKALFYAPLMHIGKLTEFDSKQNCLKNVIGKSYQSSTLTQFLCGLERVDAGNHMLELLIPLDTGTVCYIDGHMIAFWSKESMHKGKITMLGRIMSGSNALVAHDDKGRAIYIEYHPPDIHMTSVILDYCKHIRDSAGIELFIIDREVNSLEVALEFDRNGLGLMSMLXKTQYKSLSDWEYLNIGVQKDTGKFTQDSGWMKKNAGRSRL

SEQ ID NO: 16025 - DNA, 693 bp, Unknown
  Obtained from environmental sample
  misc_feature (1)..(693): n is a, c, g, or t
ttgatatattggcccgaattatacgctgaaagaacagaaattcaagaaaacgctttcaagcgaatgaaaagccatggagccctggaaaccaactatggtatcaaaaaaatatggggaccggatcgacatcagcaacgagcaaatgaagaattagagattaaattagagaaaactgaagaaaaacagcaaaaacaaacagaagatatagatgtacaaaagttaaaagtaaaagaatctgaagttaaaaaccatccaaaaatgttacctattcgtgaaaagaaacttgaagaattagagataaagcttgaagagacgaaacttaaggagcaaaaaatcaaggagggcattaaaaaaaatggtcctcccaaagagagagcagatcgagattaccgaaaacagttgattatgacgactcgcactttaagtttagaaaattgtcttatggggtttttcaacatattattgcaaaatacaaatttgaaaattgggatagatacgtttttagattcattttttgatcgtagtggttcttacttcgaaacaacctctaaaataatttatctcttggaatgtgacggtctatctaagagccttctatcgaaaataaaggccattattaatagctataacgacctaaagctgacacgaaatggaaaaacaatacaagtaagagttaaagagttacctacctaa

SEQ ID NO: 16026 - protein, 230 aa, Unknown
  Obtained from environmental sample
  misc_feature (1)..(230): Xaa is any amino acid
MIYWPELYAERTEIQENAFKRMKSHGALETNYGIKKIWGPDRHQQRANEELEIKLEKTEEKQQKQTEDIDVQKLKVKESEVKNHPKMLPIREKKLEELEIKLEETKLKEQKIKEGIKKNGPPKERADRDYRKQLIMTTRTLSLENCLMGFFNILLQNTNLKIGIDTFLDSFFDRSGSYFETTSKIIYLLECDGLSKSLLSKIKAIINSYNDLKLTRNGKTIQVRVKELPT

SEQ ID NO: 16027 - DNA, 753 bp, Unknown
  Obtained from environmental sample
  misc_feature (1)..(753): n is a, c, g, or t
atgaccaaacgtgtagaggtaaatgacaacattgaagagatagattctataaaaaatgtctttaactctatgcttgattctatagaacatcaattttactacgacaacctaaccggacttcaaaatagaagaaaactaactgagatgttagaactaagaaaatactcattcttaatgattattaatattgattcttttcaagagataaatgatctctatggagatgattccggtgataaactgcttcaagagtttgccaagttcttacagacccttataccaaaagaaggaaaactatatagacttcactctgatgagtttgcgtatctttgtcaacaaggaatggagctaaaagaatttacaacatttgcagctctcattagtgagaaaatctctcaagagagcttttcacttgactctaaaggtgaagcgagtctaagtgccactatcggtatgtcatacggaacagaaatgcttttaataaatgcagacactgctcttgtggttgctaagaaaaaaagaaaaaactacttgctgtatgaggaatcaatggcaatggcaaaagagtatgaaaagaacttcacttggacaaaacgtctaanaaatgctattgatcaggatagaatcgtaccactttttncacccgatgtagactctaaaacacaaaagattgttaagtatgagtctcttatgagaaatagtaatgatgatggcacctatattgccccaattaactttttagaactttgctaa

SEQ ID NO: 16028 - protein, 250 aa, Unknown
  Obtained from environmental sample
  DOMAIN (28)...(177): GGDEF domain
  misc_feature (1)..(250): Xaa is any amino acid
MTKRVEVNDNIEEIDSIKNVFNSMLDSIEHQFYYDNLTGLQNRRKLTEMLELRKYSFLMIINIDSFQEINDLYGDDSGDKLLQEFAKFLQTLIPKEGKLYRLHSDEFAYLCQQGMELKEFTTFAALISEKISQESFSLDSKGEASLSATIGMSYGTEMLLINADTALVVAKKKRKNYLLYEESMAMAKEYEKNFTWTKRLXNAIDQDRIVPLFXPDVDSKTQKIVKYESLMRNSNDDGTYIAPINFLELC

SEQ ID NO: 16029 - DNA, 771 bp, Unknown
  Obtained from environmental sample
  misc_feature (1)..(771): n is a, c, g, or t
ttgctgtatgaggaatcaatggcaatggcaaaagagtatgaaaagaacttcacttggacaaaacgtctaaaaaatgctattgatcaggatagaatcgtaccactttttcaaccgattgtagactctaaaacacaaaagattgttaagtatgagtctcttatgagaatagttaatgatgatggcacctatattgccccaattaactttttagaacttgctaaaagaaacaagctctatcatcaactaacaaagattatgatagataaaacatttgaaaaattcaaaaattcatcttatattgtatctataaatatatctgttgaagacatactaaatagagagatatacaactttatactagaaaaactacttactacccagatgggtgaaagagttgtttttgaaatcatagagtcagaggggatagagaacttcgatgaagttcttgagtttatcaacgaagttaaaaaacattctgctagagtatctatagatgactttggaactggctactcaaacttcgagtacctgatgaagctaaaagttgactacatcaagatagacggttcaatgattaaaaatatagacgtaaacaaagattctcaactcataactcaaacaatagttgagtttgctaaaaaaatgaatataaaaacggtagctgaatttgtttactctaaaaatgtttttgacaaaattgtagaacttgacgtagattatgctcaaggatattattttggagaaccaactccaaatattcttaagatataa

SEQ ID NO: 16030 - protein, 256 aa, Unknown
  Obtained from environmental sample
  DOMAIN (15)...(249): EAL domain
  misc_feature (1)..(256): Xaa is any amino acid
MLYEESMAMAKEYEKNFTWTKRLKNAIDQDRIVPLFQPIVDSKTQKIVKYESLMRIVNDDGTYIAPINFLELAKRNKLYHQLTKIMIDKTFEKFKNSSYIVSINISVEDILNREIYNFILEKLLTTQMGERVVFEIIESEGIENFDEVLEFINEVKKHSARVSIDDFGTGYSNFEYLMKLKVDYIKIDGSMIKNIDVNKDSQLITQTIVEFAKKMNIKTVAEFVYSKNVFDKIVELDVDYAQGYYFGEPTPNILKI

SEQ ID NO: 16031 - DNA, 483 bp, Unknown
  Obtained from environmental sample
  misc_feature (1)..(483): n is a, c, g, or t
atggataatagttggaagaaaataccttcatatgttattgctcctcaaactgcaaaagtggtaaaatctcttggtggaaaattaaaactagttgggaaagaacatcatggagatcagtttgcacaagaaattacaaatgatttaaaagggaaaaaagttctatatgtaggtggtgcaaaagtagtttctaatcttactactatactaaaaaagaataatgtagaatgtgataatttagttatatatgaaacagtatgtaaagaatataaaaagaaaataaaaattcctaaaaattctgcaataattttctcttctccatctactatagagtgttttttaaaaaatgtagaatgggatgaaagttatactgctattagtataggacaaaccactgcaaagtttttcccagactatataaaaccagtgattgcagagaatacttctttagaatcttgtgtaaaaaaagcgttggagttaaagtag

SEQ ID NO: 16032 - protein, 160 aa, Unknown
  Obtained from environmental sample
  misc_feature (1)..(160): Xaa is any amino acid
MDNSWKKIPSYVIAPQTAKVVKSLGGKLKLVGKEHHGDQFAQEITNDLKGKKVLYVGGAKVVSNLTTILKKNNVECDNLVIYETVCKEYKKKIKIPKNSAIIFSSPSTIECFLKNVEWDESYTAISIGQTTAKFFPDYIKPVIAENTSLESCVKKALELK

SEQ ID NO: 16033 - DNA, 300 bp, Unknown
  Obtained from environmental sample
  misc_feature (1)..(300): n is a, c, g, or t
gtgagtataaaaaatgaaacaccattaaaaacactagaagaaaaagtaatatcatttttacaaaaatatgcaaaaaatgaaagagctaagaatattatctctgtccaagttgcacaaacttcgttgatggaaaatcatctttatcaagatttgggttttaaaagtagagtagagatgggaagatttatgaaagaacactttccccttttagcacaaaataaacctcaagataaattatggaaaaaatatatttatgatagcataggggaaattgcccctgctggaactcagccgatctga

SEQ ID NO: 16034 - protein, 99 aa, Unknown
  Obtained from environmental sample
  misc_feature (1)..(99): Xaa is any amino acid
MSIKNETPLKTLEEKVISFLQKYAKNERAKNIISVQVAQTSLMENHLYQDLGFKSRVEMGRFMKEHFPLLAQNKPQDKLWKKYIYDSIGEIAPAGTQPI

SEQ ID NO: 16035 - DNA, 567 bp, Unknown
  Obtained from environmental sample
  misc_feature (1)..(567): n is a, c, g, or t
atgatatgtaatctacatggtccaattatgcgaaataatcctcaaaaatatatagataaatatttaaaatggagtaataaagatgatttacgacatgggaaaaaagttgtttcaatcttctatgtaactagttataaaaatactaaaaatatggcagaaagtatttataatggtattgaatctaatgataatttaatagcaaatatttatgatttaactgctcttgatgaacaaaatatgcttacaattttagaagaaagtactggtattattattggtagcccaacaattaatggagatgtaccaaaacctgtttgggatctattgagttgtatgatgttactagaaaaaaaaggaaaatttggtggttgttttggctcttatggatggagtggagaagcagttgatatgatgaatggaagattaaaaaacttgaagtttagagttcctctagatcctatgaaaataaaacttataccaacaaaagaggaactaatggattgttttgattttggaattgagtttggggaaatagtaaatgggaaaatggtggagatgacactgtga

SEQ ID NO: 16036 - protein, 188 aa, Unknown
  Obtained from environmental sample
  DOMAIN (39)...(172): Flavodoxin
  misc_feature (1)..(188): Xaa is any amino acid
MICNLHGPIMRNNPQKYIDKYLKWSNKDDLRHGKKVVSIFYVTSYKNTKNMAESIYNGIESNDNLIANIYDLTALDEQNMLTILEESTGIIIGSPTINGDVPKPVWDLLSCMMLLEKKGKFGGCFGSYGWSGEAVDMMNGRLKNLKFRVPLDPMKIKLIPTKEELMDCFDFGIEFGEIVNGKMVEMTL

SEQ ID NO: 16037 - DNA, 588 bp, Unknown
  Obtained from environmental sample
  misc_feature (1)..(588): n is a, c, g, or t
atggttgagggatataaaaaaacttcacaagatgtgagtattagaatcaatatttttcaaaagttgttaggtgtaatttttatacttgcttcactatatacactttattatttagtttttacaaaagataatatctttgtagctagtgcaaatatcaagcaagattatgctgcgttacatcaagattttagtaaggagtgtggaagttgtcatataacttacccaccttttttactccctaaaagctcttggactttgatgatgagtgacttggaaaatcattttggagatgatgcgagtatagataaggagacaaatctttctattttgagttttttaaatgaaaatagtgcagaaacatcatcacaaaaagcagcatttaaaatattaaaaagtctcaaagaaaataatagtacaatagctataacaaaaactccttattgggagaagaaacataaaaaaataaataaagatgtttttgcaaatgtgaagataaaatctaaagcaaactgtaaagcttgtcatacagatatacaaaatggacttattgaaaagcatttaataaaagtaccagatattaggggataa

SEQ ID NO: 16038 - protein, 195 aa, Unknown
  Obtained from environmental sample
  misc_feature (1)..(195): Xaa is any amino acid
MVEGYKKTSQDVSIRINIFQKLLGVIFILASLYTLYYLVFTKDNIFVASANIKQDYAALHQDFSKECGSCHITYPPFLLPKSSWTLMMSDLENHFGDDASIDKETNLSILSFLNENSAETSSQKAAFKILKSLKENNSTIAITKTPYWEKKHKKINKDVFANVKIKSKANCKACHTDIQNGLIEKHLIKVPDIRG

SEQ ID NO: 16039 - DNA, 636 bp, Unknown
  Obtained from environmental sample
  misc_feature (1)..(636): n is a, c, g, or t
gtgaaagagcaattaaaataccaaactatggaagatgggatgactaaaagttatatttggcctttgtttaacagagtatcgcatatattaatgatactcttttttgcagcttgttatttattggctgatgatgactatatctcatatcatgttgcttttggactctcttttggagtagttattcttttcagagttatttggggttatcttggaccaaaacattcaaaatttaaagactttaactttaaagttgcagatttaaaagagtatttactatcaccgttttcaaaaacaaaagagtatctagggcacaatccagcatctagctatgcaattatagttatgattattttggcgatactatctattttgtctggacttttatattatggaatagaggaaaatcatggagtattttcatttttaaatagtcaattttttaaaaagatggaactttttgaagagttacatgagctttttgcaaatctattattaggtgttattggtattcatgttgcaggaactttaatagataggtttaataaaaaaggtgatgccctagaatccatggttgatggaaataaaaaaacttcacaggatgtgagtattaaaatcaatattttccaaaagtggtaa

SEQ ID NO: 16040 - protein, 211 aa, Unknown
  Obtained from environmental sample
  DOMAIN (17)...(193): Cytochrome b561 family
  misc_feature (1)..(211): Xaa is any amino acid
MKEQLKYQTMEDGMTKSYIWPLFNRVSHILMILFFAACYLLADDDYISYHVAFGLSFGVVILFRVIWGYLGPKHSKFKDFNFKVADLKEYLLSPFSKTKEYLGHNPASSYAIIVMIILAILSILSGLLYYGIEENHGVFSFLNSQFFKKMELFEELHELFANLLLGVIGIHVAGTLIDRFNKKGDALESMVDGNKKTSQDVSIKINIFQKW

SEQ ID NO: 16041 - DNA, 741 bp, Unknown
  Obtained from environmental sample
  misc_feature (1)..(741): n is a, c, g, or t
atgaatgagttgggtgatgaagcgcagttaattgagacaaaagagatacaaaaaagaggcttgggacgtgaacctctttatgaagttgttgttgccattgatgagcaagatattaaaccaaaaatacaacataaatctgattatagaacaaaaagttctaaacctctgaatgaacaaaaacctcttctgcaagagagtagtgatattttatttaatatatcaaaagcagcttctcagataagtaaaattgctgatgtaacatctaataacagtagtaaaacaacactaaaaagcaaaccaaaagcagaaccatcagagcttaaagagataaaaaaagagatggaaaaacttggagataaagtaaaagttatacaaaatatgttttgggatgagaagtcccaaaatatagatatagctattccttcagaattttctgaaatatatagattagcctctcaaagcggaatgaaaaaagagcatttagacaaaattatgcatttaaccttagagcatatgccatttaaaatgagagagagttcagttactgtaaaacgatattttcaaacacttctacgaaaaatgatacctgttagattagagacacccccctcaaaatcaaacaaaaaagttatgatgttagtaggaccgacaggtgttggaaaaactacatcaatcgccaagttagctgcaagatactcatatctgatggaaaaagacataaagtgggacttgttgttttag

SEQ ID NO: 16042 - protein, 246 aa, Unknown
  Obtained from environmental sample
  misc_feature (1)..(246): Xaa is any amino acid
MNELGDEAQLIETKEIQKRGLGREPLYEVVVAIDEQDIKPKIQHKSDYRTKSSKPLNEQKPLLQESSDILFNISKAASQISKIADVTSNNSSKTTLKSKPKAEPSELKEIKKEMEKLGDKVKVIQNMFWDEKSQNIDIAIPSEFSEIYRLASQSGMKKEHLDKIMHLTLEHMPFKMRESSVTVKRYFQTLLRKMIPVRLETPPSKSNKKVMMLVGPTGVGKTTSIAKLAARYSYLMEKDIKWDLLF

SEQ ID NO: 16043 - DNA, 648 bp, Unknown
  Obtained from environmental sample
  misc_feature (1)..(648): n is a, c, g, or t
atgaaagagcataaatatttttctgattatcaccatttaaatcaaaaaggaagtctgatttttaatgaagatatgctcaaaagattaataaaaaacaaaaaaacaaaattaattccaaatgtacaaagtttaatttcgagcatgaatgattataatatactcagatataaaaatatatattatgcaataccacaaaaattagtaaatgtggatctagaaaatgacgatttatcgaaatttaaaggtattgttataagtaagagtctgtctgatttggaagagaagattaaaaatagtgtgccaattttaatctctagcatatatgattataatatagttaaatatcaaaatcaatattatgcaataccacaaagattagggaaaattgagcttgagcatgatgacttgtcaaaatttaaaagtattattataagtaagcaactatctggtttggaagaagagattaaaaacagtgtgccaattttaatctcaagtataaataattataatattgttaaatatcgaaacaaatattatgcaataccacaaaaattaggaaaagttgattttgtgactgatgacttatcaaaatttaaagggattattatcagtgaagaactatctagtttggaagaagaggtaaaataa

SEQ ID NO: 16044 - protein, 215 aa, Unknown
  Obtained from environmental sample
  misc_feature (1)..(215): Xaa is any amino acid
MKEHKYFSDYHHLNQKGSLIFNEDMLKRLIKNKKTKLIPNVQSLISSMNDYNILRYKNIYYAIPQKLVNVDLENDDLSKFKGIVISKSLSDLEEKIKNSVPILISSIYDYNIVKYQNQYYAIPQRLGKIELEHDDLSKFKSIIISKQLSGLEEEIKNSVPILISSINNYNIVKYRNKYYAIPQKLGKVDFVTDDLSKFKGIIISEELSSLEEEVK

SEQ ID NO: 16045 - DNA, 1005 bp, Unknown
  Obtained from environmental sample
  misc_feature (1)..(1005): n is a, c, g, or t
ttgatctgttcaattgaggcaattttagatggtagagatactcctcctcagtctgcacctgtttattttaacgattttgttaagtttttagagaaatttagcgataaaaattacagaattggtatgatttctggaagattttatataatggacagagataagagatataaaagagttaaaaaagcctatgatactttagttggaaaaaatccagaaagttacaaaacttggaaagagggattagatttaaaatattctaatggagagactgatgaattcattactccttttattttagatggtttttcaccaattgtagataatgatgggatcttcttttttaatttcagagcagacagagcaagagagatttctcatgccttcttagatgaaacttttgaagagtttgatagaggtcaaaagattaatttagcaggttttgtatcaatgacagagtatgaaaagtcattaccaacatctatagctttccctaagaatactttaactgaaacaatgggtgaagttatatctaaagcaggttttaatcaacttcgtatagcggaaactgaaaagtatgctcatgttacattcttttttaatggtggagcagagaagctttttacaaatgaggatagaattttaattccatctcctagagaagtagaaacctacgatgaaaaaccagaaatgtctatttatgaagttacagaaaagttaatagaagcaattaagagtgataagtacaaattaattgtattaaattatgcaaatggtgacatggttggtcatactggtgtttatgatgcagtaatccaagcaattacagctattgatgattgtttaagtaagggtattcctgttgcaatagagcataattatgtatcattaattacagcagaccatggtaatagtgaagagatgtggggatatgaagaaaatgttcctcatactcaacataccacagggtctgttccattatttgttggttattctacaaaaaaaatt

SEQ ID NO: 16046 - protein, 335 aa, Unknown
  Obtained from environmental sample
  DOMAIN (229)...(335): Metalloenzyme superfamily
  misc_feature (1)..(335): Xaa is any amino acid
MICSIEAILDGRDTPPQSAPVYFNDFVKFLEKFSDKNYRIGMISGRFYIMDRDKRYKRVKKAYDTLVGKNPESYKTWKEGLDLKYSNGETDEFITPFILDGFSPIVDNDGIFFFNFRADRAREISHAFLDETFEEFDRGQKINLAGFVSMTEYEKSLPTSIAFPKNTLTETMGEVISKAGFNQLRIAETEKYAHVTFFFNGGAEKLFTNEDRILIPSPREVETYDEKPEMSIYEVTEKLIEAIKSDKYKLIVLNYANGDMVGHTGVYDAVIQAITAIDDCLSKGIPVAIEHNYVSLITADHGNSEEMWGYEENVPHTQHTTGSVPLFVGYSTKKI

SEQ ID NO: 16047 - DNA, 309 bp, Unknown
  Obtained from environmental sample
  misc_feature (1)..(309): n is a, c, g, or t
ttgaaaatgaaaatgttaaatcaaaatataatcatagaatatttaaagcaacataaaacagattttaataaaaagtactctattgagaaaattggattatttggtagttttgctacaaataaaaacacagaaaatagtgatatagatatcgtttatacaacatcatcaaaaggtttgacttttgctcaagtttcacaacttgaagatgaactatctatagaatttggcaaggatatagacttggttaatgaagattttatgaatcctttgattaaaagaaaagctgtaaaagatattatttatgtatag

SEQ ID NO: 16048 - protein, 102 aa, Unknown
  Obtained from environmental sample
  DOMAIN (11)...(102): Nucleotidyltransferase domain
  misc_feature (1)..(102): Xaa is any amino acid
MKMKMLNQNIIIEYLKQHKTDFNKKYSIEKIGLFGSFATNKNTENSDIDIVYTTSSKGLTFAQVSQLEDELSIEFGKDIDLVNEDFMNPLIKRKAVKDIIYV

SEQ ID NO: 16049 - DNA, 507 bp, Unknown
  Obtained from environmental sample
  misc_feature (1)..(507): n is a, c, g, or t
atgtatagagataataatcttatttatatttttactatattagaatcaattgaaaaaatagacctttatacaaaagatttagcagatgatgaagagttttattatgccaacaatcaaatgaattttaatgctgtggttagtttgttgattgctattggtgaagaaaataaaaaaattgatcagcagataaaagatgactatacttttaactggaatgatatatcanaaatgagggataaaatatctcataattatcgtggaataaatccttatatggtgtgggatattattaaaaactcttttggtgagtatcaaaatattcttagagagattttgccaaatatcgatcaatatgaagaggcattggatgatgctttagattcaaatttttatagtcatttagaatatttaaaagataaaaaggaatggaaccccctctgccttcaccctaatgcccttttgggcaaaaaaaaagatgaaaaacgggaacccctattagacttttga

SEQ ID NO: 16050 - protein, 168 aa, Unknown
  Obtained from environmental sample
  DOMAIN (33)...(108): Protein of unknown function DUF86
  misc_feature (1)..(168): Xaa is any amino acid
MYRDNNLIYIFTILESIEKIDLYTKDLADDEEFYYANNQMNFNAVVSLLIAIGEENKKIDQQIKDDYTFNWNDISXMRDKISHNYRGINPYMVWDIIKNSFGEYQNILREILPNIDQYEEALDDALDSNFYSHLEYLKDKKEWNPLCLHPNALLGKKKDEKREPLLDF

SEQ ID NO: 16051 - DNA, 894 bp, Unknown
  Obtained from environmental sample
  misc_feature (1)..(894): n is a, c, g, or t
ttgctaggtgaaaaaataggaaaaaaagtagcagttgtaggaagtggaccagctggtattagtgtggctacttttcttttaagagcaggtattgatgtagatatgtttgaaagagctagtagagctggtggtcttttaacttatggaattccaggatttaaacttgataagtttagagtacaaagaagaattgattggttagttgaagctggtatgaatctttatacagattgtgaaattggaaaagataaatcatttgaagaattagagaaaaattacgatgctgtatttataggaataggtgcaacaaaagggaagaaaactggaatttcaggagaagataacgaaaatgtatatcttgctatggagtttttaacaggaatccaaaaaagaaattttgaagaggaaaatacaaattttatagatgtaaaagataagaatgtagttgtaataggtggtggagatactgctatggactgtgtaagaacatctataagagagggagcaacaaccgttaaatgtctttatagaagagatgaggctaatatgcctggaagtaaaaaagaggttgtaaactcaaaagaagagggtgtggagtttgtatttaatgtgagtccaaaatctattgagtcaaatggtgtaatagttgaacaaacaacaatgagtgaagctgatgaatcaggaagacaaagtgtgaaaatagtgccaaatagtgattatttagaagaggcagatattataatacttgcactaggatttgagcaagagttaccaagctttattaaagaaagtgaattagaactagatagatggaatggattaaaaataaatgaaaaataccaaacatcaaattctaaaatctatgcaggtggagatagtctcgagccgatctga

SEQ ID NO: 16052 - protein, 297 aa, Unknown
  Obtained from environmental sample
  DOMAIN (9)...(297): Pyridine nucleotide-disulphide oxidoreductase
  misc_feature (1)..(297): Xaa is any amino acid
MLGEKIGKKVAVVGSGPAGISVATFLLRAGIDVDMFERASRAGGLLTYGIPGFKLDKFRVQRRIDWLVEAGMNLYTDCEIGKDKSFEELEKNYDAVFIGIGATKGKKTGISGEDNENVYLAMEFLTGIQKRNFEEENTNFIDVKDKNVVVIGGGDTAMDCVRTSIREGATTVKCLYRRDEANMPGSKKEVVNSKEEGVEFVFNVSPKSIESNGVIVEQTTMSEADESGRQSVKIVPNSDYLEEADIIILALGFEQELPSFIKESELELDRWNGLKINEKYQTSNSKIYAGGDSLEPI

SEQ ID NO: 16053 - DNA, 357 bp, Unknown
  Obtained from environmental sample
  misc_feature (1)..(357): n is a, c, g, or t
gtgaatgagacttttttagaaactattaaagctgttgatggagagatatttaatctttcatatcatcagcaacgatacgagagtgttttaaaatcattgggttttagtagttttaaaagtctcagaaattatttgaacccttctgcctctggtctttacagatgccgtttaacttatgaatcaaaaaatatagaagtgacttatcataagtataaaaaaaaagaagtaaactctttaaaacttgtttatgataatgaaattaactacgccaaaaaatcaacttcaagaagtgctattgatagactttttgaaaagagagaaggctgtgatgacatcttaataatcaaaacaatttag

SEQ ID NO: 16054 - protein, 118 aa, Unknown
  Obtained from environmental sample
  misc_feature (1)..(118): Xaa is any amino acid
MNETFLETIKAVDGEIFNLSYHQQRYESVLKSLGFSSFKSLRNYLNPSASGLYRCRLTYESKNIEVTYHKYKKKEVNSLKLVYDNEINYAKKSTSRSAIDRLFEKREGCDDILIIKTI

SEQ ID NO: 16055 - DNA, 471 bp, Unknown
  Obtained from environmental sample
  misc_feature (1)..(471): n is a, c, g, or t
atgttaaaagattttgccaaattacagacttttttaatggtcataaaagagaaaagtttttctaaggcatcagcaaaacttggtatctctcagccggctgttactcaacaaattaaatttatagaagattaccttgatacaagaattgtagagagaaaaaagaatggtattttactaacaaaagaaggtgaagacctttatagaattgcagttaaactagacaaagcaatatcaagtagtgaaagagaacttcttaaaattataaacaaagaatttacttttattatgggttgctcaaatgcaattgggaattatgttcttccaaattatctttcagaaatcaaggaaagaataggaaatgaagtttatatgcacgttgatctatcttcaaagattattgatcagcttgaagagaaaaaaatcgatgttgcccttatagaactcctatttttagagatggataatatatag

SEQ ID NO: 16056 - protein, 156 aa, Unknown
  Obtained from environmental sample
  DOMAIN (5)...(64): Bacterial regulatory helix-turn-helix protein, lysR family
  misc_feature (1)..(156): Xaa is any amino acid
MLKDFAKLQTFLMVIKEKSFSKASAKLGISQPAVTQQIKFIEDYLDTRIVERKKNGILLTKEGEDLYRIAVKLDKAISSSERELLKIINKEFTFIMGCSNAIGNYVLPNYLSEIKERIGNEVYMHVDLSSKIIDQLEEKKIDVALIELLFLEMDNI

SEQ ID NO: 16057 - DNA, 804 bp, Unknown
  Obtained from environmental sample
  misc_feature (1)..(804): n is a, c, g, or t
gtgatggagcattttgaagcctacctcaaaggaaagacctccatatactgcatccaatatcgctgcagatgttctgacggcagttatttgtgggtagaggacagaggaaagatcgtcaagcgtacccctgaaggggaagtagccagaatgatcggggcacacctcgatatcaatgcggttaaaattgcccaggatgagttaaagacacagaacaaactgcttaaaaaagacaaggccatgcttgagacacttgtaaacgaacgtgcaggtgaacttgaacacttgaatatcaaactgcaagagcagctcgaatacaccaactatgttgccagtcatgacaaactcacctcactctataaccgttatatgtttgatgagtctcttgaaaaagagatcaaacgggccaaacgatactcacaccctttgagttttattatgaccgatcttgactactttaaagatattaatgatacctacggccatcagaccggggacaagatcttgatcgaactttccggtattcttcttgaaaatatccgtgatatagacatacttgcacgatggggaggcgaggagtttgtcatgatactcccagatactaatgaagaacaggtccactcgcttgcagaaaaactgcgcatcatcatccagcagcatagctttacgcataacatctctttgacatgcagttttggtgtgacgagctttcatcaagatgatacgaatgatgcgatcttcgcacgtatggacaaagccttgtatcangcaaaagccttgggccggaacagggttcaaagtcaataa

SEQ ID NO: 16058 - protein, 267 aa, Unknown
  Obtained from environmental sample
  DOMAIN (17)...(60): PAC motif
  misc_feature (1)..(267): Xaa is any amino acid
MMEHFEAYLKGKTSIYCIQYRCRCSDGSYLWVEDRGKIVKRTPEGEVARMIGAHLDINAVKIAQDELKTQNKLLKKDKAMLETLVNERAGELEHLNIKLQEQLEYTNYVASHDKLTSLYNRYMFDESLEKEIKRAKRYSHPLSFIMTDLDYFKDINDTYGHQTGDKILIELSGILLENIRDIDILARWGGEEFVMILPDTNEEQVHSLAEKLRIIIQQHSFTHNISLTCSFGVTSFHQDDTNDAIFARMDKALYXAKALGRNRVQSQ

SEQ ID NO: 16059 - DNA, 951 bp, Unknown
  Obtained from environmental sample
  misc_feature (1)..(951): n is a, c, g, or t
ttggatgcttttcaggaaattccagaaatgtcgttgactaaattcaataaaatagcagatgtgctttttgtatttgccaatcaattatctgagaaagcctattctaccgttcaacttgaaaataaaataaaagaaaacgaacaggtaatttacctaaaaaagcaaagtgaagaaaagtttaagtcattgtataataatgctttaatcgcgttgtttcgagtaaatttaaacaatggaagtgccattgaagcaaataattatgctgctgaaatatttggctataattccagagaagaatttttggcaaaatatattagtgtaaaccattattataatcccgaagataggactgcaataattggtcgcttaaaaaaagacgaaaaaattgataaagtgctaatgcatgctaaaaccagagatggagaagaggcgtggcacgaggcattttttcacataaattcagaaaagggttacattgattgcgtggctaccgatgtaacggaaaaaattaaggcacagcgaaactttgaagatagcgaagccaaattttcaaaagcgttttacgaacatcaaactccaatggcaattgttgatgttaacaacggtaaacatgtagatcataatcaaagtttcctcgacttatttgaattttcggaaaaggatattcaagaaaatatgacattttcacatttgccttggaccgattcattaaataaaataaaagtattccatcagtttataaaaggtagcggattaaataattattcaattgattacaaaaacaaatcgggcaaagtaaaaaatattagaatattcgcatctattattaacgatcgtaaaaataatctggctataatttctttattcgancatacacagaacttcagtccactttcgggagtatctcctaataatactcgcttagagacaatatcaatatctgcaatatag

SEQ ID NO: 16060 - protein, 316 aa, Unknown
  Obtained from environmental sample
  misc_feature (1)..(316): Xaa is any amino acid
MDAFQEIPEMSLTKFNKIADVLFVFANQLSEKAYSTVQLENKIKENEQVIYLKKQSEEKFKSLYNNALIALFRVNLNNGSAIEANNYAAEIFGYNSREEFLAKYISVNHYYNPEDRTAIIGRLKKDEKIDKVLMHAKTRDGEEAWHEAFFHINSEKGYIDCVATDVTEKIKAQRNFEDSEAKFSKAFYEHQTPMAIVDVNNGKHVDHNQSFLDLFEFSEKDIQENMTFSHLPWTDSLNKIKVFHQFIKGSGLNNYSIDYKNKSGKVKNIRIFASIINDRKNNLAIISLFXHTQNFSPLSGVSPNNTRLETISISAI

SEQ ID NO: 16061 - DNA, 486 bp, Unknown
  Obtained from environmental sample
  misc_feature (1)..(486): n is a, c, g, or t
atgacaatagcatttttggatagaaaaactttaggtaatgatgtaagtttagaacaatttaatgaacttggaaaagttattatttatgaaactacaaccccagaacaaactcttcaaagagttcaaaatgtagatatcgttgtaacaaataaagtagtaatagataaaaatattatggaaaatagtaatataaaacttgtctgtattgcagcaactgggatgaataatattgatttaaaatttgcagaacaaaaaagtattgaagttaaaaatgtggtcggatattcaacatctagcgtagtacaactcacattatcattcgtattacagtttgtacagaaaattgacttttatgancaatttggaaagtgtgactggagatatagtgatatatttacaaatttaagtaagccattttatgagcttgaaaataaaaaatgggggattatagggcttggtactattggtcttgnncgtgcaaagtag

SEQ ID NO: 16062 - protein, 161 aa, Unknown
  Obtained from environmental sample
  DOMAIN (8)...(94): D-isomer specific 2-hydroxyacid dehydrogenase, catalytic domain
  misc_feature (1)..(161): Xaa is any amino acid
MTIAFLDRKTLGNDVSLEQFNELGKVIIYETTTPEQTLQRVQNVDIVVTNKVVIDKNIMENSNIKLVCIAATGMNNIDLKFAEQKSIEVKNVVGYSTSSVVQLTLSFVLQFVQKIDFYXQFGKCDWRYSDIFTNLSKPFYELENKKWGIIGLGTIGLXRAK

SEQ ID NO: 16063 - DNA, 636 bp, Unknown
  Obtained from environmental sample
  misc_feature (1)..(636): n is a, c, g, or t
gtgtacagatacatctataaaccttatgataataaagagatccatgcagtattatcgaagttctttaaaaagaattattatataaaagagatcaatagaccagaaaaatttattaatgttggggacattgagcaacaagaaaacattgcaaatggtgaagttgaccagatggagtatgagcaagaacttgtagagagttatatagctgtacaccaaaaaacaaatgcgaaaagttttttaaaaagctatgaagattgggcctacagtttagatgatttagatgatttagagttggctttagataaattgatgatgaatcttcttatggaaaatgatttagaaacaactatgccagatattatcaatatactggaaacttataataaatttttatatctatttttagagtttgatgagttaagtaaggttgtttactctattgttatgcttttacgagagattgactataataatatcccaagccaaacaatggtatcaaaactattattgacaactattcaagaccttgttgaatggaaagagaaagtgtttgtatcagaaatagcagaggatatttactatattaatgatcctattttaaatagttatgtacaacttcaagatttactgagttaa

SEQ ID NO: 16064 - protein, 211 aa, Unknown
  Obtained from environmental sample
  misc_feature (1)..(211): Xaa is any amino acid
MYRYIYKPYDNKEIHAVLSKFFKKNYYIKEINRPEKFINVGDIEQQENIANGEVDQMEYEQELVESYIAVHQKTNAKSFLKSYEDWAYSLDDLDDLELALDKLMMNLLMENDLETTMPDIINILETYNKFLYLFLEFDELSKVVYSIVMLLREIDYNNIPSQTMVSKLLLTTIQDLVEWKEKVFVSEIAEDIYYINDPILNSYVQLQDLLS

SEQ ID NO: 16065 - DNA, 333 bp, Unknown
  Obtained from environmental sample
  misc_feature (1)..(333): n is a, c, g, or t
ttgacttcgtgtaaacccggaaccgttatgaataatttggaggatttaatggagatatttttatttaaagttcaggattatacaacagaacttataggccaaaagtacggggatagtggagcttttacaggaggcttttttgttcaacggggtgacgggacaaaatacgaatatgaaaattaccgtgttgaatggagtaaaccccatctccaaactatacataacaaggattatgcagaaatgctttcttttattaaattacaaccttgtgagtttaaaacttatattgataaatcaaaacttattagtgcaattagaaagcacttcgcataa

SEQ ID NO: 16066 - protein, 110 aa, Unknown
  Obtained from environmental sample
  misc_feature (1)..(110): Xaa is any amino acid
MTSCKPGTVMNNLEDLMEIFLFKVQDYTTELIGQKYGDSGAFTGGFFVQRGDGTKYEYENYRVEWSKPHLQTIHNKDYAEMLSFIKLQPCEFKTYIDKSKLISAIRKHFA

SEQ ID NO: 16067 - DNA, 471 bp, Unknown
  Obtained from environmental sample
  misc_feature (1)..(471): n is a, c, g, or t
ttggagtcgaaacttcctatcgtgatcaatcctattttactcaaatctggtcgtggaagttctgcttcacttattgttgaggggaaagtagttcaagataaagatgtacgagaatattatagagatttggacttactaaaaccagctgttgatagatgttttaaatatcttgacagcaaatatgactgtgtcgtgtgtgaaggtgcgggaagtccagtcgaacttaaccttatggacaaagacctctcaaatatctatatagcaaatacctatgatacaaaaataatccttgtagcagatatacaaaaaggtggcgtatttgcttctatttggggtgtatataatcttcttccagaaaaattaagatcaaatgtcataggggtaattgtcaataagtttcaaggagatatgagcctatttgatgaaggtgttagaatcatagaaaaagatttgtatccagtccggccataa

SEQ ID NO: 16068 - protein, 156 aa, Unknown
  Obtained from environmental sample
  DOMAIN (12)...(155): CobQ/CobB/MinD/ParA nucleotide binding domain
  misc_feature (1)..(156): Xaa is any amino acid
MESKLPIVINPILLKSGRGSSASLIVEGKVVQDKDVREYYRDLDLLKPAVDRCFKYLDSKYDCVVCEGAGSPVELNLMDKDLSNIYIANTYDTKIILVADIQKGGVFASIWGVYNLLPEKLRSNVIGVIVNKFQGDMSLFDEGVRIIEKDLYPVRP

SEQ ID NO: 16069 - DNA, 348 bp, Unknown
  Obtained from environmental sample
  misc_feature (1)..(348): n is a, c, g, or t
atgcaaatgaaagggaatgaaacttttaaaatagcagtacgaacactgacttcagatgtacaaaagatcatggaaaagaataattataaaaatgaagatatagatctttttataccgcatcaagcaaactatagaattataaaagctgttggtgatgcattaaagtttgaagataaacaaaaagtattaactgtagaaaaatatggaaatacttcatctgcttcaattcctatggctataaatgagtgtttcgaagatggacgacttgtaaaagggaaaacaatgcttctagatgcctttggtggtgggttgacttggggttcagcaattattaaatttaatggttaa

SEQ ID NO: 16070 - protein, 115 aa, Unknown
  Obtained from environmental sample
  misc_feature (1)..(115): Xaa is any amino acid
MQMKGNETFKIAVRTLTSDVQKIMEKNNYKNEDIDLFIPHQANYRIIKAVGDALKFEDKQKVLTVEKYGNTSSASIPMAINECFEDGRLVKGKTMLLDAFGGGLTWGSAIIKFNG

SEQ ID NO: 16071 - DNA, 567 bp, Unknown
  Obtained from environmental sample
  misc_feature (1)..(567): n is a, c, g, or t
gtgagttttcagtggaactacttctgtggtaaacaatgtacggtaaacattactcaatctacaanagtagaagaggaacaaccgaaaattcatattgccattgctcctaccaaaaacaacgacagactagaatggtttatagaaaaaaccacagaaataggtattaatgaaattacacccattatttgtgctaactctgaaagaaaaatagtaaaacatgaacgcttattaaaaacagctattgctgctatgaaacaatcaggaagggcttttttacttcaaattaatgaagcggttaaactaaaagactttctgaatcaatgtaatgctgagcaaaaattgatagctcattgttatgaagaaaatcaacaacacctaaagaaactttatatcttgagtaaagatgttgtccttttaattggtcctgaaggagattttagtttagaagaagtagaaattgccataaaaaaacataattttatccctgtaagtttaggtaaaaacagactccgaaccgaaactgcaggagtgtatgcctgtaccacaataaaactattgaatgaataa

SEQ ID NO: 16072 - protein, 188 aa, Unknown
  Obtained from environmental sample
  DOMAIN (77)...(184): Protein of unknown function (DUF558)
  misc_feature (1)..(188): Xaa is any amino acid
MSFQWNYFCGKQCTVNITQSTXVEEEQPKIHIAIAPTKNNDRLEWFIEKTTEIGINEITPIICANSERKIVKHERLLKTAIAAMKQSGRAFLLQINEAVKLKDFLNQCNAEQKLIAHCYEENQQHLKKLYILSKDVVLLIGPEGDFSLEEVEIAIKKHNFIPVSLGKNRLRTETAGVYACTTIKLLNE

SEQ ID NO: 16073 - DNA, 909 bp, Unknown
  Obtained from environmental sample
  misc_feature (1)..(909): n is a, c, g, or t
ttgttgatgaatatggatatcgaaaacttcctgtgggttggaactaataagggactgaccaaagtagatatcacaacgtatattactgaaggtaaattaaaaataattaactttgatgttaatgatggcctcccgggtttagaagtttcacaaaattcttcatgtctagattcagaaggcaacctttggttcggtactgttggtggtgtgttaaaagtaaagccctcgtcagttaaaccaagctttttagaaccccaaattaatattaatgatgtaaaagttttgacccaacagccaatcgtagaatacaaaagtataatcaaaaatattcttaaaacagagaaggaatattttgaacttccttacgacaataattcatttacgattgattatgttgggataaacttgactaatccgcaaagtgttaaatacagatacaggttaagtggatctgcctggtctccaatagtttctaaaacttcagtcttttattccaatctttctcccgggaattataattttcaagtaataagtagtaataaaaatggtatttggaattatgaacctgcaaccgttcgttttacaattgttgctccattttggcgaacatactggttttacagttttgtaggtgttttaattttctttgcctttttcactgtgtataaattcagattatctgctatcaccagaaaaaacaaagagcttgaagaacggattaaatttcgattaaaatatgaaaaggaattggaaaaatctgaacaggaattattgaaagctaaagagaaagctgaaagatccgataaattgaaatcagaatttctagcgcaaatgtcacatgaaatccgaacgccaattaattcaattcttaattttaccaatttaataaagagtgatattgngggataa

SEQ ID NO: 16074 - protein, 302 aa, Unknown
  Obtained from environmental sample
  misc_feature (1)..(302): Xaa is any amino acid
MLMNMDIENFLWVGTNKGLTKVDITTYITEGKLKIINFDVNDGLPGLEVSQNSSCLDSEGNLWFGTVGGVLKVKPSSVKPSFLEPQININDVKVLTQQPIVEYKSIIKNILKTEKEYFELPYDNNSFTIDYVGINLTNPQSVKYRYRLSGSAWSPIVSKTSVFYSNLSPGNYNFQVISSNKNGIWNYEPATVRFTIVAPFWRTYWFYSFVGVLIFFAFFTVYKFRLSAITRKNKELEERIKFRLKYEKELEKSEQELLKAKEKAERSDKLKSEFLAQMSHEIRTPINSILNFTNLIKSDIXG

SEQ ID NO: 16075 - DNA, 921 bp, Unknown
  Obtained from environmental sample
  misc_feature (1)..(921): n is a, c, g, or t
atggatttattaaccggtaaaattagcgcccatgatttttttcctaaagaattaggagtttattcaattcattttgagcctgatggtaaaatgttagtcggcacaaataaagggttatatgaagtcttttcaaatcaaatcagtcaaaagttttcaaaaaccatcacttcaagacatgtaataaacaaaatttttaaagatcggaaaggtgtcttttggatcggttccaataaaggattgtttagatatgtaggcaaacatgtcgtcaaatacacaaaagaaaatggattaactgataacaatattacttgtgtaactgaagattctaaaggtaaactgtggataggctcagaacgtgggctagatcagtttgatggacaaaggtttgttgatttttccagcaggaatggtttttctgattctaaactttggaatataattgaagatagggaacgtaatttatggtttgctacagattttggactttatgttctaaaaaacaatgatttttttctttttgataggtttaaagatcgcttgctagatccgtgggttgtttatgaaaatgatgataagagtttgcttgttggaacagatttacaagggttattaaaaattgatggtggtcaggtttctaaaattgaggagaaagtttttacaactaatgccatttttgccataaaaaaggattccgaacaaaatctctggtttggttctgattccggaattataaaatatcaaaatggaatttataaactttttaatggaagtaacggattttgtgatgatgaaaccacttacgncattatgggagatacagatnaaaatattgggtttggaactggataccgtggaatatttaaatataacgggttagagtttaaaaatatcgaaacaaaactaatattgattccgaatcat

SEQ ID NO: 16076 - protein, 307 aa, Unknown
  Obtained from environmental sample
  misc_feature (1)..(307): Xaa is any amino acid
MDLLTGKISAHDFFPKELGVYSIHFEPDGKMLVGTNKGLYEVFSNQISQKFSKTITSRHVINKIFKDRKGVFWIGSNKGLFRYVGKHVVKYTKENGLTDNNITCVTEDSKGKLWIGSERGLDQFDGQRFVDFSSRNGFSDSKLWNIIEDRERNLWFATDFGLYVLKNNDFFLFDRFKDRLLDPWVVYENDDKSLLVGTDLQGLLKIDGGQVSKIEEKVFTTNAIFAIKKDSEQNLWFGSDSGIIKYQNGIYKLFNGSNGFCDDETTYXIMGDTDXNIGFGTGYRGIFKYNGLEFKNIETKLILIPNH

SEQ ID NO: 16077 - DNA, 456 bp, Unknown
  Obtained from environmental sample
  misc_feature (1)..(456): n is a, c, g, or t
atgacaacaaatgaagataacctaaaaaaaataatttcccatgccaaagagtatggttttgtatttccatcaagtgaaatttatgatggacttagtgctgtgtacgattacggacaattaggtgctgaattaaaaaagaatattaaagatttttggtggaaatctatggtgcaaatgcatgaaaatattgtaggtatagatgccgctatttttatgcatcctgaaacttggaaagcttctgggcacgttgatgcgtttaacgacccattgattgacaataaagattccaaaaaaagataccgtgccgatgtgttaattgaagaatacattgaaaaaattcgtttaaaaaacgaaaaagaagtagaaaaagccaaaaacgttttgcagatagctttgacgaaatacattttagagctaccaatccaaaatatttttaagaaatccaggctaaaatag

SEQ ID NO: 16078 - protein, 151 aa, Unknown
  Obtained from environmental sample
  DOMAIN (33)...(143): tRNA synthetase class II core domain (G, H, P, S and T)
  misc_feature (1)..(151): Xaa is any amino acid
MTTNEDNLKKIISHAKEYGFVFPSSEIYDGLSAVYDYGQLGAELKKNIKDFWWKSMVQMHENIVGIDAAIFMHPETWKASGHVDAFNDPLIDNKDSKKRYRADVLIEEYIEKIRLKNEKEVEKAKNVLQIALTKYILELPIQNIFKKSRLK

SEQ ID NO: 16079 - DNA, 684 bp, Unknown
  Obtained from environmental sample
  misc_feature (1)..(684): n is a, c, g, or t
atggtacgaatactgggaaaaatgagcgtattaattgggcacctttcattaggtattgatgaaaaaaactatcgttttcatgatcatgttaaattagctcattacgctaatgctgcttgcgatattgaatttaatttcccaatgggatttaaagaattagaaggaattcactctcgtacagattttgatttaaagcaacacgaaaaacattcaggtaaaaaattgcaatatttcgatcctgaaatcaaccaaaattacgtgccttatgtagtagagacttctattggtttagacagaacatttttggcaatactttcttcggcttataaagaagaaaaattagaagacggttcggaaagaacagtattaaaacttccagcatttttagctccatacaaagcagctgttttgcctttggtaaagaaagatggcctacctgaaaaagcacgtgaaataatggacttattaaaacacgattacaattgccaatatgatgaaaaagattctgttggtaagcgttatagaagacaagatgcgattggaacaccgttttgtattacagttgaccacgaatctcttgaagataacaaagtaaccattagagatagagacactatgcagcaagaacgtgtagctatttcagaagtggaaaatattatcagaaagaagctgactagaaaatag

SEQ ID NO: 16080 - protein, 227 aa, Unknown
  Obtained from environmental sample
  DOMAIN (133)...(223): Anticodon binding domain
  misc_feature (1)..(227): Xaa is any amino acid
MVRILGKMSVLIGHLSLGIDEKNYRFHDHVKLAHYANAACDIEFNFPMGFKELEGIHSRTDFDLKQHEKHSGKKLQYFDPEINQNYVPYVVETSIGLDRTFLAILSSAYKEEKLEDGSERTVLKLPAFLAPYKAAVLPLVKKDGLPEKAREIMDLLKHDYNCQYDEKDSVGKRYRRQDAIGTPFCITVDHESLEDNKVTIRDRDTMQQERVAISEVENIIRKKLTRK

SEQ ID NO: 16081 - DNA, 684 bp, Unknown
  Obtained from environmental sample
  misc_feature (1)..(684): n is a, c, g, or t
atgaagtttgaagatttatttgaatttgaaaaaaataaagtatcttctagacaagatataaagaaacttgaaacaataaattctttagctaatcaacatgcaacttattattttaaagtatttaatgcaattatttcaagtttaaaagatataaaagttagtgaaaaagaaataacacaagttgaacaaaaaaacttctacattgtaatagatgaaataaatagagggaatatatctaaaatctttggagagcttattactttaatagaagaagataaaagggatagttatgaagtaactcttccatactcaaaagagaagtttaaaataccatcaaatctttatatcatagctaccatgaactctactgataaatctatagctactatagatatagcactaagaagaagatttacatttttaaagatgaaaccaaatattgatttagtttcagatatagcaaaagaattatttacaaaactaaatgaacatattacaaaagctataaatgaagattatcaattagggcatagctactttatgaagattaatagtgtagaagatttagagtttgtaaaaaaatataaaatacaacctttacttgaagagtatttttatggagatgaagataactatacaaaagcacttgatattttgaaagtaaatgttaagataaaagaatag

SEQ ID NO: 16082 - protein, 227 aa, Unknown
  Obtained from environmental sample
  misc_feature (1)..(227): Xaa is any amino acid
MKFEDLFEFEKNKVSSRQDIKKLETINSLANQHATYYFKVFNAIISSLKDIKVSEKEITQVEQKNFYIVIDEINRGNISKIFGELITLIEEDKRDSYEVTLPYSKEKFKIPSNLYIIATMNSTDKSIATIDIALRRRFTFLKMKPNIDLVSDIAKELFTKLNEHITKAINEDYQLGHSYFMKINSVEDLEFVKKYKIQPLLEEYFYGDEDNYTKALDILKVNVKIKE

SEQ ID NO: 16083 - DNA, 861 bp, Unknown
  Obtained from environmental sample
  misc_feature (1)..(861): n is a, c, g, or t
atggctcggaagttcaagtatggtttttcagatggaaaactttatgcaggaacagataatggaactgttgagatttttgatataggttcaaatcataaaatacaaactataaaactacctaatataaaagattttatgggagatgtaatacctgcaaagatatattcaatagacctaatagatgataaaatattgatagtatctcaagggatgaaagggtatagaaatatttttatttatgaaaatgaaaagctagaaaaaattattggcattgataacaagatgtttatacaacaagcaagttttatctcatctgatttagttttatttggtttattaagtaaccaagtgggactatatgatacaaaaaagaaaaaagaaaattaccttattcaagtaagtcattcatcattttcacactttatggttagcgaagataaaaatacgtttgctacaacagatgaaagtggaatagtaagagttttacaagtaaaaaacggtcagattataaatcaaccaaaagcattaaatcttgatagagtgtatcaagttgattttaaaaaagggattatattaacagcgggacaagatagaaaagctgtagtatatatgaaaaatagtgcatatagtttagattttgattttttattgtatgcctgtgctttaagtccaaatgcaaaacttggagcagtagcatacaatgaaaaaaatgaggttttagtatttgatattaagaaacaaaaatatctatacaatttaagtgctcaagaagcaacactcacacaaatactgtttataaatgaacaagagatatttgtaagtagtgatagtcaaacaataaattattataaattaaactaa

SEQ ID NO: 16084 - protein, 286 aa, Unknown
  Obtained from environmental sample
  misc_feature (1)..(286): Xaa is any amino acid
MARKFKYGFSDGKLYAGTDNGTVEIFDIGSNHKIQTIKLPNIKDFMGDVIPAKIYSIDLIDDKILIVSQGMKGYRNIFIYENEKLEKIIGIDNKMFIQQASFISSDLVLFGLLSNQVGLYDTKKKKENYLIQVSHSSFSHFMVSEDKNTFATTDESGIVRVLQVKNGQIINQPKALNLDRVYQVDFKKGIILTAGQDRKAVVYMKNSAYSLDFDFLLYACALSPNAKLGAVAYNEKNEVLVFDIKKQKYLYNLSAQEATLTQILFINEQEIFVSSDSQTINYYKLN

SEQ ID NO: 16085 - DNA, 666 bp, Unknown
  Obtained from environmental sample
  misc_feature (1)..(666): n is a, c, g, or t
atgaaagctgagattgaagctaatctaataactattcatggtgcaactcacaacggatcaatagttaaagcaaaagatgcaacaatcaattgtcatagaggaacactctcatcaaatacagcaaagattaaaactctcgaaggcggtactgtccatgccgcaacggtagaagttgatttagccctaggcggagctattcatgctaaaaatgttatagtacacgatgtaagaagtcatcttaaaatatatgcaacagaatctgtgataattcataacatgaagggtgaggataataaaatatattttgattataagcaagttcctactgttatgaaagagttaaacttcatacttcaagatatagaagatttaaaagagaaaattgaggaaacaaaaaaacactcacctcaattgattcctgatatgaataaaaagatgttaaaactaaaaaagatggctaaaaaaattgaagagtctgcttttgatgccactcttgaaatcaaagaaaaagtacaaggtataaatcttattacgttctcttttccaaaagataaatttattgaattcaggactagacctcttatgagttatacaccatttagtattgaatacaataatgaagtagcaactttgaaccctgtaggagtaagtgtagaattagaataa

SEQ ID NO: 16086 - protein, 221 aa, Unknown
  Obtained from environmental sample
  misc_feature (1)..(221): Xaa is any amino acid
MKAEIEANLITIHGATHNGSIVKAKDATINCHRGTLSSNTAKIKTLEGGTVHAATVEVDLALGGAIHAKNVIVHDVRSHLKIYATESVIIHNMKGEDNKIYFDYKQVPTVMKELNFILQDIEDLKEKIEETKKHSPQLIPDMNKKMLKLKKMAKKIEESAFDATLEIKEKVQGINLITFSFPKDKFIEFRTRPLMSYTPFSIEYNNEVATLNPVGVSVELE

SEQ ID NO: 16087 - DNA, 585 bp, Unknown
  Obtained from environmental sample
  misc_feature (1)..(585): n is a, c, g, or t
atgcgttttagtgttgaagagtatgcaaaacattttaaaatgtcaaaagagatggtttattcaaaactaaaatctaatcggttggcttatgttgtggaaggtgatgtcacttatattgttgtaaatgacagtagtggtgcagacaaagaaaacagtgtagaaaataaaataatgattacagatcagcttaaacctaaaaatgttattcctgctaaaaaaacaactactgtgggaactataatttcactatatcaaagagagaacttacaactcaaagagagagtgaaaagtttagaagataaaatagatcgtctaatagacgataaagagaagatgcttcaagaagagagagagagaattgagagagtctacattgcaaaagatgaacaattaaaatctattttggatcttgtaaatacaaaacttcaactaagtagtcatgatactgttcatgatgtaggtattgaagaagaaaataactactctgagatcatacaaacagaagattttattgaggaaaatagatatctaaaatcaataaatgtaaattctcatttgagaaagcagataagaaaacgtttttga

SEQ ID NO: 16088 - protein, 194 aa, Unknown
  Obtained from environmental sample
  misc_feature (1)..(194): Xaa is any amino acid
MRFSVEEYAKHFKMSKEMVYSKLKSNRLAYVVEGDVTYIVVNDSSGADKENSVENKIMITDQLKPKNVIPAKKTTTVGTIISLYQRENLQLKERVKSLEDKIDRLIDDKEKMLQEERERIERVYIAKDEQLKSILDLVNTKLQLSSHDTVHDVGIEEENNYSEIIQTEDFIEENRYLKSINVNSHLRKQIRKRF

SEQ ID NO: 16089 - DNA, 648 bp, Unknown
  Obtained from environmental sample
  misc_feature (1)..(648): n is a, c, g, or t
atgattaaaaaaaatattcaaacgataattgagtatgaagaaaaatcatctaatgatgctcaaatagaagctctacaacaagaattggaaatattagaaaaagaactagttaaaatagatataaaaaagaaaaaacaagaagcagaattgtatataggcaaatactctactgatatgcttaaaacattgccttttgataaaagtgattatggtgatccaaatttgaaatttgatataaaagatgtgacagcttatcaacaatctacaaataacatattctatttatcagatattggtagtgctgaaaatcatttatcatttcatttatctatattcttagggcttcataaatatattttggaacataatcaatcaatactaccgtctttaatatttttagatcaacccagtcaagtttattttgtaaaagaagaagattttaaggatggaacaggtgatattaagaaagttgaagatatgtataaatctataattaaatttattgaggatgcaaataaaacttcaatgtttaataaaatccaaattattgtagttgaccatttttatagtgaagaagaatggtatcaaaaatatttagtagaacctagatgggaaaaagataaaaagcttggattaattaaaggctga

SEQ ID NO: 16090 - protein, 215 aa, Unknown
  Obtained from environmental sample
  misc_feature (1)..(215): Xaa is any amino acid
MIKKNIQTIIEYEEKSSNDAQIEALQQELEILEKELVKIDIKKKKQEAELYIGKYSTDMLKTLPFDKSDYGDPNLKFDIKDVTAYQQSTNNIFYLSDIGSAENHLSFHLSIFLGLHKYILEHNQSILPSLIFLDQPSQVYFVKEEDFKDGTGDIKKVEDMYKSIIKFIEDANKTSMFNKIQIIVVDHFYSEEEWYQKYLVEPRWEKDKKLGLIKG

SEQ ID NO: 16091 - DNA, 462 bp, Unknown; identical to SEQ ID NO: 15925
  Obtained from environmental sample
  misc_feature (1)..(462): n is a, c, g, or t

SEQ ID NO: 16092 - protein, 153 aa, Unknown; identical to SEQ ID NO: 15926
  Obtained from environmental sample
  misc_feature (1)..(153): Xaa is any amino acid

SEQ ID NO: 16093 - DNA, 375 bp, Unknown
  Obtained from environmental sample
  misc_feature (1)..(375): n is a, c, g, or t
atgttatttagaataaatgaaattggattatttcaaaaagaaaaaaaagacattgtaaaatttaatgatgaaataaattttattagcggtgagtcaaacactgggaaaagctcaattggagcgataattaactattgtttaggttcaagtaaaaatattccaggtgctaaaataacaaatgaaccagatattttttcaattaatttaactattgatacccataatgttttaatagctagaaataaatttaatgctacaaaatttaaaggtgaaaaatatatatttttaaaaaaagttaacaatgagttttcattatatgataaagatatgtcattttttgatgacaatccatcagaatacttttacaaaggatga

SEQ ID NO: 16094 - protein, 124 aa, Unknown
  Obtained from environmental sample
  misc_feature (1)..(124): Xaa is any amino acid
MLFRINEIGLFQKEKKDIVKFNDEINFISGESNTGKSSIGAIINYCLGSSKNIPGAKITNEPDIFSINLTIDTHNVLIARNKFNATKFKGEKYIFLKKVNNEFSLYDKDMSFFDDNPSEYFYKG

SEQ ID NO: 16095 - DNA, 831 bp, Unknown
  Obtained from environmental sample
  misc_feature (1)..(831): n is a, c, g, or t
atggattatgacacttcattttttcatggggctcccaacggttctatggggtttttgggttttggcaatatccttggatatgaccactattacggaatgacagaatacagtaacgatgctgattatgacggtatttggggtatttgggatgaaccattccttgactttacggccaacatactctctaaaaagaagcaaccttttatgagtacaatattcaccgtttcatcacacacaccttatataatacctgaaaagtacgagggtaagtttcctaaaggtgatattgatatgcatcaatgtataggctatactgattttgcattgaaaaaattctttgacaaggtttcaaaagaaccctggtatcagaattcgatttttgggataacaggcgatcacagcaaccaaatacgctatagcgaatattctaaaatcgtgaatcgctttggcttgccgcttctaatttttgatccctcgggaaaatattcgggaatagacaataccttggcacaacaaattgatatttatcctactttaatggccgttgccgggtataaaaaaccgtttcgtagttggggcagaagtttaattagtgatacgatacaatcatcctttgtcattacacatacaggaaccaatcttctttttctcaaagatagtcttatctatatgggcaatgaagataaggcactggggctatatcatataaaagacaaggggttgacccataatctaatgccagaaaaagaaaaagaaaccgggcaaatgaaagcaatggccaacgggtttatgcaagattatatgaatcggattatgaaggcccagccataa

SEQ ID NO: 16096 - protein, 276 aa, Unknown
  Obtained from environmental sample
  DOMAIN (1)...(219): Sulfatase
  misc_feature (1)..(276): Xaa is any amino acid
MDYDTSFFHGAPNGSMGFLGFGNILGYDHYYGMTEYSNDADYDGIWGIWDEPFLDFTANILSKKKQPFMSTIFTVSSHTPYIIPEKYEGKFPKGDIDMHQCIGYTDFALKKFFDKVSKEPWYQNSIFGITGDHSNQIRYSEYSKIVNRFGLPLLIFDPSGKYSGIDNTLAQQIDIYPTLMAVAGYKKPFRSWGRSLISDTIQSSFVITHTGTNLLFLKDSLIYMGNEDKALGLYHIKDKGLTHNLMPEKEKETGQMKAMANGFMQDYMNRIMKAQP

SEQ ID NO: 16097 - DNA, 420 bp, Unknown
  Obtained from environmental sample
  misc_feature (1)..(420): n is a, c, g, or t
atgtgggaagatacaaaaactgctacaaatacaccaattgagtgggaaaaagcaaaaaagtattgtaaaaatttacgaataggtgaatttgaagattggcagctcccaactatcgctcagctagataatcttcataaaaatcataaagatgagatatataatggttacggtggagtgttttactggtcaaatgatacagagtctggaaaaaacaatatttggcagtatgcaaaaggtttaaatatagaagatggtgagataataaaatcagttcaagagtttaaagatggacgggttcgatgtgtacgaattatcaataaagatttaccaatacctcaatttgaaatggataacaatgaaactattgaacccatggatacaaacattacacaaaatttagaaagatttttattaaaatag

SEQ ID NO: 16098 - protein, 139 aa, Unknown
  Obtained from environmental sample
  misc_feature (1)..(139): Xaa is any amino acid
MWEDTKTATNTPIEWEKAKKYCKNLRIGEFEDWQLPTIAQLDNLHKNHKDEIYNGYGGVFYWSNDTESGKNNIWQYAKGLNIEDGEIIKSVQEFKDGRVRCVRIINKDLPIPQFEMDNNETIEPMDTNITQNLERFLLK

SEQ ID NO: 16099 - DNA, 558 bp, Unknown
  Obtained from environmental sample
  misc_feature (1)..(558): n is a, c, g, or t
ttgagaaagaatatcaatgaaaatacagatgagataaatctttatgtatataatagtattccattgaaacattatcaagattatctcaaccatgcttttgataaaaaaacagcagtaagttatagaagtgattatctagcaattggtatttataagatgttttatgaagcatttgatatggattctaaatataagatgacagctttaagttatgatgttgataaactgcaaaaagcgtataaaaacttacaaattattcagtggagaattaagtttaataaagataatagtggtaagtatctttttttaacatggcaaaataattggcaaattgaactagaaaaaaaattaaatactcaggctatagatactattaaattagctgatttatattatataaaatcaaagcaagaatcagtgctagatccatcaaataatagttttgaagttatcacatctaaaatgttgttatatttagaacatagtcttattttgttaaatgttgaacctgaagaattagggatagaaactattatgagtattttatttttaatataa

SEQ ID NO: 16100 - protein, 185 aa, Unknown
  Obtained from environmental sample
  misc_feature (1)..(185): Xaa is any amino acid
MRKNINENTDEINLYVYNSIPLKHYQDYLNHAFDKKTAVSYRSDYLAIGIYKMFYEAFDMDSKYKMTALSYDVDKLQKAYKNLQIIQWRIKFNKDNSGKYLFLTWQNNWQIELEKKLNTQAIDTIKLADLYYIKSKQESVLDPSNNSFEVITSKMLLYLEHSLILLNVEPEELGIETIMSILFLI

SEQ ID NO: 16101 - DNA, 906 bp, Unknown
  Obtained from environmental sample
  misc_feature (1)..(906): n is a, c, g, or t
ttggatggtggagagagttttatatttatgttggattatagtggagtttttcctttagcaccgagttatttaaagcatttagagggtagtagtattatagattttcaagatatgaacggacgatttatcattcgagaagagatagatattgttaaaaaaataggctcaggatatctttgggatacatttactcgtccaaattatgatacctctaggcagtttaatcagtttgcatatgtaaaaaatcttggattttataatctttacataggatcatcagagtatttagacattgcagctaaagagatggaagagagcatgttagaaactttaagaaattttgaggctaaaaaaagtaattacttctttgtaatagacaaaagtgctaatgcaataatgttaggagataatagtgagctagagggtaaaaatattctctcaatcagagatagtgatggtaaagagtttgtaaaagatcttataaaaagtgcttgttctgataagccatattttgtaacttataagtggaaaaatcctattagtaaaatgatagagcttaaatactcttatgtaaagtgtgtaccagagagtgattggattataggaagtggtttttatttggatgaattgaatagggatatagaagataagaaaaaagagcttcaaaaaaacaataaaaatgatcttcaatgtattacatacatatcgattattattctttttatatctttgatcttatcatatgttatttcaaaaatggtgaaaagaaagttccaaaactactctaaaagaatagaagctaaatctaaagagtttattgagttgaatcgctcattagaagagagagttgaaaaagaactgctngacttaaagaggcacatgaaaagatgcgcaaaattgcagtga

SEQ ID NO: 16102 - protein, 301 aa, Unknown
  Obtained from environmental sample
  misc_feature (1)..(301): Xaa is any amino acid
MDGGESFIFMLDYSGVFPLAPSYLKHLEGSSIIDFQDMNGRFIIREEIDIVKKIGSGYLWDTFTRPNYDTSRQFNQFAYVKNLGFYNLYIGSSEYLDIAAKEMEESMLETLRNFEAKKSNYFFVIDKSANAIMLGDNSELEGKNILSIRDSDGKEFVKDLIKSACSDKPYFVTYKWKNPISKMIELKYSYVKCVPESDWIIGSGFYLDELNRDIEDKKKELQKNNKNDLQCITYISIIILFISLILSYVISKMVKRKFQNYSKRIEAKSKEFIELNRSLEERVEKELLDLKRHMKRCAKLQ

SEQ ID NO: 16103 - DNA, 636 bp, Unknown
  Obtained from environmental sample
  misc_feature (1)..(636): n is a, c, g, or t
atggtcagaatcggctcgaggcgatcaaacagagttgttggatacagtgccatagcagttactaaaaaaagtgaggacaagtttatgctaaacagtgacgagaaaaagtttttgttaaacctagccagagagagtgttgagaactatattaaatttaataagatatcggtattaacagatttaagtctatcagataacttaagagtaaagtctggtgcctttgtaactttacataaagatggaaggttaagaggctgtatcggcacatttagagcagatactccgctatataatacaattcaacagatggcaatatcatcctcaactaaagatacaagatttaatcctgttactattgatgaattaagcactcttaattatgagatatcagttttaactcctatgaaaaagattaattctattgatgagattgtgttgggaaaacatggaatatatatagttaaagatgggaaaagtgggacttttttacctcaagtagctactgacactagttggacattagagcaatttttaggtcattgtgcacaagataaagcgggtattggttatgagggttggaaaagtgccgacatatacatttatgaggcaattgtatttagtgaaaaagatatataa

SEQ ID NO: 16104 - protein, 211 aa, Unknown
  Obtained from environmental sample
  DOMAIN (33)...(210): AMMECR1
  misc_feature (1)..(211): Xaa is any amino acid
MVRIGSRRSNRVVGYSAIAVTKKSEDKFMLNSDEKKFLLNLARESVENYIKFNKISVLTDLSLSDNLRVKSGAFVTLHKDGRLRGCIGTFRADTPLYNTIQQMAISSSTKDTRFNPVTIDELSTLNYEISVLTPMKKINSIDEIVLGKHGIYIVKDGKSGTFLPQVATDTSWTLEQFLGHCAQDKAGIGYEGWKSADIYIYEAIVFSEKDI

SEQ ID NO: 16105 - DNA, 990 bp, Unknown
  Obtained from environmental sample
  misc_feature (1)..(990): n is a, c, g, or t
atgctgaatcaaaagcaaaaggttctaagattatcgggaaaattcaatactctggtagcttctagaagtggaaatttacttgatcaaaaagcgattatagaagctcaaacctgtattgattattgggagagtatcctatcatcaacacaagaaagatacctctgggctgttcattataatctagctattgcttatagctggatcttagatgcagccaatgctgaagtgcacatcatgaaagttgctgaactcaatagtgaaatttttgataacatcaaaaccaagaaaggttcatttaccggtggagatttaaaaattttggaagcttataacattggtcagccttttagcatgtattatgcaaaagggatcaacaagtatccaactatagtagcaatgcttgatattgatgcttatcgtgtagctcatacaatggctatcaaccaacttattgctaatgttatagatttacctgtttcacttcctttataccctgtagagaaaaagactggtatgaaaaaatgtgaaggatctataaaattccaaaataatgctatagctaatttcagctatgatcttaagaaaggtaaaatggaatcacttcagatcaaaggtgtgaagaaaacaaaacttgatgatcttaaacaaactttttctgtaacaaaaactgcagacttacatcctagtgagcaacgtagagtttattataattcagatatggggagtgtaagaggaaactatggcctagcagctggtcctcagattttcttanattcctacaaagctaanacccataacctgatgcctgcttaccgtctagaagataaaaacatccataaaagagaacagcaaatcgaggggagcttcttggaacacaatttactaatagttacttcgttgaagaatcattggtttctggtggagaatggcttttataataatttgagattggtgattctatgtacgtatcaatttgtgctgaaaatacca

SEQ ID NO: 16106 - protein, 330 aa, Unknown
  Obtained from environmental sample
  misc_feature (1)..(330): Xaa is any amino acid
MLNQKQKVLRLSGKFNTLVASRSGNLLDQKAIIEAQTCIDYWESILSSTQERYLWAVHYNLAIAYSWILDAANAEVHIMKVAELNSEIFDNIKTKKGSFTGGDLKILEAYNIGQPFSMYYAKGINKYPTIVAMLDIDAYRVAHTMAINQLIANVIDLPVSLPLYPVEKKTGMKKCEGSIKFQNNAIANFSYDLKKGKMESLQIKGVKKTKLDDLKQTFSVTKTADLHPSEQRRVYYNSDMGSVRGNYGLAAGPQIFLXSYKAXTHNLMPAYRLEDKNIHKREQQIEGSFLEHNLLIVTSLKNHWFLVENGFYNNLRLVILCTYQFVLKIP

SEQ ID NO: 16107 - DNA, 483 bp, Unknown
  Obtained from environmental sample
  misc_feature (1)..(483): n is a, c, g, or t
ttgggacaccaatttactaatagttatttggttgaagatccattggtttctggtgaggaatggctttataataaatttgagatgggtgattctatgtacgtatcaatttgtgctgaaaataccattctaaaagcagaagctttgaatattgctgagaatggtattccaactcaatataaagtaagcatggatgtaaaaaatgctaaactaagtcttgatgcacatatcaaagcaaagtttggcgaaactacttctcatgagagctctcgtagatctcgtatgcaatctaaacttggaccgattgctcgtaagatgattatggatcacctcattgaagtaactgaagattttacccaaaatgataaaaagttgagctttgtatattcagatacatatgatctgaatgttacaaatgacagcaagggtaattggacaaacatcgaaatcggtgaatacactatcactcgtgagattaaatactaa

SEQ ID NO: 16108 - protein, 160 aa, Unknown
  Obtained from environmental sample
  misc_feature (1)..(160): Xaa is any amino acid
MGHQFTNSYLVEDPLVSGEEWLYNKFEMGDSMYVSICAENTILKAEALNIAENGIPTQYKVSMDVKNAKLSLDAHIKAKFGETTSHESSRRSRMQSKLGPIARKMIMDHLIEVTEDFTQNDKKLSFVYSDTYDLNVTNDSKGNWTNIEIGEYTITREIKY

SEQ ID NO: 16109 - DNA, 972 bp, Unknown
  Obtained from environmental sample
  misc_feature (1)..(972): n is a, c, g, or t
gtggttcagaatcggctcgagctaagagtttcagaagatgtgatctctgtaattacatccatagcacacccatcactttttacacatattaaagctggtacattagtaatttgtgagagaccatttggatataccagatattttggatttgatgagtatggctatttagggatcggcatgagcgctgcaaatatggcatttgaacttgtgtatcatgcgaagtttgaaaattgtatcttgataggacaagatctctcttatggtaaagatggaaaaagccatagcgatggacacttgtatggacgaaatgataaaaaaagaagagacgatgatatggaagttgtcgcttacggtggagagggttttgtaaaaacaagtagagtatggaacctttttagaaacttttttgaatcagacatcgtagtagcaaatcaagatggcttgagggtgattaactctactgagggtggtgcgagaattgaaggtactatagagcttccgtttaaaaaagcgatagaagaggctgtagatttagagtttaaaaaagagttgattacactggatataccttccgaagatgatatagaaaaaaaacaacagattgcccaagataagatagatgagatgatatcttatggcacaaagctgcaaaaagatgtagaagagttatttagcgaagtgatgaaagagtgtgaagccatagaagaggtagatgggttaaataatcttgaaaaagtagattatgagtcattagctgctactatggaaaaactagatgtggtaaaagcacactttgatgagcaaaagtttgtagatatcttcatagatgccacacaagccatgatagtccacccagaactaaatctcgcaaaacttcaagtaagagatgtgaaacctgatgatgatagacgaaaaaagatgatccatgggtttttgccccccgtttttggctcctctcccttgctggcatga

SEQ ID NO: 16110 - protein, 323 aa, Unknown
  Obtained from environmental sample
  misc_feature (1)..(323): Xaa is any amino acid
MVQNRLELRVSEDVISVITSIAHPSLFTHIKAGTLVICERPFGYTRYFGFDEYGYLGIGMSAANMAFELVYHAKFENCILIGQDLSYGKDGKSHSDGHLYGRNDKKRRDDDMEVVAYGGEGFVKTSRVWNLFRNFFESDIVVANQDGLRVINSTEGGARIEGTIELPFKKAIEEAVDLEFKKELITLDIPSEDDIEKKQQIAQDKIDEMISYGTKLQKDVEELFSEVMKECEAIEEVDGLNNLEKVDYESLAATMEKLDVVKAHFDEQKFVDIFIDATQAMIVHPELNLAKLQVRDVKPDDDRRKKMIHGFLPPVFGSSPLLA

SEQ ID NO: 16111 - DNA, 855 bp, Unknown
  Obtained from environmental sample
  misc_feature (1)..(855): n is a, c, g, or t
atggcagaaatttttttacagaatgccgataatttagtgaattttgattatgaacaattagattttccagatgaatggcaatatcaaaacgaacaaaacagttttcaaatacgaaatgctactataccgggcaaactgttatatactgttttgaaaggcaatatgatttttgaagatgccattcaatccaacaaaatattagaaaaggtgtatcatagtggtggcataaaaaactgtaatattttgaaaatagtagattctacagatgttcgtcatgctagctttcgtgctagaaaagattattcacaaaaattagtggcattaaataataaatataaatgtaatataaaaaatacatttatttgcggtgcgaatattatgataaaagcagctttgatgttattccatggttctctctcaagtaattatgtttttgttgatactgtagaggaagcttttgacagaatcaataaaaaaagcattgtaaatcccagtaaaaagaaagtagtagtaaaacaacaacatatttcggatcttatttcattgtgtggaaatatgttatgggaaaataagtcatcaatcaaaataccaattgacagcccattaagtgatctggaatttgtaatagatctgctcaaagatgattttaatgaattgcgaaaaaacgatttagaacaaacgcaaaacctcattactatctttgaatcaatccaggtaggtttgattattgttgatcgccaaactcatgtgatcatttatgcaaattctactgccgccttcatggctaaaacccacgatgatcatttaatcgatcaatcctgccatagttntatttgtccggctgaagaaaggtag

SEQ ID NO: 16112 - protein, 284 aa, Unknown
  Obtained from environmental sample
  misc_feature (1)..(284): Xaa is any amino acid
MAEIFLQNADNLVNFDYEQLDFPDEWQYQNEQNSFQIRNATIPGKLLYTVLKGNMIFEDAIQSNKILEKVYHSGGIKNCNILKIVDSTDVRHASFRARKDYSQKLVALNNKYKCNIKNTFICGANIMIKAALMLFHGSLSSNYVFVDTVEEAFDRINKKSIVNPSKKKVVVKQQHISDLISLCGNMLWENKSSIKIPIDSPLSDLEFVIDLLKDDFNELRKNDLEQTQNLITIFESIQVGLIIVDRQTHVIIYANSTAAFMAKTHDDHLIDQSCHSXICPAEER

SEQ ID NO: 16113 - DNA, 804 bp, Unknown
  Obtained from environmental sample
  misc_feature (1)..(804): n is a, c, g, or t
atggtaaatctggttaaaaatcgagctgggttattcctttcagaagatggtaaaccacgttttaaaggtattcttcacggtgataaatcagagaagaaacagggtgaaaactttgcaattgattcttctcaactgcaacaggaacaaataaaagtgaagaagcgagagatctaccgtggcaggaagaaaatagaaaatctatctgccagcaaaggaaggataattcgctactcatccagatctaaccaagaaactccagctgtactacccacccttaaagcggcaattcaagcaaaacattataatctgcagaaccgccagtttaatctgcataaatctgatttccgctaccctgagaagaaacagcaattacgtcacaatatcttgctggtactggattccagtaagtctatcagctgggtaatcccgcacatcgagaaattcattcccatcctcacttcccgggtaagccagagcaaagacctacttggcctaatctgcttcaataatgatctggcacggatttatcatcatcctaccagaaatgttaaagaggttgtaggaacgataaacaagttggaagtcgagggtcttacgcctttaggtaaaggttttgaacttgctttgcaaacctttcnaatgcagcgatttcaacaacccggcatgaagaacttgatcctattgatttccgattgtttcccggaacctgtagagggtggccatgaggacatgctggaggaaccatcataccagttggtgatcaagaatgctcatcaaatcaggatagtaaaatccgacttatga

SEQ ID NO: 16114 - protein, 267 aa, Unknown
  Obtained from environmental sample
  misc_feature (1)..(267): Xaa is any amino acid
MVNLVKNRAGLFLSEDGKPRFKGILHGDKSEKKQGENFAIDSSQLQQEQIKVKKREIYRGRKKIENLSASKGRIIRYSSRSNQETPAVLPTLKAAIQAKHYNLQNRQFNLHKSDFRYPEKKQQLRHNILLVLDSSKSISWVIPHIEKFIPILTSRVSQSKDLLGLICFNNDLARIYHHPTRNVKEVVGTINKLEVEGLTPLGKGFELALQTFXMQRFQQPGMKNLILLISDCFPEPVEGGHEDMLEEPSYQLVIKNAHQIRIVKSDL

SEQ ID NO: 16115 - DNA, 945 bp, Unknown
  Obtained from environmental sample
  misc_feature (1)..(945): n is a, c, g, or t
atgctgggacgctgttttataggttatcatcttgctttgaaattattacaaagaggtgatgaggttataggacttgataatatcaatgactattatgatgttaacttaaaatatgcaagattatctaaattgggtatattaaaagagaatattaaagaaaatattcttatatctagtcataagtatccaaatcataagtttatcaaaattgatttatcagataaaaagtttattgataaattatttaaggctgagaagtttgattctgtatgcaacttagcagctcaagcaggagttcgttatagtcttgaaaatccaaatgcgtatattcaaaataatgtggtggggtttatgaatatattagaggcttgtcgttattttggtgtaaaaaacttatcttatgcttcatcatcttcagtatatggattaaataaatcacaaccttttaaaacaacagatattacagatacaccagcaagtttatatgctgccacaaaaaaatcaaatgaattaatggctcatacctattctcatctttataatattgcaactacaggattacgattttttacagtttatggtccatggggaagacccgatatggcacctatgctttttagtgatgcaattttaaataatagggctataaaagtatttaatcaaggagagatgagtcgtgattttacatatatagatgatataataagtggaatagtgaaagtaatagataatccaccattgaagctatgtacaccttttaagatttataatattggaaataattcacctgtaaaattgctagattttataaaaactcttgaaaaatatttaggtaaagatactcaaaaagaatttttaccctatgcagatggagatgttgtttccacatacgcggatgtaacagaacttattgatgatttaattataaacctagtacatctttaa

SEQ ID NO: 16116 - protein, 314 aa, Unknown
  Obtained from environmental sample
  DOMAIN (1)...(314): 3-beta hydroxysteroid dehydrogenase/isomerase family
  misc_feature (1)..(314): Xaa is any amino acid
MLGRCFIGYHLALKLLQRGDEVIGLDNINDYYDVNLKYARLSKLGILKENIKENILISSHKYPNHKFIKIDLSDKKFIDKLFKAEKFDSVCNLAAQAGVRYSLENPNAYIQNNVVGFMNILEACRYFGVKNLSYASSSSVYGLNKSQPFKTTDITDTPASLYAATKKSNELMAHTYSHLYNIATTGLRFFTVYGPWGRPDMAPMLFSDAILNNRAIKVFNQGEMSRDFTYIDDIISGIVKVIDNPPLKLCTPFKIYNIGNNSPVKLLDFIKTLEKYLGKDTQKEFLPYADGDVVSTYADVTELIDDLIINLVHL

SEQ ID NO: 16117 - DNA, 711 bp, Unknown
  Obtained from environmental sample
  misc_feature (1)..(711): n is a, c, g, or t
atgaataaagagatctcagatatgacagttaatatagatgagttatcagaaacattaaatgtgcttttacatcaagtttctgatggtttaaccgtattagttaaagatgctcaagataaagaaatcacttatttagtagagcctaaatattttaaaaaactatctgaggataaatctgaattagtagaaagaaacagaacattaagccaaaatttaaaaaaacatattcgagaaaataattgtaaacttccaaatccaaatcaactgacagatgctcaaaaatctcttatacagataaagaacaaactacctttttttagctcatgcagcgacatggaactaatcagcgttgtaaataatgtaagaatcttaaaactagatcctgaagagaaagtttttttacaaagtgaaactactaaaaatatatattatgttgtaaaaggctccattgatatctataaacaactaggtgaaagcagaaagggaaagcttctaggcactattaaagcaaaagatttttttggtgaaatgtcatttattactggtgagccaagaactgcaactgctcaggtctccaaaaattcaccgacaatacttgtaagctttgaaataatagagaatgtcgagagtaacaaagagtatatttttacaagaatttatcacaactttttaaaatcattatctaaaaagctgacaaacactatctactaa

SEQ ID NO: 16118 - protein, 236 aa, Unknown
  Obtained from environmental sample
  DOMAIN (120)...(214): Cyclic nucleotide-binding domain
  misc_feature (1)..(236): Xaa is any amino acid
MNKEISDMTVNIDELSETLNVLLHQVSDGLTVLVKDAQDKEITYLVEPKYFKKLSEDKSELVERNRTLSQNLKKHIRENNCKLPNPNQLTDAQKSLIQIKNKLPFFSSCSDMELISVVNNVRILKLDPEEKVFLQSETTKNIYYVVKGSIDIYKQLGESRKGKLLGTIKAKDFFGEMSFITGEPRTATAQVSKNSPTILVSFEIIENVESNKEYIFTRIYHNFLKSLSKKLTNTIY

SEQ ID NO: 16119 - DNA, 426 bp, Unknown
  Obtained from environmental sample
  misc_feature (1)..(426): n is a, c, g, or t
ttggcaaatgaaaatttagaaatagaaacatttgagaaaagacttaaccatgaagaatattataaggaaatgactacttctcatattcttctctctcctatgagtataaacacgaaagtactattttttaaagcagtatatggtcagacaaaggtctccggcattgaagatgatattgtaagatttcaaaaatcagtgattcttccagaaaattatcatcattcacaacatgtgaagcaacttgttcttaagtacaagaatgaatcagagctttgtgaattgttgttaaaactaattaataatgaaattggaattttatatccggaagaaattctgaaattgttttttgataatgaacactattctttggaatgggcaataaataattttaaaaaaatagtccctcaatataattatgttaaataa

SEQ ID NO: 16120 - protein, 141 aa, Unknown
  Obtained from environmental sample
  misc_feature (1)..(141): Xaa is any amino acid
MANENLEIETFEKRLNHEEYYKEMTTSHILLSPMSINTKVLFFKAVYGQTKVSGIEDDIVRFQKSVILPENYHHSQHVKQLVLKYKNESELCELLLKLINNEIGILYPEEILKLFFDNEHYSLEWAINNFKKIVPQYNYVK

SEQ ID NO: 16121 - DNA, 549 bp, Unknown
  Obtained from environmental sample
  misc_feature (1)..(549): n is a, c, g, or t
ttgacgatattaaaacattttgaaataggagttagaatggctattttacacgattttgaatatgaaaagccaaatgatattaatcaagcattagaattactatctaagtacaaaaaaaaagcaaaaattttagctggcggaacggatctcgtagttcgcctaaaagaaaatcttactaaaccagatattgtaattgatgttaaaggtttagcagttttgaatgaattggaaatcacaaaagaaaacatttttataggtgcgggtattacattcacaaatcttatagaatctgaagatataaaacaaaaactcccaatattacatgaatcaagtaaaaaagttgcatccgtgggagttcggaatagagcaactgtagttggaaatatctgctctgctgtaccaagtctagactcaggtccagctttattggtttataatgcagaaattttagttcaaaatttacaagggaaaagaactataagcattcacgattggtttactggagtaaagaagacttgcctaaagcctgatgaactagttttaggataa

SEQ ID NO: 16122 - protein, 182 aa, Unknown
  Obtained from environmental sample
  DOMAIN (17)...(182): FAD binding domain in molybdopterin dehydrogenase
  misc_feature (1)..(182): Xaa is any amino acid
MTILKHFEIGVRMAILHDFEYEKPNDINQALELLSKYKKKAKILAGGTDLVVRLKENLTKPDIVIDVKGLAVLNELEITKENIFIGAGITFTNLIESEDIKQKLPILHESSKKVASVGVRNRATVVGNICSAVPSLDSGPALLVYNAEILVQNLQGKRTISIHDWFTGVKKTCLKPDELVLG

SEQ ID NO: 16123 - DNA, 843 bp, Unknown
  Obtained from environmental sample
  misc_feature (1)..(843): n is a, c, g, or t
ttgttaatgagcttacagagtttatacctcacttgcaaatggctgattttcaggaggagatccattttattttcaatatactacgatatctgggaaaatattcagaaattaaatcccaattgtcagatattaattactacaaatgcaaatacaatgcctgaacgcattgaaaatatgcttctaaaacataaaaacatacattttaatatatcgctcgacagccttgataaaacacattacgaagaaattagaaagaatgcaatctatgaagatgtaataaagaataccaaacgatttattagctattgtaaacaacacggtacgtcatgtaatcttttagtatgcccacttacaattaattgcaaagattttagagaaattattgaatttgctaacacacacgatatttgtgtttattttcatacagtagtaaaaccagaaaccttatccttaaagtatcaatcagaagatttccttaaatatttattggaacacttaaaaacttatacgccagaaacaaaaacgaacaaccaaaagacaaatgcaaataactatcaaagtcttataaaactaattgaaacatggtggaatgagttgtctattaagattgaaaaatctgaagagaatattgcagatgagatcatacttaataagcttaaagcacaaatttcgaaaaagacatttaatcggctattacaatatatcgataattacaaatctcactcatcgtatagtaattttttgcaaaaattgcataaagtaaggactagtgaattggagcatatattaaaaacttcaaccgatgaagaaattaaacaaatgatagaaaaaatgcttatttaa

SEQ ID NO: 16124 - protein, 280 aa, Unknown
  Obtained from environmental sample
  misc_feature (1)..(280): Xaa is any amino acid
MLMSLQSLYLTCKWLIFRRRSILFSIYYDIWENIQKLNPNCQILITTNANTMPERIENMLLKHKNIHFNISLDSLDKTHYEEIRKNAIYEDVIKNTKRFISYCKQHGTSCNLLVCPLTINCKDFREIIEFANTHDICVYFHTVVKPETLSLKYQSEDFLKYLLEHLKTYTPETKTNNQKTNANNYQSLIKLIETWWNELSIKIEKSEENIADEIILNKLKAQISKKTFNRLLQYIDNYKSHSSYSNFLQKLHKVRTSELEHILKTSTDEEIKQMIEKMLI

SEQ ID NO: 16125 - DNA, 738 bp, Unknown
  Obtained from environmental sample
  misc_feature (1)..(738): n is a, c, g, or t
ttggaaatttttactctctcaaaaaccatgaatggcatgattaactccattagaaactcaagagtagcatacaaagtacaacatgatgaactgctagatcaaaaaaatattttacatcatcaagctcaccatgactatcttacaggactacctaatcgtattttatttaacgatcggctagaacaggctataaagaaatctgaacgtcgtgagaaaaagatggcacttttttttattgacctagatcattttaaagagattaacgactcactaggacatgaagtaggagataaaatattaaaagaggtaacaaagtttcttcaagagattattcgtaaagaagataccctttcgcgtttgggtggcgatgagtttacgataattgtagaagatttagaaaaaatagaagacgcatctgtatttgccaaaaagatgcttgatgttttaactagacctattacaatagatgataaacagctatatatctctagcagtatcggaattagtctatacccaaatgatggaaaaacagttcaagatctctttaagtatgcagatgctgccatgtacagagctaagtatgagggtagaaacaactttcaatactatagttctgaaatgacagaggctgcacttgagagagttgtcatggagacaaatctgagagatgcattaaactgtgaagagtttgtagtatattatcagcctcaggtagatgccccagccataatccaataa

SEQ ID NO: 16126 - protein, 245 aa, Unknown
  Obtained from environmental sample
  DOMAIN (38)...(199): GGDEF domain
  misc_feature (1)..(245): Xaa is any amino acid
MEIFTLSKTMNGMINSIRNSRVAYKVQHDELLDQKNILHHQAHHDYLTGLPNRILFNDRLEQAIKKSERREKKMALFFIDLDHFKEINDSLGHEVGDKILKEVTKFLQEIIRKEDTLSRLGGDEFTIIVEDLEKIEDASVFAKKMLDVLTRPITIDDKQLYISSSIGISLYPNDGKTVQDLFKYADAAMYRAKYEGRNNFQYYSSEMTEAALERVVMETNLRDALNCEEFVVYYQPQVDAPAIIQ

SEQ ID NO: 16127 - DNA, 459 bp, Unknown
  Obtained from environmental sample
  misc_feature (1)..(459): n is a, c, g, or t
atgaaaacagataaatactctctatatcagactcttggaataactattgtattaacagtcatcgtgattatgtcaatacattcgacatatcactacatagggactaaaaacagtatgattgatgatatgagagagaactcaaagcatactattagatcactgaaaaaaaatatcactaacttaatggagtcatactcggtaaatgagtatgataggttcatatttaatgagatgggaagtcgtgaacattttgctattatcgttgaagattataatatgggtaaaattttaggagataaatcatatataagtggaaaaatacgagaagatagctggcatatagttgaatatgatcctcaaaatattcaacaaaataaacttcttaccactacctattttatagaaaaaagtgatatcaaaactgactcgggagagaaattggaactattaccctatatg

SEQ ID NO: 16128 - protein, 153 aa, Unknown
  Obtained from environmental sample
  misc_feature (1)..(153): Xaa is any amino acid
MKTDKYSLYQTLGITIVLTVIVIMSIHSTYHYIGTKNSMIDDMRENSKHTIRSLKKNITNLMESYSVNEYDRFIFNEMGSREHFAIIVEDYNMGKILGDKSYISGKIREDSWHIVEYDPQNIQQNKLLTTTYFIEKSDIKTDSGEKLELLPYM

SEQ ID NO: 16129 - DNA, 516 bp, Unknown
  Obtained from environmental sample
  misc_feature (1)..(516): n is a, c, g, or t
gtggtaaactctatacaagatagtgttgagcaaacgaataaaaagtttgcagttatgacaaaagctatagatgcaatatctaatgaaaccatatcgtattctaaaaacataaatgatgtaatggtaacttcaaaagatacttttgcaggtcttgaacatatcactgatagaatatttatgagtttagcaaaacttgatcatgttatatggaaagtaaatacatatctttctgtagcaaataaagaacccgcatttgcatttgttgatcataaaaactgtagactgggaaaatggtataatgaaggtttaggaaaaagatattttgcaaacactccaagttattcaaaacttgatattcctcattctaaagtacacaatggtacacatcatgtatttgatgagattaaaaaagaacaattagactatgatgctttattaaattcttttacagagatggaagaagcaagtaatgaggtgtttgcattgttggatagaatacttcacgaaagagagtag

SEQ ID NO: 16130 - protein, 171 aa, Unknown
  Obtained from environmental sample
  misc_feature (1)..(171): Xaa is any amino acid
MVNSIQDSVEQTNKKFAVMTKAIDAISNETISYSKNINDVMVTSKDTFAGLEHITDRIFMSLAKLDHVIWKVNTYLSVANKEPAFAFVDHKNCRLGKWYNEGLGKRYFANTPSYSKLDIPHSKVHNGTHHVFDEIKKEQLDYDALLNSFTEMEEASNEVFALLDRILHERE

SEQ ID NO: 16131 - DNA, 930 bp, Unknown
  Obtained from environmental sample
  misc_feature (1)..(930): n is a, c, g, or t
ttgacacaaaaatatgatgatgaagagttatgtgaaatcttagataatacccctgctaaacttttagagataaaagggataaaagagaaaaaacttacccaaatagtcacttcatggaataaatttaaacaccttagagaattaggaagtttcttagcacaatttggtgtaagtagtagtttcatcaataaaatatatcaacactttgaaaatgttgataatctaatagaaagaataaaagaaaacccatatatgcttacttcaataaaaggtattggatttaaaagagcagatgagatagggacaaaactaggaattgataaagagagctcttttaggatcacagcttgtatgaactatacattaaaagagttttgtgaagcaaatggaaatagttctataggaaaagaacagcttttttctcttatgaatgatgcattacattttaaagagaaagatactttatatgaaaatgcattgataaaccttgtagctaaagaggagataaatgaaactataaaagataggtttgcaccaaatatctactttcgatgtgaaacaaaaattttagaaattttaaaaaatagaaaagagtacaatagagataaaaaaataattaaagattttgatacttatattactaaaaaacaagaaaccttaggatttaccttaagtagcgagcaacanaaagctgtaagtttaatcaatgatggggaaaatactattttacttataggatatgcaggtacaggtaaatctacctcaagtcgagccatacttgaactccttgaagagatagtaagttatgatgatatccattgtatggcacttagtggtattgcagctcaaagaatctctgatactacaggaatacaaaatagtaccatacaatcatcactagtaaaaatagaaaatagtgataaagatatt

SEQ ID NO: 16132 - protein, 310 aa, Unknown
  Obtained from environmental sample
  misc_feature (1)..(310): Xaa is any amino acid
MTQKYDDEELCEILDNTPAKLLEIKGIKEKKLTQIVTSWNKFKHLRELGSFLAQFGVSSSFINKIYQHFENVDNLIERIKENPYMLTSIKGIGFKRADEIGTKLGIDKESSFRITACMNYTLKEFCEANGNSSIGKEQLFSLMNDALHFKEKDTLYENALINLVAKEEINETIKDRFAPNIYFRCETKILEILKNRKEYNRDKKIIKDFDTYITKKQETLGFTLSSEQXKAVSLINDGENTILLIGYAGTGKSTSSRAILELLEEIVSYDDIHCMALSGIAAQRISDTTGIQNSTIQSSLVKIENSDKDI

SEQ ID NO: 16133 - DNA, 897 bp, Unknown
  Obtained from environmental sample
  misc_feature (1)..(897): n is a, c, g, or t
gtgttaattgaactttatgaaaagcaaaaagactttaaaaaagctttggaagttaaaaagttaaatgataaagttgaaaaagaaatttttacccttgaaaaaataaacaaaatcaatgaaattgaaactcgacttagattaactgaaaaagaacgtataattacacaacaagaattaaaaataaaaaaagaacaacttaatacgcttgaagcaaaatcaaaaatatcacaacttatctactttattttgttgtgcattgtaattatcgtttttgtgataattatatttatacgagcaaaaaaactaaccaataaaattaaaacccagaaactattgcttgaaataaaaagcaaagaagttaccgatagtattaaatatgctaaacgaatacagtcggccatattgccatcaattaaaaccataaaagaacatttacaggattcatttattttatacaaaccaaaggatatagttgccggagatttttattggttggaaaacaaaaacaatacagtattattcgctgcagcagattgtactggacatggtgttcctggtgctatggttagtgtaatttgtaataatggactaaataaaagtgttagagaatacggactaactaaccctagtgagattttaaataaaactcgagagattgttatctcagaatttgataaaagtgaagaagatgttagagatggaatggatatagctttatgtagtataaagtataaagttgaaagtgaaaaattacatacaactgcaattttgcaatatgcaggtgctaataatccattatggataatacgaccaattaacaaccacgaacatcaaaagttgaactttgagcttatagatattaaacctgacaaacaacctattggaaaaacattttaa

SEQ ID NO: 16134 - protein, 298 aa, Unknown
  Obtained from environmental sample
  misc_feature (1)..(298): Xaa is any amino acid
MLIELYEKQKDFKKALEVKKLNDKVEKEIFTLEKINKINEIETRLRLTEKERIITQQELKIKKEQLNTLEAKSKISQLIYFILLCIVIIVFVIIIFIRAKKLTNKIKTQKLLLEIKSKEVTDSIKYAKRIQSAILPSIKTIKEHLQDSFILYKPKDIVAGDFYWLENKNNTVLFAAADCTGHGVPGAMVSVICNNGLNKSVREYGLTNPSEILNKTREIVISEFDKSEEDVRDGMDIALCSIKYKVESEKLHTTAILQYAGANNPLWIIRPINNHEHQKLNFELIDIKPDKQPIGKTF

SEQ ID NO: 16135 - DNA, 975 bp, Unknown
  Obtained from environmental sample
  misc_feature (1)..(975): n is a, c, g, or t
gtgagcttattaggagaaacagtgctggaggaaaaagtgaaagaacgtactgctgaggttgttcaaaaaagtgaagaagttgaaatgaagaataaggatattatagatagtatcaattacgctaaacgtattcaagatgctattttaccatctgaagaggtttttaaacaatcattaaaaaatacttttgtgttgtttaatcctaaggatatagtaagtggcgatttctattggatgtataatacttccgtcattgcgaacgaggaacgagtgaagcaatctgttaaaaagaatgaaattacattttctcaaccagttgacaagaatgaaaatggcgagcttattttctttgctgctgcagattgtaccggacatggagttccgggggcatttatgagtattgtaggacacaatttgttggataagattgttggagagtatcatgtaacttcgccagccgaaattttgaattatttaaacaaaggtgtttcagaaactttacgccagagtgcagagcaagctaatattaaagatgggatggatatttctctttgtgcgtataactcaaaaacaaaaatattagagtacgctggagcttacaatccattatatataataagtaaacatgatttagtgaatattaaaggagaaaccatagagccaacaatggaagatgcaaaaggtttaaaactatatgaggttaaggcagatagatttcctattggtaactatacagatgaggtaaaacaatttacaaatcatgcttttaaaatgcataaaggcgatacagtatatttgttttctgatggatatgccgatcagtttggaggtactcatggaaagaaatttcgctacaaacaatttaaagagcttttattggctattaatgcacaatctatggaagtgcaaaagatagaaatgcaaaaagtgtttaccgaatggaagggtagtttagagcaaatagatgatgttatg

SEQ ID NO: 16136 - protein, 325 aa, Unknown
  Obtained from environmental sample
  DOMAIN (111)...(315): Stage II sporulation protein E (SpoIIE)
  misc_feature (1)..(325): Xaa is any amino acid
MSLLGETVLEEKVKERTAEVVQKSEEVEMKNKDIIDSINYAKRIQDAILPSEEVFKQSLKNTFVLFNPKDIVSGDFYWMYNTSVIANEERVKQSVKKNEITFSQPVDKNENGELIFFAAADCTGHGVPGAFMSIVGHNLLDKIVGEYHVTSPAEILNYLNKGVSETLRQSAEQANIKDGMDISLCAYNSKTKILEYAGAYNPLYIISKHDLVNIKGETIEPTMEDAKGLKLYEVKADRFPIGNYTDEVKQFTNHAFKMHKGDTVYLFSDGYADQFGGTHGKKFRYKQFKELLLAINAQSMEVQKIEMQKVFTEWKGSLEQIDDVM

SEQ ID NO: 16137 - DNA, 315 bp, Unknown
  Obtained from environmental sample
  misc_feature (1)..(315): n is a, c, g, or t
atgacaaaaaaaagaatggcaaatgaatttggagtaaatctaaattttgaggatagattttcaaatattgcacatagtattatggattatttatatgaagaagattttatccattttactgtaaatgacaatcaagtgaaaaatctgattgcaaattcaataaacgaatttataaaagggtatgatgaagcagatactgctgcatacgaaaaaattaaaagttataagagaaaacttataccagggactgaagattatgatatagtatttaatagattatatgaagaagagttaatgaaaaaaggtttgatataa

SEQ ID NO: 16138 - protein, 104 aa, Unknown
  Obtained from environmental sample
  DOMAIN (1)...(104): Protein of unknown function (DUF507)
  misc_feature (1)..(104): Xaa is any amino acid
MTKKRMANEFGVNLNFEDRFSNIAHSIMDYLYEEDFIHFTVNDNQVKNLIANSINEFIKGYDEADTAAYEKIKSYKRKLIPGTEDYDIVFNRLYEEELMKKGLI

SEQ ID NO: 16139 - DNA, 690 bp, Unknown
  Obtained from environmental sample
  misc_feature (1)..(690): n is a, c, g, or t
atgtttaatcgcaaaaatagatcaaaaacagctactacaaataatctagttatagatggtgttagtgttacacatgtttataataagagcttaaaaaacagttacattacaattagtaaaaatggtgctgtgacatttaaaacaccaaccacttgcattaaagagcttttttacaaaaaagagcagtggattagaggaaaacttgatttaatagagttaaaacaagagattaaaatagattataaaaagcagatattatatcttggtacacttagagaaataagtagtgatgaagagttttgtagcttggaaaaatccttaaatagatcaaaatctgatgatgtaaagacattacaaaggttacattttaacttttttaaaacaatttccaaagagcacattcaagagcgtgtagatcactatagtactattatgcagctagagtatactcaaattctttggagaaagatgaataggagatggggcagctgcagttgtaaaaaagttttaacttttaatataaaacttatgcaagtagatgttgatctgatagattatgtagttgttcatgagttggcacatataaaacatatgaaccactcaagagagtttcacgctcttgtgagaaaatatatgcctcaggaaaagagcttaagagatagattaaaaagagctaccacttacagctga

SEQ ID NO: 16140 - protein, 229 aa, Unknown
  Obtained from environmental sample
  DOMAIN (23)...(229): Protein of unknown function DUF45
  misc_feature (1)..(229): Xaa is any amino acid
MFNRKNRSKTATTNNLVIDGVSVTHVYNKSLKNSYITISKNGAVTFKTPTTCIKELFYKKEQWIRGKLDLIELKQEIKIDYKKQILYLGTLREISSDEEFCSLEKSLNRSKSDDVKTLQRLHFNFFKTISKEHIQERVDHYSTIMQLEYTQILWRKMNRRWGSCSCKKVLTFNIKLMQVDVDLIDYVVVHELAHIKHMNHSREFHALVRKYMPQEKSLRDRLKRATTYS

SEQ ID NO: 16141 - DNA, 327 bp, Unknown
  Obtained from environmental sample
  misc_feature (1)..(327): n is a, c, g, or t
gtgaaaatttatatggatgattttggaacaggctactcatcactttcatacttaaaacagtttcctatagactcactaaaaattgataaagcatttgttgatgatatatctgaggagtcggacaataagaatatattgttaaatacaatagttgccatgggtaaaactttagatatagagcttatagctgagggtgtagaaaacacatttcaaaaagagtatctcaaagatcaagggtgtcattactatcaaggttacttcttctcaagacctgttcgagagagcgactttttggcacttttagaaacaaacagtaagggtatgtaa

SEQ ID NO: 16142 - protein, 108 aa, Unknown
  Obtained from environmental sample
  DOMAIN (1)...(91): EAL domain
  misc_feature (1)..(108): Xaa is any amino acid
MKIYMDDFGTGYSSLSYLKQFPIDSLKIDKAFVDDISEESDNKNILLNTIVAMGKTLDIELIAEGVENTFQKEYLKDQGCHYYQGYFFSRPVRESDFLALLETNSKGM

SEQ ID NO: 16143 - DNA, 474 bp, Unknown
  Obtained from environmental sample
  misc_feature (1)..(474): n is a, c, g, or t
ttgatattaaggcctttatcacccaaacccattagactaccgagatggtggggaggatacaaaaaaatgcttccaaatcccccaattgagtggggaaaaagcaaaaaaaatattgtaaaaattttacgaataggggagtttgaagattgggcaactaccaactataagcgcagctggataatcttcacaaaaatcataaagatgagatatataatggttatggtggagtttttttattggtcaaatgatacagagtctggcaaaaataatatttggcagtacgcaaaagggctaaatatagaagatggagaaataatcaaatcagttcaagagtttaaagatggacgggttcgatgtgtacgaattatcaataaagatttaccaatacctcaatttgaaatggacaataatgaaacaattgaaccaatggatgcaaatatcacacaaaatttagaaagatttttattaaaatag

SEQ ID NO: 16144 - protein, 157 aa, Unknown
  Obtained from environmental sample
  misc_feature (1)..(157): Xaa is any amino acid
MILRPLSPKPIRLPRWWGGYKKMLPNPPIEWGKSKKNIVKILRIGEFEDWATTNYKRSWIIFTKIIKMRYIMVMVEFFYWSNDTESGKNNIWQYAKGLNIEDGEIIKSVQEFKDGRVRCVRIINKDLPIPQFEMDNNETIEPMDANITQNLERFLLK

SEQ ID NO: 16145 - DNA, 321 bp, Unknown
  Obtained from environmental sample
  misc_feature (1)..(321): n is a, c, g, or t
ttggtcaacttattccctgctgttggtcaaattaatgcagatcgctctaataagccatttgttgatattgctaagagcaaagttaaaaattatggaaaatgcgatattcaaattggctcaagagggattattccccctcaaaataaacaaggtgatattgcaaggatcgctttttatatgagtgataaatatggtgtcacttactctaaaaggcaacttgagttattcaataaatgggatatccaagatccaatttcatcagaagagcgagcgcataataagcgtgtaattcaagttcaaggtttcggtataaagcaatag

SEQ ID NO: 16146 - protein, 106 aa, Unknown
  Obtained from environmental sample
  misc_feature (1)..(106): Xaa is any amino acid
MVNLFPAVGQINADRSNKPFVDIAKSKVKNYGKCDIQIGSRGIIPPQNKQGDIARIAFYMSDKYGVTYSKRQLELFNKWDIQDPISSEERAHNKRVIQVQGFGIKQ

SEQ ID NO: 16147 - DNA, 750 bp, Unknown
  Obtained from environmental sample
  misc_feature (1)..(750): n is a, c, g, or t
gtgttaacaaccctatggagtgtttataaaatgaaacaaatatttaaggcaataacaatacttcttcttttaagcacaacactgtactcagcacaaacaggttcagcgtcaatttttactttttttaatggtgtagcattagagaataatgaggttttgattgataataagtataagcaatatacagatgaggatggttctgtagagataattctcgaagttggaaagcatcaaatagagatattttccaaagatgaaaatggagctaacttaggttatgcaaagaaaactatagagattaaagattcacgtgatactcaagttatagtaacatttaatgaagactcttctgtgcctcatgttgaggtagatgtaccgctaggagaatcagatactaaaactgacaatacaaagtatgtaggaactatcaatggtaaagttgtaacatcagatacaaaaaaagctattcgtaatgcaagaatttttgtaaaaggaacctcaattgatgctaaaactgacgataaaggtgaatttagcataagtattccagcagatagaaacatgagtatttctattgttcactctgaatatagtgcatctactctcaataatattcttgtacaacgagattcaactattgagacactgattgaattaacacctggcagtatggagcttgaagagtttattggtttagctcaaaaagttagggaagtattgcgaggtgtattgctgaagagaagagagtaa

SEQ ID NO: 16148 - protein, 249 aa, Unknown
  Obtained from environmental sample
  misc_feature (1)..(249): Xaa is any amino acid
MLTTLWSVYKMKQIFKAITILLLLSTTLYSAQTGSASIFTFFNGVALENNEVLIDNKYKQYTDEDGSVEIILEVGKHQIEIFSKDENGANLGYAKKTIEIKDSRDTQVIVTFNEDSSVPHVEVDVPLGESDTKTDNTKYVGTINGKVVTSDTKKAIRNARIFVKGTSIDAKTDDKGEFSISIPADRNMSISIVHSEYSASTLNNILVQRDSTIETLIELTPGSMELEEFIGLAQKVREVLRGVLLKRRE

SEQ ID NO: 16149 - DNA, 657 bp, Unknown
  Obtained from environmental sample
  misc_feature (1)..(657): n is a, c, g, or t
atgggtgaaaaaagacttgtaagattagagttaaaacttattgcggatgttggtgttgttggatatccaaatgttggaaaatcaacacttatctcaacaatatcaaatgcaaaacctcaagtggcaaattatgagtttacaacacttactccaaagcttggggttgttgaagttggagattataactcttttgtggcagctgatattcctggaattatagagggtgctgcagaagggcgaggtttagggattgagtttttaaaacatattgaaagaacaaaaacacttctttatatgatagatatggcaaatcatagagagatgttagatcaatataatgtattacaagaggaagttgagaagttctcaccggaattagctagtagaaaatttgcaattgcgttaacaaaaatagatgcaataccacaagaagaactcaatgaaaaagttgaaggttttataaaatcaataggcttagagacaacaaaagaaaatagttttgcttttgacaaagacaaaagttattttcttcaagatttgacatataatagatatgatgaaaatttaccatattttgtattaccaatatcatcggctactaaacaaaatattgaacctattaaatttgcattatatgatttaataagtagggactaa

SEQ ID NO: 16150 - protein, 218 aa, Unknown
  Obtained from environmental sample
  DOMAIN (1)...(141): GTP1/OBG family
  misc_feature (1)..(218): Xaa is any amino acid
MGEKRLVRLELKLIADVGVVGYPNVGKSTLISTISNAKPQVANYEFTTLTPKLGVVEVGDYNSFVAADIPGIIEGAAEGRGLGIEFLKHIERTKTLLYMIDMANHREMLDQYNVLQEEVEKFSPELASRKFAIALTKIDAIPQEELNEKVEGFIKSIGLETTKENSFAFDKDKSYFLQDLTYNRYDENLPYFVLPISSATKQNIEPIKFALYDLISRD

SEQ ID NO: 16151 - DNA, 321 bp, Unknown
  Obtained from environmental sample
  misc_feature (1)..(321): n is a, c, g, or t
gtgctaaagccttctcttttgtttcttgatgagcctttctcngccttagacataggactcaaaaaagagcttcagagcatactcattgagctaatcacaaaaaaagagataagtattttgtttattacacatgatcttatggaagctattcgtctgagtgatactatgttgctccttcaagcagatccagggcatatagtgaaagagtttcattttgacaaactacataaagaacgcgatgacaagtatgtttatgcaaaaagtgcagagatactacaagatgaagagataatttacacttttgaattggagttaaaataa

SEQ ID NO: 16152 - protein, 106 aa, Unknown
  Obtained from environmental sample
  misc_feature (1)..(106): Xaa is any amino acid
MLKPSLLFLDEPFSALDIGLKKELQSILIELITKKEISILFITHDLMEAIRLSDTMLLLQADPGHIVKEFHFDKLHKERDDKYVYAKSAEILQDEEIIYTFELELK

SEQ ID NO: 16153 - DNA, 792 bp, Unknown
  Obtained from environmental sample
  misc_feature (1)..(792): n is a, c, g, or t
atgggtatttggatatttagttcatctataattttaatcattattattttcttttcctataccatcaatattattctcaaacaaaaacggttgtccgaaattaaaaacgatttcattaataatattactcacgagttaaaaacgcctatttctactatatcgctatcggcagaagtattgcttagccctgatattacccaacaacccgaccgactaaaaagttacgctaaaattattcaagacgaaaataatagattgaaaaaccaagtagataaagtacttcagttagcaactattgaaagagataaacttaagcttgaaaatgaaccgatagatctgcatgaattaatagaaaactctataaaaagctttgagttgattgttaatcaacaaggagggcaaattacagctcaattaaaagctcctgaacatattttccatggcgataaagtacacatttctaatattttgtataatcttattgataatgccataaaatactcacccgaaaaccctaaaattattgtaagtacttctccttatagagatggtatagaaataagcgtaagagataatggtgtaggaatttcggatgaagcccagaagcatatttttgaaaaattttatagagaaccaacaggaaatgtacacaatataaaaggatttggattagggttaaattatgtaaaaaccattgttgaattttataacggaaatgtgagattagtcagtaaaaagaatgaaggttctacatttattattaaattgccactaaaagaaaacaataaatag

SEQ ID NO: 16154 - protein, 263 aa, Unknown
  Obtained from environmental sample
  DOMAIN (34)...(102): His Kinase A (phosphoacceptor) domain
  misc_feature (1)..(263): Xaa is any amino acid
MGIWIFSSSIILIIIIFFSYTINIILKQKRLSEIKNDFINNITHELKTPISTISLSAEVLLSPDITQQPDRLKSYAKIIQDENNRLKNQVDKVLQLATIERDKLKLENEPIDLHELIENSIKSFELIVNQQGGQITAQLKAPEHIFHGDKVHISNILYNLIDNAIKYSPENPKIIVSTSPYRDGIEISVRDNGVGISDEAQKHIFEKFYREPTGNVHNIKGFGLGLNYVKTIVEFYNGNVRLVSKKNEGSTFIIKLPLKENNK

SEQ ID NO: 16155 - DNA, 579 bp, Unknown
  Obtained from environmental sample
  misc_feature (1)..(579): n is a, c, g, or t
ttgatgaaaataggaaaatatctggtgaaaattttagatatttttgggagggtgggggtaaatcaccattcatctttcggcatgaaagcatggaaatttttggtcatttcaaatgagaaactaaaagaggaacttcgcccagcatgtgggaatcaggtgcagataacttcatgtgcacacttagtagtagtgcttgcaggcatagagagtttaaaagtagagagctgcttacctaaaaaaaggttcttaagacgcaaaatgagccaagagaacttagatttttatttagagctatatgcaaatcatcttaaagagactcttagcagtgatgataatatctatcattggagtgcacgacaaacttatatcgcctctacaaatatgatgagtgctgcagcaactataggagtcgattcttgcccgattgaaggttttgacaaggatcaactagaagagatcttaaaacttgatagaagcaaatatagagtatccatgcttcttccatttggatatagagaaaaagagcagcctgatcaggtaagacttagttttgatgaagtggttgaatttatagagtaa

SEQ ID NO: 16156 - protein, 192 aa, Unknown
  Obtained from environmental sample
  DOMAIN (14)...(171): Nitroreductase family
  misc_feature (1)..(192): Xaa is any amino acid
MMKIGKYLVKILDIFGRVGVNHHSSFGMKAWKFLVISNEKLKEELRPACGNQVQITSCAHLVVVLAGIESLKVESCLPKKRFLRRKMSQENLDFYLELYANHLKETLSSDDNIYHWSARQTYIASTNMMSAAATIGVDSCPIEGFDKDQLEEILKLDRSKYRVSMLLPFGYREKEQPDQVRLSFDEVVEFIE

SEQ ID NO: 16157 - DNA, 987 bp, Unknown
  Obtained from environmental sample
  misc_feature (1)..(987): n is a, c, g, or t
ttggctccaaaaaaaatgaaggtattggcacatggtttggtgactacttactgccggaaaatcaagaggggtttagggaaagatttaaacgatttaagggaattggaacgactcacacagaattcccttggaaaacaaaaagcgggaaaatacgttcaagctgcctttgagggaaatatcgggtttgatctaaacggtaaatttagtcaaactcattgtaccgtagaaaatgttactgagattaatatagttaatgaaaaattagtatataaaactggactagctcaaaagtatctaagcttagctggtgttatgattatggttttagatgcaaatggggctattgtgttaatgaataaaaagggttgtgacatgattggcttagcagaaagtgatatacttggaaaaaactggtttgataatttcattcctaaaaaatccaattcaaaagtaaaaaaagtgtttgatgatatatttaaagcgaaaacggaattaaccagtgaatttgagaatacaataattattgcaaccggagaagaaaggcttatatcatggcataattcaatactacgagattcaggtgaggaagtaattggaatcatcagttctggagaagatgtcactgacgcgaggaacaaacatcgtgtagttattgaaagtgaagcaaggttaaaccgatctcaagcgatagctcaagtaggctcgtgggaactagatttacaaacaaataaaatttgggcttctcccgaagcattttcaatttatgagctacttagtgactctacctatattgagttaagtaaggttcaaagtatggtagcaaaagaagacagatatatgatgaactatgccctgaaagacttaatagaaaatgggcaaccctatgatgttagattttctataaatacactttcaaagaagaaatgggtacattcaaaagctgaaatttcttttgattctccggaaaagcctcgagccgaattctga

SEQ ID NO: 16158 - protein, 328 aa, Unknown
  Obtained from environmental sample
  DOMAIN (168)...(210): PAC motif
  misc_feature (1)..(328): Xaa is any amino acid
MAPKKMKVLAHGLVTTYCRKIKRGLGKDLNDLRELERLTQNSLGKQKAGKYVQAAFEGNIGFDLNGKFSQTHCTVENVTEINIVNEKLVYKTGLAQKYLSLAGVMIMVLDANGAIVLMNKKGCDMIGLAESDILGKNWFDNFIPKKSNSKVKKVFDDIFKAKTELTSEFENTIIIATGEERLISWHNSILRDSGEEVIGIISSGEDVTDARNKHRVVIESEARLNRSQAIAQVGSWELDLQTNKIWASPEAFSIYELLSDSTYIELSKVQSMVAKEDRYMMNYALKDLIENGQPYDVRFSINTLSKKKWVHSKAEISFDSPEKPRAEF

SEQ ID NO: 16159 - DNA, 543 bp, Unknown
  Obtained from environmental sample
  misc_feature (1)..(543): n is a, c, g, or t
atgcccataacaattataaaagaaccgctagaaaaactatacattatagaccttgtttgtatggcctcatggacggacaagattatagataatgaagaacgggatttcttaaatcagttaaaaacagatttaaacatagatcgcgcagtcattgtaaggtctgtaaatgatatcaatttattttacgacgaacacaaagagaaagttgctttccttagttctaaaaacctcgcacaaagtttttataccaatagtagcaaaattgtatataaactgattaccagaaatagtaagcgtttaattaaggaattgtctgaaagtaaagaagcgctatacttattaacgcaatcgacacagcgaaatcttaccgacgaagaacagaaaaaaattcagatgcaacttttagacatatttaaatctattccgagtttagccatatttatgttgcctggtggcatgctattgttaccgctattcattaaattcattccaaggttattaccttctgcttttgacgataacagaattgatgaggacgcctaa

SEQ ID NO: 16160 - protein, 180 aa, Unknown
  Obtained from environmental sample
  misc_feature (1)..(180): Xaa is any amino acid
MPITIIKEPLEKLYIIDLVCMASWTDKIIDNEERDFLNQLKTDLNIDRAVIVRSVNDINLFYDEHKEKVAFLSSKNLAQSFYTNSSKIVYKLITRNSKRLIKELSESKEALYLLTQSTQRNLTDEEQKKIQMQLLDIFKSIPSLAIFMLPGGMLLLPLFIKFIPRLLPSAFDDNRIDEDA

SEQ ID NO: 16161 - DNA, 438 bp, Unknown
  Obtained from environmental sample
  misc_feature (1)..(438): n is a, c, g, or t
atgaacccatcagctagcggctggataaaaaaattgctcaaagaggtttctgagaccatgtattctaacacagaaactaccgtgttttataataacctaaaacacgctggttttatttatggtagtaatattaaagtggtattagatattgtaaaaccctttgaattaagtgaagaagaacgctgtaaaattaacctgcttctcactttctacttcatttataataaggaaaaccctaaggcaccttttaccgagagtcttattaaatattacaagtctattggagaccaaaaaaggtcgttttttgaagatttatttagcgataaatcggcagacagtttgttagaaaaaattatacataagcgcattcatattgatgataattttattacaaaaagtttcaattacttttttattaaatgcgctccttattgttga

SEQ ID NO: 16162 - protein, 145 aa, Unknown
  Obtained from environmental sample
  misc_feature (1)..(145): Xaa is any amino acid
MNPSASGWIKKLLKEVSETMYSNTETTVFYNNLKHAGFIYGSNIKVVLDIVKPFELSEEERCKINLLLTFYFIYNKENPKAPFTESLIKYYKSIGDQKRSFFEDLFSDKSADSLLEKIIHKRIHIDDNFITKSFNYFFIKCAPYC

SEQ ID NO: 16163 - DNA, 321 bp, Unknown
  Obtained from environmental sample
  misc_feature (1)..(321): n is a, c, g, or t
gtggaaggactattcatgtcaaaacgtacaataaccgtgatcccaggtgatgggattggcccaagcattatcgattcagcattaaaaatcctcgacaaagcaggatgtaactttgaatatgaatttgcagatgcagggttaactgcgttagaaaagcacggtgaattagtaccacaacgtactttagatcttatcgagaaaaaccggattactcttaaaggtccgttaaccactcctgtgggagaaggttttacctcaattaatgtgagcttacgtaagaagtttgccctttatgccaacgtgcgcccagtgattcattaa

SEQ ID NO: 16164 - protein, 106 aa, Unknown
  Obtained from environmental sample
  misc_feature (1)..(106): Xaa is any amino acid
MEGLFMSKRTITVIPGDGIGPSIIDSALKILDKAGCNFEYEFADAGLTALEKHGELVPQRTLDLIEKNRITLKGPLTTPVGEGFTSINVSLRKKFALYANVRPVIH

SEQ ID NO: 16165 - DNA, 546 bp, Unknown
  Obtained from environmental sample
  misc_feature (1)..(546): n is a, c, g, or t
atggccggcgctgttttgatttgtggaggcaatcaatgtgctacaatccctggaattggaggaagagaaccaagagaaatatcttttagagccatttcggaaattattcaagcaagagttttagaaataattgatacaataagttttgaactaaaaaaatctaattattacgatgaaattgctatcggaataactcttacaggaggtggatcattattgaaaaatattgctcaacttgttgaatttagaactggatttgaaactaaaattgcaagtccagaaaaatatatttacgcagaacaagatgctttcaaaaacccaaaatattctactgcaattgggcttcttttgaaaggtgttgaatatatgaaacaactaaacaaacttcaaccaaatcaaaaacaaattttagaaaaagaaattgttgataaaaataatgaagaaaaagaagaaaaagaaaaaacagaagttaaaattaaaaaaagaaatattttagaaaaattaaaaactttttttattgaagatgatgatagttcagaagtctaa

SEQ ID NO: 16166 - protein, 181 aa, Unknown
  Obtained from environmental sample
  misc_feature (1)..(181): Xaa is any amino acid
MAGAVLICGGNQCATIPGIGGREPREISFRAISEIIQARVLEIIDTISFELKKSNYYDEIAIGITLTGGGSLLKNIAQLVEFRTGFETKIASPEKYIYAEQDAFKNPKYSTAIGLLLKGVEYMKQLNKLQPNQKQILEKEIVDKNNEEKEEKEKTEVKIKKRNILEKLKTFFIEDDDSSEV

SEQ ID NO: 16167 - DNA, 894 bp, Unknown
  Obtained from environmental sample
  misc_feature (1)..(894): n is a, c, g, or t
atggacagaatcggctcgaggcttgcttcctcgcttattaatggagtatttgaatatgctttttatgatttttttatcagcccttcctattttcaatcaggaaaaaatgagattactgtcattttatttcaatttcgatctaacagcagtgattgtagattcgacatggaactatacggatatcgagattatacagtattaaataaactcattcataacataaataacgaacgtaaactattaaaaagcgaattagaactttataccgttgaaagattacttaatgaaaaatccgatgaaattaagtttttgaatttaaaacattcaaccaataaaaacatcttcctaattgtaatgggattactggcagtaacagttattttattggtcatttccctaatattgtcgtggaaaaagaatcataatattattttagagcatagattacttgaaaaggaaacggaagataaaagcaaagaattaattaatctttctctttcactacttaaaaccaaacaatttatctcaagcctaatggaaaacctgcaaagcattcataaagaagcggatccgaatcagcaggcacagatagataaactaataaaccggattgaatttcacaaacattatgaagaagattgggaacgtttaaaaatgcatttcgacaccatacattcaggcttcttcgcacgccttaaaaataatttccctgaattgacccaaaccgagctccgccattgtacctatattaaattgcaaatgtttacatcagaaatagcacaaatgctaaatattgataataaatctgtacaggccagtcgttatcggattaaaaagaaaatgccattgccacaagaagtggatctcaaaactttcttgaagacttttaactaa

SEQ ID NO: 16168 - protein, 297 aa, Unknown
  Obtained from environmental sample
  DOMAIN (236)...(293): Bacterial regulatory proteins, luxR family
  misc_feature (1)..(297): Xaa is any amino acid
MDRIGSRLASSLINGVFEYAFYDFFISPSYFQSGKNEITVILFQFRSNSSDCRFDMELYGYRDYTVLNKLIHNINNERKLLKSELELYTVERLLNEKSDEIKFLNLKHSTNKNIFLIVMGLLAVTVILLVISLILSWKKNHNIILEHRLLEKETEDKSKELINLSLSLLKTKQFISSLMENLQSIHKEADPNQQAQIDKLINRIEFHKHYEEDWERLKMHFDTIHSGFFARLKNNFPELTQTELRHCTYIKLQMFTSEIAQMLNIDNKSVQASRYRIKKKMPLPQEVDLKTFLKTFN

SEQ ID NO: 16169 - DNA, 783 bp, Unknown
  Obtained from environmental sample
  misc_feature (1)..(783): n is a, c, g, or t
ttgttaactgataatgggtttttgtatatgaatgcttcatttgcttctgttggtgtttatattttagagtggaatgctaattttgctggatcaagttacttagtgaaagaaattgttagtgttatacctaaaataaatatgtctggtattgctaatttttctcaaatagaagccttgatagatatgaataaaaaaaagattgaaactgtaataaataagacagagcaaatgcaagagtttgctcaagaagaaatatatttaattactgattcggttaatagcatttctaaggttggtgagtatattgaagatgaaaatagaaagaaggttgatgctagtgagttggcaaaaggtagctctgatgatcaaactaataaagttgcactttctggaaggtctaatacgtcagatgataaatcactaataactggatggtcaattagtgaatactttacatcagactctagtggtgataattctagtgatgaaaatggatttgtttatttgttattattgttgatttgtattttgatagtaggagttcttcttgtttttagaggaaggggattcttcggagttaacaaaatgtcaaaaaataagaaatccaaatctgatgcggtgaatttaaagaaaagtttgggtgtaaaatcatctagtgaaaatggtatatttttgaaacaggctagtcaaagtaataagtcacatcatacaaatagattctctcaattggtaggttcagtttttggtagtaagtcaaagagagttattacctggcggtggtag

SEQ ID NO: 16170 - protein, 260 aa, Unknown
  Obtained from environmental sample
  misc_feature (1)..(260): Xaa is any amino acid
MLTDNGFLYMNASFASVGVYILEWNANFAGSSYLVKEIVSVIPKINMSGIANFSQIEALIDMNKKKIETVINKTEQMQEFAQEEIYLITDSVNSISKVGEYIEDENRKKVDASELAKGSSDDQTNKVALSGRSNTSDDKSLITGWSISEYFTSDSSGDNSSDENGFVYLLLLLICILIVGVLLVFRGRGFFGVNKMSKNKKSKSDAVNLKKSLGVKSSSENGIFLKQASQSNKSHHTNRFSQLVGSVFGSKSKRVITWRW

SEQ ID NO: 16171 - DNA, 450 bp, Unknown
  Obtained from environmental sample
  misc_feature (1)..(450): n is a, c, g, or t
atgaaactaaaccttggtaagatatttttattattaatttttcccataattacatttgcacaagtaacattaagtgcaccaaatagtttttttcaaggggatagtgtagagttttcactcagtgttagtggaaaagatatcaagatgccagatataaaagatattgatggttttatagttcaaagtttaggaacctctacacaaaccaatataattaatggtgtacgaagtgataaacttatcaaaaactatacttttagaccaacaaaagatataacaataccttcatttgaaataagtgtagatggaaaaatagaaaaaacacaaccacaaaaaataagtatgcaaaaagtggaaaaaacagtttcaactgattatgatttaactataaaagtggataaaaaagaggtttatgtaggggagagtatccatttaaccccttttatttaa

SEQ ID NO: 16172 - protein, 149 aa, Unknown
  Obtained from environmental sample
  SIGNAL (1)...(20)
  misc_feature (1)..(149): Xaa is any amino acid
MKLNLGKIFLLLIFPIITFAQVTLSAPNSFFQGDSVEFSLSVSGKDIKMPDIKDIDGFIVQSLGTSTQTNIINGVRSDKLIKNYTFRPTKDITIPSFEISVDGKIEKTQPQKISMQKVEKTVSTDYDLTIKVDKKEVYVGESIHLTPFI

SEQ ID NO: 16173 - DNA, 357 bp, Unknown
  Obtained from environmental sample
  misc_feature (1)..(357): n is a, c, g, or t
atgtgtaagagatctaaaatgatagtaaaatttatttttttcatcttactatggagttcttattccttggctgtggtaaatccttataaaagtttacccgtgaatgaaaaaatcaatgttatggtgaattattttctaaatgaagagttaaacaatctaaaaccaattttaccccaaaaagaaaagttacaagatgatgatgcaaatttagagcctataaaatatgagcagtattttaactatattcaaagattaaaagcaatacgagaaagtagggtagatgagcaaaaaaagatagatgaaaaataccaaggtcaggtagctttttataatggcaagcctcgagccgaattctga

SEQ ID NO: 16174 - protein, 118 aa, Unknown
  Obtained from environmental sample
  misc_feature (1)..(118): Xaa is any amino acid
MCKRSKMIVKFIFFILLWSSYSLAVVNPYKSLPVNEKINVMVNYFLNEELNNLKPILPQKEKLQDDDANLEPIKYEQYFNYIQRLKAIRESRVDEQKKIDEKYQGQVAFYNGKPRAEF

SEQ ID NO: 16175 - DNA, 426 bp, Unknown
  Obtained from environmental sample
  misc_feature (1)..(426): n is a, c, g, or t
ttgatgaaaacttttattgtattttgtgtgatgagtatctcaatatttgcaaatgactttgaaaaaagtttaaatatagttatagataaaacagcaaatataatgtggcaagataatcttgaatcaacacaatatcttgaagatataactatggctaaaacatattgtgaaaatctaatattaaatggttatatagattggaaaatggcaacaattaagcaacttcaaactattatggatataacaaataaagatataactataaaaaaagagtttcaatatactagtgcttcaaaatattggtcaaaaagtccttattttcttaatactaatcaattttggtatgtggattttaaaactggtattgtaaattttagtacaagagataataaatatactgtacgatgtgtaagagatctaaaatga

SEQ ID NO: 16176 - protein, 141 aa, Unknown
  Obtained from environmental sample
  SIGNAL (1)...(17)
  misc_feature (1)..(141): Xaa is any amino acid
MMKTFIVFCVMSISIFANDFEKSLNIVIDKTANIMWQDNLESTQYLEDITMAKTYCENLILNGYIDWKMATIKQLQTIMDITNKDITIKKEFQYTSASKYWSKSPYFLNTNQFWYVDFKTGIVNFSTRDNKYTVRCVRDLK

SEQ ID NO: 16177 - DNA, 369 bp, Unknown; identical to SEQ ID NO: 11467
  Obtained from environmental sample
  misc_feature (1)..(369): n is a, c, g, or t

SEQ ID NO: 16178 - protein, 122 aa, Unknown; identical to SEQ ID NO: 11468
  Obtained from environmental sample
  misc_feature (1)..(122): Xaa is any amino acid

SEQ ID NO: 16179 - DNA, 1008 bp, Unknown
  Obtained from environmental sample
  misc_feature (1)..(1008): n is a, c, g, or t
gtgatcgctcggatttactattattttatatttatgattattaacagatttataaagccttatgtaagtatattttactcaatcaaagatgtgatgatgaatgcatatcgtggaaactactctgtacgtgtagatggatataataatcctgagagccaatcagttgcagatcttctaaatactatgctcgagaaacttcaacatacctttgaggaactagataaaaaagtatatattttcataaaaaataaaaactacgtaaaagagcctgatccactaaaaaatattaatacaacaatagagcgcttgtctgatatatataaattcaaacagacaatagagaatgataaagagttagaagatatatatctaagaattgcctatgttctaaaaaatcattttaaattagatgattttaccttagccgagatagacaacgcaagtaaaataaagaaaattgtgcactcggagaagggttgccactgcgaaattttagataaggagtgtcgagcaaaccgtataaatacaaatgtagattctagtatttttactaattcatgtgagctgtataattttgaaggaactgagcatatctgtactccatataccatatcaaatgatttaactattatattaaccatagttacaaaagagcaagaagaaacagatcgtgtaagatctatcatgagtgacgttgaagattatattattacggctagacctgcaatagtaagtaaaaaactgatgcagatgcttaacttgatggcaagagtagatcagcttaccggtatgtacaatcgtaaatttttagacgaatttatagatgtatctattcctcaagcgcttcgctcaaatattagttatggtattttgatgatagatatagactattttaaaatgataaatgatacttatggtcatgacgtangagacgatgcgatacgtatagtttcaggtgtaataaaacagcaaatacgtaaatctgatatagcaattagatacgggcgg

SEQ ID NO: 16180 - protein, 336 aa, Unknown
  Obtained from environmental sample
  DOMAIN (252)...(336): GGDEF domain
  misc_feature (1)..(336): Xaa is any amino acid
MIARIYYYFIFMIINRFIKPYVSIFYSIKDVMMNAYRGNYSVRVDGYNNPESQSVADLLNTMLEKLQHTFEELDKKVYIFIKNKNYVKEPDPLKNINTTIERLSDIYKFKQTIENDKELEDIYLRIAYVLKNHFKLDDFTLAEIDNASKIKKIVHSEKGCHCEILDKECRANRINTNVDSSIFTNSCELYNFEGTEHICTPYTISNDLTIILTIVTKEQEETDRVRSIMSDVEDYIITARPAIVSKKLMQMLNLMARVDQLTGMYNRKFLDEFIDVSIPQALRSNISYGILMIDIDYFKMINDTYGHDVXDDAIRIVSGVIKQQIRKSDIAIRYGR

SEQ ID NO: 16181 - DNA, 849 bp, Unknown
  Obtained from environmental sample
  misc_feature (1)..(849): n is a, c, g, or t
gtggaaatcgagcaatcagtatacaaaaacgaatcttctcatattgaatctaatgtagacaattcgtataagaaacagaaatctctaccagacaatcaattgtctattaatgataatttaaatgccgataatgaaatggaagtttcttctgaatataattctaatattgatttatcttctaaatatatatctagtgaagcaacaaataatgaatataaagttaataatggttgtaataaatacacgagaaccatgagtgttggttccaaaggggaagacgtcaaacatctacaagacttattgatacatttgggttatattacctcagtcaatgaaagtggatattttgatgaagaaacaaaaaaagccctaggatctttccaagattatttaaacatttatcctaatagtggatattttggcctgataacacacaaaaaagttagtgaaggatactgtgacttatctaaaatagattatgaatcttcttcaactaacgcagataatgattcagactcagactcagactcagaaaatgttgaaccgtatatttccatagaaaacattaaaggaactcaaacagggaaaataggttatattactcaggatggaaatgcacgtattaagggtattatgagtactggcgatgaaggttacgaagttgtttttatagatggtgacgacgaaattaatatagatgcagatttgagttttaaaaatacattatctatatctataccatacgatttaccagtatccacgtcacaattctatgtgaagaatggcgaatttgaaagtaataaattaggtgttgtggtgtataaaaaagaggctaaaganagaaattga

SEQ ID NO: 16182 - protein, 282 aa, Unknown
  Obtained from environmental sample
  DOMAIN (90)...(152): Putative peptidoglycan binding domain
  misc_feature (1)..(282): Xaa is any amino acid
MEIEQSVYKNESSHIESNVDNSYKKQKSLPDNQLSINDNLNADNEMEVSSEYNSNIDLSSKYISSEATNNEYKVNNGCNKYTRTMSVGSKGEDVKHLQDLLIHLGYITSVNESGYFDEETKKALGSFQDYLNIYPNSGYFGLITHKKVSEGYCDLSKIDYESSSTNADNDSDSDSDSENVEPYISIENIKGTQTGKIGYITQDGNARIKGIMSTGDEGYEVVFIDGDDEINIDADLSFKNTLSISIPYDLPVSTSQFYVKNGEFESNKLGVVVYKKEAKXRN

SEQ ID NO: 16183 - DNA, 540 bp, Unknown
  Obtained from environmental sample
  misc_feature (1)..(540): n is a, c, g, or t
atgaaattaatttccaagattcttttaatactagccattataaccagcggtgttttatctgctcaagagactactactggcgatgccattattcacgacccggctgctaaaaataatgtattgattgttccttttgaaaccaaaatgtatttttctgatattgatggcgacttaagtcagaaaaacgaaatgaattttcacgaaattaaagccatgtttcgtgcggaattagataaaaatctatttatctcacttaaagagtattttaatccattatcgttttatactatggaacaagatgttgttcaaaaagagctgacgtatatctacagttccattggctataaataccaagtaattgaacccgaagttgtagaaaaagaaactcctgctaaaaagctattcaataaaattaaacccaaagaaaaggaaaaagagccancagcagcaaccatacaaaatggtgagattgtttctgaaattgacaatagagaaaagtttatgaataccgntatcactaacgaggacctcattccntaa

SEQ ID NO: 16184 - protein, 179 aa, Unknown
  Obtained from environmental sample
  SIGNAL (1)...(20)
  misc_feature (1)..(179): Xaa is any amino acid
MKLISKILLILAIITSGVLSAQETTTGDAIIHDPAAKNNVLIVPFETKMYFSDIDGDLSQKNEMNFHEIKAMFRAELDKNLFISLKEYFNPLSFYTMEQDVVQKELTYIYSSIGYKYQVIEPEVVEKETPAKKLFNKIKPKEKEKEPXAATIQNGEIVSEIDNREKFMNTXITNEDLIP

SEQ ID NO: 16185 - DNA, 840 bp, Unknown
  Obtained from environmental sample
  misc_feature (1)..(840): n is a, c, g, or t
atgtcgactagtttaaatgataaagtaatttgtagagaaacaaattttgcgagaggcaattatgccgttcaagcaattgttgaatctttttatttttctgaaaaaccagttagagttttagatgttggtgttggttttgaaaatccttttattaattgttcatgggaaccttattttatagcttcatattttgaatcaaaaaaacaagattatgaaatgactctaattgatatttgtgacgaaaccctaactgatattaaaaaaagaaatgaattatttgttcttgattttgataataggtgtgactcttggcctttatatttagaaaatacaaatcaatcttcaacaaaagtatctaaagttgaaaaaggtcttattattccaaatcgtaaaatagttaaagatcttttaaagcaaggtattgttaaagcaaatataccttattcatttaagcaaaaaagagatgaaggacaaatacagctacttaacaaagacatatccgataaatttgatttgaattctgaatatgatattattgtttgttcaaatgtgttatatcagttaagtcaagattcacaatttactgcattaaacaacttcgcaaatttattgtcacacgatggaattttagtaactgacgatcatataaaaagtaaaaataaacttcttatagaaaatggcggttggtatgacgacttagctgaacaaagtccgttgattattgataaaaaacttcttctaaaaaagataaatatgaattgttcactatgcgaaaacaattatgaatgcttttttttcactataaacctgtgtttttttagaataacatttataaattaa

SEQ ID NO: 16186 - protein, 279 aa, Unknown
  Obtained from environmental sample
  misc_feature (1)..(279): Xaa is any amino acid
MSTSLNDKVICRETNFARGNYAVQAIVESFYFSEKPVRVLDVGVGFENPFINCSWEPYFIASYFESKKQDYEMTLIDICDETLTDIKKRNELFVLDFDNRCDSWPLYLENTNQSSTKVSKVEKGLIIPNRKIVKDLLKQGIVKANIPYSFKQKRDEGQIQLLNKDISDKFDLNSEYDIIVCSNVLYQLSQDSQFTALNNFANLLSHDGILVTDDHIKSKNKLLIENGGWYDDLAEQSPLIIDKKLLLKKINMNCSLCENNYECFFFTINLCFFRITFIN

SEQ ID NO: 16187 - DNA, 570 bp, Unknown
  Obtained from environmental sample
  misc_feature (1)..(570): n is a, c, g, or t
ttgctttttgttcacggttttactactgccaaaaatcttacggatatttcaggacgtggggtaggaatggacgtaatcaaaaaagcaattgttgatttacgaggtgatattgaaatagattccgaaccagatttaggaacaagtgttacaataaagttgcctcttacactttcaattatcgaaacattacacgtttcggctggtaaaatgcatttccttattcctttgacaaacatagtgttatgttcaaaaattaaacattctgaaattaaaaattattctggtaaaagaattattattgatggagaattattgccatatattgatattagagaattattcaaaattggaggagaaaaagaagacgaagaaaatctaattattataaaacatggaaaacggagaattggattgatttttagttctattcacggagaatatcaagcagtaataaaaaatttaggaactatttttaataatttagatttcttaatcggtgcgagtattttaggaaacggttctgttgcttatattcttgattcatataaacttttaaaaagagtacaataa

SEQ ID NO: 16188 - protein, 189 aa, Unknown
  Obtained from environmental sample
  DOMAIN (61)...(189): CheW-like domain
  misc_feature (1)..(189): Xaa is any amino acid
MLFVHGFTTAKNLTDISGRGVGMDVIKKAIVDLRGDIEIDSEPDLGTSVTIKLPLTLSIIETLHVSAGKMHFLIPLTNIVLCSKIKHSEIKNYSGKRIIIDGELLPYIDIRELFKIGGEKEDEENLIIIKHGKRRIGLIFSSIHGEYQAVIKNLGTIFNNLDFLIGASILGNGSVAYILDSYKLLKRVQ

SEQ ID NO: 16189 - DNA, 720 bp, Unknown
  Obtained from environmental sample
  misc_feature (1)..(720): n is a, c, g, or t
ttgggttcagtagaactctctatcgacatggagtcattgattgcatcaatgtataaggggcttgacgctgcatatagtatgatagtgaaagctgatgcaataaagcttgtcatggatgatttatatcttaaaaatcactatcatgagacttgtcttggcagtgactactatatgcatacaaatattcataactcaaaagtgattaataaaagtattgcaaaatcgatctatcctgaattaaaatccaatcttccaaaagatagagcatttgctattaacagagtaacatctctattagagagtgagatatatctgtttcttcctacagttgataaaagtggtgagaatatgggttatatggtctctaaaagaatagagggtactgttaatgagatctatatagagcagtgtttaaagttacttagtgtgttaatagtattttatatatttacgcttttatataaaaaaaatctaaaatcgattgcacttttagatcaatataaaaatgtagttgatcagactactctactatcaaaaacagatcttagtggtaaaattacctatgtaaacagtgcatttgagaaactatcaggttattcaaatgaggagctgcttggaaaagcacactctatagtaaggcatgctgatatgccaagtgaatcatttgagaatttatggaaaacaataaaagctggaaaatgtgtggcatggnaaaagtaa

SEQ ID NO: 16190 - protein, 239 aa, Unknown
  Obtained from environmental sample
  DOMAIN (165)...(227): PAS domain
  misc_feature (1)..(239): Xaa is any amino acid
MGSVELSIDMESLIASMYKGLDAAYSMIVKADAIKLVMDDLYLKNHYHETCLGSDYYMHTNIHNSKVINKSIAKSIYPELKSNLPKDRAFAINRVTSLLESEIYLFLPTVDKSGENMGYMVSKRIEGTVNEIYIEQCLKLLSVLIVFYIFTLLYKKNLKSIALLDQYKNVVDQTTLLSKTDLSGKITYVNSAFEKLSGYSNEELLGKAHSIVRHADMPSESFENLWKTIKAGKCVAWXK

SEQ ID NO: 16191 - DNA, 741 bp, Unknown
  Obtained from environmental sample
  misc_feature (1)..(741): n is a, c, g, or t
atgaatatagtgggttttgatgctaaaaattttggatatgaagttttaaatgagatactccgtggcggaaatgataaaataaaagagtgtgtgggagttttaatgggtggacacaccattgaaacacctgagatgtactatggattaagtgtaacagggatgatacacncctcaaatattttaaaaaataacagtggaaaaattggagatgttttaatacttacaaagccaattgggcttggtgtattaacaactgcaataaaaagagatttactagacccctctatgataaaggaagtaataaaagtaatggaatgtttaaactatgaaacttcaaagatattaaaagagtatagagtaagtgcttgtacagatattacagggtttagtcttttaggacatagtttagagtcaacaagagatgatatatcttataaactttataatgactctattcctgtttttgataaagtaagagaacttacagaacaagatgtagtaccaggtggaagtaaaaaaaataaaaaatacttagaagataaagtatcctatgcatcaagtattagtgagataagaaaacaaattttatgtgatgcacaaacttcaggagggcttttagtagcaatagataaaaatgatgccaaagaatatctaaaaagaatagagaattttacttttggatatgcaaaaattattggggaaattgtcccaagagttgataagccaattgttgttgtttag

SEQ ID NO: 16192 - protein, 246 aa, Unknown
  Obtained from environmental sample
  DOMAIN (67)...(246): AIR synthase related protein, C-terminal domain
  misc_feature (1)..(246): Xaa is any amino acid
MNIVGFDAKNFGYEVLNEILRGGNDKIKECVGVLMGGHTIETPEMYYGLSVTGMIHXSNILKNNSGKIGDVLILTKPIGLGVLTTAIKRDLLDPSMIKEVIKVMECLNYETSKILKEYRVSACTDITGFSLLGHSLESTRDDISYKLYNDSIPVFDKVRELTEQDVVPGGSKKNKKYLEDKVSYASSISEIRKQILCDAQTSGGLLVAIDKNDAKEYLKRIENFTFGYAKIIGEIVPRVDKPIVVV

SEQ ID NO: 16193 - DNA, 876 bp, Unknown
  Obtained from environmental sample
  misc_feature (1)..(876): n is a, c, g, or t
gtgataaaagagttttattttcacccctttacacttctaagcattgccttaagaaagtttatagagagtgagtttaatgctcatttttggggcttcatagatagcagtaaaagcggtgatgagattttcaatccaaaagagatagagagtttagattntgatctgattttgattttatctccaaatcatgcattaaatatttntaatgctcttagtaaacactcaaaaaaatctaaactacagattatagatcttcaacatggaagctattttattcaaaatgtctggcaactgaaactaacaaaattgcaagagtcaatctctgtaaatatcatgaaacactcgatcaaatatctgaaaaagttttttgtaaagaaaaaccacattctatttttagcaccggactttgtagacaataatattaaagatctctatatctacatatctactcaaacagactatagagctgtgatagcaactaataatctttctcatgaagagcttttaaaaaatagtggctttcatgtaataaaatacccctctttagcatttgtatacaatagcttaaaatcaaacataacaattcttgatcacactccaaactcaaaactcttaaaagagtccataaaaaactcatttactgttcagatttggcatgggatagctcttaaaaagatcggtggggctgattataaagatatcgattatgatctatttatatctacctctgattatgtaagcgaaaagaatttcaaagatgtcttcaaatataaagagatcatcaacagcggataccctcgtaatgatattttcacaaatcaaaatattacacaaatgcacaaagtttttttgagtgatgagatatatgaattgtaa

SEQ ID NO: 16194 - protein, 291 aa, Unknown
  Obtained from environmental sample
  misc_feature (1)..(291): Xaa is any amino acid
MIKEFYFHPFTLLSIALRKFIESEFNAHFWGFIDSSKSGDEIFNPKEIESLDXDLILILSPNHALNIXNALSKHSKKSKLQIIDLQHGSYFIQNVWQLKLTKLQESISVNIMKHSIKYLKKFFVKKNHILFLAPDFVDNNIKDLYIYISTQTDYRAVIATNNLSHEELLKNSGFHVIKYPSLAFVYNSLKSNITILDHTPNSKLLKESIKNSFTVQIWHGIALKKIGGADYKDIDYDLFISTSDYVSEKNFKDVFKYKEIINSGYPRNDIFTNQNITQMHKVFLSDEIYEL

SEQ ID NO: 16195 - DNA, 576 bp, Unknown
  Obtained from environmental sample
  misc_feature (1)..(576): n is a, c, g, or t
atgatagaattacagaagataaaagaacggaaaatgaaagaaactgcagtaaaattacaagaagtatataataaccaggaagatacttcttctcccttggactatatttcagtgcttacatccaaacccagtatgatcaagaaatttcatgaacttggaaattgtgctaaagagatcgtaagatcattcaataaatgtccgtatgctgtaaccctagaacttgaatctattaaaaaagatagtgattctatagtggaaagtttgaataaaggtactatcagtaaagctttatatgaaatagaaaaagacgatcaagatcatttcattaagtcattacaatattacagtgatattggagaagaaattagagtttgtgaccaccttcccatgaagatgctcatctctgataataatactgttatgatctctttacgtaacaatggaagttccaaattcaaattaacctcgatgatcgtagaacactccgatcttaccgatgctctcattgaattatttgatatttactgggaaagatctattactttagatgagtttatcaaaaatcaaaatcaataa

SEQ ID NO: 16196 - protein, 191 aa, Unknown
  Obtained from environmental sample
  misc_feature (1)..(191): Xaa is any amino acid
MIELQKIKERKMKETAVKLQEVYNNQEDTSSPLDYISVLTSKPSMIKKFHELGNCAKEIVRSFNKCPYAVTLELESIKKDSDSIVESLNKGTISKALYEIEKDDQDHFIKSLQYYSDIGEEIRVCDHLPMKMLISDNNTVMISLRNNGSSKFKLTSMIVEHSDLTDALIELFDIYWERSITLDEFIKNQNQ

SEQ ID NO: 16197 - DNA, 390 bp, Unknown
  Obtained from environmental sample
  misc_feature (1)..(390): n is a, c, g, or t
atgaaaatatgtggtatagagataaaatcaaattatgcgatactaagtgtagtagaggaggggagttatcttgatttaaagataaaaaaactcacattagaagatgatgaactacaaaaaaatatagtactttttaaagagagtttagaatcttttctcaatgagaatcanatagaaaaaatcattattaaaaagcgttcaaaaaaagggaactttgcaggtggtgctgttacatttaaaatagaaacaattatccagttaaatagtatttgtgaagttggatttatatctggtcaagctttgagtaaatttgagaagaaaaatgaagttatttatccaaaaagtttaaataaataccaagaacaaagttatctttgttgtttggtataa

SEQ ID NO: 16198 - protein, 129 aa, Unknown
  Obtained from environmental sample
  misc_feature (1)..(129): Xaa is any amino acid
MKICGIEIKSNYAILSVVEEGSYLDLKIKKLTLEDDELQKNIVLFKESLESFLNENXIEKIIIKKRSKKGNFAGGAVTFKIETIIQLNSICEVGFISGQALSKFEKKNEVIYPKSLNKYQEQSYLCCLV

SEQ ID NO: 16199 - DNA, 504 bp, Unknown
  Obtained from environmental sample
  misc_feature (1)..(504): n is a, c, g, or t
atgaatgattttaaaatttgcatcaataagcctttttgcatattaaattttgtatcatacattatacataaacaatatttaggtcagtcaatgcaaattagagaactcaacttaacagagttagaagatatttacaaactagtctgcactaaactaactcttacatatgatgagtttgaaaatatcatatatgacatgagacatcaaaactacaagatgttcggaatttatgagggaaagtttctagtatgttatgcgggtatctccatgcaacactcccttgaatttagacaacatctatatatctatgaactaataacaaaaaagatatatcaagatagaggctatgatagagagatgtttaactatatatttgactacgcaaaaatgctaaattgcaaaagtgtagttttaagtagtagtaatacatttaaagaattggataaattctatattttaaaagaatttagagatgaaagctncatctacataaaagagatataa

SEQ ID NO: 16200 - protein, 167 aa, Unknown
  Obtained from environmental sample
  misc_feature (1)..(167): Xaa is any amino acid
MNDFKICINKPFCILNFVSYIIHKQYLGQSMQIRELNLTELEDIYKLVCTKLTLTYDEFENIIYDMRHQNYKMFGIYEGKFLVCYAGISMQHSLEFRQHLYIYELITKKIYQDRGYDREMFNYIFDYAKMLNCKSVVLSSSNTFKELDKFYILKEFRDESXIYIKEI

SEQ ID NO: 16201 - DNA, 834 bp, Unknown
  Obtained from environmental sample
  misc_feature (1)..(834): n is a, c, g, or t
ttgaaaaatgttgctatttcgacattacatgatctttacagtggtgctactcctatggagtatcggctggtggataagttgggtgaggttcatgtcatggagaccactatccagaaattccagcaggacgatggatcggatggatatatcctttattcacgtgatatcaccttgcgaaaacaggctgaggaagagacccataagctaaaaatggtggttgaacagtctcctagcagtattgtaattactgataccgaagggacaattgaatacgttaatccggcgtttgaacagatcacaggatacagctttgctgaggcagttggtcagaatccgcgggtattaaagtcgggaaataccccccagtcagcgtttaaaaagctctggacaaccattactgccggtaatgtctggcgcggtgaatttattaatcgaaaaaagaacggtgacctttataacgaaaacgttctggttcttccaatcaagaatgtcaaaggtgagatcaccaactttgttgcagttaaagagaatgtcacggaactgaaacgtgccagaaagcgtgcagagcaggccaatcaagccaaatctaactttctttcccatatgagtcacgagcttagaactcccctgaatgcaatcaatggattttcgcaattgatgctcaaaagcaaaaaaaatccattaaatgcaaaacaggcggatatgaccggacagattcatactgcgggtcaacatctgctacagctgatcaacgaaattctcgatctggcacgtatcgaatcaggagagttctccctctcagtagagccgttagatccacatgcttttccttga

SEQ ID NO: 16202 - protein, 277 aa, Unknown
  Obtained from environmental sample
  DOMAIN (67)...(130): PAS domain
  misc_feature (1)..(277): Xaa is any amino acid
MKNVAISTLHDLYSGATPMEYRLVDKLGEVHVMETTIQKFQQDDGSDGYILYSRDITLRKQAEEETHKLKMVVEQSPSSIVITDTEGTIEYVNPAFEQITGYSFAEAVGQNPRVLKSGNTPQSAFKKLWTTITAGNVWRGEFINRKKNGDLYNENVLVLPIKNVKGEITNFVAVKENVTELKRARKRAEQANQAKSNFLSHMSHELRTPLNAINGFSQLMLKSKKNPLNAKQADMTGQIHTAGQHLLQLINEILDLARIESGEFSLSVEPLDPHAFP

SEQ ID NO: 16203 - DNA, 693 bp, Unknown
  Obtained from environmental sample
  misc_feature (1)..(693): n is a, c, g, or t
atgcgtagtaaacttgagatagatagtgttctaaaatcatttaattataaccaaattctgactgacatctatttgaaaatccaaacaggtgaggtagtaggaatactgggtagaaatggatgtggaaaatcaaccttattgaaaattctatttggaactctacgagcagaatacaaatttataagagttgatggaaaaacatataatcgtccatatacgaaaaacgatttgataaattatatgcctcaatttaattttctccctaaacaactcaaagtaaagaagattattcagctatatttagataaagagaatgcaattactctaatgaaagatgaaatcattcaaccattactattaaataaagccgcccagctttctggtggtgaattacgctatttggaaatccttttattactgaataaaaaatcaaaattcattctattggatgaaccattcaatggcatatcaccaattttagtagaatccattaaagtgcaaattcgtaaattttctaaacacaaagggatactcgttacggatcatgattacagaaacgtattagatatagccgatcgcctttgtctcatgtatgacggcggaattaaggaaataaataacaaagaagagctcgttagatggggatatatatctcanacgagattgcaatctttggatagcaagaaaaattga

SEQ ID NO: 16204 - protein, 230 aa, Unknown
  Obtained from environmental sample
  DOMAIN (30)...(200): ABC transporter
  misc_feature (1)..(230): Xaa is any amino acid
MRSKLEIDSVLKSFNYNQILTDIYLKIQTGEVVGILGRNGCGKSTLLKILFGTLRAEYKFIRVDGKTYNRPYTKNDLINYMPQFNFLPKQLKVKKIIQLYLDKENAITLMKDEIIQPLLLNKAAQLSGGELRYLEILLLLNKKSKFILLDEPFNGISPILVESIKVQIRKFSKHKGILVTDHDYRNVLDIADRLCLMYDGGIKEINNKEELVRWGYISXTRLQSLDSKKN

SEQ ID NO: 16205 - DNA, 756 bp, Unknown
  Obtained from environmental sample
  misc_feature (1)..(756): n is a, c, g, or t
atgaaaaatataccaataggtaaatataccccatatccacaagttgttttgccagatagaacatggccgacaaaaactattacaaaagcaccattatggtgtagtgttgatcttagagatggaaatcaatctcttgtaacacctatgaatttagaacaaaaacttgaactatttgctctcctactaaaaattggttttaaacatattgaagttggatttccatctgcatcgcaggtagagtttgattttttacgccgtttagttgatgataatctgattccagatgatgtaacaatccaagttttggttcaagcacgagaacatcttatagcaaaaacatttgagtcattaaaaggtgtaaaaaaagctatagttcatatgtataactctacatctattgctcaaagaaaaattgtatttcaaaaaagtaaagatgagattatcaagttagccgtaaatggtgtagatttagtaaaaaaatatgaagcttctcatgatggtgagattatgctagagtattcaccagagagttttactggaactgagttagagttctcagctaanatttgtaacgaagtaaccgccagatggggaatttcaaatgatcgtaaagtgattattaatcttccggcaactgtagagatgtcaacacccaatgtttatgccgatcagatagagtggatgagcaaacacttaaagagtcgtgaaaatatattaatatctacacacacgcataatgacagagggacttcagtt

SEQ ID NO: 16206 - protein, 252 aa, Unknown
  Obtained from environmental sample
  DOMAIN (39)...(252): HMGL-like
  misc_feature (1)..(252): Xaa is any amino acid
MKNIPIGKYTPYPQVVLPDRTWPTKTITKAPLWCSVDLRDGNQSLVTPMNLEQKLELFALLLKIGFKHIEVGFPSASQVEFDFLRRLVDDNLIPDDVTIQVLVQAREHLIAKTFESLKGVKKAIVHMYNSTSIAQRKIVFQKSKDEIIKLAVNGVDLVKKYEASHDGEIMLEYSPESFTGTELEFSAXICNEVTARWGISNDRKVIINLPATVEMSTPNVYADQIEWMSKHLKSRENILISTHTHNDRGTSV

SEQ ID NO: 16207 - DNA, 408 bp, Unknown
  Obtained from environmental sample
  misc_feature (1)..(408): n is a, c, g, or t
atgggtttatgtttatttaacaaagattgcaatctactaaattttgccggagcaaaactcgatttgctctattttaaagatggtgaaattaatattgttaaagcgaacagacagagcattgggtatagaagatctaaaaatgattatgagtatacaaatcatgagcttcatcttgacttttcagagtcattttacctctatacggacgggattacagatcaaataggaggagataaaaattttcctttaggcaataaaaaatttaaagagatactctcaactatacaaaatattcctatagttgagcaagaagctattatattagataaattggcaatatatcaaaaggataacagcagaagagacgatataacagtaatttcatttaaagttaaaaaaggcgtataa

SEQ ID NO: 16208 - protein, 135 aa, Unknown
  Obtained from environmental sample
  misc_feature (1)..(135): Xaa is any amino acid
MGLCLFNKDCNLLNFAGAKLDLLYFKDGEINIVKANRQSIGYRRSKNDYEYTNHELHLDFSESFYLYTDGITDQIGGDKNFPLGNKKFKEILSTIQNIPIVEQEAIILDKLAIYQKDNSRRDDITVISFKVKKGV

SEQ ID NO: 16209 - DNA, 798 bp, Unknown
  Obtained from environmental sample
  misc_feature (1)..(798): n is a, c, g, or t
atgacagataatccacataaaattagtatcttaaaccaaacccatcttgaattatttaagaaaaattttctttcccttcaaaaaaaatacgaagaaaaaatagacgaattgtcaatattaaaggagatggttgagtcaatgaaatccattgacttgacagatcctgatatagtctggcgtcgtcaactcgactgcctggttaaatacaagaatctatccggagctgttttttatctatttaaagattttcaaaacaagaaagaaagctatatatcttccagttttaatacgggcatcaactattccttcttaaaaaattccaacctcttaaaaaaaatctccaatgagaaaaaaaatattctcattgaggatcttgaggattgggaggattgcattcaacttacagggtctctctacgcactgcctgttgtttcaggggatgacctccatggcgcgcttattttgttcaacgataaaaaatacggttttaagaatgaggatcgttttttttactctattgtccggaatcatctaatgaacaccatcacattcagacgattttattctgataaaataaatgaagaaaaacatattttccaattttccagatttttttccaaagatgttgtcaaaaccatattaacaagcggcaacccaaaattaggcggagagaaaaaaaaagcttgtataatattcgccgatttagaaggattcacctccctttccgagaagaccacagcagaagaagtggttgaaaattttaaattatttttattcttccatgattccaattgtttt

SEQ ID NO: 16210 - protein, 266 aa, Unknown
  Obtained from environmental sample
  misc_feature (1)..(266): Xaa is any amino acid
MTDNPHKISILNQTHLELFKKNFLSLQKKYEEKIDELSILKEMVESMKSIDLTDPDIVWRRQLDCLVKYKNLSGAVFYLFKDFQNKKESYISSSFNTGINYSFLKNSNLLKKISNEKKNILIEDLEDWEDCIQLTGSLYALPVVSGDDLHGALILFNDKKYGFKNEDRFFYSIVRNHLMNTITFRRFYSDKINEEKHIFQFSRFFSKDVVKTILTSGNPKLGGEKKKACIIFADLEGFTSLSEKTTAEEVVENFKLFLFFHDSNCF

SEQ ID NO: 16211 - DNA, 615 bp, Unknown
  Obtained from environmental sample
  misc_feature (1)..(615): n is a, c, g, or t
ttgaaaatcagtgttaaaatttttacagtatctatacttatgatattgctctttgttgggtgtggaaaaaagcaaaatgatgatataaaaattggttttattgccggcttaagtggtaaatactcctctttgggaataagtataagagatggttttttactagcatttgatgagataaactataaaatagatggtaaacaagttactgtaatacaaaaagatgataaacaagatatagaaaaagcaaaaaaagctataaaatattttatcaataataatataaaacttgttgttggaaatgctacaagttctatgacaaaagtttctattgcagaggtaaataagcataaagatatgttacttatctctgcaacagctagtggctatgaatttacacataaagatgacaatttcttgcgtgtacaagttgaaaactcccaaaaaagatatggtacacttttaaaatatattaaaaataaagggtataaaaatatttttttaatttatgattctaggaatatagcttatgtagagggatataaagatattttgcaagatatgattatagaaaatgaaaggggaagagttttgttggaagtgtttgatttaaaatag

SEQ ID NO: 16212 - protein, 204 aa, Unknown
  Obtained from environmental sample
  misc_feature (1)..(204): Xaa is any amino acid
MKISVKIFTVSILMILLFVGCGKKQNDDIKIGFIAGLSGKYSSLGISIRDGFLLAFDEINYKIDGKQVTVIQKDDKQDIEKAKKAIKYFINNNIKLVVGNATSSMTKVSIAEVNKHKDMLLISATASGYEFTHKDDNFLRVQVENSQKRYGTLLKYIKNKGYKNIFLIYDSRNIAYVEGYKDILQDMIIENERGRVLLEVFDLK

SEQ ID NO: 16213 - DNA, 786 bp, Unknown
  Obtained from environmental sample
  misc_feature (1)..(786): n is a, c, g, or t
atgggtatgtcacgtaaaatatttttaagaacatttggcgctatttcattgcagcggaagcttctttttttcattgttgtcgcactttctcttatatttatcatcagtagtgtatttatatataaacttgtcagtagtacatttatagaggctgaaaaaaagcatattgcaataactgctgaatcgttatctcagaaagtaggggtgtggtattttataaacaatgaaactgatagttccgaaattgataagttatttaaaaaagcacttatttcatataggcttgaatatttatcctttatagataataaagggtctcttatatctgaggttagtgtaccaaaatatatttctgaagattcttataatataaaatataagataaatgtttacagtcctgagaacggtaattttaaagatagcatgggaacactagaacttgcatatggaaatcatattttaaaaaagctttttaataaatatgctactaccggagtgattcttgtcattttattagctctgtacttttatttggagatgcatctgttaaaagaactattaatgcctttgaatagaattgcagcagagataaaagattatgtaccaggtgataaacttgtttttgattcgtttagcanaaataaagatgatgtaatttttgagattattaacgggtttaagcaaatgcagcaaaatatcgatgattccatgagagagaaggtgttagaagaagaaataaatagagctaaagatgctttttttggtaaagcaatcacgaattattga

SEQ ID NO: 16214 - protein, 261 aa, Unknown
  Obtained from environmental sample
  misc_feature (1)..(261): Xaa is any amino acid
MGMSRKIFLRTFGAISLQRKLLFFIVVALSLIFIISSVFIYKLVSSTFIEAEKKHIAITAESLSQKVGVWYFINNETDSSEIDKLFKKALISYRLEYLSFIDNKGSLISEVSVPKYISEDSYNIKYKINVYSPENGNFKDSMGTLELAYGNHILKKLFNKYATTGVILVILLALYFYLEMHLLKELLMPLNRIAAEIKDYVPGDKLVFDSFSXNKDDVIFEIINGFKQMQQNIDDSMREKVLEEEINRAKDAFFGKAITNY

SEQ ID NO: 16215 - DNA, 321 bp, Unknown
  Obtained from environmental sample
  misc_feature (1)..(321): n is a, c, g, or t
ttgcataatgctgtagatgctgtaatagatagtaatgaaaaaagtgctaagatagttatcgagtgtatggttgaaaatgaaaataatattatcaaaattcatgataatgggggaggatttaatcctaaaacagttgataaaatatntgatgcatattttacaactaagcatccatctcagggcacaggattaggactttttataacaaaaacaattgtagaaataaaatttaacggcaccatagaagcatataatgctaaagatggtgcgctttttgtgattaaaattcctttaccaaagaggaaaaagaatattacctaa

SEQ ID NO: 16216 - protein, 106 aa, Unknown
  Obtained from environmental sample
  DOMAIN (2)...(99): Histidine kinase-, DNA gyrase B-, and HSP90-like ATPase
  misc_feature (1)..(106): Xaa is any amino acid
MHNAVDAVIDSNEKSAKIVIECMVENENNIIKIHDNGGGFNPKTVDKIXDAYFTTKHPSQGTGLGLFITKTIVEIKFNGTIEAYNAKDGALFVIKIPLPKRKKNIT

SEQ ID NO: 16217 - DNA, 399 bp, Unknown
  Obtained from environmental sample
  misc_feature (1)..(399): n is a, c, g, or t
atggattcattaaatatttcagttaacgggtttagagccccatataatcgattaaatgatgactcgtttaagattttatcagaaaattatgactatgatgcatcaataatagagggtttttcagtattttactctgactctacattggcagaaattaaagtatcttcatttctgtttgttccattggaagatgtaatatttttatattatcttaaagttcctagtaaaatttattattttttattaactcatttacccggaacaaattcttatctatttcatccgcaacacgtaaccaaaaaaaattcttttaaatattttgacaaatttctaaacgatagtttaaataaaaacactgagtttttgacccaccaaaaatatctaagattaattaattag

SEQ ID NO: 16218 - protein, 132 aa, Unknown
  Obtained from environmental sample
  misc_feature (1)..(132): Xaa is any amino acid
MDSLNISVNGFRAPYNRLNDDSFKILSENYDYDASIIEGFSVFYSDSTLAEIKVSSFLFVPLEDVIFLYYLKVPSKIYYFLLTHLPGTNSYLFHPQHVTKKNSFKYFDKFLNDSLNKNTEFLTHQKYLRLIN

SEQ ID NO: 16219 - DNA, 738 bp, Unknown
  Obtained from environmental sample
  misc_feature (1)..(738): n is a, c, g, or t
atgcttgagtgtttagatatccacgcgtttaaacttattgaagatattcatattgatttcaaagagggttttagcgtaattacaggtgaaactggggctggtaaatcaataatgctttctgctctttctttgctctcaggagccaaaggagaagtggcatcaatacgtaatggttttgatagtgccagtgttatgggtcaattcttcatcaataatgatgataaagaattaataaattttcttagccaaaataatattgaatatattgatgatactttaataataaaaagaatcattaaaactaatggaagaactctaagttatattaataatgatgcaattaatagaactttgttaatgcaattatctacatatttaattgatatttcagctcaacatgcgcatcaatcaattatgaaaagcagtaaacaattgtttttagttgatagctatggagaaacttttgattatttaaatgaatataaagaagcttttcaaaaagtaaaagatttagaaaccaaaaaggttgaaattgaaaatattattaattcttcaaaacaacaggaagattacttaaaatatgcttttgaagaaataaacagtgttgatccaaaagagaacgaagatgatgaactaagtgataaaattagaagaatcagtcagtttgagcaaatccatgacaatattagctacataaataatattcttaatattcatatgaaagcgctagtactctaa

SEQ ID NO: 16220 - protein, 245 aa, Unknown
  Obtained from environmental sample
  misc_feature (1)..(245): Xaa is any amino acid
MLECLDIHAFKLIEDIHIDFKEGFSVITGETGAGKSIMLSALSLLSGAKGEVASIRNGFDSASVMGQFFINNDDKELINFLSQNNIEYIDDTLIIKRIIKTNGRTLSYINNDAINRTLLMQLSTYLIDISAQHAHQSIMKSSKQLFLVDSYGETFDYLNEYKEAFQKVKDLETKKVEIENIINSSKQQEDYLKYAFEEINSVDPKENEDDELSDKIRRISQFEQIHDNISYINNILNIHMKALVL

SEQ ID NO: 16221 - DNA, 714 bp, Unknown
  Obtained from environmental sample
  misc_feature (1)..(714): n is a, c, g, or t
atgatagtggaagataatattaaatttgatatttttgattctgtttctcttcgacaatttaaaggtgaagcagtattagatgaacattcaggtgaaactggttttgaactatatttaaccttgaaagataccataactaaaactattaatcattataatattaacaacaaagatgtcagtgagagaattgttgatatgacatatagttggattgagagatctctaagtgttgttgatgactttgaattaaaacaaattgcaagagatattgataattattcaatgatttctaagggtagtaaatttactccaaccgatacaatattcattgagaacattggaacttgtctaagagcattacgatcccttttcatcacaccaaatactttatcctgggaatctaaaaaacaaagtgtttctcaccttattgatttcataatgatacagggtagaaaaaaagaaaaagataccgttaaagaaatatttaacaccgaagcaaaatccattgcttctagaattaaagttgatggtttgcataattatttaattgaatataccataaattttttatcaatggctcatgatgaaaaattaaatcttgaaatgaaaactttgcaaaatattgtttatacatacatagataaagatttagataaattaaatattaatattcttctatttagtgaaatgaaagctttattaaactttgcttaa

SEQ ID NO: 16222 - protein, 237 aa, Unknown
  Obtained from environmental sample
  misc_feature (1)..(237): Xaa is any amino acid
MIVEDNIKFDIFDSVSLRQFKGEAVLDEHSGETGFELYLTLKDTITKTINHYNINNKDVSERIVDMTYSWIERSLSVVDDFELKQIARDIDNYSMISKGSKFTPTDTIFIENIGTCLRALRSLFITPNTLSWESKKQSVSHLIDFIMIQGRKKEKDTVKEIFNTEAKSIASRIKVDGLHNYLIEYTINFLSMAHDEKLNLEMKTLQNIVYTYIDKDLDKLNINILLFSEMKALLNFA

SEQ ID NO: 16223 - DNA, 717 bp, Unknown
  Obtained from environmental sample
  misc_feature (1)..(717): n is a, c, g, or t
ttgcaaaacagtacctatctgaagagtctctttacatctttagccgagtataaaaaaaactctctgcttatcaaacagagcagactctatatcaaaaatcatgagataaatcttcttatcaataaagaccgatatgaagctggtgagatagatataagtgctttgaatcttatacttatagaaaaagagagagaacagttgaaacttataggttatgagagtgctttgaaaaataccaaacttactatggagcagttaagttctgagagtgtttcaaatatgaacctgccactagtccccctaatgagtcttgttgagtatcttgaaaatcatatctctattctaaaaactaaaagtgtcacttctacactaaaatataaagctgacttaaaaagctctgcttatcttcctaaagtcacactaaatggctcgtatggatataaagagtatgatggtatgactgaatatgatgcaaataactactactatggagcaactatctccatgccgctggactttaacagaaactcanacgtggagtctgccanagtagaagcactgcanagcagtgttgagagtgatgatttgaaaaatgagatacttatcgcatataacaagagtctaaacagcatagatgagtatgaaaaaaggattcctcttttcaaagagaatattaaactctatcaagagcttgtagattttacggctggaacattt

SEQ ID NO: 16224 - protein, 239 aa, Unknown
  Obtained from environmental sample
  misc_feature (1)..(239): Xaa is any amino acid
MQNSTYLKSLFTSLAEYKKNSLLIKQSRLYIKNHEINLLINKDRYEAGEIDISALNLILIEKEREQLKLIGYESALKNTKLTMEQLSSESVSNMNLPLVPLMSLVEYLENHISILKTKSVTSTLKYKADLKSSAYLPKVTLNGSYGYKEYDGMTEYDANNYYYGATISMPLDFNRNSXVESAXVEALXSSVESDDLKNEILIAYNKSLNSIDEYEKRIPLFKENIKLYQELVDFTAGTF

SEQ ID NO: 16225 - DNA, 588 bp, Unknown
  Obtained from environmental sample
  misc_feature (1)..(588): n is a, c, g, or t
atgaacctgccactagtccccctaatgagtcttgttgagtatcttgaaaatcatatctctattctaaaaactaaaagtgtcacttctacactaaaatataaagctgacttaaaaagctctgcttatcttcctaaagtcacactaaatggctcgtatggatataaagagtatgatggtatgactgaatatgatgcaaataactactactatggagcaactatctccatgccgctggactttaacagaaactcaaacgtggagtctgccaaagtagaagcactgcaaagcagtgttgagagtgatgatttgaaaaatgagatacttatcgcatataacaagagtctaaacagcatagatgagtatgaaaaaaggattcttctttcaaaagagaatattaaactctatcaagagcttgtagattttacggctgaacaatttgacgtaggttataaaacgaaactggatcttgaatcacttcaaaactcactagatattcaaaaaacagaaacaaaaattcaaacactaaatatagagatagagaaactaaaactctattttgacactacactctctagctctctaaaatga

SEQ ID NO: 16226 - protein, 195 aa, Unknown
  Obtained from environmental sample
  DOMAIN (8)...(191): Outer membrane efflux protein
  misc_feature (1)..(195): Xaa is any amino acid
MNLPLVPLMSLVEYLENHISILKTKSVTSTLKYKADLKSSAYLPKVTLNGSYGYKEYDGMTEYDANNYYYGATISMPLDFNRNSNVESAKVEALQSSVESDDLKNEILIAYNKSLNSIDEYEKRILLSKENIKLYQELVDFTAEQFDVGYKTKLDLESLQNSLDIQKTETKIQTLNIEIEKLKLYFDTTLSSSLK

SEQ ID NO: 16227 - DNA, 939 bp, Unknown
  Obtained from environmental sample
  misc_feature (1)..(939): n is a, c, g, or t
atgttgatactatggcaaataaaattgcttacgaatatattggagttccttggaaaagaaagtgctatgggaagtgttatggaattgacaagtgaattgaatattccccttcttgtatttgtagattcagatttaaaaagtattgaaccgtggtggtttgaaagacttacaacaccaataattgaaaaaaaagcatcctatgtcacaccattttacgttagacataaatacgatggtacaataaccaataatatctgctatccattgacgacagcactttatggtgaaaaaatccgtcagcccatcggtggagattttggagttagtcttgaagttattaaaaaatatcttgcaaaaccagttgattggtggagtggagatatcggaagatttggaattgatatatttatgacaacagttgcaataaatgaaagcaaatatggtgttatgcaggctgcattaggtgcgaaaattcatgatgccaaagatcccggagaagaccttgggccaatgtttagccaagttgttggaacactattcaaattgatggaagtgtacaaagataactggaaatgtgataaagaaatacaaatggctgaaatatatggagaaatccctgaagtagaagttaaaccaataaaggtcaactttgataacttaattgcaaaatccagaagtaccgttgccgaatacgaaaattattacaaagataatttgagtgaagaaatatttaactcaataatcaatagtaatggaatgatagaagttgaattgtgggcaaaaattatatttaaatttgaagaattgtttaccaattcagaaaataaagaagaagtaataagtgcactcattcctctttattattcaagagttgcagattttgtgaatcgaacaatgaatatgacaactaatgatacagaagtctcagccgaattctga

SEQ ID NO: 16228 - protein, 312 aa, Unknown
  Obtained from environmental sample
  misc_feature (1)..(312): Xaa is any amino acid
MLILWQIKLLTNILEFLGKESAMGSVMELTSELNIPLLVFVDSDLKSIEPWWFERLTTPIIEKKASYVTPFYVRHKYDGTITNNICYPLTTALYGEKIRQPIGGDFGVSLEVIKKYLAKPVDWWSGDIGRFGIDIFMTTVAINESKYGVMQAALGAKIHDAKDPGEDLGPMFSQVVGTLFKLMEVYKDNWKCDKEIQMAEIYGEIPEVEVKPIKVNFDNLIAKSRSTVAEYENYYKDNLSEEIFNSIINSNGMIEVELWAKIIFKFEELFTNSENKEEVISALIPLYYSRVADFVNRTMNMTTNDTEVSAEF

SEQ ID NO: 16229 - DNA, 834 bp, Unknown
  Obtained from environmental sample
  misc_feature (1)..(834): n is a, c, g, or t
atggctgaggatgagggtgatgtatttggaaatggacttctatactctgagcactttaaacttctaggtgcaattgctcataaggagatatttcttgatcctaatccagatccaaaaattagttttgacgagcgtaaaagactttttgaatcttcaggtggatggataaattataataaagagctaatttctaaagggggtggtgtatttttacgttctgaaaagtccatagaactctctagtgaagtgaaaaaaatgttaggaactgcaaaaaaagctcttagcggtgaagagcttgctaaaaagctgctcatgatgagagtagacctactctttaacggtggtgtcggaacttatgttaaaagtgtagatgagagtaatctagaccttggcgataaacaaaatgaagctgtcagactagatgcacatgaacttaatgccagagtggtaagtgagggtggaaacttaggttttacacaaagagccagaattgagtatgcacaagcaggtgggaaaataaatattgatggaattgataatgcagcaggtgttgacacatctgaccatgaagtaaatttaaaaatcttactaaatattatccgatcaaaaggtcttttatgcaaagaagatgcagataaaactcttcaaggattaacagatcaggtggtaaacttagttctatggagtaactaccatcaagctcttgccatatctaaagacagctacttaagtacgaagtatcanaatgattttataacaacaattgaggtacttgaaaatagtgagttaggttttaatagaagagatttctatattcctaaaatgagaatataa

SEQ ID NO: 16230 - protein, 277 aa, Unknown
  Obtained from environmental sample
  misc_feature (1)..(277): Xaa is any amino acid
MAEDEGDVFGNGLLYSEHFKLLGAIAHKEIFLDPNPDPKISFDERKRLFESSGGWINYNKELISKGGGVFLRSEKSIELSSEVKKMLGTAKKALSGEELAKKLLMMRVDLLFNGGVGTYVKSVDESNLDLGDKQNEAVRLDAHELNARVVSEGGNLGFTQRARIEYAQAGGKINIDGIDNAAGVDTSDHEVNLKILLNIIRSKGLLCKEDADKTLQGLTDQVVNLVLWSNYHQALAISKDSYLSTKYXNDFITTIEVLENSELGFNRRDFYIPKMRI

SEQ ID NO: 16231 - DNA, 912 bp, Unknown
  Obtained from environmental sample
  misc_feature (1)..(912): n is a, c, g, or t
gtggatgcagttttaggtattcagttgacttatcggcctaaagataaagaacaccccttagattggtacataatttcaaaagacaaaagtacatttttaacacttatttatccatatagcattgaaaattatagttacttaaaagttagtaaagatgtaacaaatactcagcaccttttgaaaaaaataattagatcaattgttataataaatatacttggttttgtaatactatttatatatgcaattactatgtctaaaatgttaagctcaccagtacgtgcattgacgttaagactatcaaatatgaatgaacatctcatacgtccgattgtagtaaaagagcttcctgaagagtttgtgccgcttggtgagatgctaaacagattaataagcagaatgcaaaactttgtaaagtatcaaaaagagctctttataggtgcagcacatgagcttaaaactccactggcagtaataaagttaaaaaatcaggtaacactcataaaaaaacgaactccagaagagtatatagaagccataaatattacaaataagagcgttgatgatatgaataagatagtctccgacatattaaccataggtagagaagagggagcacaattagataagcctgtagaggtagatgtaattgaaatattaagaagcaaagcaaacgattttagattattggcagaaaatgagtcaaaagttcttgagtttaattttactcctaatgtattcatggcgacactgcaagttaaacttttaaatcaaatagcacaaaactttttacaaaatgcgctgaagtttacacctaagggtaaaaaagttattttaagaacctctcaaagtgatgagggtctgttaatggaagtaattgatgagggatgcggaatctcgagccgattctga

SEQ ID NO: 16232 - protein, 303 aa, Unknown
  Obtained from environmental sample
  DOMAIN (140)...(206): His Kinase A (phosphoacceptor) domain
  misc_feature (1)..(303): Xaa is any amino acid
MDAVLGIQLTYRPKDKEHPLDWYIISKDKSTFLTLIYPYSIENYSYLKVSKDVTNTQHLLKKIIRSIVIINILGFVILFIYAITMSKMLSSPVRALTLRLSNMNEHLIRPIVVKELPEEFVPLGEMLNRLISRMQNFVKYQKELFIGAAHELKTPLAVIKLKNQVTLIKKRTPEEYIEAINITNKSVDDMNKIVSDILTIGREEGAQLDKPVEVDVIEILRSKANDFRLLAENESKVLEFNFTPNVFMATLQVKLLNQIAQNFLQNALKFTPKGKKVILRTSQSDEGLLMEVIDEGCGISSRF

SEQ ID NO: 16233 - DNA, 357 bp, Unknown
  Obtained from environmental sample
  misc_feature (1)..(357): n is a, c, g, or t
ttgataaaaaatcctgaacaccaaaaaacatatgatggaacaacatggtttcaactttcaaaagagagtaaaaatgctctagcaaaaatagagaatttagaaacatttactaaccttgaagagttaaataacttcttagatactctgcaatatgactatcttagtctaaatctttttgcaaaagataaactcaatactttaaaaatagatacagctaaaattattagtcaaagtgagcaattctttggaacatatagtgctatgtatattaacaatcttctaaactataagggaaaacttctccacataagtttagatgaaaataacagagcttatcttttctactttactaaataa

SEQ ID NO: 16234 - protein, 118 aa, Unknown
  Obtained from environmental sample
  misc_feature (1)..(118): Xaa is any amino acid
MIKNPEHQKTYDGTTWFQLSKESKNALAKIENLETFTNLEELNNFLDTLQYDYLSLNLFAKDKLNTLKIDTAKIISQSEQFFGTYSAMYINNLLNYKGKLLHISLDENNRAYLFYFTK

SEQ ID NO: 16235 - DNA, 1083 bp, Unknown
  Obtained from environmental sample
  misc_feature (1)..(1083): n is a, c, g, or t
ttgatggaggttggaactttttttgagacctatgaagtgaataatgatgaggaaaaaatagggaaggctaaagagatagcggaacttctcaatatccagcttacaagaaaaaacaaatcaatccttgaaaactcacaaacaaatccacttatggcaggagtaccagcagtctcttttgagaaacatattaaccgtattattcaagagcaaaaatatacaatagctattattaaacaagttggaactccaccaaatgttagaagagtattggatgctataatatctcctggtacaaactttgattttgctgtttcaagtgatgaaaataatatcacttctattactgttgatatggttagaggaaattatcttatagggtatagtgccatagatgtcactactggaaaatgtttttttaatgagatgtttggaactagtgaagaccctagctttgcacttgatgaggtgtttaattatatgaatatgcacaaaacaagtgaagtagttataacctttttggataaaagtatcaatcaaaaagaggtgtgtgaatatcttgaactttcacaaaaaacttttcatatctctaacatgcgacctaaaatagcgtaccaaaatgagctttttagaaatgtatttgatattcaatcacttcttaccccaatagaacatcttaatatggaaagatatgctcttgcaagtgaaagtttagcgatacttatagattttgtaataggacacgatagtaagattatagagaagctttcatatcctgtaaaacttgatgtgagcagatatatctatcttgggaataatgctcttgaacagttaaatatcctagagatgcctcatcagccaaatttattgaaacttattaataatacagcaactgctatggggaaaagacttttaaaagagaaactaacacttcctttaaagaaggaaaagggtttaatgggcgaatttaatttaggggggattgtgaagattatcaggccccttttgaaaaccgtttgggtaatttttttgaatatgaaaggaccccccggaaaaattaaactgaacccggtatcctccctttga

SEQ ID NO: 16236 - protein, 360 aa, Unknown
  Obtained from environmental sample
  DOMAIN (1)...(103): MutS domain I
  misc_feature (1)..(360): Xaa is any amino acid
MMEVGTFFETYEVNNDEEKIGKAKEIAELLNIQLTRKNKSILENSQTNPLMAGVPAVSFEKHINRIIQEQKYTIAIIKQVGTPPNVRRVLDAIISPGTNFDFAVSSDENNITSITVDMVRGNYLIGYSAIDVTTGKCFFNEMFGTSEDPSFALDEVFNYMNMHKTSEVVITFLDKSINQKEVCEYLELSQKTFHISNMRPKIAYQNELFRNVFDIQSLLTPIEHLNMERYALASESLAILIDFVIGHDSKIIEKLSYPVKLDVSRYIYLGNNALEQLNILEMPHQPNLLKLINNTATAMGKRLLKEKLTLPLKKEKGLMGEFNLGGIVKIIRPLLKTVWVIFLNMKGPPGKIKLNPVSSL

SEQ ID NO: 16237 - DNA, 474 bp, Unknown
  Obtained from environmental sample
  misc_feature (1)..(474): n is a, c, g, or t
atgaatttcaagcaactttttttatccgtattattgatacttactattgttttatctatcaatgctcaaaatggaactattagaggatttatttataatgaaaaaacaggtgaatctgaaattggtgctacagcctatttaaaaggcactactatgggggccgcttcagatgttaatgggttttattctattaccaaaattccagcaggaaattatactttaatggttacttctttaggttttgacaccgttaaaattgctatttctataaaagcagatgaaattattaatcagaaagtatatttaaaagagggttctttaatgttaaatacctttgaactttcagcagaaaaacaagaagcaagaactgaagtgaaaatgtcggtttctaaagtaacgccaaaagaaataaagtctatggtttcaattggtggagaacctgatatcgctcaatattacaagttttacctgtga

SEQ ID NO: 16238 - protein, 157 aa, Unknown
  Obtained from environmental sample
  SIGNAL (1)...(19)
  misc_feature (1)..(157): Xaa is any amino acid
MNFKQLFLSVLLILTIVLSINAQNGTIRGFIYNEKTGESEIGATAYLKGTTMGAASDVNGFYSITKIPAGNYTLMVTSLGFDTVKIAISIKADEIINQKVYLKEGSLMLNTFELSAEKQEARTEVKMSVSKVTPKEIKSMVSIGGEPDIAQYYKFYL

SEQ ID NO: 16239 - DNA, 381 bp, Unknown
  Obtained from environmental sample
  misc_feature (1)..(381): n is a, c, g, or t
ttggcagcattaatgagttttgtacaactttccaaccgttatcagcaagttacttatgaagttgctaagctaaatcttcaaaaaaaagctaatgtaagtagtagtgttattaatcagcttgttgagaaaaatatttttgagatttatgatgtagttgtaaataggttagatgactatggaaaagaggtggaagatgttaagtcacttaatgaacatcaggtaaaagcttataacgagattaaaacatcttttaaacaacacgatactacattgttgcatggtgttacaggttctggaaaaacagaaatttatattcagcttattaaagaagcaataaagaaggcaagcaagtactgtatctgtgcctcagccgaattctga

SEQ ID NO: 16240 - protein, 126 aa, Unknown
  Obtained from environmental sample
  misc_feature (1)..(126): Xaa is any amino acid
MAALMSFVQLSNRYQQVTYEVAKLNLQKKANVSSSVINQLVEKNIFEIYDVVVNRLDDYGKEVEDVKSLNEHQVKAYNEIKTSFKQHDTTLLHGVTGSGKTEIYIQLIKEAIKKASKYCICASAEF

SEQ ID NO: 16241 - DNA, 384 bp, Unknown
  Obtained from environmental sample
  misc_feature (1)..(384): n is a, c, g, or t
gtgcttatcaaaaatgttccatctaaagaagcaagtgtagttacccaagctctcatagaaatgatacaaccagtcaaagctattactaaaataatcacaagcgataatggtaaagagttcgcatatcataagcaagtatcggctgcacttgatactgatttttactttgctaatccatatcactcttgggagagaggattaaatgaacatattaatggtttaatcagacaatatttaccaaaaaaaagtgtatttataggtgtatctaaggaagagattattatgattcaaaacagactcaaccatagacctagaaaagtactaaagtacaaaactccatatgaagtattttttagtgaaatgagtaaaaaactagctgtttaa

SEQ ID NO: 16242 - protein, 127 aa, Unknown
  Obtained from environmental sample
  DOMAIN (1)...(118): Integrase core domain
  misc_feature (1)..(127): Xaa is any amino acid
MLIKNVPSKEASVVTQALIEMIQPVKAITKIITSDNGKEFAYHKQVSAALDTDFYFANPYHSWERGLNEHINGLIRQYLPKKSVFIGVSKEEIIMIQNRLNHRPRKVLKYKTPYEVFFSEMSKKLAV

SEQ ID NO: 16243 - DNA, 804 bp, Unknown
  Obtained from environmental sample
  misc_feature (1)..(804): n is a, c, g, or t
gtgcatacaatctcactaaagcgtctaaaaaaagagaaaagcatctcttatctcatagagactatttcaaaactgcgtaaccttggagagtttgatctaattatcgatatgcaaggcttaataaaatcagccgtagtcgcaagatttataggtaaaaatgtttttggttatgataaaaactctgtacgagagaagttggcttcactattttacaaaaatacaacctcgatggattatggtgaaaatgtcattaagagaaatataaatctgatctcaaaagcactaaatatagatataacagacagagatatcttaaataaagagccatcacttccttcgcataaactacattcaaatcagatagtttttgtaataggtgcttcatgggagtctaaaaaataccctagagactcatttgttcaactagcaaacttgttaaaagagaaaattttaattctttggggagatgagagtgaatttcaagatgctttatatatagcagaacactctaaatatgttcatattagtgaaaaattttctcttttagagcttcgtgatgttatagcttgtgcaaaaatagttataggaaatgatacaggaccaactcatttagcatgggctctcaatgtaccatcagtaacactctttggtcctacaaatgagagaatgatctacgagacagcgattaactgtgctattcactcaccaagtagtgtagatatttaccatatagataaaaaagatttctccataaaagagattgatccaacacttatatttaatcaaattcaggagattgtttga

SEQ ID NO: 16244 - protein, 267 aa, Unknown
  Obtained from environmental sample
  DOMAIN (15)...(259): Glycosyltransferase family 9 (heptosyltransferase)
  misc_feature (1)..(267): Xaa is any amino acid
MHTISLKRLKKEKSISYLIETISKLRNLGEFDLIIDMQGLIKSAVVARFIGKNVFGYDKNSVREKLASLFYKNTTSMDYGENVIKRNINLISKALNIDITDRDILNKEPSLPSHKLHSNQIVFVIGASWESKKYPRDSFVQLANLLKEKILILWGDESEFQDALYIAEHSKYVHISEKFSLLELRDVIACAKIVIGNDTGPTHLAWALNVPSVTLFGPTNERMIYETAINCAIHSPSSVDIYHIDKKDFSIKEIDPTLIFNQIQEIV

SEQ ID NO: 16245 - DNA, 633 bp, Unknown
  Obtained from environmental sample
  misc_feature (1)..(633): n is a, c, g, or t
atgaaaattattttccatgaagatatggaagcacgactatactgggcattttgtcgaccctcaggctcccatccaaatcagataaaagacccacatcctcttgtatcaattatggcttttaatcactcgcgactaggagcattggaacgatttaagattatcaatcaagaagttataaaagatgatgaattacgaaaaaaaatacgaaatagaacaagaatgttatttcgcgatttgattgataatgattttacagaattaaatcaagtattagaaatagtacctgtctttttaagtgttgcaattgaccaattagtaaatggtcgactttggaatgatatagtagcttctgaaatagaagctagtaaatttttaaaaagaatctataaaagtgaagaaaatataaatgatgaatttctagaggctcttcatagaaaactagcagactttagtgagtttgatagtggagaattaaaagagtacttaaataatttacttgtgcaaaaagaacagatagataaaatcattttagaatattataaagaaaaaacttttgaatatacacaagagtgtgatttacacatacttcaaaaaaaagggctagaaaaactagcttctaatttactttcataa

SEQ ID NO: 16246 - protein, 210 aa, Unknown
  Obtained from environmental sample
  misc_feature (1)..(210): Xaa is any amino acid
MKIIFHEDMEARLYWAFCRPSGSHPNQIKDPHPLVSIMAFNHSRLGALERFKIINQEVIKDDELRKKIRNRTRMLFRDLIDNDFTELNQVLEIVPVFLSVAIDQLVNGRLWNDIVASEIEASKFLKRIYKSEENINDEFLEALHRKLADFSEFDSGELKEYLNNLLVQKEQIDKIILEYYKEKTFEYTQECDLHILQKKGLEKLASNLLS

SEQ ID NO: 16247 - DNA, 963 bp, Unknown
  Obtained from environmental sample
  misc_feature (1)..(963): n is a, c, g, or t
atgcttgaaagattcgaagagtttcaagaaactttttccaattctcaagtatgggataaagagcatctaaaaacaattgaaccaagacttgtattgattgagaatggagatgagcgacctgaaacaattgtaggggttgtttcacaaggggagtggacaaccgttgattataagaagctggcagaccatatgattgaaaatgcaaaaaaacaagatgatactacagttgatctgtttttaaattcacaagtgacagatattgagaaagttgaaaatggatttgtaataaaaactaaagataaaactattgaagctgactttgtagttgtaaatgctggtgcacactcactctatcttgcacatcaaatgggatacgggcatgagtatagttgtttaccagttgcaggaagtttttatatgacaaaccaaaaaatactaaatggtaaagtgtatatggttcaaaatccaaaactcccatttgcagcacttcatggtgatccagatattttggaaaatggtcttacacgatttggaccaactgctttagttttgccaaaactggaaagatttaaatctggtacttataaagacttttggacaacattacgatttgataaaaagattgtaaagatatttatagatttactgaaagatagtgatataagaaactatatatttagaaacttcttatttgagataccttttataaacaaaaaactttttgtaagagatgctaaaaaaatcataccagctcttagggctgatgagatagagtatgcccaagggtttggaggtgttagaccacaggttttaaataaaaaagaggaaaaactgatgctaggagaagcttctatcaatacaggtgaagggatagtatttaatatgaccccatcaccgggggctactagctgtttgggaaatgcaaaaagggatgntaataaatgtaacaaaatacttaaataa

SEQ ID NO: 16248 - protein, 320 aa, Unknown
  Obtained from environmental sample
  misc_feature (1)..(320): Xaa is any amino acid
MLERFEEFQETFSNSQVWDKEHLKTIEPRLVLIENGDERPETIVGVVSQGEWTTVDYKKLADHMIENAKKQDDTTVDLFLNSQVTDIEKVENGFVIKTKDKTIEADFVVVNAGAHSLYLAHQMGYGHEYSCLPVAGSFYMTNQKILNGKVYMVQNPKLPFAALHGDPDILENGLTRFGPTALVLPKLERFKSGTYKDFWTTLRFDKKIVKIFIDLLKDSDIRNYIFRNFLFEIPFINKKLFVRDAKKIIPALRADEIEYAQGFGGVRPQVLNKKEEKLMLGEASINTGEGIVFNMTPSPGATSCLGNAKRDXNKCNKILK

SEQ ID NO: 16249 - DNA, 756 bp, Unknown
  Obtained from environmental sample
  misc_feature (1)..(756): n is a, c, g, or t
ttggtagacactactaatgaacgtagaagggttgatattactattaaagtgcttaataaaaaagtaacagaaaaaaatgacagtactgatacagaaaaagtaaggcacaaaaaatatactattaacgatattaatgtttacctaagcaaagattttttgaataaaaatgtgagtactttcgatacggttagctataaaaaaataactatcggacatgaagatgaattaatttatcgtccgaaaatgattaatcacgccataaatattaagcctgatgaagattattctttggaagatcagcaactgacttataaataccttacagaattaggtttgtttagaacagtgaatattcagtttaataatgctgaagattcaggaaataaaataggtggtgataaaaaagaattggatgtaaatatttatttaacacctttaaaaattaaatcgttatcattagaagcaacaggaacaaatagcggtggaaaccttggtgtgaaaggagggatagtatttgtgaataaaaatttatttaaaggaggagaaagattaacagttaggttaaatggtggtttagaatcgcaacagctaattaaccagtctgcagagcaagttgagtttttaggcttgccatttaacacactagagtttggtccagaggttaatttagaatttcctaggtttatactaccttttgtaaatacagataattttgttaaaagtttaaatccaaaaccctcattaattacttattaa

SEQ ID NO: 16250 - protein, 251 aa, Unknown
  Obtained from environmental sample
  misc_feature (1)..(251): Xaa is any amino acid
MVDTTNERRRVDITIKVLNKKVTEKNDSTDTEKVRHKKYTINDINVYLSKDFLNKNVSTFDTVSYKKITIGHEDELIYRPKMINHAINIKPDEDYSLEDQQLTYKYLTELGLFRTVNIQFNNAEDSGNKIGGDKKELDVNIYLTPLKIKSLSLEATGTNSGGNLGVKGGIVFVNKNLFKGGERLTVRLNGGLESQQLINQSAEQVEFLGLPFNTLEFGPEVNLEFPRFILPFVNTDNFVKSLNPKPSLITY

SEQ ID NO: 16251 - DNA, 708 bp, Unknown
  Obtained from environmental sample
  misc_feature (1)..(708): n is a, c, g, or t
atgtccgatagcataattatcataccaacctacaatgaaaaagaaaaccttgagaaaatggttagaaaggttttttcattgaaaaaagattttcaccttttgattgtggatgataattctcctgatggatctgcacaaatagtaaaaaacttacaaaaagaattcccagagaaattacatttagaagagagaaaaggcaaattaggcttaggaacagcctatattcatgggtttaaatgggcattaaaaaataactacgaatatatttttgaaatggattgtgatttttctcataatccgaatgatttaataaaattatacaactcttgtgcaaaagagggtgctgatttagccattggttcaaggtatgtaacaggtgttaatgtggtaaactggccaatgggaagggttttaatgtcttactatgcttctgcttatgtacgtttagttacaggcatgaaaattagagatactacctctggatttaagtgttataaaagaagggttttggaaagaattaacttagacaaagttaaatttaaaggttatgccttccaaattgaaatgaagtttactacctataaattagggtttaaaattgttgaagttcctattatttttacagatagactagaaggcacctctaaaatgagtaaaggcattttaaagaagctattttgggtttatcagatgaaaactcggccataa

SEQ ID NO: 16252 - protein, 235 aa, Unknown
  Obtained from environmental sample
  DOMAIN (5)...(174): Glycosyl transferase
  misc_feature (1)..(235): Xaa is any amino acid
MSDSIIIIPTYNEKENLEKMVRKVFSLKKDFHLLIVDDNSPDGSAQIVKNLQKEFPEKLHLEERKGKLGLGTAYIHGFKWALKNNYEYIFEMDCDFSHNPNDLIKLYNSCAKEGADLAIGSRYVTGVNVVNWPMGRVLMSYYASAYVRLVTGMKIRDTTSGFKCYKRRVLERINLDKVKFKGYAFQIEMKFTTYKLGFKIVEVPIIFTDRLEGTSKMSKGILKKLFWVYQMKTRP

SEQ ID NO: 16253 - DNA, 723 bp, Unknown
  Obtained from environmental sample
  misc_feature (1)..(723): n is a, c, g, or t
atgattaattataatcccaaaaattggttcatacatattttgtcttttcataaaagcgataccattcgtattttatggaaagaattaattttaatggctttacttaccactgctatttcctatttagagattgaatttttagttgaagcatcttggcaccgtgagttaatggctgtttattctctagtgggttttgtattatcacttttgttggtttttagaacaaacactggttacgaacgctggtgggaaggaagaaaaaaatggggagaattggtaaataacactagaaatttggcaataaaaatctcaagctcttctgtatttaaccaacatgataaagatttctttgctcgtatgattcctaactatgcttatgccatgaaagaacatttacgcgaaggtgttaatatggatgaactttctcttacagaaagcgaaaaacaaatattagaaaacaaagaacataaagtaaattatatcgcaaaacttatttatgataaactacacgaagttaaatcaagaaatgagttatctgaaatagaatatttatcgttagataccaatttaaaaacctttgctgatataaatggagcttgcgaaagaataaaaacactcccatttcatattcttatagcttggttccttaaaaaattcatttttatttatgtaaccactatgccccctggcttttgtcgcttcctttggaatattggtctgtaa

SEQ ID NO: 16254 - protein, 240 aa, Unknown
  Obtained from environmental sample
  DOMAIN (1)...(231): Uncharacterised protein family (UPF0187)
  misc_feature (1)..(240): Xaa is any amino acid
MINYNPKNWFIHILSFHKSDTIRILWKELILMALLTTAISYLEIEFLVEASWHRELMAVYSLVGFVLSLLLVFRTNTGYERWWEGRKKWGELVNNTRNLAIKISSSSVFNQHDKDFFARMIPNYAYAMKEHLREGVNMDELSLTESEKQILENKEHKVNYIAKLIYDKLHEVKSRNELSEIEYLSLDTNLKTFADINGACERIKTLPFHILIAWFLKKFIFIYVTTMPPGFCRFLWNIGL

SEQ ID NO: 16255 - DNA, 354 bp, Unknown
  Obtained from environmental sample
  misc_feature (1)..(354): n is a, c, g, or t
ttgaatatcacttttttaaaaaataaatataataaagttaataattgtatttatattatctctttacataattttaaagatttcaattctgaaaaaggttgggagagtggtaataaactacttcataattttgcaaacaaattaaaagatcattttaaaggtcatatgctttttagaatacacgccaatgattttataatattgagccaagaacccatagatattgacactgcattttttgaagatattgctttcttagaaagagaagatataacgtattcagtaaagcagatatacaatgaagacgacaatattgaaacgcttcaagatgttgaaagacagatgtacatgtaa

SEQ ID NO: 16256 - protein, 117 aa, Unknown
  Obtained from environmental sample
  misc_feature (1)..(117): Xaa is any amino acid
MNITFLKNKYNKVNNCIYIISLHNFKDFNSEKGWESGNKLLHNFANKLKDHFKGHMLFRIHANDFIILSQEPIDIDTAFFEDIAFLEREDITYSVKQIYNEDDNIETLQDVERQMYM

SEQ ID NO: 16257 - DNA, 351 bp, Unknown
  Obtained from environmental sample
  misc_feature (1)..(351): n is a, c, g, or t
ttgcaaaataataaaacaaaactcgaaaaacttctttacaataagaaattttctgatcaaaatgttattaaatttgctgatggctatcatcttgatattagtctaaatgagactttttataaaaataaaaagttaaaacttacaaaaaaagagacatcatttattcagctattaatagcgcagttagatcaggtagtagattttaatcaagcagttaactatatttgggaaaacaagggtgcaacggaaaataatatccgaactctagtgtggagattaagaaataaactcccaaccgatatcataaaaagcagctcaggacatggctactacatagaatccagtaaataa

SEQ ID NO: 16258 - protein, 116 aa, Unknown
  Obtained from environmental sample
  DOMAIN (42)...(112): Transcriptional regulatory protein, C terminal
  misc_feature (1)..(116): Xaa is any amino acid
MQNNKTKLEKLLYNKKFSDQNVIKFADGYHLDISLNETFYKNKKLKLTKKETSFIQLLIAQLDQVVDFNQAVNYIWENKGATENNIRTLVWRLRNKLPTDIIKSSSGHGYYIESSK

SEQ ID NO: 16259 - DNA, 528 bp, Unknown
  Obtained from environmental sample
  misc_feature (1)..(528): n is a, c, g, or t
atgattaattttttaataaaacacacagtagtaacaatagttgtatttatatcaatatttggttcattaagcttttggtctataaagaactataatgattctttaaataatgaaaaattatttataaatttgaataataaagataaagaaataattgaattaaaaaaagaatttgatattgaaaaaaaaatctttttacaaacaaagaaagactttgataaaaaagttgctaattataactttcaagaagaaacgataataaaaaaattaaaaattgaaaatgcaaagttaaataagcaacttagtattatatcaaggttagatagtttagtagaagaatataaacatgaatatgggaaattaacgaaatttgatatgattaaagatatggaaaattataaaaaatttcaaattgcatctcaaaaatataatacattatataaacaaattctggaaaataaattagaaaaaagatatgcatcatttatagaagatacatattttagattaaaaaagattactgattaa

SEQ ID NO: 16260 - protein, 175 aa, Unknown
  Obtained from environmental sample
  misc_feature (1)..(175): Xaa is any amino acid
MINFLIKHTVVTIVVFISIFGSLSFWSIKNYNDSLNNEKLFINLNNKDKEIIELKKEFDIEKKIFLQTKKDFDKKVANYNFQEETIIKKLKIENAKLNKQLSIISRLDSLVEEYKHEYGKLTKFDMIKDMENYKKFQIASQKYNTLYKQILENKLEKRYASFIEDTYFRLKKITD

SEQ ID NO: 16261 - DNA, 654 bp, Unknown
  Obtained from environmental sample
  misc_feature (1)..(654): n is a, c, g, or t
ttgagagggaaaaatgtttcaaataatcttcataaaataatgnaagattcggataatctatctgacaaatcgacaagaaacgaaattattgattggacgaatagcgcgatggaagagatccagcattccttttctgaaactgaacagcaggagttgatgttaagctgtgcctgccaatatccaaagggaaaacttcaggaattaaaagcagattttactcaatatggagatattagcaggataatttcaaaattaaaatccaggttcattaaatttctgaaagaagatttggaactggaaatgaaggatattgagtttgttattgatcaaggttggggattagcaggtgttttaaaggataataagattattgccactaagattcccaaaagtggttacctcaaaagatatctctcagaatctgatcctgagaaaaagcgaaattattattgccattgtccgagaataagaagtgtaatggagtcagataaaatgattcccacaatttattgttattgtggcgctggattctataaaggaatatgggaagaaattctccagaaaccggttaagataaaactattgaagagtgtgttaaaaggtgatgatgtatgtcaaatcgagatacagctgcctatggaaagttcaatctga

SEQ ID NO: 16262 - protein, 217 aa, Unknown
  Obtained from environmental sample
  misc_feature (1)..(217): Xaa is any amino acid
MRGKNVSNNLHKIMXDSDNLSDKSTRNEIIDWTNSAMEEIQHSFSETEQQELMLSCACQYPKGKLQELKADFTQYGDISRIISKLKSRFIKFLKEDLELEMKDIEFVIDQGWGLAGVLKDNKIIATKIPKSGYLKRYLSESDPEKKRNYYCHCPRIRSVMESDKMIPTIYCYCGAGFYKGIWEEILQKPVKIKLLKSVLKGDDVCQIEIQLPMESSI

SEQ ID NO: 16263 - DNA, 315 bp, Unknown
  Obtained from environmental sample
  misc_feature (1)..(315): n is a, c, g, or t
atggctcggatcatttggttatacactacaatagctccaaatgcaacacttacagatggtatgtttgatgtttgcattgttaaaaaacctgaaatctataaactgccccttattgctaaccttctgctattgcggaaactcgaaatgtcgcctcttgtaagagttattaaagcaaaggaattaaaaatttgtagggaaaaaccaggtgttgtaaatattgatggggaagccattatgtttgataaagatgtttcaataaaaataaaccctttatctttgaaaattataataaatccagatgtcagcaaagtttaa

SEQ ID NO: 16264 - protein, 104 aa, Unknown
  Obtained from environmental sample
  misc_feature (1)..(104): Xaa is any amino acid
MARIIWLYTTIAPNATLTDGMFDVCIVKKPEIYKLPLIANLLLLRKLEMSPLVRVIKAKELKICREKPGVVNIDGEAIMFDKDVSIKINPLSLKIIINPDVSKV

SEQ ID NO: 16265 - DNA, 339 bp, Unknown
  Obtained from environmental sample
  misc_feature (1)..(339): n is a, c, g, or t
atgtcagcaaagtttaaaaatacaaaggttatttattcaaccaacccagattataatcaatgggaagatgaagaagaggttatggaaacactatcgaaagataaacaaaagttatatgtaagtatcgataaaaaacagcgaaaaggtaagaaagtaaccttagttgcgggttttattggtgatgaaaatgatcttaaagaattaggtaaaatacttaaatccaaatgtggagtaggagggacggttaaagacggtgagatactcattcaaggcgattttaaggaaaaagtaaatgatatcctgttggatcttggatataaatcgaaaatgataggttaa

SEQ ID NO: 16266 - protein, 112 aa, Unknown
  Obtained from environmental sample
  DOMAIN (32)...(110): Translation initiation factor SUI1
  misc_feature (1)..(112): Xaa is any amino acid
MSAKFKNTKVIYSTNPDYNQWEDEEEVMETLSKDKQKLYVSIDKKQRKGKKVTLVAGFIGDENDLKELGKILKSKCGVGGTVKDGEILIQGDFKEKVNDILLDLGYKSKMIG

SEQ ID NO: 16267 - DNA, 549 bp, Unknown
  Obtained from environmental sample
  misc_feature (1)..(549): n is a, c, g, or t
atggttatgaatgatcctgtaaaggagtataataaactatatgaggttcagtacgatcgtaacttatttgaaggtagtaactggaaatatatcaaccttccaaatgataaaattaaagaatttgccagtaaatcaatcatcggtaatgaagctatgtatttttcatgtgatgttggtaaacaactaaatgtaaaaagtggtgtacttgatttagacaattataattatgaagatttgatgggtgttgatttttcgatggataaaaaacagcgaatcgaaacattcgaaagtggatcaagtcatggaatggcattggtaggtgtaaatatattacctgatggatccatcgataaatggcttctcgaaaacagttggggagcaacaaaaggtcacaagggttatttaacgatgactgatagatggtttgatgagtatatgtttcgtttggttatccataaacgttttatcgatgaaaaaactcttaagatattaaatcaaaaaccaatattgcttccaccttgggatccaatgtttgccgatgaagagtaa

SEQ ID NO: 16268 - protein, 182 aa, Unknown
  Obtained from environmental sample
  DOMAIN (1)...(178): Peptidase C1-like family
  misc_feature (1)..(182): Xaa is any amino acid
MVMNDPVKEYNKLYEVQYDRNLFEGSNWKYINLPNDKIKEFASKSIIGNEAMYFSCDVGKQLNVKSGVLDLDNYNYEDLMGVDFSMDKKQRIETFESGSSHGMALVGVNILPDGSIDKWLLENSWGATKGHKGYLTMTDRWFDEYMFRLVIHKRFIDEKTLKILNQKPILLPPWDPMFADEE

SEQ ID NO: 16269 - DNA, 504 bp, Unknown
  Obtained from environmental sample
  misc_feature (1)..(504): n is a, c, g, or t
atgaattcatttaccgaagaaaattatttgaaagctatttataagttgagtttaaatggggttcagggagtttctactaatgctattgcagataaactagcaacaaaaccttcttctgtaacagatatgattaaaaaattagcagataaaaaattggttagttaccaaaaatatcaaggagttaatttaacaaaaagaggtagggatatagcagtttctattattagaaatcacaggctgtgggaagtttttttggtggaaaaattaaattttaaatgggatgaagtgcatgatttagctgaagagctagagcatattaatacgcataagctaacagaaagattagatgagtttttagaatttcctaagttcgaccctcatggggatcctattcctgataaggatggaaatatagttcagcataaagatattacactttcagatttatctacagggagaaaaacggtaatagtgggaattaaaaaccattctaaagttttttaa

SEQ ID NO: 16270 - protein, 167 aa, Unknown
  Obtained from environmental sample
  DOMAIN (1)...(62): Iron dependent repressor, N-terminal DNA binding domain
  misc_feature (1)..(167): Xaa is any amino acid
MNSFTEENYLKAIYKLSLNGVQGVSTNAIADKLATKPSSVTDMIKKLADKKLVSYQKYQGVNLTKRGRDIAVSIIRNHRLWEVFLVEKLNFKWDEVHDLAEELEHINTHKLTERLDEFLEFPKFDPHGDPIPDKDGNIVQHKDITLSDLSTGRKTVIVGIKNHSKVF

SEQ ID NO: 16271 - DNA, 702 bp, Unknown
  Obtained from environmental sample
  misc_feature (1)..(702): n is a, c, g, or t
atgtcaatttttactaaagtttttatactgttttctattagtattttgttgatgttgtacttatcaacaaaaacaaatgctataactgacgaaaaaatagaactaatacataaagagaaatatatacaagcctcaaaagaactttttaattatcttgtaaatggagatatgacaacattaaataaaagagttcaagagttaaattatgagaaaagaacattagatacaaatagtgaagatttttctactatatataaacaagctatctcctttggacaaataaaaatatttaaacaagatgatctatattttctttttatggaatatcttgatgataagttttatttttatgatagatctcaaaaaaaagggattgaacaaaaagagcatttaaattatcttatagtagttgatatagctatcttgattattatgtttttagtgatcattaatattttaagaccccttaaatctatatcaaaaggtattaaaaagtttggtagtggtgactactcttcaaggcttgacacatcaaattcaaaagatgagataggagaagttgttgatagatttaatacaatggctgacaatcttgaaagcttaataatagcaagaacccagtttttaaatgatattagtcatgaactaagaactcctatttcaaaagcaaagctttcattggagatgatagaggagagttag

SEQ ID NO: 16272 - protein, 233 aa, Unknown
  Obtained from environmental sample
  DOMAIN (131)...(200): HAMP domain
  misc_feature (1)..(233): Xaa is any amino acid
MSIFTKVFILFSISILLMLYLSTKTNAITDEKIELIHKEKYIQASKELFNYLVNGDMTTLNKRVQELNYEKRTLDTNSEDFSTIYKQAISFGQIKIFKQDDLYFLFMEYLDDKFYFYDRSQKKGIEQKEHLNYLIVVDIAILIIMFLVIINILRPLKSISKGIKKFGSGDYSSRLDTSNSKDEIGEVVDRFNTMADNLESLIIARTQFLNDISHELRTPISKAKLSLEMIEES

SEQ ID NO: 16273 - DNA, 618 bp, Unknown
  Obtained from environmental sample
  misc_feature (1)..(618): n is a, c, g, or t
atgtggggtgatataaataagcaaagaatagataaatgggctacaaagacaaataaacataaagctattataggtggcaacatgtggcttgcttacaataaaaaaattagtattggtgaaactatagaaaaaatagataatgacaagctaactatattagtatcactacagggtgatagtttcatacctgaattttttatagagtttattgaaaaatttggaagtaattataactggtattttcgagatcatccaaggatacctatatcaaataaaataaaaagtatatttgaaaagtatgcatttgaaaattttgaaaccacagctaagtataatttgtatagtttattaaaagttgttgatgttaatattacaggtttttcaacagtagcttttgaagcacaaagttttgataaactaacaatatttacacatgaaaatgcaaaaaatggattcaataatttattaaataaagatggatttatatatgttgatactaaattagctttaaatgagactttggataaaataagattcaataaactaaaaattaaaaattattatattatttcagatagtagtataatttataaaacaatgaaagagataataaattga

SEQ ID NO: 16274 - protein, 205 aa, Unknown
  Obtained from environmental sample
  misc_feature (1)..(205): Xaa is any amino acid
MWGDINKQRIDKWATKTNKHKAIIGGNMWLAYNKKISIGETIEKIDNDKLTILVSLQGDSFIPEFFIEFIEKFGSNYNWYFRDHPRIPISNKIKSIFEKYAFENFETTAKYNLYSLLKVVDVNITGFSTVAFEAQSFDKLTIFTHENAKNGFNNLLNKDGFIYVDTKLALNETLDKIRFNKLKIKNYYIISDSSIIYKTMKEIIN

SEQ ID NO: 16275 - DNA, 306 bp, Unknown
  Obtained from environmental sample
  misc_feature (1)..(306): n is a, c, g, or t
ttgaatttagccccaatagtcttgtttgtttacaatagaccagatcacacaaaacaaacagttgaagcactacagaaaaatgagttagctagtggtagtgagctttttatatatagtgatgaagctaaaaatgaagatgctaaaaaaaatgttaatnaagtaagagagtatataaaaattatagatgaatttaaaaatataactatagttgagcgagataaaaactggggtcttgcaaacagcgttattgatggtgttactaaaatagtaaatgaatatggaaaaattatagttcctgaagaatga

SEQ ID NO: 16276 - protein, 101 aa, Unknown
  Obtained from environmental sample
  misc_feature (1)..(101): Xaa is any amino acid
MNLAPIVLFVYNRPDHTKQTVEALQKNELASGSELFIYSDEAKNEDAKKNVNXVREYIKIIDEFKNITIVERDKNWGLANSVIDGVTKIVNEYGKIIVPEE

SEQ ID NO: 16277 - DNA, 771 bp, Unknown
  Obtained from environmental sample
  misc_feature (1)..(771): n is a, c, g, or t
atgcatgttgaggtgagtaaacttcttatgcaaagaggtgagttcccattcctggttagtcttaccagttttagtgataaattatcgcgatggtgtaataaagaatacagctattacctgacgaaacctgacgaatttgaagacgaattgctggataccaaagaagacttgctcgaccccataaagcgctttatgaatggtgaacaggctaagatttacagcgacatcaaaaacctgctggctggtgatacctctaatcttgattatgttgaaggcaatgagataaatgtattacatagtataattgatgccgacaaaccctatacaggcaacaaaataaaagatgcaaaggcaagtaaggatgcactctcaaagaaggtgcaggacaagatctcttcagaaaaaacagaagctgttcaatccatcgaaaaggcaattgttgatttaatggcaaaagatgatttctccgaattagaggaactccagcaaagaacaattgtaaagcctcttgaggatgaactggagaagctgcaaaagacaaaatatattgcccgtatacgtgatattaaaagaagagctaccgatgatatattcaccaagcaattaaatgcgatggtcgcacttgccaatctggtagagcaaccaaatgatggtgcaagtgtggtggcggaacctaaagttcattacataaaaagaagcaacgtaaaaccaccattttcaaagtctgagttaaaacagaagaagaggtggatgagtatgtggaagcattaa

SEQ ID NO: 16278 - protein, 256 aa, Unknown
  Obtained from environmental sample
  misc_feature (1)..(256): Xaa is any amino acid
MHVEVSKLLMQRGEFPFLVSLTSFSDKLSRWCNKEYSYYLTKPDEFEDELLDTKEDLLDPIKRFMNGEQAKIYSDIKNLLAGDTSNLDYVEGNEINVLHSIIDADKPYTGNKIKDAKASKDALSKKVQDKISSEKTEAVQSIEKAIVDLMAKDDFSELEELQQRTIVKPLEDELEKLQKTKYIARIRDIKRRATDDIFTKQLNAMVALANLVEQPNDGASVVAEPKVHYIKRSNVKPPFSKSELKQKKRWMSMWKH

SEQ ID NO: 16279 - DNA, 624 bp, Unknown
  Obtained from environmental sample
  misc_feature (1)..(624): n is a, c, g, or t
atgactaaagacgaactcatacaaaaattatccgacctcgaatgggaagattttgaggtgaaagcggcaaaagctgaagtaccaaaagatgcttgggaaaccgtaagtgctttttcaaatacttccgggggatggttgctttttggcgtgaaacaaatcgggaaaaaattcgaggtacaaggtgtaacaaatcctgagaaaattgaacaggatttcctaaacacaattcgtggggggaagtttaatatttttgttccaacacgtcaggaaaaacacaccattgaagggaatacggtaatagtattttatattcccgcatcgaaaaacaaacctgtttattacaatagccttgcaaataccttcattcgcaggggaagctccgaccaacgtgctaccaaagaagaaatagattccatgtaccgcgatcagacttttggcacaaagacctctgaagtggccgtaggtaccagtcgtgcagatattaataatgcatctctatctcgctaccgtgattatatgagccgttttaatccttctgtaagttataatcgttacaatgaaaccgattttttgcagaagcttcggattatggatggcgaccattgtacgtctcagccgatctga

SEQ ID NO: 16280 - protein, 207 aa, Unknown
  Obtained from environmental sample
  DOMAIN (38)...(134): Divergent AAA domain
  misc_feature (1)..(207): Xaa is any amino acid
MTKDELIQKLSDLEWEDFEVKAAKAEVPKDAWETVSAFSNTSGGWLLFGVKQIGKKFEVQGVTNPEKIEQDFLNTIRGGKFNIFVPTRQEKHTIEGNTVIVFYIPASKNKPVYYNSLANTFIRRGSSDQRATKEEIDSMYRDQTFGTKTSEVAVGTSRADINNASLSRYRDYMSRFNPSVSYNRYNETDFLQKLRIMDGDHCTSQPI

SEQ ID NO: 16281 - DNA, 624 bp, Unknown
  Obtained from environmental sample
  misc_feature (1)..(624): n is a, c, g, or t
gtgattaactttctcttagatcaactcaaaggggataataaataccttgaaataggagtaagaaacccaaatgttaatttcaataaaattaactgcgaaacaaagtatagtgttgatccaggtattgaatttaaagaaaatcccgttgattttaaattaactagtgacgaattttttaatgagctttctaagggtaatattttagataagggaattaagtttgatgttatatttattgatggacttcacttagcaaatcaagtgtataaggacattttaaatgcattagattatttaacagaagatggttttatagtagttcacgattgtaatccaccaacagaataccatgcaagagaagatcatgggttcacattatctccagccagaaatttttggaatggttctgtatggaaagcattttataagatgcgttttaatgcagagacatcttgtttttgcatagattctgattggggaattggtgtaattagtaaacaaaaaatagtagctcctttaacagaagattttaatccttttttggaatattttatttttgatgctcaacgaaaggagagtttgaatttaatggattttgaaacattcaaatcgatgatagtttaa

SEQ ID NO: 16282 - protein, 207 aa, Unknown
  Obtained from environmental sample
  misc_feature (1)..(207): Xaa is any amino acid
MINFLLDQLKGDNKYLEIGVRNPNVNFNKINCETKYSVDPGIEFKENPVDFKLTSDEFFNELSKGNILDKGIKFDVIFIDGLHLANQVYKDILNALDYLTEDGFIVVHDCNPPTEYHAREDHGFTLSPARNFWNGSVWKAFYKMRFNAETSCFCIDSDWGIGVISKQKIVAPLTEDFNPFLEYFIFDAQRKESLNLMDFETFKSMIV

SEQ ID NO: 16283 - DNA, 768 bp, Unknown
  Obtained from environmental sample
  misc_feature (1)..(768): n is a, c, g, or t
gtggagcattttgcaggggtagataatagaattacttatataaggcagccaaaaaatttgggtatctctagaaatatggagtttttactttctcaatcaaatactccttattttatgtgggcagcagatgatgatttgtgggacaaaatgtttgttgaaaaattaataattttattaaatcaaaacaaagaagctatagctgctttttgtaggtatagtcttatcaatgatgagggggcacaattagataaaggaaggttatttcaatatggtgctgctaagccaaaccaacggttaaacaaatttattacgaacccgaatgatgcatttggatatggtatttttagaacagaaaaaataaaagggcttagatttcctgtttggtggtggcccaatcaaaaatgtgcctataataatatttaccctacgctttgtttctatttagctaagggagatatagtttatcatcaatcggatgttttattttttaagcgagttaaaaaagaagcattggttaatcataaactgccttacaaagaaaatagtttacccgaagtaattgcttacagcataaggaagtttaacctagtgtggatatcttttttgatgattaaaaaagcgagtgatttaaaagtaggtttttctgttttccctttgctaatacaccaatggtttattaaaccttcttattataaatggaaacattttgtaaaaatcacgctaggcattaacacagtatctaaacgaaaaacagattatctttattaa

SEQ ID NO: 16284 - protein, 255 aa, Unknown
  Obtained from environmental sample
  misc_feature (1)..(255): Xaa is any amino acid
MEHFAGVDNRITYIRQPKNLGISRNMEFLLSQSNTPYFMWAADDDLWDKMFVEKLIILLNQNKEAIAAFCRYSLINDEGAQLDKGRLFQYGAAKPNQRLNKFITNPNDAFGYGIFRTEKIKGLRFPVWWWPNQKCAYNNIYPTLCFYLAKGDIVYHQSDVLFFKRVKKEALVNHKLPYKENSLPEVIAYSIRKFNLVWISFLMIKKASDLKVGFSVFPLLIHQWFIKPSYYKWKHFVKITLGINTVSKRKTDYLY

SEQ ID NO: 16285 - DNA, 879 bp, Unknown
  Obtained from environmental sample
  misc_feature (1)..(879): n is a, c, g, or t
ttgggtttatggctgggattcataaaacccattgagaacgagggtgcgtcaagggatcttgaagagagtctcaggtttactttttcccaggccccggaacacgaatcggttattttaacaggcctgggggtcgctgttcctgaaataatagaatatgtgaaccgatttgcagcaagcggtgtcacgcccctgttaatctcaaaaacatcacaggtgacgtcaaaggatcccgacccggccgatgctgcctttggcacggcggcaggggccggaatacgagagcttaaagacaagtcatttaaaaatgttggcatcgatgatcttgacccgctttatataaggatcaagaaaaatgcttatatcatgccccttgccgcgacgggaatgattgccctgggtcttctagggcataatcaatatatgaaatatcaggaaagacaattcaaggctgaaataaaaaaatattccgttgagctgaaaaaaaacaaagccaaaatccagaaatatgaaaccttgttagaggaaagtgacaaaatcaatgaggacatcaaaaacaccaaaaataaaataacctttgtagaaaaagagtctgataaaaccctggttaatctgatcacatactttactacatttgcatctgatcttccctgcgaagttgtcctggattcaatttgtcaaaatgaagataaaattaacatttttttgataaagggaagatcctatgaacttaatcccataggagagtttgccacctcccttcaacggtattggtggtgtgactctgccgtaataaaagaactgaaaaaagcggatcaaggggaaaagctatattttgaaatgtcaataaaaaccaagggaacacaggataaaaacaaatga

SEQ ID NO: 16286 - protein, 292 aa, Unknown
  Obtained from environmental sample
  misc_feature (1)..(292): Xaa is any amino acid
MGLWLGFIKPIENEGASRDLEESLRFTFSQAPEHESVILTGLGVAVPEIIEYVNRFAASGVTPLLISKTSQVTSKDPDPADAAFGTAAGAGIRELKDKSFKNVGIDDLDPLYIRIKKNAYIMPLAATGMIALGLLGHNQYMKYQERQFKAEIKKYSVELKKNKAKIQKYETLLEESDKINEDIKNTKNKITFVEKESDKTLVNLITYFTTFASDLPCEVVLDSICQNEDKINIFLIKGRSYELNPIGEFATSLQRYWWCDSAVIKELKKADQGEKLYFEMSIKTKGTQDKNK

SEQ ID NO: 16287 - DNA, 357 bp, Unknown
  Obtained from environmental sample
  misc_feature (1)..(357): n is a, c, g, or t
gtggaaaagaccatcgaaaaaaataaaaaaattcttgaagatcttcgccgggagagcggtgatctttcagtcaaaaccggccaccccgatgaaatcacagagcttttaagtcaaataaaccagataattgagtcaaacagacttgatgtcaatttaattgttccacaacagggaatagatggccgttttttcaaatgggccccatttcaaatggatctttccggctcatttgccagtcttatcgcctttatggaagagataaagaatcttgatgatgctgtggatatcaggaatctggttcttgaaaattcaggcgaaaaaaagggcatcaatataaaatttacattgaaaatttaa

SEQ ID NO: 16288 - protein, 118 aa, Unknown
  Obtained from environmental sample
  misc_feature (1)..(118): Xaa is any amino acid
MEKTIEKNKKILEDLRRESGDLSVKTGHPDEITELLSQINQIIESNRLDVNLIVPQQGIDGRFFKWAPFQMDLSGSFASLIAFMEEIKNLDDAVDIRNLVLENSGEKKGINIKFTLKI

SEQ ID NO: 16289 - DNA, 570 bp, Unknown
  Obtained from environmental sample
  misc_feature (1)..(570): n is a, c, g, or t
atgagaatatccatattattggcagtagtaagttcaatcatatttgcacaagagtactcagttcaggtaatggcacttaaagatgaaaaaaatgtgacgccagatttactgatgaaggtagaaaagtttggtaagtgtcagattatacatgaagatggttacacaaaagtaagggtaggtggatttgatgattatttaaaagtatcttcaaaacttttagagataaaaaattcttttacttgtgatgcatttctagttaaagaaaaagttgattgtaaagatcagaaaatgactatggctaaagctgatgtagaaaaagatgtaaagagtttacctaaagaagttgcattaaaagagagtatttctgaatctaataatactatgaagacaacagaggtatttatggacacttctagaaataatataatgatgagcagtacaaaaatagttataaaagagagtccaaaaataacaaaaaaagagtcaaaaaaactacgtcgtanatctgaactcgcagaagccatggctttttatgcaaactcagattactacaattttgctgggtattag

SEQ ID NO: 16290 - protein, 189 aa, Unknown
  Obtained from environmental sample
  SIGNAL (1)...(16)
  misc_feature (1)..(189): Xaa is any amino acid
MRISILLAVVSSIIFAQEYSVQVMALKDEKNVTPDLLMKVEKFGKCQIIHEDGYTKVRVGGFDDYLKVSSKLLEIKNSFTCDAFLVKEKVDCKDQKMTMAKADVEKDVKSLPKEVALKESISESNNTMKTTEVFMDTSRNNIMMSSTKIVIKESPKITKKESKKLRRXSELAEAMAFYANSDYYNFAGY

SEQ ID NO: 16291 - DNA, 627 bp, Unknown
  Obtained from environmental sample
  misc_feature (1)..(627): n is a, c, g, or t
atggaaaggggtttgatgaaaggaaaaaaaactggtggaagaaaaaaaggtacaacaaataaaaaatcaattttttatacatatcaagaagatattatttgttattttaaaaatggaaattcaataaatcaaactctaaaaaaaataaataaaagaaataatgagaatttttctgtaagtggattttggtcatatataaagaaaatgaagttagatgtttatctcacagaaaaaagtcctgctaagtcagtatatacatataaaagggaacaagaagtaaatgaatataagatagataaagataaatatacaatattttttcgttgccataaagtaaggtttccaagtggtcttaatagtgtatattataataattttggattaaacaaaatggaaaaaatattatctaattatgataaacagttttcagaagaagaggtatatgagaatatttatgaaccaatacttaacttaattaatgaatttgacaatacgcatatagataaagcttttagggattataccaatagtttaaatacagaagaaaatacatataattattcttctaaatataanaatgaaaaaagtatacgaaaganaagaattgatattaatgaatacttttaa

SEQ ID NO: 16292 - protein, 208 aa, Unknown
  Obtained from environmental sample
  misc_feature (1)..(208): Xaa is any amino acid
MERGLMKGKKTGGRKKGTTNKKSIFYTYQEDIICYFKNGNSINQTLKKINKRNNENFSVSGFWSYIKKMKLDVYLTEKSPAKSVYTYKREQEVNEYKIDKDKYTIFFRCHKVRFPSGLNSVYYNNFGLNKMEKILSNYDKQFSEEEVYENIYEPILNLINEFDNTHIDKAFRDYTNSLNTEENTYNYSSKYXNEKSIRKXRIDINEYF

SEQ ID NO: 16293 - DNA, 531 bp, Unknown
  Obtained from environmental sample
  misc_feature (1)..(531): n is a, c, g, or t
ttgggcccgatggcccgatatcttttgaatgtgtttacttttaaagatcttaaagatgatgttgaagaaaaaacagaattattaaatattaagtttaaaatattttgggtttattttttagatttatttaaaatggatttggatttattagttaaaatggaagatcgtcaaaaagaagcgaagtcagaaggagattcggaattatatgaaaaaatattgaataattataatgagattaattatacattgatacctgttcaatatccgaagattgaaaatgtagaaaatttattattaaatgatttgatttttttatttaaagagtttaaaaattcttatggtgaaatagatgataagaattttagtttttctattttatctcaaggtgcattagatcaaattcaagaatttattaaattattaagaatagaaatttatttttgggggaattgtgaatttagatatggttttgtcggtgaaatggatagaatgaaaaatattttaaaagaagaaaataaaataatattataa

SEQ ID NO: 16294 - protein, 176 aa, Unknown
  Obtained from environmental sample
  misc_feature (1)..(176): Xaa is any amino acid
MGPMARYLLNVFTFKDLKDDVEEKTELLNIKFKIFWVYFLDLFKMDLDLLVKMEDRQKEAKSEGDSELYEKILNNYNEINYTLIPVQYPKIENVENLLLNDLIFLFKEFKNSYGEIDDKNFSFSILSQGALDQIQEFIKLLRIEIYFWGNCEFRYGFVGEMDRMKNILKEENKIIL

SEQ ID NO: 16295 - DNA, 366 bp, Unknown
  Obtained from environmental sample
  misc_feature (1)..(366): n is a, c, g, or t
atgacaaataaaaatataaaaattaaagattggcaggaaatgactttgggagaagttgcagagattaaaggtggaaaacgattgcctaaaggcgaatcactcattattaataaaaccaatcatccttatattagaattacagatttagaaaatggttatataaaaaaagaaaaattgcagtttataactgatgatgtattttctaatatttcaaggtatatagtaaaatcgggtgatattataatatcaattgttggaactattggtttgattgctaaaatagacaatgatttagataatgcaagcttaactgaaaattgtgntaaatgtattaatttatataggattgattccntttttctttaa

SEQ ID NO: 16296 - protein, 121 aa, Unknown
  Obtained from environmental sample
  misc_feature (1)..(121): Xaa is any amino acid
MTNKNIKIKDWQEMTLGEVAEIKGGKRLPKGESLIINKTNHPYIRITDLENGYIKKEKLQFITDDVFSNISRYIVKSGDIIISIVGTIGLIAKIDNDLDNASLTENCXKCINLYRIDSXFL

SEQ ID NO: 16297 - DNA, 324 bp, Unknown
  Obtained from environmental sample
  misc_feature (1)..(324): n is a, c, g, or t
atgagagttgattattctgcaaaggaagtgattgaaacaatacaagatcctcctttttatatacagcatttagaaaattcgaataatattaaagaggtctatgattcagtacttgatttacaaccatacttaaattatttttctgaaaaagagatgtctcttttaagtaagttgtttattgagaatgaaaatattgcattggcttgtaatgagtttgtagaggtcagagcattctttcatcaattatttaaaatgtggaaaaataaaatatcagaagaacaaaaggaaattattcgaagtgtttataaaagtataattaattaa

SEQ ID NO: 16298 - protein, 107 aa, Unknown
  Obtained from environmental sample
  misc_feature (1)..(107): Xaa is any amino acid
MRVDYSAKEVIETIQDPPFYIQHLENSNNIKEVYDSVLDLQPYLNYFSEKEMSLLSKLFIENENIALACNEFVEVRAFFHQLFKMWKNKISEEQKEIIRSVYKSIIN

SEQ ID NO: 16299 - DNA, 714 bp, Unknown
  Obtained from environmental sample
  misc_feature (1)..(714): n is a, c, g, or t
ttgaaaaatgtaaaattatttgtggagtcacaagaggtaagtaagttagatatttatgcacatttaaaatgtaataaggatgaagtaaaagtattacaataccttactcgtcaatatattataggaaatgataatatccttgttgtagatattttaggtgaattttatgatattaaaaaacttgaacatatagagcatatctatttgattaaaaacttattagaattagggtggataactcaaagtaactttattactacaaaaataagtgagttgtcacaacttgaacttataaatacagcagtgagtttaagtagctcatttttaaaacttctagaggttggttcacttgaacttactttaccagaaattaaagagtatagtgatcatcttgagtatttacaagatcaattttttaaaattgatttagcacaaaagcttaatattgtaaaacataattttgatgaaaactcaccaaatgcaaatcgtcttagaagtaaattatctcttttagaaaataggataaaagagagagttgaaactacaaaaaataatattatgcttgaagatttttttagacaacatgatttagctgaaaaagagcagatgatatttttagcacttttaaaagaggaatatggtggaagtgatgaatcaattcgagatatgaactctttgattgcattggtttcagtgatgattatgagaagataa

SEQ ID NO: 16300 - protein, 237 aa, Unknown
  Obtained from environmental sample
  misc_feature (1)..(237): Xaa is any amino acid
MKNVKLFVESQEVSKLDIYAHLKCNKDEVKVLQYLTRQYIIGNDNILVVDILGEFYDIKKLEHIEHIYLIKNLLELGWITQSNFITTKISELSQLELINTAVSLSSSFLKLLEVGSLELTLPEIKEYSDHLEYLQDQFFKIDLAQKLNIVKHNFDENSPNANRLRSKLSLLENRIKERVETTKNNIMLEDFFRQHDLAEKEQMIFLALLKEEYGGSDESIRDMNSLIALVSVMIMRR

SEQ ID NO: 16301 - DNA, 873 bp, Unknown
  Obtained from environmental sample
  misc_feature (1)..(873): n is a, c, g, or t
atgttttcgttagtgnataaaagtttgaaaaaaagaaaaaaaggaaatcctgttcgatttagttttgataaaaaaatgagcaaggatttattagaatatattgtgaaactttttaaaataggaaaggttgatgttgtgttatcgggcgggagataccataatacaaaggattttataaaatttcctaatgtacttgggtctgatgccgtttttgaaaaattaaaaccaattccaattcctgattttgataatcaaaaaagtttctttgaaactttgagcaaaaaagacatacttttacattatccgtatcattcatttaactattttattgattttttgaaagaggcatcagttgatccttacgttgaaagcattaaagttactttgtatcgtttgagtaaagaatctgacgttatttcagcattgctaaatgctgtgagaaatgggaaattagtaactgttgtaatagaattgcaagctcggtttgatgaggtagcaaatatttattggagtgaaatgcttacagacggaggagtacgtgttatttacggtgtgcagggactgaaagttcattcaaaattgactcttattaaaagaattgaaggagagaataaaaaatattatgcagctattggtactggaaattacaatgaaacaactgctaagatttatacagattttactattttaactgctgatagtaggataaccaaggatattgtaaaattattttcattctttaaaaacaattataaacattttgattataaacatcttcttgtttcgccattcaatgcacgtgaaaaattacaaaatcttattaatactgagatagagaatgccaaacaaggcaaaaaagcgtttattcattaa

SEQ ID NO: 16302 - protein, 290 aa, Unknown
  Obtained from environmental sample
  DOMAIN (1)...(290): Polyphosphate kinase
  misc_feature (1)..(290): Xaa is any amino acid
MFSLVXKSLKKRKKGNPVRFSFDKKMSKDLLEYIVKLFKIGKVDVVLSGGRYHNTKDFIKFPNVLGSDAVFEKLKPIPIPDFDNQKSFFETLSKKDILLHYPYHSFNYFIDFLKEASVDPYVESIKVTLYRLSKESDVISALLNAVRNGKLVTVVIELQARFDEVANIYWSEMLTDGGVRVIYGVQGLKVHSKLTLIKRIEGENKKYYAAIGTGNYNETTAKIYTDFTILTADSRITKDIVKLFSFFKNNYKHFDYKHLLVSPFNAREKLQNLINTEIENAKQGKKAFIH

SEQ ID NO: 16303 - DNA, 684 bp, Unknown
  Obtained from environmental sample
  misc_feature (1)..(684): n is a, c, g, or t
atgataacaatttcagaaatattagaccttgcaatacgagaagatataggcgatggcgaccacacaactttgtcaactattcctgctgatgcgataggaacagcaatattattttcaaaagatgaaggaattctttcaggagtcgaaattgcacgaaaagtgtttgaaaaaattgataaagatttacaacttgaggtttttataaaagatggtgaagaaataaaaagaggggtagaaatttttacaataaaagggaaagttcggtcgattttgcaatcagaacgtttgatgttaaattttatgcaaagaatgagcggaattgcgactcaaacaaataaatacgcaaaattaattgcagatttaccaacaaaagttcttgatactcgaaaaacaacaccaaatatgcgagtttttgagaaaatggcagtcgaaatgggtggcggaatgaaccacagaatgggactttacgatatggttatgataaaagataatcacattgattttgctggtggaatagaacaagcaatcacaagagtaaattcttatctaanagaaaaaaataaaaatttacaaattgaaatagaagtgcgtgatttttacgaactataccaaagttttgaaagtggaaatattcacagaattatgcttgataatttactcccgaacaaacaaaaaagctgttga

SEQ ID NO: 16304 - protein, 227 aa, Unknown
  Obtained from environmental sample
  DOMAIN (107)...(226): Quinolinate phosphoribosyl transferase, C-terminal domain
  misc_feature (1)..(227): Xaa is any amino acid
MITISEILDLAIREDIGDGDHTTLSTIPADAIGTAILFSKDEGILSGVEIARKVFEKIDKDLQLEVFIKDGEEIKRGVEIFTIKGKVRSILQSERLMLNFMQRMSGIATQTNKYAKLIADLPTKVLDTRKTTPNMRVFEKMAVEMGGGMNHRMGLYDMVMIKDNHIDFAGGIEQAITRVNSYLXEKNKNLQIEIEVRDFYELYQSFESGNIHRIMLDNLLPNKQKSC

SEQ ID NO: 16305 - DNA, 846 bp, Unknown
  Obtained from environmental sample
  misc_feature (1)..(846): n is a, c, g, or t
atggcaattacaggggcaagggggtttggtaggctcaaaattaaaaagatatttttcatcaaaatgggtcatgatgttatagcaataaaaggagaagacttaaagataattgaaatattatcaattcttcttantgggtgtgatgcggttgtcaaccttgcaggtgcgaatattattagtaggtggagtgatgagtataaaaatcttttgtacagtagtagaattggtacaactagaaacctttttaaagcgatagagaaaacaaaaaacaaaccagaagtttttatctctacaagtgccgtgggtatttatgataatcaatctacatacgatgaagagaatttcaactatggagatgattttttagcaaagttatgtaaagattgggaagaggaagctttaaaagttcaaactttaggtataagaactgttatatttagatttggtattgttttaggagatggaggtgcattaggcaaaatgcttttaccatttaaattaggacttggtgggactataggtgatggaaaacaagcattttcatttatccatattgatgatttaaaaaatgcttttgagtttgcattagaacatgataatatagagggcatttataatatgacagcaccaactcctacaacaaattatggactgacaaaagcattaggaaaatcacttcatagaccaactattcttcctgttcctgcttttgttcttgatctagtttttagtgaagggtcaaaagttttaacagatgggcaaagtgctgttcctaaaagacttcttgatgctggatttgagtttaaatttaaaaatatagaagatactattgataatttagtatag

SEQ ID NO: 16306 - protein, 281 aa, Unknown
  Obtained from environmental sample
  misc_feature (1)..(281): Xaa is any amino acid
MAITGARGFGRLKIKKIFFIKMGHDVIAIKGEDLKIIEILSILLXGCDAVVNLAGANIISRWSDEYKNLLYSSRIGTTRNLFKAIEKTKNKPEVFISTSAVGIYDNQSTYDEENFNYGDDFLAKLCKDWEEEALKVQTLGIRTVIFRFGIVLGDGGALGKMLLPFKLGLGGTIGDGKQAFSFIHIDDLKNAFEFALEHDNIEGIYNMTAPTPTTNYGLTKALGKSLHRPTILPVPAFVLDLVFSEGSKVLTDGQSAVPKRLLDAGFEFKFKNIEDTIDNLV

SEQ ID NO: 16307 - DNA, 822 bp, Unknown
  Obtained from environmental sample
  misc_feature (1)..(822): n is a, c, g, or t
ttgtgttgggaaggtgaagggcaaaaatggattaaagaaaatatattatcttataataaaaatataactatcaaaaaagaggttattgtaaaagatatatataatacagaccgttgttttgatgtagaaattagttctatagaatttgatggtcaaattgagttagtaattattggaaaggatatcacagaagagaaacttaatgcggataagctaaaaaatgcttatactgtttttgataatacaaatgatgggattttaataacagatgaagatgctaaaatagtagatgttaataaagcttttacgaaaaatacagggtatactctattagatgtagtgggaaaaaatcctaatatattaaaatcacaaagacatgataatgatttttataataaaatgtggaaagtattagaaaaagataatttttggcatggtgaaattgtaaataaaaataaagatggttctttttatgttgagcttttaactattaatagaatattgaaaaatgatggtagtgttaaaaactatatagcagtttttaccaatataacaaaacaaaaaaaacaagaaaaactcttaaaagagaaagagcaaatacttttttcacaatcaaaaatggctgcaatgggggagatgcttgagaatatagcacaccaatggcgacaacctttatctgtaatatcaacagctgccagtggtattcagatgcaaaaagagttttatatacttgatgagaaagtgatggacgaatcttttacacttatttgtacaactacagaacatcttttcagtaccataaatgattttgaaaactttttt

SEQ ID NO: 16308 - protein, 274 aa, Unknown
  Obtained from environmental sample
  DOMAIN (209)...(273): His Kinase A (phosphoacceptor) domain
  misc_feature (1)..(274): Xaa is any amino acid
MCWEGEGQKWIKENILSYNKNITIKKEVIVKDIYNTDRCFDVEISSIEFDGQIELVIIGKDITEEKLNADKLKNAYTVFDNTNDGILITDEDAKIVDVNKAFTKNTGYTLLDVVGKNPNILKSQRHDNDFYNKMWKVLEKDNFWHGEIVNKNKDGSFYVELLTINRILKNDGSVKNYIAVFTNITKQKKQEKLLKEKEQILFSQSKMAAMGEMLENIAHQWRQPLSVISTAASGIQMQKEFYILDEKVMDESFTLICTTTEHLFSTINDFENFF

SEQ ID NO: 16309 - DNA, 654 bp, Unknown
  Obtained from environmental sample
  misc_feature (1)..(654): n is a, c, g, or t
ttgtacacatttatgttgaaaaatcctggatccgaccgtctcctaaaagaaataatgcgctcatattcgggtatttttacagactatataaacattaatgaagctttacttgctaaccgagctgaaatgaaacgtgaagatgttgttaggaagttagcttattttaataagcttaagataatcagttatatacctattaaagtcaagcctcagttagtgtatgcgtatgaacgacttagcactaaacatattcatctttcggatgaaaattatgagggacagaaaaaatctgcaaaaacaaggttaacttcattgttgaactttgttaataattcactggagtgcagaagtaaggtgttgttggagtattttggtgagaaaaaagtaagaagatgcggtatttgtgatgtttgtctttctgaaaatagtttgaatctcaatgaaatagagttctcatcaatcgaaaagttattagttgtcaatctaaaatccggaccaaaacatttgtatgaattgatatctagtatgggtgatcagaaagaagaagatgtaattcaagtaataagatggttgattgataacaataaaattattaggcataaggatgaaactttgtcatggtacaatcagctcgatttaggttttgatagttaa

SEQ ID NO: 16310 - protein, 217 aa, Unknown
  Obtained from environmental sample
  misc_feature (1)..(217): Xaa is any amino acid
MYTFMLKNPGSDRLLKEIMRSYSGIFTDYININEALLANRAEMKREDVVRKLAYFNKLKIISYIPIKVKPQLVYAYERLSTKHIHLSDENYEGQKKSAKTRLTSLLNFVNNSLECRSKVLLEYFGEKKVRRCGICDVCLSENSLNLNEIEFSSIEKLLVVNLKSGPKHLYELISSMGDQKEEDVIQVIRWLIDNNKIIRHKDETLSWYNQLDLGFDS

SEQ ID NO: 16311 - DNA, 471 bp, Unknown
  Obtained from environmental sample
  misc_feature (1)..(471): n is a, c, g, or t
atgaatttggtcgagagtttaaatacaatagctgaaaaatatcaaattccaataatcgttagtagccatccaagaactagaaagatgattgaagttaaaggaattgaattcaatcctttagttaagattatgaaacctttcggatttaatgattatgttaaattacagaagtattcaaaagccgtacttagtgatagtggaactattagtgaagaatcatcaattcttggatttagagcattaaatatcagacagtctcatgaaaggccagaagcgatggaagaagcttctgtgatgttggtgggactaaaaaaagagagaatacttcaaggattagaagttttggaaactcaagggaaagatactttgaagttagctacagattatagtatgccaaatgtatctgagaaggtactaaggatattattgtcatatacagattatgtgaatagagttgtttgggggaaatag

SEQ ID NO: 16312 - protein, 156 aa, Unknown
  Obtained from environmental sample
  DOMAIN (1)...(143): UDP-N-acetylglucosamine 2-epimerase
  misc_feature (1)..(156): Xaa is any amino acid
MNLVESLNTIAEKYQIPIIVSSHPRTRKMIEVKGIEFNPLVKIMKPFGFNDYVKLQKYSKAVLSDSGTISEESSILGFRALNIRQSHERPEAMEEASVMLVGLKKERILQGLEVLETQGKDTLKLATDYSMPNVSEKVLRILLSYTDYVNRVVWGK

SEQ ID NO: 16313 - DNA, 330 bp, Unknown
  Obtained from environmental sample
  misc_feature (1)..(330): n is a, c, g, or t
ttgtttgggggaaatagaatgaatccagagattagtataattgtaccgatatatcaagtggagaaatatatttatgattgtatggtttctatttgcaatcaaacttttaaaaacttcgaagttatcttagttaatgacggctcaaaggataaatcgctggatatcgcaattagcatactcgaaaaaaacaaaataaattttaaagttattgaacaaaaaaatatgggacaatcagttgcaagaaatgaagggctaaaaaaagcagtaggagaatgggttgtttgtattgattcagatgatgtaatcactagtgactttcttaaatattga

SEQ ID NO: 16314 - protein, 109 aa, Unknown
  Obtained from environmental sample
  misc_feature (1)..(109): Xaa is any amino acid
MFGGNRMNPEISIIVPIYQVEKYIYDCMVSICNQTFKNFEVILVNDGSKDKSLDIAISILEKNKINFKVIEQKNMGQSVARNEGLKKAVGEWVVCIDSDDVITSDFLKY

SEQ ID NO: 16315 - DNA, 678 bp, Unknown
  Obtained from environmental sample
  misc_feature (1)..(678): n is a, c, g, or t
atgaatataaaagaagagataatcaagcttaaaaaagagcttgatgtaactattgttgcacatttttatcaaaaagatgaagtatttgaaatgggtgatattgtaggtgatagtttagaattagctaaaaaatctatggaggcacctacggaaaacattatcttttgtggcgtaggatttatggggcaaagtgtgaaagtattagcacctcaaaaaagagtacttatgcctaaaatcgcatgctgtgctatggcgaagatgattgatgtagattattacaatatgaatttaaaaatattaaatgatgcaggaatagcaaatgatgatattttaccaataacatatattaactctagtgctgaagtaaaagctgaagttggaaaaatgggtggatatgtttgtacaagttcaaatgcctataaaattatcaacaaaggattagaaagtggcaaaaaaatattctttgttccagatagatgtttagggcaaaactttgcaaaacagattggattaaaatcagcagttgtaggaattgatgatattgaagatgtaaaaaatgcggatatcatttgttttaatggtttttgctcagttcatcaactttttacccctgaagatgtagatttttatagagaaaaatatccagatattttagtagctgttcatccagaaatgtga

SEQ ID NO: 16316 - protein, 225 aa, Unknown
  Obtained from environmental sample
  DOMAIN (3)...(225): Quinolinate synthetase A protein
  misc_feature (1)..(225): Xaa is any amino acid
MNIKEEIIKLKKELDVTIVAHFYQKDEVFEMGDIVGDSLELAKKSMEAPTENIIFCGVGFMGQSVKVLAPQKRVLMPKIACCAMAKMIDVDYYNMNLKILNDAGIANDDILPITYINSSAEVKAEVGKMGGYVCTSSNAYKIINKGLESGKKIFFVPDRCLGQNFAKQIGLKSAVVGIDDIEDVKNADIICFNGFCSVHQLFTPEDVDFYREKYPDILVAVHPEM

SEQ ID NO: 16317 - DNA, 873 bp, Unknown
  Obtained from environmental sample
  misc_feature (1)..(873): n is a, c, g, or t
atggcagctgatatgttgttaatggcgacaccgcagcttgatatcctgacaatcaggagatcaaaaagagttaaacattattcccatatttttcattctattgctgatatcggtatttatgccagatatgcttttgattattttgattcaatactctgtgccggagtgtatcagaaaaaaaatattcttgaatttgaaaaaagaagggagagtccttcaaagcttcttcttgaaaccgggtatactccttttgactatcttagtgaagttaaaaaaaatacacttgaaaaaagcaatgataaaataacaattctggtggctcctacctggagcagcaacagtcttctgactctttttgagatgaagattctggaaccgctgttaaccggtaaatataacattattttgagaccgcatccgcagatgtttgtatcccagaaagatttaatagcaaaaattaaaaagaaaacggaaaacaatccgcatctgatctgggacactgctccgagcggtgcaaagtctatggaagactcagacattatgctgtcagatgtttcgggcataattatagaatattcatttatatataaaaaaccggtaattactattgatacaccggtaataacaaccggtcttgaagctgatgatatggatattaatgatatctgggaagttgcagtcagagacagccttggaaaacttgttgatgaaaaagaaataaacaatcttcctgatattattgacaatgttctgtccgaatttaatgcttatgatatcgacagaataattgatgaaaatatatataactttaaaaatgccggtactgctgcagctcagcagctgattcagatttctgaggatctaaaaaaataa

SEQ ID NO: 16318 - protein, 290 aa, Unknown
  Obtained from environmental sample
  DOMAIN (89)...(264): CDP-Glycerol:Poly(glycerophosphate) glycerophosphotransferase
  misc_feature (1)..(290): Xaa is any amino acid
MAADMLLMATPQLDILTIRRSKRVKHYSHIFHSIADIGIYARYAFDYFDSILCAGVYQKKNILEFEKRRESPSKLLLETGYTPFDYLSEVKKNTLEKSNDKITILVAPTWSSNSLLTLFEMKILEPLLTGKYNIILRPHPQMFVSQKDLIAKIKKKTENNPHLIWDTAPSGAKSMEDSDIMLSDVSGIIIEYSFIYKKPVITIDTPVITTGLEADDMDINDIWEVAVRDSLGKLVDEKEINNLPDIIDNVLSEFNAYDIDRIIDENIYNFKNAGTAAAQQLIQISEDLKK

SEQ ID NO: 16319 - DNA, 612 bp, Unknown
  Obtained from environmental sample
  misc_feature (1)..(612): n is a, c, g, or t
ttggcttcatacggacaagcaacttatgaaaaagaatacaacggaggaatgggtagtaatggtctaacatcagctaggcatgatgtttttaataagtctgttgcagaaaaatatcctgaaacttatgataataaagtgcctgaaaagttggtttattcgggtttgaaaaaactaacagacaaagtagaaggtgttgatattgatgcagggaaattggtgctttcgccaactagaacctatgcacctatcattaaaaaaatactagaaaaatacagaaaacaaattcacggaatggtgcattgtagtggaggtgcacaaactaaaattttacattttgtagatgacttacatatagtgaaagataatttgtttgaaacaccgccattatttaagttaattaaagaacaatcgggaactagttgggaagaaatgtataaagtttttaatatgggacacagaatggagttatatgtttcgcaagcaatagccgatgaaattattgcgatatctcaatcatttaatgttgacgcccaaattattgggaaagtagttgaaaaaggagagaaaaaattgaccataaagagtacttatggagaatttgtttatcattaa

SEQ ID NO: 16320 - protein, 203 aa, Unknown
  Obtained from environmental sample
  DOMAIN (45)...(194): AIR synthase related protein, C-terminal domain
  misc_feature (1)..(203): Xaa is any amino acid
MASYGQATYEKEYNGGMGSNGLTSARHDVFNKSVAEKYPETYDNKVPEKLVYSGLKKLTDKVEGVDIDAGKLVLSPTRTYAPIIKKILEKYRKQIHGMVHCSGGAQTKILHFVDDLHIVKDNLFETPPLFKLIKEQSGTSWEEMYKVFNMGHRMELYVSQAIADEIIAISQSFNVDAQIIGKVVEKGEKKLTIKSTYGEFVYH

SEQ ID NO: 16321 - DNA, 945 bp, Unknown
  Obtained from environmental sample
  misc_feature (1)..(945): n is a, c, g, or t
atgaaaaccaaggcggaagcagaaagagataagctggaagccaacgaaaaaaaacttcaggaatataaactcaaacatgacatatatacgataaatgatcaggaagcatttttccccagaaaaatttctgaaatcagttcccgcctgattaatgtacaggcaaccgtaaatgaactggaatcccgttataaagagatcagccgaatttcaacgggagagattctgaacttgtctatgatgacaaacaatcagagcgttcagaacctgcgtgaaatgattattacgaaagagcaggagatcaccgaattatcaaaaacgattggtccgaaacatccggtattgatcggtgctcaaaaagatcttcgattgcttgaagataaactggattcagaagtcaaagacgtcatccaggccgttaaaaccgagtatgaacttgcgaaaaatcaagccgccggcatccgggagcagttggaaaaaacaaagcaggaatcggcttttatgagtgaaaagcttattcaatacgaaattttaaatcgtgatgttgaaattaatcgtctcttatatgaccggctgatcagccggatcaaagaatatgatgccactgaaaagagccaggatgttgatgtctgtgtgatagaaaaagcaactatccctagtttctcattgaacgaggggccaaaacggaaattgggtatcggtttttttatgagtttatctatggggttgggtttgatttttttgctggaatttctggataacacggtaaaaacgtctgaagatgcggaagagcggttgggcataccggttttagggatgattccgttcttgcggggccaagatgaaaaaattgaagtaattgttaaaaattctccgaatttcattgtttccgaaaaatataaaacaaattcggaccgctttgctgctttcgtctccgggcgggctttt

SEQ ID NO: 16322 - protein, 315 aa, Unknown
  Obtained from environmental sample
  misc_feature (1)..(315): Xaa is any amino acid
MKTKAEAERDKLEANEKKLQEYKLKHDIYTINDQEAFFPRKISEISSRLINVQATVNELESRYKEISRISTGEILNLSMMTNNQSVQNLREMIITKEQEITELSKTIGPKHPVLIGAQKDLRLLEDKLDSEVKDVIQAVKTEYELAKNQAAGIREQLEKTKQESAFMSEKLIQYEILNRDVEINRLLYDRLISRIKEYDATEKSQDVDVCVIEKATIPSFSLNEGPKRKLGIGFFMSLSMGLGLIFLLEFLDNTVKTSEDAEERLGIPVLGMIPFLRGQDEKIEVIVKNSPNFIVSEKYKTNSDRFAAFVSGRAF

SEQ ID NO: 16323 - DNA, 708 bp, Unknown
  Obtained from environmental sample
  misc_feature (1)..(708): n is a, c, g, or t
atgacaatgaagatttcttctaatgaattaggtagtgctgtggcttattttaaaaaagaattagctcctttttatgataaaaatgaagtggatagtatgctttatattttttttgagcattattttggtgtgacaagaacagattttttattgcatcaagataggaagctttctgaatcggatttgttgttagtgatttatggggtaaaggatttaaaaaaatacaagcctttagcctatattattggtgagtgggagtttttcggattgtctttttatgttaatgaacatgtgcttattccccgaccagaaaccgaagaattggttcagttaattattaatgaatatgatgaaaacccacctaaaaatattcttgatattggaagtggtaccggttgtattgcattgagtttaaaacatcattttagaaatactaatgtaaccgcttgngatgtttctgatgaagctttaaaagtaattgataaaaatgcccataacttacaattagcaattgaaattcaaaaagtagatgttttatctcaaccaataccaaatgtaanatttgatgtaattgtgagtaacccggcttatataacgcacaatgaaaaaaatcaaatgcacactaatgtgttagactttgagcccaattttagccttgttgtacccacgaaaagccattgcttttttatgaaaaaaatggctgactag

SEQ ID NO: 16324 - protein, 235 aa, Unknown
  Obtained from environmental sample
  misc_feature (1)..(235): Xaa is any amino acid
MTMKISSNELGSAVAYFKKELAPFYDKNEVDSMLYIFFEHYFGVTRTDFLLHQDRKLSESDLLLVIYGVKDLKKYKPLAYIIGEWEFFGLSFYVNEHVLIPRPETEELVQLIINEYDENPPKNILDIGSGTGCIALSLKHHFRNTNVTAXDVSDEALKVIDKNAHNLQLAIEIQKVDVLSQPIPNVXFDVIVSNPAYITHNEKNQMHTNVLDFEPNFSLVVPTKSHCFFMKKMAD

SEQ ID NO: 16325 - DNA, 432 bp, Unknown
  Obtained from environmental sample
  misc_feature (1)..(432): n is a, c, g, or t
atgaatgaacaaaaattaaaatcatgctttcaatataaatcaaatgagatgataccatcaactcaactcataagaaaaagtaaacaagtatttgatgccatacaatacaatgatatagaaaaagctgtaatattaagagatggtaaaccttcatttttgttaatggattttgctaaatatgaagaactaattaatttttttatctcaaataacttattaattgataaagagttatctatgttagaaactcttgagataaaagagactgaaaaaatagataattcaacaaatgataaagtaataaataaagaagtgaatacaggacttaaaacaaaaaagaatgatcttcttgataaactagataatattgaaggcataataaataacgataaaacagtaattcaagataatttaaaagacttttgggagtaa

SEQ ID NO: 16326 - protein, 143 aa, Unknown
  Obtained from environmental sample
  misc_feature (1)..(143): Xaa is any amino acid
MNEQKLKSCFQYKSNEMIPSTQLIRKSKQVFDAIQYNDIEKAVILRDGKPSFLLMDFAKYEELINFFISNNLLIDKELSMLETLEIKETEKIDNSTNDKVINKEVNTGLKTKKNDLLDKLDNIEGIINNDKTVIQDNLKDFWE

SEQ ID NO: 16327 - DNA, 597 bp, Unknown
  Obtained from environmental sample
  misc_feature (1)..(597): n is a, c, g, or t
atgcaagaaataaattattactcaaactatgtaaaagaaggaaactggcataaatcaaagattttcacccatatagataagcctttttcacaattgagtgggaaaaactggggaataataggtttaggtagtattggagagaaggttgctcaaattgcatctgcttttgactgtaatgttaattattactcaacttcaaatatgaactttaatacaaactacaatacaactaatcttacagcactattggaaagttcagacataatatcgatacattgccctttaaatgagaaaacaaaagatttattaaattatgaaaatatgaaattgttaaaaaataatgcaattatcataaatgttgccagaggtggaataataaatgaatatgacataaccaggataataaaagaaaagaatctatattttggcttagatacaatatctacagagccaatagaagaagattctcctttaaatagcatattagagttagataatataattgtaacacctcatatagcatgggcatcaagagagtcaagaaaaaagctaattgagagtgtatataacaatataaaaggatttataaatgaatga

SEQ ID NO: 16328 - protein, 198 aa, Unknown
  Obtained from environmental sample
  DOMAIN (7)...(172): D-isomer specific 2-hydroxyacid dehydrogenase, NAD binding domain
  misc_feature (1)..(198): Xaa is any amino acid
MQEINYYSNYVKEGNWHKSKIFTHIDKPFSQLSGKNWGIIGLGSIGEKVAQIASAFDCNVNYYSTSNMNFNTNYNTTNLTALLESSDIISIHCPLNEKTKDLLNYENMKLLKNNAIIINVARGGIINEYDITRIIKEKNLYFGLDTISTEPIEEDSPLNSILELDNIIVTPHIAWASRESRKKLIESVYNNIKGFINE

SEQ ID NO: 16329 - DNA, 363 bp, Unknown
  Obtained from environmental sample
  misc_feature (1)..(363): n is a, c, g, or t
atgaatgaacaaaaattaaaatcattgcttcaatataaatcaaatgagatgataccatcaactcaactcataagaaaaagtaaacaagtatttgatgccatacaatacaatgatatagaaaaagctgtaatattaagagatggtaaaccttcatttttgttaatggattttgctaaatatgaagaactaattaatttttttatctcaaataacttattaattgataaagagttatctatgttagaaactcttgagataaaagagactganaaaatagataatttcacaaatgataaagntataaataaagaagtgaatacaggactaaaaacaaaaaagaatgatcttcttgataaactagaa

SEQ ID NO: 16330 - protein, 121 aa, Unknown
  Obtained from environmental sample
  misc_feature (1)..(121): Xaa is any amino acid
MNEQKLKSLLQYKSNEMIPSTQLIRKSKQVFDAIQYNDIEKAVILRDGKPSFLLMDFAKYEELINFFISNNLLIDKELSMLETLEIKETXKIDNFTNDKXINKEVNTGLKTKKNDLLDKLE

SEQ ID NO: 16331 - DNA, 714 bp, Unknown
  Obtained from environmental sample
  misc_feature (1)..(714): n is a, c, g, or t
atgaaagtattactcacaggttccacagggtacataggaagaagattaaaacatagactcattcaagatgaaaatattgatttaagattatttgtaagagataagaagtctatctcttctaaaataatacaaaaagttgatgttcatgaaggtgatactttcaataaagagagtttaaaaaaagcacttaaagatgtagatattgcattttatttaatccactctttaaatagaaaagattataaagatcttgataaaacttctgcacaaaatttcttggatacggcaatatcatgtggagtaaaaagagtaatctatctaggtggtcttggagttaaaaatgagcgtacaagcgagcatcttttaagtcgtttagaaacaggagagattctaagttcaagtgataaaatacaaactatctggataagagctggcatgattattggctctggaagtacaagttttgagataataagaaatctaacagaaaaacttcctatcatgacaactccaaaatgggtaaatacaaaagctcagccaattgctgttgatgatgtactttcttatctttattcatcaatatatctagaagagaaagaaaaccttattgtagatataggggcagaacaattaacatataaacagatgatggaaaaaactgctcttgcgttaggactaaaaagatatattatcctctgccccgagccaatctga

SEQ ID NO: 16332 - protein, 237 aa, Unknown
  Obtained from environmental sample
  misc_feature (1)..(237): Xaa is any amino acid
MKVLLTGSTGYIGRRLKHRLIQDENIDLRLFVRDKKSISSKIIQKVDVHEGDTFNKESLKKALKDVDIAFYLIHSLNRKDYKDLDKTSAQNFLDTAISCGVKRVIYLGGLGVKNERTSEHLLSRLETGEILSSSDKIQTIWIRAGMIIGSGSTSFEIIRNLTEKLPIMTTPKWVNTKAQPIAVDDVLSYLYSSIYLEEKENLIVDIGAEQLTYKQMMEKTALALGLKRYIILCPEPI

SEQ ID NO: 16333 - DNA, 552 bp, Unknown
  Obtained from environmental sample
  misc_feature (1)..(552): n is a, c, g, or t
atgttgaatcgagttattttttattttttcctatttgcgacactaccatttatttcaattggtcaggaaaaacccttacgaattgaattagagtgtcaacaaggagtagagccttatgtttctgtaccctgcggggtatatggtgcacttattatgtatcctacgctggaggaaaatgaaaacagtatagtttggaccttcatgcttgtagatgtaaacttcaagcccgtgtggagtgttccctataatattggcaaaaaattaaaattcaggcatcaggagcttgaagaagaaacgctgtaccttgctttttctaaatcaggaaaaaccaacgaagagacaaaccttcaaatcttaagaattgagttacctacaggaaattcctccgacctcaaagctaccattgaaggccgcccacaggcttcacaaatgaaagcatcgcgaaatgcggtggtacttggaattgaaaaatctaaaggatctgctaatcttatctatttcgatttcaatactaaaaacaaaaacgcatgtgccttttaccctaaacgatga

SEQ ID NO: 16334 - protein, 183 aa, Unknown
  Obtained from environmental sample
  misc_feature (1)..(183): Xaa is any amino acid
MLNRVIFYFFLFATLPFISIGQEKPLRIELECQQGVEPYVSVPCGVYGALIMYPTLEENENSIVWTFMLVDVNFKPVWSVPYNIGKKLKFRHQELEEETLYLAFSKSGKTNEETNLQILRIELPTGNSSDLKATIEGRPQASQMKASRNAVVLGIEKSKGSANLIYFDFNTKNKNACAFYPKR

SEQ ID NO: 16335 - DNA, 747 bp, Unknown
  Obtained from environmental sample
  misc_feature (1)..(747): n is a, c, g, or t
gtgaattatggaattttatttaagactatgttaaaagagggtaaaatagcccattntaagatgaaagtgaaatatactatgtggaaatatttactcccttttttaattgttagcggttcttatgcagaattggttgacggtgtagctattattgtaaaaaatgagcctataactctttatgagatttctaaagagatgactaacagttcaaaatctgttaaagaagtaacggatgagcttatcaagaaaaaacttgaagagatcgaaataagtgaaagaaagattgttgttagttctgatgaggttcatgctgatttagagacaatggctcaacaaaataatatgactattttacagctctatgaagcgatgcaaaatacaaataagctctcatctagtgagcttaaagctaagataaaagagaagcttttagcacaaaaactgtatcaagctatatcatattcaaaaatgtctcaaccgacacagttagaaaaagagcagcactataagttaaatattgatcaattttcttaccctgaagagtatggcgtaattatctatcactctagttcaaaagagaaacttcaagagaagatatcaaaccctatgttctactccgctgatgttgcaaatgaagaggcaaaattggctcactctaaaatagatcctcatttagctatgatactaaatcaaactaaagagaatagctttactcctttaatgccatctcctcaaggtggattgtaa

SEQ ID NO: 16336 - protein, 248 aa, Unknown
  Obtained from environmental sample
  misc_feature (1)..(248): Xaa is any amino acid
MNYGILFKTMLKEGKIAHXKMKVKYTMWKYLLPFLIVSGSYAELVDGVAIIVKNEPITLYEISKEMTNSSKSVKEVTDELIKKKLEEIEISERKIVVSSDEVHADLETMAQQNNMTILQLYEAMQNTNKLSSSELKAKIKEKLLAQKLYQAISYSKMSQPTQLEKEQHYKLNIDQFSYPEEYGVIIYHSSSKEKLQEKISNPMFYSADVANEEAKLAHSKIDPHLAMILNQTKENSFTPLMPSPQGGL

SEQ ID NO: 16337 - DNA, 315 bp, Unknown
  Obtained from environmental sample
  misc_feature (1)..(315): n is a, c, g, or t
gtgttctatattagaccatttctatggcggagacacagagtaattcaaaaagctagagaatatttcaataagggaataagttcttatcaaagtaaagattatgagaattctataaaaaacttcaccaaaagttatgagttagacccaaaaaacatagatgcgctttataacagagctgctattttctttgaaattgaaaaactagaattagcctgtaaagattggaatgaattatctgaactaggacagaaaagaggaattgaattattaaagaaaaactgtaaaaaaactacctacaacaacgtgtataattaa

SEQ ID NO: 16338 - protein, 104 aa, Unknown
  Obtained from environmental sample
  DOMAIN (18)...(51): TPR Domain
  misc_feature (1)..(104): Xaa is any amino acid
MFYIRPFLWRRHRVIQKAREYFNKGISSYQSKDYENSIKNFTKSYELDPKNIDALYNRAAIFFEIEKLELACKDWNELSELGQKRGIELLKKNCKKTTYNNVYN

SEQ ID NO: 16339 - DNA, 438 bp, Unknown
  Obtained from environmental sample
  misc_feature (1)..(438): n is a, c, g, or t
atgaaaaaattattactgatttacattttacttttatcaacaataacttttgcacaaaaagttacagtcaaaggaattgcattagattcaacaaatggcaggaataaagtatacataacattaaacgatactattaataagtatcttaaaaataaagattttgatatggataaatatgaatctctttatgataataaaaacttcaatacaaaagtaaataatcaaaataggttcaaaatcaaagcanaattaagtgattctcttactttcagttcttggagacatattaccaaatcctatcttgtttcagatttaaaatcaaaaaaggatattaaaattgtattagaactcaagtttgcgaagaatatgttccttgtaaagaggaaatncaaaattatatgttttcattggagaaaaaataaagtagattatgctaaa

SEQ ID NO: 16340 - protein, 146 aa, Unknown
  Obtained from environmental sample
  SIGNAL (1)...(18)
  misc_feature (1)..(146): Xaa is any amino acid
MKKLLLIYILLLSTITFAQKVTVKGIALDSTNGRNKVYITLNDTINKYLKNKDFDMDKYESLYDNKNFNTKVNNQNRFKIKAXLSDSLTFSSWRHITKSYLVSDLKSKKDIKIVLELKFAKNMFLVKRKXKIICFHWRKNKVDYAK

SEQ ID NO: 16341 - DNA, 978 bp, Unknown
  Obtained from environmental sample
  misc_feature (1)..(978): n is a, c, g, or t
atgtggttcaataacttttttgataaaatcctcttcatgaaaaaaatagcaattgtaagattatcagcacttggtgacattatcaacacaactgtagttttacagtttattaaaaaaaaatatccctatattaagatagattggatttgtgaagaggcttttgcacctataatatctgatcatccacttatacatagagtgcatacaatctcactaaagcgtctaaaaaaagagaaaagcatctcttatctcatagagactatttcaaaactgcgtaaccttggagagtttgatctaattatcgatatgcaaggcttaataaaatcagccgtagtcgcaagatttataggtaaaaatgtttttggttatgataaaaactctgtacgagagaagttggcttcactattttacaaaaatacaacctcgatggattatggtgaaaatgtcattaagagaaatataaatctgatctcaaaagcactaaatatagatataacagacagagatatcttaaataaagagccatcacttccttcgcataaactacattcaaatcagatagtttttgtaataggtgcttcatgggagtctaaaaaataccctagagactcatttgttcaactagcaaacttgttaaaagagaaaattttaattctttggggagatgagagtgaatttcaagatgctttatatatagcagaacactctaaatatgttcatattagtgaaaaattttctcttttagagcttcgtgatgttatagcttgtgcaaaaatagttataggaaatgatacaggaccaactcatttagcatgggctctcaatgtaccatcagtaacactctttggtcctacaaatgagagaatgatctacgagacagcgataaactgtgctattcactcaccnagtagtgtagatatttaccatatagataaaaaagatttctccataaaagagatgatccacacctataattaa

SEQ ID NO: 16342 - protein, 325 aa, Unknown
  Obtained from environmental sample
  DOMAIN (81)...(322): Glycosyltransferase family 9 (heptosyltransferase)
  misc_feature (1)..(325): Xaa is any amino acid
MWFNNFFDKILFMKKIAIVRLSALGDIINTTVVLQFIKKKYPYIKIDWICEEAFAPIISDHPLIHRVHTISLKRLKKEKSISYLIETISKLRNLGEFDLIIDMQGLIKSAVVARFIGKNVFGYDKNSVREKLASLFYKNTTSMDYGENVIKRNINLISKALNIDITDRDILNKEPSLPSHKLHSNQIVFVIGASWESKKYPRDSFVQLANLLKEKILILWGDESEFQDALYIAEHSKYVHISEKFSLLELRDVIACAKIVIGNDTGPTHLAWALNVPSVTLFGPTNERMIYETAINCAIHSPSSVDIYHIDKKDFSIKEMIHTYN

SEQ ID NO: 16343 - DNA, 381 bp, Unknown
  Obtained from environmental sample
  misc_feature (1)..(381): n is a, c, g, or t
ttgaataattgcaatttgagcaagttgccaaaagaaatttttaaactaaagcaacttcaagagttaattatttccaataatccaatagaaattatcccacccgaaataggagaattaaaaaacctaaaatggctttatgctacatttattaaagcaactactgttcctccaagtattaaagaattaaaaaaaatacatacgctttttctttgggggagcgagattacctactttccacctgaatttttagaattaaaatcgactttaaaagtgcttaatattcgttctgttaaaatgagtaaaaaagcagctaaagaattaaagaaccaactatccgatacacgagttcgttattcgtacagatgtgattgtagtttttaa

SEQ ID NO: 16344 - protein, 126 aa, Unknown
  Obtained from environmental sample
  misc_feature (1)..(126): Xaa is any amino acid
MNNCNLSKLPKEIFKLKQLQELIISNNPIEIIPPEIGELKNLKWLYATFIKATTVPPSIKELKKIHTLFLWGSEITYFPPEFLELKSTLKVLNIRSVKMSKKAAKELKNQLSDTRVRYSYRCDCSF

SEQ ID NO: 16345 - DNA, 498 bp, Unknown
  Obtained from environmental sample
  misc_feature (1)..(498): n is a, c, g, or t
ttgggtaatataaaggtaatattggttttcatttcgctttttttaattgcgattactgcttcggctcaggatgagttactgtttttaaatggaaaacagttagaaggaaaaattttagaatacaacaaatatcaacttacttttcagactaaaaaagataaagaattaaccatagaaaactataggttattttctttttctaaagatagtaaggatactatattatataagtatgatactttagaaggaaattttttaagtgaaaaagacatgcagctctttgtttatggaggacgagatgcacatttgacttattcgtctaaattttctaataaattaggttttgctgttggtgctggtgcagggtattttatgcattacgaccaaaagtttatttttgtagctactccgntggtatatgcattagggacattagttttttcaacacgagtaaaacaaaggaaaataaaggattttgcatatattaaggaagacgaa

SEQ ID NO: 16346 - protein, 166 aa, Unknown
  Obtained from environmental sample
  SIGNAL (1)...(19)
  misc_feature (1)..(166): Xaa is any amino acid
MGNIKVILVFISLFLIAITASAQDELLFLNGKQLEGKILEYNKYQLTFQTKKDKELTIENYRLFSFSKDSKDTILYKYDTLEGNFLSEKDMQLFVYGGRDAHLTYSSKFSNKLGFAVGAGAGYFMHYDQKFIFVATPXVYALGTLVFSTRVKQRKIKDFAYIKEDE

SEQ ID NO: 16347 - DNA, 609 bp, Unknown
  Obtained from environmental sample
  misc_feature (1)..(609): n is a, c, g, or t
gtgatacccaagttgttagaatatagagaggcttttaaacttcattcaacttatattgagccacttttagagttaggacttaaaaatgaggacaatattatctatacatcatttttacaaactggaacagcaacaggaagattaagtagtaaaaatccaaatcttcaaaatatacctgtaagaacagaagctggaagagccataagaaaaggttttattgcaagagagggttataaactagttggtattgattattcacaaatcgaattaagactattagcacactactcaaaagacccagcgttactagaagcatttaacaataatctagatatccatttacaaactgctgtgaaaatatttggtagtgaggaaggaaaagagaaaagaaatattgcaaaatcaattaactttggtcttttatatggaatgggtagtagaaaacttggagaacagcttgggattccttctaaggaagctaaaacatatattgatagttattttgagagttttggaaccgtaaaaaagtttttacagacaatacaagatgatgctatgcagaatggttttgtaaaaacacttcttgggagaaaaagaagattgatttga

SEQ ID NO: 16348 - protein, 202 aa, Unknown
  Obtained from environmental sample
  DOMAIN (1)...(201): DNA polymerase family A
  misc_feature (1)..(202): Xaa is any amino acid
MIPKLLEYREAFKLHSTYIEPLLELGLKNEDNIIYTSFLQTGTATGRLSSKNPNLQNIPVRTEAGRAIRKGFIAREGYKLVGIDYSQIELRLLAHYSKDPALLEAFNNNLDIHLQTAVKIFGSEEGKEKRNIAKSINFGLLYGMGSRKLGEQLGIPSKEAKTYIDSYFESFGTVKKFLQTIQDDAMQNGFVKTLLGRKRRLI

SEQ ID NO: 16349 - DNA, 606 bp, Unknown
  Obtained from environmental sample
  misc_feature (1)..(606): n is a, c, g, or t
atgtattttaataaatcaacattaaaaattttgcaaatatttgttggacatattactgaatcatttactttgagggaaattgcaaggaagttaaatatgcatgtttcttttacacatagggcaatacagccattaatagaaaataaaattattcaacaagataaacataaaaatctttctttgaattataaaattcattatgagactcttgcttttgttgaatatttaagaagagatgatttattaaataaaagtaaattcaaagatattaatttgtttgcagaagaaattgttaataaaattaaggaagatagttttattttacttgtgtttggttcaaccgttgaatctgataaaccaagggatattgatgtattattaattgtagatagcacggataaaatagattttcatgaaaaatttcttcataatattgtgtcaaattatgattttccatttgaagaaagagtgattggatttgaaagtgtttatgaaatgcttactaaacgtgatgaaaaaaatattatgaatgagatattaaataaacatataattttatatggtgcagaattgttttatagattaattcaacgagggcgatcataa

SEQ ID NO: 16350 - protein, 201 aa, Unknown
  Obtained from environmental sample
  misc_feature (1)..(201): Xaa is any amino acid
MYFNKSTLKILQIFVGHITESFTLREIARKLNMHVSFTHRAIQPLIENKIIQQDKHKNLSLNYKIHYETLAFVEYLRRDDLLNKSKFKDINLFAEEIVNKIKEDSFILLVFGSTVESDKPRDIDVLLIVDSTDKIDFHEKFLHNIVSNYDFPFEERVIGFESVYEMLTKRDEKNIMNEILNKHIILYGAELFYRLIQRGRS

SEQ ID NO: 16351 - DNA, 627 bp, Unknown
  Obtained from environmental sample
  misc_feature (1)..(627): n is a, c, g, or t
atgttttcaaatctagtggacctaaaagaccaagggttgaaacttccagactatgaaacactatcaaacgatataaaagaagttattgatattgctcactcagataactcactgaaaggccacgtacttgagaacttaagcgacttcatcattaaagatcctgaagtagcaagactactagaaagatttaaacgctttggaaagaagttaattttaattacaaatagtgaatggtcatggacaaagagattaatggagtacacgattaatccatttctaaaagaaaatgaaacttggactgacctttttgatatttcaatctgtcttgctagtaaacctagattttttaatgttaataatatgtttcttgaagttcaacaagacacaggtcttatgaccaatgctgaaggccctcttgagaaaaataaggtttatcaaggaggctgggcaggaaaacttcaaaaagatcttggccttgacggtgaagagattctctatctaggtgatcatatctatggtgatgttctaactcttaaganaacatttaactggagaacggcccttattcttgatccacttgaagctgaaattcagcaattaataaatcaggaccgactcaggcactaa

SEQ ID NO: 16352 - protein, 208 aa, Unknown
  Obtained from environmental sample
  DOMAIN (1)...(208): 5' nucleotidase family
  misc_feature (1)..(208): Xaa is any amino acid
MFSNLVDLKDQGLKLPDYETLSNDIKEVIDIAHSDNSLKGHVLENLSDFIIKDPEVARLLERFKRFGKKLILITNSEWSWTKRLMEYTINPFLKENETWTDLFDISICLASKPRFFNVNNMFLEVQQDTGLMTNAEGPLEKNKVYQGGWAGKLQKDLGLDGEEILYLGDHIYGDVLTLKXTFNWRTALILDPLEAEIQQLINQDRLRH

SEQ ID NO: 16353 - DNA, 774 bp, Unknown
  Obtained from environmental sample
  misc_feature (1)..(774): n is a, c, g, or t
atgagaaatctaattcatcttctcatgaacaaaggcgtaaaagttagatatatctcaaaactatctagtgaattaaatatcaaaatatatcaaaaaatgtatgagttatgtgttcctctcgagatgcatcaaaaagctgctcttataatcatgggaagtgaaggaagaggtgaacaacttctaagaagtgatcaagataacgctttaatattaaaagatagtaagtacgaaaatgagtttgaaacttacatgaagctctttaacaaaaatttgagtgaaataggatttccacagtgtaagggagatgttatggtaacaaatgatttttggagaaaagatattgcttcatataaaaaagatattgaaagttggtgcgatagtttaaacgcatcttcacttcaagcactctctatatttttagacgcttcatgtgttgcaggagagtgctctttacttgatgagcttagagagcatctatttcaagttttcagcactagaagtgatattttgtcacatgccgcgaaacctgtactcttttttgagacgcctctgagcctattttctaactttattgttgataacaaagaacatgcaagcgaactggatattaaaaaaggtgggattttcgctattgtacatggagtaagaattttatctttagagcataagatagatgagacaaacactacaaacagaattaaaaaattaaataatctctcggtaatagacaagtcatttgcaactgaacttatagaggcgtatgacacgctttaa

SEQ ID NO: 16354 - protein, 257 aa, Unknown
  Obtained from environmental sample
  DOMAIN (1)...(257): Putative nucleotidyltransferase DUF294
  misc_feature (1)..(257): Xaa is any amino acid
MRNLIHLLMNKGVKVRYISKLSSELNIKIYQKMYELCVPLEMHQKAALIIMGSEGRGEQLLRSDQDNALILKDSKYENEFETYMKLFNKNLSEIGFPQCKGDVMVTNDFWRKDIASYKKDIESWCDSLNASSLQALSIFLDASCVAGECSLLDELREHLFQVFSTRSDILSHAAKPVLFFETPLSLFSNFIVDNKEHASELDIKKGGIFAIVHGVRILSLEHKIDETNTTNRIKKLNNLSVIDKSFATELIEAYDTL

SEQ ID NO: 16355 - DNA, 909 bp, Unknown
  Obtained from environmental sample
  misc_feature (1)..(909): n is a, c, g, or t
atggttgcccgtgttgatgaaatttttatacactctccttgtattgttaatcaaaatgaatctatattaaactctatcaaaaaaatgaaatccgaacaatctagttctatcttaatcaaacttaatgatcaatatggaatcgttacagataccaaccttcgtgatcgcgttttattaggcgatgtgaatgtaacagacgctattaaaaaaattgccacatacccgcttattactatcgaatacaatgacttcttatttaatgcccttttactttttactaaacatcaggttaagcgtctagttgtcattaaagatggtgttattacaggtgttttagagcagattgatttgcttagcttctttgcgaatcatacacatctcatttcacaaaagattgatcgtgcagatgatattgattcacttaaaactgttgagagtgatatgagaaatctaattcatcttctcatgaacaaaggcgtaaaagttagatatatctcaaaactatctagtgaattaaatatcaaaatatatcaaaaaatgtatgagttatgtgttcctctcgagatgcatcaaaaagctgctcttataatcatgggaagtgaaggaagaggtgaacaacttctaagaagtgatcaagataacgctttaatattaaaagatagtaagtacgaaaatgagtttgaaacttacatgaagctctttaacaaaaatttgagtgaaataggatttccacagtgtaagggagatgttatggtaacaaatgatttttggagaaaagatattgcttcatataaaaaagatattgaaagttggtgcgataagttaaacgcatcttcacttcaagcactctctatatttttagacgcttcatgtgttggaggagagtggctctttactttgagagcttag

SEQ ID NO: 16356 - protein, 302 aa, Unknown
  Obtained from environmental sample
  DOMAIN (146)...(302): Putative nucleotidyltransferase DUF294
  misc_feature (1)..(302): Xaa is any amino acid
MVARVDEIFIHSPCIVNQNESILNSIKKMKSEQSSSILIKLNDQYGIVTDTNLRDRVLLGDVNVTDAIKKIATYPLITIEYNDFLFNALLLFTKHQVKRLVVIKDGVITGVLEQIDLLSFFANHTHLISQKIDRADDIDSLKTVESDMRNLIHLLMNKGVKVRYISKLSSELNIKIYQKMYELCVPLEMHQKAALIIMGSEGRGEQLLRSDQDNALILKDSKYENEFETYMKLFNKNLSEIGFPQCKGDVMVTNDFWRKDIASYKKDIESWCDKLNASSLQALSIFLDASCVGGEWLFTLRA

SEQ ID NO: 16357 - DNA, 537 bp, Unknown
  Obtained from environmental sample
  misc_feature (1)..(537): n is a, c, g, or t
atggctcagggtgttgttgcattgcttgagcctcttatagatacagtaattatttgtactatgaccgctttagttattataatagtgaatttaaaaaacggattgtttaattatggaaatcttgatgcaactaaagataatgtatatttaaattcaactggcgaccctgtaaatggagtggacttaacttcgttagcatttgatactgcaatacctaatttctctattgtgttgactatagctgttattttatttgctttttctaccatgctttcttggtcttattacggtttacaagcttggaaatttttatttggaaaaggaaaaacagttgatttaatttataaatttttgtttttaatttttgttgttataggagcttctataagtttgggttcagttataaaattctctgatgccatgatatttgctatggttttcccaaatattttaggcttgttactactatcttctaaagtaagagaggaacttaataaatataagaacaagattaaagcttttgttaaatccaaataa

SEQ ID NO: 16358 - protein, 178 aa, Unknown
  Obtained from environmental sample
  misc_feature (1)..(178): Xaa is any amino acid
MAQGVVALLEPLIDTVIICTMTALVIIIVNLKNGLFNYGNLDATKDNVYLNSTGDPVNGVDLTSLAFDTAIPNFSIVLTIAVILFAFSTMLSWSYYGLQAWKFLFGKGKTVDLIYKFLFLIFVVIGASISLGSVIKFSDAMIFAMVFPNILGLLLLSSKVREELNKYKNKIKAFVKSK

SEQ ID NO: 16359 - DNA, 372 bp, Unknown
  Obtained from environmental sample
  misc_feature (1)..(372): n is a, c, g, or t
atgaacattaaagactacttttctttcacaaaaagtgaaaaaagaggagtaattgttttactcattattcttttattaatattgttttcttttccatttgttgattacctaaaacaacaaaatacacctgactttacggagtatgaaaatgctattttagcttttgaaaaagctttggaagaacagaaagaacaacaaaaacaagcttatcaacaaaaagataagcaagcattaaccattaccttgtttgattttaatccgaataccatttctgatgaagagtggaagcaattaggatttagagattggcaaataaaaaccataaataattacaagctaaaggcggaaattggagaaccaaagctgatgtga

SEQ ID NO: 16360 - protein, 123 aa, Unknown
  Obtained from environmental sample
  misc_feature (1)..(123): Xaa is any amino acid
MNIKDYFSFTKSEKRGVIVLLIILLLILFSFPFVDYLKQQNTPDFTEYENAILAFEKALEEQKEQQKQAYQQKDKQALTITLFDFNPNTISDEEWKQLGFRDWQIKTINNYKLKAEIGEPKLM

SEQ ID NO: 16361 - DNA, 543 bp, Unknown
  Obtained from environmental sample
  misc_feature (1)..(543): n is a, c, g, or t
atgcgacaatttaaaatattatttatcggtttgtttacattaataattatgacaggttgtatatcaactaagggctatttagttaaaatggatacctcttccaatacaatagaagaagcctttattaaagatgatatacaaataaaacttattaataactacaatgaaagttatgatttaaaagatgtaattattggatatggaacacatccttttaatccacttgaaaataaatcaattaatcaagtacttatttcaaataaccagacttttaatacaaaatactcaaaatattcaaaaaaaggtttagaaaaaagttttttaaatacttactatatgagttttacagatgaagctttactggctatcttagcaaaagaatatgagatgactgtggttgtttcagatacaaaaaataacaagctctataatatagactataagttatctaatattattttatcagaagagataagacaaaatatttattatggatttttagatactttacaatattatgaagacagagaaaatgacaagtaa

SEQ ID NO: 16362 - protein, 180 aa, Unknown
  Obtained from environmental sample
  misc_feature (1)..(180): Xaa is any amino acid
MRQFKILFIGLFTLIIMTGCISTKGYLVKMDTSSNTIEEAFIKDDIQIKLINNYNESYDLKDVIIGYGTHPFNPLENKSINQVLISNNQTFNTKYSKYSKKGLEKSFLNTYYMSFTDEALLAILAKEYEMTVVVSDTKNNKLYNIDYKLSNIILSEEIRQNIYYGFLDTLQYYEDRENDK

SEQ ID NO: 16363 - DNA, 603 bp, Unknown
  Obtained from environmental sample
  misc_feature (1)..(603): n is a, c, g, or t
atgtcatttatgaaaaataatagtgtattagatataaaaagtatcacttttggttataaaaaagaaaaacttatatatgaaaacttttcattactcctaaataaaagtgaaataacttctatagtaggagctagtggaagtggtaagtcaactttatttgaattaataactaataatttaatcccttttaatggtgaagtaaaaacaaaaaaaatagcttcaatttatcaagacccttatagttcatttcatccaacatatagtataatagaacagataaatgatgttgttgaggcatatgatagtatagagttggaatcgatactagaaaagttgaatttagataaagatttgatttataaaaaacctcatgagttaagtggtggacaattgcaacgatgcagtattttgcgtgcaatattgataaaaccagatttaatacttgcagatgaacctacaagtgctttagacaatataacagcattagaaacgatgaagatgctaatctcctttttagataggtttggtattcttttaattacgcatgataaagatttagcttcgtggtgtagtgatacaataatagaaatagataaaaaatag

SEQ ID NO: 16364 - protein, 200 aa, Unknown
  Obtained from environmental sample
  DOMAIN (36)...(200): ABC transporter
  misc_feature (1)..(200): Xaa is any amino acid
MSFMKNNSVLDIKSITFGYKKEKLIYENFSLLLNKSEITSIVGASGSGKSTLFELITNNLIPFNGEVKTKKIASIYQDPYSSFHPTYSIIEQINDVVEAYDSIELESILEKLNLDKDLIYKKPHELSGGQLQRCSILRAILIKPDLILADEPTSALDNITALETMKMLISFLDRFGILLITHDKDLASWCSDTIIEIDKK

SEQ ID NO: 16365 - DNA, 537 bp, Unknown
  Obtained from environmental sample
  misc_feature (1)..(537): n is a, c, g, or t
atgaaaaaagtaagagtaggaactatttggcttgatggatgttctggatgccatatgtcttttttggatatggatgaaagattagtagagttgtctcaatatatggatgtagtgtatagcccttatgtggatgcaaaagagataccaagtgatattgatctatttattgttgaaggagctttaagtacagaccatgatattaaaatcataaaagagattagaaaaaactctaaattgattttagctttgggtgattgtgcagttactggaaatatatcggctatgaaaaatctttttggaacagaagctgttttagaaaaaggatattttgatttagcagatataaataaaggtaagtatccaagtgaagttgtaccaacacttttagataaagtaataccattaaatgaagctattgatgttgattattttgtccctggttgtccaactccagcagatgcgatttatgaagttataaaagcgattattgaaaacaaagagataaaaattagtgattatacaaggtttggcaagtaa

SEQ ID NO: 16366 - protein, 178 aa, Unknown
  Obtained from environmental sample
  DOMAIN (35)...(163): NADH ubiquinone oxidoreductase, 20 Kd subunit
  misc_feature (1)..(178): Xaa is any amino acid
MKKVRVGTIWLDGCSGCHMSFLDMDERLVELSQYMDVVYSPYVDAKEIPSDIDLFIVEGALSTDHDIKIIKEIRKNSKLILALGDCAVTGNISAMKNLFGTEAVLEKGYFDLADINKGKYPSEVVPTLLDKVIPLNEAIDVDYFVPGCPTPADAIYEVIKAIIENKEIKISDYTRFGK

SEQ ID NO: 16367 - DNA, 366 bp, Unknown
  Obtained from environmental sample
  misc_feature (1)..(366): n is a, c, g, or t
atggtaacaagaaatactccacaaagaatgaaaattcttcaatatttgaaatcagtccattctcatccgactgctgaaatagtttataatgcaattaaagctgatatgccaacaattactttggcaacagtttatagaaatttaaatctattagcagaaagtggagaaatattaagacttgaaataaataaagaatttcattatgatgcatattgtaattctcaccaacattttgtttgtgaaaacacaggtaaaatttatgatttagaagataacgaaattaccgagttaattaaatctaaaatcaattcaactaaatttaatcccaaatctgttagcataataattaggggaacgtgtaattaa

SEQ ID NO: 16368 - protein, 121 aa, Unknown
  Obtained from environmental sample
  DOMAIN (3)...(117): Ferric uptake regulator family
  misc_feature (1)..(121): Xaa is any amino acid
MVTRNTPQRMKILQYLKSVHSHPTAEIVYNAIKADMPTITLATVYRNLNLLAESGEILRLEINKEFHYDAYCNSHQHFVCENTGKIYDLEDNEITELIKSKINSTKFNPKSVSIIIRGTCN

SEQ ID NO: 16369 - DNA, 543 bp, Unknown
  Obtained from environmental sample
  misc_feature (1)..(543): n is a, c, g, or t
ttgaaaaataacaaaaatggattaagaacagatattagtaatatattattagatataaaagaagatgcaattgaaaagtatagtataaaggaagagttagttaaaggtattttagactatcttaagtcaaaaacttatggtaactatgagatatctaaagaaaacttgagatctatttataatattaacttactttttcaatcaatatctgaagacaagttagaagaattatcacactttattaaaatttatcccgatcaaataaaatatgctgtctggaaatttgattattactataaaagaaaggatagaatagaaatagatggttatttatttgagaatatattaagaatactagataatttgtatactatattacaatctgatattcacttatcatattcgagttttaatggcaaatatgatgatatagttaacaaaaaaaatattcttgcatcaatttcaaatgaagaaaaaaatgatcataaaataatttttctagatagtagtaaagatataaatttaggatatagatttctttag

SEQ ID NO: 16370 - protein, 180 aa, Unknown
  Obtained from environmental sample
  misc_feature (1)..(180): Xaa is any amino acid
MKNNKNGLRTDISNILLDIKEDAIEKYSIKEELVKGILDYLKSKTYGNYEISKENLRSIYNINLLFQSISEDKLEELSHFIKIYPDQIKYAVWKFDYYYKRKDRIEIDGYLFENILRILDNLYTILQSDIHLSYSSFNGKYDDIVNKKNILASISNEEKNDHKIIFLDSSKDINLGYRFL

SEQ ID NO: 16371 - DNA, 837 bp, Unknown
  Obtained from environmental sample
  misc_feature (1)..(837): n is a, c, g, or t
atgcatgatttaaatagtttatgtattccttcaataaaagactcaagaattttcgaacgattatgtcgtgatatatggaaaaacaatgatttatatatcaatgttgaattaaatggttctagtgggcagggacagcaaggtgtggatgtatttgggcgtaataaaaatactaataattggtttgggatacaatgtaaagtaagggaaaagaaattaacaagacaagaaatacaaagagaaatagacgaagctaaaaagtttaacccgaaactagaaaaatatataatttgcactactttaaaaagagatgcaaaattacaagaaattttaagagagtttaatagtaaggatatatttaatattcaattattattttgggatgatatagaagaactattaaaagaagaaagaaattttaatatttttcatagatattatgaagagttttttgttgataatcaaacattaggacattctattgggaagttaattaatttagagttaggaataggtaattctagagatacgcattatgatttgatgattggcaaaattccacaatataaaaaagaaaaaaaaactagtgtagattattatcaagatacatattttattattaatttccatgaaagaaaaatggatacatttcctttaccatgttttgatagtgatttagaacaagtcttttttcttccatttgatcgatttagaataacaaaatggataaatagtattaagaatcttgataaatttatttattcaaatgaagatagtttagaaacttatattacaaaagaagaatatacaaatnttttggaggcaatgaatgagttatga

SEQ ID NO: 16372 - protein, 278 aa, Unknown
  Obtained from environmental sample
  misc_feature (1)..(278): Xaa is any amino acid
MHDLNSLCIPSIKDSRIFERLCRDIWKNNDLYINVELNGSSGQGQQGVDVFGRNKNTNNWFGIQCKVREKKLTRQEIQREIDEAKKFNPKLEKYIICTTLKRDAKLQEILREFNSKDIFNIQLLFWDDIEELLKEERNFNIFHRYYEEFFVDNQTLGHSIGKLINLELGIGNSRDTHYDLMIGKIPQYKKEKKTSVDYYQDTYFIINFHERKMDTFPLPCFDSDLEQVFFLPFDRFRITKWINSIKNLDKFIYSNEDSLETYITKEEYTNXLEAMNEL

SEQ ID NO: 16373 - DNA, 570 bp, Unknown; identical to SEQ ID NO: 8247
  Obtained from environmental sample
  misc_feature (1)..(570): n is a, c, g, or t

SEQ ID NO: 16374 - protein, 189 aa, Unknown; identical to SEQ ID NO: 8248
  Obtained from environmental sample
  SIGNAL (1)...(16)
  misc_feature (1)..(189): Xaa is any amino acid

SEQ ID NO: 16375 - DNA, 648 bp, Unknown
  Obtained from environmental sample
  misc_feature (1)..(648): n is a, c, g, or t
atggtacaaaataatcaaggtgaagagcttaaccgcctatttagaaaaccgaaacctttcatagagtttgtgattgatcaagtagtatctagctataacctaaaagatccaagagataaagagagggcactaaatgagagtagtgcatatctgaaaactctctcagcacttatgcaagaggagtataaactatatctcagtacaaagctttcagtccctgcatctatgataaaactggcatcttcaaacaagccaaatgctgagataattagattttcaactaaagattcatgggagctttcactcataaaatcagtaatagaacatcccgaatatattgatcagatacttgactttttatctcctgacatattaaagtttcatcaaaatgagtttgccttggcgataggtaacagattggatgatccttccattatggcgatagcagtggatgatggaatagaagcatttgaagatagtgatcaacttaaagctgaattgatcacatttttaggaaaacactacgatagagagctaaaaaaggtacagcttgataacagtgcatcgtatgataaaaaaacttttttaatcaggtcgtacagagagaaaatagttaaattaaaacgtggcgaattagtaccactataa

SEQ ID NO: 16376 - protein, 215 aa, Unknown
  Obtained from environmental sample
  misc_feature (1)..(215): Xaa is any amino acid
MVQNNQGEELNRLFRKPKPFIEFVIDQVVSSYNLKDPRDKERALNESSAYLKTLSALMQEEYKLYLSTKLSVPASMIKLASSNKPNAEIIRFSTKDSWELSLIKSVIEHPEYIDQILDFLSPDILKFHQNEFALAIGNRLDDPSIMAIAVDDGIEAFEDSDQLKAELITFLGKHYDRELKKVQLDNSASYDKKTFLIRSYREKIVKLKRGELVPL

SEQ ID NO: 16377 - DNA, 306 bp, Unknown
  Obtained from environmental sample
  misc_feature (1)..(306): n is a, c, g, or t
atgggaaaaaataaaacaaaaattgatgtaaaagatttaaacctttggtatggtgaaaaacatgctctgcataatctcaacatagatatatatgaaaaccaaattactgctctcataggaccatctggttgtggtaaatcaacattcttacgatgtttaaacagaatgaatgacttggttagttcagctagggttgagggtaaagtagttattgatgaaaaaaatatttatgataaagatgttgatgaagtaagtgtaagaaaaagagttggtatggtatttcaaacaacaaaacccttttcctaa

SEQ ID NO: 16378 - protein, 101 aa, Unknown
  Obtained from environmental sample
  misc_feature (1)..(101): Xaa is any amino acid
MGKNKTKIDVKDLNLWYGEKHALHNLNIDIYENQITALIGPSGCGKSTFLRCLNRMNDLVSSARVEGKVVIDEKNIYDKDVDEVSVRKRVGMVFQTTKPFS

SEQ ID NO: 16379 - DNA, 663 bp, Unknown
  Obtained from environmental sample
  misc_feature (1)..(663): n is a, c, g, or t
atgttagtaaattataaagaaaaacttgatgaaactaagagaagcattaaagagataggaaataatcttatagaatcaaataatataatcatagatgcattaaaggactgtaaacttgataagtttaatgaagctaaattagcaattaaaaatactagtaacaaaacaaatgagatagataatgatattattactacattggcactgcactctccagaagcaaaagatttaagaacaatggtatcatatcttaaaattacaaatgaacttgtaagggcttgttctaatacaagaagctttataaaaggttttcaagaggtttgtcaaaaagtagatattaaaactgtaaatgaatatgcaatacctatgcaaaaagcaactgtagaagcattagtacatacagtaaaaatgatagacattgattgtgtagatgagatacaagagtgttttaataaagtattaatagctgaaaataaaacggatgatttatatgagatgattgaaaatactctcataaagcaagcaaataaagctgataatttttcaagataccaccaaatgttatcttctttaagaaaaagtgaaaaagtagcagatagagctataagtatagctagcttactattatttgcaaataatggtggcgagatacatcaagtataa

SEQ ID NO: 16380 - protein, 220 aa, Unknown
  Obtained from environmental sample
  misc_feature (1)..(220): Xaa is any amino acid
MLVNYKEKLDETKRSIKEIGNNLIESNNIIIDALKDCKLDKFNEAKLAIKNTSNKTNEIDNDIITTLALHSPEAKDLRTMVSYLKITNELVRACSNTRSFIKGFQEVCQKVDIKTVNEYAIPMQKATVEALVHTVKMIDIDCVDEIQECFNKVLIAENKTDDLYEMIENTLIKQANKADNFSRYHQMLSSLRKSEKVADRAISIASLLLFANNGGEIHQV

SEQ ID NO: 16381 - DNA, 771 bp, Unknown
  Obtained from environmental sample
  misc_feature (1)..(771): n is a, c, g, or t
atgcagtgggatttgactattgcagagtgtccaattaagatgaagtttttgaaaatattaaatgatcatggtgtgacaccatttgatctgttttatatctttattgctctaaaaaatagtatagcaactctattttatgaaaatatgtttctctcttttgcattacaaaaagatttagagactatttcactaaatatttcaaaagatatctttgtaacatatgagcagatacaaaaaaatgagataaatttttcagatgttcactctaacttacttaatgagtacaaaaaagccgttgatatcagtaatattgtttcaaaatcaaatacaaaagggatcattacatatgttaatgataaattttgtgaaatcagcggatacactaaatctgaacttatcggtaagcctcactctatagtccgtcatccatcaatgcctagttcgatatttaaggaactttgggatgtaataaaagagaaacgtgcatggcatggtgtaatcacaaatatgaaaaaagatggacgtaagtatgtagtggactctacggtcatacctatnttggatgttgatggagatatagtcgaatatattgctatacgacatgatgtaacagagtttgagcagacaaaagagcagctaggtacgctaaatcgtgctatgaaaaataaagtggatgagctattctccatgactgcaacattggaagaagaagcctctatagatgcattaacagggtgcattaatcgttcaaaatttgaaaaatttttttga

SEQ ID NO: 16382 - protein, 256 aa, Unknown
  Obtained from environmental sample
  DOMAIN (93)...(155): PAS domain
  misc_feature (1)..(256): Xaa is any amino acid
MQWDLTIAECPIKMKFLKILNDHGVTPFDLFYIFIALKNSIATLFYENMFLSFALQKDLETISLNISKDIFVTYEQIQKNEINFSDVHSNLLNEYKKAVDISNIVSKSNTKGIITYVNDKFCEISGYTKSELIGKPHSIVRHPSMPSSIFKELWDVIKEKRAWHGVITNMKKDGRKYVVDSTVIPXLDVDGDIVEYIAIRHDVTEFEQTKEQLGTLNRAMKNKVDELFSMTATLEEEASIDALTGCINRSKFEKFF

SEQ ID NO: 16383 - DNA, 681 bp, Unknown
  Obtained from environmental sample
  misc_feature (1)..(681): n is a, c, g, or t
ttgaaaaagatgggacgtaagtatgtagtggactctacgttcatacctattttggatgttgagggagatatagtcgaatatattgctatacgacatgatgtaacagagttngagcagacaaaagagcagctaggtacgctaaatcgtgctatgaaaaataaggtggatgagctatattccatgactgcaacattggaagaagaagcctctatagatgcattaacaggtgcatttaatcgttcaaaatntgagaaattttttgatcttgagatagagaaagctcagatgagccaaaatgtattgactatgatagtcttagatatagaccattttaaattaattaatgataattatggacatcacgttggtgatgatgttttaaaaaatatcgcatctcttgtgagtaaagctctaaaaaggacagatgtatttgctagatggggaggcgaagagtttgttgtacttctaccaggaactgatcttgaaggtgctgctattttagctgaaaagttaagaaaactgatcgaagagagtgatttttctattgcaggacagataacatccagttttggtgtaggtctgcataaagatgaagagaataaaaaagagttttttgagagagtggataagtttttatatgaggctaaaaagagtggtagaaatagagttgtatcagaataa

SEQ ID NO: 16384 - protein, 226 aa, Unknown
  Obtained from environmental sample
  DOMAIN (65)...(222): GGDEF domain
  misc_feature (1)..(226): Xaa is any amino acid
MKKMGRKYVVDSTFIPILDVEGDIVEYIAIRHDVTEXEQTKEQLGTLNRAMKNKVDELYSMTATLEEEASIDALTGAFNRSKXEKFFDLEIEKAQMSQNVLTMIVLDIDHFKLINDNYGHHVGDDVLKNIASLVSKALKRTDVFARWGGEEFVVLLPGTDLEGAAILAEKLRKLIEESDFSIAGQITSSFGVGLHKDEENKKEFFERVDKFLYEAKKSGRNRVVSE

SEQ ID NO: 16385 - DNA, 363 bp, Unknown
  Obtained from environmental sample
  misc_feature (1)..(363): n is a, c, g, or t
atgatgaagagaatccccttttttaatgttcgcagtatacttgtcatattcagttcctattcgcctaagagcttttacgagtttcgtatccatctcggcagttttcagaatggttttaggcaaatatacaatcataaacgatatttgcgcttctctttcattcaaatcctgataaagcaagtgcttattcaaacgataaatttcacgaattcttcttttcaaaagattacgcttaacagcatgcttaaaacttcgtttagttaccgtaatagcaacctgagcaggaaaatcaacatcaagtggtatactcttccaaacaatacgaaatgggtaacatgtaaaccccataccgtcctcaaataa

SEQ ID NO: 16386 - protein, 120 aa, Unknown
  Obtained from environmental sample
  misc_feature (1)..(120): Xaa is any amino acid
MMKRIPFFNVRSILVIFSSYSPKSFYEFRIHLGSFQNGFRQIYNHKRYLRFSFIQILIKQVLIQTINFTNSSFQKITLNSMLKTSFSYRNSNLSRKINIKWYTLPNNTKWVTCKPHTVLK

SEQ ID NO: 16387 - DNA, 741 bp, Unknown
  Obtained from environmental sample
  misc_feature (1)..(741): n is a, c, g, or t
ttggcacaaccaccactttaccgctataaaaaaggtaaaaaagagatttactttaaagatgataaagagatgaatactttcttaatagatcaaggagttgattcattagaaattgcggatgttggtcataatgatttagtatcattttttaagatggttgatcactacagtagctctttagatgcacttgaaagacgttattcacttataaaacttattcgttattttatagagaatcctgattatgtaggattagacacagataaaatgtatgatgttgtagaaaaatatttaacatctattggaaataatattttaacaaaaactattactgaagatcagatacatctatttgttcaaacaaatgatggtttagatgaacttatgattaacgatgatctgttttcaactccgcactttgcagaagctaactatatttatcaaaaaattaaagagtgggatcttaatatagatatggatgtattagaagctcttaaagaggtaaaagattttgctaaaaaaggttcttatattcagcgttataaaggtcttggtgagatgaatcctgagcagttatgggaaactaccatgactccagaaaatcgtgttctacttcgtgtaaatattgaagatgcagaagcagcttcagaagcattcacactatttatgggtgatgaagtagaaccacgccgtaactacatagaaactcatgcaaaagatgttaaacatttagacgtttaa

SEQ ID NO: 16388 - protein, 246 aa, Unknown
  Obtained from environmental sample
  DOMAIN (169)...(235): DNA gyrase B subunit, carboxyl terminus
  misc_feature (1)..(246): Xaa is any amino acid
MAQPPLYRYKKGKKEIYFKDDKEMNTFLIDQGVDSLEIADVGHNDLVSFFKMVDHYSSSLDALERRYSLIKLIRYFIENPDYVGLDTDKMYDVVEKYLTSIGNNILTKTITEDQIHLFVQTNDGLDELMINDDLFSTPHFAEANYIYQKIKEWDLNIDMDVLEALKEVKDFAKKGSYIQRYKGLGEMNPEQLWETTMTPENRVLLRVNIEDAEAASEAFTLFMGDEVEPRRNYIETHAKDVKHLDV

SEQ ID NO: 16389 - DNA, 903 bp, Unknown
  Obtained from environmental sample
  misc_feature (1)..(903): n is a, c, g, or t
atgagccttaaaaaaagagaaattaatacagttgcactgatatctattgataatataaacagtataaatgaagagtatggatttataaatggtgataatattttaaaagatgtatcaaattatatctctaaattttttcttgataagttgtataagagagttccaatagggcatataaaaggcggagattttttagttggatttgatacaaaaaaagatgatgttaaagctttaatagatatgttgaatttaaaattagattcaattgaagtaaattcaatagagatatatacatctagcagtgtggttgattcaaactattcaaatgatataaaccatattttaaatagattgtatgaattaaagaaaaatagacgtatagacagtgtaaaagatgaagagttaatcaatccaaatgagttagagacacttgttataaaagcgataaaaagtagaaatatctctatcaaatttcaaaaaattgaaaataacggtgaaaatatattagaagcatctgtaaaacttttagatgatagtggcaattacatacatcaaaaagagtttataggtgtaatcaatagattaggtatgagtaaagattttgatatggttatacttgagctattagtgaatatattaaatagatatggtgatataacgctatctatcaaattttctacaatatctattcgtcacaaagagttttatgataggttaatatctcttgtatctgataaaagtgatttatctaaaagattaatttttataattagtgaaaaagattactacagagatataaaaagatttaattcacacctaaataattacagaagattgggcataaaaatagtacttgataattttggtaatgacacaatatcactgcatcccagccaatcctga

SEQ ID NO: 16390 - protein, 300 aa, Unknown
  Obtained from environmental sample
  misc_feature (1)..(300): Xaa is any amino acid
MSLKKREINTVALISIDNINSINEEYGFINGDNILKDVSNYISKFFLDKLYKRVPIGHIKGGDFLVGFDTKKDDVKALIDMLNLKLDSIEVNSIEIYTSSSVVDSNYSNDINHILNRLYELKKNRRIDSVKDEELINPNELETLVIKAIKSRNISIKFQKIENNGENILEASVKLLDDSGNYIHQKEFIGVINRLGMSKDFDMVILELLVNILNRYGDITLSIKFSTISIRHKEFYDRLISLVSDKSDLSKRLIFIISEKDYYRDIKRFNSHLNNYRRLGIKIVLDNFGNDTISLHPSQS

SEQ ID NO: 16391 - DNA, 474 bp, Unknown
  Obtained from environmental sample
  misc_feature (1)..(474): n is a, c, g, or t
atgatgggatttttaaataccatattcaataaaataaaaagcgctgcaagggaaagatttatcctcaacaaagagacaaattcgatacaaatactacttgatagttcccatgaacaatattttacactcacctttgataatatgaatataaaaactttatacgatccaaatatctttagaagtactgtcatagatgcaaatagtttagatttaggagagctttacatagaggtgattgagctagattatcaacacgattggaatggaagtgcaggaggttgttttgatctttttatcaaacaagagtttcaaaaatcaaagtttgaatttgtaaaaagttttgatgatgattttgccaagtttactaaataccaagtgaatgataaatatgaggtaggatctatctggttttctttaaacaaacaagatatttttatctttgatacaaaggggaagctttttatgacctactaa

SEQ ID NO: 16392 - protein, 157 aa, Unknown
  Obtained from environmental sample
  misc_feature (1)..(157): Xaa is any amino acid
MMGFLNTIFNKIKSAARERFILNKETNSIQILLDSSHEQYFTLTFDNMNIKTLYDPNIFRSTVIDANSLDLGELYIEVIELDYQHDWNGSAGGCFDLFIKQEFQKSKFEFVKSFDDDFAKFTKYQVNDKYEVGSIWFSLNKQDIFIFDTKGKLFMTY

SEQ ID NO: 16393 - DNA, 597 bp, Unknown
  Obtained from environmental sample
  misc_feature (1)..(597): n is a, c, g, or t
atgatgggatttttaaataccatattcaataaaataaaaagcgctgcaagggaaagatttatcctcaccaaagagacaaattcgatacaaatactacttgatagttcccatgaacaatattttacactcacctttgataatatgaatataaaaactttatacgatccaaatatctttagaagtactgtcatagatgcaaatagtttagatttaggagagctttacatagaggtgattgagctagattatcaacacgattggaatggaagtgcaggaggttgttttgatctttttatcaaacaagagtttcaaaaatcaaagtttgaatttgtaaaaagttttgatgatgattttgccaagtttactaaataccaagtgaatgataaatatgaggtaggattaatctggttttctttaaacaaacaagatatttttatctttgatacaaaagggaagctttttaatgacctactaaaaatatatgatgtaaaaaatagcttatattttatcaagaagctagatagtgtaagtatgaaactaaaaaatagccttacacaaacaaatcttattggggattatattagtaaaatagactaa

SEQ ID NO: 16394 - protein, 198 aa, Unknown
  Obtained from environmental sample
  misc_feature (1)..(198): Xaa is any amino acid
MMGFLNTIFNKIKSAARERFILTKETNSIQILLDSSHEQYFTLTFDNMNIKTLYDPNIFRSTVIDANSLDLGELYIEVIELDYQHDWNGSAGGCFDLFIKQEFQKSKFEFVKSFDDDFAKFTKYQVNDKYEVGLIWFSLNKQDIFIFDTKGKLFNDLLKIYDVKNSLYFIKKLDSVSMKLKNSLTQTNLIGDYISKID

SEQ ID NO: 16395 - DNA, 567 bp, Unknown
  Obtained from environmental sample
  misc_feature (1)..(567): n is a, c, g, or t
atggccttgagtgaagaggggctggtcatctcctttgaacgcagaccgaaggtatccctgtatgattttaagggaaaaaagataaaaaactatccgctggcgcaggaacttcaggagatagagaactatacaagagcaaacaaggctttggagtctgtcacagaacatcctctctttggcatcatcacagctccggaagtccctttgaaaggcagcgatgcaggtcttcatactctctacagtctaaacaagaagtggagctttaaggcaagcggagagatcaccgcgatagagttactgccggataataacctgttgatccttgagcgtgactatgacttcttcaaaggccatagtatatggctaagtaaggtcaatatcatggagtgtaaggcaggaagctgtccgtctaagaacttggctaccttgaaaaaaagtgatggctggaagctggataactttgaaggtctgacccgtatcaaagatgatctgtatctgatgatcagcgatgataacgggagctttctgcaggagtgtatcgtcgttctatttgagataaaacattaa

SEQ ID NO: 16396 - protein, 188 aa, Unknown
  Obtained from environmental sample
  misc_feature (1)..(188): Xaa is any amino acid
MALSEEGLVISFERRPKVSLYDFKGKKIKNYPLAQELQEIENYTRANKALESVTEHPLFGIITAPEVPLKGSDAGLHTLYSLNKKWSFKASGEITAIELLPDNNLLILERDYDFFKGHSIWLSKVNIMECKAGSCPSKNLATLKKSDGWKLDNFEGLTRIKDDLYLMISDDNGSFLQECIVVLFEIKH

SEQ ID NO: 16397 - DNA, 921 bp, Unknown
  Obtained from environmental sample
  misc_feature (1)..(921): n is a, c, g, or t
gtggttgaacaggatatcgctgtcctcaaccagctgaatgatcaggtgcaaagcggccacatgacaaaacaacaggcaaaagacaggtttcagaaacatgccctcaaccagataataggcaaaagcggttatattgttgccttaaaaccgcaggattcccgcattatgatcaagatccacccgttctcccgcaataccgactgcgcattcaaccagggatgccgggactggatcttgcagaaaaacggctatagtgaatatgaatggaaaaatcctgaagacaaacaaatccggaaaaaagtcagctatataaattattttgagccctgggactgggttgtgggagcgacatcctacgaagatgagttcacccagctggttaaaatagaggatctggagcggttcatcagcccgattaccatcctgggccaggggtatttttttgtgctggataagaatttggatattctgattcatcctgagctaaaagggcagtcgggcaaggatttaaaggattttgaagggcggtttattgccagggagataaccaggaacccgggaactttcttttattaccgctggaaaaatccttccgaaaaaagggtcaagaaaaaatttgcctatgcaaaggaaattaataattttaactggtacctggtggcaactggatatttagaggatgttaccctccccatcgacagactcatgcggatcagctatgcccttgttgtattggtgacgattttgttaaccggcctgacactgtttttcagccgcagcctgtcacggccattgaccgaattggtcaatggtttgcaagcctttgaccgggcaaaaaaaatctttaaaatgccatccagatccgtgactgagattgaaggtactggggccttccctggaaacatggaccaaccattgtga

SEQ ID NO: 16398 - protein, 306 aa, Unknown
  Obtained from environmental sample
  misc_feature (1)..(306): Xaa is any amino acid
MVEQDIAVLNQLNDQVQSGHMTKQQAKDRFQKHALNQIIGKSGYIVALKPQDSRIMIKIHPFSRNTDCAFNQGCRDWILQKNGYSEYEWKNPEDKQIRKKVSYINYFEPWDWVVGATSYEDEFTQLVKIEDLERFISPITILGQGYFFVLDKNLDILIHPELKGQSGKDLKDFEGRFIAREITRNPGTFFYYRWKNPSEKRVKKKFAYAKEINNFNWYLVATGYLEDVTLPIDRLMRISYALVVLVTILLTGLTLFFSRSLSRPLTELVNGLQAFDRAKKIFKMPSRSVTEIEGTGAFPGNMDQPL

SEQ ID NO: 16399 - DNA, 804 bp, Unknown
  Obtained from environmental sample
  misc_feature (1)..(804): n is a, c, g, or t
ttgaagcatttaaatacaattggtcgatattggcgaaaaaagtatggacaaaaagtttataaaatacctattagtatatctggatttacttgtccaaatatagatggaacagtagcaaaagggggttgtaccttttgtgaaaatgaatctttttctccaaatttagtagataaatcaagatttaaacttaatcttcattcaaaagagaatccctatttagagaaacaacttttacaacttcaaatgcaatttgatgctacaaaagagagactagaaaataaatatggtgcaaaaaaatttattgtttattttcaatcatttacaaatacctatgctcccctagatactttaaagtcactttatgaaaaagctttgagctttgataatgtggtaggtttaagtataggtacacgaacagatagtatcacagaagaaactttagattatctacaaagtttatcaaaagataaagagatctgggttgagtacggaatacaatcaatttatgatgaaactctagaaaaaataaatcgtggacacacttttgcaaatattcaagagtggatacttaaaacaaaagatagaaatttgttagtttgtggtcatatgatatttggacttcctaacgaaacacaagagatgatgcttaaaggtgttaaagaatcactaaagctaggtatagattctattaaatttcatcctttgtatgtaacgaaaaatacactcttggcaaatgaatataagcagggagagtttaccccaataagtgaagaactttatgtaaatacccttgtgaagtcataa

SEQ ID NO: 16400 - protein, 267 aa, Unknown
  Obtained from environmental sample
  DOMAIN (25)...(222): Radical SAM superfamily
  misc_feature (1)..(267): Xaa is any amino acid
MKHLNTIGRYWRKKYGQKVYKIPISISGFTCPNIDGTVAKGGCTFCENESFSPNLVDKSRFKLNLHSKENPYLEKQLLQLQMQFDATKERLENKYGAKKFIVYFQSFTNTYAPLDTLKSLYEKALSFDNVVGLSIGTRTDSITEETLDYLQSLSKDKEIWVEYGIQSIYDETLEKINRGHTFANIQEWILKTKDRNLLVCGHMIFGLPNETQEMMLKGVKESLKLGIDSIKFHPLYVTKNTLLANEYKQGEFTPISEELYVNTLVKS

SEQ ID NO: 16401 - DNA, 441 bp, Unknown
  Obtained from environmental sample
  misc_feature (1)..(441): n is a, c, g, or t
atgtcagtaatcagaattaccaaagaatttaagtttgaaatggctcatgccttactaggttatgatgggccatgtaaaaatattcacggacattcatacaaattaaatgttaccgttaaaggaaaaataaaaaatggcacttcagattctgatgaaggaatggtggtagattttggtatcatcaaaaaaattgtaaatgatttaatcgttcataaatacgatcatgcattggttttaaatgaaaaaatggacatagactttacgcagtttgattttatgcctaaattgattacagttccatttcaacctacttgcgaaaacctgttaatacattatgcagcgttgattaaagcacaacttccttctaatattactttacacagcttatttttaagagaaactcctacctcttatgcagagtggtttgcagcagacaattaa

SEQ ID NO: 16402 - protein, 146 aa, Unknown
  Obtained from environmental sample
  DOMAIN (1)...(140): 6-pyruvoyl tetrahydropterin synthase
  misc_feature (1)..(146): Xaa is any amino acid
MSVIRITKEFKFEMAHALLGYDGPCKNIHGHSYKLNVTVKGKIKNGTSDSDEGMVVDFGIIKKIVNDLIVHKYDHALVLNEKMDIDFTQFDFMPKLITVPFQPTCENLLIHYAALIKAQLPSNITLHSLFLRETPTSYAEWFAADN

SEQ ID NO: 16403 - DNA, 609 bp, Unknown
  Obtained from environmental sample
  misc_feature (1)..(609): n is a, c, g, or t
atgaatattattataactgctgaagagtttttcagagctagtaaatctcaacctatcgtattttctaaaaaagaagatggagagtttgtagcaactgcaatcatggggattaaagagaattctaacctctttgtaaatgcaaaaggagagtggaaaaattcagagtatattcctgcttatttaagacgttatccattcatttttgttcaaaatgaagagactttagcacttgctgttgatgaagattgtaaagctgtaaatgagaaagagggtcaaagtctatttgatgaaaatggagaatcatctgaatatacaaaaaaagttatggaatttatgcaaaattttcaaagttcaagcattaaaactgctaatttgattaaagagttagacagtttaggacttttagaagagacaaatgtaaatatgacaattaaagatgaaaaattatctttcacaggatttatgagagtaaatgaagctaaattaaatgagctaagtgatgaagatacactcaaacttgtaaaaagtggtgcttacaaactaataacagcacacttaatatcattaactaattttgataaattagtctcttattacagtagtaaataa

SEQ ID NO: 16404 - protein, 202 aa, Unknown
  Obtained from environmental sample
  DOMAIN (1)...(195): SapC
  misc_feature (1)..(202): Xaa is any amino acid
MNIIITAEEFFRASKSQPIVFSKKEDGEFVATAIMGIKENSNLFVNAKGEWKNSEYIPAYLRRYPFIFVQNEETLALAVDEDCKAVNEKEGQSLFDENGESSEYTKKVMEFMQNFQSSSIKTANLIKELDSLGLLEETNVNMTIKDEKLSFTGFMRVNEAKLNELSDEDTLKLVKSGAYKLITAHLISLTNFDKLVSYYSSK

SEQ ID NO: 16405 - DNA, 951 bp, Unknown
  Obtained from environmental sample
  misc_feature (1)..(951): n is a, c, g, or t
ttgtatttaaagtatgataaaaaattaataatagatactagaaatatatcaataggctaccagggtaatacaaaaagtgttgatatgaaagttaaattttcaattgaaagcttttttgataattattttattgaggtctatgagtatgttttatttgaaccatacctaaaagcatcaggaaaatttatagttaacttagatgatttgtcacttgagtcaataataaaagatacaaatataaatgattttgcattacaatttaataacaaccttaagtttataacagcccagagttgttttgtaacttttaaggataataatttttattttagttttaaaaaacctatgtatgaaggggttaatttagaggggagtaaagctacaatccttgatttggatagattaaaactagagcttacttctggggataaattaaaaaaaccactattggaacttttgagtaactataaaatcaatcttcctttagttcaagaatatggttcaaatacaatttttacagaacttttaataccctttaatatacaaaaagaacttacagttcaatcaaaaattgcattagaaaatgctaaagtatatctttataatattccattatatactaaaaaatttgatatttttttagataataatatcttaacagggagtgggaaacttcataaaacagatgatgacaatagcactttagcatatgattctgatgttgtatttgatatagactttaaaaagaatagtgtcaaaggtaattttataacacaaagtataaattttaaagatattaatataaccaatattgagggtgattttaatcttgattttaataatagctttttttcagatattagaatacaaaatggaaatttaaaattaaaagatcaaaattttgtattaaaaaaattcaaatctacttataaagatattgataaaacattt

SEQ ID NO: 16406 - protein, 317 aa, Unknown
  Obtained from environmental sample
  misc_feature (1)..(317): Xaa is any amino acid
MYLKYDKKLIIDTRNISIGYQGNTKSVDMKVKFSIESFFDNYFIEVYEYVLFEPYLKASGKFIVNLDDLSLESIIKDTNINDFALQFNNNLKFITAQSCFVTFKDNNFYFSFKKPMYEGVNLEGSKATILDLDRLKLELTSGDKLKKPLLELLSNYKINLPLVQEYGSNTIFTELLIPFNIQKELTVQSKIALENAKVYLYNIPLYTKKFDIFLDNNILTGSGKLHKTDDDNSTLAYDSDVVFDIDFKKNSVKGNFITQSINFKDINITNIEGDFNLDFNNSFFSDIRIQNGNLKLKDQNFVLKKFKSTYKDIDKTF

SEQ ID NO: 16407 - DNA, 348 bp, Unknown
  Obtained from environmental sample
  misc_feature (1)..(348): n is a, c, g, or t
gtgctttcacttcatgctcaaaaattagcaactaaaaatattaaaaaggggaaccatatagggtatggaagtgattcttttataacaccgtcagatatggttgtatcaaattataatattggatatggagatggattatttagagccaattctcataaacaaagaaaaatagctaatggattagagatacttggtcgagtttctatggatagtttttctgtagaatctaaagacgatgaagtatgtgtttttgataatgtaacccatctagcacaagtgcacaatacaatcaaatatgagatactcacaagtttaaaaccatcaataaaaaggctgattgttgagtaa

SEQ ID NO: 16408 - protein, 115 aa, Unknown
  Obtained from environmental sample
  DOMAIN (1)...(114): Alanine racemase, C-terminal domain
  misc_feature (1)..(115): Xaa is any amino acid
MLSLHAQKLATKNIKKGNHIGYGSDSFITPSDMVVSNYNIGYGDGLFRANSHKQRKIANGLEILGRVSMDSFSVESKDDEVCVFDNVTHLAQVHNTIKYEILTSLKPSIKRLIVE

SEQ ID NO: 16409 - DNA, 567 bp, Unknown
  Obtained from environmental sample
  misc_feature (1)..(567): n is a, c, g, or t
ttgttgagtaatcgaatcccatttggagagattaatcaaaaaaagaaaaatgcagtatttttatctatctacacagatgaaatagccccttggaaatacttcaacgatgatataaaacacacacggtgtcccgctgttattatgatagatagatgggatggacggattggttttccaggtgggacactagaggatggagaaccacttttagatgccttggtgcgggaaatcaaagaggaagttggtattcgagttcgacctgaaaaagtaaaaggtgtcgtttcccatgaagatgaaaaatttgtaacacatctttatgctcttcatgtaaatgaattagagtttttacatatctattatcatatcttaaataacttttctcgttctattttaaatcatgcatatgaggaagcggatgagtcacattttatgtctgaaattacagggataaaaatagttcccatagtacaacatagaaataaagggattaatanatttttagaaaatagttttgcagggagctgtagaaaagatttgaagtatttatcacagagattttacaaataa

SEQ ID NO: 16410 - protein, 188 aa, Unknown
  Obtained from environmental sample
  DOMAIN (40)...(142): NUDIX domain
  misc_feature (1)..(188): Xaa is any amino acid
MLSNRIPFGEINQKKKNAVFLSIYTDEIAPWKYFNDDIKHTRCPAVIMIDRWDGRIGFPGGTLEDGEPLLDALVREIKEEVGIRVRPEKVKGVVSHEDEKFVTHLYALHVNELEFLHIYYHILNNFSRSILNHAYEEADESHFMSEITGIKIVPIVQHRNKGINXFLENSFAGSCRKDLKYLSQRFYK

SEQ ID NO: 16411 - DNA, 327 bp, Unknown
  Obtained from environmental sample
  misc_feature (1)..(327): n is a, c, g, or t
ttgaataatctgtcgcagagccttaggaagatccgaattaagagcatccatagagtgaaagataacaaatccaacactattgccgtcggctggaagcctgcagggaaccatctcagaatctgcggcgagtccatgatagacagcacgacgacaatcctgaacaatcatctcataggcaagaatcccatattcgagactctctgtttttccttcagcctgcttgaacgaacgtattccacctataaacatagtatagatagtgtacatgatgacaacaagaacagcagcagcaatacagacttcaacaagagtgaaaccttttcttaa

SEQ ID NO: 16412 - protein, 108 aa, Unknown
  Obtained from environmental sample
  misc_feature (1)..(108): Xaa is any amino acid
MNNLSQSLRKIRIKSIHRVKDNKSNTIAVGWKPAGNHLRICGESMIDSTTTILNNHLIGKNPIFETLCFSFSLLERTYSTYKHSIDSVHDDNKNSSSNTDFNKSETFS

SEQ ID NO: 16413 - DNA, 621 bp, Unknown
  Obtained from environmental sample
  misc_feature (1)..(621): n is a, c, g, or t
atgaagatacacaatccaaaatacttaaaagtagcgagagaactttgtacaaaatatgatatcccacttattgcagatgagatagctacaggttttggacatacaggaaaaatgtggggatgtgaccatgcaaatataaagcctgatattatcactgtaggaaaaggattaactggtggagttatgacaatggctgctatgatgacaacaaaaaatattagtgatacaatttcatctagtgatattggtgttattatgcatggtcccacttttatgggaaatcctttagcttgtagtgtagcaaatgctagtattgatttactattacattcatcttgggagcaaaaagtaaaaaatatagagaatatatttactcaagagttagcatcacttcaaaaattaaatatagttcaagatacaagaaatataggggctataggagttgtagagctcaaagatgatactcatgcacaaactattcaagaatactgtgtcaacaatggtgtttggatacgaccatttggaaaactagtttatagtatagttgcttatactattagtgatgaagaactctataagataacaaatacaatcaaaaaagccttggagagcttaaaataa

SEQ ID NO: 16414 - protein, 206 aa, Unknown
  Obtained from environmental sample
  DOMAIN (1)...(206): Aminotransferase class-III
  misc_feature (1)..(206): Xaa is any amino acid
MKIHNPKYLKVARELCTKYDIPLIADEIATGFGHTGKMWGCDHANIKPDIITVGKGLTGGVMTMAAMMTTKNISDTISSSDIGVIMHGPTFMGNPLACSVANASIDLLLHSSWEQKVKNIENIFTQELASLQKLNIVQDTRNIGAIGVVELKDDTHAQTIQEYCVNNGVWIRPFGKLVYSIVAYTISDEELYKITNTIKKALESLK

SEQ ID NO: 16415 - DNA, 363 bp, Unknown
  Obtained from environmental sample
  misc_feature (1)..(363): n is a, c, g, or t
atgatttacgatttttggaaagattatgaggaattactttcttatgatcaagcttcacttttggattatcgactagataatataggtatcaaattaaatgatttttttcaaaggttaattataggtcatataaaaaaacgagatataaagtgctatcttgctggttcttgtttgaagtcggataattttgctgatttagatctgtttttcccctcaaatgaagatagagagttaataaataatgctatgaataaagattattttgagtatgagaataattcatatacttatagatacaaaaatgatatatatcaacttgtttatagagaaaggtttaaaggagctactttaaaagagctttag

SEQ ID NO: 16416 - protein, 120 aa, Unknown
  Obtained from environmental sample
  misc_feature (1)..(120): Xaa is any amino acid
MIYDFWKDYEELLSYDQASLLDYRLDNIGIKLNDFFQRLIIGHIKKRDIKCYLAGSCLKSDNFADLDLFFPSNEDRELINNAMNKDYFEYENNSYTYRYKNDIYQLVYRERFKGATLKEL

SEQ ID NO: 16417 - DNA, 885 bp, Unknown
  Obtained from environmental sample
  misc_feature (1)..(885): n is a, c, g, or t
ttgatggctcgggacattgattttgataaaccaattaaagttttagtttatcaaaaaggtcaaaagaataatgcaaaaacttttacttttactttacctgagtttaaaattactgaatttaaatttacaggcaaagaaccctttgatcaaaataaattaggaagtattaatgttgcaattaaaggtcctccaaaggctgagtatctttatattttcaaaactcctgattcaagatttagagtgaacggtgagtggcaatatattgtagcaattcataaaacaaatgatcaaacattttcaataagatgggaatctccaatggtttcacaaaaagtggatttagaagagctttatcttatgttagttatggacacttcatttaacatggggatgaaagtgggtaatattttagctggagatcttgttaaaaaaaatattaaaacaatcactggttcagggaaaactcctccaataactatggaacaatttgaagcttatacgggtgctttaaaatggggtaattatggttataatggtttgtcaaaattaggacaacaaaataaagattggaatagaaaacaaggtgaaggtgaagattggatgtatcatcaaggtaaaaaagcttttgcagttgtatctgcagttgaaggttttgtaggtaattttattcctgaaaaatataatgttcctggtgctgttttaagtgttggtttagaagcagttgatggttggtataaagcagtagatgcaacaatcgcaataagcaattctaaagaaataactagggtgattccaattgcagtagatgtaattcttccagggtatgaaactcaatcaaaaaaaataaatgttactgttatcggttctgagttggtgtcaatatga

SEQ ID NO: 16418 - protein, 294 aa, Unknown
  Obtained from environmental sample
  misc_feature (1)..(294): Xaa is any amino acid
MMARDIDFDKPIKVLVYQKGQKNNAKTFTFTLPEFKITEFKFTGKEPFDQNKLGSINVAIKGPPKAEYLYIFKTPDSRFRVNGEWQYIVAIHKTNDQTFSIRWESPMVSQKVDLEELYLMLVMDTSFNMGMKVGNILAGDLVKKNIKTITGSGKTPPITMEQFEAYTGALKWGNYGYNGLSKLGQQNKDWNRKQGEGEDWMYHQGKKAFAVVSAVEGFVGNFIPEKYNVPGAVLSVGLEAVDGWYKAVDATIAISNSKEITRVIPIAVDVILPGYETQSKKINVTVIGSELVSI

SEQ ID NO: 16419 - DNA, 678 bp, Unknown
  Obtained from environmental sample
  misc_feature (1)..(678): n is a, c, g, or t
gtgaaaaaggttttattaattgttcctcatcaattagaccgtaatccaagtcaaagatttaggatagagcagtatattaattttttggaaagcaaaggttatacttttaaagtttcttatttattaaaccataaagatgataaggtattttattctacaggaatgatactacataaacttttattattacttaagtttattattataagatttttcgatattttcaagatgcataaatatgatataatctttgtgcaaagggaagcaatatttatagggacaatgttttttgaatatattttttctctgtcaaaagcgaaattagtatatgattttgatgactctatatggttacctaatgtttctgaagcgaataaaaactttgactggcttaagaattatcataaaacttcaaatataataaaattgtcagacatcatcatagccggcaatcaatacttgtcagattatgcaatgcgatttaataaaaatatacttattatacctactactgttgacacaagcaaatttaaacctactaacaaaaaaccaaaagacgtgttatgtattgngtggtcaggaagtcaaactacattaaaatactttgaatcaattataggtgttttagaaagaatatcattacaatatgcgggaaaagtaagtttaaagtatcagtaa

SEQ ID NO: 16420 - protein, 225 aa, Unknown
  Obtained from environmental sample
  misc_feature (1)..(225): Xaa is any amino acid
MKKVLLIVPHQLDRNPSQRFRIEQYINFLESKGYTFKVSYLLNHKDDKVFYSTGMILHKLLLLLKFIIIRFFDIFKMHKYDIIFVQREAIFIGTMFFEYIFSLSKAKLVYDFDDSIWLPNVSEANKNFDWLKNYHKTSNIIKLSDIIIAGNQYLSDYAMRFNKNILIIPTTVDTSKFKPTNKKPKDVLCIXWSGSQTTLKYFESIIGVLERISLQYAGKVSLKYQ

SEQ ID NO: 16421 - DNA, 870 bp, Unknown
  Obtained from environmental sample
  misc_feature (1)..(870): n is a, c, g, or t
atggacagatcggctcggaggactaaagaagaacaagccgaagatggtataaaagaattaaaacaaaatgtagatgctattattgttatacgtaatgataaaattagagaattttatggaaatcaaaaaataacaacggcttttgctaatgcagataatgttttgaatatcgctgcaaaaagcatttcaagtgttatttatagtcagggaataataaatcttgatttcgaagatgtaaaaactgttatgcaaaatagcggtgttgcaattatgggagcagaccaaggagaaggcgaagatagagctgaaaaagtaactcttggagctttagactcacctttgttgaatgataatcatatcgctggagctcaaaatgttctattatatgttagctatggaaatgaagaaattactatggatgagttggaaaaaataactgaaatagtacaagaacaagcaggaatggatgcaaatcttatgttaggatatggaaaagaagcaagccttgaaaataaaatatcaataactattgttgctacaggatttaaagatgcacctgatataggtattaatatagaaaaagaagtagagaaaaaacattctttgaataacgagagaaatcaacaaaataatgaaaataaagaagtccaaacaaaagtaaataacgaaattaaagacaagtttattttaacagttaaagagcctgtgaaaactcaaaatatacctgaaaaaaatataataaatataagtaatcaaatagggattgaactaaatgaagaagaggcaaaacaagatataccagaaacgataacagatgaaaccgaaactggaaatataaatttatcatttaatcctgaaatgacacattaa

SEQ ID NO: 16422 - protein, 289 aa, Unknown
  Obtained from environmental sample
  DOMAIN (72)...(197): Tubulin/FtsZ family, C-terminal domain
  misc_feature (1)..(289): Xaa is any amino acid
MDRSARRTKEEQAEDGIKELKQNVDAIIVIRNDKIREFYGNQKITTAFANADNVLNIAAKSISSVIYSQGIINLDFEDVKTVMQNSGVAIMGADQGEGEDRAEKVTLGALDSPLLNDNHIAGAQNVLLYVSYGNEEITMDELEKITEIVQEQAGMDANLMLGYGKEASLENKISITIVATGFKDAPDIGINIEKEVEKKHSLNNERNQQNNENKEVQTKVNNEIKDKFILTVKEPVKTQNIPEKNIINISNQIGIELNEEEAKQDIPETITDETETGNINLSFNPEMTH

SEQ ID NO: 16423 - DNA, 756 bp, Unknown
  Obtained from environmental sample
  misc_feature (1)..(756): n is a, c, g, or t
ttggtgaaaattgcttcgaaatacggtattgcttttattgtggacaatacaatatcaccaatagtagtaaaaccttttgagtatggtgcggatattgttatctattccacaacaaaaattattagtggaaactcttctgctttaggtggagttgctatttttaaaaaagttgaagaaaatgataaatttcataatagtagatatcagtttttaaaaccatttatcaataaacttcaaggcaaagcactcattggatgcgctaaaaaaagagcgatgagagactttggtatgagtgcaaatgccaatagtagctatcaaactttacttggtcttgaaacactccctttgcgattacaacagattaataactcttgtgaaatagttgcggcgtttttagaaaaaaatggaattaaagtaaatcatccttcactagataatcattcagataatcaactctataaagagagatacagtgctggtgtaggttctatgataactattgatatgggaacaaaagagaaagctttcacctttcttgatagttcaaaactttgtatcctgactgcaaatattggagatagtagaactttagcattacatatgggtagtactatatatagtgattttacacaagaacaaaaagaatttttaggtattacttctggacttattcgtgtatctataggcttagaagatcctaaatttatttgtgatgatttgcttgaatcctatagattaagtgatttgaagatataa

SEQ ID NO: 16424 - protein, 251 aa, Unknown
  Obtained from environmental sample
  DOMAIN (1)...(245): Cys/Met metabolism PLP-dependent enzyme
  misc_feature (1)..(251): Xaa is any amino acid
MVKIASKYGIAFIVDNTISPIVVKPFEYGADIVIYSTTKIISGNSSALGGVAIFKKVEENDKFHNSRYQFLKPFINKLQGKALIGCAKKRAMRDFGMSANANSSYQTLLGLETLPLRLQQINNSCEIVAAFLEKNGIKVNHPSLDNHSDNQLYKERYSAGVGSMITIDMGTKEKAFTFLDSSKLCILTANIGDSRTLALHMGSTIYSDFTQEQKEFLGITSGLIRVSIGLEDPKFICDDLLESYRLSDLKI

SEQ ID NO: 16425 - DNA, 390 bp, Unknown
  Obtained from environmental sample
  misc_feature (1)..(390): n is a, c, g, or t
atgaaaaacttaataggattagacaaagaaaaaacattggttttaagagaaaaactaaatgatttattggcagattaccagttgttttaccagaacttaagaggtctacactggaatattaaagggaaagaattttttgagcttcatgtaaagtttgaggaattttacaacgatgccattataaaaatagatgaaattgctgaaagaattttaacattagagggcgagccactacatacttattcggcatacttgcaagcttctgaaattaaagaagaaaaaagtgtaacggatggagtaaaaggagtggagattattattaaaaattttggtgtattaactcttaaagaaagagaaatcttaaagctaacccgcggatgcaaacgatga

SEQ ID NO: 16426 - protein, 129 aa, Unknown
  Obtained from environmental sample
  misc_feature (1)..(129): Xaa is any amino acid
MKNLIGLDKEKTLVLREKLNDLLADYQLFYQNLRGLHWNIKGKEFFELHVKFEEFYNDAIIKIDEIAERILTLEGEPLHTYSAYLQASEIKEEKSVTDGVKGVEIIIKNFGVLTLKEREILKLTRGCKR

SEQ ID NO: 16427 - DNA, 384 bp, Unknown
  Obtained from environmental sample
  misc_feature (1)..(384): n is a, c, g, or t
atgtacaaaccaattaaatttaaaattatgacagaaattataggtgtatcaattccaatttttataacactaggtgtttttgcaatgatagtattgcttagaagaatggaaaatcaggaaagattaaaaatgatagaaaaaggcatggatttaaacttgcctaaaaaagaaaataacagtggttcagcattaaagtttgcattaatagcagtaggtgttggtgtaggcttgttagtaggaaatttgttggatgtttatacgccattaaaagatgaggtatgttatttttcaatgatctttttatttggaggtttaggcttgtttattgccaataaaatggacgagaaaaaacgtaaaaacaataataacggagatattagttaa

SEQ ID NO: 16428 - protein, 127 aa, Unknown
  Obtained from environmental sample
  misc_feature (1)..(127): Xaa is any amino acid
MYKPIKFKIMTEIIGVSIPIFITLGVFAMIVLLRRMENQERLKMIEKGMDLNLPKKENNSGSALKFALIAVGVGVGLLVGNLLDVYTPLKDEVCYFSMIFLFGGLGLFIANKMDEKKRKNNNNGDIS

SEQ ID NO: 16429 - DNA, 930 bp, Unknown
  Obtained from environmental sample
  misc_feature (1)..(930): n is a, c, g, or t
atgcactataaagcaatgatgcaagaattactcaatgcaatagaagatgaaaagtttgaacaaataattcgaatgaaaaaaatttatcaaggtatatttccatcaattgttaaaagatttggatatgaaagtattgaacaaatatataatatggtaaattctaaaatgattaagtattatctacaaacaaatcagtgtaatcagcttaatattgttattaaggatatagctgatgatgtgttattattacttattaaagatgaaaaaactgtagataaacttttttcttgtatgatagaagttccagatgagagaacttataaagtagctaaagatgtgtatggaaaagctaaaaataatcgaatttatttttatttagagagagttgctcttattttgaaaaaatatgatgatgcgaaagctttttctcaaaaacttgatatgtttagtgatgcagatgtattgtcagatgagtttttatatagatttttaatatatgcaaatgaagataactcacaagcgatgcaaaacttttttgcatatgctagagcaaatccagagtttataattaacaataaaaacaaccctttaataattgatttttatcaccaatattatctttatttacttaaagaaaaagaggaaaatgaagcagtagctattttaaaagatttatataaaaaacaaaatgagatgaaggctagagtatactcgccatttgttgagattgaattatcaaagtatgcaaagttagatgataattatgatgaagctttagagtatttacaatatggacttaatatanaaagactcaaagatggaaaaagcttagatagaaaaatcaaagatgaggatttagttcatatatattatgaaatgccaagatttatgagcatcagggtaaaaaaaatagatataaagatgccataa

SEQ ID NO: 16430 - protein, 309 aa, Unknown
  Obtained from environmental sample
  misc_feature (1)..(309): Xaa is any amino acid
MHYKAMMQELLNAIEDEKFEQIIRMKKIYQGIFPSIVKRFGYESIEQIYNMVNSKMIKYYLQTNQCNQLNIVIKDIADDVLLLLIKDEKTVDKLFSCMIEVPDERTYKVAKDVYGKAKNNRIYFYLERVALILKKYDDAKAFSQKLDMFSDADVLSDEFLYRFLIYANEDNSQAMQNFFAYARANPEFIINNKNNPLIIDFYHQYYLYLLKEKEENEAVAILKDLYKKQNEMKARVYSPFVEIELSKYAKLDDNYDEALEYLQYGLNIXRLKDGKSLDRKIKDEDLVHIYYEMPRFMSIRVKKIDIKMP

SEQ ID NO: 16431 - DNA, 615 bp, Unknown
  Obtained from environmental sample
  misc_feature (1)..(615): n is a, c, g, or t
atggtaagaatgactgccgagattgtaaaatctacgcatttaccagttaccgttaaaacccgtttaggctgggacgaaagcactaaatatattgttgaagttgccgaaagactacaagatgttggcatacaagccatctctatacatggcagaaccagaaaacaaatgtataagggagaagccgactggaccttaattggagaagtaaaaaacaaccccagaatgcacattcctgtttttggaaatggagatgtagatactccagaaaaagcattagcaaataaaaacagatatggaattgatggtgtgatgataggcagagcaagtattggctacccatggatttttaatgagataaaacatgttatggctactggagaacatcttgctccaccaaccatagaacaacgtattaatgttgccaaacgccatttagaaatgtctataaaatggaaaggagaaaaattaggtgtggttgaaatgcgaagacattatgctaattattttaaaggtattccacacttaaaagaatttagaataaaattagttactgaaaacaaccccgaaattttattccacaccttggatgaaattgctacagcgttgagttattaa

SEQ ID NO: 16432 - protein, 204 aa, Unknown
  Obtained from environmental sample
  DOMAIN (1)...(199): Dihydrouridine synthase (Dus)
  misc_feature (1)..(204): Xaa is any amino acid
MVRMTAEIVKSTHLPVTVKTRLGWDESTKYIVEVAERLQDVGIQAISIHGRTRKQMYKGEADWTLIGEVKNNPRMHIPVFGNGDVDTPEKALANKNRYGIDGVMIGRASIGYPWIFNEIKHVMATGEHLAPPTIEQRINVAKRHLEMSIKWKGEKLGVVEMRRHYANYFKGIPHLKEFRIKLVTENNPEILFHTLDEIATALSY

SEQ ID NO: 16433 - DNA, 768 bp, Unknown
  Obtained from environmental sample
  misc_feature (1)..(768): n is a, c, g, or t
atgcatagaanagctcaganncaaggagttgatgctgtcattctcctggaagaagagcaaattaaaagaattaagaaaaataatcttttaactacttctctctttgaattatcgtctaaagcagacaccgcaattattaaaaatgaagaaataattaatggtgtaggaataaaatataaagagaatgtagattatttagaaaaatttgtaaagtcaaaagatatatacatcaatacttcatctaaagaaagattcatatttaatgggagcatttttattgatttcaaaggaaatgatgtcagaacagtaacaaagaaaaggcaaggtattgagcattataagaactttataagagcctattcctatcagtttttggcagtggaagtaaatgaattttggtcatataagaataactcaaaaggagacgttattaaaagaatccttcttaatgatgaaggatttcctgaattaaaatgcacattagaatatgattatgatgaccaattagttcttatcattattaaaaaaatgtctgtttcttttagttcagaaaacgaaattgttgaatttttctatgatgaaaaaaataggatgatagaacaatcaattctgactcaatcaaatgaagaattaagaatataccactcatatgatttttcaggcaaactcacagaaagtgttttgcaaagaatgaaagggcaaagagaagttccttttattaaagttgtttacaattactatgcgagtaaggacattaatcagttttaa

SEQ ID NO: 16434 - protein, 255 aa, Unknown
  Obtained from environmental sample
  misc_feature (1)..(255): Xaa is any amino acid
MHRXAQXQGVDAVILLEEEQIKRIKKNNLLTTSLFELSSKADTAIIKNEEIINGVGIKYKENVDYLEKFVKSKDIYINTSSKERFIFNGSIFIDFKGNDVRTVTKKRQGIEHYKNFIRAYSYQFLAVEVNEFWSYKNNSKGDVIKRILLNDEGFPELKCTLEYDYDDQLVLIIIKKMSVSFSSENEIVEFFYDEKNRMIEQSILTQSNEELRIYHSYDFSGKLTESVLQRMKGQREVPFIKVVYNYYASKDINQF

SEQ ID NO: 16435 - DNA, 429 bp, Unknown
  Obtained from environmental sample
  misc_feature (1)..(429): n is a, c, g, or t
gtgattcaaataggatatccatggatacaagatgctcaaaaattatatagttggcaaaggtttataaaacttttttatccgcatctaaaagatgtagaagagattgaagagttttattttaatctccttgatacactagcacacaagatggtaaagcaaaatcctaaaagagcaataattgagaactatgtacagttatgtgaacatgaaggacgattacatactgaatatgaatgtttattatgtgaagagattattgaaaatgatatatcattagtaagaagttttttaccaactcatgctaaatgcagttacagtaaaagattttccatcaataagataaaagagctgtttgaagaaaaaagttcattacagttaagtgatgaagaggtagagtatttatgggatattttactgcaaggtttataa

SEQ ID NO: 16436 - protein, 142 aa, Unknown
  Obtained from environmental sample
  misc_feature (1)..(142): Xaa is any amino acid
MIQIGYPWIQDAQKLYSWQRFIKLFYPHLKDVEEIEEFYFNLLDTLAHKMVKQNPKRAIIENYVQLCEHEGRLHTEYECLLCEEIIENDISLVRSFLPTHAKCSYSKRFSINKIKELFEEKSSLQLSDEEVEYLWDILLQGL

SEQ ID NO: 16437 - DNA, 900 bp, Unknown
  Obtained from environmental sample
  misc_feature (1)..(900): n is a, c, g, or t
atgatagtctcatacgatactatgcntgatgcgtactggaaagatactcagattaaatcactgatcgaaaaatttccagatggtcaagttgttataagaatcgatggagagatagcaggggcggctctctctatcatagtagactatgaaaaatttgcactacaccatacttatcgtgagataactggagattatacatttaacacacatacagacactggtaatattctttatggtattgacgtctttgtaaaaccgaaatttagaggacttcgtttaggtcgtcgtctatatgactacagaaaagagttgtctgaaaagctaaatctaaaaggtatcgcgtttggcggcagaattccaaactatcacaaacattcaaatgaggtatcgcctaaagagtatattgaaagagtaaagagaaaagagattcatgatcctgttcttaattttcaaatgtcaaatgattttcacccatcgaaaatcttaaaaggatatttgaaagatgataaagagtcaggtgaatttgcagttttacttgagtgggataatatctactatgaaagaccaaatacaaaagctacaacaaagaaaaaaattgttcgtttgggattaatacagtggcagatgagaccttatgcaaatttagaagagttgatgcagcaagcagagtattttattgatacagtttcagggtatcgttgtgattttgctctatttccagagtttttcaatgcacctttaatggctgtaaataatcacatgtcagaaccagatgctattagagagttggcaaaacatacagattcaatagtaaaaaaattctctgagttttctatatcttacaatattaatattatcacgggaagtatgcctgagatgaaagatgngtcatctctataa

SEQ ID NO: 16438 - protein, 299 aa, Unknown
  Obtained from environmental sample
  DOMAIN (30)...(129): Acetyltransferase (GNAT) family
  misc_feature (1)..(299): Xaa is any amino acid
MIVSYDTMXDAYWKDTQIKSLIEKFPDGQVVIRIDGEIAGAALSIIVDYEKFALHHTYREITGDYTFNTHTDTGNILYGIDVFVKPKFRGLRLGRRLYDYRKELSEKLNLKGIAFGGRIPNYHKHSNEVSPKEYIERVKRKEIHDPVLNFQMSNDFHPSKILKGYLKDDKESGEFAVLLEWDNIYYERPNTKATTKKKIVRLGLIQWQMRPYANLEELMQQAEYFIDTVSGYRCDFALFPEFFNAPLMAVNNHMSEPDAIRELAKHTDSIVKKFSEFSISYNINIITGSMPEMKDXSSL

SEQ ID NO: 16439 - DNA, 660 bp, Unknown
  Obtained from environmental sample
  misc_feature (1)..(660): n is a, c, g, or t
atgtttttttatagtataatcccaacaataaaaaagaaggttgatatattggttgcaatagttgattataatatgggaaatttagcaagtgtttataatgcttgtaagctaatagatgcagatgctacaatagtaaaagacccaactaaattaaaagattttaatagaataatacttccaggtgttggtgcttttggagatgctatggaacatttaaaatctacagggatgtacgatgcagtaaaagagtttgcatctagtggaaaaccaattattggtatctgtttaggtatgcaattattatttgaaagtagtgaagagtttggcgatacacaaggtttaggactaattcctgggaaagttgtaccatttgataaatcaagaatggatatggatgaccacaaagtaccacatgtgggctggaataagatattcaataaaccaaataaactttttgaaggattggaaaatccatatctgtattttgtacattcatttcatgcggtaacagaagaaaaatatactattggtacaacacattatggatatgattttgtaagtgcagtacaaaaagataatatctacggatttcaaccacatccagaaaaatcacacgataatgggatacagatattaaaaaactttatgaaatttaattaa

SEQ ID NO: 16440 - protein, 219 aa, Unknown
  Obtained from environmental sample
  DOMAIN (47)...(175): CobB/CobQ-like glutamine amidotransferase domain
  misc_feature (1)..(219): Xaa is any amino acid
MFFYSIIPTIKKKVDILVAIVDYNMGNLASVYNACKLIDADATIVKDPTKLKDFNRIILPGVGAFGDAMEHLKSTGMYDAVKEFASSGKPIIGICLGMQLLFESSEEFGDTQGLGLIPGKVVPFDKSRMDMDDHKVPHVGWNKIFNKPNKLFEGLENPYLYFVHSFHAVTEEKYTIGTTHYGYDFVSAVQKDNIYGFQPHPEKSHDNGIQILKNFMKFN

SEQ ID NO: 16441 - DNA, 555 bp, Unknown
  Obtained from environmental sample
  misc_feature (1)..(555): n is a, c, g, or t
gtgataccagtggtttccatgcgtgggatgggaggaaataaccaaggacgaatgctggttatgattgatggagttcctataaataaaagtgatggtggttctgtaaattggaatgctattaacatcaataatattaaagaaataagtattattcaaggagctgcatcaaccctttatggagcaaatgccatgggtggagttatagaccttcgaacatcaatcccgaccgagagatggaaagccggagcaagtattanatacggaacatacaacaccctttttgccgatacctacgtgggacaaagtacatcgatagcttgcagcnaggcacattctggagtgtttcatgcatggagaaaaaccaatgggtactttacaaaagtgagaattttctggaaatacannnncgttnnnnnnnntccttcatttttaaagaaaatccggctgnnnnnnnnnngcgaattcccnnnncccccaaaaattttgttttttaaaannnnntantctccnaaaaaaaaaagggggaaatttttaataaagagggggtttttttaa

SEQ ID NO: 16442 - protein, 184 aa, Unknown
  Obtained from environmental sample
  misc_feature (1)..(184): Xaa is any amino acid
MIPVVSMRGMGGNNQGRMLVMIDGVPINKSDGGSVNWNAININNIKEISIIQGAASTLYGANAMGGVIDLRTSIPTERWKAGASIXYGTYNTLFADTYVGQSTSIACSXAHSGVFHAWRKTNGYFTKVRIFWKYXXVXXXPSFLKKIRLXXXXEFPXPPKILFFKXXXSPKKKRGKFLIKRGFF

SEQ ID NO: 16443 - DNA, 897 bp, Unknown
  Obtained from environmental sample
  misc_feature (1)..(897): n is a, c, g, or t
atgagaattacaatatttatgacaatttttttaatagtttttgcgttaattagtttttatgtatcaaaaaggtttatcagtaagttggatataaacactagatataaaaaatatttcaacatatttttagtgataaactttataggtattattggatatataataggacgatattatgctaatatccctaatacaatatactttttattttcacttcctattggtgtactatttttacttttttgtacagcagttatatatgacatctctagagttactatagaaaagataccccttaaatctactagacgaaaattttttaaaaaatctcttgatattttttccctaataggtgcagttgcattaagtggaagagccttatatgaagcaagatttgtaaaaatagaaaaagtaaatataaaattgaaaaatctacaacaaccatataaaatagtacagttaagtgatattcatattggtggacttatagatgagaaatttattggtgatattgtttctcgtgtgaataatttacaaccagacatggtagttattacaggagacttaatagatattaaaattaattctgcaaaaaaagctttaaaagaatttacaaacattgaatcaatttatggtacttatttcatagttggaaatcatgaatattttcatgggattgaagagattattactacaatgaaatctcttggtataatggtattggaaaatgaaaatgtttatattgnagaaaaaggtaaaggaatttattttgcaggagtatatgatgtttttggctatngagcaaatagattccaacccgatttaaaaaaagcccttcaaaataaaaccgacaactctcctacaatttcttttgcaccatccgcccaaaatttatag

SEQ ID NO: 16444 - protein, 298 aa, Unknown
  Obtained from environmental sample
  misc_feature (1)..(298): Xaa is any amino acid
MRITIFMTIFLIVFALISFYVSKRFISKLDINTRYKKYFNIFLVINFIGIIGYIIGRYYANIPNTIYFLFSLPIGVLFLLFCTAVIYDISRVTIEKIPLKSTRRKFFKKSLDIFSLIGAVALSGRALYEARFVKIEKVNIKLKNLQQPYKIVQLSDIHIGGLIDEKFIGDIVSRVNNLQPDMVVITGDLIDIKINSAKKALKEFTNIESIYGTYFIVGNHEYFHGIEEIITTMKSLGIMVLENENVYIXEKGKGIYFAGVYDVFGYXANRFQPDLKKALQNKTDNSPTISFAPSAQNL

SEQ ID NO: 16445 - DNA, 636 bp, Unknown
  Obtained from environmental sample
  misc_feature (1)..(636): n is a, c, g, or t
atgtgttttcatagcaaacaaagcaaaaaagcagtagaagtagaaaatagattcaatgcaaaaattgaaaagctagatttatttgtagcttcggagcatatcaacgcttttgcctatccaaaaacacctataattacagatgaaaagcagagcattatacagcattacaagtggggattaataccaagttggagcaaggacacaaaaattagtcaatataccattaacgcacgaatagaaaccataaaagaaaaatctgccttcaggaacaatttcaataaaagatgtttggtaatagccaatggcttttatgagtggaaatggttagatgcatcaggtaagaaaaagaacaagtatttaatctccttacccaacgaggaactatatgcctatggaggaatttattccgaatgggtagataaaagcacaggagaaatagtaaatacttattccattgtaactacagaagccaatgcgttagtggcagaaatacaccgaaaaaagagaatgcctgtaatcttaaagcccgaagatgaaagcaaatggctacaaggaaaagagataagcgattttgctctaccctattccgttgagttaatcgctaccaatttagatgataatccaacattgttttaa

SEQ ID NO: 16446 - protein, 211 aa, Unknown
  Obtained from environmental sample
  DOMAIN (16)...(206): Uncharacterised ACR, COG2135
  misc_feature (1)..(211): Xaa is any amino acid
MCFHSKQSKKAVEVENRFNAKIEKLDLFVASEHINAFAYPKTPIITDEKQSIIQHYKWGLIPSWSKDTKISQYTINARIETIKEKSAFRNNFNKRCLVIANGFYEWKWLDASGKKKNKYLISLPNEELYAYGGIYSEWVDKSTGEIVNTYSIVTTEANALVAEIHRKKRMPVILKPEDESKWLQGKEISDFALPYSVELIATNLDDNPTLF

SEQ ID NO: 16447 - DNA, 669 bp, Unknown
  Obtained from environmental sample
  misc_feature (1)..(669): n is a, c, g, or t
atgaaaacagaaagaaaaaaagagctattagaggctttaaagaatatcccagattatagagtagatgtaggtaaaatagagtatcccctatacgaagtattatttatgacactatttgcattacttaaaggcaatacaacttttaaagatatttttgtttggatgacatttaacaaagagaatgaaatactcaaagaagtatttgaaaaagagaagataaatgtaccttctcgttctacattgcataccttacttattaacacagataacaatgccttagaagctgtttttagagaatatttttttgagtatattcttcaaaagagtattgcaattgatgggaaatggctcagaggaagtgatgttaatggacaatatacacaagagtcccataaagccatacttaatattttagataaagatatcaaaattgtttttgcacataaatttttagataaaaataaaaagagtgagataagagcacttcaagagatacttgatgataaactttttagtggtgagggtcanatcttctcatttgatgcactattaacacaatcaaacattctcaatactatcaattcccaaggaaatagatatattgctaaactcaaagataatcaagataacctaaaacaaaaagctgttgagacagttgaaagcgtttga

SEQ ID NO: 16448 - protein, 222 aa, Unknown
  Obtained from environmental sample
  misc_feature (1)..(222): Xaa is any amino acid
MKTERKKELLEALKNIPDYRVDVGKIEYPLYEVLFMTLFALLKGNTTFKDIFVWMTFNKENEILKEVFEKEKINVPSRSTLHTLLINTDNNALEAVFREYFFEYILQKSIAIDGKWLRGSDVNGQYTQESHKAILNILDKDIKIVFAHKFLDKNKKSEIRALQEILDDKLFSGEGXIFSFDALLTQSNILNTINSQGNRYIAKLKDNQDNLKQKAVETVESV

SEQ ID NO: 16449 - DNA, 834 bp, Unknown
  Obtained from environmental sample
  misc_feature (1)..(834): n is a, c, g, or t
gtggataaaggggccggggggctggtaacggctatggcaccggtactcaaaaatagaaacggcacctggatcggctggcccggctatgtgcaggaggaagatattgaagacagtatgttgccggcaattcaggcagcagcttctggatatagtgttaagccggttatgcttaacgcagaggagttaaaaaattattacgaaggtttttccaattcaattatatggcctcttttccatgattttacggataagtgcattttcttgactgaatactggacaagttatcaaaaggttaataaaaaatttgcatcggctgtttatcagaatgcaaatgacctggattttatctgggtgcatgattatcaattaatactcgtgggtgcaaagttgcgcaaaatgcacttacgcaaccccatggggtttttcctgcacatcccatttccgccttttgatacctttgctcgatgtccatggcgttttgagcttctttgtgccatgttgcaatacgaccttatcgggttccataccattcaaaataaacgtaattttatcagatgcgtcaaaaaaataatccaggacgtgaaaatcgataaaaaaatagagtccaataaggcggtaagtgaattgatattaggcaacagaaaggtacgcatcggggtttttcccatcagcattgattataatgaattttttcttaaggcctgggacagcaacgtgtataaaagatcaaaacaaatgcggaaaaatgcagatacaaaaataatactgggggttgaccgactggattataccaagggcttacctgaaaagctgatcgcatttaaacggttttaa

SEQ ID NO: 16450 - protein, 277 aa, Unknown
  Obtained from environmental sample
  DOMAIN (1)...(277): Glycosyltransferase family 20
  misc_feature (1)..(277): Xaa is any amino acid
MDKGAGGLVTAMAPVLKNRNGTWIGWPGYVQEEDIEDSMLPAIQAAASGYSVKPVMLNAEELKNYYEGFSNSIIWPLFHDFTDKCIFLTEYWTSYQKVNKKFASAVYQNANDLDFIWVHDYQLILVGAKLRKMHLRNPMGFFLHIPFPPFDTFARCPWRFELLCAMLQYDLIGFHTIQNKRNFIRCVKKIIQDVKIDKKIESNKAVSELILGNRKVRIGVFPISIDYNEFFLKAWDSNVYKRSKQMRKNADTKIILGVDRLDYTKGLPEKLIAFKRF

SEQ ID NO: 16451 - DNA, 873 bp, Unknown
  Obtained from environmental sample
  misc_feature (1)..(873): n is a, c, g, or t
atggcttacaataaatttatactaattatagctataagagtatttttgattcttacaaactgcttttttctggtttatgaatacttcttacgagagtattatattactgtaataaatttagctgtatttctgattttacaaacagtattcctaatcaggtacgttggaaaaacaaatctgcaaataattgaatatttcgatttaataaaaaacaaagagtcgggttttagattaaaaaataccacaaataaaaatagtttttcgagattacgaaagcagtttaacgatacaaataaaataatccagaatgccagaattgaaaaagagatccaaacaaattacctaaatcatcttgttaactacattaatattggccttttttcttttgatgagaatgaaaggatacaatttattaatcctgaagcaaaaaggattcttggtgctaaaaatatattcaagctagatgacctgaatattgtaaataaagactttgccaattttttaagacaaataaatcccggagaatctgaagtaattgagatctctgctccagctataaaacaaaagctatctgttaattgcggattgttgaatttaaaaaactcaaaaataaaactcgtgtcctttcaggatattgacaaacacctttataaaaatgaaatagaatcgtggaataagcttataagaatattaaatcacgagataatgaattcaataaccccaataacctcattatcaaaaacaattaaaaaatatttttttgatgggaaaaatgtgatgctgcctaaaaatattccatcaacatcgattaacagaaccgttgaaggtcttgagattattgaagaaagaggaattggcttaattaatttttaa

SEQ ID NO: 16452 - protein, 290 aa, Unknown
  Obtained from environmental sample
  misc_feature (1)..(290): Xaa is any amino acid
MAYNKFILIIAIRVFLILTNCFFLVYEYFLREYYITVINLAVFLILQTVFLIRYVGKTNLQIIEYFDLIKNKESGFRLKNTTNKNSFSRLRKQFNDTNKIIQNARIEKEIQTNYLNHLVNYINIGLFSFDENERIQFINPEAKRILGAKNIFKLDDLNIVNKDFANFLRQINPGESEVIEISAPAIKQKLSVNCGLLNLKNSKIKLVSFQDIDKHLYKNEIESWNKLIRILNHEIMNSITPITSLSKTIKKYFFDGKNVMLPKNIPSTSINRTVEGLEIIEERGIGLINF

SEQ ID NO: 16453 - DNA, 648 bp, Unknown
  Obtained from environmental sample
  misc_feature (1)..(648): n is a, c, g, or t
atggctatcgtttcacctgataaaatggaatcgaccatgtatgcacttaatgcagaacaatgtacattccacattttaccaacacaaaatggcggtagcatttttaaagcatacgaaggcacggcagccagcagtttgtcctttaaaaactgtagttttttaaatagctatagaggactgaatttatcttacgataaagataattttggaaaatacaacgcattagaacttattattgataactgtgtttttaaagatatcgaagagtttgcggtaaattacattcgaaatattccagatgttaccataaaaggtggaaaactgcttgttacaaatagtgtatttgataaggttggtaataaagaaaaagggaaagttctaattacaaacggtatccataaagttaccattaaaaattctgtgtttataaatagttataaagctgaaacacctgttaacttaaaaggtacaaataacattatatccaattgcttatttgacgacaatggttaccctaaaataaccaaaggtgctaaagaaaaaaatgtcatttataaaaaccctaaatgggaagacaaagagcaatatatacctagtaaaaagtctcctttacttaaagagaataatggaaacgccttaattgcctaa

SEQ ID NO: 16454 - protein, 215 aa, Unknown
  Obtained from environmental sample
  misc_feature (1)..(215): Xaa is any amino acid
MAIVSPDKMESTMYALNAEQCTFHILPTQNGGSIFKAYEGTAASSLSFKNCSFLNSYRGLNLSYDKDNFGKYNALELIIDNCVFKDIEEFAVNYIRNIPDVTIKGGKLLVTNSVFDKVGNKEKGKVLITNGIHKVTIKNSVFINSYKAETPVNLKGTNNIISNCLFDDNGYPKITKGAKEKNVIYKNPKWEDKEQYIPSKKSPLLKENNGNALIA

SEQ ID NO: 16455 - DNA, 852 bp, Unknown
  Obtained from environmental sample
  misc_feature (1)..(852): n is a, c, g, or t
atgaaaaaatttaatataaaattaataattatatttatatcaagcctgtttttagcaagcttgattgttttttgtatattgtattttacatctagagttatagataaaaaacagtttgagacaggcttttatttatcaaatccaagtgacttatctttttttgaaactgcttttatgtttgataaaaaaagaattgatttatctggtaaaaaagttgtggctggcatcattccgcatcacttgttagctgctgatttaatagctgagcaattttcaaatctcaaaggtaaggattatgacgctattattttgataggacctaatcattttgacaccggtatttcaagtgtgattacttcagaatataattggcaaacgccctatggtttattggagtacgatcaagatattttagaccaaatattacaattagatatagttaaaatagagaatgaagctattgaagatgagcatgctataaatagtgaagtttcttttattaagaaaatttttcctcaagcaacatttttgccacttgtattgaaaccagaaataaatagcgagcaagctgaaaagttagcagagaaactttttgaaattagtaaaaataaaaaaatattagtcttgggtagtattgatttttcacattacaaaaatagtgtaactgctcaaaaaaatgatcaagtcagcattgaggctataaataaatttgattacaatactatttataatttggatattgattctccagcttcgctttatacagtgctcaaattcagtcaattaagtggagctaggtttgaattaattgaatattcaaattcagccatacttngtaataagccaaaactg

SEQ ID NO: 16456 - protein, 284 aa, Unknown
  Obtained from environmental sample
  SIGNAL (1)...(19)
  DOMAIN (43)...(277): Protein of unknown function DUF52
  misc_feature (1)..(284): Xaa is any amino acid
MKKFNIKLIIIFISSLFLASLIVFCILYFTSRVIDKKQFETGFYLSNPSDLSFFETAFMFDKKRIDLSGKKVVAGIIPHHLLAADLIAEQFSNLKGKDYDAIILIGPNHFDTGISSVITSEYNWQTPYGLLEYDQDILDQILQLDIVKIENEAIEDEHAINSEVSFIKKIFPQATFLPLVLKPEINSEQAEKLAEKLFEISKNKKILVLGSIDFSHYKNSVTAQKNDQVSIEAINKFDYNTIYNLDIDSPASLYTVLKFSQLSGARFELIEYSNSAILXNKPKL

SEQ ID NO: 16457 - DNA, 375 bp, Unknown
  Obtained from environmental sample
  misc_feature (1)..(375): n is a, c, g, or t
ttgttnnnnnngggttatcgccggcaaccacaaaatagaccaaaagagtgtgagataacgatgatgacattccaaacaaataatccaaagtcttgtggagtagttatgactgataagcgaggtgtactaactggcttttatgagaaagtagaaaagccaccaacagatatagcaaatgcagctgtttatatatttgaacctagtattttgaagtttttagaaagtatgaaaaaaaaacagatagatttgagtacagaagtgataccagagttcctagagaaaatttatacatttcataatgatatgtatcatagagatatagggactcttgaaagttatgggctgtcacaagtggaggttttgaagtatgagtaa

SEQ ID NO: 16458 - protein, 124 aa, Unknown
  Obtained from environmental sample
  misc_feature (1)..(124): Xaa is any amino acid
MXXXGYRRQPQNRPKECEITMMTFQTNNPKSCGVVMTDKRGVLTGFYEKVEKPPTDIANAAVYIFEPSILKFLESMKKKQIDLSTEVIPEFLEKIYTFHNDMYHRDIGTLESYGLSQVEVLKYE

SEQ ID NO: 16459 - DNA, 597 bp, Unknown
  Obtained from environmental sample
  misc_feature (1)..(597): n is a, c, g, or t
atgagtaaagtaaaaaaacttataagatacatagtcttatctagtttatttccattagcatctttttatatgtggttattaaatttatatagaccaactaaaattgcttttttagttattgatagaatgggacatttagctgtaaatacagagctttttatgagaaggaagcagttagctgaggtagactctagtgtaaaaataatatttattggtggtagagataaaaatattgctaataaatatttatatagtttgtgggaaaaaaaaataggcgtatatagcccaaatttttttacttttttatttttaaattcattgaggctatttagatcaaaatatattcaagacttacctgccaactcaaatgaatacagagaatttaccactacacaaccctctctttctatacctaatctagatgataaaaaaggtagagaaatactaaagcaaatcggtatagatttagacaaagactggtttgtatgtatttttgcacgagatagtacatatttagatatgataaatcctagtaataattgggaatatcacgattatagagacatggatgtgaatacatatataaatgcagtggaa

SEQ ID NO: 16460 - protein, 199 aa, Unknown
  Obtained from environmental sample
  misc_feature (1)..(199): Xaa is any amino acid
MSKVKKLIRYIVLSSLFPLASFYMWLLNLYRPTKIAFLVIDRMGHLAVNTELFMRRKQLAEVDSSVKIIFIGGRDKNIANKYLYSLWEKKIGVYSPNFFTFLFLNSLRLFRSKYIQDLPANSNEYREFTTTQPSLSIPNLDDKKGREILKQIGIDLDKDWFVCIFARDSTYLDMINPSNNWEYHDYRDMDVNTYINAVE

SEQ ID NO: 16461 - DNA, 378 bp, Unknown
  Obtained from environmental sample
  misc_feature (1)..(378): n is a, c, g, or t
gtggtttatagaatgacaaatattttatcacttataggtagaacaaaagagctttttatagaagatataaataaatatgataaaaaattaaaacaaatagtttcaatttcatcttttcttataattggtggagcaggttctattggtcaagctgttacaaaagagatatttaaaagaaatcctaaaaaacttcatgttgttgatataagtgaaaataatatggtagaattagttcgagatatacgaagtagtattggatatattgatggagagtttgctacatttgctcttgatattggttcattggaatatgatgcttttataaaatctgatggaaaatatgattatgttttaaatctttctgcactcaaacattaa

SEQ ID NO: 16462 - protein, 125 aa, Unknown
  Obtained from environmental sample
  misc_feature (1)..(125): Xaa is any amino acid
MVYRMTNILSLIGRTKELFIEDINKYDKKLKQIVSISSFLIIGGAGSIGQAVTKEIFKRNPKKLHVVDISENNMVELVRDIRSSIGYIDGEFATFALDIGSLEYDAFIKSDGKYDYVLNLSALKH

SEQ ID NO: 16463 - DNA, 477 bp, Unknown
  Obtained from environmental sample
  misc_feature (1)..(477): n is a, c, g, or t
atggatatatatctgcaagcaaagacaaagtttactataactggaagtggttcaggggcaacagatatctccactgtattaggtacaccatatttatgtgtaaatggaactccaattgactgggcaccagtaggtcaaaaaacattatttatacctaaaaaattgaaaaagaatggaaaatacttatcgcttaataactattttgacattttatcaaatgatgataaaggtagttatctcatgagccaattttataacaatgaagcaatgagtatagaagataactcagctgaagaaatacttgatgctacgaatgagatgtttctaaggctagaggaagtctataaagagtcagacgaggatagagcaagacaagaaaaataccaagagatacacagcaaatcacctcagtttggagaatcaaaaactcccatctgtagagagtttctaaaatcaaatcagtggtttatagaatga

SEQ ID NO: 16464 - protein, 158 aa, Unknown
  Obtained from environmental sample
  misc_feature (1)..(158): Xaa is any amino acid
MDIYLQAKTKFTITGSGSGATDISTVLGTPYLCVNGTPIDWAPVGQKTLFIPKKLKKNGKYLSLNNYFDILSNDDKGSYLMSQFYNNEAMSIEDNSAEEILDATNEMFLRLEEVYKESDEDRARQEKYQEIHSKSPQFGESKTPICREFLKSNQWFIE

SEQ ID NO: 16465 - DNA, 579 bp, Unknown
  Obtained from environmental sample
  misc_feature (1)..(579): n is a, c, g, or t
atgcataaggtcatgttaattggttggtttcggttaccagaagtggaatctatttcgaaactatttaatatttccagtttgggaacttccgatcttcgaacgatgaaacatataacccctgatgcaattaaaaccctccagtcctcagagattgcggatgacctaattcaaggggctatgcgttgttgtgcaaggataattgatactaatgactctgactgtaaagaagcttcagtatatctatttcaagatgattttgatggtagtgaaggtgtaatcgatttgtttgaatcggaattcccaaaagctaatattgtaaattggattcctaaagcaagtcgaccaagaggaactttaccaaaaccacagcaaaagcaagaggtagttattgagtatttgttaaaaactttagaatccaatagcacatatttgaggcctgatttgtgtaatgaatgttcaatatctccacccacaatgactcgttggttgaaatctggttactttaaagatcgcttgaatgaattaggtatttatcttgagaaatttgatggtaagtcggaagtattcaaattcaaataa

SEQ ID NO: 16466 - protein, 192 aa, Unknown
  Obtained from environmental sample
  misc_feature (1)..(192): Xaa is any amino acid
MHKVMLIGWFRLPEVESISKLFNISSLGTSDLRTMKHITPDAIKTLQSSEIADDLIQGAMRCCARIIDTNDSDCKEASVYLFQDDFDGSEGVIDLFESEFPKANIVNWIPKASRPRGTLPKPQQKQEVVIEYLLKTLESNSTYLRPDLCNECSISPPTMTRWLKSGYFKDRLNELGIYLEKFDGKSEVFKFK

SEQ ID NO: 16467 - DNA, 426 bp, Unknown
  Obtained from environmental sample
  misc_feature (1)..(426): n is a, c, g, or t
atggaaagaagattatttctaaaaggtgcaacaatacttgcaagttcggctgtaatagctccaaatatactatttgctaattctgatatttatagatttggtatcacaaaagatacaagagttttttctattgaaaattcatttgaattagagataaataatcaagtagcacaactttgggttcctctacctcttgatagtgagtatcaaaaggttttagatatctcttatgagggagattttgatgaagctcatatttcaaataacaatccatataatacaaaattattgtatgcaaaatggaataaaaatagtaaatcaagaaaattaaaagtacattttaaagtaagtatgagtgaaagaagtgttaacctaaatttagcaactaatagtacaacttttccaactaaagtgaaagagttttaa

SEQ ID NO: 16468 - protein, 141 aa, Unknown
  Obtained from environmental sample
  SIGNAL (1)...(20)
  misc_feature (1)..(141): Xaa is any amino acid
MERRLFLKGATILASSAVIAPNILFANSDIYRFGITKDTRVFSIENSFELEINNQVAQLWVPLPLDSEYQKVLDISYEGDFDEAHISNNNPYNTKLLYAKWNKNSKSRKLKVHFKVSMSERSVNLNLATNSTTFPTKVKEF

SEQ ID NO: 16469 - DNA, 615 bp, Unknown
  Obtained from environmental sample
  misc_feature (1)..(615): n is a, c, g, or t
gtgagtgattttttagatagtcataaaatcaactatcatccaaaagagatagcagatatgtttgctggaaaactagaagcacccatatatgttgagatatctccaacaggtatttgtaatcataaatgtcttttttgtcattataactatttagggcatgaagggaaatttcaaaaaggtaaaataccagaacttataaaagagtttgctcaaatgggtgttaagtcattggtatttgcgggtaatggagaaccaacacttcatgtggatactattgaagcaatccagttatctaaagagttaggtttggatgtagcactaagtacaaatggtgcattacttaaagaagaacattttgagattcttgcaaaaaaccttacatggatacgattttcttttaatgcaggaagtagtgaaaattatgcttatgttcatcaaacaaaaagtgatgattttaataaagtagttgaaaatattaaaagattaaaagctactaaagagagattaaaaagtaatattacgattggaacacagtttgttttaatacaagaaaataaagattttgcattagagcatgggaagatgttgaagtctctaggggttgattatttttag

SEQ ID NO: 16470 - protein, 204 aa, Unknown
  Obtained from environmental sample
  DOMAIN (33)...(189): Radical SAM superfamily
  misc_feature (1)..(204): Xaa is any amino acid
MSDFLDSHKINYHPKEIADMFAGKLEAPIYVEISPTGICNHKCLFCHYNYLGHEGKFQKGKIPELIKEFAQMGVKSLVFAGNGEPTLHVDTIEAIQLSKELGLDVALSTNGALLKEEHFEILAKNLTWIRFSFNAGSSENYAYVHQTKSDDFNKVVENIKRLKATKERLKSNITIGTQFVLIQENKDFALEHGKMLKSLGVDYF

SEQ ID NO: 16471 - DNA, 606 bp, Unknown
  Obtained from environmental sample
  misc_feature (1)..(606): n is a, c, g, or t
atggcaatagctgtgattcnaaatttatttatagatatttctcatgaaaaatatatagaactaaaaacttttgctattacttcattagataacttcaatctaccatcttcagtttttgatgattttgaattagattgtagaaattacaatataagttcacaagattggtgtggtgaatttatgaaatggcttagaaaaaaaattccatcttcttctcttgtagcgagtaaatctaaatttaaggagtctcttgatgagtacaaaccacctcgtgaagtcatagagataacaaaatattttatttcaaaattaaaagcaattgatcctcagtttatagagccatttaatgttttagaatgggcaaaacatgtaaataatcttcttactattaatggttatacaatgcaagatatagaacaaagtattaactggttatttagtgaaaaaggaaactggtatagaccaaatgttaaaaatacggaagatttaaataaaaagttttcatatatcatttcacatgttagaagctatcgtgatggagagagtaaactcccagctaatatagatctatttgaactaattagaaacaggaataaagagtcctaa

SEQ ID NO: 16472 - protein, 201 aa, Unknown
  Obtained from environmental sample
  misc_feature (1)..(201): Xaa is any amino acid
MAIAVIXNLFIDISHEKYIELKTFAITSLDNFNLPSSVFDDFELDCRNYNISSQDWCGEFMKWLRKKIPSSSLVASKSKFKESLDEYKPPREVIEITKYFISKLKAIDPQFIEPFNVLEWAKHVNNLLTINGYTMQDIEQSINWLFSEKGNWYRPNVKNTEDLNKKFSYIISHVRSYRDGESKLPANIDLFELIRNRNKES

SEQ ID NO: 16473 - DNA, 618 bp, Unknown
  Obtained from environmental sample
  misc_feature (1)..(618): n is a, c, g, or t
gtgcaacacacaaatatcagtacaaataaaaacagctttaatgaaccatctttagatgataaaataagagaaaaatttgtagattcacttatgaactattttaaaatagcagaagatgaatttttacgggcacacataaatgatcttataaaaaaaatcaaattagatgattatgaagaattttttagacgtctatctgatggaacgcatgaatttaaaaacgcatttgagagaatatctttagtagctacatctatgctaaaaaaagaggaacaaaaactatttacagatgtagatagaagagttaaaaaactatatgatgtttgctatgagctctatatgaaattttcaaatcatgatgatgctcagggtaaatttacaaacatctcatttatgagtatgaaactaggtgaatatggagaaaaaatttttgatcatcttgatgagatagtaattagaaaaataacaaaagagtggctatataaaaatgtaaattttgataaatcattatttattactcgtgcagagactgaatataaaaacactattttagaattaaatcaagaaaaagagcaatccaaaatatctaataatacaaatgccgtcttaaagagctaa

SEQ ID NO: 16474 - protein, 205 aa, Unknown
  Obtained from environmental sample
  misc_feature (1)..(205): Xaa is any amino acid
MQHTNISTNKNSFNEPSLDDKIREKFVDSLMNYFKIAEDEFLRAHINDLIKKIKLDDYEEFFRRLSDGTHEFKNAFERISLVATSMLKKEEQKLFTDVDRRVKKLYDVCYELYMKFSNHDDAQGKFTNISFMSMKLGEYGEKIFDHLDEIVIRKITKEWLYKNVNFDKSLFITRAETEYKNTILELNQEKEQSKISNNTNAVLKS

SEQ ID NO: 16475 - DNA, 789 bp, Unknown
  Obtained from environmental sample
  misc_feature (1)..(789): n is a, c, g, or t
ttgaaaaaggagaaacaccctttaaaagaaaaacctacagtagcaccaaaagaagcagtaaaaaaagagattaaaactgaaccaaaactagagattaaagtacctaaaacttgtatggaagatataaaagaatatgcaaaaaatgaagagagtatattgctaataaatacatataaaggtataacaattcataatcaaggggagcttttaaactgtgaagaaaatagttttgaagtaaaggcctcaactgcacaaattgtagctgcaaaatatgaaaaacatgtaatattaaaagttgaaatgaaaaataaatatatatttgcaaatattattaatattgatttaaaaaataataaattaagattggtaaaaccttactatataagttatcaacaaagagataaaagtgtattaagattaacagctgatagtagttttaaagcaacaatgttttttaacaatacacatattgattttaaagctaaacaactttcatctcagtatgtattattaactacagataccttagatcttgatataaagccaaatatgcaacttgatttaacatttggatttgatatatcttcaccaagtgttttaattaaagagaaaaagtttacaaaaacatttgcaaaaggtacagttatcagagtagataaaacaagtagtggtatacaaatagcaatggcaatcgaggtacaaaaatcaggtcaaagtaatttctcaaaatatttaaaacaaagagaaaatgaaaccatagaagagttaaaacaaataatgaaaagataa

SEQ ID NO: 16476 - protein, 262 aa, Unknown
  Obtained from environmental sample
  misc_feature (1)..(262): Xaa is any amino acid
MKKEKHPLKEKPTVAPKEAVKKEIKTEPKLEIKVPKTCMEDIKEYAKNEESILLINTYKGITIHNQGELLNCEENSFEVKASTAQIVAAKYEKHVILKVEMKNKYIFANIINIDLKNNKLRLVKPYYISYQQRDKSVLRLTADSSFKATMFFNNTHIDFKAKQLSSQYVLLTTDTLDLDIKPNMQLDLTFGFDISSPSVLIKEKKFTKTFAKGTVIRVDKTSSGIQIAMAIEVQKSGQSNFSKYLKQRENETIEELKQIMKR

SEQ ID NO: 16477 - DNA, 801 bp, Unknown
  Obtained from environmental sample
  misc_feature (1)..(801): n is a, c, g, or t
atgaacccaacaaaaaaagtagctttatacaccctcggttgtaaactgaatttttcagaaacttcttctattgccagaatgtttcaggaagaaggttttgcacgagttgactttaacgatactcccgatgtttttgtaataaatacttgttcggttaccgaaaatgccgacaaaaaatgcaaacaattagtaaagaaagctaaaaaaataaatcctgatgcatttgttgctataattggctgttatgctcaattaaaacctgaagaaattgctcaaattcatggtgtaaacatggtgcttggtgctgctgaaaaattcaaaatagttgattactttaatcagcaagaaaaaaatgaaattgctcaggtttatgcttcaaaaattaaagaagcaaaagactttattccttcctactctcatggcgacagaacacgttctttccttaaaatacaagatggttgtgattacttttgtactttttgtaccattcctttagcaagaggaaaaagtagaaatcaatccatagccgaaacggtaaaagttgctgaagaaattgctaaaaccaatattaaagaagtcgttttaactggtgtgaacattggagattttggtcaagacgaaggaaaagaagattttttccaattagtacaagcattagataaagttgatggcattaatagatacagaatctcatctatagagcctaatttacttagcaatgacattattgattttgtgagcgaatctgataaatttatgcctcattttcatattccattacaatcgggctctaataaataa

SEQ ID NO: 16478 - protein, 266 aa, Unknown
  Obtained from environmental sample
  DOMAIN (6)...(101): Uncharacterized protein family UPF0004
  misc_feature (1)..(266): Xaa is any amino acid
MNPTKKVALYTLGCKLNFSETSSIARMFQEEGFARVDFNDTPDVFVINTCSVTENADKKCKQLVKKAKKINPDAFVAIIGCYAQLKPEEIAQIHGVNMVLGAAEKFKIVDYFNQQEKNEIAQVYASKIKEAKDFIPSYSHGDRTRSFLKIQDGCDYFCTFCTIPLARGKSRNQSIAETVKVAEEIAKTNIKEVVLTGVNIGDFGQDEGKEDFFQLVQALDKVDGINRYRISSIEPNLLSNDIIDFVSESDKFMPHFHIPLQSGSNK

SEQ ID NO: 16479 - DNA, 396 bp, Unknown
  Obtained from environmental sample
  misc_feature (1)..(396): n is a, c, g, or t
atgtgggtaaaaaaaacagaacaagagttagctaaagaaagaaaaggttttaaaccttctttaattgcaccaataactgtttttattagtgttttattagtaatgataatatcaaaaattactggggagtcaaagtcatattatggcagtaaacctgctagttttatagaattcatttcatttttaccaataatattattgatagcaataggcttgtctttacttgtctatttattgcaattaatattacgtataaattttcttaaagagaaagaaaaagttgttatttgtgataaatgcaataataagaaagtaaatgatggaaactttaattgtgattgtggaggtagttttattattattactgatatgaaatggattgaagatgaaaactga

SEQ ID NO: 16480 - protein, 131 aa, Unknown
  Obtained from environmental sample
  misc_feature (1)..(131): Xaa is any amino acid
MWVKKTEQELAKERKGFKPSLIAPITVFISVLLVMIISKITGESKSYYGSKPASFIEFISFLPIILLIAIGLSLLVYLLQLILRINFLKEKEKVVICDKCNNKKVNDGNFNCDCGGSFIIITDMKWIEDEN

SEQ ID NO: 16481 - DNA, 576 bp, Unknown
  Obtained from environmental sample
  misc_feature (1)..(576): n is a, c, g, or t
gtgaaagagaatctttcaacttcatctttagatttattgaataaaaaactaccatacttttataaaattcatttagaagagttcccaacaacacgaaagctcgaacagataagaaaagagcttaaacagatgacaaatattaaaagggtggaaactttttcaactgaccataatcagatatattcattacttattttgatacaagatattgtttttattttatttgtggttgttttagcactttcattacttttactttcaaaacagataaaaatctggttctttgaacacaatgagagaatatcaattattcagctacatggtgggtcactgctttatagttcaaaaccaattattaaaactataatactaagcgctatcgtttcaagtgttatagttatatcattgttaattgtagttgtaaataatattagcttatttgtgcaacctgagataatttcaattatgcctaaaattatacatttagagttagagatttttcaaatatttatattgtcattcataatcccatttataacattttttggacttttagttcaatataaatcgaagtaa

SEQ ID NO: 16482 - protein, 191 aa, Unknown
  Obtained from environmental sample
  misc_feature (1)..(191): Xaa is any amino acid
MKENLSTSSLDLLNKKLPYFYKIHLEEFPTTRKLEQIRKELKQMTNIKRVETFSTDHNQIYSLLILIQDIVFILFVVVLALSLLLLSKQIKIWFFEHNERISIIQLHGGSLLYSSKPIIKTIILSAIVSSVIVISLLIVVVNNISLFVQPEIISIMPKIIHLELEIFQIFILSFIIPFITFFGLLVQYKSK

SEQ ID NO: 16483 - DNA, 801 bp, Unknown
  Obtained from environmental sample
  misc_feature (1)..(801): n is a, c, g, or t
gtgaaaagttatattatagaaaaaactactccagtaaaatcaaaatgggaaaaactagcagttgttaaagatagatacaatgtagagtatatagatgatgatttaggagataatgagatctatatatatcgtattattgttgaaacatttgatggtatcatatcaaaccctagtgcaatagtaagtgcaactacaaaaccacttcctttacaaatttcaaaattagaagctacacgagatttaccaaaaaagatacaactttcatggggaccatcaaaaacaccagatgttgtagagtataatatatatagagcttcaagtgcaaatggattttttagtaagatagcaaaagcaaaagcagaccacaatagatttgatgataatattcaagaagatggtgagatatatttttataaaatcacaactgtagataaagatggattagaaagtaatataaaacaagtaacacctgttatgggttcaacattggcaaaaccaaatgtaccacaaattacactatcacaaattcaaggaaataaagtaatattaaattgggtatcaacagatgatagaacagtttcatataatatttataaaacaacaaaaacatcatttgtttcctcaaaagagaaacttattcctaatgtacaaggattgagatttgaagatccagatgttgtaaggggagttgagtataactatactttacaagcagttgatacttatgggttaatctctgataaaacacaagaggtatctataaagttacctaagttagctcaagaagtacaacaaaattaa

SEQ ID NO: 16484 - protein, 266 aa, Unknown
  Obtained from environmental sample
  DOMAIN (69)...(150): Fibronectin type III domain
  misc_feature (1)..(266): Xaa is any amino acid
MKSYIIEKTTPVKSKWEKLAVVKDRYNVEYIDDDLGDNEIYIYRIIVETFDGIISNPSAIVSATTKPLPLQISKLEATRDLPKKIQLSWGPSKTPDVVEYNIYRASSANGFFSKIAKAKADHNRFDDNIQEDGEIYFYKITTVDKDGLESNIKQVTPVMGSTLAKPNVPQITLSQIQGNKVILNWVSTDDRTVSYNIYKTTKTSFVSSKEKLIPNVQGLRFEDPDVVRGVEYNYTLQAVDTYGLISDKTQEVSIKLPKLAQEVQQN

SEQ ID NO: 16485 - DNA, 324 bp, Unknown
  Obtained from environmental sample
  misc_feature (1)..(324): n is a, c, g, or t
ttgcaaaaagggcattttcaaacacgtatttggcagagtgttatcttaaaaaatgctacattaaatgagctaagtctatacatacaaaaaaaacttctaaataatcatctcttagaggtctcttctatgtttaataaaaaaagtacaagactgatacatcaattaacaaatggaaattacagagacactaacaagcttttatacactctatttggcatatacgagtactacgaaagtacaaagcctagtataattaataactcatccatcaaaacaaaatttattgaaatggcagcaatagagtcaggatttataaatgcataa

SEQ ID NO: 16486 - protein, 107 aa, Unknown
  Obtained from environmental sample
  misc_feature (1)..(107): Xaa is any amino acid
MQKGHFQTRIWQSVILKNATLNELSLYIQKKLLNNHLLEVSSMFNKKSTRLIHQLTNGNYRDTNKLLYTLFGIYEYYESTKPSIINNSSIKTKFIEMAAIESGFINA

SEQ ID NO: 16487 - DNA, 516 bp, Unknown
  Obtained from environmental sample
  misc_feature (1)..(516): n is a, c, g, or t
atgagaatatttaattatttaattatgagcatactgctgagtgtgactttaatggcaaataataagatagaagagtctattgtgaaaatatatactgtttctaaaattccagattacaatacaccatggaacagcagtataaaaagatcaagcggttcaggttccataatagatggtaataaaatcttaacaaatgctcatgtagtggcaaatcaaactttcatagaagtaaaacgtgacggcgatacaaaacgatatgaagcaaaaatagagtttatctctcatcaagcagatttagcactgcttagtgtgaaagataaaaagtttttcaaaggtgtaaagagtctcaaatttggtggacttcctgcaatacaacaaaaagtggcagtgtatggttttcctgtgggaggaaatactttgagtgtaagtactggcatagtctcaaggatagaacataaacgatacactcactctaaagagactcgagccgattctgtacatgggnnnnnnnnataa

SEQ ID NO: 16488 - protein, 171 aa, Unknown
  Obtained from environmental sample
  SIGNAL (1)...(19)
  misc_feature (1)..(171): Xaa is any amino acid
MRIFNYLIMSILLSVTLMANNKIEESIVKIYTVSKIPDYNTPWNSSIKRSSGSGSIIDGNKILTNAHVVANQTFIEVKRDGDTKRYEAKIEFISHQADLALLSVKDKKFFKGVKSLKFGGLPAIQQKVAVYGFPVGGNTLSVSTGIVSRIEHKRYTHSKETRADSVHGXXX

SEQ ID NO: 16489 - DNA, 393 bp, Unknown
  Obtained from environmental sample
  misc_feature (1)..(393): n is a, c, g, or t
atggagggagcttcaccancaaagctcatancaagagagattttaaaagagatgaaaaaaggtagtgtattagtagatattactatagatcaaggcggtatctctgaaacgtcaaagcctactactcatacaaatcctgtttttatagaagagggcgtacttcattactgcgtggcaaatatgccaggagggtaccctaaaactgctacaatcgctttaacaaatagcacatttgattatgttaaaaagttggcaaatagtggagttgtagaagcgattaaaaatgacttatctctagcacttggtgtaaatgtttttaatggtattgtcacaaacaaagcggtagctgaactttttggtatggaacatagaaccattggttcattaatatag

SEQ ID NO: 16490 - protein, 130 aa, Unknown
  Obtained from environmental sample
  DOMAIN (2)...(96): Alanine dehydrogenase/PNT, C-terminal domain
  misc_feature (1)..(130): Xaa is any amino acid
MEGASPXKLIXREILKEMKKGSVLVDITIDQGGISETSKPTTHTNPVFIEEGVLHYCVANMPGGYPKTATIALTNSTFDYVKKLANSGVVEAIKNDLSLALGVNVFNGIVTNKAVAELFGMEHRTIGSLI

SEQ ID NO: 16491 - DNA, 624 bp, Unknown
  Obtained from environmental sample
  misc_feature (1)..(624): n is a, c, g, or t
atgactaagattatttcaaattcaatgtatggtgataagttcagcgcaaccattataagcatagactcagatgactttatcgtctcaaatgagtatgcatcattcagagctaaaaaggctntgagctgtttagttgagccaaaactatctgacatagtagttctttataaagtagacgaagaaaacatatttattacagatattttagctcggcatgatagctcttcgctagagattattgctaaagacggtatgagcattaaaactcaaaatgcagacttgaacttatctagtgatacaaacataactatcaatgcaaatgagtctttgaatacttttgcagatgaggctaatgttgtcatctcaaaggtgagttttttaacaaaaatagctacgctcaaatctgaaacactcaatattatcgcttctatgtatcagggtgcaatagagcattttcacatgaaaaatgagagtgtgactaaacatgtaagcggacatgaagaacttcagtgtaattcaagtcgtaagattgttaaagagagtgatatatacaatgttaaagatagcatcttaattgctaacggacaagtaaagatagatgccgatcagataaatatgggttaa

SEQ ID NO: 16492 - protein, 207 aa, Unknown
  Obtained from environmental sample
  misc_feature (1)..(207): Xaa is any amino acid
MTKIISNSMYGDKFSATIISIDSDDFIVSNEYASFRAKKAXSCLVEPKLSDIVVLYKVDEENIFITDILARHDSSSLEIIAKDGMSIKTQNADLNLSSDTNITINANESLNTFADEANVVISKVSFLTKIATLKSETLNIIASMYQGAIEHFHMKNESVTKHVSGHEELQCNSSRKIVKESDIYNVKDSILIANGQVKIDADQINMG

SEQ ID NO: 16493 - DNA, 579 bp, Unknown
  Obtained from environmental sample
  misc_feature (1)..(579): n is a, c, g, or t
ttgatttttctaaaaaagcagtatctatttttaagctctattattgtaattggtcttttgttgattgtgagttattttggtgttttaaaatttgcaaaaaaacagattatttctaatgccaaatatgaatctattaaagtggctgattctataaaaatattaaatgatagagtagagtacacattaaatagcattgtactaaatagtaattttataaattatgtaaagcatctgtataacccagaagatagtaagatcgttaattcactgttcaagacgattgcacgttgcgaaccgacaatcatgcaactaagatacatcgataaagatggagatgaacgtatccgcgtagagcgtaataactatgactcacctctattattaatagataaagcatctttacaaaacaagaggcatcgttactattttcaacaaatttcaaaaaccataaacggagagatttggtcatcaaaactagatctaaatattgagcacaactcggttgaagtgcctcataaaccgactctacgcctcggtattcctgtttatatagagaatgaatttccgagccgattctga

SEQ ID NO: 16494 - protein, 192 aa, Unknown
  Obtained from environmental sample
  misc_feature (1)..(192): Xaa is any amino acid
MIFLKKQYLFLSSIIVIGLLLIVSYFGVLKFAKKQIISNAKYESIKVADSIKILNDRVEYTLNSIVLNSNFINYVKHLYNPEDSKIVNSLFKTIARCEPTIMQLRYIDKDGDERIRVERNNYDSPLLLIDKASLQNKRHRYYFQQISKTINGEIWSSKLDLNIEHNSVEVPHKPTLRLGIPVYIENEFPSRF

SEQ ID NO: 16495 - DNA, 978 bp, Unknown
  Obtained from environmental sample
  misc_feature (1)..(978): n is a, c, g, or t
atggagaaatatgctccaaataaactagaactagcttcaagagatgttgtttcaagagctattacaaaagagattttagaaggtagaggttgtggtgaaaataaagaccatgtacttattgacttaacacatcttggtgaagagattattatgactagacttccagaattaagagatttagctattacattcctaggtcaagatatgattaaagagcctattagtattgcagcaactgcacactactcgatgggtggaattccagtaaataaacatggtcatgtaagaaaaaatacaaaagagtttgtagaaggtttttacgcagctggtgaatgtagttgtgtaagtgtacatggagcaaatagacttggtgcaaactcagtacttgaagctttattttttggaagacatgtgggacaaacaattgttgaggatgtaaaaagaggtatcgtttttaaagatgcaaaagttacagatgcaacacctgcattagaaagaattgaatctattagaacatcaagtggaaatgaaaaagtaccagccttacgagaagagttacaacaaggtatgacagataatgctggtgtatttagaacagaaaaatcacttttagtacaacaagaaaatattaaaaaacttaaagaacgatttaaaaatgtacgaatagatgacaagtctaaaatctacaatactgatcttcaagaggctattgaatttagtcatatgttagattatagttcatttatagttgatggagcaatccatagaaaagagagtagaggtgctcactatagaagagagtatncaaccagagatgatgagaatttcttaaaacatactatggcttatatggataaagatgggaatataaaaacagaatatatgggatgtagttatggggttactttggagccacaagaaccgaacttactagggagattaatgatgagtcccaaacatgngaacaaaaaaaattaa

SEQ ID NO: 16496 - protein, 325 aa, Unknown
  Obtained from environmental sample
  DOMAIN (1)...(160): FAD binding domain
  misc_feature (1)..(325): Xaa is any amino acid
MEKYAPNKLELASRDVVSRAITKEILEGRGCGENKDHVLIDLTHLGEEIIMTRLPELRDLAITFLGQDMIKEPISIAATAHYSMGGIPVNKHGHVRKNTKEFVEGFYAAGECSCVSVHGANRLGANSVLEALFFGRHVGQTIVEDVKRGIVFKDAKVTDATPALERIESIRTSSGNEKVPALREELQQGMTDNAGVFRTEKSLLVQQENIKKLKERFKNVRIDDKSKIYNTDLQEAIEFSHMLDYSSFIVDGAIHRKESRGAHYRREYXTRDDENFLKHTMAYMDKDGNIKTEYMGCSYGVTLEPQEPNLLGRLMMSPKHXNKKN

SEQ ID NO: 16497 - DNA, 561 bp, Unknown
  Obtained from environmental sample
  misc_feature (1)..(561): n is a, c, g, or t
ttggatagtgttaaggtatcaattgctgggactgatggaagttcaagttcctacactactgatagtttaggttttattgctattaaacttaaaccagaattggcatattcaataattgtgacaaaaagtaactacttaaatggaaaaagtaaattatatactagaaaaaatcaaaaaatatatagtttacaattttatttagaaaaaataaagacattgggatgttttccatttccaaaatttgattattcggaaaataattatgagagaattcataaaaattctgaagacgattgtttgtcagaaacttatggcgtaatggtagaaaacccaactattgtaatagaattaattgcatataggtctgaaaatgaacccaaaaagatttccaaaaaaagagttgaaaaaataataaacgaattagttgcccaaggaatagaaaaagacaggttggtttttaaagatggtggtattggagaaaatgaaaaagaagaagataacaggtatgttgtttttagaattatcaaaaccgactatgtttctaaaaaaacaaagaaatga

SEQ ID NO: 16498 - protein, 186 aa, Unknown
  Obtained from environmental sample
  misc_feature (1)..(186): Xaa is any amino acid
MDSVKVSIAGTDGSSSSYTTDSLGFIAIKLKPELAYSIIVTKSNYLNGKSKLYTRKNQKIYSLQFYLEKIKTLGCFPFPKFDYSENNYERIHKNSEDDCLSETYGVMVENPTIVIELIAYRSENEPKKISKKRVEKIINELVAQGIEKDRLVFKDGGIGENEKEEDNRYVVFRIIKTDYVSKKTKK

SEQ ID NO: 16499 - DNA, 444 bp, Unknown
  Obtained from environmental sample
  misc_feature (1)..(444): n is a, c, g, or t
atgattgaaaaaacaataataatagtcgatgaccaagaactatttgcaaatggaataaaacaacttttggaacaagatggagatatttttgttgaaaaaatagtaaatataggtataaacgcattgcattctatcgaaaaccacaaacccgatgcaatattacttgatctgaatatgcctgataaaaatgggtttgaaatcttagatgaaattagagataaatttccaaaattaccaatatgtatactctcaacttacgacagcaacgcatttatagaaaaggcgaaaaaactaagagcaaatgcatatttttcaaaagatgcaagtattgacgaacttagacaatttatttttcaaaactatactgataaatttttgttgagtgaaagaatacaaaaaagagaacaacaaactaaaacagtttttgataatttgtacaagtaa

SEQ ID NO: 16500 - protein, 147 aa, Unknown
  Obtained from environmental sample
  DOMAIN (4)...(125): Response regulator receiver domain
  misc_feature (1)..(147): Xaa is any amino acid
MIEKTIIIVDDQELFANGIKQLLEQDGDIFVEKIVNIGINALHSIENHKPDAILLDLNMPDKNGFEILDEIRDKFPKLPICILSTYDSNAFIEKAKKLRANAYFSKDASIDELRQFIFQNYTDKFLLSERIQKREQQTKTVFDNLYK

SEQ ID NO: 16501 - DNA, 738 bp, Unknown
  Obtained from environmental sample
  misc_feature (1)..(738): n is a, c, g, or t
ttgggttgggagccacgggccaggcaggaaaaatttatgattgagattttcgaaatgaaaaaatctcccggaaataaatttgtggattttataaatattcatgataatgaaaacccattattagaggaaaaaatccctcgtcttggcaagtttgcagatttacctgaaattattattagtaataaaattgaagaggttattattgcaatcgaatcaggagaacacgatgaaattagaaaaatattaagtaagcttttgttgacaaatgtgagagttaaaattttgccgagtttatatgatattatttctggttatgtaagattggttacgctttataaaacacctttgatagagattcataatcgaaatatgactgtaagtcaggagaatataaagcgaataattgatgttgttttatcttcggttgcggttattatacttttgccagtttatattggtgtgagtattgctgtgaaaatgtcttcgaaaggacctgttttttataaacaagaacgagtagggaaaaatggaaaaccattcaaaattattaaatttcgttcgatgtttacagatgccgaaaaagctggaccggcactttcttcggacaatgatagcagaataactccatttggaaaaataatgcgaaaaacgcgtcttgatgaaatacctcaatttataaatgtaatatttggagaaatgtcgcttgttggaccacgtcccgaacgacagtttttatga

SEQ ID NO: 16502 - protein, 245 aa, Unknown
  Obtained from environmental sample
  DOMAIN (132)...(245): Bacterial sugar transferase
  misc_feature (1)..(245): Xaa is any amino acid
MGWEPRARQEKFMIEIFEMKKSPGNKFVDFINIHDNENPLLEEKIPRLGKFADLPEIIISNKIEEVIIAIESGEHDEIRKILSKLLLTNVRVKILPSLYDIISGYVRLVTLYKTPLIEIHNRNMTVSQENIKRIIDVVLSSVAVIILLPVYIGVSIAVKMSSKGPVFYKQERVGKNGKPFKIIKFRSMFTDAEKAGPALSSDNDSRITPFGKIMRKTRLDEIPQFINVIFGEMSLVGPRPERQFL

SEQ ID NO: 16503 - DNA, 375 bp, Unknown
  Obtained from environmental sample
  misc_feature (1)..(375): n is a, c, g, or t
atgggattgaaaaaccagatatacgcagttgaaaaagataaagatgaagtaggtacaatagtatgtagttttactactacagatgaggtgctaactataacgatttcagatgatggagaagggattaatatagaaaaattaaaggaaaagttacgaaataataatatagatgtagaaaaattatctgaagatgaaatataccagtttatttttaatgatagttttacaacaaaagaaacaatatcagaaatttctggacgaggggtaggaatgagtgcagtgaaaaatgaagttgataagttaaatggtgtgataaatataaattcacaaaaagatattggaaccactttggaaatcgtggtaccactttcataa

SEQ ID NO: 16504 - protein, 124 aa, Unknown
  Obtained from environmental sample
  DOMAIN (2)...(124): Histidine kinase-, DNA gyrase B-, and HSP90-like ATPase
  misc_feature (1)..(124): Xaa is any amino acid
MGLKNQIYAVEKDKDEVGTIVCSFTTTDEVLTITISDDGEGINIEKLKEKLRNNNIDVEKLSEDEIYQFIFNDSFTTKETISEISGRGVGMSAVKNEVDKLNGVININSQKDIGTTLEIVVPLS

SEQ ID NO: 16505 - DNA, 861 bp, Unknown
  Obtained from environmental sample
  misc_feature (1)..(861): n is a, c, g, or t
gtgtcaaagagtaatgttgacggaaatattacgtatattaatgataacttttgcaaggtcagtggatacagtcgtgaagaagtgattgggggaaatcataatattttaagagataaatctacctctgaaaaaatgtatagaaaattatggtcaacaatcactgctaaaaacacatggcacggcagaataaaaaacgtaaaaaaagatggctcactgtactgggtagatgcaacaattacgccaataattaatgctaaagatgagataattgaatatatttctattagacatgatataacgcaactaattaatcaaaaaaatgaactccatattcttgcaaatacagacactctaacaagcctcagcaatagaaatgcattaaaagaagagatagataataataataatctctcattaataattgtaaatatagatagtttttctcagataaatgacttttacggacatgaacttggagatgcagtcttagtagaatttgctaaagaattacagataagttgtactagaagtgaagaattgaggctttttagagttagtggagatgaatttgctatattagcagtagatgttcctgctcatatagttgtacaaaaagctcaagaaattgcaaagtttataaactcacatgtttatgatgtaaaagctgaaagtatagaattaagtgcaacgttaagtgtttctttggaagaaaaagaacaattattaattacagcagatatggctctcaaaattgcaagaaaagaagcaaaagatattatagtttatgattcaacaatgaacttggataaagagtatcaaaaacatatgctttggactaaaaaaatcaaagatgcaatttga

SEQ ID NO: 16506 - protein, 286 aa, Unknown
  Obtained from environmental sample
  DOMAIN (60)...(102): PAC motif
  misc_feature (1)..(286): Xaa is any amino acid
MSKSNVDGNITYINDNFCKVSGYSREEVIGGNHNILRDKSTSEKMYRKLWSTITAKNTWHGRIKNVKKDGSLYWVDATITPIINAKDEIIEYISIRHDITQLINQKNELHILANTDTLTSLSNRNALKEEIDNNNNLSLIIVNIDSFSQINDFYGHELGDAVLVEFAKELQISCTRSEELRLFRVSGDEFAILAVDVPAHIVVQKAQEIAKFINSHVYDVKAESIELSATLSVSLEEKEQLLITADMALKIARKEAKDIIVYDSTMNLDKEYQKHMLWTKKIKDAI

SEQ ID NO: 16507 - DNA, 408 bp, Unknown
  Obtained from environmental sample
  misc_feature (1)..(408): n is a, c, g, or t
ttgcaaagaaaagagtactatttagaagatatcatcgataatgccgcagatattttgatgtgtgatgaagaagaggtgataaaagagagtgtaaacattaaactaaatgttgattttgatatcttctgcattgcagttaaaaaccttttagataacggcataaaatactcaaaagataaaatagtaacactaaagtcagatggagagagagttatttttgaaaatgtgggagataaattagagtatccacttgagagttactttgaaccgtttttcagaggcgatgatgttaaatcgaaccaaagtttcggactgggactctacatcgtaaaacatatactagatgcacatgatatggaattacaatatgagtatgaaaacggcataaatagctttataatagtgtag

SEQ ID NO: 16508 - protein, 135 aa, Unknown
  Obtained from environmental sample
  DOMAIN (37)...(135): Histidine kinase-, DNA gyrase B-, and HSP90-like ATPase
  misc_feature (1)..(135): Xaa is any amino acid
MQRKEYYLEDIIDNAADILMCDEEEVIKESVNIKLNVDFDIFCIAVKNLLDNGIKYSKDKIVTLKSDGERVIFENVGDKLEYPLESYFEPFFRGDDVKSNQSFGLGLYIVKHILDAHDMELQYEYENGINSFIIV

SEQ ID NO: 16509 - DNA, 933 bp, Unknown
  Obtained from environmental sample
  misc_feature (1)..(933): n is a, c, g, or t
atgggtcaagatcggctcgagaagagtattagaaatccaataaataattatagagagtataaaaaagaagatttaattatttttgaaaatgcaaaaattcattttgatacaaactatcatgcaaatatagctccaactaaaccatataaaagtattgaattatttgctggtgctggtggtcttgctttaggacttgaaaaagcaggaataaaacatactttattaaatgaaattgataaatacgcagttcaaactcttcaacaaaatagaccaaattggaaaattgaagagggtgatatcgccaaaattaactttaaaccttacagagataaaatagacttattaacaggtggctttccatgtcaagccttcagttatgcaggaaaacgattaggttttgaagacacaagaggaactctattttttgaatttgtaagagcactacaagagacaaatgcgcctgtgtttttaatcgaaaatgtaaaaggtttattgagtcatgataatggtaaaactttacaaacaatgatagatgttcttactaaagatatggattaccacatctttacaccaaaagttttaaaagctattcaccatagagttccacaaaaaagagagagactaataatagtaggtataaaaagtgattacaaagataaagtaacttataactatcctgaacctcatgaaaaaatatatactttaaaagatgcattaaaaaaaggtgaattatatgatactgatgtcctttcttccccaggacaaatctatcctaaacgaaaaaaagaaattttagaaatggtaccacctggaggatattggagaaatttaccacttgaaattcaaaaagagtacatggcaaaaaagcttttatcttggaagggggtaaaactggaatggccagaaaaatttcttgggatgaacctagtttaa

SEQ ID NO: 16510 - protein, 310 aa, Unknown
  Obtained from environmental sample
  DOMAIN (49)...(292): C-5 cytosine-specific DNA methylase
  misc_feature (1)..(310): Xaa is any amino acid
MGQDRLEKSIRNPINNYREYKKEDLIIFENAKIHFDTNYHANIAPTKPYKSIELFAGAGGLALGLEKAGIKHTLLNEIDKYAVQTLQQNRPNWKIEEGDIAKINFKPYRDKIDLLTGGFPCQAFSYAGKRLGFEDTRGTLFFEFVRALQETNAPVFLIENVKGLLSHDNGKTLQTMIDVLTKDMDYHIFTPKVLKAIHHRVPQKRERLIIVGIKSDYKDKVTYNYPEPHEKIYTLKDALKKGELYDTDVLSSPGQIYPKRKKEILEMVPPGGYWRNLPLEIQKEYMAKKLLSWKGVKLEWPEKFLGMNLV

SEQ ID NO: 16511 - DNA, 642 bp, Unknown
  Obtained from environmental sample
  misc_feature (1)..(642): n is a, c, g, or t
gtgaaaacaatgagtagaagctatttgtttattccaggaaacactccatcaatgattcaaaatcttgatgtttttgaaagtgattctgtaatcattgattttgaagattcagttattagttatgataaagatgcagctcgaatattgataaacaactttttaaaaaaattcagttttaaagactttgatatttatattagaattaatgattcattaaatccaaactttttaaaagatgtagaagctacaactgatttaaatataaatggatatgttcttcctaaagccagtgttgatgcaataataaaactgaatagtttaattggaaataaaaaaataattccaataattgaatctcctttagctttattaaatgctaaagaaattgcacaatctaaaaatgtatctggtctattactaggcgcagaagattatacaaaagagttaggaaatcacagaactttaaaaggtactgagatactatacgctagaagttatattgcaattatttgtaatgcctatggaattgaatctatagatactccatatacttctaaagatgatgaaattgngttaagagaggattcaataatgctaaaaattaggatcacagctaaatcattaatccatccaatccagtag

SEQ ID NO: 16512 - protein, 213 aa, Unknown
  Obtained from environmental sample
  misc_feature (1)..(213): Xaa is any amino acid
MKTMSRSYLFIPGNTPSMIQNLDVFESDSVIIDFEDSVISYDKDAARILINNFLKKFSFKDFDIYIRINDSLNPNFLKDVEATTDLNINGYVLPKASVDAIIKLNSLIGNKKIIPIIESPLALLNAKEIAQSKNVSGLLLGAEDYTKELGNHRTLKGTEILYARSYIAIICNAYGIESIDTPYTSKDDEIXLREDSIMLKIRITAKSLIHPIQ

SEQ ID NO: 16513 - DNA, 594 bp, Unknown
  Obtained from environmental sample
  misc_feature (1)..(594): n is a, c, g, or t
gtggagatgttagaaatgggcttagtagaaaaattatatgatgttcagtgctttgatttagaagcagttgaatcaattaatataaataaaaatcatatcccaataagtgcttcaacttatgctaatcctaataatccagatcaagtgattaaggatttagatatagtaattttaggagcaactgagattgattacaactttaatgtgaacgttacaacagattcacatcagacattaattggtggtagtggtggtcatagtgatacagccacagaagctaaagtttcagttattgtgtctcctttaatcaaaggtaggattccagtaattaaagaaagagttactacaattactactttaggtaaaaacatcgactgttttgtaactgaaagaggaatcgcaattaatcctaaaagaacggacttattgaagatattaaaagattctaaacttaagatatattcaatagaagaattggcgaacattgcacacaaatatacaaaagttcctaaaagtatagtaaaacatgataaaataataggtgaagtagtagatagaacatttgaagtaattgacaagatatatcaaaaataa

SEQ ID NO: 16514 - protein, 197 aa, Unknown
  Obtained from environmental sample
  DOMAIN (1)...(197): Citrate lyase, alpha subunit (CitF)
  misc_feature (1)..(197): Xaa is any amino acid
MEMLEMGLVEKLYDVQCFDLEAVESININKNHIPISASTYANPNNPDQVIKDLDIVILGATEIDYNFNVNVTTDSHQTLIGGSGGHSDTATEAKVSVIVSPLIKGRIPVIKERVTTITTLGKNIDCFVTERGIAINPKRTDLLKILKDSKLKIYSIEELANIAHKYTKVPKSIVKHDKIIGEVVDRTFEVIDKIYQK

SEQ ID NO: 16515 - DNA, 675 bp, Unknown
  Obtained from environmental sample
  misc_feature (1)..(675): n is a, c, g, or t
ttgacatacataaaagggacaaatgagatgaataagtttgatatagatgatatgcctgcaagtgaattaaaaactagacttcttttagataataagaaaatcgctgatgggataaatagaattagcaatattgtagaatcaatgagagagatgtctcaagtaacttcatcagtcaaagagaaatcaaacctatattcaacgcttataacaatacttagactaattaacaatcgttcaaaacatatatctagaatatatataaatgatgaactgtttgatgtacaattagcagataaggaaaaatataaatttttcacttatcttaataggcaaaaaattgaacaggtttggacaattatcattaataatgctttagatgaacttataaaaattgatgattatgaaaaaagaaaattatctattaatattagttcagataacaatacaattaaaataacatttcaagataatgcaggtggtataaatgaagatattattgaagatatttttgaaccatttataagtactaaactctcacatggtattggaattggtcttaatgtagctaaaaagatactagatgagcatgaagctacaatagaagtttctaacaaagacaagggagcattatttttaataaaatttacaattcaagataataatcaatcaaaataa

SEQ ID NO: 16516 - protein, 224 aa, Unknown
  Obtained from environmental sample
  DOMAIN (108)...(218): Histidine kinase-, DNA gyrase B-, and HSP90-like ATPase
  misc_feature (1)..(224): Xaa is any amino acid
MTYIKGTNEMNKFDIDDMPASELKTRLLLDNKKIADGINRISNIVESMREMSQVTSSVKEKSNLYSTLITILRLINNRSKHISRIYINDELFDVQLADKEKYKFFTYLNRQKIEQVWTIIINNALDELIKIDDYEKRKLSINISSDNNTIKITFQDNAGGINEDIIEDIFEPFISTKLSHGIGIGLNVAKKILDEHEATIEVSNKDKGALFLIKFTIQDNNQSK

SEQ ID NO: 16517 - DNA, 480 bp, Unknown
  Obtained from environmental sample
  misc_feature (1)..(480): n is a, c, g, or t
atgtttaaaacaataaattttaaaaaatacacctctattcatattggtggagagcataatgtaaaagttataaatgaggtaggtgaatattcacaattccgaattttaggtcgtggaaataatattcttatctcaactactccacccccaatggcactcttaggcgaaaagtttgattatatgaaacaagtggatgataaacttatagttggtgcagctacatctagtggtaaacttcttacatattgtagaaaaaatgatatagcacattttgagcttcttgcaaaactccctggaaatatgggtggtttagtgaagatgaatgcagggcttaaagagtgggagatatttaactatctttattctataaaaactcaagatggggagatattaaaaaagatattcctcatagttatcgtcatacacaaaattgatggaatcatctatgagattacttttatagtagaaaaaagggtatga

SEQ ID NO: 16518 - protein, 159 aa, Unknown
  Obtained from environmental sample
  misc_feature (1)..(159): Xaa is any amino acid
MFKTINFKKYTSIHIGGEHNVKVINEVGEYSQFRILGRGNNILISTTPPPMALLGEKFDYMKQVDDKLIVGAATSSGKLLTYCRKNDIAHFELLAKLPGNMGGLVKMNAGLKEWEIFNYLYSIKTQDGEILKKIFLIVIVIHKIDGIIYEITFIVEKRV

SEQ ID NO: 16519 - DNA, 315 bp, Unknown
  Obtained from environmental sample
  misc_feature (1)..(315): n is a, c, g, or t
ttgagaataacttcaatgtttgacaatttgttcaaaaaagaaaaaggaaatctaactataaagagttctgttgcaatccatagtgcaataatagctgaaccagtaactgctgatttagataatgatggagaacaagaactcataataggaaatcaagacggagatttactagttatagatcaaaactttaaactaaagtggaaattcaaagtaaaagaagacttaactgaaacagaaaaactatttttagatgaagcgtctggcttcggcattcatagtgcgcctcttgtggcagatattgaccaccgccggtaa

SEQ ID NO: 16520 - protein, 104 aa, Unknown
  Obtained from environmental sample
  misc_feature (1)..(104): Xaa is any amino acid
MRITSMFDNLFKKEKGNLTIKSSVAIHSAIIAEPVTADLDNDGEQELIIGNQDGDLLVIDQNFKLKWKFKVKEDLTETEKLFLDEASGFGIHSAPLVADIDHRR

SEQ ID NO: 16521 - DNA, 420 bp, Unknown
  Obtained from environmental sample
  misc_feature (1)..(420): n is a, c, g, or t
atgatacaaaaagaagttgcggacaaatttacagcacagtgtggagataaagaatactctagcctgagcgtaataacacagttaatctcaaaacaggcacgaacactaattgttgttccgcctattagttntgatccacctccaaaggtggattcaagtgttatctatattcaaaaagatatggataaagaacttgattttgactttaacaaatttttaaaagtgtgtttttcccaaccaagaaaaaaattgagtaaaaacttatcaactgcttataacaaagcgatgattaactctatttttgatgaacttaatataaaagagtctgcaagacctcatgaagttgatgcatctttgtatagccatatttatacaaaggtaaaacaaaatggaagaaacgaaagttacacaaacaactga

SEQ ID NO: 16522 - protein, 139 aa, Unknown
  Obtained from environmental sample
  misc_feature (1)..(139): Xaa is any amino acid
MIQKEVADKFTAQCGDKEYSSLSVITQLISKQARTLIVVPPISXDPPPKVDSSVIYIQKDMDKELDFDFNKFLKVCFSQPRKKLSKNLSTAYNKAMINSIFDELNIKESARPHEVDASLYSHIYTKVKQNGRNESYTNN

SEQ ID NO: 16523 - DNA, 948 bp, Unknown
  Obtained from environmental sample
  misc_feature (1)..(948): n is a, c, g, or t
atgatggctgagcgaggctcatttactttttattttttccatcatctcatttacttgtttactctttcacctgtttatttattcactcatacacacatcatcatgatcatatataagtttggtggggtatcagtaaaagatgcagctgccataaaaaatatcagcaatattattggagaggcaaaaggacctttagtcgttgtgatttctgcaattggtcaaacgaccaacttgatagaaggaattatcgatgcacattattcagggaaagctaatgttaatgccttgtttgaagagctgaaagaaaaacacctgaccctgacgcttgatttgttcgatgagtttcctcaagatttgttagataagcttcagtctttttttacagagatagaaactcgattgtctaaaccttttagtgagtcttttaattttgagtacgatcaattgattgcatttggagagcttttatcaacaacaatcgtttcggcatatttaaaccatatcggtcaaaagaacaagtgggttgatattagaaagtgtttagatgctgatgacaaataccgtgatgcaaatattctttgggatagttctgagacgaaagtaaagaagaaattcaaagtcgaaaataactcactttatatcacacaaggttttattgcttccgattttaaggggaatacgtgttctctaggtcgcgaaggttcagattatacggcggctattttggcttatcttctnaatgctgataaaatgattatctggaaagatgtattgngtgtgttaaatgccgatcctgattatttcaataatacaactaagctcgatttgattccatatcaggaaagcattgaattgtcgtattatggagcaagtgttattcatcccgagactatnaagtttttgcaggcaaaacgaattctttatggggtaaatcttttattcagccaa

SEQ ID NO: 16524 - protein, 316 aa, Unknown
  Obtained from environmental sample
  DOMAIN (34)...(311): Amino acid kinase family
  misc_feature (1)..(316): Xaa is any amino acid
MMAERGSFTFYFFHHLIYLFTLSPVYLFTHTHIIMIIYKFGGVSVKDAAAIKNISNIIGEAKGPLVVVISAIGQTTNLIEGIIDAHYSGKANVNALFEELKEKHLTLTLDLFDEFPQDLLDKLQSFFTEIETRLSKPFSESFNFEYDQLIAFGELLSTTIVSAYLNHIGQKNKWVDIRKCLDADDKYRDANILWDSSETKVKKKFKVENNSLYITQGFIASDFKGNTCSLGREGSDYTAAILAYLLNADKMIIWKDVLXVLNADPDYFNNTTKLDLIPYQESIELSYYGASVIHPETXKFLQAKRILYGVNLLFSQ

SEQ ID NO: 16525 - DNA, 453 bp, Unknown
  Obtained from environmental sample
  misc_feature (1)..(453): n is a, c, g, or t
gtgatacttaaaaacgcggattgggtaactgacatgacgctcggcaaaaaactctacgaagaaaattgcgtcaaatgccatggcgatcatggtcaaggcaactggcaccaggatatgctggggccggacggcgagaagattgaagttaaagttgaaggtgatgccgtaaaacaagagcctgcatattatccggtcatagcgggacagacctacctctacctgatcagacaattcagctggattcagatcggcaaaagaagaaatgccaatcccgatatgatcaaacagattgaaaagttttctttcctcgatatgaagagcgttgttgattatgcctctcgctttataatgaaagagggggactggcaggaagtcggtgatgtggatgaagagggatgggatctcggggaagaggaagaagatgacgatatgcctgcgcacatgaggcgatag

SEQ ID NO: 16526 - protein, 150 aa, Unknown
  Obtained from environmental sample
  misc_feature (1)..(150): Xaa is any amino acid
MILKNADWVTDMTLGKKLYEENCVKCHGDHGQGNWHQDMLGPDGEKIEVKVEGDAVKQEPAYYPVIAGQTYLYLIRQFSWIQIGKRRNANPDMIKQIEKFSFLDMKSVVDYASRFIMKEGDWQEVGDVDEEGWDLGEEEEDDDMPAHMRR

SEQ ID NO: 16527 - DNA, 543 bp, Unknown
  Obtained from environmental sample
  misc_feature (1)..(543): n is a, c, g, or t
ttggttcttaagattcaaaggatattcataaaaagtaaatcaaataagaagcagatattagcaacaattatagttgttttcagtataactttttttctatttttttatcaatcataccgacatgccaaactggcatttgaagagatagataatatatttgatacaaatataaatagtctttttgaagaagtagatactaaaatgctcaaaaaaaatttaattgagagatcagatatattactctctattctcgaaaaagataactttttagatttggttgaacaaaatagaagagctgaattaatttcactgttagaaccagagtataatctgctaaaagagcagcttcctgacttccatattttacatatacatgacataaacggaacatcaattttaagaatgcatgcaaaagagatgtatggagacaacttaaaagcattcagatcacatataaaagagatagttacatatccaaaaaagagcaccttttatgaagttggcaaacatggactttactatagatatatcactccgctataa

SEQ ID NO: 16528 - protein, 180 aa, Unknown
  Obtained from environmental sample
  misc_feature (1)..(180): Xaa is any amino acid
MVLKIQRIFIKSKSNKKQILATIIVVFSITFFLFFYQSYRHAKLAFEEIDNIFDTNINSLFEEVDTKMLKKNLIERSDILLSILEKDNFLDLVEQNRRAELISLLEPEYNLLKEQLPDFHILHIHDINGTSILRMHAKEMYGDNLKAFRSHIKEIVTYPKKSTFYEVGKHGLYYRYITPL

SEQ ID NO: 16529 - DNA, 651 bp, Unknown
  Obtained from environmental sample
  misc_feature (1)..(651): n is a, c, g, or t
atgatagatgtatgtgtggtaggtattggtgaatatgtcacaggattaagtggagataaaaaagcaaattctgataaaagtttaggggtgattgctttaagtttatttgacttaaaagagcaaggttttataaaaaatattaaactagctggtagagatggcgataaatttactactataaaagaacattttgataccaacatgaaagctttttatcctacactcaataccacatttgaaggttttccacaaaaaaacactcaaagtgatactgcctacaaagatgcaatagatagtttaaaaaaaggctcatgcgttctcatctttaccccagatgatacacactttgagatagcacagtatgcactaaaatctggaatgcacacacttgtagctaagccactagtgaaaacaacaaaagagcataaaaaacttcaaaaactagctacaaaaaacaatcttttattgatgttagaagttcataaaaggtttgatccaatctatgcagatgcgagagataatattagaacttttggtgatttttcctattttaatagctatatgtcacaaccaaaatcacaacttgatactttcgcttcttgggctgggataagtagtgatattagttactatctaattctcatcatatag

SEQ ID NO: 16530 - protein, 216 aa, Unknown
  Obtained from environmental sample
  DOMAIN (2)...(160): Oxidoreductase family, NAD-binding Rossmann fold
  misc_feature (1)..(216): Xaa is any amino acid
MIDVCVVGIGEYVTGLSGDKKANSDKSLGVIALSLFDLKEQGFIKNIKLAGRDGDKFTTIKEHFDTNMKAFYPTLNTTFEGFPQKNTQSDTAYKDAIDSLKKGSCVLIFTPDDTHFEIAQYALKSGMHTLVAKPLVKTTKEHKKLQKLATKNNLLLMLEVHKRFDPIYADARDNIRTFGDFSYFNSYMSQPKSQLDTFASWAGISSDISYYLILII

SEQ ID NO: 16531 - DNA, 591 bp, Unknown
  Obtained from environmental sample
  misc_feature (1)..(591): n is a, c, g, or t
atgatgggatttttaaataccatattcaataaaataaaaagcgctgcaagggaaagatttatcctcaacaaagagacaaattcgatacaaatactacttgatagttcccatgaacaatattttacactcacctttgataatatgaatataaaaactttatacgatccaaatatctttagaagtactgtcatagatgcaaatagtttagatttaggagagctttacatagaggtgattgagctagattatcaacacgattggaatggaagtgcaggaggttgttttgatctttttatcaaacaagagtttcaaaaatcaaagtttgaatttgtaaaaagttttgatgatgattttgccaagtttactaaataccaagtgaatgataaatatgaggtaggattaatctggttttctttaaacaaacaagatatttttatctttgatacaaaagggaagctttttaatgacctactaaaaatatatgatgtaaaaaatagcttatattttatcaagaagctagatagtgtaagtatgaaactaaaaaatagccttacacaaacaaatcttattggggattatatagtaaaatag

SEQ ID NO: 16532 - protein, 196 aa, Unknown
  Obtained from environmental sample
  misc_feature (1)..(196): Xaa is any amino acid
MMGFLNTIFNKIKSAARERFILNKETNSIQILLDSSHEQYFTLTFDNMNIKTLYDPNIFRSTVIDANSLDLGELYIEVIELDYQHDWNGSAGGCFDLFIKQEFQKSKFEFVKSFDDDFAKFTKYQVNDKYEVGLIWFSLNKQDIFIFDTKGKLFNDLLKIYDVKNSLYFIKKLDSVSMKLKNSLTQTNLIGDYIVK

SEQ ID NO: 16533 - DNA, 324 bp, Unknown
  Obtained from environmental sample
  misc_feature (1)..(324): n is a, c, g, or t
atgaatattaaaagtgaaattaaagagataatagtatctcttatacctgaaagagcaaccgttagcccagaaaatagttctatatttacatattatgtaagttggtcaaatggaagtgaggctccgatgattaagttctttaagcctatagctattcaactgtcacatgaaactatcattgaattcaatagtctgacattaggtaagcaagagttgcaaattaaaaaaataaagtattttttagagtcaaagtttaaagggtttactcctgactttaatattccaacagacagtgatataccgaatgtaaaatgggacatttaa

SEQ ID NO: 16534 - protein, 107 aa, Unknown
  Obtained from environmental sample
  misc_feature (1)..(107): Xaa is any amino acid
MNIKSEIKEIIVSLIPERATVSPENSSIFTYYVSWSNGSEAPMIKFFKPIAIQLSHETIIEFNSLTLGKQELQIKKIKYFLESKFKGFTPDFNIPTDSDIPNVKWDI

SEQ ID NO: 16535 - DNA, 756 bp, Unknown
  Obtained from environmental sample
  misc_feature (1)..(756): n is a, c, g, or t
atgagaataatacattgtgcaccttttaatattattactaaaacaggtggttctttgtatgcaaatccaataaaaatttcccaaggacttatccaaaacaatcattttgtgcataattttgattatagagatacttcacgatatatgtcatttcttagaaataaaaagaatggtacaaaaaagatgaatcaattttttttagatttagtaaacgatattaatccagatttaattatctttggtcatgctgaacttatacaagaagaaacttttgagtatataaaaagaaaaaagattaaaatgatttattggtataatgatgttccaatacaaatatattttaaaaaaatagcacattattttgaatttattttaactactgctggtggagagtttattgaagacctcaagcagtacaacaaagaggtgttttttttaccaaatttagtagatgaaaatattgagaaatataaagggtatgaaaatactacttttcaaagtgatgttgtgtttacagggcgtgctgataaagaaagaggagctttaatagattatttaacttctaatttagattcaactatagaaacaaaatttataggttttgataaacagtctgttgttataggggataaatatttacaagctttagcaaactctaaaatagctataaatcataatagagattttacattaaaatatgaatggtatacttcggatagacttgtgcatatnctaggaaatggttcttttgcttaa

SEQ ID NO: 16536 - protein, 251 aa, Unknown
  Obtained from environmental sample
  misc_feature (1)..(251): Xaa is any amino acid
MRIIHCAPFNIITKTGGSLYANPIKISQGLIQNNHFVHNFDYRDTSRYMSFLRNKKNGTKKMNQFFLDLVNDINPDLIIFGHAELIQEETFEYIKRKKIKMIYWYNDVPIQIYFKKIAHYFEFILTTAGGEFIEDLKQYNKEVFFLPNLVDENIEKYKGYENTTFQSDVVFTGRADKERGALIDYLTSNLDSTIETKFIGFDKQSVVIGDKYLQALANSKIAINHNRDFTLKYEWYTSDRLVHXLGNGSFA

SEQ ID NO: 16537 - DNA, 549 bp, Unknown
  Obtained from environmental sample
  misc_feature (1)..(549): n is a, c, g, or t
gtgaaaattcttttttacggctcttttatccctttacatgggattgatgtgattttaaaagcttttagtttgatggaaaaagatggtttggaatttgaagccaatattattggttgtgggcaaatttattctcagatgaaagagctatttgatactttgggattaaaacaagtaactatgaatggtgaaattattgaagagattgaattagcctcaagaataagagaacatgatattatccttggtatctttggagatagtacaaaagcaaaaagtgttgtaccaaataaattgtaccaagctgttgcaactgcaaaaactattgttacaatggaatcaaaagctatcgaagagttttttgataaggacgatttaattgtttgtaacaatacaccagaacaactctctttggaattaactaatttagtgaataataaagaagtattagatgctacagcaacaaatggatataataagtttttaaaaatatatgagaagacaaaagtagattttgaaaattttattaaagaaatagatagaggattataa

SEQ ID NO: 16538 - protein, 182 aa, Unknown
  Obtained from environmental sample
  DOMAIN (2)...(159): Glycosyl transferases group 1
  misc_feature (1)..(182): Xaa is any amino acid
MKILFYGSFIPLHGIDVILKAFSLMEKDGLEFEANIIGCGQIYSQMKELFDTLGLKQVTMNGEIIEEIELASRIREHDIILGIFGDSTKAKSVVPNKLYQAVATAKTIVTMESKAIEEFFDKDDLIVCNNTPEQLSLELTNLVNNKEVLDATATNGYNKFLKIYEKTKVDFENFIKEIDRGL

SEQ ID NO: 16539 - DNA, 807 bp, Unknown
  Obtained from environmental sample
  misc_feature (1)..(807): n is a, c, g, or t
gtgattacagccacaaatggtattgaagccttggatatattacataataacagtcaaaaaatttctttaatattaacagattttaacatggctcaaatggatggaatgacccttactctaaaaatgagagaaacatatcaaaaagacatcttaggtattattgcacttagtgcgaatgatacaccagatatttcaacaaaatttataaaaattggtgcaaatgatttcataaataaaccttatagtccaatagaggttataacacgagtaaattcaaatcttgaaacattagagttatttgaacaaacaagagatatggcaaataaagattttatgactggttcatataatagaagatacttttttgaaaaaggtgaatatctttttaataatgccaaaacagaacataaagatatagcagtagctatgtttgatattgataagtttaaaaatatcaacgatacttatgggcatgatgtgggtgatgtagctatttgtgaagtagcaaatattttaaataatcatcttagaaaaaatgatttaatcgcaagatttggtggtgaagagttttgtgttatattagaaaatataactatggatgagataaaaaaactttttgaaaatatacgaaaagtatttgaagaaaacattattcatatcaataatttaaaaattcaatttacaacctctataggtatctgttatgggatagaggatgatttagaaaaaatgataaaagtagcagatgatggattataccattgtaaaaacaatggacgaaaccaagtagctatcaatataaaatag

SEQ ID NO: 16540 - protein, 268 aa, Unknown
  Obtained from environmental sample
  DOMAIN (1)...(98): Response regulator receiver domain
  misc_feature (1)..(268): Xaa is any amino acid
MITATNGIEALDILHNNSQKISLILTDFNMAQMDGMTLTLKMRETYQKDILGIIALSANDTPDISTKFIKIGANDFINKPYSPIEVITRVNSNLETLELFEQTRDMANKDFMTGSYNRRYFFEKGEYLFNNAKTEHKDIAVAMFDIDKFKNINDTYGHDVGDVAICEVANILNNHLRKNDLIARFGGEEFCVILENITMDEIKKLFENIRKVFEENIIHINNLKIQFTTSIGICYGIEDDLEKMIKVADDGLYHCKNNGRNQVAINIK

SEQ ID NO: 16541 - DNA, 381 bp, Unknown
  Obtained from environmental sample
  misc_feature (1)..(381): n is a, c, g, or t
atgaaaactttaatcttcacagatcttgatggaacttttttgaatcatgatgattactcttttgaagactcctttgatgctctaaaaaaaattaaacaaaaaaagatccctctcatatttactactagtaaaactaaatctgaagttatacaactacaacaaaaagttggtattgttgagccgtttatcattgaaaatggtgcagcgctttttataccacaaggttatcaaggtttaaatttaaatgatttgacaacttacgatggatataaaagtttaatatttggcataaaatataacgaaatactcaaattctatgaaacatataaagataagtttggaatgagaggattcagtgatatgagcttagatgaagtatga

SEQ ID NO: 16542 - protein, 126 aa, Unknown
  Obtained from environmental sample
  misc_feature (1)..(126): Xaa is any amino acid
MKTLIFTDLDGTFLNHDDYSFEDSFDALKKIKQKKIPLIFTTSKTKSEVIQLQQKVGIVEPFIIENGAALFIPQGYQGLNLNDLTTYDGYKSLIFGIKYNEILKFYETYKDKFGMRGFSDMSLDEV

SEQ ID NO: 16543 - DNA, 549 bp, Unknown; identical to SEQ ID NO: 10485
  Obtained from environmental sample
  misc_feature (1)..(549): n is a, c, g, or t

SEQ ID NO: 16544 - protein, 182 aa, Unknown; identical to SEQ ID NO: 10486
  Obtained from environmental sample
  misc_feature (1)..(182): Xaa is any amino acid

SEQ ID NO: 16545 - DNA, 627 bp, Unknown
  Obtained from environmental sample
  misc_feature (1)..(627): n is a, c, g, or t
ttgaatttagttgttggatcaggattttatttgacagaattaaaagatcttttagcagatgaaaatagaaaacttgaagagtctctgtttacaaatttaaaaaaaatattgctcatactggttattttaattgttctttctcttctatctgctctatatgtatcaagaagaattaaaagagttgaagagtcacaaaaagagtacttaaatatgcttgaacagtatcaactgatcttagattcaagtgctttagtgtctaaagcaaatttagatggagtaattagctatataaacagtagctttacaaatgtaagcggttattcaaaagacgaggcgattggtcaacctcatagtatagtaaggcatcctaactcgtcaaaggagcagtttagacgtttatggaaaactatccaaaatggacagatttggaaaggtgttattaaaaacagaaataaaaatggtgaaacatactttaacagcactacaatagtaccaataaaagatagctatggaaatatagttgagtatatatcttctggtgcagatgtaactgagttacttngaaatagaactaaaataaaaaatatttttaatacagatcaattaaccggcttagaaatagagtag

SEQ ID NO: 16546 - protein, 208 aa, Unknown
  Obtained from environmental sample
  DOMAIN (73)...(135): PAS domain
  misc_feature (1)..(208): Xaa is any amino acid
MNLVVGSGFYLTELKDLLADENRKLEESLFTNLKKILLILVILIVLSLLSALYVSRRIKRVEESQKEYLNMLEQYQLILDSSALVSKANLDGVISYINSSFTNVSGYSKDEAIGQPHSIVRHPNSSKEQFRRLWKTIQNGQIWKGVIKNRNKNGETYFNSTTIVPIKDSYGNIVEYISSGADVTELLXNRTKIKNIFNTDQLTGLEIE

SEQ ID NO: 16547 - DNA, 882 bp, Unknown
  Obtained from environmental sample
  misc_feature (1)..(882): n is a, c, g, or t
atgacagaatggctgagggtgcgatgcactattgaagtaacaaaaaaaattgattctcttccatcaattgcaatagaagatggttcagttgaacagagtaatctaaatagaagtttttttagttcaattgttggtgacatgaatgttttgtctatttttaatgttgaacgaggatataaaaaagttgatttttacagttcagagatagcaagagaaaatagtgaatttgattatgttttacgttttaatgtagaaaaatttgatgctagaggtataaatgtatctataaagttctttcaaacaaaagagctgacttttcagaaaagttatcgtgtaaatgatagctcgttatatccatttttagctcactcaatagcatatgatattaataagtatatgggtgctgatagtgtagagtggatgaagaaaaaagtaattatttcacgtttaactgaagctggtagaagtgaaattgttattgccgactactcattaacatatcaaaaggttatattgagaaagaagctattagtttttccaaaatgggctaataaagagcaaaatgcattttactatacctcattaagtgatgatatacctacactctataaaatggatttaaaaacaggaattgcgaaaaaaattattagttcagatggtatgatgatatgttctgatgtatcagaagatgaaaatagtttacttttaactatggcaccaaatggtcagcctgatatataccttttcaataatttaacaaataaatataagaggttaacaacatacagcgggatagatgttagtggtcaatttatggatgataataaaatagcttttatatcaaatcgcctgggatatcccaatgttttttctaaaaaatag

SEQ ID NO: 16548 - protein, 293 aa, Unknown
  Obtained from environmental sample
  misc_feature (1)..(293): Xaa is any amino acid
MTEWLRVRCTIEVTKKIDSLPSIAIEDGSVEQSNLNRSFFSSIVGDMNVLSIFNVERGYKKVDFYSSEIARENSEFDYVLRFNVEKFDARGINVSIKFFQTKELTFQKSYRVNDSSLYPFLAHSIAYDINKYMGADSVEWMKKKVIISRLTEAGRSEIVIADYSLTYQKVILRKKLLVFPKWANKEQNAFYYTSLSDDIPTLYKMDLKTGIAKKIISSDGMMICSDVSEDENSLLLTMAPNGQPDIYLFNNLTNKYKRLTTYSGIDVSGQFMDDNKIAFISNRLGYPNVFSKK

SEQ ID NO: 16549 - DNA, 396 bp, Unknown
  Obtained from environmental sample
  misc_feature (1)..(396): n is a, c, g, or t
atgatgaataatattgattatatggtaaagtataaaacgaaaaattataaagaaaatcttgtattaatgttttattttttatttgacactttgcttgatatatctgaaaataaacaacttctaaaagatattaaaaaacttcaaaaatttaaagtacctgagatatataaaaaagagttaatagatattaaaaacgaagcagaattaatctctaaaaaatataaaattatgaacaatatgccaaaaccatttttaatgggaaaagacttgataaattttggatataaacctagtgtgaagtttggagtagttttaaaaaaaatataccaatctcaacttgatggagagattggtagtaaaaaagaggcagagaagttactctctactcttttataa

SEQ ID NO: 16550 - protein, 131 aa, Unknown
  Obtained from environmental sample
  misc_feature (1)..(131): Xaa is any amino acid
MMNNIDYMVKYKTKNYKENLVLMFYFLFDTLLDISENKQLLKDIKKLQKFKVPEIYKKELIDIKNEAELISKKYKIMNNMPKPFLMGKDLINFGYKPSVKFGVVLKKIYQSQLDGEIGSKKEAEKLLSTLL

SEQ ID NO: 16551 - DNA, 336 bp, Unknown
  Obtained from environmental sample
  misc_feature (1)..(336): n is a, c, g, or t
ttgccggacaatatcataaagagctactttgagagtgtagaagagattgctaatgaagttacatttgttatacgtggaactattgacggtatagataaaatgaaaccaacacttgcatggatagatagagtcacaaccaaaacagatggcacaaaatatagagcaactgttatcatagaaccaagagttgttaaaaagtacaacatcaaaaaagtacctgcagttttatatataaaaaactatgatcagacttatctgaaatcagatggtaagatgtttaaaattcattatggaacggttgatttttggtatgctatagagaagatgaaagattaa

SEQ ID NO: 16552 - protein, 111 aa, Unknown
  Obtained from environmental sample
  misc_feature (1)..(111): Xaa is any amino acid
MPDNIIKSYFESVEEIANEVTFVIRGTIDGIDKMKPTLAWIDRVTTKTDGTKYRATVIIEPRVVKKYNIKKVPAVLYIKNYDQTYLKSDGKMFKIHYGTVDFWYAIEKMKD

SEQ ID NO: 16553 - DNA, 936 bp, Unknown
  Obtained from environmental sample
  misc_feature (1)..(936): n is a, c, g, or t
atgaaaactattcctggatttgaaaatgtcaaaatgtttcgtccgggttatgctatagagtatgattatttcccaccaacacaattgaagcactcattagaaactaaattagtggagggcttgtattttgctggacaaattaatggtacaacaggatatgaagaagcggcgtgtcaaggattgatggctggaatcaatgctgcaagaaagattcaaggtaaagacgagtttattttaaatcgctctgatgcttatataggtgtattaattgatgatcttataacaaagggtacaaaggagccttatagaatgtttacatctagagcagagtataggattcttttacgacaagataatgctgaccttagactaacgccaataggacattcaattggtatgattgatgatgagcgtcttgaaaaggtaaatgctaagatgaatttggtttctgaattaaaaaagaagctctctaaagtgggagttaaaccagaagaggcgaaccctgttttaaattctcttgattcctcaccaattaagcaacaaattagacttactaagctgataactcgaccaaatattggtatgactcaacttttagaaatgagtgaggagcttagaggatatgtagagaatattgcggctgatgtgctagaacaagtagagattcaattgaaatatgaaggatatatttcccgcgaacaagatgtagctgacaaattgaatcgtctggatgaggtaaagattaccagtgatgttgagtttagtaaattagaaagcctgagtgcagaggctgtagaaaaattaaacaaaattagaccggcaaccataggacaagcttcgcgcataagcggtgttagtccgagtgatgtgaatgtactgttgatttatttgggtagatattttcacgtgaacgttaatatgtataaatatgaaata

SEQ ID NO: 16554 - protein, 312 aa, Unknown
  Obtained from environmental sample
  misc_feature (1)..(312): Xaa is any amino acid
MKTIPGFENVKMFRPGYAIEYDYFPPTQLKHSLETKLVEGLYFAGQINGTTGYEEAACQGLMAGINAARKIQGKDEFILNRSDAYIGVLIDDLITKGTKEPYRMFTSRAEYRILLRQDNADLRLTPIGHSIGMIDDERLEKVNAKMNLVSELKKKLSKVGVKPEEANPVLNSLDSSPIKQQIRLTKLITRPNIGMTQLLEMSEELRGYVENIAADVLEQVEIQLKYEGYISREQDVADKLNRLDEVKITSDVEFSKLESLSAEAVEKLNKIRPATIGQASRISGVSPSDVNVLLIYLGRYFHVNVNMYKYEI

SEQ ID NO: 16555 - DNA, 744 bp, Unknown
  Obtained from environmental sample
  misc_feature (1)..(744): n is a, c, g, or t
ttgaaaaaaggattatttaaaaaatttgtaaccagttttatagtgatagttttagtaaatctaatttcttttattttaattgaaagtaaactaaaacttaacgttctaaatctattatatttatctacaatacttttcattattttttatctgattttcttcccaacgattttatatattcttaaaaattcaacttcaataaagaatgttgaaaatgtatttttgtctattaacgaaagtaatattgatagtttttatcagtcaatagaaaaaaatcaaaccgcgagtgaatatatagaacaacatgaaaaaaatccttttaatatcataaaagaccaatgccttcaatctattgagaataaagaccattcaattcctaaattaatagtatttgaaatggaaacatggttaataaaaaacatggataactcaatctcagatgaaaaaaatagtaagaggctgggtatttatattactgttatagaaagcatttccaatcgaataattgataaaaaagaaaaacaattatatgagtatttatttgatagcttatcgaattgttatttttttattgcaaaaatgaaatttgatttaaaattaatcgaacaatataatcaattgtacaaacaatgtattctaaatatagttagaaatgaacatgatacatattttcataaattcaataatttaataaataatattttaagtttaatattgaaaaattatacaccagaagaaaaatag

SEQ ID NO: 16556 - protein, 247 aa, Unknown
  Obtained from environmental sample
  misc_feature (1)..(247): Xaa is any amino acid
MKKGLFKKFVTSFIVIVLVNLISFILIESKLKLNVLNLLYLSTILFIIFYLIFFPTILYILKNSTSIKNVENVFLSINESNIDSFYQSIEKNQTASEYIEQHEKNPFNIIKDQCLQSIENKDHSIPKLIVFEMETWLIKNMDNSISDEKNSKRLGIYITVIESISNRIIDKKEKQLYEYLFDSLSNCYFFIAKMKFDLKLIEQYNQLYKQCILNIVRNEHDTYFHKFNNLINNILSLILKNYTPEEK

SEQ ID NO: 16557 - DNA, 513 bp, Unknown
  Obtained from environmental sample
  misc_feature (1)..(513): n is a, c, g, or t
gtggagaaaattagtaatcaaaaagctatttatgatactttatactttgtagtaaaaggtaatcttaaaatagctgatgaaattnttaaagaagaggaatataanatagttnataaaggggaaggagtaggactaattgccaatgctccatctttagtgtttgtttattctttcaaagttgggaaactacttagaaatttaaataacaaaattaataaaaaattatcccaagaagtagcttttgtaaaaaattctgttactagtaaaattctttttcaaagtgatattttaagtttaactcttttatcattagatgaagggcaaggattaaattctcattcggcttctggggacgctttagtaatttctctagaaggggaagttttaattaaaattgatcaagatgaatataatttaagtgaaacggattcaattatacttccagtaggaattccacatagtttattagctaaaaaaccctataaaatgtttttaacagtagtcaaacaataa

SEQ ID NO: 16558 - protein, 170 aa, Unknown
  Obtained from environmental sample
  misc_feature (1)..(170): Xaa is any amino acid
MEKISNQKAIYDTLYFVVKGNLKIADEIXKEEEYXIVXKGEGVGLIANAPSLVFVYSFKVGKLLRNLNNKINKKLSQEVAFVKNSVTSKILFQSDILSLTLLSLDEGQGLNSHSASGDALVISLEGEVLIKIDQDEYNLSETDSIILPVGIPHSLLAKKPYKMFLTVVKQ

SEQ ID NO: 16559 - DNA, 423 bp, Unknown
  Obtained from environmental sample
  misc_feature (1)..(423): n is a, c, g, or t
atgacttatataaataatattgaaaaagcaaagatttttaaatcaaaagaaattatagatatctatagctctcaaattgttagttcgaagttagcagataatgatagttttaatctagaagtatattcttttgatgtaggtgagaaaattagtaatcaaaaagctatttatgatactttatactttgtagtaaaaggtaatcttaaaatagctgatgaaattattaaagaagaagaatataaaatagttaataaaggggaaggagtaggactaattgccaatgctccatctttagtgtttgtttattctttcaaaagtgggaaactacttagaaatttaaataacaaaattaataaaaaattatcccaagaagtagcttttgtaaaaaaatctgttactagtaaaattcctttttcaaagtga

SEQ ID NO: 16560 - protein, 140 aa, Unknown
  Obtained from environmental sample
  misc_feature (1)..(140): Xaa is any amino acid
MTYINNIEKAKIFKSKEIIDIYSSQIVSSKLADNDSFNLEVYSFDVGEKISNQKAIYDTLYFVVKGNLKIADEIIKEEEYKIVNKGEGVGLIANAPSLVFVYSFKSGKLLRNLNNKINKKLSQEVAFVKKSVTSKIPFSK

SEQ ID NO: 16561 - DNA, 429 bp, Unknown
  Obtained from environmental sample
  misc_feature (1)..(429): n is a, c, g, or t
ttgtttnnnnnnnnggttgtatggctgggtcgagagattgtacccatcaagaatattgccatgcacggtagacccacctcaaagctggatagtcgcgatctatggaaaaaatataattacaaggattatggtataacttctgaaccttactttgatatagattttaacaaggttctttatataaccgatgccggacgttcctgggataatgaaaagatcaataaacgtgataaagtaacttcagaatttaacttccattttaaacatacaaatgatattatcaaagctttagaggaaaacaaattacctgatcaaataatgattaatattcatccggaacattgggctgattcaacgttggagtggttgtggatttggagtgttcgtaagttgaaaaatgcagttaaaagattaatcctcaataggtag

SEQ ID NO: 16562 - protein, 142 aa, Unknown
  Obtained from environmental sample
  misc_feature (1)..(142): Xaa is any amino acid
MFXXXVVWLGREIVPIKNIAMHGRPTSKLDSRDLWKKYNYKDYGITSEPYFDIDFNKVLYITDAGRSWDNEKINKRDKVTSEFNFHFKHTNDIIKALEENKLPDQIMINIHPEHWADSTLEWLWIWSVRKLKNAVKRLILNR

SEQ ID NO: 16563 - DNA, 969 bp, Unknown
  Obtained from environmental sample
  misc_feature (1)..(969): n is a, c, g, or t
ttgatggctcggaggtataattgnnaatatttaatagattttatacaaaatgaaaacgttgagaaagcagaaatatttccacatctgaaatgtgaactttcacaagtaaatatattgaaaaatcttacaaaaaagtatgtaagcggcagtgaagatgcacttgtggttgatctcttacaagatatatatggtgatgatgattttatattcataaatcatttgagtgatgtaaagatgcttttagagttgggttggctaacccaaaacagttttgcacctctgaaaatttcagatctttcagagttagaacttttaaactctgccgtaggacttagttcatcatttttaaaactgctagtagctggatcattagagatgactctgccggatattaaaccttatgaagatcacttagagtatctacaagatcaattttataaaatagagttatatcagcaaatgagcgcagtaagacataatgttcatgagaactcattgggcataaaccgcatacaaaataaagttgaattgttagaaaaacgtatagaagatcgtatggcacaaacagatcaagaaattgttcttgatcgttttataaaacagaaaaaaatggatgaaaaagagcaggtgatttttctggctcttcttaaagaggagtacagctcaaatgagtcatcacttcgtgagatgaatgttcttattgatcttataagcatcgatgagtatgaccgtattaaaaatcgttctcttcttgaagatggatctcggcttatttctgatgagatcatagattatgaggagatgttaaatccatttggcggtataacacgtgctttttacatagtagatgaagttttgcaaaatattattcatccacaaaagaaaaaaaaggtgagtcgtcttaaaatagatatgctcattaaagatcaagatctttttgaggtggttggacccctacacatcttttag

SEQ ID NO: 16564 - protein, 322 aa, Unknown
  Obtained from environmental sample
  misc_feature (1)..(322): Xaa is any amino acid
MMARRYNXXYLIDFIQNENVEKAEIFPHLKCELSQVNILKNLTKKYVSGSEDALVVDLLQDIYGDDDFIFINHLSDVKMLLELGWLTQNSFAPLKISDLSELELLNSAVGLSSSFLKLLVAGSLEMTLPDIKPYEDHLEYLQDQFYKIELYQQMSAVRHNVHENSLGINRIQNKVELLEKRIEDRMAQTDQEIVLDRFIKQKKMDEKEQVIFLALLKEEYSSNESSLREMNVLIDLISIDEYDRIKNRSLLEDGSRLISDEIIDYEEMLNPFGGITRAFYIVDEVLQNIIHPQKKKKVSRLKIDMLIKDQDLFEVVGPLHIF

SEQ ID NO: 16565 - DNA, 669 bp, Unknown
  Obtained from environmental sample
  misc_feature (1)..(669): n is a, c, g, or t
atgcacgtattattttttacggtgcccctggaactgggaaaaactatgacagcttactcatgggcaaaatctttaaaacgtcaagttcttagttttgactgctcgaaaattctatcaatgtatgtaggagagagtgaaaaaaatgtaagaaaaatttttgatacctactatgatcttacactcaaaaccaaaaccgaaccaatactttttttaaatgaggcagatcagtttctaagctcgcgctcatcaggtataaattcaagtgcagatcagatgcataatcagatgcaaaatatatttttagagcagatagaaaacttcagaggtattttaatagctacgacaaatcttcttgaaaatatagatgctgctttttcacgcagatttaactacaaaatagagttcaaaaaaccatctcgtgaacaaagagaacttttgtgggataaaatgcttccaaaaaatgcaccatatgaaaaagattttgatagtaaaaaactttcagagtatgatttaacaggtgggcaaataaatttgattattaaaaacaacgcttatgctatagcagctcaagaggaaccattatttaccatggataatttcataactgaaattcaaaaagagaaaaaagggagttttgactcagaaaaatcgatgggatttttgagttaa

SEQ ID NO: 16566 - protein, 222 aa, Unknown
  Obtained from environmental sample
  DOMAIN (2)...(190): ATPase family associated with various cellular activities (AAA)
  misc_feature (1)..(222): Xaa is any amino acid
MHVLFFTVPLELGKTMTAYSWAKSLKRQVLSFDCSKILSMYVGESEKNVRKIFDTYYDLTLKTKTEPILFLNEADQFLSSRSSGINSSADQMHNQMQNIFLEQIENFRGILIATTNLLENIDAAFSRRFNYKIEFKKPSREQRELLWDKMLPKNAPYEKDFDSKKLSEYDLTGGQINLIIKNNAYAIAAQEEPLFTMDNFITEIQKEKKGSFDSEKSMGFLS

SEQ ID NO: 16567 - DNA, 342 bp, Unknown
  Obtained from environmental sample
  misc_feature (1)..(342): n is a, c, g, or t
atggaatttctaagtacacttttacctgatcctgcatctcttggttctagaactacgggcaaaactaatattggcatagttgctgagggtataaaagatggtgtgaaaaagaagatttatatctaccaagtaaaagaccatgaagattgctttgcagagactaactcacaaggtgtttcttactctactggagttccggcaatgataggtgcaaaacttatgttgcaaggtaaatggaatggaataggtgtttttaatatggaacaattagaccctgatccattcatggaggagatgaatactcaaggtcttccttggcaaataaaagaattagaagtataa

SEQ ID NO: 16568 - protein, 113 aa, Unknown
  Obtained from environmental sample
  misc_feature (1)..(113): Xaa is any amino acid
MEFLSTLLPDPASLGSRTTGKTNIGIVAEGIKDGVKKKIYIYQVKDHEDCFAETNSQGVSYSTGVPAMIGAKLMLQGKWNGIGVFNMEQLDPDPFMEEMNTQGLPWQIKELEV

SEQ ID NO: 16569 - DNA, 900 bp, Unknown
  Obtained from environmental sample
  misc_feature (1)..(900): n is a, c, g, or t
atgtcaataaatgaatcaaacaaattcttaaaagcaatatcaaaagaactaccaacacacaaaggtaatttaagaatatggatagcatcagttaaattaaacaatacaaatttaattcaaactctttcatatcattacactataaataaaagaaaaaaacaaattataattaaaacaagtaaaaatgataatagaaagattactgttagaaaatctaatgctttacctattatagatattaacaataatgagataacagatctatataaagatataaatagaattactattaaaatttataaacatgaaattattattgaacctttaaaagaagctcttgaacaacaaagagcaaaagcaaaactgaaagcaaagaaaattacttttatagatatgtttgcaggttcaggtactctaagtgaatcttttaagaatgttggaatgtttccaattgcagcaactgaattagaagataaatatttaattaattatgaaaaaaacaatactgatacctttacttacaatactgatattacacacatagactttagcctacttccaaaaaatgcaacaggtatgattgttggtattccttgtgaatgtttttgcccttcaggaacagtaaaaaaagaaagtttgggacaaaaaagtaaagaagcaggagatacaggaagtctaggctatttctttttacaagcagttgaaataataagacctgcatttattgtaattgaagaagttattggatttagaaaatctgtaatgatggatattattcgttctgtattgggacatagaggatatacactttcagaaaaaatactaaatgcagatgaatatggtggaatgactaaaagaaaaagattttgcatgggtgcaactattagcaaaatacctttt

SEQ ID NO: 16570 - protein, 300 aa, Unknown
  Obtained from environmental sample
  misc_feature (1)..(300): Xaa is any amino acid
MSINESNKFLKAISKELPTHKGNLRIWIASVKLNNTNLIQTLSYHYTINKRKKQIIIKTSKNDNRKITVRKSNALPIIDINNNEITDLYKDINRITIKIYKHEIIIEPLKEALEQQRAKAKLKAKKITFIDMFAGSGTLSESFKNVGMFPIAATELEDKYLINYEKNNTDTFTYNTDITHIDFSLLPKNATGMIVGIPCECFCPSGTVKKESLGQKSKEAGDTGSLGYFFLQAVEIIRPAFIVIEEVIGFRKSVMMDIIRSVLGHRGYTLSEKILNADEYGGMTKRKRFCMGATISKIPF

SEQ ID NO: 16571 - DNA, 789 bp, Unknown
  Obtained from environmental sample
  misc_feature (1)..(789): n is a, c, g, or t
ttgatttcagcttgtggtacgggtaaaacaatcattgcaaaaaaaactgcctattcccttattcacgaactaaataattcattaatcataatatttatgccaactcttacacttgttaatcaatttaataatgtttggagtaaaaaacatcctggacttaactttgataatgaaccttttgttttttgttctgacaaaagctcattgaatgaatcacaaaaagagattagtggtattgatctaaaaaaactcaaacaatttctagaaaataaatcaattaaacataaagttattttaactacttatcaatcttcaatcaccctttgtaatttttttaaatattcaaactatttaattgattttggtatttttgatgaagctcataaaacagttgggttagaagataaagaatttgctcatgcaatttatgataaaaatatacttataaaaaaacgtctatttatgacagcaacacgtattataacaaatgacaatccttatcatcaaaaactttcaagacatgggaaagttaacctaatggatgatattgtaacttatggaagagttgcatacaatttatcaatgtttgatgcaataaaaaagaatataataaaagattttaaacttgcaataggtgttattgataaagattttattcaaaagcacaaagaattattttcttctggcaaagatttttattcaaatgtaatggcttattcatatattaaagctctaaaagaaaaaaatatcaaaaaaagcattatctttaattctaaattaaagatttaa

SEQ ID NO: 16572 - protein, 262 aa, Unknown
  Obtained from environmental sample
  DOMAIN (2)...(161): Type III restriction enzyme, res subunit
  misc_feature (1)..(262): Xaa is any amino acid
MISACGTGKTIIAKKTAYSLIHELNNSLIIIFMPTLTLVNQFNNVWSKKHPGLNFDNEPFVFCSDKSSLNESQKEISGIDLKKLKQFLENKSIKHKVILTTYQSSITLCNFFKYSNYLIDFGIFDEAHKTVGLEDKEFAHAIYDKNILIKKRLFMTATRIITNDNPYHQKLSRHGKVNLMDDIVTYGRVAYNLSMFDAIKKNIIKDFKLAIGVIDKDFIQKHKELFSSGKDFYSNVMAYSYIKALKEKNIKKSIIFNSKLKI

SEQ ID NO: 16573 - DNA, 579 bp, Unknown
  Obtained from environmental sample
  misc_feature (1)..(579): n is a, c, g, or t
atggatggatttgtaaaaacatttttggtaaatgaaggtcagtttgtagaaacaggaacaccccttgctgtggtttctaaaaacaaaaagttgattctgcaagcaagtgtttcgcaaaaatatttcagcaagctaccaactatttcatctgcgaattttaaaccgattggttctgaagaggtattcgatacgaaaatattaaacggaaaaattgtttcctacggaaaaagcaccgcaggcaattcagcttttctcccaatcacttttgaaattgacaacaaaggaaatcttatttcaggttctgtggcagaagtctttttaaaatctactcctattcctaatactttgataattccagtttcagcattaatggaagagcaaggaaatttctatgtatatgtgcaattaggtggcgaaagctttcaaaagcgagaaataaaaattggtgcaagtgatggagaaaatgtacaggtgctttcaggtgtaagcgaaggcgaacgggtggtaactaagggagcttatcaaattaaactttcgtctgcatctggtgaattgccagcacacggtcacgaacactag

SEQ ID NO: 16574 - protein, 192 aa, Unknown
  Obtained from environmental sample
  misc_feature (1)..(192): Xaa is any amino acid
MDGFVKTFLVNEGQFVETGTPLAVVSKNKKLILQASVSQKYFSKLPTISSANFKPIGSEEVFDTKILNGKIVSYGKSTAGNSAFLPITFEIDNKGNLISGSVAEVFLKSTPIPNTLIIPVSALMEEQGNFYVYVQLGGESFQKREIKIGASDGENVQVLSGVSEGERVVTKGAYQIKLSSASGELPAHGHEH

SEQ ID NO: 16575 - DNA, 507 bp, Unknown
  Obtained from environmental sample
  misc_feature (1)..(507): n is a, c, g, or t
gtgggcggttacgtaggcgatactgcgagcgaagtcatcaaaaactatcccgactttaaaaagatttatcttatagaaccaattgctgaaaatatccgtatcgctaaacgcgaacttgggaagtatgaaaacatagaattttttagctgtggcgtttcaaacaaaaaagagacgcttcactttaatgaagaaaaatccttttccaccatctacggcaaaggcacgcaaagcgtggaagtagacgctatagacaacgtcgtaaaagaaaaggtcgactacatcaagcttgacattgaaggcgctgagcaaaacgccatcgagggagcttgcgagaccatcaaaaagtacaaaccaattttagctatctgcgtttatcataaggctgaagactggtacaaaatcccccagaaggttttagccatagaaaatgggtataagatttatcttagacattacatggaaggaatcttcgagacagttatgtacttcatccctccagttaaataa

SEQ ID NO: 16576 - protein, 168 aa, Unknown
  Obtained from environmental sample
  misc_feature (1)..(168): Xaa is any amino acid
MGGYVGDTASEVIKNYPDFKKIYLIEPIAENIRIAKRELGKYENIEFFSCGVSNKKETLHFNEEKSFSTIYGKGTQSVEVDAIDNVVKEKVDYIKLDIEGAEQNAIEGACETIKKYKPILAICVYHKAEDWYKIPQKVLAIENGYKIYLRHYMEGIFETVMYFIPPVK

SEQ ID NO: 16577 - DNA, 747 bp, Unknown
  Obtained from environmental sample
  misc_feature (1)..(747): n is a, c, g, or t
atgaaagcttttaatgcgttgcatgacaaaatgttaagagcaacaattactgatctttctgcgatgttaagaaaaattgttgatgtaaaactctatagtattgaacagatgacttatggggagtttattttatcaattcctcaaataacaagtttaaatactctgtcaataagacctttagagggtagaattgttatggagtgtaacccagcaatcagtcataaaataattgcacatttacttggaaatggtgatagtacattaactgattctacagagaaagagttaacggagatagaactagaagtatttaatcatttttatcaacttattacaaaacatcttaaaaaagcttgggaagatgtagcaacaatcaattttaaaacagaaagtatggatacaaatgccaatgctattcaaattatttcagatcatgagattgttttattggtcgtttttgagataacaattgatgatgaatctggatttttatcaatttgttatcctatctcttatatagagtctttactaaatgttatagttgaaaaaatatttgctgaagcaaaaaatagaaaagtaagtaagcaaaaagatattaatgcacttatgtccggttcanaaatgaaaattgatgctatgttagcagaaacagaactttctataaaagatttattaaatttaaaagaaaatgatgtaattgtatttagtaaaaatgcaagcagttcatcttcaaaatttatattataa

SEQ ID NO: 16578 - protein, 248 aa, Unknown
  Obtained from environmental sample
  DOMAIN (1)...(180): Flagellar motor switch protein FliM
  misc_feature (1)..(248): Xaa is any amino acid
MKAFNALHDKMLRATITDLSAMLRKIVDVKLYSIEQMTYGEFILSIPQITSLNTLSIRPLEGRIVMECNPAISHKIIAHLLGNGDSTLTDSTEKELTEIELEVFNHFYQLITKHLKKAWEDVATINFKTESMDTNANAIQIISDHEIVLLVVFEITIDDESGFLSICYPISYIESLLNVIVEKIFAEAKNRKVSKQKDINALMSGSXMKIDAMLAETELSIKDLLNLKENDVIVFSKNASSSSSKFIL

SEQ ID NO: 16579 - DNA, 894 bp, Unknown
  Obtained from environmental sample
  misc_feature (1)..(894): n is a, c, g, or t
atgacagatcggctgagactcttagtaaatatttttggattattttggatggtaatagcactttctgttttcccaatagtggatatattagacaatattaccaccaaccttttccaaacagattctgttcatgcgtctttaggagctccaataggcattgcactgttccattcaggttacaacattattaatgttgctataatggcttggtttattcctcaattagtacggttggctactaaaacaattaaatcgagaggagaaactgatgaagagtttagactagaacatattagtacaggaattatgactactcctgagatgtctattgttgaagctcagaaagaaatagctaaatttggtaagttaacccaccgaatgaaagagcaggtgttggaattgcttacagaacagaatcctaaaaatgttgataagcttctagcgaaaattaaaaaatatgaagacattacagatgatatagagagagatgtagccgattacttggcaaagatttcacaacgagaaatgagtgaagaatcttctatacaaattagaggaatgttaagcatcattggggatttagaacgaataggcgacattttttatcagatatctaaagtgttagaaagaaaatttgaggaaaaaatttggtttactcccgatcaaagaaaaaacattatagaaatgtttggaattttagatganaccttggtggtaatgaacaaaaatctaaaaacgaactatgctttagtaagcaaaaaagaagctgttgaagccgaacaaaagcttaatgcgttcagaaagaaattacgtanagagcactttaaaaatgtagaacaaggagcgtataattttaaaatgctgctatctataacgatattttccactcgttag

SEQ ID NO: 16580 - protein, 297 aa, Unknown
  Obtained from environmental sample
  DOMAIN (117)...(208): PhoU family
  misc_feature (1)..(297): Xaa is any amino acid
MTDRLRLLVNIFGLFWMVIALSVFPIVDILDNITTNLFQTDSVHASLGAPIGIALFHSGYNIINVAIMAWFIPQLVRLATKTIKSRGETDEEFRLEHISTGIMTTPEMSIVEAQKEIAKFGKLTHRMKEQVLELLTEQNPKNVDKLLAKIKKYEDITDDIERDVADYLAKISQREMSEESSIQIRGMLSIIGDLERIGDIFYQISKVLERKFEEKIWFTPDQRKNIIEMFGILDXTLVVMNKNLKTNYALVSKKEAVEAEQKLNAFRKKLRXEHFKNVEQGAYNFKMLLSITIFSTR

SEQ ID NO: 16581 - DNA, 867 bp, Unknown
  Obtained from environmental sample
  misc_feature (1)..(867): n is a, c, g, or t
ttgtcttataaaaaccacttttcaatcacttttatgagtaagcaacatgttgacgtaataataattggaggtggtgcagctggtttttttactgctatcaatattgctgaacttcaccctcatctttctgtggctattgtagaaaaaacttcacaactactaaaaaaagtaaagatttctggtggtggaagatgtaatgttacccacgcttgttttgaccctaaagaacttagtaattattatcccagaggaggaaaagaattgttaggtgctttttatcaatttcagccacttaacactattgaatggttcagctcaaaaaatattgaactaacaacagaaagtgatggacgaatgtttcctgtttccaacacttccgaaaccatagtaaattgctttttacaccttgctaaaaaacataaaatagctattattaccgaaaccaaagtagaaaaaattctgcccttaactgatggttttgaaattcaaaccaataacggagaatttactaccaacaaagtagtggttacagctggaggttttaacaaagcagaacaatatcagtttttaaccgatttaggacatagcattcaaccaccaattccatctctttttacatttaatttacctcaacaccccatttgcgaacttcagggaattagtgtaccccatgtagctataaaaattaaagatagtagttacaaagaagaaggtccgttattaattacccactggggaatgagtggtccggcagtactaaaacttagtgcttgngcagctcgttttctgcaagaaaaaaactataatttcacctattttgttaattggttgcccacttatcggcagaacaaattgcagaacagttaa

SEQ ID NO: 16582 - protein, 288 aa, Unknown
  Obtained from environmental sample
  DOMAIN (63)...(288): HI0933-like protein
  misc_feature (1)..(288): Xaa is any amino acid
MSYKNHFSITFMSKQHVDVIIIGGGAAGFFTAINIAELHPHLSVAIVEKTSQLLKKVKISGGGRCNVTHACFDPKELSNYYPRGGKELLGAFYQFQPLNTIEWFSSKNIELTTESDGRMFPVSNTSETIVNCFLHLAKKHKIAIITETKVEKILPLTDGFEIQTNNGEFTTNKVVVTAGGFNKAEQYQFLTDLGHSIQPPIPSLFTFNLPQHPICELQGISVPHVAIKIKDSSYKEEGPLLITHWGMSGPAVLKLSAXAARFLQEKNYNFTYFVNWLPTYRQNKLQNS

SEQ ID NO: 16583 - DNA, 375 bp, Unknown
  Obtained from environmental sample
  misc_feature (1)..(375): n is a, c, g, or t
ttgaaattcaggactgaatctgcaatggagcttattaggagattgagtgtaaaattgaatttcaacagcagaagggaggctaatgcgcaatcatacaacgcccgcaatagccttcttccacttcaatcgatgcctgccagaatggtgctgtctggcaaagaggaaggcggatatggacaattaattccaaccaaatctcacataaaattcttaatcttcttagaatttcacttcaacagcatcgaagaattcagcgccaaattatcattaatcttaaaactcttaaaatccccaccaaaagcaaagaaggggcattcagaagaaataccaataaaatcatattcaaagataaccagttccactggaccagtctaa

SEQ ID NO: 16584 - protein, 124 aa, Unknown
  Obtained from environmental sample
  misc_feature (1)..(124): Xaa is any amino acid
MKFRTESAMELIRRLSVKLNFNSRREANAQSYNARNSLLPLQSMPARMVLSGKEEGGYGQLIPTKSHIKFLIFLEFHFNSIEEFSAKLSLILKLLKSPPKAKKGHSEEIPIKSYSKITSSTGPV

SEQ ID NO: 16585 - DNA, 402 bp, Unknown
  Obtained from environmental sample
  misc_feature (1)..(402): n is a, c, g, or t
atgagtctaaaggtatataatatgaaatatggtgagcaagagatagttgaatttgatataaataaaaaagaaaactattggccaaatcaacataaaaaaaactacctaattgatattgagcttcctgaatttatggcaaaatgtccacgaagtggttatccagattttgcagagttaagactacagtatgtaccaaataaaaaagttatagaactaaaagctttgaaaatttatattaatacatttatgtatagagagatctctcatgaaaatggtgcaaatgagatttatgatactctttataaaaatctaaaaccaaaaaaaatgaaacttgtggcagattttaaaccaagaggtaatgttcatacagttatcactatagatagtgaaaataataagtag

SEQ ID NO: 16586 - protein, 133 aa, Unknown
  Obtained from environmental sample
  DOMAIN (35)...(130): GTP cyclohydrolase I
  misc_feature (1)..(133): Xaa is any amino acid
MSLKVYNMKYGEQEIVEFDINKKENYWPNQHKKNYLIDIELPEFMAKCPRSGYPDFAELRLQYVPNKKVIELKALKIYINTFMYREISHENGANEIYDTLYKNLKPKKMKLVADFKPRGNVHTVITIDSENNK

SEQ ID NO: 16587 - DNA, 663 bp, Unknown
  Obtained from environmental sample
  misc_feature (1)..(663): n is a, c, g, or t
atggaaaatcaatctataaaaaatgacctaatgaaagagaggagaactgtagattctctccttgaatcattatattttattgcaattttttatcaaaggcatacttcaaaagactctttaatgtcaggtcttccactccataatagttcaatgtctattgatgactttttaatctcttcaaaaagaattggtcttatctcaaaagtagtaaaacgggaactcaaaggtatatcaagacttgctttacctgctattttaattcttgaaaaaaatagagcttgtgttttacttgatatggattttgacaaagggactgcacaagtaataatccctggacttagtgaaggtgaaatcactatgtcaatagaagatttagaaagagaatttatacaacaagtcatcatcataaaacctacttataaatttgaaaataaagtttcaaatgaaatcgtaataccaaagccaaaagactggttttggggtgcatttagagcaaatttacctatatataaaaaagtgatagtagcggcaatatttatcaatctttttgtacttgctatgccacttttcatgaaaaatgtttttgatagagttttaccaaataatgctattggaaacacttcttgctatgacttttggnattgtatttattttagtatttga

SEQ ID NO: 16588 - protein, 220 aa, Unknown
  Obtained from environmental sample
  misc_feature (1)..(220): Xaa is any amino acid
MENQSIKNDLMKERRTVDSLLESLYFIAIFYQRHTSKDSLMSGLPLHNSSMSIDDFLISSKRIGLISKVVKRELKGISRLALPAILILEKNRACVLLDMDFDKGTAQVIIPGLSEGEITMSIEDLEREFIQQVIIIKPTYKFENKVSNEIVIPKPKDWFWGAFRANLPIYKKVIVAAIFINLFVLAMPLFMKNVFDRVLPNNAIGNTSCYDFWXCIYFSI

SEQ ID NO: 16589 - DNA, 762 bp, Unknown
  Obtained from environmental sample
  misc_feature (1)..(762): n is a, c, g, or t
ttgtataatgctgtgcagatatcaggcccgtctttgcaaattcctgaatttccagattttatagtaaaagaaaaagatgatgaaatcaacaggagtgttatagttggtggcaggcagtataatgtaattgaaaaaaagcttattcttatccccacaaaatcaggacaatatacaattgcgccggctgtgttgaattgcaatgttgctataaaagataatacaaggcgaaatgatccttttgattctttgtttaatgattcattcttcaggcgctcgcgtatgaaaagaaagatattgcgaactaatacacttggactaaatgtgaaaaaacttcctgcctatccttttgattttaatttttcaggagtagtcgggcgggtaagcatgagtgcttcaatcgaagaaaaaaaattaaaagccggagattcaacaacgtttacaattattattaaaggcaatggtaatataatggatgctgaagaacctttcgttgatgtgccggaaggctttaaggtttataaagataatcctgaagaagaaatcaaaaaaggaataaagggatattccggaaaaaaaatctttcgtatggctattgtggctgttgaatcaggtaaatatacaattccaaaaataaaatccagttattttgatgttcatagtggaaaataccgattgcttgaagcagggcctttttctataagtgttgcgccttcccaaccagaaaatttcataaaaaataaagttttatcggcagacaaataa

SEQ ID NO: 16590 - protein, 253 aa, Unknown
  Obtained from environmental sample
  misc_feature (1)..(253): Xaa is any amino acid
MYNAVQISGPSLQIPEFPDFIVKEKDDEINRSVIVGGRQYNVIEKKLILIPTKSGQYTIAPAVLNCNVAIKDNTRRNDPFDSLFNDSFFRRSRMKRKILRTNTLGLNVKKLPAYPFDFNFSGVVGRVSMSASIEEKKLKAGDSTTFTIIIKGNGNIMDAEEPFVDVPEGFKVYKDNPEEEIKKGIKGYSGKKIFRMAIVAVESGKYTIPKIKSSYFDVHSGKYRLLEAGPFSISVAPSQPENFIKNKVLSADK

SEQ ID NO: 16591 - DNA, 837 bp, Unknown
  Obtained from environmental sample
  misc_feature (1)..(837): n is a, c, g, or t
gtgcctaataaaatactttttgaaggaacaaaacaagctgaagaagcttttgtttggtggaaaactaattttggtgaagatttttatgtggaaattaatcgtcatggagtacaagaagaagaagcggtaaataaagtattattagattttgctaagaaatacgatgtaaaacctatagcaacaaacaatacttattatatagataaaatagatgctgtttcgcaagatgtgttgttgtgtattggtggtggaaataaagtttctcaaccaaaaaaatacataggttctaaaggcagagagttcaggtttggctttccaaatgatgagtattattttaagtcgaaggatgagatgaaacagctttttgctgatatgccggaagctattttaaatacagttgaggtagccgataaagtagaaccttttaaattagagcgagatgtattgcttcctaaatttgatattcctgataaatttaaagaccctaaggatgaagaagattcaaccttaaaaattggagaaaatgcttatctccgccatataacttacgaaggagcaaaagaacgctatggagaaattactgatgagcttagggaaagaatagattttgagttgggcgtaattaaaaagactggttatccaggatatttcttaattgtagaagattttattagagaagctcgcaaaatgggagtttctgttggaccangtagggggtctgcagcaggttcggtagttgcttattgtacaaaaattaccaatatagaccctataaagtacgatttactttttgagcgtttcttaaatccccgacgtaattccatgcccgaatattga

SEQ ID NO: 16592 - protein, 278 aa, Unknown
  Obtained from environmental sample
  misc_feature (1)..(278): Xaa is any amino acid
MPNKILFEGTKQAEEAFVWWKTNFGEDFYVEINRHGVQEEEAVNKVLLDFAKKYDVKPIATNNTYYIDKIDAVSQDVLLCIGGGNKVSQPKKYIGSKGREFRFGFPNDEYYFKSKDEMKQLFADMPEAILNTVEVADKVEPFKLERDVLLPKFDIPDKFKDPKDEEDSTLKIGENAYLRHITYEGAKERYGEITDELRERIDFELGVIKKTGYPGYFLIVEDFIREARKMGVSVGPXRGSAAGSVVAYCTKITNIDPIKYDLLFERFLNPRRNSMPEY

SEQ ID NO: 16593 - DNA, 564 bp, Unknown
  Obtained from environmental sample
  misc_feature (1)..(564): n is a, c, g, or t
atgaaatttatagataatgatctctcttatgcacagcaaaaagagagagaaagaagatttaaattagcacttcgtatgggacttcccatatttgcgtttgcttctcttcttactttttcacttctaagcgaatatttcagtaaaattcctcaatcttttttaataatagcagtaggtatattagctattatgatctattttttcttctatatgatatatagaggatttgatgaacgtattactgacagtgtaacagatactctaaatcgtaagaatatattagaacttttttcacatgagcttaaaaaaagagaaaattatacagttgcactgatatctattgataatataaacagtataaatgaagagtatggatttataaatggtgataatattttaaaagatgtatcaaattatatctctaaattttttcttgataagttgtataagagagttccaatagggcatataaaaggcggagattttttagttggatttgatacaaaaaaagatgatgttaaagctttaatagatatgttggaatttaaaattagattcaattga

SEQ ID NO: 16594 - protein, 187 aa, Unknown
  Obtained from environmental sample
  misc_feature (1)..(187): Xaa is any amino acid
MKFIDNDLSYAQQKERERRFKLALRMGLPIFAFASLLTFSLLSEYFSKIPQSFLIIAVGILAIMIYFFFYMIYRGFDERITDSVTDTLNRKNILELFSHELKKRENYTVALISIDNINSINEEYGFINGDNILKDVSNYISKFFLDKLYKRVPIGHIKGGDFLVGFDTKKDDVKALIDMLEFKIRFN

SEQ ID NO: 16595 - DNA, 381 bp, Unknown
  Obtained from environmental sample
  misc_feature (1)..(381): n is a, c, g, or t
atgaaatatggtgaaaaaatagtaaatgagtttgatgtagagaaagatttagaaatcgggccaaatgagcatgatcgtacctatttgattaagatgacgcttcctgagtttagctgtctatgtcctagaagcggttatcctgattatgcaacgatctacttagagtacacacctgataagctggtagtagagctaaaagctattaaactctatataaactcttttagagatcgtcacatttcacatgagaacagtgcaaatgagatttatgatgttttagataaaaagttaaagccaaaatatatgaaagttgtagcagattataaccctagaggaaatgttcatactgtcatagagatagatagtagtaaaattatttaa

SEQ ID NO: 16596 - protein, 126 aa, Unknown
  Obtained from environmental sample
  DOMAIN (28)...(124): GTP cyclohydrolase I
  misc_feature (1)..(126): Xaa is any amino acid
MKYGEKIVNEFDVEKDLEIGPNEHDRTYLIKMTLPEFSCLCPRSGYPDYATIYLEYTPDKLVVELKAIKLYINSFRDRHISHENSANEIYDVLDKKLKPKYMKVVADYNPRGNVHTVIEIDSSKII

SEQ ID NO: 16597 - DNA, 456 bp, Unknown
  Obtained from environmental sample
  misc_feature (1)..(456): n is a, c, g, or t
ttgacagatagcttagttagacttatttcaattttaaagtctcaaaaatattctgacttagcattcaaaaaaagaataatttcatcaatggtcgaacttcttcaaaatataattcttcacgggaaacgaaacatcgaagatagaaattattcgccaggaattttttatattagtcaaaaaggaaacattttcaacctaaataccgttaattatattttaaatactgaaaccgaaaaactcgacaaaaaattgactaatctaaactctttaaacaaagaagagttagaagactcttacaacgaacaattatttgatttttctgatgatggacaaaatgcaggtcttggttttatagaaatgaaaatgaaaagtaaaaataatctaacatttagcttttcaaaagtagatgaaaaatactctttatttaatttgaaattaacttttatcgacaactaa

SEQ ID NO: 16598 - protein, 151 aa, Unknown
  Obtained from environmental sample
  misc_feature (1)..(151): Xaa is any amino acid
MTDSLVRLISILKSQKYSDLAFKKRIISSMVELLQNIILHGKRNIEDRNYSPGIFYISQKGNIFNLNTVNYILNTETEKLDKKLTNLNSLNKEELEDSYNEQLFDFSDDGQNAGLGFIEMKMKSKNNLTFSFSKVDEKYSLFNLKLTFIDN

SEQ ID NO: 16599 - DNA, 375 bp, Unknown
  Obtained from environmental sample
  misc_feature (1)..(375): n is a, c, g, or t
atgcaacaactaataataaaaaaaacggaagaaactcctgcaatcattcttaacccacaaagaaagatttttcaacttgttgcaacttcgtggcctgaaaatgcaaaaacattttacgaacccgtttttaactggataaacgaatatttcacaaacgcacctctcgaagaaacaatttttcaatttagatacagctactttaatactgcatctgcaaaacaaatagcaaaactacttactcttcttaaaaaatattcaaataaccataacgttaaaattcattggtactccgaaaaagatgactatgacatggaaaaagaaggacgaagattttctgctatcctnaaatttgaatttgaattcaaagaanaataa

SEQ ID NO: 16600 - protein, 124 aa, Unknown
  Obtained from environmental sample
  misc_feature (1)..(124): Xaa is any amino acid
MQQLIIKKTEETPAIILNPQRKIFQLVATSWPENAKTFYEPVFNWINEYFTNAPLEETIFQFRYSYFNTASAKQIAKLLTLLKKYSNNHNVKIHWYSEKDDYDMEKEGRRFSAILKFEFEFKEX

SEQ ID NO: 16601 - DNA, 402 bp, Unknown
  Obtained from environmental sample
  misc_feature (1)..(402): n is a, c, g, or t
ttggctcagaaatatgaaatatgtggaatagagataaaatcaaattatgcgatactaagtgtagtagaggaggggagttattttgatttaaaaataaaaaaactcatattagaagatgatgaactacaaaataatatagtacttttcaaggagagtttagaatcctttctcaatgagaatcaaatagaaaaaatcactatcaagaagcgttcaaaaaaaggaaactttgcaggtggtgctgttacatttaaaatagaaacaattatccagttaaatagtatgtgtgaagttgggtttatatctggtcaagttttgagtaaatttgagaagaaaaatgaaatcatctatccaaaaagtttaaataaataccaagaacaaagttatctttgttgtttggtatag

SEQ ID NO: 16602 - protein, 133 aa, Unknown
  Obtained from environmental sample
  misc_feature (1)..(133): Xaa is any amino acid
MAQKYEICGIEIKSNYAILSVVEEGSYFDLKIKKLILEDDELQNNIVLFKESLESFLNENQIEKITIKKRSKKGNFAGGAVTFKIETIIQLNSMCEVGFISGQVLSKFEKKNEIIYPKSLNKYQEQSYLCCLV

SEQ ID NO: 16603 - DNA, 417 bp, Unknown
  Obtained from environmental sample
  misc_feature (1)..(417): n is a, c, g, or t
atgagtatttattgtaaaattagaataggtgataacatgaataatttaaagagtataaggaagaatagaaaactatctcaactggaattatctgaagcaataggattacctcaaactacatattcaagatatgaacgaggaacttctaagcttgattcagatactttagtgaagttatcagagtactataatgtttctacagactacctacttggactaattgagattcctttaacttcagaacaagcaatattcattaagaaaattcagcaagaagaagatcctgagaaaattgctgaagagttcgaagtactcttaggtgatcgtgttgtaactggtaaagaattattagaacttttgaacactatgaaaaaattggatgaagcagtccacggagatttttttaagaaaaaataa

SEQ ID NO: 16604 - protein, 138 aa, Unknown
  Obtained from environmental sample
  DOMAIN (16)...(70): Helix-turn-helix
  misc_feature (1)..(138): Xaa is any amino acid
MSIYCKIRIGDNMNNLKSIRKNRKLSQLELSEAIGLPQTTYSRYERGTSKLDSDTLVKLSEYYNVSTDYLLGLIEIPLTSEQAIFIKKIQQEEDPEKIAEEFEVLLGDRVVTGKELLELLNTMKKLDEAVHGDFFKKK

SEQ ID NO: 16605 - DNA, 858 bp, Unknown
  Obtained from environmental sample
  misc_feature (1)..(858): n is a, c, g, or t
ttgaacatatttagcaaaagcagatttgtaattattttaaccataattcccagcatatgtatattttctcagtcagcgttatcactaaagaataatagtcacacatatataaaatctaacttagagtttctttctgcggatgaattggaaggtagagaagcagcttcaaggggagagaaaatagcggccttatttatttctgaggaattagaaaagtatggagtattgccatatggagataatggaacttattttcaagattttggagttataacttcaaggtattctgatgagagcaacgcaacattaattatagacggaaaagaacacaattaccttaatggctccgatatggtgtttagttcaagatcgctgccaagcaataagtataataataaagaatatgaaatagtttttaccggctatggaattacttctgatgaagataattacgataattacaaaaatatagatgtaaaaaacaaagtcgtaatgtttattaatggaactcccaaagctgatggccaagaatttttaagtaagtccgttatcaataaatttggaaaatcatctacagaaaaaataaagttagcacaaatgaatggagcagttggggttatcattttaccagatgaaaaaattcttaaatattgggaatacaatacaaggtggacgaagaatgaatcattcaaattagaagaagaagttgatacaacagaaattggtaaaagtattcctgctattattctaagtgaaaactccagtaaattattgttggaaaatgaagcgcaaaattttgaatttattactaagaactccgatcctcatnctaaatcttttttattaaaatcaaattaa

SEQ ID NO: 16606 - protein, 285 aa, Unknown
  Obtained from environmental sample
  misc_feature (1)..(285): Xaa is any amino acid
MNIFSKSRFVIILTIIPSICIFSQSALSLKNNSHTYIKSNLEFLSADELEGREAASRGEKIAALFISEELEKYGVLPYGDNGTYFQDFGVITSRYSDESNATLIIDGKEHNYLNGSDMVFSSRSLPSNKYNNKEYEIVFTGYGITSDEDNYDNYKNIDVKNKVVMFINGTPKADGQEFLSKSVINKFGKSSTEKIKLAQMNGAVGVIILPDEKILKYWEYNTRWTKNESFKLEEEVDTTEIGKSIPAIILSENSSKLLLENEAQNFEFITKNSDPHXKSFLLKSN

SEQ ID NO: 16607 - DNA, 810 bp, Unknown
  Obtained from environmental sample
  misc_feature (1)..(810): n is a, c, g, or t
ttgttggaaaatgaagcgcaaaattttgaattattaactaagaactccgatcctcatcttaaatcttttttattaaaatcaaaattaagatttgattataattttcaagttaagaataaaacagcaagaaatattattggattaataaaaggcgcaaataaaaatttgaaggatgaatatcttacaatgggtgctcattatgatcatgaagggattaaaaatggggaagtttataatggggctgatgataatggttctggaacagtcacacttttagaggttgctagaaagctatctattagcaaagaaaacgaaagacctattattgtaatatttcacactggtgaagaaaaaggattaaagggttcaaaatatttaaccaataattcgaattttatggatagcgtaatagtccatgttaatgttgatatggttggaagaaaaagtgaagattctatttattgtataggtgccagtaaaattagtagcgaacttggggaattaattaaagatgtaaatcttgaaacaaccaactttcatttggattataaatttgatgatccaaacgatcataatagattttactatcgaagtgatcatataaactatgcgaagaaaggaattccaattgcctttttctatgattatatgaaaaccgattatcataaaccgaccgatactgtagacaagattaactttgataaaatagtgagaatgacagatttgatttataatttgtttgttaagatttctaatcttgatcacaaattattagttgatgaactatcaactaatctcagccgaatctga

SEQ ID NO: 16608 - protein, 269 aa, Unknown
  Obtained from environmental sample
  DOMAIN (59)...(128): Peptidase family M20/M25/M40
  misc_feature (1)..(269): Xaa is any amino acid
MLENEAQNFELLTKNSDPHLKSFLLKSKLRFDYNFQVKNKTARNIIGLIKGANKNLKDEYLTMGAHYDHEGIKNGEVYNGADDNGSGTVTLLEVARKLSISKENERPIIVIFHTGEEKGLKGSKYLTNNSNFMDSVIVHVNVDMVGRKSEDSIYCIGASKISSELGELIKDVNLETTNFHLDYKFDDPNDHNRFYYRSDHINYAKKGIPIAFFYDYMKTDYHKPTDTVDKINFDKIVRMTDLIYNLFVKISNLDHKLLVDELSTNLSRI

SEQ ID NO: 16609 - DNA, 735 bp, Unknown
  Obtained from environmental sample
  misc_feature (1)..(735): n is a, c, g, or t
ttgatgaaatttaaagctgaattggaaaattttggtagagagatacaagttttaaacgacaacttctatattgagcttgattctcttaaaagtgctaaaaaagtaatcaatccgctaaatgaagcactaataattacactcttacaacaacaactaaacagtgttgaagagctagttaaaaaacaatccgagcatattaaaaaactaaatgaaattggtgttgctctgtcgtttgaacatgacctagataagcttttagaactgattttaaaacaggctaaaatatttactaatgctgatgccggaactctatatatgatgagtgaagataaaaaatcactccactttagagtggttgaaactgattcattaaatattaagatgggaggttcaggtgacataatttcttggcctccacttgaactttatcgtgctgatggctctgaaaacagagagatggtagccgctgtttgcgcactagatggagatatgattaatattcctgatgtttatgagagtaaaggttttaactttaacggaacaaaagcatttgataaaagtaccggtttcaaatctacgtcaatgcttgtaattcccatgaaaaataatgataatgaggtagtaggtgtttgtcagcttataaaccgtcaaaacagtattggttttgtcactcaattttctataaatgatgaagagggtatcaaacctcttgcatctcaagctgcagtgccctga

SEQ ID NO: 16610 - protein, 244 aa, Unknown
  Obtained from environmental sample
  misc_feature (1)..(244): Xaa is any amino acid
MMKFKAELENFGREIQVLNDNFYIELDSLKSAKKVINPLNEALIITLLQQQLNSVEELVKKQSEHIKKLNEIGVALSFEHDLDKLLELILKQAKIFTNADAGTLYMMSEDKKSLHFRVVETDSLNIKMGGSGDIISWPPLELYRADGSENREMVAAVCALDGDMINIPDVYESKGFNFNGTKAFDKSTGFKSTSMLVIPMKNNDNEVVGVCQLINRQNSIGFVTQFSINDEEGIKPLASQAAVP

SEQ ID NO: 16611 - DNA, 348 bp, Unknown
  Obtained from environmental sample
  misc_feature (1)..(348): n is a, c, g, or t
atggtaatgcctaattatttagataagtttgttgatcgtattgagaaagcagggttaaataagacagttganaaatccttcagtttctattataaccaagttcttcagggtgaaaccggtattatgtctgagactgaaatatctcctccagagaaagagtttattgttgactatacaaagcttgagagtgggaaagaagcaccttttgataagctggttgttattaaattaaacggtggtttaggcacaagtatggggctttctcaagtaaaatctctccttanngtaaaggatgagtacacttttctggatattatctctcaacagattttacgtttaagaagagaa

SEQ ID NO: 16612 - protein, 116 aa, Unknown
  Obtained from environmental sample
  misc_feature (1)..(116): Xaa is any amino acid
MVMPNYLDKFVDRIEKAGLNKTVXKSFSFYYNQVLQGETGIMSETEISPPEKEFIVDYTKLESGKEAPFDKLVVIKLNGGLGTSMGLSQVKSLLXVKDEYTFLDIISQQILRLRRE

SEQ ID NO: 16613 - DNA, 483 bp, Unknown
  Obtained from environmental sample
  misc_feature (1)..(483): n is a, c, g, or t
ttgaaagagtatctgatgcagaacaataactttcttcatttacctatgattttaaataaaaaagtagtaggggagacaccagtatatcaaattgaaacggcaatgggtgctgcaatcaacgtttttgaaggtgcaaaagcaatccaagttcccagaaagcgatttgttcctgtgaagaaaactaatgaattattagctctttggtcagatgcctatatttttgatgataatttcaatataatgcttaatgatggtcttgaaaaatcacctcaaatttctttgggagatcattacaataccatagatcagatgcttcaaagaattaaatccactccctctttaaaaaattgtagttccctggaagttgaaggagatgtcagctttgaggaaaatgtgattattaagggtaaatgtactattaaatcaacccaaaagatcacattaagagatattattattgacaatgaagatgtaaaaaattag

SEQ ID NO: 16614 - protein, 160 aa, Unknown
  Obtained from environmental sample
  misc_feature (1)..(160): Xaa is any amino acid
MKEYLMQNNNFLHLPMILNKKVVGETPVYQIETAMGAAINVFEGAKAIQVPRKRFVPVKKTNELLALWSDAYIFDDNFNIMLNDGLEKSPQISLGDHYNTIDQMLQRIKSTPSLKNCSSLEVEGDVSFEENVIIKGKCTIKSTQKITLRDIIIDNEDVKN

SEQ ID NO: 16615 - DNA, 843 bp, Unknown
  Obtained from environmental sample
  misc_feature (1)..(843): n is a, c, g, or t
atgagggataatgtgtttacaacaagtgagtatgaacatataaacgaagaatatacaagaatacttgactcaaaaatgaaaaagttgaaagttgtttcagttagaatactgattgtatatattgtgtttttcatttctgcacttttcattagaggcatatcaagttcccttagagaattcatagctccgattataggatcaatatgcttgacaggattaataattttcatggggctcattgtttttgttttagtaagttatcaatataaaagtagtaaacctttttatgattatgttatgaaaaaaatagttgaaaagattaataataatctggagataaatattcaattagtcgatatagtgaaaactaaatatgattttaattttaagggtggattgtttactagatattgtactactaaagtcagaatgcatcttcaaggagattcaattaacggaaagcactttgatatgtatgagactatattatctacaagtaatggtaaatcgcaatcaatacatctgaatggaatttatatcgtcactccatcaaatgaaaccttttatcaacaaattagaagcaatggaagccctcatctaacaggtaaaaagtataagttgattgaaaaaatagatggatacaaaaactatttgaatgatgaatctatgattggtgcaaattataagtatgtaaatttgtttaagaatcttcataaaactttaagatataaaaaagcatatatgtcaattattgaaaaagaaattcatttcgctgttcaacctgttacactatataagtataaagaattaagttcaaaaattagattagctcagccgatctga

SEQ ID NO: 16616 - protein, 280 aa, Unknown
  Obtained from environmental sample
  misc_feature (1)..(280): Xaa is any amino acid
MRDNVFTTSEYEHINEEYTRILDSKMKKLKVVSVRILIVYIVFFISALFIRGISSSLREFIAPIIGSICLTGLIIFMGLIVFVLVSYQYKSSKPFYDYVMKKIVEKINNNLEINIQLVDIVKTKYDFNFKGGLFTRYCTTKVRMHLQGDSINGKHFDMYETILSTSNGKSQSIHLNGIYIVTPSNETFYQQIRSNGSPHLTGKKYKLIEKIDGYKNYLNDESMIGANYKYVNLFKNLHKTLRYKKAYMSIIEKEIHFAVQPVTLYKYKELSSKIRLAQPI

SEQ ID NO: 16617 - DNA, 795 bp, Unknown
  Obtained from environmental sample
  misc_feature (1)..(795): n is a, c, g, or t
atgaaaataaaagaatcttataatgaaataaaacatattttagactcaactatggagtgtgtttttatttttgaaaatgggtattgtatagatgtaaatgatgaaactgtacgattatttggttatcctgataaaaatacaatgttaggaaaaaaagctacagaatttgttgcaaataactctgtagtaactgttgcaaataatatccaaaataactataccaaagcttatgagatagagatgaaaagatatgatggaacaacttttccaggttttgtaaaagggagtagctttacaagaagagataagcttgtaagagttaccactgcattagatttaacagaattaaaatctaaagagtccctattgatacaacaatcaaaaatggctgcattaggagagatgatagcaaatatttcacatcagtggagacaaccattaagtattattactactgttgctagtggaataaaactcaaactagaatataatgtctttaataaagaagatgagataaaaaacttagatattcttatcaattcagcaacttatttatcaactactattgatgattttaaaaattttataaatccaaaaaaaataaataaaaaatttaatataaaaacaattataaataaaacaattgaaatgtttggtaaaaatttttcaagtcatggtattgatattattacaaatattcaagatacagaaactattggaaacgaaaatgaattgctacaagtaattatcaatatccttaataactcaaaagatgttttaactcacaaaaattag

SEQ ID NO: 16618 - protein, 264 aa, Unknown
  Obtained from environmental sample
  DOMAIN (131)...(201): His Kinase A (phosphoacceptor) domain
  misc_feature (1)..(264): Xaa is any amino acid
MKIKESYNEIKHILDSTMECVFIFENGYCIDVNDETVRLFGYPDKNTMLGKKATEFVANNSVVTVANNIQNNYTKAYEIEMKRYDGTTFPGFVKGSSFTRRDKLVRVTTALDLTELKSKESLLIQQSKMAALGEMIANISHQWRQPLSIITTVASGIKLKLEYNVFNKEDEIKNLDILINSATYLSTTIDDFKNFINPKKINKKFNIKTIINKTIEMFGKNFSSHGIDIITNIQDTETIGNENELLQVIINILNNSKDVLTHKN

SEQ ID NO: 16619 - DNA, 699 bp, Unknown
  Obtained from environmental sample
  misc_feature (1)..(699): n is a, c, g, or t
atgcgttttagtgttgaagagtatgcaaaacattttaaaatgtcaaaagagatggtttattcaaaactaaaatctaatcggttggcttatgttgtggaaggtgatgtcacttatattgttgtaaatgacagtagtggtgcagacaaagaaaacagtgtagaaaataaaataatgattacagatcagcttaaacctaaaaatgttattcctgctaaaaaaacaactactgtgggaactataatttcactatatcaaagagagaacttacaactcaaagagagagtgaaaagtttagaagataaaatagatcgtctaatagacgataaagagaagatgcttcaagaagagagagagagaattgagagagtctacattgcaaaagatgaacaattaaaatctattttggatcttgtaaatacaaaacttcaactaagtagtcatgatactgttcatgatgtaggtattgaagaagaaaataactactctgagatcatacaaacagaagattttattgagttaaatagatatctaaaatcaataaatgtaaattctcatttgagaaagcagataaganaacgttttgaaaaagcttacaggcacgatgtcagagttattaaacaaaatggtctattttttttagatttttcaaaatatgactatagtaatctactaaaaagagagatagcagatgacaattga

SEQ ID NO: 16620 - protein, 232 aa, Unknown
  Obtained from environmental sample
  misc_feature (1)..(232): Xaa is any amino acid
MRFSVEEYAKHFKMSKEMVYSKLKSNRLAYVVEGDVTYIVVNDSSGADKENSVENKIMITDQLKPKNVIPAKKTTTVGTIISLYQRENLQLKERVKSLEDKIDRLIDDKEKMLQEERERIERVYIAKDEQLKSILDLVNTKLQLSSHDTVHDVGIEEENNYSEIIQTEDFIELNRYLKSINVNSHLRKQIRXRFEKAYRHDVRVIKQNGLFFLDFSKYDYSNLLKREIADDN

SEQ ID NO: 16621 - DNA, 483 bp, Unknown
  Obtained from environmental sample
  misc_feature (1)..(483): n is a, c, g, or t
gtggaaaaaactttagaattccagattttaaataacgtgagaaaggaaatgaagattggagaggactatatcggggttggagggggcgttcttattttcaacgagaatgatgagattttgcttttgaaaagagggactgaatctaaaaatgaagttggtttttggcaaaaaccaggaggagaggttgattatggtgaaagagtaatcaattcaatgaaaagagaaattgaggaggaaactggtttaattgtcgaaatttggggatatttaccccatactgatcatattatcgaaaaagatcagcaacattgggttgccttcaattatcttgggagagtaacttcgggtgttgctaaaattgtggagccccaaaaatgtgaaaagttgggctggttctctctggatgatttacctaaggaaattcaacaaacaacaagagaatcagttgaaaattttctcgaaggaaggtatattaaaatttag

SEQ ID NO: 16622 - protein, 160 aa, Unknown
  Obtained from environmental sample
  DOMAIN (24)...(155): NUDIX domain
  misc_feature (1)..(160): Xaa is any amino acid
MEKTLEFQILNNVRKEMKIGEDYIGVGGGVLIFNENDEILLLKRGTESKNEVGFWQKPGGEVDYGERVINSMKREIEEETGLIVEIWGYLPHTDHIIEKDQQHWVAFNYLGRVTSGVAKIVEPQKCEKLGWFSLDDLPKEIQQTTRESVENFLEGRYIKI

SEQ ID NO: 16623 - DNA, 477 bp, Unknown
  Obtained from environmental sample
  misc_feature (1)..(477): n is a, c, g, or t
atgtcccacttcaatgttggaaggnccaatgataataaatatctaaatgatgaactagataagacaagaactaaaaacaatcctcaaatgctttcaaaagatgaagccggacgaggacttataaaagctttaaaaaatgatagaatagttggtttgtttattgatcaacataattcagcagggatagatgtgaattttttaggacatagagtaaaacaaactgattcctcttctaaactttcagtaaaatttaatgccattattttacctctattttttactatggatagttttggaaaatacactgcaaagttttatgagccacttgagccatctaagtatgaaggtgaagatcaaatacttaagcttacacaagcccaagctgatatcatggagaaacacatcctcgaaaaacctgaacaatggttttggcaacataaaagatttaaacaatacaatagtgaaatttatgaataa

SEQ ID NO: 16624 - protein, 158 aa, Unknown
  Obtained from environmental sample
  misc_feature (1)..(158): Xaa is any amino acid
MSHFNVGRXNDNKYLNDELDKTRTKNNPQMLSKDEAGRGLIKALKNDRIVGLFIDQHNSAGIDVNFLGHRVKQTDSSSKLSVKFNAIILPLFFTMDSFGKYTAKFYEPLEPSKYEGEDQILKLTQAQADIMEKHILEKPEQWFWQHKRFKQYNSEIYE

SEQ ID NO: 16625 - DNA, 711 bp, Unknown
  Obtained from environmental sample
  misc_feature (1)..(711): n is a, c, g, or t
ttgtctctttatattatggaaaatatattaaactataatccaaaagattcaaaagatgatagtagagacagatttattatttcaaaaggtcatggttctatctctatgtatccattgctcgcagatattggattttttgataaaagtgaattaaataatgtatgtaaagatggtacatttttaggtggtattccagatcctattattccaggatatgagacggttaacggttcattaggacatggtttaggagtaggatgtggtatggcggtagccttaaaaactaaacaaaaaaaacaaagtgttgtagttcttactggtgatggtgaattaaatgaaggctcgaattgggaagctattatgtttgctcctcagcataaactagataatttaactttaatagtagattataataaagtttcaatgcttgattttagtaaaaatattatagatatgaattcattaaatgaaaaattcatagcatttaattggaaagtttatgaagttattgatggacataatgtagatgaagttcatgtagttttaaaagaagctattaacgatagaagcaataaaccaaaagtaattattgtaaatacgataaagggtaaaggcgtaccatttttggaaacacactctttaagtcatatactatcagtaaaaccagaagatattgatactttgatagaggagattcaaaatgcagattaa

SEQ ID NO: 16626 - protein, 236 aa, Unknown
  Obtained from environmental sample
  DOMAIN (1)...(234): Transketolase, thiamine diphosphate binding domain
  misc_feature (1)..(236): Xaa is any amino acid
MSLYIMENILNYNPKDSKDDSRDRFIISKGHGSISMYPLLADIGFFDKSELNNVCKDGTFLGGIPDPIIPGYETVNGSLGHGLGVGCGMAVALKTKQKKQSVVVLTGDGELNEGSNWEAIMFAPQHKLDNLTLIVDYNKVSMLDFSKNIIDMNSLNEKFIAFNWKVYEVIDGHNVDEVHVVLKEAINDRSNKPKVIIVNTIKGKGVPFLETHSLSHILSVKPEDIDTLIEEIQNAD

SEQ ID NO: 16627 - DNA, 753 bp, Unknown
  Obtained from environmental sample
  misc_feature (1)..(753): n is a, c, g, or t
ttgaaagaatgggatgccagggaagcagctgatcttatatcagatggttccataccaaaaaatacctattttgttgattgtggacttgtactaaacagtgaaaagggattatttgatcatcatcaggacagagatcttgatagtgcagtactattaatttttaataagtacttctcccacatgaaaaatacagaacttcatgattatatcaggctggtttctaaagttgacacaaagggagcaatgagtcttgatgattttcatcttatcagtgagagcagagactacttctcatttggacagagtattttacttaaaacatttgaaaatgatccaatgctgattcttaaaatttttattgccggccttgatgacaaaatttcttttgaaaaacaaaagcaaaaagctgatacctggttaaaaagtcccggaaatattgaaatattgaatattgaacatattaaggtaatcaaatatctaaaaaaagctccatctgaattggtttcacctattagatctgttatttcaaaaatagttgataaaaatgatattactgcaatattatcttttgatgataaaatgcccgatgttttaactctttttaggactaactatggacacaatattattaatttttcaaattcagaaccaaaagagactatttttaatcacaaaggtgggtttttaatgaaatttattccttctgatgaaaaagaatggattaaattgattaatgaatctataaattcataa

SEQ ID NO: 16628 - protein, 250 aa, Unknown
  Obtained from environmental sample
  misc_feature (1)..(250): Xaa is any amino acid
MKEWDAREAADLISDGSIPKNTYFVDCGLVLNSEKGLFDHHQDRDLDSAVLLIFNKYFSHMKNTELHDYIRLVSKVDTKGAMSLDDFHLISESRDYFSFGQSILLKTFENDPMLILKIFIAGLDDKISFEKQKQKADTWLKSPGNIEILNIEHIKVIKYLKKAPSELVSPIRSVISKIVDKNDITAILSFDDKMPDVLTLFRTNYGHNIINFSNSEPKETIFNHKGGFLMKFIPSDEKEWIKLINESINS

SEQ ID NO: 16629 - DNA, 300 bp, Unknown
  Obtained from environmental sample
  misc_feature (1)..(300): n is a, c, g, or t
gtggtgctaaaaggtaacttaccagaaaaattaaaaaatgatgctgaaatgtatgctggatgcgtatcaggggcaatccaattagatgaatatttagagattattaaaaattcaggctttaaaaatattaccgttcaaaaagaaaaaagcattgtattgcctaaagagattgttgctgaatatttatctgagcaagaactaacgaaatattacgaatctccagactttggtatttatagtgtaacggtttatgctgaaaaagccgaaagttgttgtgatccaaattcaaactgttgttaa

SEQ ID NO: 16630 - protein, 99 aa, Unknown
  Obtained from environmental sample
  misc_feature (1)..(99): Xaa is any amino acid
MVLKGNLPEKLKNDAEMYAGCVSGAIQLDEYLEIIKNSGFKNITVQKEKSIVLPKEIVAEYLSEQELTKYYESPDFGIYSVTVYAEKAESCCDPNSNCC

SEQ ID NO: 16631 - DNA, 813 bp, Unknown
  Obtained from environmental sample
  misc_feature (1)..(813): n is a, c, g, or t
ttggctgaggaagcattctatgccgcagctgattcgactaaatttactgaccaattggacgagctaaaaacttggcagaccaagcgtatctattggaatacctggataccaaatgatcaagcaatctcaattgatattggggaatatgatgcattgtttggggagtcttacaatgcaatatctgcaatgagccgatcgatgcacaagagccagggctttggtgctactccaaaacgaggtagccaaactgtgtacttcaattatactgctggtgaaagagccaaagctaatctttttgatggaatagatttaacttggggaagagttattgatagtaagaatgttcaaagtttggtgaatgatgcaatcaataatttcgattttgattctcccaaaaactcaatcccgattttagtaaaaattcataatgaattaaactcagtaaaagatgaatattggaaaaacggaaaacaaaatgaagttaaaaaattaattcaactttgcagcggactttggatggaatcaacagttaagcaatctaatatttctccaggaaataagattgatgtcaattcaatgataataaatcgctctggatttccaataactcttgaaagtgtaaatgtaaaatattcgacagatgactcaattttagattcatcacttaataaaaacaaatcatactctttcaccgaaaaggtcaatattcccatggatgcagaatattcacaaccatattggcttcgcgaacaatcggatggaaaaatgtttataattccatcaccagatttaattgnggaaaccagcaaatga

SEQ ID NO: 16632 - protein, 270 aa, Unknown
  Obtained from environmental sample
  misc_feature (1)..(270): Xaa is any amino acid
MAEEAFYAAADSTKFTDQLDELKTWQTKRIYWNTWIPNDQAISIDIGEYDALFGESYNAISAMSRSMHKSQGFGATPKRGSQTVYFNYTAGERAKANLFDGIDLTWGRVIDSKNVQSLVNDAINNFDFDSPKNSIPILVKIHNELNSVKDEYWKNGKQNEVKKLIQLCSGLWMESTVKQSNISPGNKIDVNSMIINRSGFPITLESVNVKYSTDDSILDSSLNKNKSYSFTEKVNIPMDAEYSQPYWLREQSDGKMFIIPSPDLIXETSK

SEQ ID NO: 16633 - DNA, 387 bp, Unknown
  Obtained from environmental sample
  misc_feature (1)..(387): n is a, c, g, or t
atgtttggaccagtaagccttagtggaaactatccacaatatgcaaaagagttgatagttgatttttatagtaactattttggtagtgctgacaaacttgttgaggcacaattagaatttgaatttgaaactagtgatatagcacttgacaacccttttagctacaaagagtataaggatgattttaaacttctaaaaaacaaacttaaaagtatggacttaactattcctacactttataaacaatatagtgaattgtgtgaagaaggtggtataaaattttatgattttaacatcgatccagatttttctaactgtatcgatagttttatcgttgttgagattgcaaaaatcaaacaatcaaaacttgataggtatatggggtaa

SEQ ID NO: 16634 - protein, 128 aa, Unknown
  Obtained from environmental sample
  misc_feature (1)..(128): Xaa is any amino acid
MFGPVSLSGNYPQYAKELIVDFYSNYFGSADKLVEAQLEFEFETSDIALDNPFSYKEYKDDFKLLKNKLKSMDLTIPTLYKQYSELCEEGGIKFYDFNIDPDFSNCIDSFIVVEIAKIKQSKLDRYMG

SEQ ID NO: 16635 - DNA, 654 bp, Unknown
  Obtained from environmental sample
  misc_feature (1)..(654): n is a, c, g, or t
atgtttttccacacttacaaagagttcaaaaaagattttcctcaaatccttgaaaaatatagagtacgagttctcaaaacaaactatggttcaactggagaaggagtttatcttataaatttaagagatgatgaaagtattgtatgtactgaggctgttgataatatcaaatatttttatagcaatatggacgaatttatcaaaagttttaaagaaaaatttgaacatgatgattcaaatgagatttattttaaagggaaaagtggttttgtaggatgtagatatctatcaagaataaatgaaggtgagataagagccctgcttgtcaatgacaaaatagtaagtattgtacacaaaaaaccacaaaacggtgaattttcagcaacactgtttagtggagcaaagtatgaatataacaaaccagataatccacaatacaaagatgtggttgagattacaaataaagcattgaaagatataaaaaaacatcttaataatcaaaactatcccctactttggactatggactatatccttgattatgataaaaagggaaaagacaaactagtcttaagtgagataaactgctcttgtgtagggatatctacacaactagaacttagcgatgagattgctaaagtatttttgcagtaa

SEQ ID NO: 16636 - protein, 217 aa, Unknown
  Obtained from environmental sample
  misc_feature (1)..(217): Xaa is any amino acid
MFFHTYKEFKKDFPQILEKYRVRVLKTNYGSTGEGVYLINLRDDESIVCTEAVDNIKYFYSNMDEFIKSFKEKFEHDDSNEIYFKGKSGFVGCRYLSRINEGEIRALLVNDKIVSIVHKKPQNGEFSATLFSGAKYEYNKPDNPQYKDVVEITNKALKDIKKHLNNQNYPLLWTMDYILDYDKKGKDKLVLSEINCSCVGISTQLELSDEIAKVFLQ

SEQ ID NO: 16637 - DNA, 375 bp, Unknown
  Obtained from environmental sample
  misc_feature (1)..(375): n is a, c, g, or t
ttgatggggagggtgtttttttttattccaaaagaaaacacagagttatttaaaattttcaaaaaaacagcttcgattgttttaagtagaatccatcccggaaatttcaaagagatagatgagtattttatttttttaaaatctttaagtgatgtgggtagtaatatacatactcatcctgatgtgatgataaatcttgattttaaagatatcttagaaaagctcaaaaactccccttgtaggagacaaaggaaactatgtttttccacacttacaaagagttcaaaaaagattttcctcaaatccttgaaaaatatagagtacgagttctcaaaacaaactatggttcaactggagaaggagtttatcttataa

SEQ ID NO: 16638 - protein, 124 aa, Unknown
  Obtained from environmental sample
  misc_feature (1)..(124): Xaa is any amino acid
MMGRVFFFIPKENTELFKIFKKTASIVLSRIHPGNFKEIDEYFIFLKSLSDVGSNIHTHPDVMINLDFKDILEKLKNSPCRRQRKLCFSTLTKSSKKIFLKSLKNIEYEFSKQTMVQLEKEFIL

SEQ ID NO: 16639 - DNA, 648 bp, Unknown
  Obtained from environmental sample
  misc_feature (1)..(648): n is a, c, g, or t
atggaatatgccgaaagatttggaattactacaccaatttatccattttacacactttctgtaggcagtatggaagtaaagccatttgagttaattagtgcttacacaaccttcccaaatggtggagaacgtgttaaaccaatatatattagacgtgtagaagataagtatggcaagattttaaaaaccaacgaaccagaaaagatcagagtgattaacgaacaggccgcttatattatggctaacctgatgaaatcagtttgtgatgaaggaacaggtgtaggaatccgctggcaatctggttatgaaacactgggatcgataagttataaatggaatgcagctggtaaaactggtacaactgatgatttcagagatgcctggtttattggatacaataaaaaactagttactggtatttgggttggctttgatgataatgcgagtttaggtagaggtcaatctggagcaacagcagcacttccatcatggccttatattatgaagaaagcggtttatctggattccccaaaagatagcaagggagatcctattgtaaatggagatgaattgcaatttaaaaaacctgagggaattactactgtagaaatttctaaaagtacaggattactacccaagaataattag

SEQ ID NO: 16640 - protein, 215 aa, Unknown
  Obtained from environmental sample
  misc_feature (1)..(215): Xaa is any amino acid
MEYAERFGITTPIYPFYTLSVGSMEVKPFELISAYTTFPNGGERVKPIYIRRVEDKYGKILKTNEPEKIRVINEQAAYIMANLMKSVCDEGTGVGIRWQSGYETLGSISYKWNAAGKTGTTDDFRDAWFIGYNKKLVTGIWVGFDDNASLGRGQSGATAALPSWPYIMKKAVYLDSPKDSKGDPIVNGDELQFKKPEGITTVEISKSTGLLPKNN

SEQ ID NO: 16641 - DNA, 867 bp, Unknown
  Obtained from environmental sample
  misc_feature (1)..(867): n is a, c, g, or t
ttggcattattgaaaattaaattgcgtgactatacaaatgcaaaaatatatttggaacaagcatataataatgcaaaaggtgataagtcaaaaaatgaagttttatggattaagctttttaatgcattaaaagcaaatgatattacaaatatttcagatacaatttttaaaatcgaagagagaaaaagaatatttaatgtaaatcaagacttaaaacttgaattattttttaataaaaataaatttacacctaaagaatactttgatcagattgtaaatttgtcacatgatagaaaattggattttgtttactattttgcaccatttatatttgaagattatgatagtatgggaataaatgaagcaagaggttttataataaaaaatgaaaatagtatatctgaattaaacatgatgatacaatataatgcagattttttagaagttattaaattagatccaattcaaagaacatataaactacaaaaaatgatagatgaaaagtatgatacaaaagcttacgagtattataatttagctttaacatatgctcaaatatatgattataataatgcatataaatattttaaaaaagcatatagtttagatcatggaaataagctgtattctattatgacatttattacttctaaaaagttaagtttaaatgaagataaagtattttgggaaatattagtaagaaatatacaatcaaataaaggaagttttaattattttgcaaaatatatttataaaatatttgaaaatccagaacaagtattagatgaaaaaacattaagctttaaacaaaaaaaatcaatattttttcgagcattatattttatagataatatagangaaaatgga

SEQ ID NO: 16642 - protein, 289 aa, Unknown
  Obtained from environmental sample
  misc_feature (1)..(289): Xaa is any amino acid
MALLKIKLRDYTNAKIYLEQAYNNAKGDKSKNEVLWIKLFNALKANDITNISDTIFKIEERKRIFNVNQDLKLELFFNKNKFTPKEYFDQIVNLSHDRKLDFVYYFAPFIFEDYDSMGINEARGFIIKNENSISELNMMIQYNADFLEVIKLDPIQRTYKLQKMIDEKYDTKAYEYYNLALTYAQIYDYNNAYKYFKKAYSLDHGNKLYSIMTFITSKKLSLNEDKVFWEILVRNIQSNKGSFNYFAKYIYKIFENPEQVLDEKTLSFKQKKSIFFRALYFIDNIXENG

SEQ ID NO: 16643 - DNA, 345 bp, Unknown
  Obtained from environmental sample
  misc_feature (1)..(345): n is a, c, g, or t
atgaaaattatatctctttgttttaaaaaatatgatttcaaaattaaaaaagtatcggacaattacaaaatattcgatgaaataagaaaaaaatatgttgttctaacaccagaagaatgggtaagacaaaatattattcgatatttaattgaagaaaagaattatccagccacactttttgctgttgaaaccggaatattgtacaataatcttaacaaaaggattgatattttgatttataacaaagatttcaatccttggatgataattgaatgtaagtctgaaactgttgaacttactaatgaagtattagaacaagccaaaagatatttttttcagtcatag

SEQ ID NO: 16644 - protein, 114 aa, Unknown
  Obtained from environmental sample
  misc_feature (1)..(114): Xaa is any amino acid
MKIISLCFKKYDFKIKKVSDNYKIFDEIRKKYVVLTPEEWVRQNIIRYLIEEKNYPATLFAVETGILYNNLNKRIDILIYNKDFNPWMIIECKSETVELTNEVLEQAKRYFFQS

SEQ ID NO: 16645 - DNA, 546 bp, Unknown
  Obtained from environmental sample
  misc_feature (1)..(546): n is a, c, g, or t
ttggcgaatgtaaaattatattatttatcgaaaacaaaaaacattttaatggataattataagtcaatattactagaattaaaaaacaaagtatacagacctgtctatatgcttatgggagaggagtctttttatattgataaaatcatagattttattgagaaagacgttctaaatgagcaggaaaaagaattcaacttatctgtagtttacggaatggaaacgactgtagataatgtaatttctatggcgcagagatttcctatgatgggaaattatcatcttgtaatagtaaaagaggctcagaatttaaagaaaattgagaagctgcaatcatatattaaaaaaccttcttcgtcaactatacttgttctcagttacaaacataaaacaattgataaaagaactgtttttgcaaaatcaattccagcggctaaaggaattgtttttaattcagaaagaattagagactacaaaattcccgaatggataaaagattatgttagtttacaaaagttttctattgatgacaaaacagctcaataa

SEQ ID NO: 16646 - protein, 181 aa, Unknown
  Obtained from environmental sample
  misc_feature (1)..(181): Xaa is any amino acid
MANVKLYYLSKTKNILMDNYKSILLELKNKVYRPVYMLMGEESFYIDKIIDFIEKDVLNEQEKEFNLSVVYGMETTVDNVISMAQRFPMMGNYHLVIVKEAQNLKKIEKLQSYIKKPSSSTILVLSYKHKTIDKRTVFAKSIPAAKGIVFNSERIRDYKIPEWIKDYVSLQKFSIDDKTAQ

SEQ ID NO: 16647 - DNA, 375 bp, Unknown
  Obtained from environmental sample
  misc_feature (1)..(375): n is a, c, g, or t
atggaaaatacaagaatggcagcaagaagttttagggatctaattgtatggcaaaaatcacatcaattagttcttgaagtatataaatatagtgaagcttttccaaaaaaagaaatgttcggattaacttcacaattaagaaggtcaataatttcagttccagcaaatattgcagaagggtttaagaaaagaggtaaaccagataaaatgcgttttttaaatattgctcagggttcgcttgaagaatcaagatattatttgattttggcttttgatttgaagtatggagataatgttattttaatggataaaatagaagaagtgagtaaattaattgaatcatataataaggctattctgaattcaaaattctga

SEQ ID NO: 16648 - protein, 124 aa, Unknown
  Obtained from environmental sample
  DOMAIN (9)...(115): S23 ribosomal protein
  misc_feature (1)..(124): Xaa is any amino acid
MENTRMAARSFRDLIVWQKSHQLVLEVYKYSEAFPKKEMFGLTSQLRRSIISVPANIAEGFKKRGKPDKMRFLNIAQGSLEESRYYLILAFDLKYGDNVILMDKIEEVSKLIESYNKAILNSKF

SEQ ID NO: 16649 - DNA, 936 bp, Unknown
  Obtained from environmental sample
  misc_feature (1)..(936): n is a, c, g, or t
atggctcggaggagtcgtatcaagcgtagagcaggaaccattctcgatagagaaaatccaatacaatctcaaagtattacaggagctgagctttgtaaagcagcctgttgtaatctggctgaaagttttgagactaatgcttcagttgatgtatcctatgctgatgctgcaacaggagctaagtcaattaagcttttaggtcttactgggaagtatattgagatgatgactgagaaaaatccaaattttaaaggattagcatctgtatacggaatggcttatgtgccaggaccatggatggaatctattcaggtttcaaaaggagttggttctgttgtaaatggttttgaatcaattacagggcaaataaatattgaataccagaagcctcaaaacgctccaaagctatatctaaatacttatggaaatagtatggggatgtctgaagctaacttgatgacaggcgttaagttttctgataagctttctacatcgattttagctcacggacaggataataaaaaagagaatgatcacaataatgataattttcttgatgatcccatggtgcgtcagtacaattttgtgaacaggtggcattggaaacctaataagaattggattactcaatttggtgttaagtttattgatgagcagagaattggtggacaaaaaggtttcgatgaaagtaagcctaatgatgtcaataatgcttatcgtatagatattgacacacgtcgttacgaagcttttgccaaaataggttatatttttcctaaaaatgatgatagaagtattgccttgattactaatttctcatctcacgaacagaaatcattttatggtttgagaaaatacgatgcaaaacagaataatctgtatgttaatttactttttccaatctatatggaaaattttactcataaatacaccgct

SEQ ID NO: 16650 - protein, 312 aa, Unknown
  Obtained from environmental sample
  misc_feature (1)..(312): Xaa is any amino acid
MARRSRIKRRAGTILDRENPIQSQSITGAELCKAACCNLAESFETNASVDVSYADAATGAKSIKLLGLTGKYIEMMTEKNPNFKGLASVYGMAYVPGPWMESIQVSKGVGSVVNGFESITGQINIEYQKPQNAPKLYLNTYGNSMGMSEANLMTGVKFSDKLSTSILAHGQDNKKENDHNNDNFLDDPMVRQYNFVNRWHWKPNKNWITQFGVKFIDEQRIGGQKGFDESKPNDVNNAYRIDIDTRRYEAFAKIGYIFPKNDDRSIALITNFSSHEQKSFYGLRKYDAKQNNLYVNLLFPIYMENFTHKYTA

SEQ ID NO: 16651 - DNA, 549 bp, Unknown
  Obtained from environmental sample
  misc_feature (1)..(549): n is a, c, g, or t
ttggattctttagctagattggaaaaacagttatccgactataaaaaaggttttgagtgtgtatggactgtaattccagaatccaaactaaataaactattactttcagttagtagcgatattggaataaaaattttagatgataacaacaacttacatacttacagagaagcgaagtctgagcttggtaatgtaacacacggagggttatttagcctattgagagaaaaagagtttctattattgttgcaaattcactatggtcacgagtttaactgccaatcgcatgaaacacaaaaaattctaatgagcatgtttgaagccattaatatagaacaagcccataaatattccgttaatattatcaagcagcggattttgcaacgtaagttttcattactaatcaataattctccaaatagcttattgtcaattggattgaacccctctatacaaaaagatgctaagaaatttttgtcttttttggattcatctattagtaactttgagaatcatattaatatggtgtgtcatggaaaactgttttaa

SEQ ID NO: 16652 - protein, 182 aa, Unknown
  Obtained from environmental sample
  misc_feature (1)..(182): Xaa is any amino acid
MDSLARLEKQLSDYKKGFECVWTVIPESKLNKLLLSVSSDIGIKILDDNNNLHTYREAKSELGNVTHGGLFSLLREKEFLLLLQIHYGHEFNCQSHETQKILMSMFEAINIEQAHKYSVNIIKQRILQRKFSLLINNSPNSLLSIGLNPSIQKDAKKFLSFLDSSISNFENHINMVCHGKLF

SEQ ID NO: 16653 - DNA, 468 bp, Unknown
  Obtained from environmental sample
  misc_feature (1)..(468): n is a, c, g, or t
atgcttttattaaaaaggccaacaaatcggcaatttgcagatattctggacgaagatttctatgatttgcatatgaatcataaagaacttggctttgatgctttgggagattatctaactattggtcgaagacctccaaacccaggaggttccccagcagtaacggtagtaatacattatacttatcctactggagacaataatgaggttattcgcattcgtaggttttttggctatataagcaaagaaggtaaaaacaagcatcacagtggaataatgcaagcaatgagtgaagctaaagaatttatttcagattattcaagcagtaagtgtagcctttgtgatgaatgcaaggaactcatcaggcaagtgtcacaaaaagatgcaaaagtttataatttgggtgaattaaaacagttttccatgacacaccatattaatatgattctcaaagttactaatagatga

SEQ ID NO: 16654 - protein, 155 aa, Unknown
  Obtained from environmental sample
  misc_feature (1)..(155): Xaa is any amino acid
MLLLKRPTNRQFADILDEDFYDLHMNHKELGFDALGDYLTIGRRPPNPGGSPAVTVVIHYTYPTGDNNEVIRIRRFFGYISKEGKNKHHSGIMQAMSEAKEFISDYSSSKCSLCDECKELIRQVSQKDAKVYNLGELKQFSMTHHINMILKVTNR

SEQ ID NO: 16655 - DNA, 816 bp, Unknown
  Obtained from environmental sample
  misc_feature (1)..(816): n is a, c, g, or t
atggctcggaatacatttactccatccatacattggacaccaattggttttatgtcagatattcaaaactggtctatagaagatattagagagtttcactcaaaattttacacacctgagaatgctattattgtagttgctggagatataacaaaagaggaagttttctcaactgccaaaaaacatttttcttctattaaaaacagtgaaaatagtaaagaaattacaaaaacgcttcacactgtagagccaaagcaagatggagagaaaagagttgttatacacaaagattctcaagtagagattttagctataaactttcatattccaaactttttagataaagatcaagtagcactttctgcacttagtgagcttttaagtagtggaaaaagtagtagactaaatgaactattaatagataaaaagcaaatggtaaacacaatatatgcttacaacatggagttaaaagaccccggagtttatctatttttagcagtttgtaatccaggagttaaagctgtggatgttgaaaaagagatttggaaagagataaaaaatatacaaaaaggtgatgtgaaaaaatctgaacttgcaaaaattaagaaaaatacaaaatcagattttatattttctctagaaagctctagtagtgtagcttcactatatggaagttatcttatccgtggtgacatctctccacttatgaactatgaagaagatattaaaaatttacaaacaaaagatataatagaagttgcaaaaaaatatcttactaaaaacaactcaacaacaatgattttaaaacaagattaa

SEQ ID NO: 16656 - protein, 271 aa, Unknown
  Obtained from environmental sample
  DOMAIN (23)...(205): Peptidase M16 inactive domain
  misc_feature (1)..(271): Xaa is any amino acid
MARNTFTPSIHWTPIGFMSDIQNWSIEDIREFHSKFYTPENAIIVVAGDITKEEVFSTAKKHFSSIKNSENSKEITKTLHTVEPKQDGEKRVVIHKDSQVEILAINFHIPNFLDKDQVALSALSELLSSGKSSRLNELLIDKKQMVNTIYAYNMELKDPGVYLFLAVCNPGVKAVDVEKEIWKEIKNIQKGDVKKSELAKIKKNTKSDFIFSLESSSSVASLYGSYLIRGDISPLMNYEEDIKNLQTKDIIEVAKKYLTKNNSTTMILKQD

SEQ ID NO: 16657 - DNA, 753 bp, Unknown
  Obtained from environmental sample
  misc_feature (1)..(753): n is a, c, g, or t
atgaagaataactctttaaataaagagtatgaaaataacttaaaatggacaaaaaagataaaaattgcaattgaagaggatagagtagttccatttttccaaccaattgtaaataatctaactaatagtaatgaaaaatatgaatcacttataagaatattagaagatgataaagttatctcaccatattttttccttgaaatttccaagaaaacaaaatattataatatcttaacaaaaataatgttggaaaaaagttttaaaatgttccacaaaaaagagtttgaattctctgttaatctcactattgatgatattttaaatattgagatacaagactatatttttgagttactcaataagtatgggataggggaacgagttgtatttgaaatagtagaatcagaatctattgaaaactttaatcaagtggtaagttttattagaaatgtgaaagagtttgggtgtaaaattgctatagatgactttggtacaggatacagtaactttgaatatcttatgaagcttgaagcagattatatcaagatagatggttctatgattaaaaatattgatactgataacaatgctaaaatggtagtagaaactattgtaaactttgctaaaaagatgaatatgaaaacaattgcagagtttgttgagaatgaagagatattaaaaattgtaaacgaattagggatagattactcacaaggttattattttagtgctccaaaaccagagctagattaa

SEQ ID NO: 16658 - protein, 250 aa, Unknown
  Obtained from environmental sample
  DOMAIN (12)...(245): EAL domain
  misc_feature (1)..(250): Xaa is any amino acid
MKNNSLNKEYENNLKWTKKIKIAIEEDRVVPFFQPIVNNLTNSNEKYESLIRILEDDKVISPYFFLEISKKTKYYNILTKIMLEKSFKMFHKKEFEFSVNLTIDDILNIEIQDYIFELLNKYGIGERVVFEIVESESIENFNQVVSFIRNVKEFGCKIAIDDFGTGYSNFEYLMKLEADYIKIDGSMIKNIDTDNNAKMVVETIVNFAKKMNMKTIAEFVENEEILKIVNELGIDYSQGYYFSAPKPELD

SEQ ID NO: 16659 - DNA, 957 bp, Unknown
  Obtained from environmental sample
  misc_feature (1)..(957): n is a, c, g, or t
ttggaattaactaaaaagttagagccgaatgtaattattttgaatgtaaatcaaaataatcaaaaattagtagagttagttaaaaagaagtttgcaaattgtgcaattatcgcagtttatgaccagataagtaagttggatattgctagattaaccctaaatggtgtctcatctgtcttaacaaatcctataaaaggtaaagagcttcaaagagagttctataaaataacacaaacacatttctctaatagatatatcttattagagcctaaaaaaattagaagatttgttgataacctatctgctctgccagatagcatgcaaagagtaaaagatgtatgtgattcagaagagagcacaataaaagaacttatagaagtggtcaggactgatcctatattagtaggggtgattttaaatgcttctagaaatcctatttatggattgaaggagattaaaagtattgatcaagcagtcagcgtttttgggaaaagaaccattaaagctcttgttttaatacagagcagtgcaattataggaaaatctgatttagatgtgtatggtattaatgatgcaacattttctaaagtctcttctgaacgattagctttaatgatgctttggtactcaaatgtagatagtactatgttagatattttatgtactacagccgttttaggaaatttgggacaactgctaattgctaaagagataaaagagttaaagaaagagaatgagtttaaaaaagctctgcaaggaagagatattagagatgtagaagaggcatatgtacatacaacttcagcttacataagcagtgatatatcatcatattggaaactgcaagagcacgtcgtaaactctatgagatttagtgattacccagaagatcccccctctgaattaaggaaatattgtattgcaaattatattacctacccccctgtgccccttgac

SEQ ID NO: 16660 - protein, 319 aa, Unknown
  Obtained from environmental sample
  misc_feature (1)..(319): Xaa is any amino acid
MELTKKLEPNVIILNVNQNNQKLVELVKKKFANCAIIAVYDQISKLDIARLTLNGVSSVLTNPIKGKELQREFYKITQTHFSNRYILLEPKKIRRFVDNLSALPDSMQRVKDVCDSEESTIKELIEVVRTDPILVGVILNASRNPIYGLKEIKSIDQAVSVFGKRTIKALVLIQSSAIIGKSDLDVYGINDATFSKVSSERLALMMLWYSNVDSTMLDILCTTAVLGNLGQLLIAKEIKELKKENEFKKALQGRDIRDVEEAYVHTTSAYISSDISSYWKLQEHVVNSMRFSDYPEDPPSELRKYCIANYITYPPVPLD

SEQ ID NO: 16661 - DNA, 960 bp, Unknown
  Obtained from environmental sample
  misc_feature (1)..(960): n is a, c, g, or t
atgccgagtgttgaccgagagacaggtacagtactttctgtgaataatgatccaggaacgatccctacatatttaggatattttttattagcacttggacttttgatgaatatgtttgataaaaaatcaagattttcaaaattacttaactatacaaaacagtttaatagtatcgctgttattctagttgctacagtaatttttacaaatacttcttatgcaaatgacactttagattatcttgagaaatataaagttgaatctaaagagacagcaaaactttttggtaaacttgtaacacaatcacagcaaggaagaatgaaacctgttgacactttaaatagagagatacttaataagctttctcgaaaaagtacattcttagggatgaatccagatcaagttgttttaggtatgattactcgtccagagatttggcgagaattaaaaatgttaaaaataacaactccaaaactcaaaagagaattagggcttgaagatagtagaaaatatgtagcattttcagagatgttcacagcagagggtgagtataaactgaaaaaacttatcaatgatgtaaatgcaatgaatccaaatcaaagaggtacatttgaaaaagatatactaaaacttgatgagagattaaatattgcatatatggtttattttggaaatctttttcaaatttttccacgcccagatgatggacataatcacgatacaacaaaatggtacacaccaattgatgcaatggatcaattccatgataaagataagcaagtggtgcaacttatggttagaggatttattgataatgttgtggcacanaaatatgaagaagcaaataaatatattggtttgatttcacagtttcaaagaaaagttggacaagatgttatccctagtcaagataaaattaataatgagatatttatttatggattaaatggatttttttaa

SEQ ID NO: 16662 - protein, 319 aa, Unknown
  Obtained from environmental sample
  misc_feature (1)..(319): Xaa is any amino acid
MPSVDRETGTVLSVNNDPGTIPTYLGYFLLALGLLMNMFDKKSRFSKLLNYTKQFNSIAVILVATVIFTNTSYANDTLDYLEKYKVESKETAKLFGKLVTQSQQGRMKPVDTLNREILNKLSRKSTFLGMNPDQVVLGMITRPEIWRELKMLKITTPKLKRELGLEDSRKYVAFSEMFTAEGEYKLKKLINDVNAMNPNQRGTFEKDILKLDERLNIAYMVYFGNLFQIFPRPDDGHNHDTTKWYTPIDAMDQFHDKDKQVVQLMVRGFIDNVVAXKYEEANKYIGLISQFQRKVGQDVIPSQDKINNEIFIYGLNGFF

SEQ ID NO: 16663 - DNA, 648 bp, Unknown
  Obtained from environmental sample
  misc_feature (1)..(648): n is a, c, g, or t
ttgacctgcgaacattgtaggcctgtgatgaaatcaacatttgataatctgtcagagaaaaagagacagcgtgtaattaatgcctgtatagaagaattcagtgaacatggatatgattccagttctatggatggaatcatcaaacgtgcaggtatatccaagggggggctgtatgaatatgtctcttccaaagaggaactatttacctttattgtagattatacatattccaggctttatagttatctaaaacagcgggttgaaagtgaaatcaggatctttccatcagacctgctggatcgtttgaaacttgtttcggaactggccatcgatttttatattgatcatcctgagtttatatatcttattgttcgtacagtaaatcttgataatgagaaaattgctttaggtgttcaggatgttttccgaaatcattttctggagctttttggtgatgctgacacatcgaaacttaaatatccaaagaaaagaattcttgatcttgccatgtggttccttttaaaaacacgcattgaattcctcaatgagataaaaacggaaaaagatccggtaaaaattaaggaggattatatggataactggtatttttaccttgngataatgcggggtggaatttactccccctga

SEQ ID NO: 16664 - protein, 215 aa, Unknown
  Obtained from environmental sample
  DOMAIN (25)...(71): Bacterial regulatory proteins, tetR family
  misc_feature (1)..(215): Xaa is any amino acid
MTCEHCRPVMKSTFDNLSEKKRQRVINACIEEFSEHGYDSSSMDGIIKRAGISKGGLYEYVSSKEELFTFIVDYTYSRLYSYLKQRVESEIRIFPSDLLDRLKLVSELAIDFYIDHPEFIYLIVRTVNLDNEKIALGVQDVFRNHFLELFGDADTSKLKYPKKRILDLAMWFLLKTRIEFLNEIKTEKDPVKIKEDYMDNWYFYLXIMRGGIYSP

SEQ ID NO: 16665 - DNA, 699 bp, Unknown
  Obtained from environmental sample
  misc_feature (1)..(699): n is a, c, g, or t
atgggtgagatgctaagtattatagcacatcaatggagacagccattaagtgtgatagatatgacagcatttaatatacgaaataaaattgatctagataaattcgatttaaaagatgaaatatcacaagaagcttttttaaagtttttaaaagaggagataaaagatatacataattattcgcaatatctaacaaatactatagaagactttactcaattttttaaaccaaataaagaaaaagaattagtaaacttaataattcctattgaaaaagctttaagtattctttattcagttataacaaaagaaaagattaaaattcaagtttgtaatagtacaaaaaatagtataaatatctttatttctgaagtgatgcaggttattttaaatatagtgaacaatagtattgataactttatagataagaatacaataaaccctcaaataaatatagatgtagaagaaaatgataataaatttacgataaaaattagtgataatggtggagggatagatgagtcgatattatataaaatatttgatccatatttttctacaaaaacagagaaaaatggaacagggcttggcttatatatatcaaaaatactaattgaaaattatagtgcaggtttgttaaatgtaaataatatagaaaatggtgtctgttttgaaattgttttatatggagatatatga

SEQ ID NO: 16666 - protein, 232 aa, Unknown
  Obtained from environmental sample
  DOMAIN (120)...(231): Histidine kinase-, DNA gyrase B-, and HSP90-like ATPase
  misc_feature (1)..(232): Xaa is any amino acid
MGEMLSIIAHQWRQPLSVIDMTAFNIRNKIDLDKFDLKDEISQEAFLKFLKEEIKDIHNYSQYLTNTIEDFTQFFKPNKEKELVNLIIPIEKALSILYSVITKEKIKIQVCNSTKNSINIFISEVMQVILNIVNNSIDNFIDKNTINPQINIDVEENDNKFTIKISDNGGGIDESILYKIFDPYFSTKTEKNGTGLGLYISKILIENYSAGLLNVNNIENGVCFEIVLYGDI

SEQ ID NO: 16667 - DNA, 663 bp, Unknown
  Obtained from environmental sample
  misc_feature (1)..(663): n is a, c, g, or t
atgagtgaatcaatatcaggtttttccaaactttctaaatcaaaaaaaatagactggattgtcaatacttatttttctaacgccgacgaagccaaacgtattttagaacaatattggcatattgatgaaaaaattcaacaactgcatgatgaatttattgaaaatacaatttcaaattattatttaccattaggagttgctccaaattttttgattaatggtaaactatataccattcctatggctattgaggaaagttctgtggtagcagcggctagcaaagctgcaaaattttggttagacagaggcggctttaaaaccaaggttatttcaacaacaaaaataggtcaggtacactttatgcatcatggcaacaaaaaaacattggagtccttttttagctatgtaaaaccactactttttaaagatgcgaagcccattactaaaaacatggagcaacgtggtggtggcatcctagatattgaattgcgggataaaacagacgacattgcaggctactatcaattgcatgtttcttttgaaactcttgatgctatgggagctaattttataaactcgtgcttagagcaatttgccaaaacttttaaaagtgaagccttgatttatgatgccttttctgaagaggaaaagaacttcaaatag

SEQ ID NO: 16668 - protein, 220 aa, Unknown
  Obtained from environmental sample
  misc_feature (1)..(220): Xaa is any amino acid
MSESISGFSKLSKSKKIDWIVNTYFSNADEAKRILEQYWHIDEKIQQLHDEFIENTISNYYLPLGVAPNFLINGKLYTIPMAIEESSVVAAASKAAKFWLDRGGFKTKVISTTKIGQVHFMHHGNKKTLESFFSYVKPLLFKDAKPITKNMEQRGGGILDIELRDKTDDIAGYYQLHVSFETLDAMGANFINSCLEQFAKTFKSEALIYDAFSEEEKNFK

SEQ ID NO: 16669 - DNA, 822 bp, Unknown
  Obtained from environmental sample
  misc_feature (1)..(822): n is a, c, g, or t
atggtcagaattcggctcgagacgggattcttaaagacaaaaaataacgaagattttgttaattcaaattcagatataaaatttgatagtcgattcctatttaaatcttcaattcctaaagcagtttcagatagtatttttaacttaagcgttggtgaggtttatggcccttataaagacaatggatattttaaaatatctaagttggttgctgtaaaacaaataccagattcagcaaaggtacgtcacattttaatcccatttgttggagcaagagctgctgcccaagatgttactagaacagatgcagaagcaaaacaattggccgatagtattttagcggtggtgaaatcaaataaatcaaaattccctgacctagtaaaggaattttcatcagatcaaggaagtttagataaagaaggtcgatacgactggcatccttacaactctatggttcctgaatttaatgattttgaatttgaaggaaaggtaggagatattggtgtagttaaaacaatttttggttatcatgttatcgagattgaaggtcagaaagataaagagaaagcagttcaggttgctaccatagcaagaaagattgagccttcacaagccacaatagacaaagtgtttagagatgcttctaattttgagatttcattagaaaagaaagattttcaagaattggcaaaagaaaataaatatgccgttcgtccggttaatggtattaaagtattagatgagaatataccaggaattggaaatcaaagacctattgtaagatgggcatttgatgaagaatctgaagtaggagatatttaa

SEQ ID NO: 16670 - protein, 273 aa, Unknown
  Obtained from environmental sample
  DOMAIN (83)...(183): PPIC-type PPIASE domain
  misc_feature (1)..(273): Xaa is any amino acid
MVRIRLETGFLKTKNNEDFVNSNSDIKFDSRFLFKSSIPKAVSDSIFNLSVGEVYGPYKDNGYFKISKLVAVKQIPDSAKVRHILIPFVGARAAAQDVTRTDAEAKQLADSILAVVKSNKSKFPDLVKEFSSDQGSLDKEGRYDWHPYNSMVPEFNDFEFEGKVGDIGVVKTIFGYHVIEIEGQKDKEKAVQVATIARKIEPSQATIDKVFRDASNFEISLEKKDFQELAKENKYAVRPVNGIKVLDENIPGIGNQRPIVRWAFDEESEVGDI

SEQ ID NO: 16671 - DNA, 726 bp, Unknown
  Obtained from environmental sample
  misc_feature (1)..(726): n is a, c, g, or t
atgtcagtagttaaatgtacccattgtcatttagaatttgatgaaaaggttatgataaaagaactcgaaaatcctgagttgaatttttgttgtaatggttgtcaaggggtatatcatttacttaaagatgatggtttagatagtttttacgacaaaatgggaaaaaatagtatcgcaccaccagttgccttaggtgctgatagtagtaactttgatatggagagttttaaaagtcgatatattaaaactacaaatgaaggatttagtagagtcgatttgataattgaagggatccattgtgctgcatgtatttggttgaatgaaaaagtattagggcaaactgatgggatagtagaagctagtataaatttcactaacaataaagccaaaatagtttgggatgaagatactataaagttatctgaaattatagataaaataagaagtattggctataacgcctatccttatgatagaagcgaaagtgaaaaacaagctacaaaaaataatagagactattttttacggatgagtgttgctatttttgcttctatgaatcttatgatgataggggttgcaaaatatactggtttttttacaggtatggaagaggatatgctccggcttatacatatggcagaatttatttttgcaacaccagttgtgttttatagtggatggatattttatcgtggtgcttattatggtttaaaaaataaattttaa

SEQ ID NO: 16672 - protein, 241 aa, Unknown
  Obtained from environmental sample
  DOMAIN (92)...(156): Heavy-metal-associated domain
  misc_feature (1)..(241): Xaa is any amino acid
MSVVKCTHCHLEFDEKVMIKELENPELNFCCNGCQGVYHLLKDDGLDSFYDKMGKNSIAPPVALGADSSNFDMESFKSRYIKTTNEGFSRVDLIIEGIHCAACIWLNEKVLGQTDGIVEASINFTNNKAKIVWDEDTIKLSEIIDKIRSIGYNAYPYDRSESEKQATKNNRDYFLRMSVAIFASMNLMMIGVAKYTGFFTGMEEDMLRLIHMAEFIFATPVVFYSGWIFYRGAYYGLKNKF

SEQ ID NO: 16673 - DNA, 627 bp, Unknown
  Obtained from environmental sample
  misc_feature (1)..(627): n is a, c, g, or t
ttgtctaagtattccagcaagcaacaggctatgcgtaattcagaactatggagttcaataccttatcaattagcaagagaaaataaaaaattcaaatatagtagcattaaaactggaactagatcagcaaactataatcaatctattgaatggttaaaaaatgcaggattagtgaatgttgcttataacataacaaaaccctttctaccactatccggttatataaatgcttcaaaatttaaattatatttatttgactccggtcttctaggtgcaatattgaatatatcttctgatctaataataaaaccaacagaactattttctcaatacaatggagcttttatagaaaattatgtcgcatctgaattcactatacatggatttaaagagctctattactggacatcagaaaatgatgctgaagtagatttcattgttagtaagaacaacaaagcatatcccgtagaagtaaaaagtggtatgaacaggaacacaaagagtttgaatagttacaagttaaaatattcacctgaactggtttatcgttgttcaccaaggaatttcacgcagtcaggtgatttcaataatatcccgttatatgcagtttctaaattatgccaataa

SEQ ID NO: 16674 - protein, 208 aa, Unknown
  Obtained from environmental sample
  misc_feature (1)..(208): Xaa is any amino acid
MSKYSSKQQAMRNSELWSSIPYQLARENKKFKYSSIKTGTRSANYNQSIEWLKNAGLVNVAYNITKPFLPLSGYINASKFKLYLFDSGLLGAILNISSDLIIKPTELFSQYNGAFIENYVASEFTIHGFKELYYWTSENDAEVDFIVSKNNKAYPVEVKSGMNRNTKSLNSYKLKYSPELVYRCSPRNFTQSGDFNNIPLYAVSKLCQ

SEQ ID NO: 16675 - DNA, 579 bp, Unknown
  Obtained from environmental sample
  misc_feature (1)..(579): n is a, c, g, or t
ttggataatcgggaggtaaacaatgcgacgaatcaatgctttataattgacgaaaaaaaaggcgcctacgatttagttagattttatttagataatgaaaaaaagaacatagggtggtttgcccctaaaggccatgacaatcaaccgctacactactcttttaaagaaagatacgagaccgtaaaagatgaggtactaaaagagaaaggtgccgtattctcagaatatcgcataaaaaaaagtgctgaattacataaattgaaagataatttatgtataaatggaaagtggcctgacgtgataatatgttacgattttcatttttacgatatcttatttcaccttgctagacacccgaaatttaatatcccaaaagaaactcagtttgcatatttttgctctgaatataatcagcgactatatagctcaaaatttgtcaccaccattgaccttcccgaatatcaggtaggaatcgatggtgcaaaatacttggtaaatactcttcaaaaaacaaaacaaaatagaatagaacctataccaggggttttaaatattaaagacgaacaacctatcacttaa

SEQ ID NO: 16676 - protein, 192 aa, Unknown
  Obtained from environmental sample
  misc_feature (1)..(192): Xaa is any amino acid
MDNREVNNATNQCFIIDEKKGAYDLVRFYLDNEKKNIGWFAPKGHDNQPLHYSFKERYETVKDEVLKEKGAVFSEYRIKKSAELHKLKDNLCINGKWPDVIICYDFHFYDILFHLARHPKFNIPKETQFAYFCSEYNQRLYSSKFVTTIDLPEYQVGIDGAKYLVNTLQKTKQNRIEPIPGVLNIKDEQPIT

SEQ ID NO: 16677 - DNA, 534 bp, Unknown
  Obtained from environmental sample
  misc_feature (1)..(534): n is a, c, g, or t
atggaacagatacactctaatatagtgcaggtagttcaagaaaataaaactctttataaatgtgatggattagtaaccaatcaaaaaaatagacctttgatggttatggttgctgattgtattcctatactattttatgataaaatcagagatgttatagccgtagctcatgcaggtagagttggaacttttgaaaatatttcaaaaaatacaatagagtgtatgtgtaaaacttttgattgtgaggtaaaagacatagcagtaacacttggacctagcatacaaaaatgttgttatgaagtatcacaaaagatggctaagtatacagaaaatacttttggaaaagagtttgtaaaaaatcgtaatattgatttacaaggaatcaataaaaaacagttagaaaaaatgggaattagtgaaactaatataacaatatcttctatttgtacacaatgttcaaacaaaccatatttctcttatagaaaagataatagttgtggaagatttgctggcattattatgttaagaggttaa

SEQ ID NO: 16678 - protein, 177 aa, Unknown
  Obtained from environmental sample
  DOMAIN (1)...(175): Uncharacterised ACR, YfiH family COG1496
  misc_feature (1)..(177): Xaa is any amino acid
MEQIHSNIVQVVQENKTLYKCDGLVTNQKNRPLMVMVADCIPILFYDKIRDVIAVAHAGRVGTFENISKNTIECMCKTFDCEVKDIAVTLGPSIQKCCYEVSQKMAKYTENTFGKEFVKNRNIDLQGINKKQLEKMGISETNITISSICTQCSNKPYFSYRKDNSCGRFAGIIMLRG

SEQ ID NO: 16679 - DNA, 450 bp, Unknown
  Obtained from environmental sample
  misc_feature (1)..(450): n is a, c, g, or t
ttgctcgacgaagaaaaagatttgccacaactaataattattgatggtggcaagggacaattatctgcatctgtaaaaagtttagttgatttgggaattgaaaataaagttgaaataattgggattgcaaaaaggttagaagaaattttcaaaccaaatgatccatatccgctgtacttagataaaaattcatatagtttaaaaataattcaacacgccagagacgaagctcaccgttttggaataacatttcaccgacaaaagagagacaaagcgatgattaaaagtcaattgacagatataaacggagttggagaaaaaacaatcgaaaaattattgaaacattttggcagcattgcaagagtcaaatcttcatcaattgaagagatcgctataatcacaggaaaatcaaaagcagaaattattttcaaaaaccttcaagatggataa

SEQ ID NO: 16680 - protein, 149 aa, Unknown
  Obtained from environmental sample
  misc_feature (1)..(149): Xaa is any amino acid
MLDEEKDLPQLIIIDGGKGQLSASVKSLVDLGIENKVEIIGIAKRLEEIFKPNDPYPLYLDKNSYSLKIIQHARDEAHRFGITFHRQKRDKAMIKSQLTDINGVGEKTIEKLLKHFGSIARVKSSSIEEIAIITGKSKAEIIFKNLQDG

SEQ ID NO: 16681 - DNA, 765 bp, Unknown
  Obtained from environmental sample
  misc_feature (1)..(765): n is a, c, g, or t
ttgtcaaatgaactacctattggcatttctaaaactaatgtaaaatcaattattactgttcacgatttaatttttgtgagatatccagaactttacaaaactatcgaccgaaaaatatatttttcaaagataaaacgagcctgtaatgaagcagacaaaataattgcaatcagcagacaaacaaaaaatgacattgttgaatttttaaatataaatccaaataaaattgaaatagtttatcaaggttgtagtgatatttattatcaacaacacacagaagaacaaaaaaattcagtaaaaaagaaatacaatttaccagatgattttattttaaatgttggcacaattgaacctcgaaaaaatgcatttcaaattgtaaaagcactaaaaaaaggaaatattgattttccattagtcataattggacgagaaactaattacacaaagggaataagaaattttattattctcaataaattagagaaacaaattttcatattaaacaatgttacttttgaagatttaccaacaatttatcaaagtgctgaaatatttatttatccttcattttttgagggatttggaataccaattattgaagcttttaattccaatacacctgttattacaagcgacattgatgttttcaaagaagtagctgaagatgctgctttatttttcgagaacaataatattgacagttttgctaatgcgattcaaatattgctgaaaataaaaataaaagaaatgctcagccgaatctga

SEQ ID NO: 16682 - protein, 254 aa, Unknown
  Obtained from environmental sample
  DOMAIN (96)...(253): Glycosyl transferases group 1
  misc_feature (1)..(254): Xaa is any amino acid
MSNELPIGISKTNVKSIITVHDLIFVRYPELYKTIDRKIYFSKIKRACNEADKIIAISRQTKNDIVEFLNINPNKIEIVYQGCSDIYYQQHTEEQKNSVKKKYNLPDDFILNVGTIEPRKNAFQIVKALKKGNIDFPLVIIGRETNYTKGIRNFIILNKLEKQIFILNNVTFEDLPTIYQSAEIFIYPSFFEGFGIPIIEAFNSNTPVITSDIDVFKEVAEDAALFFENNNIDSFANAIQILLKIKIKEMLSRI

SEQ ID NO: 16683 - DNA, 588 bp, Unknown
  Obtained from environmental sample
  misc_feature (1)..(588): n is a, c, g, or t
ttggaagtaaaattgataaaaaagttactaatagtatatcttttcattgtttctgcattatttgcagatccaaagttctatgaggataatctcaatggctttgggttttgtagtgctaacttttttatattatcaaaatcacaagatacagcaatagcaagtacctataaagaggctgaactattagctaatatctttgcaaaattatactacaaagagttatataaaaaagaggcaatatcaagagatatatcaaaattaaaatctacctacttaagaagattagaacaagaatataaaaacttgaataatctctctgcttcaacttataataaaattggaaaatgtgaaacttttataaaaaatatacttcaaaatcaaaataatatagaatctagttttatagcagcagaaaagaatattgtaacaaaaagacggcttttagaatcattttctttaacaaaaagccaaccaacagatattcctaaagaaaaaatcttagagatttataaaaattggtttgagaataaacctcaaagaaaacctattatgaaattattaccagctaatgtgaaggtaatgaggtag

SEQ ID NO: 16684 - protein, 195 aa, Unknown
  Obtained from environmental sample
  misc_feature (1)..(195): Xaa is any amino acid
MEVKLIKKLLIVYLFIVSALFADPKFYEDNLNGFGFCSANFFILSKSQDTAIASTYKEAELLANIFAKLYYKELYKKEAISRDISKLKSTYLRRLEQEYKNLNNLSASTYNKIGKCETFIKNILQNQNNIESSFIAAEKNIVTKRRLLESFSLTKSQPTDIPKEKILEIYKNWFENKPQRKPIMKLLPANVKVMR

SEQ ID NO: 16685 - DNA, 336 bp, Unknown
  Obtained from environmental sample
  misc_feature (1)..(336): n is a, c, g, or t
ttgttgcagacaaagaaagactttgataaaaaagttgctaattataactttcaagaagaaacgataataaataaattaaaaattgaaaatgcaaagttaaataagcaacttagtattatatcaaggttagatagtttagtagaagaatataaacatgaatatgggaaattaacgaaatttgatatgattaaagatatggaaaattataaaaaatttcaaattgcatctcaaaaatataatacattatataaacaaattctggaaaataaattagaaaaaagatatgcatcatttatagaagatacatattttagattaaaaaagattactgattaa

SEQ ID NO: 16686 - protein, 111 aa, Unknown
  Obtained from environmental sample
  misc_feature (1)..(111): Xaa is any amino acid
MLQTKKDFDKKVANYNFQEETIINKLKIENAKLNKQLSIISRLDSLVEEYKHEYGKLTKFDMIKDMENYKKFQIASQKYNTLYKQILENKLEKRYASFIEDTYFRLKKITD

SEQ ID NO: 16687 - DNA, 663 bp, Unknown
  Obtained from environmental sample
  misc_feature (1)..(663): n is a, c, g, or t
atgtcattaattgcaaagatatttggattacaggatacagcagatgtgtctagacgaagttttcttaaaagtctagttaaagattgttcagaagatgcaattatactcagtacttttataccaacatcattatatgcaaaagacaagagtgcttttgagattgattcaatagattcaattgtaaaattaaattcattactaaaagagtttgattcaaaattatcaaatgatgaattttatcaatcaaaatccacattaagcagagatttaaaacaaatccaagtaaatgaaaagattccaattacgtttaatgattttagtgattatttcagtattcgttttaaagggaaggatgtattagtttcaaaaggtcattttcaacctcatgtagcagggtatgatactttaaatgataaaatggaagttaatggtctaaatcctttggttaaattaggaagcttattaaaaggaatagctgatgttcaaaactcaattttacatgaaacaatccactattttcaagatgaattttcaaaagaggatattctttatgatattgaaagagatagtggtattgagtcaaaatattactcaaaacaaaatgggttactactaaaagcagtagataagggaaggaaaaggttatgctcagattacaaataa

SEQ ID NO: 16688 - protein, 220 aa, Unknown
  Obtained from environmental sample
  misc_feature (1)..(220): Xaa is any amino acid
MSLIAKIFGLQDTADVSRRSFLKSLVKDCSEDAIILSTFIPTSLYAKDKSAFEIDSIDSIVKLNSLLKEFDSKLSNDEFYQSKSTLSRDLKQIQVNEKIPITFNDFSDYFSIRFKGKDVLVSKGHFQPHVAGYDTLNDKMEVNGLNPLVKLGSLLKGIADVQNSILHETIHYFQDEFSKEDILYDIERDSGIESKYYSKQNGLLLKAVDKGRKRLCSDYK

SEQ ID NO: 16689 - DNA, 528 bp, Unknown; identical to SEQ ID NO: 12341
  Obtained from environmental sample
  misc_feature (1)..(528): n is a, c, g, or t

SEQ ID NO: 16690 - protein, 175 aa, Unknown; identical to SEQ ID NO: 12342
  Obtained from environmental sample
  misc_feature (1)..(175): Xaa is any amino acid

SEQ ID NO: 16691 - DNA, 432 bp, Unknown
  Obtained from environmental sample
  misc_feature (1)..(432): n is a, c, g, or t
ttggagtttttagcttcaaaaggatatgcaatagggacggattttatagttggacatccaggagagagtgaagaagtttgggaagatgctatgaaaaatcttcaaaaatttccgctaacccattgtcatagttttacttatagtaaaagggatggaacaccaagtgctacaatgaaaccacaagtcaatggagcgattgcaaaacagcgtctaaaacaattagatgatataataaaacaaaaaaaccttgagtttagaaaacaacaaaaaagtttagatatacttatagaatcttctaaagatgatatttatacaggctatgatcaattttttaatcctattgaagtatcatcaagtagtgatattgttggggattggatagtatgtgatcagtttgaggtaaaggagaattataatgtttccaaattttaa

SEQ ID NO: 16692 - protein, 143 aa, Unknown
  Obtained from environmental sample
  misc_feature (1)..(143): Xaa is any amino acid
MEFLASKGYAIGTDFIVGHPGESEEVWEDAMKNLQKFPLTHCHSFTYSKRDGTPSATMKPQVNGAIAKQRLKQLDDIIKQKNLEFRKQQKSLDILIESSKDDIYTGYDQFFNPIEVSSSSDIVGDWIVCDQFEVKENYNVSKF

SEQ ID NO: 16693 - DNA, 912 bp, Unknown
  Obtained from environmental sample
  misc_feature (1)..(912): n is a, c, g, or t
gtgcctttcgatgatcaacgcttctcgatgggcatacgtaatgattggcctgaattagcaagtatcctcgataaaggcttggctacaataacgcaaagtgaacaggataaaatacgtaataggtacttctctgttcgacaagatcagataactaccatcgtagtttttaagtgggttggtattgtgattgcaacggctttaatcatcatactcctatttatcttttggaacctaattcttagaaaagaagttttaaatcaaactgaagaacttacggaactaaatagtaaattaatctctgaaattgagaataacaaaaagacaaattacgttttacaggaaaaggaacgcctccttaataagattgctgataattatccaaattcctatttatcaattatcgaaaaagattatactattggcttcacagcaggccaggagtttcaacggcaaaaccttgatccaaaacaatttattggtttacacattgagaaagtgtttagtgagcattatgagcttgtaaaagggtttgtagataaagcatttgcaggtaaagaacaatcctttgaactatttattaacgatcaatatcaatcatatcatatggttccacttaagtctgatgatgatgaaactaatcgaattttatcagtatcagaaaatataacggaccgaaaaagaattcaggacgaaattgagatcaanacaacagagctagaagaacaattcagtagaagtgaaaaacaaagaattgctaatctagtaatattgaaagatttgagcataacaactaaggatcttaaaagtgagattatcgaacgtaagccgacagaagagttattgaagcaaagaatgtcagaacttgagatatttaatagtgctactggagatagagaggttaaggatcaatgc

SEQ ID NO: 16694 - protein, 304 aa, Unknown
  Obtained from environmental sample
  misc_feature (1)..(304): Xaa is any amino acid
MPFDDQRFSMGIRNDWPELASILDKGLATITQSEQDKIRNRYFSVRQDQITTIVVFKWVGIVIATALIIILLFIFWNLILRKEVLNQTEELTELNSKLISEIENNKKTNYVLQEKERLLNKIADNYPNSYLSIIEKDYTIGFTAGQEFQRQNLDPKQFIGLHIEKVFSEHYELVKGFVDKAFAGKEQSFELFINDQYQSYHMVPLKSDDDETNRILSVSENITDRKRIQDEIEIXTTELEEQFSRSEKQRIANLVILKDLSITTKDLKSEIIERKPTEELLKQRMSELEIFNSATGDREVKDQC

SEQ ID NO: 16695 - DNA, 354 bp, Unknown
  Obtained from environmental sample
  misc_feature (1)..(354): n is a, c, g, or t
gtggcaatagcagatactataaagggactaaaaatgtttcaacaagtaaatattccgatcacgggaatggttgaaaatatgtcttattttgctcctgaagactcagataaaacatattatatattcggaaaagatggtgttaaagaagctgctaagaaacatgaaattccttttcttggaggagttccacttgagatgggaatgagggagtcttctgatgaagggcatccctatatggccaatgataagaataaatcctttgaaggatggaaatcatatatggcaattgctgaaaatgtggttaagattgtaggtggagagaaaaagggaatttttcaaaaacttttcaagtag

SEQ ID NO: 16696 - protein, 117 aa, Unknown
  Obtained from environmental sample
  misc_feature (1)..(117): Xaa is any amino acid
MAIADTIKGLKMFQQVNIPITGMVENMSYFAPEDSDKTYYIFGKDGVKEAAKKHEIPFLGGVPLEMGMRESSDEGHPYMANDKNKSFEGWKSYMAIAENVVKIVGGEKKGIFQKLFK

SEQ ID NO: 16697 - DNA, 768 bp, Unknown
  Obtained from environmental sample
  misc_feature (1)..(768): n is a, c, g, or t
atgcaagaacttcaagaaaaatttcttaacggtcaacttttacttattgataaaccaataggttggacatcttttgatatcgtcagaaaaatccattatcaacttaaaaatcaactacaacttaaaaaaataaaagtgggtcatgccgggacattagaccctttagccactgggttgttaattgtttgtacaggaaaattcaccaaaaagattgatgaaattcaagctcaaaaaaaagaatatacaggaataataacgctaggagcaacaacaccttgcttcgatttagaaaaaccttttgatgctttttttgaaaccaaacatatctctgatgaaatgataaatgaagtggcagcaacttttatcggcacacaagaacaaactgctcccatacattctgccaaaaaaattgatggcaaaagagcttatgaattagctagagcaggagaagaagtagttattaaaaaaaatactattgttattgatgaatttgaaattacacaaatagaacgcaatgaacttgttctgccatcagataagttaattgctagtgatgaagctaaaatcaaccaagaaaaaccttacaacaaaggaattcacgttcattttcgtgttgtctgcagtaaagggacatacattcgttctattgcaagagatttaggtttaaaacttaattctggaggttatttgtctgcgttaaccagaacaaaaattggtgattacaaattaaatgatgcaaaaaaaataacatcattatcagttatttaa

SEQ ID NO: 16698 - protein, 255 aa, Unknown
  Obtained from environmental sample
  DOMAIN (33)...(213): TruB family pseudouridylate synthase (N terminal domain)
  misc_feature (1)..(255): Xaa is any amino acid
MQELQEKFLNGQLLLIDKPIGWTSFDIVRKIHYQLKNQLQLKKIKVGHAGTLDPLATGLLIVCTGKFTKKIDEIQAQKKEYTGIITLGATTPCFDLEKPFDAFFETKHISDEMINEVAATFIGTQEQTAPIHSAKKIDGKRAYELARAGEEVVIKKNTIVIDEFEITQIERNELVLPSDKLIASDEAKINQEKPYNKGIHVHFRVVCSKGTYIRSIARDLGLKLNSGGYLSALTRTKIGDYKLNDAKKITSLSVI

SEQ ID NO: 16699 - DNA, 636 bp, Unknown
  Obtained from environmental sample
  misc_feature (1)..(636): n is a, c, g, or t
ttgatagggtattttcatacaagacaatatattccattcaagagaatgcaagagattttcaacgatgtgtttggtacatcaataagtgaaggaggcatacattatattttaaacaaacttgttgtaaaggcccaacctgcttaccaattgataaaggaacgtttgcaatcgaattcaaaatatgctgttggcagtgacgaaacaggcattaaagtaaacgggaaaaaacattgggcatggacatggcaaaataaagaagctacatttatcacaataacagataacagggggcagaaaactataaccaatagttttaaggatgggtttaaaaatacaacacttgttcacgattgttgggcaagccatttcaatacacctgccatgacacaccaaatatgtattgtccatttgctaagagatttgaattaccttaatgaactttactcacacaagtggagccaaactgttaaactgctttttcaaaaagcgataaaattaaaagcacaaatganaccagcagattattacattcaaaataagcaaagagcacaaatcgaaaagcgacttgattttttgataaattactatttacccgatgataaaaaagagctcatcaacgtttcaaaaacgacttaa

SEQ ID NO: 16700 - protein, 211 aa, Unknown
  Obtained from environmental sample
  misc_feature (1)..(211): Xaa is any amino acid
MIGYFHTRQYIPFKRMQEIFNDVFGTSISEGGIHYILNKLVVKAQPAYQLIKERLQSNSKYAVGSDETGIKVNGKKHWAWTWQNKEATFITITDNRGQKTITNSFKDGFKNTTLVHDCWASHFNTPAMTHQICIVHLLRDLNYLNELYSHKWSQTVKLLFQKAIKLKAQMXPADYYIQNKQRAQIEKRLDFLINYYLPDDKKELINVSKTT

SEQ ID NO: 16701 - DNA, 483 bp, Unknown
  Obtained from environmental sample
  misc_feature (1)..(483): n is a, c, g, or t
atggaattttacgacattacaccaaccccgaaaaataacaataatatacctattgaaagcacaaaatttgcaattgttcaggacacaaatattcgtaaaggtattttttatgttttccgttggttttggttcttaacggtaaacggcagacgttggcaaataattagtacaacaatgattttaacgcttttaggcttgccgtttgcccttgctgttgatgtaattatcttgatattatatcatattgtttggaaatttctaaaaaagctatttggtaacttttggcataatgccaaagagattttaaagactatttggactttgttcttagatttaatcagagctttttttgataaagctatttttccaacacttaaactaattcttaaaattattgcgatagtaataattgcaattatactgatattcaagtttgattacatcaagaatttagtttttaacctctttgaatatttcacataa

SEQ ID NO: 16702 - protein, 160 aa, Unknown
  Obtained from environmental sample
  misc_feature (1)..(160): Xaa is any amino acid
MEFYDITPTPKNNNNIPIESTKFAIVQDTNIRKGIFYVFRWFWFLTVNGRRWQIISTTMILTLLGLPFALAVDVIILILYHIVWKFLKKLFGNFWHNAKEILKTIWTLFLDLIRAFFDKAIFPTLKLILKIIAIVIIAIILIFKFDYIKNLVFNLFEYFT

SEQ ID NO: 16703 - DNA, 435 bp, Unknown
  Obtained from environmental sample
  misc_feature (1)..(435): n is a, c, g, or t
gtggaaaataaaaaaatatcatcaagtagtcccatagggtttttcgattccggattaggaggattaactatactatcggaagtatatcaaatgctacctaatgaacagttgatttatttggcagatagtaaaaatgctccctacggcaaaaaatctaaagaagaaattattgctttaagtattaaaaatactgaaaaactgattgatttaggatgcaaaatgattgtggtagcttgtaatacagccacaacaaatgccattaaatatttaagagaaaattatagtattccttttataggaattgaaccagcaataaaacctgctgctttaaattctaaaacagataaagtgggagtgttagcaaccaaaggaaccttaagtagtgagttgttacactaccgccaaaaagttaaaacacgccagcataacccataa

SEQ ID NO: 16704 - protein, 144 aa, Unknown
  Obtained from environmental sample
  DOMAIN (11)...(143): Asp/Glu/Hydantoin racemase
  misc_feature (1)..(144): Xaa is any amino acid
MENKKISSSSPIGFFDSGLGGLTILSEVYQMLPNEQLIYLADSKNAPYGKKSKEEIIALSIKNTEKLIDLGCKMIVVACNTATTNAIKYLRENYSIPFIGIEPAIKPAALNSKTDKVGVLATKGTLSSELLHYRQKVKTRQHNP

SEQ ID NO: 16705 - DNA, 339 bp, Unknown
  Obtained from environmental sample
  misc_feature (1)..(339): n is a, c, g, or t
ttgtatatttgcagtatgatagaattaactaaagcagaagaagaaataatgcaagtagtttggcagttaaaaaattgttttgtaaaagaaataattgagcaacttccagaaccaaaacctgcatacaatacggtttcaacaattgtaagaatattagaacgaaaaaactttgtgagttataaagcttttggaaaaacgcatcaatattatcctattataaataaagaagaatacaccaagtataaaactaacaacttattaagcaactattttggtggatcagcagaaaaaatgatgtctttttttataaaagaaaaaagattgatgtctcacaactag

SEQ ID NO: 16706 - protein, 112 aa, Unknown
  Obtained from environmental sample
  DOMAIN (6)...(111): Penicillinase repressor
  misc_feature (1)..(112): Xaa is any amino acid
MYICSMIELTKAEEEIMQVVWQLKNCFVKEIIEQLPEPKPAYNTVSTIVRILERKNFVSYKAFGKTHQYYPIINKEEYTKYKTNNLLSNYFGGSAEKMMSFFIKEKRLMSHN

SEQ ID NO: 16707 - DNA, 897 bp, Unknown
  Obtained from environmental sample
  misc_feature (1)..(897): n is a, c, g, or t
atgaaggaaacaggatcttattacacaccagaatatttaattaagttcatgtgtaaactaattaatcaatcaaaagcgaaaaatgttgaaaacgtgttagagccatcatttggggatggtcgttttttggacgagctgttacaatatagatttaaagatatttatggtgtagaactggattcgaaaaaagtaaatcagtacaaagctatcgaaaatgatactagattaaagtgtctaaattatgattttatggatttcgcaaaagaaactgatttaaaatttgatttaattattggtaatccaccttatattaaaaggtcacttatgactgaagaaaatattgaatacactaaagaattaatcagcaaaattgatggtggaaactacattaaagtaaatacatgggttatgttcttgcttgcatcaatcaaactcatttctaaaaatggtgctgtattttatgtgttaccattggatgttttacaggttttttatgccgaaagtattcgtaaacacctagagagtaagtttaatatgattaaagtatacgtgtctgatttccaaatgtttcccaaaatccagcaacgaacttgtgttttatacctttcaaatgagcctagtgttgaacctganatctcgtttcataaactggaattgtcaaagggaattttaaattcaaatttagtcaacactgtgaagagaaataaaccagtgaagaaatggacaaatgtttatttaggggacgttacgctagaatttataaaagagactcaggataaatatcctttactatncagtttaatagattctagtcccaggctggtgacnagtgctaataaagtctttgttgttaatgacgacatactaaaacaaaacaatttatctaagtattctaga

SEQ ID NO: 16708 - protein, 299 aa, Unknown
  Obtained from environmental sample
  misc_feature (1)..(299): Xaa is any amino acid
MKETGSYYTPEYLIKFMCKLINQSKAKNVENVLEPSFGDGRFLDELLQYRFKDIYGVELDSKKVNQYKAIENDTRLKCLNYDFMDFAKETDLKFDLIIGNPPYIKRSLMTEENIEYTKELISKIDGGNYIKVNTWVMFLLASIKLISKNGAVFYVLPLDVLQVFYAESIRKHLESKFNMIKVYVSDFQMFPKIQQRTCVLYLSNEPSVEPXISFHKLELSKGILNSNLVNTVKRNKPVKKWTNVYLGDVTLEFIKETQDKYPLLXSLIDSSPRLVTSANKVFVVNDDILKQNNLSKYSR

SEQ ID NO: 16709 - DNA, 864 bp, Unknown
  Obtained from environmental sample
  misc_feature (1)..(864): n is a, c, g, or t
atgactgagaataaaaaaataaaatttgctgttgtaggctgtggacatattggtaagcgacatgcagaaatgataattggcaatcctgaagcggaattagtagcactttgtgatgccgctccgaaagaaaacttagggattgaaaaatatgacgtacctttttttaattcattagaagattttttaaaatcagggattgaagtagatgttgtaaatatttgtacaccaaatggtttacattccgaccaagcttcattagcattagattataacctacacgtagtagttgaaaaacctattggcttatctaaagcaaaatgcgaaaaagtaatttataaagcacttagaaatcacaaacaagtatttgctgttatgcaaaaccgttactctcctccttctgtttggataaaggatttaatagaacgaaaagtgttaggcgaaatttttatggttcagttaaattgttattggaacagagatagtcgttactataaaaaaggtggctggaaaggaacgcaagatttagatggcggtactttatttacgcaattctctcactttatagatattatgtattggttgtttggcgacattaccaatatacaagcaaagtttaaagattttacgcacaaagattctaccgattttgaagactctggttttgtaagttttgattttattgaagggggtatgggttgtttgaattactctacagcagttgctactcaaaatttagaaagtagcatcaccattattggtgaaaaaagaagtgtaaaaattgccggtcagtacatgaatgaggtgggagtttgtaatattgatggttatgaaatgcctcaacttgaagcagcaaaaccttcctaa

SEQ ID NO: 16710 - protein, 287 aa, Unknown
  Obtained from environmental sample
  DOMAIN (137)...(254): Oxidoreductase family, C-terminal alpha/beta domain
  misc_feature (1)..(287): Xaa is any amino acid
MTENKKIKFAVVGCGHIGKRHAEMIIGNPEAELVALCDAAPKENLGIEKYDVPFFNSLEDFLKSGIEVDVVNICTPNGLHSDQASLALDYNLHVVVEKPIGLSKAKCEKVIYKALRNHKQVFAVMQNRYSPPSVWIKDLIERKVLGEIFMVQLNCYWNRDSRYYKKGGWKGTQDLDGGTLFTQFSHFIDIMYWLFGDITNIQAKFKDFTHKDSTDFEDSGFVSFDFIEGGMGCLNYSTAVATQNLESSITIIGEKRSVKIAGQYMNEVGVCNIDGYEMPQLEAAKPS

SEQ ID NO: 16711 - DNA, 483 bp, Unknown
  Obtained from environmental sample
  misc_feature (1)..(483): n is a, c, g, or t
atgtttaaaactatattatttacttttatacttattacaaatattttttcacaagaactcattttaggaaaaattgataagtttgatttacctgacttaaacctaaagtctgtaagagcaaaaatagatacaggagcaaaaacctcatcactgcattgtatgacaataaaaccaactaaaaatggttatgtaaaatttattacacttgatgaaaataataaaaaatttacaggtgattatatcacaaaaaagatttctagaattgccaatgtaaaaagttcaaatggaactatacaaacaagatatttcatacaaacacctattgttatttataataaaacttacaatatggagttgtccttaagttttagaggaagtatgaaatttcctcttttaataggtagagaacttataaagcaagattttttagtagatgttacaaaaaaagatttatcgtttaacgctagtcagttgtctcaatag

SEQ ID NO: 16712 - protein, 160 aa, Unknown
  Obtained from environmental sample
  SIGNAL (1)...(17)
  DOMAIN (21)...(155): Protein of unknown function (DUF785)
  misc_feature (1)..(160): Xaa is any amino acid
MFKTILFTFILITNIFSQELILGKIDKFDLPDLNLKSVRAKIDTGAKTSSLHCMTIKPTKNGYVKFITLDENNKKFTGDYITKKISRIANVKSSNGTIQTRYFIQTPIVIYNKTYNMELSLSFRGSMKFPLLIGRELIKQDFLVDVTKKDLSFNASQLSQ

SEQ ID NO: 16713 - DNA, 561 bp, Unknown
  Obtained from environmental sample
  misc_feature (1)..(561): n is a, c, g, or t
atgaagcaatatattaatggtgaaagtgaaattgatttatatgagttgataaaatcaatatttacattcatgtttaaaaataagtggttactgttattagctctttttttaggagccgctttaggttggtttagagttaaacaacaacctaatatttatactaattattatcagtcaactttttatgtaaaatcgtctgtaataactgacgaaatgttacatacttttattaaaaatttgaatgagcaattaccaattgtcgataacgaattaacaaaagtgttaaaagaggtagagcctgttaaagagttaagtatagatggtttaagatctgatattaaaatctatgttaattataaagagccggtaaaaaatgaggtcattattaattttttgggcgattacttaaaaggcttgggttattatcaaacaagagtcgattctaataccttttatattaaggaactacaacatataattgagcaaaagtttgatagtttaggtgttcgattaactaataatgatgcaaaaattcaattaaatcaacccgagccgatctga

SEQ ID NO: 16714 - protein, 186 aa, Unknown
  Obtained from environmental sample
  misc_feature (1)..(186): Xaa is any amino acid
MKQYINGESEIDLYELIKSIFTFMFKNKWLLLLALFLGAALGWFRVKQQPNIYTNYYQSTFYVKSSVITDEMLHTFIKNLNEQLPIVDNELTKVLKEVEPVKELSIDGLRSDIKIYVNYKEPVKNEVIINFLGDYLKGLGYYQTRVDSNTFYIKELQHIIEQKFDSLGVRLTNNDAKIQLNQPEPI

SEQ ID NO: 16715 - DNA, 843 bp, Unknown
  Obtained from environmental sample
  misc_feature (1)..(843): n is a, c, g, or t
atgtatcagaatcggctcgagttcgggaaatcttttaatttaaaaattaaaacaaataaagaagcgaaaggtttaagtgggttgtttaatagaaaacaacgggctcaaatttcatatacttactataatgcaccaataattgaaaagccatggctgcatcgcccagatgagatttccagggatggtcaaacattttatccccgaaaagaaacgatttacggcacgggtctaattgattattatacatcccttggtggtgtagctgcaactattggtgtagctatttttaaaaaaataacagaaggtctggtgcatcaaataatagaacactgtcagtgtcctgatcagtttgaacaattccttgatggtaaaaaatatcaaatgaatgctgaggggattttttttaatattgataataaggatgagatcttactcgattcactggatatcccggtttcatattttaaagaatcatattttgcgatggatgaaaatgatcaaataattcatgggttgaatgatgaaaccattaagactgatgaaagaataaataagagattctcagtaaatacaaaaagagtaacttttgtaactgattatgagagaacatataaatatggaaaatttaagatagacatagcaatagacaaagatgctaattataaagatttaactttctttaaagatgttatacctgctttttttgcccgcagaggtggattgattactgcagttatcggaactgcaattatgtatactctgattaaatttcaattgttaacaattgatttatacgggcttattgccggtgcatttttctttctcggaatatcccggggatag

SEQ ID NO: 16716 - protein, 280 aa, Unknown
  Obtained from environmental sample
  misc_feature (1)..(280): Xaa is any amino acid
MYQNRLEFGKSFNLKIKTNKEAKGLSGLFNRKQRAQISYTYYNAPIIEKPWLHRPDEISRDGQTFYPRKETIYGTGLIDYYTSLGGVAATIGVAIFKKITEGLVHQIIEHCQCPDQFEQFLDGKKYQMNAEGIFFNIDNKDEILLDSLDIPVSYFKESYFAMDENDQIIHGLNDETIKTDERINKRFSVNTKRVTFVTDYERTYKYGKFKIDIAIDKDANYKDLTFFKDVIPAFFARRGGLITAVIGTAIMYTLIKFQLLTIDLYGLIAGAFFFLGISRG

SEQ ID NO: 16717 - DNA, 309 bp, Unknown
  Obtained from environmental sample
  misc_feature (1)..(309): n is a, c, g, or t
atgaattttaatgctgtggttagtttgttgattgctattggtgaagaaaataaaaaaattgatcagcagataaaagatgactatacttttaactggaatgatatatcaaaaatgagggataaaatatctcataattatcgtggaataaatccttatatggtgtgggatattattaaaaactcttttggtgagtatcaaaatattcttagagagattttgccaaatatcgatcaatatgaagaggcattggatgatgctttagattcaaatttttatagtcatttagaatatttaaaagataaaaagtaa

SEQ ID NO: 16718 - protein, 102 aa, Unknown
  Obtained from environmental sample
  misc_feature (1)..(102): Xaa is any amino acid
MNFNAVVSLLIAIGEENKKIDQQIKDDYTFNWNDISKMRDKISHNYRGINPYMVWDIIKNSFGEYQNILREILPNIDQYEEALDDALDSNFYSHLEYLKDKK

SEQ ID NO: 16719 - DNA, 324 bp, Unknown
  Obtained from environmental sample
  misc_feature (1)..(324): n is a, c, g, or t
ttgaatttaataaaattaggtgctattactataattggaacactaggatggttattatataaaaaaagaaaaagaaatttttttgtaagttatcatagtaaaaatgatgctcgatataggatgataatagctgattttacaaacagtagtactaacgtatattttgaagcgggtttcgccatgggtatgagaattccagtaatatggacatgtaaagaagggcatgagttctcttttgatacaggtcaatttccacatatcacatggcaagatgcagatgatttaaaaaaacagcttgtaaatagaatacaagcaattatctag

SEQ ID NO: 16720 - protein, 107 aa, Unknown
  Obtained from environmental sample
  misc_feature (1)..(107): Xaa is any amino acid
MNLIKLGAITIIGTLGWLLYKKRKRNFFVSYHSKNDARYRMIIADFTNSSTNVYFEAGFAMGMRIPVIWTCKEGHEFSFDTGQFPHITWQDADDLKKQLVNRIQAII

SEQ ID NO: 16721 - DNA, 792 bp, Unknown
  Obtained from environmental sample
  misc_feature (1)..(792): n is a, c, g, or t
gtgcattaccaggtggttgatgtggatctttcgtcaagaaatctgaaaaaagcctttctctttatgagacagaaggttgaactgacgatacttgatattttaagacaatctccaaatgggatgcctgaaagctatcttgggctttatgctcaaagtatggcggcaaacattgatctttttaacagattcgataagaaagccgaggttctgaaagttcttttatcacagaaagatgaatttcaaaagacagtaggagttcccgttaacgatgaagttttttctattctggcacggactcttttttctgaaaaaatagaaaaggctgtggagaatattcatctgagacttggatcatactatatttccagagatggtgttcctgctgattatgagcttaatcatattgctgttaaaaaaggtgactcgattatagatgttccgcttgataaggttatttccggtgaaaatctcagagaggagatcaagtacagtcagaatgttcttttgcagacaaatgagctgtcaggaaaaggtctggaggtcgtagcctctctttcttactggacaatcagggataacattattttctcaaacgagctgactgaagaaaaaaagcttgttgcatggaataactcggcaaaggaagagttcacaattaaaaatggtgaagttgtaaaaaggtccggagagattatcacttcaagagacatcatgatctttcgcgagatatccaaacagtcatccgacaagtcttttttgagggtttttattcaaaatctcgagccgatctga

SEQ ID NO: 16722 - protein, 263 aa, Unknown
  Obtained from environmental sample
  misc_feature (1)..(263): Xaa is any amino acid
MHYQVVDVDLSSRNLKKAFLFMRQKVELTILDILRQSPNGMPESYLGLYAQSMAANIDLFNRFDKKAEVLKVLLSQKDEFQKTVGVPVNDEVFSILARTLFSEKIEKAVENIHLRLGSYYISRDGVPADYELNHIAVKKGDSIIDVPLDKVISGENLREEIKYSQNVLLQTNELSGKGLEVVASLSYWTIRDNIIFSNELTEEKKLVAWNNSAKEEFTIKNGEVVKRSGEIITSRDIMIFREISKQSSDKSFLRVFIQNLEPI

SEQ ID NO: 16723 - DNA, 498 bp, Unknown; identical to SEQ ID NO: 8655
  Obtained from environmental sample
  misc_feature (1)..(498): n is a, c, g, or t

SEQ ID NO: 16724 - protein, 165 aa, Unknown; identical to SEQ ID NO: 8656
  Obtained from environmental sample
  misc_feature (1)..(165): Xaa is any amino acid

SEQ ID NO: 16725 - DNA, 582 bp, Unknown
  Obtained from environmental sample
  misc_feature (1)..(582): n is a, c, g, or t
atgggctttcttccacggcataaaaatacaaaaaaatcagaaaaaccgttattggcacagatattaaaattgataccaaatcatattcttcaagactctatacggataaatcagacagataaaggttgttgggcatacaaaacgtatgatcaattagtggcaatgattttcggacagcttaataaatgcctgagtttaagagagattaacttaggtttaagtgttgatgagaaattaatcagagatttaaatttagttcaaagccctgcaaaatcaacaatgtcagatggtaattcaaatagggactggaaagtatatgagtatatctattttgagctcataaaatattataaaggtattttttcaaaacagccaggctataaagaaataactgaaatagagggtaagacaataaagctggttgatgctacaattatgagcgtatgttttgaccttttcgattgggcaaagtatcggacagctaaaggtggtataaagatacacaccagtttagatgaaaggactcttttgcgggatattatcaatattacagaagcaaacttagcgaccgacgtggtgtag

SEQ ID NO: 16726 - protein, 193 aa, Unknown
  Obtained from environmental sample
  misc_feature (1)..(193): Xaa is any amino acid
MGFLPRHKNTKKSEKPLLAQILKLIPNHILQDSIRINQTDKGCWAYKTYDQLVAMIFGQLNKCLSLREINLGLSVDEKLIRDLNLVQSPAKSTMSDGNSNRDWKVYEYIYFELIKYYKGIFSKQPGYKEITEIEGKTIKLVDATIMSVCFDLFDWAKYRTAKGGIKIHTSLDERTLLRDIINITEANLATDVV

SEQ ID NO: 16727 - DNA, 462 bp, Unknown
  Obtained from environmental sample
  misc_feature (1)..(462): n is a, c, g, or t
atgacgaaaattaatcaagttgataaagattcaaaatattatcttattggtgctagacgaaaagattttttaggttttaagacgataacaaaacaagatatgaacttattattttcaaatatttcttcaaagattgaaaaaatacctggagaagatactgatgatcatatggaaagatttcataatttattgaatggtgaagaatatgttcataactgtgctcaattaaaaaaagcaaaacaaatatttcttagtaagtattttgacaatttacctgcattcgagcaatattctatagatcctccctatgatgtgggtcgtgatttggcaaatttaactcttcatgtattaatggggcatcctctcgtaactaaaaacacaacacctaattatgaattatctgaaagattatcaaaattaattctaacgggtgttgattgtgaaattggaaaaaatcattaa

SEQ ID NO: 16728 - protein, 153 aa, Unknown
  Obtained from environmental sample
  misc_feature (1)..(153): Xaa is any amino acid
MTKINQVDKDSKYYLIGARRKDFLGFKTITKQDMNLLFSNISSKIEKIPGEDTDDHMERFHNLLNGEEYVHNCAQLKKAKQIFLSKYFDNLPAFEQYSIDPPYDVGRDLANLTLHVLMGHPLVTKNTTPNYELSERLSKLILTGVDCEIGKNH

SEQ ID NO: 16729 - DNA, 837 bp, Unknown
  Obtained from environmental sample
  misc_feature (1)..(837): n is a, c, g, or t
atgataatactaaatcgaattgatactttaaagaacgaactaaggcagataacaaaagataaaaaaattgctttcgtaccaacaatgggtgctttacatgagggacatttaagtttaatctcaaaagcaaaaaaagaaaatgatattgttgttgtctccatatttataaatcctactcaatttttacaaggggaagatttagatacatacccaaaaaaagaacaagctgatgcaaagctatgtgagctgtgtggtgttgattatctttttttaccaaataaagagatgatgtatgaaaaagatgagatacttattaaagcacctaaaacaaaaggttttattttagaaggtgaaaaaagacctggacactttgatggaatgttacaaatagttttaaaactttttaatatcgtaaaccccacaaatgcttattttgggaaaaaagatgcacaacaactctcattaattaatcaaatggttaaaaatttttatttagatattaatattgtagcttgcgaaatagtcagagaaaataatggtttagccatgagtagtagaaatgtttatctagataaagatcaaagagaattagcattaaatatttcaagatctttaaactttgcggctaaagcagtgggtgcaaataaaactaactctacactaattataaaggagatggaagattttttatcccagtatacagagataaagattgagtatatcactatagtaaatagagagtttgaacagattaatacaatagaaataaaaaatagtataatactaatagctgtaaaaataggaaatattaggttaattgataatatttgggtttaa

SEQ ID NO: 16730 - protein, 278 aa, Unknown
  Obtained from environmental sample
  DOMAIN (1)...(278): Pantoate-beta-alanine ligase
  misc_feature (1)..(278): Xaa is any amino acid
MIILNRIDTLKNELRQITKDKKIAFVPTMGALHEGHLSLISKAKKENDIVVVSIFINPTQFLQGEDLDTYPKKEQADAKLCELCGVDYLFLPNKEMMYEKDEILIKAPKTKGFILEGEKRPGHFDGMLQIVLKLFNIVNPTNAYFGKKDAQQLSLINQMVKNFYLDINIVACEIVRENNGLAMSSRNVYLDKDQRELALNISRSLNFAAKAVGANKTNSTLIIKEMEDFLSQYTEIKIEYITIVNREFEQINTIEIKNSIILIAVKIGNIRLIDNIWV

SEQ ID NO: 16731 - DNA, 432 bp, Unknown
  Obtained from environmental sample
  misc_feature (1)..(432): n is a, c, g, or t
atgataatactaaatcgaattgatactttaaagaacgaactaaggcagataacaaaagataaaaaaattgctttcgtaccaacaatgggtgctttacatgagggacatttaagtttaatctcaaaagcaaaaaaagaaaatgatattgttgttgtctccatatttataaatcctactcaatttttacaaggggaagatttagatacatacccaaaaaaagaacaagctgatgcaaagctatgtgagctgtgtggtgttgattatctttttttaccaaataaagagatgatgtatgaaaaagatgagatacttattaaagcacctaaaacaaaaggttttattttagaaggtgaaaaaagacctggacactttgatggaatgttacaaatagttttaaaactttttaatatcgtaaaccccacaaatgcttaa

SEQ ID NO: 16732 - protein, 143 aa, Unknown
  Obtained from environmental sample
  DOMAIN (1)...(143): Pantoate-beta-alanine ligase
  misc_feature (1)..(143): Xaa is any amino acid
MIILNRIDTLKNELRQITKDKKIAFVPTMGALHEGHLSLISKAKKENDIVVVSIFINPTQFLQGEDLDTYPKKEQADAKLCELCGVDYLFLPNKEMMYEKDEILIKAPKTKGFILEGEKRPGHFDGMLQIVLKLFNIVNPTNA

SEQ ID NO: 16733 - DNA, 765 bp, Unknown
  Obtained from environmental sample
  misc_feature (1)..(765): n is a, c, g, or t
ttgattattcagttaccaacttcaaaaattgattctattatgagttttaataatgagtntgataaatcaggtttaggaaaaacagaaagtgtatttttagttggaagtgactataaaatgagaaatgattatagatttattgatagtttaacaaataaggatgttaaaagttcaagtacaactgtttctctttttgaaatgaagacagagtccacacttgatgtttttaaaaatggtaaaaatcataaagagataaaaaatataaatgcagaggatgtcttaagttcttatgatacattagatgtatttgatacaaaatgggcagtagttgctgaaataaatagtgatgaagcctttgaacaagcaacacaattaaatatgatattgataggtatatctttacttgttttatctatcacaatatttgtatcaataattttactaaatggatttattattaagcccttaaataggtttcaaaatggactgttaggcttttttaagtatttaaataatgaagtgtcaaatgttgaatatctagatgaaagaggagatgatgaaatctctaagatgtcaagtgtggtaaatgaaaatattaaaaaaacagatgaaacaataaagaaggataaaattctaatagctgaaacagttaaggttttaggagagtttcaaaatggagatctatcacaaagaattaaaaaagattccaataatccagcactaaatgaactaaaaaatgttttaaataatatgggaagtaattag

SEQ ID NO: 16734 - protein, 254 aa, Unknown
  Obtained from environmental sample
  misc_feature (1)..(254): Xaa is any amino acid
MIIQLPTSKIDSIMSFNNEXDKSGLGKTESVFLVGSDYKMRNDYRFIDSLTNKDVKSSSTTVSLFEMKTESTLDVFKNGKNHKEIKNINAEDVLSSYDTLDVFDTKWAVVAEINSDEAFEQATQLNMILIGISLLVLSITIFVSIILLNGFIIKPLNRFQNGLLGFFKYLNNEVSNVEYLDERGDDEISKMSSVVNENIKKTDETIKKDKILIAETVKVLGEFQNGDLSQRIKKDSNNPALNELKNVLNNMGSN

SEQ ID NO: 16735 - DNA, 435 bp, Unknown
  Obtained from environmental sample
  misc_feature (1)..(435): n is a, c, g, or t
atgtcatatgtaagaatatggattcatacagtttgggcaacgaaaagtagagagcgattaataacaaaagaactaaaacctaaactattagctcacatgagggaaaatgcaaaggacaaaaagatttatattaaagaaattaattgtgaagccgaacatatgcacgcactaatatccttatcaacagagcaatcaattggaaaggtgctacaattattgaaaggggaatcatcacattgggtaaataaaaacagattgactaaaactaaatttggatggcaagaagagtattttgcagtatcagtaagtgagtcacaaactgaaaaagttgtcagatatatcagaacgcaagaagaacatcacagaaaaaaaagttatactgaagaatgcgatgagttttataagaaatatggttttgagaaatttaatgaatga

SEQ ID NO: 16736 - protein, 144 aa, Unknown
  Obtained from environmental sample
  DOMAIN (11)...(110): Transposase IS200 like
  misc_feature (1)..(144): Xaa is any amino acid
MSYVRIWIHTVWATKSRERLITKELKPKLLAHMRENAKDKKIYIKEINCEAEHMHALISLSTEQSIGKVLQLLKGESSHWVNKNRLTKTKFGWQEEYFAVSVSESQTEKVVRYIRTQEEHHRKKSYTEECDEFYKKYGFEKFNE

SEQ ID NO: 16737 - DNA, 957 bp, Unknown
  Obtained from environmental sample
  misc_feature (1)..(957): n is a, c, g, or t
gtgcccagggccaaacatttcattttccaaaaagatgatgtacaagatagtaaaaaactttataagtggtttatggaaaatgagagtgaagtaaaagagtggaatgatgaatataaaaatcatccaagtaaacagatgagttcactagcttcaaaatatggtgatatggttgacaagagacctgatgaattattgaatgatagaaaagtagctagagagtttgtaaggaactatacaaaagatcttttacaatatgcaggagatgctagaaaatctctttataaaatacaaaatgtaaaacaaaaacaatttaaaaatgaatttaaagaagagagaattaccaaaaatagttttgatacagagtttaagagattagatagtttacaaaacagactgatacaaggaaaagagataaacgagggaagtctcaaaagatacaacatagatacaagcatattttcaacagatgctaaaactatcgaacttgatggaataaatttaaaagagcaggatagtgaagtaagaaaaaatgtgatatctaaaattaatgatcataaagaaaatttagataagagactggaagataaaataattgatgaagaatatcacaaaacttatatcaaaaaagcaactgcattaaactatgtggtatctaaagcggataatattagtatatctgctttagaaaatattggattagatagagagacagatttaaaagatctaaaaattgaaaaggtacaaactgaactaaaaataattaattttaaagatacagatatagaaaatagttacattgatattctaaaggctgaaagtgaaaataaattaaaaccactcaatcatcaaatgcaaaaaatagcagctattgaaaataatttaaaagtaaaagcagataattttagtcttacgaattataaagatgcaaataaatttatagatacatacaaagaatag

SEQ ID NO: 16738 - protein, 318 aa, Unknown
  Obtained from environmental sample
  misc_feature (1)..(318): Xaa is any amino acid
MPRAKHFIFQKDDVQDSKKLYKWFMENESEVKEWNDEYKNHPSKQMSSLASKYGDMVDKRPDELLNDRKVAREFVRNYTKDLLQYAGDARKSLYKIQNVKQKQFKNEFKEERITKNSFDTEFKRLDSLQNRLIQGKEINEGSLKRYNIDTSIFSTDAKTIELDGINLKEQDSEVRKNVISKINDHKENLDKRLEDKIIDEEYHKTYIKKATALNYVVSKADNISISALENIGLDRETDLKDLKIEKVQTELKIINFKDTDIENSYIDILKAESENKLKPLNHQMQKIAAIENNLKVKADNFSLTNYKDANKFIDTYKE

SEQ ID NO: 16739 - DNA, 1020 bp, Unknown
  Obtained from environmental sample
  misc_feature (1)..(1020): n is a, c, g, or t
atgacagaatggctgagttatgactactcatctataagtgaactaagtggaaaaaatataagtgctgcaacatctgtaaaagatactattgcttcaaatggtagttttaataaagcaccaactggagcaactgcaggtgtgacaaatatgtcaagtggtggaagtattggtggaggtggtgcttcaagtttggcaggatatagctcttctattggtggaagttttggaggtggaagtgttccaggtattactcaatttggtttagtaaaaatgacaggaacagaggggaaacttcaaaatggatatacaatagggaaagatgcagtttcacgagcaagtgcatcattagattatatcactagagaagaaaatggaaaatcaattgcagagataaaagatgaatatggaaatagactatctaaactagaagctaaaaataaaatcaataatattcaagctgaaagaagattggtattaagtccaaatcctagattgaatttagatgataaacagctagataagattgtcagaacaactatgagtagttattctgagagttttggaaaagaatttgaatatatgtacgcaatacataataatacagcaactcctcatgctcatatacaaatgtttacgaaacatcctgatggagatggtatcaagatgtataaagatgaattatttgaacttaaaatgaattttgaagatgcagtanaagaggaagttgaaaattcanatataaaaataaaagacaatacaactttaccaatggctagacaaattggaaattttattggtgctattcctgatacaaatatgttttatcaaaataaatttttagctaacaagatatctaaaaagtttgatttagattatgatcaaaaaactataggtaatgatccacaaaaacttgaagaatggtttactaaaaatccaactctatttaaagagtattttatgagtgccacaaataaagaagcatttttattccaggattattctaaaaagtgcaatgaacta

SEQ ID NO: 16740 - protein, 340 aa, Unknown
  Obtained from environmental sample
  misc_feature (1)..(340): Xaa is any amino acid
MTEWLSYDYSSISELSGKNISAATSVKDTIASNGSFNKAPTGATAGVTNMSSGGSIGGGGASSLAGYSSSIGGSFGGGSVPGITQFGLVKMTGTEGKLQNGYTIGKDAVSRASASLDYITREENGKSIAEIKDEYGNRLSKLEAKNKINNIQAERRLVLSPNPRLNLDDKQLDKIVRTTMSSYSESFGKEFEYMYAIHNNTATPHAHIQMFTKHPDGDGIKMYKDELFELKMNFEDAVXEEVENSXIKIKDNTTLPMARQIGNFIGAIPDTNMFYQNKFLANKISKKFDLDYDQKTIGNDPQKLEEWFTKNPTLFKEYFMSATNKEAFLFQDYSKKCNEL

SEQ ID NO: 16741 - DNA, 681 bp, Unknown
  Obtained from environmental sample
  misc_feature (1)..(681): n is a, c, g, or t
atgaaatttagtattagtggaactgtgtttaatgcagaaacagatgagattatcccaaatgcattaatttcatttaaagacattaaaggtgataaagaaacaatatttattactacagatgaacaaggaaactacgagttagctttacaacctaattgggatttgtttattaaagctcaaaaggcaaaatactttggagatgcctctaatatttcaacaactggtttgactgaatctaagcattttttgcaagatttctttttaacaccaattccaatgggtgagcttgaaattccaggtatagaatatgattttgataaagctaccttaagaccaaaatcaaaagaaattttagataaattaattgaatttttaacactaaatgacaacattgttattgagattagagcacatacagatgcaagaggaaatgatgattataatttaagattatctcagcaaagggctcagtcggttgttgattatttgataaaaggaggaataacaaaagaaaggcttcaagctgttggaaaaggtgaaacagaaccattagatgattgttctaaatatgaagattgtggtataacaggtaaagatgattgcgattgtcatcaaaaaaatagaagaacagcatttaaaactttaagcgaagattttaaagatgtatttaaagggaaatag

SEQ ID NO: 16742 - protein, 226 aa, Unknown
  Obtained from environmental sample
  DOMAIN (102)...(208): OmpA family
  misc_feature (1)..(226): Xaa is any amino acid
MKFSISGTVFNAETDEIIPNALISFKDIKGDKETIFITTDEQGNYELALQPNWDLFIKAQKAKYFGDASNISTTGLTESKHFLQDFFLTPIPMGELEIPGIEYDFDKATLRPKSKEILDKLIEFLTLNDNIVIEIRAHTDARGNDDYNLRLSQQRAQSVVDYLIKGGITKERLQAVGKGETEPLDDCSKYEDCGITGKDDCDCHQKNRRTAFKTLSEDFKDVFKGK

SEQ ID NO: 16743 - DNA, 615 bp, Unknown
  Obtained from environmental sample
  misc_feature (1)..(615): n is a, c, g, or t
gtggaatttgcaaaccactctttaagccatgactacctcatagctctaaaatctgaaacaaaaagtagttggaaagaacgtgttacaaaagagataatcgatgctcaaaaaaaattgcatgatgagcttggaacttttgcaaatgaaaagcctaaacttttctcttacccttttggtgagtacagcaaagagctaaaaaatcttctaaaagatctagactacataggagttacacaaacatcaggtgtcatagactctgagagtgacttaagagccataccccgttttgccatgacagatattttcggtaatcaaaaagggtttattttaaaggtaaatacacttcctttagctgttgagtccatatctccaattgatcctattgtcacttcaaaaaatccacccatcttagagataacgctaaaaaagcccataaaaaatgtagggtgttacagagcaaatggagagagaataaatataaattggatatctgaaactacactacaaatccaagccaaaacaccactaaaagctccaagagatcactacacatgcacagcccccgcaaatgatggcaaatggtattggtacagcaatttatggataatcaagtag

SEQ ID NO: 16744 - protein, 204 aa, Unknown
  Obtained from environmental sample
  misc_feature (1)..(204): Xaa is any amino acid
MEFANHSLSHDYLIALKSETKSSWKERVTKEIIDAQKKLHDELGTFANEKPKLFSYPFGEYSKELKNLLKDLDYIGVTQTSGVIDSESDLRAIPRFAMTDIFGNQKGFILKVNTLPLAVESISPIDPIVTSKNPPILEITLKKPIKNVGCYRANGERININWISETTLQIQAKTPLKAPRDHYTCTAPANDGKWYWYSNLWIIK

SEQ ID NO: 16745 - DNA, 447 bp, Unknown
  Obtained from environmental sample
  misc_feature (1)..(447): n is a, c, g, or t
ttgatttctgtatctgttatcgtaaatttattacgtttaaaaaatataaaaaaggaaaaaaatatgctttatacagttgagtcaaaaaatgatcttaatagagtaaaagaagagatggaagttaaagctaaagagcttggttttggtattttaaaagagtactcatttaaaaagatgcttaatgagaagggttttccaattgagaaagacataactgtttttgaactatgtaatccaagtgcggcacaaaaagcattaactcttcacccagagctttcagtatacctaccatgtagaatttcattatatgaaaaagatggaaaaacagttttaagcactattgcattagaagatatgttaggtagttttgatttagagagttcatttaaaaaagagctgagtacaatttttgataaactaaaaaagttaatcactaactgtgaataa

SEQ ID NO: 16746 - protein, 148 aa, Unknown
  Obtained from environmental sample
  DOMAIN (23)...(143): Domain of unknown function DUF302
  misc_feature (1)..(148): Xaa is any amino acid
MISVSVIVNLLRLKNIKKEKNMLYTVESKNDLNRVKEEMEVKAKELGFGILKEYSFKKMLNEKGFPIEKDITVFELCNPSAAQKALTLHPELSVYLPCRISLYEKDGKTVLSTIALEDMLGSFDLESSFKKELSTIFDKLKKLITNCE

SEQ ID NO: 16747 - DNA, 423 bp, Unknown
  Obtained from environmental sample
  misc_feature (1)..(423): n is a, c, g, or t
atgaaaaatatattctttctttttatagcagttctgattttaagcaattgtaaaaattcaacaatagatgaacttcatgcacaaaatcaaatattagattcaaacaaagtaattgagccattagatttccatccggaaattaataaaatggttaccagaattttatctaggtatcattataaagaaatgaatttaaatgattctctctcatctgtaatatttgataattacataaaatctctagattataataaatcatatttcctacaaagtgatttagacgaatttgaaaaatatcgttatgaatttgatgaaaatttatacttaggtaaattatttcctgcctatcatatttttaatttatataaatcaagaatgggggaaagaattgatttgctctcaaaagttagaaacccgatttga

SEQ ID NO: 16748 - protein, 140 aa, Unknown
  Obtained from environmental sample
  SIGNAL (1)...(19)
  misc_feature (1)..(140): Xaa is any amino acid
MKNIFFLFIAVLILSNCKNSTIDELHAQNQILDSNKVIEPLDFHPEINKMVTRILSRYHYKEMNLNDSLSSVIFDNYIKSLDYNKSYFLQSDLDEFEKYRYEFDENLYLGKLFPAYHIFNLYKSRMGERIDLLSKVRNPI

SEQ ID NO: 16749 - DNA, 852 bp, Unknown
  Obtained from environmental sample
  misc_feature (1)..(852): n is a, c, g, or t
ttgatgggatttataattgacttaagaaacaatgggggcggtgctttggatgaggcagtagaattaacaggtttatttattgaagatggtccagttgtacaagtaaaacaatcatcagggaaaatagatattgaaaaagatcctgatccagcaattgtttacgatggcccattatcagttatagtaaacagatatagcgcttcagcttcagaaattttttctggtgcaatacaagattatgggcgcggacttgttctaggtgaacaaacttatggaaagggtacagttcaaaacttaattgggttagatcggtttgttccatcggccggagataagagcggacatctaaaattaactattgcaaagtattataggataaacggaagtagtacacaaaatcttggagttgttcctgatattgctttcccatcagctgttgatccagacgaatatggtgaaagttcaagaccaagtgcattaaaatgggatcaaattaaaaccagtgaatttaaaaagtatggcgatttaacagaaataattccatcattgttagaaaaacaccaagaaagaattttaagtgaaccggagtttaactatttaatggaagatataagagagtataaagaaaagaaaaataaaattgaattttctttaaatgaaagcgttagaaaagaagaacgtgagacaagagaagccaaaagaaaggatagggaagaacaaagagaaaagtttaataaaatagaaattattgataaagaagaagtaagtaaaaaaagtcttaaagttgaagatccatttttagaagaaactggacatattttggcagatttgttgattatgtcaaacagctaa

SEQ ID NO: 16750 - protein, 283 aa, Unknown
  Obtained from environmental sample
  DOMAIN (1)...(142): Peptidase family S41
  misc_feature (1)..(283): Xaa is any amino acid
MMGFIIDLRNNGGGALDEAVELTGLFIEDGPVVQVKQSSGKIDIEKDPDPAIVYDGPLSVIVNRYSASASEIFSGAIQDYGRGLVLGEQTYGKGTVQNLIGLDRFVPSAGDKSGHLKLTIAKYYRINGSSTQNLGVVPDIAFPSAVDPDEYGESSRPSALKWDQIKTSEFKKYGDLTEIIPSLLEKHQERILSEPEFNYLMEDIREYKEKKNKIEFSLNESVRKEERETREAKRKDREEQREKFNKIEIIDKEEVSKKSLKVEDPFLEETGHILADLLIMSNS

SEQ ID NO: 16751 - DNA, 450 bp, Unknown
  Obtained from environmental sample
  misc_feature (1)..(450): n is a, c, g, or t
atggaatacagttgtttagaaaaattagttctaaaagcaatggaaactatatcgaattataattatacaaacgggtatattagaagtaacaaatcatatttcaaacgtgtattagaatttgctaaaattgaacccacattcaatttcaatcaagctacagaaaaaaagcttatacatttcatctgtggaacatatcggttggttgaaaataatctttcaattgataaaaaggatttagttcaccgatacatcagagcttttcatattctagaatcaatttataataatgaatctataaaattgcattataaagctaaaattatagatattcccaacaaatttaaaccaattactgaacaatattcaaattggctgagagaaagattagaatgtcagaatacaataaatacaaaaacttccagattattaactttcctttttatatattga

SEQ ID NO: 16752 - protein, 149 aa, Unknown
  Obtained from environmental sample
  misc_feature (1)..(149): Xaa is any amino acid
MEYSCLEKLVLKAMETISNYNYTNGYIRSNKSYFKRVLEFAKIEPTFNFNQATEKKLIHFICGTYRLVENNLSIDKKDLVHRYIRAFHILESIYNNESIKLHYKAKIIDIPNKFKPITEQYSNWLRERLECQNTINTKTSRLLTFLFIY

SEQ ID NO: 16753 - DNA, 456 bp, Unknown
  Obtained from environmental sample
  misc_feature (1)..(456): n is a, c, g, or t
atgaagaagaataatccatttcatgaatacctaaccaattatcttattacttatttacctctgcaaagaggaaatagtacaaataccgtaaaaagctatgcaacatcattttccttattatttcaatatttacaggaagaacaacatataaaagttgataaagttagttttgaaactcttactcttgatgttattaaagactttggaaactggttagaagcaaagagaaaatgtaaacctaaaactaggaatttaagaattcaggcaataaaaagtttttgcaattatgttatggtttttcacccagagtatagttctttggtaaaacctatattattaattaaagacaaaaaaattgtcattcctttacctcctcatctatctagtgaagagataataatactgcttaaacaacctaataccaaaaaaaaacaaggtgtaagagattggctttaa

SEQ ID NO: 16754 - protein, 151 aa, Unknown
  Obtained from environmental sample
  DOMAIN (11)...(96): Phage integrase, N-terminal SAM-like domain
  misc_feature (1)..(151): Xaa is any amino acid
MKKNNPFHEYLTNYLITYLPLQRGNSTNTVKSYATSFSLLFQYLQEEQHIKVDKVSFETLTLDVIKDFGNWLEAKRKCKPKTRNLRIQAIKSFCNYVMVFHPEYSSLVKPILLIKDKKIVIPLPPHLSSEEIIILLKQPNTKKKQGVRDWL

SEQ ID NO: 16755 - DNA, 396 bp, Unknown
  Obtained from environmental sample
  misc_feature (1)..(396): n is a, c, g, or t
atgggtcccgaaggaaagatcgggaacataattccctttctttttggcaacttccacaagaagagctgtgttgctgatatcggaataggtgacactcacaccaagctttatatctcccctgctgccccaacgtccaggtcctatcagcaaaaattgcctatgtggaagaatctgattaagttttcctattatcttacccaccatcttcaagtcttcaaggctcgacagctctccatatttaaccgggtcaacataaacaatatgagtgagatccggaaccgaaccattggaaatatgtttctccgctgtaaaaaggatttcatcctcaggaatatcctgtggaatcagggctggcttcaacaaggatggatcgaactgaggtctgcactgaagtag

SEQ ID NO: 16756 - protein, 131 aa, Unknown
  Obtained from environmental sample
  misc_feature (1)..(131): Xaa is any amino acid
MGPEGKIGNIIPFLFGNFHKKSCVADIGIGDTHTKLYISPAAPTSRSYQQKLPMWKNLIKFSYYLTHHLQVFKARQLSIFNRVNINNMSEIRNRTIGNMFLRCKKDFILRNILWNQGWLQQGWIELRSALK

SEQ ID NO: 16757 - DNA, 615 bp, Unknown
  Obtained from environmental sample
  misc_feature (1)..(615): n is a, c, g, or t
atgtttaataaagaaggtatccctttttttacaataactattccttttttatgtattgtttttttagctttcttttcaacttcatactacttaaaaaccacacaagagagttttgagtctgatttaatactatttgaaaaatacaatatgcaaaatagtgatacaactttagaaaagtactctttaatgattaaagagaaaaaagatatcttagaaaaaaagaatgatgagtttataaattttatttttattctaagtatttcaatcatattttttatggcactttttagttttcttatgacatcaattattagtgatattataaaaaagtataaaaaacaagtccaaaataaagaagaaaaacttgaaactctcaataaaactctagcttcaaaagtagctagaggaatagaagatggaaaaagaaaagataaagcaattctagatcagtcaagattagcaaaaatgggttcaatgatttcaatgatagcccatcaatggagacaacctttaagtgaactctccggtattttgatggaacttgnaaactgctacaagattttaaaaaagtggaggagagtcataatttttaacttccgtaaaatagaaagttaa

SEQ ID NO: 16758 - protein, 204 aa, Unknown
  Obtained from environmental sample
  misc_feature (1)..(204): Xaa is any amino acid
MFNKEGIPFFTITIPFLCIVFLAFFSTSYYLKTTQESFESDLILFEKYNMQNSDTTLEKYSLMIKEKKDILEKKNDEFINFIFILSISIIFFMALFSFLMTSIISDIIKKYKKQVQNKEEKLETLNKTLASKVARGIEDGKRKDKAILDQSRLAKMGSMISMIAHQWRQPLSELSGILMELXNCYKILKKWRRVIIFNFRKIES

SEQ ID NO: 16759 - DNA, 687 bp, Unknown
  Obtained from environmental sample
  misc_feature (1)..(687): n is a, c, g, or t
atggataataacttaatagatgaattaaaagatgtaacaatattgtgtgttgaagacgaagatggtattagagagtttattgtaaatactttaaaatactattttaaagaggtatatgcggctaaaaatggacttgatgcttatgaggtatatgaagagtataaacctaaaatagttttaacagatattgaaatgccaaagatggatggaattgaacttgtaaaaaaaatacgtaaaaatgatttatcaactatggttatcatgttaacagcctattcaaatgaagagtaccttatgaatttgataaatttaaacgttgatcattttattttaaaacctctaaattcaaaaaagctaaatgaagctttaaataaatatatagagagaaacttttcccaacagatacttttacatgcagatttaaagcttaatttatcaaaaagagaattgatttataaagatactgaaataatacctttgagaaaaagagagcaagattttttatatcttttacataaaaataaaaactcaataactacatatgaacagcttgaaatagagttatggcaagataagtttatgacaagccatgctttaaaatcttttataaaagagattagacataaaataccaataaatattataaaaaatatttcacaagcaggttatatattagtaaatgagtaa

SEQ ID NO: 16760 - protein, 228 aa, Unknown
  Obtained from environmental sample
  DOMAIN (154)...(225): Transcriptional regulatory protein, C terminal
  misc_feature (1)..(228): Xaa is any amino acid
MDNNLIDELKDVTILCVEDEDGIREFIVNTLKYYFKEVYAAKNGLDAYEVYEEYKPKIVLTDIEMPKMDGIELVKKIRKNDLSTMVIMLTAYSNEEYLMNLINLNVDHFILKPLNSKKLNEALNKYIERNFSQQILLHADLKLNLSKRELIYKDTEIIPLRKREQDFLYLLHKNKNSITTYEQLEIELWQDKFMTSHALKSFIKEIRHKIPINIIKNISQAGYILVNE

SEQ ID NO: 16761 - DNA, 465 bp, Unknown
  Obtained from environmental sample
  misc_feature (1)..(465): n is a, c, g, or t
atgggtcgatacgccaacaagaaaaatcaaattgaaagcgcttctatatttcaattatctctttcacatggatcagaactcgttgatgcagactatgcttatattgtcattccgggtatcgatatcaaaacattacaaaacatctttaagaaactgccaattatcattcaaaataataagatggctcaagccattcaatatgataccgattcatacatgattattttctataaggcaggagaagttacactgaataatatctataagcttactgtaaataaaccttcaattattcatcttaaaaaggaaatgaatacatggcaaatctgtatttcagacccattgcataaacaagaaaaaactaaaatcagaattagtaaaaaaggacatagtaaaacttgcacaatccttttccctactggaattaacaaaggaaaatcaattgaatcaactttaaatctttaa

SEQ ID NO: 16762 - protein, 154 aa, Unknown
  Obtained from environmental sample
  misc_feature (1)..(154): Xaa is any amino acid
MGRYANKKNQIESASIFQLSLSHGSELVDADYAYIVIPGIDIKTLQNIFKKLPIIIQNNKMAQAIQYDTDSYMIIFYKAGEVTLNNIYKLTVNKPSIIHLKKEMNTWQICISDPLHKQEKTKIRISKKGHSKTCTILFPTGINKGKSIESTLNL

SEQ ID NO: 16763 - DNA, 825 bp, Unknown
  Obtained from environmental sample
  misc_feature (1)..(825): n is a, c, g, or t
atggctgaaattaccataggaatgcctgtttttaacgatgtcgattttattgaactatcgttaaaaagtatattagaacaatcgtttaaagattttaatttaattatttcagatgatggatcttccgatggaagtcaggcaatttgtgagcaatatgcaggggtagataatagaattacttatataaggcagccaaaaaatttgggtatctctagaaatatggagtttttactttctcaatcaaatactccttattttatgtgggcagcagatgatgatttgtgggacaaaatgtttgttgaaaaattaataattttattaaatcaaaacaaagaagctatagctgctttttgtaggtatagtcttatcaatgatgagggggcacaattagataaaggaaggttatttcaatatggtgctgctaagccaaaccaacggttaaacaaatttattacgaacccgaatgatgcatttggatatggtatttttagaacagaaaaaataaaagggcttagatttcctgtttggtggtggcccaatcaaaaatgtgcctataataatatttaccctacgctttgtttctatttagctaagggagatatagtttatcatcaatcggatgttttattttttaagcgagttaaaaaagaagcattggttaatcataaactgccttacaaagaaaatagtttacccgaagtaattgcttacagcataaggaagtttaacctagtgtggatatcttttttgatgattaaaaaagcgagtgatttaaaagtagggttttctgttttccctttgctaatacaccaatgggtttattaa

SEQ ID NO: 16764 - protein, 274 aa, Unknown
  Obtained from environmental sample
  DOMAIN (5)...(167): Glycosyl transferase
  misc_feature (1)..(274): Xaa is any amino acid
MAEITIGMPVFNDVDFIELSLKSILEQSFKDFNLIISDDGSSDGSQAICEQYAGVDNRITYIRQPKNLGISRNMEFLLSQSNTPYFMWAADDDLWDKMFVEKLIILLNQNKEAIAAFCRYSLINDEGAQLDKGRLFQYGAAKPNQRLNKFITNPNDAFGYGIFRTEKIKGLRFPVWWWPNQKCAYNNIYPTLCFYLAKGDIVYHQSDVLFFKRVKKEALVNHKLPYKENSLPEVIAYSIRKFNLVWISFLMIKKASDLKVGFSVFPLLIHQWVY

SEQ ID NO: 16765 - DNA, 642 bp, Unknown
  Obtained from environmental sample
  misc_feature (1)..(642): n is a, c, g, or t
atgttaaaggtattttttggtcatcataaatgtgcttctcaatggattgccttggttatagagcgtgtctgtaatgaaatggctttgaaatcattttgtgcctaccaagatgaaataaacaaatacggaagtttacagagcctaatagacaaggagaagcctgactttttaattataccagaatcgaataaagaccgtattaaagaaattaaaacagattttttaggttttcatacagttagagatccaagagacattatagtttcttgttatttctcacataaaaaatcacataaaataagtaattacataccaacaattgagcatagagacaaattacaacaattaccaaaaaaagaaggaattgattatgaaattatgataagtaaggtttttattgaaaatctttatgattgggaatataattatccgaatataatcgaaaccaaatttgaaaaaataactagctctcctcaagaagaatttgaaaagatttttaattttttagacttttttgaaactaaggagaatatcttatttcctttagtatgttattacaatagaatgctacgaaagttaaagataaacaaatggaccatcaggctaactaattactctaaaagtcaattacaaaaaacctga

SEQ ID NO: 16766 - protein, 213 aa, Unknown
  Obtained from environmental sample
  misc_feature (1)..(213): Xaa is any amino acid
MLKVFFGHHKCASQWIALVIERVCNEMALKSFCAYQDEINKYGSLQSLIDKEKPDFLIIPESNKDRIKEIKTDFLGFHTVRDPRDIIVSCYFSHKKSHKISNYIPTIEHRDKLQQLPKKEGIDYEIMISKVFIENLYDWEYNYPNIIETKFEKITSSPQEEFEKIFNFLDFFETKENILFPLVCYYNRMLRKLKINKWTIRLTNYSKSQLQKT

SEQ ID NO: 16767 - DNA, 348 bp, Unknown
  Obtained from environmental sample
  misc_feature (1)..(348): n is a, c, g, or t
atggaagaaggaagcagacatatttatataaataataatgcgccaggatgcaatttcatggatgagatagaagaagcatgtgagacggtagggttggaagggcaagaacaaataaaattctccctattccctaaccccgccaccgaaaaaatccacatcactttttcacaaaaacatatttccgggatgaagatggagatcataaacataaatggcgaggtcgttaaaactaaatcagcaacatctccttttgaagtatttgaaatcgctgacctgtcaaaaggtatttacatccttaggataagacaacatgcagatactaagtcgatgtattttgttaaacaataa

SEQ ID NO: 16768 - protein, 115 aa, Unknown
  Obtained from environmental sample
  misc_feature (1)..(115): Xaa is any amino acid
MEEGSRHIYINNNAPGCNFMDEIEEACETVGLEGQEQIKFSLFPNPATEKIHITFSQKHISGMKMEIININGEVVKTKSATSPFEVFEIADLSKGIYILRIRQHADTKSMYFVKQ

SEQ ID NO: 16769 - DNA, 579 bp, Unknown
  Obtained from environmental sample
  misc_feature (1)..(579): n is a, c, g, or t
atggctaagaaaaaaagtgttctttttgagtgtcaacattgtgggtttacttcaccaaagtggatgggaaagtgtacaaactgtggtgcatgggactcattagttgagttaactcaagaacaacaagatgtagttaaaaggacatcttcactctcaaacagtgaatcatcaaaagcacaaagcatattggatgtaaaagagagtgttgtagagagattcagctcaaacgatgttgagttagatttagttctaggtggtggaatagttcctggatctttgagcttaattggtggaagtccaggtgttggaaaatctacactgctactcaaaattggtgcaaatatcgcaaaaagtggtaaaaatgtactttatgtaaccggcgaagagagtgaaagccagataaaaattcgtgcaaatagactaaatgcaaatgagaaaaatctataccttctaaatgagataaggttagagcaggtattagtagagttaaaagagagagattatgaatttataattattgactctattcaaactctatattctgaaagtatcagcagtgcccccagatctgtttacccg

SEQ ID NO: 16770 - protein, 193 aa, Unknown
  Obtained from environmental sample
  misc_feature (1)..(193): Xaa is any amino acid
MAKKKSVLFECQHCGFTSPKWMGKCTNCGAWDSLVELTQEQQDVVKRTSSLSNSESSKAQSILDVKESVVERFSSNDVELDLVLGGGIVPGSLSLIGGSPGVGKSTLLLKIGANIAKSGKNVLYVTGEESESQIKIRANRLNANEKNLYLLNEIRLEQVLVELKERDYEFIIIDSIQTLYSESISSAPRSVYP

SEQ ID NO: 16771 - DNA, 300 bp, Unknown
  Obtained from environmental sample
  misc_feature (1)..(300): n is a, c, g, or t
atgaactttattgctaagttaaaaaatctatcacaccactataatgatgttattgctttagatgacatcactttagagataccatctgggaaaatgataggttttataggtcctgatggntgtggtaaatctacactattatccatttatttcagcataaaaaaagttcaaacaggtacggtagaagtattaggtggagatattaccaactcaaactttagagatgcaaattgttctaaaaattgcttatatggccccaaggacttggaaaaaaatcttaaatgtcacctttcggaataa

SEQ ID NO: 16772 - protein, 99 aa, Unknown
  Obtained from environmental sample
  misc_feature (1)..(99): Xaa is any amino acid
MNFIAKLKNLSHHYNDVIALDDITLEIPSGKMIGFIGPDGCGKSTLLSIYFSIKKVQTGTVEVLGGDITNSNFRDANCSKNCLYGPKDLEKNLKCHLSE

SEQ ID NO: 16773 - DNA, 306 bp, Unknown
  Obtained from environmental sample
  misc_feature (1)..(306): n is a, c, g, or t
atggcaaatgatagaacaataggtatgtggctttaccaaaatggtggtggagatgttatccaaaaaaaaatgataaaaaaacttcaagatagaggtatagatacaataacagaactaaaccttagaaatgcagtggcaaaaaataaaaatatcatttgtaaaagtggtggtattcgacacaagttaaatgaactagatctctttttctcatataatgcaggggaacaaactcaataccaagtctatttatatcaagctctaaatcgaatgataccaatgattaattcttatgacgcatttgcttaa

SEQ ID NO: 16774 - protein, 101 aa, Unknown
  Obtained from environmental sample
  misc_feature (1)..(101): Xaa is any amino acid
MANDRTIGMWLYQNGGGDVIQKKMIKKLQDRGIDTITELNLRNAVAKNKNIICKSGGIRHKLNELDLFFSYNAGEQTQYQVYLYQALNRMIPMINSYDAFA

SEQ ID NO: 16775 - DNA, 852 bp, Unknown
  Obtained from environmental sample
  misc_feature (1)..(852): n is a, c, g, or t
gtgagattgaatatgaaaacaaacgccactttgccgattttactaaaaaaccaaaagatattacttattggtggtggaaatgtagctttacaaaaagcacaagtattaagtgaaaataatattgattttataataatatctcaagagcttaatcaagagatacaaaaaataaaacgaaaacagatcaaaaaaaagtttacactcaaagatataaaaaatttctatattattatagatgcaacaggagatccaaaagtagctaaaaaacttgtaaactataaaaaaactcacaatattttactcaatgtagttgatgtaccagagctttgtgatttttattttatggcattaacagcaaatcaacctttacaaatagcagtatcttcaaatggtgcatctccaactgcttcaatgttttttagagatgagtgtgcaaaacttatccctaaagatataaaaaaatatcttgaacaaaaacaaaaacaaagagatgaggggattatagatgttacccaaacacaaaaagaacttgaacttttaaaaacgcaagtgtatcttgtgggatgtggtttaggagatgtggaacttttgacaatcaaagcttataatattatcaaaagtgttgatgtggttttgtatgattatcttataagtgatgaaattatgagtatagtgccaaaatctacaaaaaaagtatttgtgggaaagaaaaaagattttcactcaaaaacacaagaggagataaatgcacttattattaaatacgcaaaaaaaggtttaactgtagcacgacttaaaagtggtgatccttttgtattggtcgggtgcgaagagtgcagactatccacataa

SEQ ID NO: 16776 - protein, 283 aa, Unknown
  Obtained from environmental sample
  misc_feature (1)..(283): Xaa is any amino acid
MRLNMKTNATLPILLKNQKILLIGGGNVALQKAQVLSENNIDFIIISQELNQEIQKIKRKQIKKKFTLKDIKNFYIIIDATGDPKVAKKLVNYKKTHNILLNVVDVPELCDFYFMALTANQPLQIAVSSNGASPTASMFFRDECAKLIPKDIKKYLEQKQKQRDEGIIDVTQTQKELELLKTQVYLVGCGLGDVELLTIKAYNIIKSVDVVLYDYLISDEIMSIVPKSTKKVFVGKKKDFHSKTQEEINALIIKYAKKGLTVARLKSGDPFVLVGCEECRLST

SEQ ID NO: 16777 - DNA, 855 bp, Unknown
  Obtained from environmental sample
  misc_feature (1)..(855): n is a, c, g, or t
atggctgagtacgggacagccaatgcaatgggtggtagagaagttggtggattatctactatgcttgcagttcatcttggatttgatgaggaatctataaaaaaagtatctgcattttggaatacagataaaattgataataaaccaggtcttcctgctacaaaaatgcttgatgcaaatttagatgttttaattatatgtcatacagatcctgtataccatttaccaaatagaaaagagactgaggagttattaaaaaagattccatttgtcgtggagataaatgcttatgaaaacagcgaaacagcaccttattctcatataagacttccagcagcgccttggggagaaaaagagggaactcaaacaaatcttgatagaactattacaaaacaagagaaacttacacgcatatctatagattgtaagcctgattgggagatatttcaacttattgcccagaaacttggctataaaaaacattttaattatacaaatccacaagagatatttgaagagtttcaagcaatgagtaaactaaattcttatatgaatattcatgaagcatcttatgaaaatctttcaaaagaaccttttatctggggtaaaaatattgatacatttttaacacctgataaaaaaggaaacctattttttgtagaaaataaattattgagtgaaaaaacaaatttagaatatccatttattctactaacaggtaggacaagagatcagtggcatactggtacaaaaacaaatctacctactacattgttaaaatttaaagaactaaatttttgtgagattaattcttttgacgctgaagaattaatatcaaagatggtgataccataa

SEQ ID NO: 16778 - protein, 284 aa, Unknown
  Obtained from environmental sample
  misc_feature (1)..(284): Xaa is any amino acid
MAEYGTANAMGGREVGGLSTMLAVHLGFDEESIKKVSAFWNTDKIDNKPGLPATKMLDANLDVLIICHTDPVYHLPNRKETEELLKKIPFVVEINAYENSETAPYSHIRLPAAPWGEKEGTQTNLDRTITKQEKLTRISIDCKPDWEIFQLIAQKLGYKKHFNYTNPQEIFEEFQAMSKLNSYMNIHEASYENLSKEPFIWGKNIDTFLTPDKKGNLFFVENKLLSEKTNLEYPFILLTGRTRDQWHTGTKTNLPTTLLKFKELNFCEINSFDAEELISKMVIP

SEQ ID NO: 16779 - DNA, 636 bp, Unknown
  Obtained from environmental sample
  misc_feature (1)..(636): n is a, c, g, or t
ttggatagtaacaattcgataattatcagaacaacaatcatgaacgaaacaaacaaaatccacaccgatcagtattttatcaactggcacgaaaccgattttaagggcttggctacgcctgtaaccctgtgcaattatttgggagaatcggcctggcggcaagccgaagaactgggatttggctataaagatgctttgcgattaaaccagttttgggttgtgctgcgctgggctataaaaatggaaaagtatcccaaatggcgcgacgagatcattatggaaacatggtcgcggatgcctgaacgtttgtatgcttaccgcgattacaccattaaaagcctggatggcgaaaagcttggtgcagcaaactcaacgtggatggtgctggatgcaaaaaccagaagacctcaaaaacttgaactgattgaaggcttgctgcatcataccctcgacaagaaatcgcttgacgagaatgcccgaaaaataattcccccggacactattacctcaacaagcattatgcaatcgcaatacagtgacatggattacaacgggcatgtgatcaaattcaaaatatgtaagctggtgcctggatttattcgatcacaaatttcaccaaaaccattttcttgctga

SEQ ID NO: 16780 - protein, 211 aa, Unknown
  Obtained from environmental sample
  DOMAIN (18)...(208): Acyl-ACP thioesterase
  misc_feature (1)..(211): Xaa is any amino acid
MDSNNSIIIRTTIMNETNKIHTDQYFINWHETDFKGLATPVTLCNYLGESAWRQAEELGFGYKDALRLNQFWVVLRWAIKMEKYPKWRDEIIMETWSRMPERLYAYRDYTIKSLDGEKLGAANSTWMVLDAKTRRPQKLELIEGLLHHTLDKKSLDENARKIIPPDTITSTSIMQSQYSDMDYNGHVIKFKICKLVPGFIRSQISPKPFSC

SEQ ID NO: 16781 - DNA, 393 bp, Unknown; identical to SEQ ID NO: 8203
  Obtained from environmental sample
  misc_feature (1)..(393): n is a, c, g, or t

SEQ ID NO: 16782 - protein, 130 aa, Unknown; identical to SEQ ID NO: 8204
  Obtained from environmental sample
  misc_feature (1)..(130): Xaa is any amino acid

SEQ ID NO: 16783 - DNA, 705 bp, Unknown
  Obtained from environmental sample
  misc_feature (1)..(705): n is a, c, g, or t
ttggttaaacctgataaagtaaaaggtttgatttctagaatgattgagtttttttcattgatgctatctcgctcagtcattacttgtactgatgggttatatgattatcatgttaaatgtttttttggtttttttaaaaagaaagtttttcttattgagaacggccatagtctagctctaacgtcgtctttgttttgtaatataaatcttgaaaataagaatttaattaatgctgtttgtgctgggaagttctctgagtatggtgttgataaatgtaaagctataattgatgagctttcttttcgatattcaaagtctaaagtcttattaaaaataataggcgcagattttgaagtgaataattgggttgttggctactctcgtgatagaggtgtaagtgtaactttaatagaacgaaaaccttatgaggaggttgtttcgctggtcactgaggctgatatagctatcgccgttattcgagacccatcttatgattatggaacaaaagtatttgattatatttcctgtggggtacccattttagatgtatactcaggtacagtattcagaaataaattttcaggatgttttgatacagattataagccagtagctgcttaccataaagcgtgtgaatttcgaagatctgagaaatcctctcaagggtttgatgttttatttaaaaatcttggtattgttagatga

SEQ ID NO: 16784 - protein, 234 aa, Unknown
  Obtained from environmental sample
  misc_feature (1)..(234): Xaa is any amino acid
MVKPDKVKGLISRMIEFFSLMLSRSVITCTDGLYDYHVKCFFGFFKKKVFLIENGHSLALTSSLFCNINLENKNLINAVCAGKFSEYGVDKCKAIIDELSFRYSKSKVLLKIIGADFEVNNWVVGYSRDRGVSVTLIERKPYEEVVSLVTEADIAIAVIRDPSYDYGTKVFDYISCGVPILDVYSGTVFRNKFSGCFDTDYKPVAAYHKACEFRRSEKSSQGFDVLFKNLGIVR

SEQ ID NO: 16785 - DNA, 912 bp, Unknown
  Obtained from environmental sample
  misc_feature (1)..(912): n is a, c, g, or t
atgaaggagcagcttaagagcgtcctgattaaacatcaggatgtacgcgataacatctctcgtaaagagatgattcagcaagctgttaataatcgagaagcaattgtatccgcgtgtggggctttggatacatggacgccaccggaatctaccggaagaagtcctaaagatacagttatcgtaaaaagaccaattagccaggataatattgactgggattcacctaacaatattcccctgaaaccagaaacatttgatatgctatttgaagatgctctggctgttttagaaaaaaaagaaaaattatacactacggacagaattattggagccgattccaattacgcgcttccaaccagaacaatatctgaccttgctcttaccgctttattcacagacaacatgttccgacctgttccgaagaatattacgaatagtgttttctacgacaatggctttacccttatcgcactaccttatgacaaattagatccttccaaatatgaaggcagattgcgcaaattccccaacggcaaaacatcaaacatggcggtagcagtcgatttcgaccgcagaatcggtattgtttttggttcagcttattgtggaagcgttaagaaaatgatgttcactgtaatgaactactaccttcctgctgaggggattcttcctctgcactgcagtgccaacgaaggtaaagatggagattctgccctcctgctgggtctttccggaacagggaaaaccactctatcggcagatcctaacagagctcttctgggtgatgatgagcatggttggagccaagatggtattgccaacttcgaaaacggctgttatgctaaacttatcaacctaagcccggtaaaagaacctgagatctataaagcttttccaaaagtccggccataa

SEQ ID NO: 16786 - protein, 303 aa, Unknown
  Obtained from environmental sample
  DOMAIN (13)...(301): Phosphoenolpyruvate carboxykinase
  misc_feature (1)..(303): Xaa is any amino acid
MKEQLKSVLIKHQDVRDNISRKEMIQQAVNNREAIVSACGALDTWTPPESTGRSPKDTVIVKRPISQDNIDWDSPNNIPLKPETFDMLFEDALAVLEKKEKLYTTDRIIGADSNYALPTRTISDLALTALFTDNMFRPVPKNITNSVFYDNGFTLIALPYDKLDPSKYEGRLRKFPNGKTSNMAVAVDFDRRIGIVFGSAYCGSVKKMMFTVMNYYLPAEGILPLHCSANEGKDGDSALLLGLSGTGKTTLSADPNRALLGDDEHGWSQDGIANFENGCYAKLINLSPVKEPEIYKAFPKVRP

SEQ ID NO: 16787 - DNA, 744 bp, Unknown
  Obtained from environmental sample
  misc_feature (1)..(744): n is a, c, g, or t
atggaagatttaggtaatgacagcttaacttttgctgagattaaagcagaggtgtcaggcaatccattaattttagagcatttacaaactacaaaacttgttgaaaagttagctatgcagcaaaagcgccaccagcaacagcaacatagataccaaagatcattaaccaatttaaaatatgaaattgagaaccaccaccgagctatagaaagcatcaataaggacaaagctttatacgaacaaaataagttacctgaaggtgagtttaaagcggttatagatgggtatacgattccaaaatataacatggctggtgaaatggtaatgaaaaaagtgcaagaatacaatttctacaaatctaataaaatggacgaaaccgttatgaaatattgcggattcacgatccaagtatctagggcttgggggtctctcgtactacttattttaggggcgcagacctaccaaattgaacttaaaaaaggaaagaacactagccctctttcagtgatgaactctattactaaaagtttagctaaattagattcatttataaacattaggaaagaacacatagttgaagctgagaaaaatatactatcagctaaagaacagattggcgctagctttgaaaaactagatgaattgatacaggccaaacaacgactaaatgaaattaagcatgttctattgagtgacgataaacctgaagttaaggaagaactagaagtaaatgcagccgcttaa

SEQ ID NO: 16788 - protein, 247 aa, Unknown
  Obtained from environmental sample
  misc_feature (1)..(247): Xaa is any amino acid
MEDLGNDSLTFAEIKAEVSGNPLILEHLQTTKLVEKLAMQQKRHQQQQHRYQRSLTNLKYEIENHHRAIESINKDKALYEQNKLPEGEFKAVIDGYTIPKYNMAGEMVMKKVQEYNFYKSNKMDETVMKYCGFTIQVSRAWGSLVLLILGAQTYQIELKKGKNTSPLSVMNSITKSLAKLDSFINIRKEHIVEAEKNILSAKEQIGASFEKLDELIQAKQRLNEIKHVLLSDDKPEVKEELEVNAAA

SEQ ID NO: 16789 - DNA, 363 bp, Unknown; identical to SEQ ID NO: 14787
  Obtained from environmental sample
  misc_feature (1)..(363): n is a, c, g, or t

SEQ ID NO: 16790 - protein, 120 aa, Unknown; identical to SEQ ID NO: 14788
  Obtained from environmental sample
  DOMAIN (2)...(120): Response regulator receiver domain
  misc_feature (1)..(120): Xaa is any amino acid

SEQ ID NO: 16791 - DNA, 561 bp, Unknown
  Obtained from environmental sample
  misc_feature (1)..(561): n is a, c, g, or t
atgagtcaatttttaattaaacttgaccttgtccatggagacattaaacctgaaaatatcatagtaaacaagcgtgatgagaagctgatatttaagatgatagattacggctcaatcgtagaggtcttttccataaacaacaaagcaggaactccgtcatatttggcacctgagagatttgagggtgcatccataacagagcagagtgagatattttctatcggtgtgactctatacgaatcattaacactaaagtatccttatggtgagatagagccttttcaaaacccatctttttcaaatgcaacaaggcctaaaaaacataataacaatattccctcatggttggagagtgttatcttaagagcgctttcttcaaaaactgatgataggtatgaggtatattctcaaatgagttttgagttagatcacagtgataaagtaagagcatatttttctaaagagacacctcttatagatcgtgatccattgaagttttacaagtatggattttttgtaatgttagttataaactttttaataatattatctaccacttag

SEQ ID NO: 16792 - protein, 186 aa, Unknown
  Obtained from environmental sample
  misc_feature (1)..(186): Xaa is any amino acid
MSQFLIKLDLVHGDIKPENIIVNKRDEKLIFKMIDYGSIVEVFSINNKAGTPSYLAPERFEGASITEQSEIFSIGVTLYESLTLKYPYGEIEPFQNPSFSNATRPKKHNNNIPSWLESVILRALSSKTDDRYEVYSQMSFELDHSDKVRAYFSKETPLIDRDPLKFYKYGFFVMLVINFLIILSTT

SEQ ID NO: 16793 - DNA, 882 bp, Unknown
  Obtained from environmental sample
  misc_feature (1)..(882): n is a, c, g, or t
ttggactcaatggcatctttaggcgaagtatattatgatggttttaagaatattaccaaagcagaagagctttttcaaaaaattataaaaattatttcagcctctgataaagatcatgaaaaaaagaaacttcgaattgattattatttagctcaaatactgattgataaaggtgagggtaaaaaagcagaaaaattattaaaagaaacccttgaaacttctatacgaatttatggtttaaaacatgatgccacgattaatataagagatgtgcagttaagaaacttctctacgaatgattatagtacggaacttaaatacatcgatgcttcctcttctagttacaatgaatatgtattagatgcatttaaagccgattctaaaagcaaaaaagtaagggtttttctttcttcaacttttaaggatatgatgcaggaaagagaatacctgatgaagaatatttttccaaaactgaagaaactatgtcgaaacaaaggattggattttacagaagttgatttgaggtggggaatcactgaatcggaagcggagcaagggaaggtaattgaaatttgtttaaacgaaatagataaaagccgacccttctttattggtatgataggtcaacgatatggttggattccaccttacgagaagacttcagggtttaaacgaatgttggctaactataattggatcggtaaggacattgaagatggattgagcgtaaccgaaatggaagtgcaatacggtgttttgagaaaccctaaaatgaaggaaatgcttttttttatattcgggaggacagtattgccccctgaagatcctgatttctacgaagacaaagactcagagtcgtatcgtaaaattgcctttgtttaa

SEQ ID NO: 16794 - protein, 293 aa, Unknown
  Obtained from environmental sample
  misc_feature (1)..(293): Xaa is any amino acid
MDSMASLGEVYYDGFKNITKAEELFQKIIKIISASDKDHEKKKLRIDYYLAQILIDKGEGKKAEKLLKETLETSIRIYGLKHDATINIRDVQLRNFSTNDYSTELKYIDASSSSYNEYVLDAFKADSKSKKVRVFLSSTFKDMMQEREYLMKNIFPKLKKLCRNKGLDFTEVDLRWGITESEAEQGKVIEICLNEIDKSRPFFIGMIGQRYGWIPPYEKTSGFKRMLANYNWIGKDIEDGLSVTEMEVQYGVLRNPKMKEMLFFIFGRTVLPPEDPDFYEDKDSESYRKIAFV

SEQ ID NO: 16795 - DNA, 390 bp, Unknown
  Obtained from environmental sample
  misc_feature (1)..(390): n is a, c, g, or t
atggtgttgatattgaaaaaatatctcttggttacagatgcacaaaaagtgatacaaaaccaccatgaaaaagttgatggaagtggctacccaaatggactaacaaaagatgatattcccatagaagccagaatattcgcagttgtagatgtatttgatgcacttacatctaaaagaccatacaaagaggcttttgatatagaaaaaagtatcaatattattaaaagtgggattaatgtgcattttgatgaaaaagttatttataaatttgaagagatttatgaaaaaatatattatgatattttagatatatctgccaaagagctagaagatatattttctataaatattgaaccttattttgatgtaaaatatattatacgaggataa

SEQ ID NO: 16796 - protein, 129 aa, Unknown
  Obtained from environmental sample
  misc_feature (1)..(129): Xaa is any amino acid
MVLILKKYLLVTDAQKVIQNHHEKVDGSGYPNGLTKDDIPIEARIFAVVDVFDALTSKRPYKEAFDIEKSINIIKSGINVHFDEKVIYKFEEIYEKIYYDILDISAKELEDIFSINIEPYFDVKYIIRG

SEQ ID NO: 16797 - DNA, 474 bp, Unknown
  Obtained from environmental sample
  misc_feature (1)..(474): n is a, c, g, or t
atgaaacaaatcgataccttgatacttcaatctatacataaatactcaaatattattatgttttcccttgatacaaattatagatatatatcattttcacaaaaatataatgcggttattaaaaataaattagatatagatataaaaataggtgattgcatgttagattctattgaagatacttttgataagaatcgagcaaaatgtcattttgataaagtattacaaggtgatagttttacactcagtgaagagtttattgataaaaaaactatatctactcattgggaaaattattatactcctatatatgaaaatgaaaatatcataggtataaatataataatatttgatgtgacacatcatgtaaggatttcaagaaaatttgatgaagtcaaactatttgaagaaatagtaaatttaattgatgtaggcatcgctatagttgaccctcatcaacaagatatcccataa

SEQ ID NO: 16798 - protein, 157 aa, Unknown
  Obtained from environmental sample
  misc_feature (1)..(157): Xaa is any amino acid
MKQIDTLILQSIHKYSNIIMFSLDTNYRYISFSQKYNAVIKNKLDIDIKIGDCMLDSIEDTFDKNRAKCHFDKVLQGDSFTLSEEFIDKKTISTHWENYYTPIYENENIIGINIIIFDVTHHVRISRKFDEVKLFEEIVNLIDVGIAIVDPHQQDIP

SEQ ID NO: 16799 - DNA, 621 bp, Unknown
  Obtained from environmental sample
  misc_feature (1)..(621): n is a, c, g, or t
atgcggatatataatgttcatatccatactatcacaaaccaggcgttaccaaagaattttcttccttttggcttggttagacttctagcaaaaaaaaaattcactaaacgactagcaaaacttttcaataacctaaatccattcagtaacaacgatattttagacagatacgcaaaatttcttacaataggaaaccttggatcacaagaaaaaatattcaattatatcacgaggttttatcctgctaaaactgttttttgtgttttatctgtagatttggcatatatgaatgctggaaaagttaaacaagattaccatgaccagcttcttgagctcgtcgaattaaaaaagaaatataatgataaaattctgccatttatatgtgttgatccaagaaggcccggcataactgagcttgcaatagaatttctagaaaaacacagttttcacggtatcaaactatatcctgcactaggatatttccctaatgatgaaaggctttcaaaactttacagttacgcagagaaaaaaggtgtaccaatagttgcccattgctctaaagacggagcttattataaaggtaaacttgataactcaattttttcagagtttgaaaaatga

SEQ ID NO: 16800 - protein, 206 aa, Unknown
  Obtained from environmental sample
  misc_feature (1)..(206): Xaa is any amino acid
MRIYNVHIHTITNQALPKNFLPFGLVRLLAKKKFTKRLAKLFNNLNPFSNNDILDRYAKFLTIGNLGSQEKIFNYITRFYPAKTVFCVLSVDLAYMNAGKVKQDYHDQLLELVELKKKYNDKILPFICVDPRRPGITELAIEFLEKHSFHGIKLYPALGYFPNDERLSKLYSYAEKKGVPIVAHCSKDGAYYKGKLDNSIFSEFEK

SEQ ID NO: 16801 - DNA, 810 bp, Unknown
  Obtained from environmental sample
  misc_feature (1)..(810): n is a, c, g, or t
atgactcaatatcaccaatactttggtgttctaaaatcacatgatagtattaaaaaatctatcaagcctaatggagatggtaaggcaggtatagtatggcacacgcaaggtagcggtaaaagcctttcaatgctaatgcttagttcaaagctaataaatgataagacattgaataatcctactatagttgtacttactgatagaaacgatcttgatgaacaactttttaatacatttacaagtggaattgaattcttaaaaacaacacctgtaaaagttgattcaaaagcatctttagtggagcaactttcatatattaaaactggtggagttattttcactacaatttggaaatttgataaagaaaatatagtgcctaatttaagagaaaatattattgttatatctgatgaagcacatcgatcgcattatggtatagatgaaaagatagtatttgttaatgatgaaaatggaaatagagtacctatatctaaatatggaatggccaagtacattagagatgtattgccaaacgctacatttattggatatacagggactcctgtagatacaagagataaatcaacaactgcagtttttggagatatcattgatgtttacgatatgactcaatcagttatagatggatctactgtgccactatattatgaaagtagaaatgcaagggtttggttggatgagactaaattaaaagaactagacaattattatagtgaaactgaaagagtaggtgttacagaagcgatcttagaagaatctaagcgaagaatgtcaaagatggaattattg

SEQ ID NO: 16802 - protein, 270 aa, Unknown
  Obtained from environmental sample
  DOMAIN (9)...(190): Type III restriction enzyme, res subunit
  misc_feature (1)..(270): Xaa is any amino acid
MTQYHQYFGVLKSHDSIKKSIKPNGDGKAGIVWHTQGSGKSLSMLMLSSKLINDKTLNNPTIVVLTDRNDLDEQLFNTFTSGIEFLKTTPVKVDSKASLVEQLSYIKTGGVIFTTIWKFDKENIVPNLRENIIVISDEAHRSHYGIDEKIVFVNDENGNRVPISKYGMAKYIRDVLPNATFIGYTGTPVDTRDKSTTAVFGDIIDVYDMTQSVIDGSTVPLYYESRNARVWLDETKLKELDNYYSETERVGVTEAILEESKRRMSKMELL

SEQ ID NO: 16803 - DNA, 474 bp, Unknown
  Obtained from environmental sample
  misc_feature (1)..(474): n is a, c, g, or t
atgatgacaacatcctttaaaaatataagtatcccgattattttcgggatattttttttgatttcagcatgttctaatgcagaaaaagagcaacaagtaaatgaagaagtaataacagaggtagttgacaatcatccgaacaaagatagtgagttggctttgctaatgcgaaaaatgtataatgatgccgatagtattaaacagcttattgtaaacgatgagggaaatatttctaaagaatatattgatgcgcttgaaagaatacataccgcaacaccaacagatgcagatgtaaaaacacctgaatttaaagcctataccgaattaatggtaaatgaggcaaatgcacttttctctagcgaaactaataaaaaagaaggctttaataatttggtaaacaaatgtgtggaatgtcaccaatctttttgtccaggaccaataaaaaagattaaaaaattagaaattaaagattag

SEQ ID NO: 16804 - protein, 157 aa, Unknown
  Obtained from environmental sample
  misc_feature (1)..(157): Xaa is any amino acid
MMTTSFKNISIPIIFGIFFLISACSNAEKEQQVNEEVITEVVDNHPNKDSELALLMRKMYNDADSIKQLIVNDEGNISKEYIDALERIHTATPTDADVKTPEFKAYTELMVNEANALFSSETNKKEGFNNLVNKCVECHQSFCPGPIKKIKKLEIKD

SEQ ID NO: 16805 - DNA, 861 bp, Unknown
  Obtained from environmental sample
  misc_feature (1)..(861): n is a, c, g, or t
atgaatacaggagatcccgtacagataaaaaaagcagaagatgaggcacgctcaattaaaggtgttcaaaacttaacaattgcaaaaagcaaagctcttatggagatgtatggagacactagtccttatacaaaagatcaaaaagtactagaaacatttgacacaaagaaagagcacattatcgagattgatgatgacaatgaacacaacttgagaatgataaaaccaatgattgcaacgcctgagtgtattatgtgtcatgtgaaccaaaaagagggagatattgttggtgtaatggatttaacattctctttaaaagatgcagatgatagtttaaaaagtattatcttaaatattatcatggcatcaactattttgggatggatcactattggtattattttttatgttgtaagaaaagctacaaagcctatagatggtttaaaagagggatttcaaagtttaattgattcaactgaattaaaagatgattttaagttagatgttaaaactaaagatgagattggtgaagtagctgaactattcaataaatatatggataaagtaaaaaatgatttaaaacaagatgagatagttatcaatgaaacaaatgatgttttacaaaaaacagcaagtggtttttttgtatatgaagtaaaatcaactgcatcaaaccctcatgtagaagcgatgaagtcaaatctaaactttatgataaaaaatgttaaagcaacacttgacaaaataaatttaacattaagaaactacagtcaatcaaaatatgattttaaaatagatgataaagatatttatggggatttaggtgcagtaactgctggtattaagttagttgggaaataa

SEQ ID NO: 16806 - protein, 286 aa, Unknown
  Obtained from environmental sample
  DOMAIN (120)...(191): HAMP domain
  misc_feature (1)..(286): Xaa is any amino acid
MNTGDPVQIKKAEDEARSIKGVQNLTIAKSKALMEMYGDTSPYTKDQKVLETFDTKKEHIIEIDDDNEHNLRMIKPMIATPECIMCHVNQKEGDIVGVMDLTFSLKDADDSLKSIILNIIMASTILGWITIGIIFYVVRKATKPIDGLKEGFQSLIDSTELKDDFKLDVKTKDEIGEVAELFNKYMDKVKNDLKQDEIVINETNDVLQKTASGFFVYEVKSTASNPHVEAMKSNLNFMIKNVKATLDKINLTLRNYSQSKYDFKIDDKDIYGDLGAVTAGIKLVGK

SEQ ID NO: 16807 - DNA, 903 bp, Unknown
  Obtained from environmental sample
  misc_feature (1)..(903): n is a, c, g, or t
atgatggctgagcagcgcccttctggaaaagaattttataaaaatataattatccgtgtgactattctgttcctgttgatgtctgtcacctttctattcatatacagcaagttcaaatctctttccaattccgtttccaaagatatttctatgataagcagtcatttcgaaacacgaaaagatgatcctgaattattcgacctctctgcgtttagatacaatgagttttcggtgattgccggagaagcaaacaggatgattatcagacagaaagaagcagaaacaaaaagacagtactctgaattccggctccggctgcagagagagcagtcgcccatggcatatatcggacgaaatttaaaaaatgaaatcattgagtggaatcctgcagcagagaaaatattcggatactcaagggaagaggccatgggaaatgatctgacacttatcagcccggattataatatcttatcagttaaagaattattccaaaaccttaaaaaaaacagcaccagctcaaagcatataaatgagaatatcataaagagcggacaaaaaattatatgtgaatggcttaactataatcttgaggatgatgatgggaatacccttgggattataagcataggacaggatgtgagcgaaagaatccggtttcaggacaagatatcggcaaagaataaagaactcgagcagtctttagaggaaaaacaaatccttctaaaagaggttcaccacagggtaaagaataatatggcaattatctcatccctcctgtcccttcaatctaataattccgaggatgatcatcttcataatctgataagaagcagccagaatagaatcaaatccatggcaatggtacatgaacagctctaccggaatgaaatctcagggatataa

SEQ ID NO: 16808 - protein, 300 aa, Unknown
  Obtained from environmental sample
  DOMAIN (174)...(216): PAC motif
  misc_feature (1)..(300): Xaa is any amino acid
MMAEQRPSGKEFYKNIIIRVTILFLLMSVTFLFIYSKFKSLSNSVSKDISMISSHFETRKDDPELFDLSAFRYNEFSVIAGEANRMIIRQKEAETKRQYSEFRLRLQREQSPMAYIGRNLKNEIIEWNPAAEKIFGYSREEAMGNDLTLISPDYNILSVKELFQNLKKNSTSSKHINENIIKSGQKIICEWLNYNLEDDDGNTLGIISIGQDVSERIRFQDKISAKNKELEQSLEEKQILLKEVHHRVKNNMAIISSLLSLQSNNSEDDHLHNLIRSSQNRIKSMAMVHEQLYRNEISGI

SEQ ID NO: 16809 - DNA, 585 bp, Unknown
  Obtained from environmental sample
  misc_feature (1)..(585): n is a, c, g, or t
atgaaaaataaaccatacactttagaagaaatagagctgaataatttttttgttttttcattgatttccgatagaaaatattctgtcattcgattcaatagaagctcggggaattattttaaagaaggggattttgtttgcgtaattgatagttttggaagaaaagaaaaaataaccgctccaaaatctggattcattgaatttttgtgggaaaatgaagtaatattaaatgagccatatttatttgcaatatttgattcaaaacaaactagatttcaagaattatactcacatcgcttcaagtttaccaaagatttgtttagtanatcaaatgagattcaaactactgctgtaggaataccttcgtatgagttttcaagtttcagtaaaaaagatattccaaattactataataatggattattcaaaatagatgtaggtctttttattagcttcagcaatataaatggtacggatttcttacgaatacggtgtaacactaaccactacaaactatatattaatggacggtttaattctactcttatcagacatttcaataatagagtaccgactagaaaatga

SEQ ID NO: 16810 - protein, 194 aa, Unknown
  Obtained from environmental sample
  misc_feature (1)..(194): Xaa is any amino acid
MKNKPYTLEEIELNNFFVFSLISDRKYSVIRFNRSSGNYFKEGDFVCVIDSFGRKEKITAPKSGFIEFLWENEVILNEPYLFAIFDSKQTRFQELYSHRFKFTKDLFSXSNEIQTTAVGIPSYEFSSFSKKDIPNYYNNGLFKIDVGLFISFSNINGTDFLRIRCNTNHYKLYINGRFNSTLIRHFNNRVPTRK

SEQ ID NO: 16811 - DNA, 453 bp, Unknown
  Obtained from environmental sample
  misc_feature (1)..(453): n is a, c, g, or t
ttgaacaaaacaggctctaatcttcctacaaaaatagagaaccagtttggagatagttactatatagttattgctattttaataattggaataggagttttgttatggttaaaaaaaggcatcaactctcaaaatggattaaacaagggttctatttttggaggactatctaaaaaaagtagtgaaacttcagtgcgttttcaaaaaaaccttgatcctaaaaataaagttatgatgatagatcatggtgatgagagctatcttattcttgttggaaattccaatattcttttagataaatttcataactcaaaacctgtaaagagtcaaaacgagtttaatgatatgctagagactggaaaatatgaactagataagtttatgcaattaggggatagtaaacagaatgataactttaaaaaatacaaagaaaaagcagcttccatgagttaa

SEQ ID NO: 16812 - protein, 150 aa, Unknown
  Obtained from environmental sample
  misc_feature (1)..(150): Xaa is any amino acid
MNKTGSNLPTKIENQFGDSYYIVIAILIIGIGVLLWLKKGINSQNGLNKGSIFGGLSKKSSETSVRFQKNLDPKNKVMMIDHGDESYLILVGNSNILLDKFHNSKPVKSQNEFNDMLETGKYELDKFMQLGDSKQNDNFKKYKEKAASMS

SEQ ID NO: 16813 - DNA, 306 bp, Unknown
  Obtained from environmental sample
  misc_feature (1)..(306): n is a, c, g, or t
atgattaatttaaaatatgtaatatataattcgctattgattgctacttgtagtataactttacatgcttcgcagttaagtgacgatgccttaaaaggtaaagagttatttgatgaagcaaattgtaaaaaatgtcacatggtagatggagagtttgataagatgaaccagaaggttcaaaatattaaaaacttagcatcgtgggtaagtgcatgtgacaattctcttcagattggatggtttccagaggaacaagagaaagtaacaaagtatctaaacgaaacacattataagttagaaaagtaa

SEQ ID NO: 16814 - protein, 101 aa, Unknown
  Obtained from environmental sample
  misc_feature (1)..(101): Xaa is any amino acid
MINLKYVIYNSLLIATCSITLHASQLSDDALKGKELFDEANCKKCHMVDGEFDKMNQKVQNIKNLASWVSACDNSLQIGWFPEEQEKVTKYLNETHYKLEK

SEQ ID NO: 16815 - DNA, 738 bp, Unknown
  Obtained from environmental sample
  misc_feature (1)..(738): n is a, c, g, or t
gtgtatccaaactttttgattgttccttatgtgatgcctggatttattttggctcatacaatttatgagatggttcaaggattggattgggaaagttgtgaggggattatcttacacaatcatgggatatttacttttgatgatgacgcaaaaaaatcgtatgataagatgatagaagcagtttcaaaagcggaacagtttttagagaaaaatgccccactcgtcatagaaaaatatatgccacgaggaacacttgatatagataagttacaacaaatcataagtgaagaaaaaggatatgaagtatttgtaaaagtaaatcaatcatccctagcacttcactatgcctcaacaagaaacctaaaaacatttgccacaagaggggtactaactcctgaacatatcatccgaacaaaaagagagccacttatacttgaagatgatgatattcaaggtgcaatcaatagatacaaagaaaactatatagagtattttaactctcataaaaaagatgaaatcatgctcaacccagctccaaattgggtagtggtaaaaaactttggaacagtaagctttgggaaaaatgaaaaagaagctagtatcatagaagatataaacaaccacactatgaatgcagttctaaaagcagatatgttaggtggctatgaaagtattagtttacaagatagctttgagatggaatattgggaattagaacaagcaaaattgaaaaaatag

SEQ ID NO: 16816 - protein, 245 aa, Unknown
  Obtained from environmental sample
  misc_feature (1)..(245): Xaa is any amino acid
MYPNFLIVPYVMPGFILAHTIYEMVQGLDWESCEGIILHNHGIFTFDDDAKKSYDKMIEAVSKAEQFLEKNAPLVIEKYMPRGTLDIDKLQQIISEEKGYEVFVKVNQSSLALHYASTRNLKTFATRGVLTPEHIIRTKREPLILEDDDIQGAINRYKENYIEYFNSHKKDEIMLNPAPNWVVVKNFGTVSFGKNEKEASIIEDINNHTMNAVLKADMLGGYESISLQDSFEMEYWELEQAKLKK

SEQ ID NO: 16817 - DNA, 495 bp, Unknown
  Obtained from environmental sample
  misc_feature (1)..(495): n is a, c, g, or t
atgaaaattaatcaattttatcttttttcaaaattaagcggcgattctcttgataaattagagtcaaaagtatcaaagaaaaagtatagtgcaaatagtattattttttacaatggtgaaaaatcagatgagctgcatatgttggttagcggtatagtgaagatctacaaatataacttccataatgaagagattgtactaaactactttaactctccatcattggtagctgagatgccgacattagagaagataccatttcctgcatcgtgttctgcagagagtgatgtagagatgtggattttaaaaagagatgactttataaatttactagaagagaatccatctatctctttggagattataagctccatgagtagaaagataaaggcgcttgaacatagtatagatcaaaatatatctaaaagtgcaacgcagagggtcatctcaacaattttagatactcctgagatgtttgaaaaacttcacgcgtaa

SEQ ID NO: 16818 - protein, 164 aa, Unknown
  Obtained from environmental sample
  DOMAIN (23)...(116): Cyclic nucleotide-binding domain
  misc_feature (1)..(164): Xaa is any amino acid
MKINQFYLFSKLSGDSLDKLESKVSKKKYSANSIIFYNGEKSDELHMLVSGIVKIYKYNFHNEEIVLNYFNSPSLVAEMPTLEKIPFPASCSAESDVEMWILKRDDFINLLEENPSISLEIISSMSRKIKALEHSIDQNISKSATQRVISTILDTPEMFEKLHA

SEQ ID NO: 16819 - DNA, 498 bp, Unknown
  Obtained from environmental sample
  misc_feature (1)..(498): n is a, c, g, or t
gtggaagcggcagtgatagttttatctaaaatagagttaaatgaagatacttctcaccttcctaccacagaagtagaacaacagcgcttctctttctacttcaaagatcaaacaactgatctatataatcaacagtacttaaatattatcctaaaaagaaatcagcttaattatgaattcaaatgtttaaacataatatttatgcataacttctctcaatataatgaaaaacatggatggcaaggcggtgatgaactactgaaaaaatttgcctcaatcattaaaaatgagtttccaagcggattgatttttagactgcatggagacgattttattgttataaataaggatcatacagatatcaatattgaaaaactagagtctctttgcgaacttaaaaaagatcacataacacttactaatatgtacttccacattaaaaacgacgaaataaataacatagaagagttagaaaaccacctactaactcaagcctga

SEQ ID NO: 16820 - protein, 165 aa, Unknown
  Obtained from environmental sample
  DOMAIN (31)...(160): GGDEF domain
  misc_feature (1)..(165): Xaa is any amino acid
MEAAVIVLSKIELNEDTSHLPTTEVEQQRFSFYFKDQTTDLYNQQYLNIILKRNQLNYEFKCLNIIFMHNFSQYNEKHGWQGGDELLKKFASIIKNEFPSGLIFRLHGDDFIVINKDHTDINIEKLESLCELKKDHITLTNMYFHIKNDEINNIEELENHLLTQA

SEQ ID NO: 16821 - DNA, 1002 bp, Unknown
  Obtained from environmental sample
  misc_feature (1)..(1002): n is a, c, g, or t
atgacagaatggctgaggatgtcatggcagatggcacatacaaaaaactatatgataagtggttctgcttttttagataaaaaatatgaactatatgagagtatgatctcaaatctttacattgcactctctattttagctctaatcattataatcgcaattttttggcatattagtctgaaaaagcaggtcaacaaaaagacaaatgagatcaaagagagtcaaaaacgttatagtgacttttttgataatagtagaagtgcaaatattatttataacagtgacgataatggagagacatttagaattgttgatgttaatactatttttgaagagctagaagagttaaaaaaagaggatattgtaggtaaaaaagtagatgaaattttctcaggcgttgaaacaacaggtatttttgagatttttaaaaatgtatttcaaagcggagagacatatcatctgccattaacacgttttacatatggaaataaagaagtatggagagataactatattttcaaactctctacaggagaggtagttgcctcttacatcgacaagtcagttgaaagaaatatggaaattgaacgtattgataactatgaacaaactcttgtttcacttgttgaacttatagagcaacgtgattcttacacaggtggtcactctttgcgtgtggctacgtactctaaaatgattgctgaggcacttaattactcaaaagaggattgtgatttaatatatcgcgcaggtattttacatgatatcggcaaagtaattactccagatgcaattcttttaaaaccaggtgcacttaatgataatgagtataaatttaataaatatcatgcaggcagcggtgctcaaatgcttgaaaaaatacctatgtataaggaggagagtgaaattgttctatctcatcatgagagaattgatggctctggctatcctaaaggtttaaaagggaagaaattccccccacaacgcgtattaaggctggta

SEQ ID NO: 16822 - protein, 334 aa, Unknown
  Obtained from environmental sample
  DOMAIN (219)...(333): HD domain
  misc_feature (1)..(334): Xaa is any amino acid
MTEWLRMSWQMAHTKNYMISGSAFLDKKYELYESMISNLYIALSILALIIIIAIFWHISLKKQVNKKTNEIKESQKRYSDFFDNSRSANIIYNSDDNGETFRIVDVNTIFEELEELKKEDIVGKKVDEIFSGVETTGIFEIFKNVFQSGETYHLPLTRFTYGNKEVWRDNYIFKLSTGEVVASYIDKSVERNMEIERIDNYEQTLVSLVELIEQRDSYTGGHSLRVATYSKMIAEALNYSKEDCDLIYRAGILHDIGKVITPDAILLKPGALNDNEYKFNKYHAGSGAQMLEKIPMYKEESEIVLSHHERIDGSGYPKGLKGKKFPPQRVLRLV

SEQ ID NO: 16823 - DNA, 849 bp, Unknown
  Obtained from environmental sample
  misc_feature (1)..(849): n is a, c, g, or t
atggtaattaaaggtagggcaagaagattaacctgtattgaaattttagataatgaagtaaaaattgatttatgtgaaagttatcataattataatactagagatcttgaaagggttgtaggtgaaacttctagtttaatttcaattggagctactggtgaaaaatgtattgattatgcttctataaatattgattctataaatgtcgggcgtgcaggaatcggaagtatttttggaacaaaaaatcttaaatatatttccattcataataatgagaatacagttagaagcccatattatgaaactataagagatgaattaaatagttattttaataataaaaaagatgttaatttacttgaatattcaaataaattaggttgggcggcaattgagtcatataaatatcgttgtgatccccgtttatggggacttggcagtaaattaacaagtgattgtaaaatagattggttaactgctttagcacttggctcaaatattggaatatatgattttaagaaagttgaaattttagaagaatgttgtttagctctaggagttgatcccttttcaataagtaattatttaatttggataattggagccgaagaagaaaaaattgttaacttaaaaattgataaaaatttaccctatttaaatcgattaattgttattttagaatacctatcttgttcaaagggtatttttgcagcattaaatgaaggaattgctactttgtctgaaaaatatggattccaaaataataattttacttcattaaataaagaattattgccccttaaatttaagagggcttccaggctttattcttttagctacagctcctga

SEQ ID NO: 16824 - protein, 282 aa, Unknown
  Obtained from environmental sample
  misc_feature (1)..(282): Xaa is any amino acid
MVIKGRARRLTCIEILDNEVKIDLCESYHNYNTRDLERVVGETSSLISIGATGEKCIDYASINIDSINVGRAGIGSIFGTKNLKYISIHNNENTVRSPYYETIRDELNSYFNNKKDVNLLEYSNKLGWAAIESYKYRCDPRLWGLGSKLTSDCKIDWLTALALGSNIGIYDFKKVEILEECCLALGVDPFSISNYLIWIIGAEEEKIVNLKIDKNLPYLNRLIVILEYLSCSKGIFAALNEGIATLSEKYGFQNNNFTSLNKELLPLKFKRASRLYSFSYSS

SEQ ID NO: 16825 - DNA, 573 bp, Unknown
  Obtained from environmental sample
  misc_feature (1)..(573): n is a, c, g, or t
atgtttaaaaaagctcttctagtattttatatttttttaggaataactatggcaaatcaactacaaaatgaaacttccccttatctattacaacacaaagacaatccagtagattggtatccttggaacgatgttgcttttgaaaaagctaaaaaagagaataaacttatctttctctccataggttatagcacttgtcactggtgtcatgtgatggcacatgaatcttttgaggatgaagaggtggcgaaaattttaaataaagactttatctctattaaaatagatagggaacaatttcctcatatcgatggtttttatcaaaaagtgtatagagtgatgaataaaaaaggtggtggttggccacttactattgtgatgacgcctaatatggagccatttttttcggcaacctatgtaccaaaatatgcaggatatggctcaagaggacttatggaagtattaagagagattgcagtttatgataaagacaaactacaagagcaagggaaacatatacttgaagttgtaaataatgaagagaatgttactttatcaaatgcaaccttttga

SEQ ID NO: 16826 - protein, 190 aa, Unknown
  Obtained from environmental sample
  SIGNAL (1)...(18)
  DOMAIN (17)...(89): Protein of unknown function, DUF255
  misc_feature (1)..(190): Xaa is any amino acid
MFKKALLVFYIFLGITMANQLQNETSPYLLQHKDNPVDWYPWNDVAFEKAKKENKLIFLSIGYSTCHWCHVMAHESFEDEEVAKILNKDFISIKIDREQFPHIDGFYQKVYRVMNKKGGGWPLTIVMTPNMEPFFSATYVPKYAGYGSRGLMEVLREIAVYDKDKLQEQGKHILEVVNNEENVTLSNATF

SEQ ID NO: 16827 - DNA, 327 bp, Unknown
  Obtained from environmental sample
  misc_feature (1)..(327): n is a, c, g, or t
atggaaaagatgattgtttacaactggcctggaaatgtaagggaacttgaaaactgtattgaaaggctaatggtaataagccctggaaatatactagatgaaggtttttttaaatctgaaacagtcagcataaattatttagttgagaaagatggtgcatctaatattggagaaagttatgatctttttgaaatcgaaaaaaaggttcttcttgaagttcttaaaaaagcagactggaacaagtccatggctgcaagaatgcttaatatagacagaaaggctctgtataatcgaattaaaaaattcaacataacatcgtctaattaa

SEQ ID NO: 16828 - protein, 108 aa, Unknown
  Obtained from environmental sample
  DOMAIN (62)...(102): Bacterial regulatory protein, Fis family
  misc_feature (1)..(108): Xaa is any amino acid
MEKMIVYNWPGNVRELENCIERLMVISPGNILDEGFFKSETVSINYLVEKDGASNIGESYDLFEIEKKVLLEVLKKADWNKSMAARMLNIDRKALYNRIKKFNITSSN

SEQ ID NO: 16829 - DNA, 396 bp, Unknown; identical to SEQ ID NO: 14781
  Obtained from environmental sample
  misc_feature (1)..(396): n is a, c, g, or t

SEQ ID NO: 16830 - protein, 131 aa, Unknown; identical to SEQ ID NO: 14782
  Obtained from environmental sample
  misc_feature (1)..(131): Xaa is any amino acid

SEQ ID NO: 16831 - DNA, 366 bp, Unknown; identical to SEQ ID NO: 14837
  Obtained from environmental sample
  misc_feature (1)..(366): n is a, c, g, or t

SEQ ID NO: 16832 - protein, 121 aa, Unknown; identical to SEQ ID NO: 14838
  Obtained from environmental sample
  misc_feature (1)..(121): Xaa is any amino acid

SEQ ID NO: 16833 - DNA, 912 bp, Unknown
  Obtained from environmental sample
  misc_feature (1)..(912): n is a, c, g, or t
atgaataataaaacgaagatatttctccccattttattagctatggctattgttttgggtatgtatattaattcttattttcaagtaagttctggatcgagaatttttaatgcgcctgctacaacggcaagtcataaattagatgcagttctaaatatgattgttgacgattatgtagatacggtttcagcagatcgattagttgagcaagcaatacctgctattcttaaagatttagacccacacactgtatatatcccaaaggaagatttagaacggtacaatcaagacttgaaaggtaattttggaggaattggtattcaatatatcacttatcgtgatacagttactgtcgtaaaaacaattgaaggaggtccatcagaatatgctggagttcttgctggcgatagaattgtaaaagttgatagtacgccaataataggtactgatttaagcactgaattcattcaaggcaagcttaaagggcctaagggaacaggagtaaaagtatccatttttcgtcgtggggttaaagatttgattgaattggatattattcgaggttcaattcctgttgcgagtgtcgatatatcttatatgattaataaagacttgngttatataaaagtcagacgttttggagcaacaacttttcacgagttcgcaaaagggctagagaaattaaaggagcaaggtttaaagaaattagttgttgacctaagaggtaattcaggtggatatatgtctgctgcgaccaatatgatcaatgaatttctggcagaagggaagatgattgtttacaccgaaggtaaatcgccagctaaaacagattacctttcaacaggaagaggtgattatcaagagttacctatcgttattttaattgatgaaggttctgcttcagcaaggtaa

SEQ ID NO: 16834 - protein, 303 aa, Unknown
  Obtained from environmental sample
  SIGNAL (1)...(20)
  DOMAIN (204)...(303): Peptidase family S41
  misc_feature (1)..(303): Xaa is any amino acid
MNNKTKIFLPILLAMAIVLGMYINSYFQVSSGSRIFNAPATTASHKLDAVLNMIVDDYVDTVSADRLVEQAIPAILKDLDPHTVYIPKEDLERYNQDLKGNFGGIGIQYITYRDTVTVVKTIEGGPSEYAGVLAGDRIVKVDSTPIIGTDLSTEFIQGKLKGPKGTGVKVSIFRRGVKDLIELDIIRGSIPVASVDISYMINKDLXYIKVRRFGATTFHEFAKGLEKLKEQGLKKLVVDLRGNSGGYMSAATNMINEFLAEGKMIVYTEGKSPAKTDYLSTGRGDYQELPIVILIDEGSASAR

SEQ ID NO: 16835 - DNA, 900 bp, Unknown
  Obtained from environmental sample
  misc_feature (1)..(900): n is a, c, g, or t
ttgcatcaaaagccttggtgttttcccattctttttcaagtcctgcactttcaaagtgataaaaaagcttggatctgttatggtagtgaggctaaacctagtaaagtatttccaccttttttgattttcaaggatggtaaagagccatattcaaatataaatgtagagttaggtgctttaaatgagaatcagattaacctttttattgccatagaggagcctttagaagatgcagagaaacgtctaaaaccagaagcgtggaaaaaaacatactctcatcatgcaccttataatgattggaatgtagacaaaactgaaaatgatctgccactctttggctctatcggtaaaatgtatgagacgctatgggcatatattgagattacatatagtgatggaacaacacttttaggagagctctcaaaagcgcaagaaaaaggtcttcaacgtgaccaatttaacacacaaacagcttatcatcctaaaaaagagtttccacatattgcaacaactctaggtgaatatagtaatgagttgatcttaaaaatagaacttctaaatattattaatgctatcacagatcaaggagagggaaaaggtgttgttcaatctatcttagatatttgggatacagacaatgttttagccagtcatatagcatctaaacagggtagtttctcacatgctatgaaaagtatgccaggtatgctaaaagcagtgcgtccgaactttcaacctgataaagaggcattaaaagaagattataaaggttacaacgatgagggtcaccaaacagagatctcaggtcaagcaaaagcacgtattgatgcagcaagttttgatcactatgagacatttaaaatagttaaagagatcagaaagagagtggtttctacatga

SEQ ID NO: 16836 - protein, 299 aa, Unknown
  Obtained from environmental sample
  misc_feature (1)..(299): Xaa is any amino acid
MHQKPWCFPILFQVLHFQSDKKAWICYGSEAKPSKVFPPFLIFKDGKEPYSNINVELGALNENQINLFIAIEEPLEDAEKRLKPEAWKKTYSHHAPYNDWNVDKTENDLPLFGSIGKMYETLWAYIEITYSDGTTLLGELSKAQEKGLQRDQFNTQTAYHPKKEFPHIATTLGEYSNELILKIELLNIINAITDQGEGKGVVQSILDIWDTDNVLASHIASKQGSFSHAMKSMPGMLKAVRPNFQPDKEALKEDYKGYNDEGHQTEISGQAKARIDAASFDHYETFKIVKEIRKRVVST

SEQ ID NO: 16837 - DNA, 849 bp, Unknown
  Obtained from environmental sample
  misc_feature (1)..(849): n is a, c, g, or t
atgtgtagaaaaaaagagttaaaaaaaatttattttaaagctgtaaacgcagtattgcctaaaacaatagtaaaagaaaatattacaaagtacaaaaataaaaaagtatatatattttctattggtaaagctggatatgatatggcaaaagaggctgaaaaaatattgaaaaacaatattttaggaggagttgcagtttctaataaaaaaggaaagttgaaatatataaagcatttaacttcgacccatccattagttacacaaaaaagtgtaaaggctactaaacttcttattcaagagataaaaaaactaaaaaaaacagatatctttatttttttccttagtggtggagcctctgctatggttgagttaccaaatgataatattagtttaaaaaaatttcaaaaaatctctacaaaacttttactctcagggattgatattcatgaacttaatctccaaagaaaaaaactctcatctgtcaaaggtggaaaactagctaataatttcaaaacaaaaaagggtgaggtatttgtattaagtgatgtgattggagatgatatagatactataggatcagcccctatgaataatggaaaatttaaacatacaatcataggaaataatacaaaagcacttaaagctgcaaaaaaagagattcaaaataaagttgagaaaacaaaaatagttacaaccactcttaatatgaatacaactgatgcttcaaaatatatatcaaaaaaagtagaaaaatatgataaaaaatataaaagcttttgtttactatttggtggtgagacaactacaaaagtaaatagcagtggaaaaggtggtagaaaccaagagtaa

SEQ ID NO: 16838 - protein, 282 aa, Unknown
  Obtained from environmental sample
  misc_feature (1)..(282): Xaa is any amino acid
MCRKKELKKIYFKAVNAVLPKTIVKENITKYKNKKVYIFSIGKAGYDMAKEAEKILKNNILGGVAVSNKKGKLKYIKHLTSTHPLVTQKSVKATKLLIQEIKKLKKTDIFIFFLSGGASAMVELPNDNISLKKFQKISTKLLLSGIDIHELNLQRKKLSSVKGGKLANNFKTKKGEVFVLSDVIGDDIDTIGSAPMNNGKFKHTIIGNNTKALKAAKKEIQNKVEKTKIVTTTLNMNTTDASKYISKKVEKYDKKYKSFCLLFGGETTTKVNSSGKGGRNQE

SEQ ID NO: 16839 - DNA, 678 bp, Unknown
  Obtained from environmental sample
  misc_feature (1)..(678): n is a, c, g, or t
ttgatgcttgaaaaaaagctattatttgcaccaggacccgtaatgaccgatataagggtaaaagaagctgcccttgcaccggatctttgtcataggcgtccgggttttgaagaggtttacagtgatgtaagggatagtttacttaaactttttcatgccccaaagaatgaatatacagctattgtagtaagtggttccgggacatcttctaatgaaaccgtattatcttcgatagtcgaaaaggaaaaaaaggttttattaattacaaatggagtatttggaaatagattaaaagatattataagctgctatggcttaggtttaaaccttttagagtttaaatggggtgaagtccctgatcttgaaaaaatagagaatgagcttaaaaatgacaaagatattagtataatatcgatggtttatcatgaaacaagcactggaatgataaaccctgttcacgaagtaggagatctggcagtaaaatataataaaatgtaccatgtagatactattagtgctattggtggagaagatatcgatgtaaaaagagataatattgatttttgcacaggtgtacctaataaagccgttggcgggcagcctggggttgcctttgtctgcatcaggaaatctgctttgaaaagattaagaatgtccccgggcgtaatatatatctaa

SEQ ID NO: 16840 - protein, 225 aa, Unknown
  Obtained from environmental sample
  misc_feature (1)..(225): Xaa is any amino acid
MMLEKKLLFAPGPVMTDIRVKEAALAPDLCHRRPGFEEVYSDVRDSLLKLFHAPKNEYTAIVVSGSGTSSNETVLSSIVEKEKKVLLITNGVFGNRLKDIISCYGLGLNLLEFKWGEVPDLEKIENELKNDKDISIISMVYHETSTGMINPVHEVGDLAVKYNKMYHVDTISAIGGEDIDVKRDNIDFCTGVPNKAVGGQPGVAFVCIRKSALKRLRMSPGVIYI

SEQ ID NO: 16841 - DNA, 387 bp, Unknown
  Obtained from environmental sample
  misc_feature (1)..(387): n is a, c, g, or t
gtgataaaggtaaaccctgggagggcaggcacccgggcttggatttccggttctcggcgggacatatggttcaaggacaatgtgattttaacagcccagctgtacccgccatcgatgaggccggatggcagtttggtactttacctttgccttccgaacccaaagggggaggaacatatcactgttgagaagggttctgtatcggtcaatggggtcagtctgaccgtggtcaattcgaaggataaatcattccaggtggccatcatccccttcacctatgatatgaccaatttccaccagttcaaagtgggaagtgtggtaaaccttgaatttgacatcattggaaaatacatcgcccgtatcctgaaagcacagctaaagaattaa

SEQ ID NO: 16842 - protein, 128 aa, Unknown
  Obtained from environmental sample
  DOMAIN (25)...(112): Lumazine binding domain
  misc_feature (1)..(128): Xaa is any amino acid
MIKVNPGRAGTRAWISGSRRDIWFKDNVILTAQLYPPSMRPDGSLVLYLCLPNPKGEEHITVEKGSVSVNGVSLTVVNSKDKSFQVAIIPFTYDMTNFHQFKVGSVVNLEFDIIGKYIARILKAQLKN

SEQ ID NO: 16843 - DNA, 909 bp, Unknown
  Obtained from environmental sample
  misc_feature (1)..(909): n is a, c, g, or t
atgcaataccaagagatagcaaataaatgtaatttagagataaaactaggagatccaacaccgccaaattttaaatttacaagagaaaaagctgaattaaatggattaacacttcctcaaccagaattagaatatagtttagaaaatgataaagtattatttattgatgagtgttggagaggattagaagaaaggttaaaaatagtagatccatcacgacatcaagagtataaagatagactccaagttgagatagatattataaataacatgaaattcccaggatatatgcttattgtttgggactttgtggaatatggtaaatctataggggtacctgtgggaccaggacggggaagtgcagctggaagcttagtagcattttcacttaaaattacagatattgaccctatcccttatggactactttttgagagattcttaaatccagagagggtatctatgccagatattgatatggatttttgtcaagcaagacggcaagaggtcatagactatgttgttgaaaaatatggtcgagcaaatgtagctcaaattatcacttttgggaaacttcttgcaaaaggtgttattcgagatgttgctagagttcttgatatgccttattctcaagcagatgcaatggcaaaacttataccagatgaattagggataaatttaaaagatagttgggaaaaagagcctaagataaaagagttgtgcgaatctgatccaaaagctgcaagggtatgggagtatgctttggcattagagggattaaatagaaatgctggaacacacgcagcaggtgttgttatctcaaatgaagctttatggaaaaaaacaccactttttaaaccatcaggactggatacattagctacgcagaacaatggaaaaatttgttag

SEQ ID NO: 16844 - protein, 302 aa, Unknown
  Obtained from environmental sample
  misc_feature (1)..(302): Xaa is any amino acid
MQYQEIANKCNLEIKLGDPTPPNFKFTREKAELNGLTLPQPELEYSLENDKVLFIDECWRGLEERLKIVDPSRHQEYKDRLQVEIDIINNMKFPGYMLIVWDFVEYGKSIGVPVGPGRGSAAGSLVAFSLKITDIDPIPYGLLFERFLNPERVSMPDIDMDFCQARRQEVIDYVVEKYGRANVAQIITFGKLLAKGVIRDVARVLDMPYSQADAMAKLIPDELGINLKDSWEKEPKIKELCESDPKAARVWEYALALEGLNRNAGTHAAGVVISNEALWKKTPLFKPSGLDTLATQNNGKIC

SEQ ID NO: 16845 - DNA, 333 bp, Unknown
  Obtained from environmental sample
  misc_feature (1)..(333): n is a, c, g, or t
atggttcagccaaaaattcaaacaaaggagattagcatcatgagtacaaaagaaattgaaaatattcaaaattttttgacaatttataaagaggatgaaaacagaaggcaccagattgttaatgttgaattaatgctgagaaagcacccaccagcagcggtaatcacttttcttgatggtcttcatcgggaatatgcccaaaaattacaaaaaataatcaaggaggatagaacctcatccaggttgaataaaattgtagcaactaaattcagaatcaagatggcgatcaattgtataaaaaatgctcataaagaaggaggacaagcagcatga

SEQ ID NO: 16846 - protein, 110 aa, Unknown
  Obtained from environmental sample
  misc_feature (1)..(110): Xaa is any amino acid
MVQPKIQTKEISIMSTKEIENIQNFLTIYKEDENRRHQIVNVELMLRKHPPAAVITFLDGLHREYAQKLQKIIKEDRTSSRLNKIVATKFRIKMAINCIKNAHKEGGQAA

SEQ ID NO: 16847 - DNA, 738 bp, Unknown
  Obtained from environmental sample
  misc_feature (1)..(738): n is a, c, g, or t
ttgatggcncgaggtttggcatttagttttcgaaaaaacttcactactaaatttctattttattttttaactgctaaagaaaaatttatctatacaagattagataaaaagttagatatacatcaagtgataagatataatgatttcataaatagaagtttagagttatcaactgatccaaagaatttgaaaatatatacaaagccatcttcagattctaagaaaaatagttcaaagttagtattagggattaatccaggggcaacctatggaagtgctaaaagatggtatccaaaggaatttgctaaaacagcaatagaattgtctaaaaattatgatatcaaaatatttggtgggcctggtgaagttgatataactttagatattgaaaaagagcttcaaaatgcaaatattacaaactatcaaaatttatcaggaaagacttctatcgaggagttgattattgaaatttccaaacttgatctatttataacaaatgactctggtcctatgcatgtagcagcagcttttgatataccaactgttgctatttttggaccaacaagatatattgagacacatcaatggcaaaatactcatgagatgctattacgaaaagagttagagtgtagtccttgtatgaaaagagtttgtcctttaaaacaccatgattgtatgaaattaataacatcaaaggatgtaatctcaatgttaagaaaaaaccaatatataaactaa

SEQ ID NO: 16848 - protein, 245 aa, Unknown
  Obtained from environmental sample
  DOMAIN (7)...(224): Glycosyltransferase family 9 (heptosyltransferase)
  misc_feature (1)..(245): Xaa is any amino acid
MMARGLAFSFRKNFTTKFLFYFLTAKEKFIYTRLDKKLDIHQVIRYNDFINRSLELSTDPKNLKIYTKPSSDSKKNSSKLVLGINPGATYGSAKRWYPKEFAKTAIELSKNYDIKIFGGPGEVDITLDIEKELQNANITNYQNLSGKTSIEELIIEISKLDLFITNDSGPMHVAAAFDIPTVAIFGPTRYIETHQWQNTHEMLLRKELECSPCMKRVCPLKHHDCMKLITSKDVISMLRKNQYIN

SEQ ID NO: 16849 - DNA, 447 bp, Unknown
  Obtained from environmental sample
  misc_feature (1)..(447): n is a, c, g, or t
ttgttaagtatgaaagaatttgcacatattgcagagatatataaaaaatttcctacaaaggaagactgtattcggtttattgagaaggtaaggtggagtaataaacctgtatgtcctcattgtcattcacatagagtcagtcctatgaagaaggaatttagatatcattgtaattcatgtaacgtctccttttctgttacagttaaaactctatttcataataccagaataccacttcaaaaatggtttgctgcaattgaaatttttaagcagaacgaaaacaaaattagtgttcgtaaactggctgaagttttagatgtaaataaagatactgcatggactatgattttaagaataaagaaagcaggttctgaatatggagaattgttttcacgtcttgtagagtctggtgaaatatatttaaatggtcgaattaaagtaaaatag

SEQ ID NO: 16850 - protein, 148 aa, Unknown
  Obtained from environmental sample
  misc_feature (1)..(148): Xaa is any amino acid
MLSMKEFAHIAEIYKKFPTKEDCIRFIEKVRWSNKPVCPHCHSHRVSPMKKEFRYHCNSCNVSFSVTVKTLFHNTRIPLQKWFAAIEIFKQNENKISVRKLAEVLDVNKDTAWTMILRIKKAGSEYGELFSRLVESGEIYLNGRIKVK

SEQ ID NO: 16851 - DNA, 519 bp, Unknown
  Obtained from environmental sample
  misc_feature (1)..(519): n is a, c, g, or t
ttggaaagaagagtaattgtaattgttggtgcaactggctctgggaaaactgcactttcccttaagttagcggcaaaaatcaacagtgaaattatttctgctgatagcagacagatatataaaattctagttattggaacagccaaaccactcaaagagcaactcaatcaagtcaaacatcattttatagattcgcttaatcccgatgaatcttttaacgtaagtaaatttgaagtggaatcgttaaagataattaatgagcttcatcaaagaaataaaatcccaattgttgttggtggctccggattatatatcaaagctttggtggatggacttttcaatgaagttgatacggatgaagagtttcgtaaaaaacttcttgatgaaaaagaaaatttcggaaacgattacctttaccaaaaattaattgctgttgataaagttagtgccgatacaatgcttccacaaaattggaagagagtaattcgtgcgcttgaggtttttcatctaacgcggtga

SEQ ID NO: 16852 - protein, 172 aa, Unknown
  Obtained from environmental sample
  DOMAIN (37)...(172): IPP transferase
  misc_feature (1)..(172): Xaa is any amino acid
MERRVIVIVGATGSGKTALSLKLAAKINSEIISADSRQIYKILVIGTAKPLKEQLNQVKHHFIDSLNPDESFNVSKFEVESLKIINELHQRNKIPIVVGGSGLYIKALVDGLFNEVDTDEEFRKKLLDEKENFGNDYLYQKLIAVDKVSADTMLPQNWKRVIRALEVFHLTR

SEQ ID NO: 16853 - DNA, 354 bp, Unknown
  Obtained from environmental sample
  misc_feature (1)..(354): n is a, c, g, or t
atgggagtaaaagtcttctcaattgagaggaatgatgacatatattttagaactcaaaaactttttgataagctcatgctcagagcagcgttacgtttgggtgatggcactattggatgggaagagtacgcaccatataatggaattattgttactgccggcggacccacaattccacagagactagtaaaacaattagccattggtggaagaatggttgtaccgataggaaatagaaaaactcaaactatgaaaatcattacaaaaatatctgaagatgaatttcaaactaaagatattcctaactttaaatttgttccactaattggtaaagagggttggaaagaagagtaa

SEQ ID NO: 16854 - protein, 117 aa, Unknown
  Obtained from environmental sample
  DOMAIN (1)...(113): Protein-L-isoaspartate(D-aspartate) O-methyltransferase (PCMT)
  misc_feature (1)..(117): Xaa is any amino acid
MGVKVFSIERNDDIYFRTQKLFDKLMLRAALRLGDGTIGWEEYAPYNGIIVTAGGPTIPQRLVKQLAIGGRMVVPIGNRKTQTMKIITKISEDEFQTKDIPNFKFVPLIGKEGWKEE

SEQ ID NO: 16855 - DNA, 402 bp, Unknown
  Obtained from environmental sample
  misc_feature (1)..(402): n is a, c, g, or t
ttgtttttcctttttaccaacttaattcatgctcaaaaagtcaccgtaacagttgttgtggaggatataacatttgaaagtggcagtgtaaatattggcatatttgatactgattcagcgtttcaatcaaaacaagaaccgtttgtgaaagcatcagcttcagtaagtgatacttccaagatcaaagcaattatagaacttccttctggaatttatgcaattgctgtttaccacgatgaaaatgaggacaatcaattgaacaaaaagaaaatgggtattcccgaagaaggcgttggattttcaggcacgatcaaaagtaaaatcaggcaaccaaaatttgaggaagcttcatttcaattgaaaaatgatacaacaattcatattacgctaagatatccataa

SEQ ID NO: 16856 - protein, 133 aa, Unknown
  Obtained from environmental sample
  misc_feature (1)..(133): Xaa is any amino acid
MFFLFTNLIHAQKVTVTVVVEDITFESGSVNIGIFDTDSAFQSKQEPFVKASASVSDTSKIKAIIELPSGIYAIAVYHDENEDNQLNKKKMGIPEEGVGFSGTIKSKIRQPKFEEASFQLKNDTTIHITLRYP

SEQ ID NO: 16857 - DNA, 453 bp, Unknown
  Obtained from environmental sample
  misc_feature (1)..(453): n is a, c, g, or t
atggttgtagatttagataatatcaatgaagtagtaacttctttagaaaaactaattagagaaaaaaatattgttgtattactgcaaggtgatttagcaagtggaaaaactactttagtaaaaaactatctaaaagcaattggatgtgatgataaagtaactagtccaactttttcaatccaatccatctacggtaataatatttatcactatgatgtgtataataaaactttagaagaatttatctctttaggtttattagaagagtttgaaaaggatggtatccattttgtggagtngggtgatgagaatttaaaaaagattttagatgattatggctttgaggtactggttgtaaaaataaataaattaaatgaaaaaagagagtatataattggaatcttaaaattagaggtaaaaaacctccgccaagatgataaaaaaaaaccccaa

SEQ ID NO: 16858 - protein, 151 aa, Unknown
  Obtained from environmental sample
  DOMAIN (5)...(130): Uncharacterised P-loop hydrolase UPF0079
  misc_feature (1)..(151): Xaa is any amino acid
MVVDLDNINEVVTSLEKLIREKNIVVLLQGDLASGKTTLVKNYLKAIGCDDKVTSPTFSIQSIYGNNIYHYDVYNKTLEEFISLGLLEEFEKDGIHFVEXGDENLKKILDDYGFEVLVVKINKLNEKREYIIGILKLEVKNLRQDDKKKPQ

SEQ ID NO: 16859 - DNA, 372 bp, Unknown
  Obtained from environmental sample
  misc_feature (1)..(372): n is a, c, g, or t
ttgacaatattgtttcaaaagagatatttcatggttatatcaaaattgatggtgttttttccaaaaaatatttcttatagttatcaaaaaattgacgaagaattattaagggaagtgagagaagaacaagatactgtttttaataatttatctggtcttttagatcttgataatattaaggtggatataattaaagcaccagattattcaaaatcatctgcaattttttataaattgccatttattactaaggataaaattttgtttggaactcaaatttggattaatcatccattttatcaaggttcttttaataattataactttggtgggaaagtatttaatgataaattagttattcatcaacagtaa

SEQ ID NO: 16860 - protein, 123 aa, Unknown
  Obtained from environmental sample
  misc_feature (1)..(123): Xaa is any amino acid
MTILFQKRYFMVISKLMVFFPKNISYSYQKIDEELLREVREEQDTVFNNLSGLLDLDNIKVDIIKAPDYSKSSAIFYKLPFITKDKILFGTQIWINHPFYQGSFNNYNFGGKVFNDKLVIHQQ

SEQ ID NO: 16861 - DNA, 441 bp, Unknown
  Obtained from environmental sample
  misc_feature (1)..(441): n is a, c, g, or t
atgagccaaatgaaaacaatatatttaaaagattacaaaaagccggagtttgagatacatagttgtgagttgcattttgaactttatgaagagtatgcaatagtcacaaatactatgagaattaaaaagattgacaactcttctaatgatatactcttagatactatagacttagagctcatagaactatatttaaatgacttaaaactaaaagatacacgttaccatattgaagaggaaagtttgaagattttaaatgttccagactccttttctcttaaaatcaaaaacaaaatttatcctcaaaataacactgaacttgaagggctttacaagtcaggttcaattttctgtacacaaaacgaaccggaaggttttagaaggattactccgtatttagacagaccggacgtaatgagtgtgtttactacaactgtatag

SEQ ID NO: 16862 - protein, 146 aa, Unknown
  Obtained from environmental sample
  misc_feature (1)..(146): Xaa is any amino acid
MSQMKTIYLKDYKKPEFEIHSCELHFELYEEYAIVTNTMRIKKIDNSSNDILLDTIDLELIELYLNDLKLKDTRYHIEEESLKILNVPDSFSLKIKNKIYPQNNTELEGLYKSGSIFCTQNEPEGFRRITPYLDRPDVMSVFTTTV

SEQ ID NO: 16863 - DNA, 330 bp, Unknown
  Obtained from environmental sample
  misc_feature (1)..(330): n is a, c, g, or t
atgataaacaaatcgacactctttattgtaaatgatattgataaatctagcgaagatataagtagtagtttacctaaacactctgttagagttataagaaacgagactgaggggaaaaatgagtttttaatagatgaagcaaaaaaagctatcaaagaagcatatatcgctacaagtgaaacaaagtatatacttctttgtggtaattcttttggaatacccgctcaaaattcacttttaaaagtacttgaagaaccacctaaaaatattatttttataattataactatctcaaaaagttcaattctccctacaatttatcccgagtag

SEQ ID NO: 16864 - protein, 109 aa, Unknown
  Obtained from environmental sample
  misc_feature (1)..(109): Xaa is any amino acid
MINKSTLFIVNDIDKSSEDISSSLPKHSVRVIRNETEGKNEFLIDEAKKAIKEAYIATSETKYILLCGNSFGIPAQNSLLKVLEEPPKNIIFIIITISKSSILPTIYPE

SEQ ID NO: 16865 - DNA, 552 bp, Unknown
  Obtained from environmental sample
  misc_feature (1)..(552): n is a, c, g, or t
gtgcaagagtttacaaattggacggtagatactatacgaagggataagcttttaggtgctgggctagaggagcgtaaatttgattggctccctttagtatctcaaactatcattaatattatagataaaaacaaatcagtacttattatcactgatgatgagcacgactggtttatgagatatattttaattaatattaataaaaagaaactctctcgaccctatttcccattttatgcttttaactctttccattcaaatattgataatataaaaacagaaaatgatatacaactaatacacgatatgcttgataactcttttccaaatggatactttttttggtatataggaaaaagtagaagtaaaagagcaaccttagcaaaaatatcgaaacaaccatttttatggttaatggatgaagagttatcaaatagtttttatttagatagtaatgatgaagctttagatatacgacttttaaatatgtatcgactttttaataaaactcttgacgctgttctttgcgctcaaattgatgtaactaaatga

SEQ ID NO: 16866 - protein, 183 aa, Unknown
  Obtained from environmental sample
  misc_feature (1)..(183): Xaa is any amino acid
MQEFTNWTVDTIRRDKLLGAGLEERKFDWLPLVSQTIINIIDKNKSVLIITDDEHDWFMRYILININKKKLSRPYFPFYAFNSFHSNIDNIKTENDIQLIHDMLDNSFPNGYFFWYIGKSRSKRATLAKISKQPFLWLMDEELSNSFYLDSNDEALDIRLLNMYRLFNKTLDAVLCAQIDVTK

SEQ ID NO: 16867 - DNA, 702 bp, Unknown
  Obtained from environmental sample
  misc_feature (1)..(702): n is a, c, g, or t
gtgcagatcaaaaacaatgagatcaatgcccagctcgtccatggaagaggcggtgtcctgtttcaaagtgtggacaataacttttccgttttcggacgggagcttaatgatacgttcatgaacagactcttcaagttctctacttttgaaggaggggaactctcttttaccatgcagggagattttgatcgttttaacggcctgtttaaggtcgacaatacaaagatcaaagactataccgtactgaacaacacccttgcttttttcaatactatccctgcccttgtcaccttttccgttcccggttattcacgaaaaggactcaaggtcagtgagatgtacaccaattttgaagtcaacaaagatcacgtcacgataaaagataccaagatcagctccaaagaacttacgatcaccgccaagggagagagcgatctgaaaaaggagagcatcgatctgctgatggaagtcaagacagatataggaagttccgctaaaaacatccctctgctgggatatatcatctttggagacgacaccgtctctactaccgtgcgtgtccacggggatctaaaagatcctaaggtcgaaaactctgtcgcaaaaagcattatcgttgcgccttacaacatcatcaaacgcactatcactctgccctttaaggtcttcgatatctttgatgacaaaaacacaagccaatag

SEQ ID NO: 16868 - protein, 233 aa, Unknown
  Obtained from environmental sample
  misc_feature (1)..(233): Xaa is any amino acid
MQIKNNEINAQLVHGRGGVLFQSVDNNFSVFGRELNDTFMNRLFKFSTFEGGELSFTMQGDFDRFNGLFKVDNTKIKDYTVLNNTLAFFNTIPALVTFSVPGYSRKGLKVSEMYTNFEVNKDHVTIKDTKISSKELTITAKGESDLKKESIDLLMEVKTDIGSSAKNIPLLGYIIFGDDTVSTTVRVHGDLKDPKVENSVAKSIIVAPYNIIKRTITLPFKVFDIFDDKNTSQ

SEQ ID NO: 16869 - DNA, 645 bp, Unknown
  Obtained from environmental sample
  misc_feature (1)..(645): n is a, c, g, or t
atgagaggcaaacaaactatcacagcgattgatataggcaccactaaaatctgcgtgctcatcgctgttacaactgatgacgataaatatgaagtaaagggttttggcatcagtaaatctgaagggatcaataacggtcaggttactgatatcatgaaaactgccaaatcgattcagaaggctttgaaagaagcggaagagatggcaggtgtaaaacccaaaaacatctatgtaggaattgccggtgatcatattaaaagccagaataccatgggtagaatttctttaacaagcggaacagacgcttgtgaaattaccagtgaacatgtggaaaatgtgctcagcaatgccaaaaataatgttaaactccagccgggtaacgaccgtttggaaataattcatgcgattcctcaatatttcgatatcgacgaaatgaagggaatcatgaatcctcttcgtatgagcggattcaacctgtctgctcatgtacacattgttttagcagataaaactgccatgactaatataaaaaaatgtgtggaaatttgcggtcacaaagttaacgatatttttttggaacaattgcgtcctcctactccgtactcaacgaagtggaaaaagaatctagggctccattcctattga

SEQ ID NO: 16870 - protein, 214 aa, Unknown
  Obtained from environmental sample
  DOMAIN (7)...(195): Cell division protein FtsA
  misc_feature (1)..(214): Xaa is any amino acid
MRGKQTITAIDIGTTKICVLIAVTTDDDKYEVKGFGISKSEGINNGQVTDIMKTAKSIQKALKEAEEMAGVKPKNIYVGIAGDHIKSQNTMGRISLTSGTDACEITSEHVENVLSNAKNNVKLQPGNDRLEIIHAIPQYFDIDEMKGIMNPLRMSGFNLSAHVHIVLADKTAMTNIKKCVEICGHKVNDIFLEQLRPPTPYSTKWKKNLGLHSY

SEQ ID NO: 16871 - DNA, 783 bp, Unknown
  Obtained from environmental sample
  misc_feature (1)..(783): n is a, c, g, or t
atggccgatatggtcgtaaatatgcaaggtgtaacttttattgccgattttaaaagactctcaaatgataagtttttattaaagataaaatcttatctgattacaaatctgcttttttgcgcaaatgatattcgatatgagatattcagacatgactactccatggatattgagctacaatataagcttcttcatgagatagaacactcacttaactttagcacaagatggatggtgaaatatttagataagcatcaagtagatattaaccacatcttagattataaagatagattatttgatcttttagctaaaaacaatattcgtaaaagagagatattaaaagataatgagagttttaatctattcttctcatccatagattatttacgttttgcagttgcagctatcatgatcaaagagacttctcgtcacacttttgagaatgtatcaactctattttacttagtactcaaagagtttaaagtgttagagatgattacatcactagataccattaagactacatctgcaaacgaaaagatattaagacatcaggtacttcaatttttagagtttatagttgttcactacacagaaaatgtactctcttttcaacgtataaatgagactccagatcaagcattcgccagttacttagagaatgagaaagagacatttacatcagtaaaagagaaaattgactcttttacaaaaacagagtcaaaaaatattaatgaagttgcaattacagtaaaccagattatggcttctattatttag

SEQ ID NO: 16872 - protein, 260 aa, Unknown
  Obtained from environmental sample
  misc_feature (1)..(260): Xaa is any amino acid
MADMVVNMQGVTFIADFKRLSNDKFLLKIKSYLITNLLFCANDIRYEIFRHDYSMDIELQYKLLHEIEHSLNFSTRWMVKYLDKHQVDINHILDYKDRLFDLLAKNNIRKREILKDNESFNLFFSSIDYLRFAVAAIMIKETSRHTFENVSTLFYLVLKEFKVLEMITSLDTIKTTSANEKILRHQVLQFLEFIVVHYTENVLSFQRINETPDQAFASYLENEKETFTSVKEKIDSFTKTESKNINEVAITVNQIMASII

SEQ ID NO: 16873 - DNA, 768 bp, Unknown
  Obtained from environmental sample
  misc_feature (1)..(768): n is a, c, g, or t
atgaactttctcattacacgaaaacttggcgatattatctccaacgataaaccatttgattttattgaagaaaacagccagataataggcgctgagataatgttgagtaagccggaacttattgatgatattgatttgtcggaaataaaaagaaagtgtgaaggacttaggcttactgctcatttgcctttctatgatctaaatatagcttcagttgattcttttattagaaactacagcatggatgtaatgttaaatggactggctttctgtgaaaaactggatataagaagtgccgttgctcattttggctttaatgttaagcttgcaggtaagtcagcggcaaaatggaaagagaagttctttcctcaaaaaagacttcttgaaagtgaggcacagaaaagaggcgtgaatcttatatgggaaaatacatacgaaaacaactttgagttttttgatgagattttaaaagtaagccctgatacacgtttctgtcttgacagtggccactgtaactgttttgctgatttttctcctgttgagttcattgataggtatcaagagaaagttgtgcatcttcatcttcatgataatgacggaaaagaagattcgcacatgcctcccggatatggaagtgtcaatttttcagcactttttaatgaaataggaaaatcaaaaattgaaaatgccgtttttgagatagagccggaaatgtatatggaaaataaagataatatttgtgaaatattcaaaacgaggaaaaaatga

SEQ ID NO: 16874 - protein, 255 aa, Unknown
  Obtained from environmental sample
  DOMAIN (9)...(213): AP endonuclease family 2
  misc_feature (1)..(255): Xaa is any amino acid
MNFLITRKLGDIISNDKPFDFIEENSQIIGAEIMLSKPELIDDIDLSEIKRKCEGLRLTAHLPFYDLNIASVDSFIRNYSMDVMLNGLAFCEKLDIRSAVAHFGFNVKLAGKSAAKWKEKFFPQKRLLESEAQKRGVNLIWENTYENNFEFFDEILKVSPDTRFCLDSGHCNCFADFSPVEFIDRYQEKVVHLHLHDNDGKEDSHMPPGYGSVNFSALFNEIGKSKIENAVFEIEPEMYMENKDNICEIFKTRKK

SEQ ID NO: 16875 - DNA, 537 bp, Unknown
  Obtained from environmental sample
  misc_feature (1)..(537): n is a, c, g, or t
ttgattttatnggattatcgctcagggcttttggagaaacaagtacaagatttaaaagagaaacaagaaattttaaaagacttaccaatagcttggcattttgtaggaagtttacaaaaaaataaaataaataaccttatagattgtaatccatcattgatgcactcacttgatagtttagaattagctcaggaattagataaaaaactaaaagtaaaaaacaagaccatgcgatgtttacttcaaataaactctgcctatgaagagtctaaatcaggagttgatccaaaagaggcagttagtatttataagcaaattcaagaaaaatatacaaatataaaactacaaggtattatgagtataggagcccatagtgaagattcaacaaagattctggaaagttttcaaatcacaagagctattttcaatcaatgtgatggtgcaaccatttgctctatgggtatgagcggagattttgaacttgctattgctaatggaagtaatatgatcagagtaggaagtgctttatttaaataa

SEQ ID NO: 16876 - protein, 178 aa, Unknown
  Obtained from environmental sample
  DOMAIN (2)...(178): Alanine racemase, N-terminal domain
  misc_feature (1)..(178): Xaa is any amino acid
MILXDYRSGLLEKQVQDLKEKQEILKDLPIAWHFVGSLQKNKINNLIDCNPSLMHSLDSLELAQELDKKLKVKNKTMRCLLQINSAYEESKSGVDPKEAVSIYKQIQEKYTNIKLQGIMSIGAHSEDSTKILESFQITRAIFNQCDGATICSMGMSGDFELAIANGSNMIRVGSALFK

SEQ ID NO: 16877 - DNA, 525 bp, Unknown
  Obtained from environmental sample
  misc_feature (1)..(525): n is a, c, g, or t
atgcgatgtatgttatgtgaaaaattcagtttttcacatatctgcaaagagtgtcgcaataattttttaactccttctatctacaaaagaaaaattttaaataaaatagatgttatctcattttataaatatagtgatattgagtcacttcttcacacaaaacacactgagctaggttattacatttatagtatattggctgatgtcgctatgaaaaagttctcacgagagtttaattttagtgaagatgttgcaattatagcagtggatgatcatgtaagacatggatactcccatactgcaattttatcaaaagccttaagtaatttaaatttacacacaaaaactagaaaactaagagctaaaaatcagacaaaatattcggcaaaaagttaccagtttagattaaatagtccaagagattttcagtttgaaacttttaaacagagtaatgtaatagttgtagatgatataattacaacttcattaacactcagtgaggctgtaagtgtgttagagaagtaa

SEQ ID NO: 16878 - protein, 174 aa, Unknown
  Obtained from environmental sample
  misc_feature (1)..(174): Xaa is any amino acid
MRCMLCEKFSFSHICKECRNNFLTPSIYKRKILNKIDVISFYKYSDIESLLHTKHTELGYYIYSILADVAMKKFSREFNFSEDVAIIAVDDHVRHGYSHTAILSKALSNLNLHTKTRKLRAKNQTKYSAKSYQFRLNSPRDFQFETFKQSNVIVVDDIITTSLTLSEAVSVLEK

SEQ ID NO: 16879 - DNA, 777 bp, Unknown
  Obtained from environmental sample
  misc_feature (1)..(777): n is a, c, g, or t
atggataaaattctgaaattcgatttgagctattttttcaaagaaaaacgaggagatgtaatttcaaaaatgatagtagatgttaaagaaattgaaatttcggttatagcttctttggaaatgatattaaaagatccaattcttatcatcgtatacctctatgtattatttttgataaatataaaactaaccataattgcattgttaatatttcctgtgtctgctttaattattgggagaattggtaaatctctaaaaaaagcgacaaagcgaggacaggataaaatgggaaaccttattggaatgttggaggaaacattaataggaataaaaatcgtaaaggcttttggtgttgaagagtttgtgaaaaaccgatttgaaaggttgaatcaaaattacagcaagctttttggaactatatggaaaaatagagccatagcaaatcccattaatgatattatttccacggtatcaattcttataattatgtgggttggtggtaaaatgattttaaatggagaagatgtttttacttcgcagattttcataggataccttgctgtttttacacaagtaataagacctgccaaggcaatgactaattcatattataatattatacggggcattacatctaaagaaagaattgacactattttgtctcatgtgggaggggtcaacgaaaggaacggttcaataaaaatcaaagagtttaaaaggactattgattttgagaatgttacatttggatataatggaagtgctcagccagtgtaa

SEQ ID NO: 16880 - protein, 258 aa, Unknown
  Obtained from environmental sample
  misc_feature (1)..(258): Xaa is any amino acid
MDKILKFDLSYFFKEKRGDVISKMIVDVKEIEISVIASLEMILKDPILIIVYLYVLFLINIKLTIIALLIFPVSALIIGRIGKSLKKATKRGQDKMGNLIGMLEETLIGIKIVKAFGVEEFVKNRFERLNQNYSKLFGTIWKNRAIANPINDIISTVSILIIMWVGGKMILNGEDVFTSQIFIGYLAVFTQVIRPAKAMTNSYYNIIRGITSKERIDTILSHVGGVNERNGSIKIKEFKRTIDFENVTFGYNGSAQPV

SEQ ID NO: 16881 - DNA, 810 bp, Unknown
  Obtained from environmental sample
  misc_feature (1)..(810): n is a, c, g, or t
atggtaaaacaaagagagcaaaaagagctacttttagcaagaagagaatctcttcaaaaagagctaaatacaaaacaaactttactttcaaataaagagcaagagatatataaactaaaaacttcaatagaacaacttcaaacagataaaatgcaaaatactacaaaacaacaagagctacaaaatgaactctcaaaattatatacaaaatataagcttgtatttgatgaaagttttgaagataattttagattgctagtagataaaaaagatcagtttataaaaaatgaatctctaaaaaaagagtgtgatacaaaacttcaaacaatagctgtagaattaaaagaattggagactaagatatcatctaaagagacaaatctcaaagagcaaaatgaacaacttcaaagtttaatacaagagctaaaagaattagagcaaaaaagtaaagctatcttagatatacaagatatagatacctttgaaaaagagataacaaatagttttaatgtcataaatgaaaactacaacaacttgtcaaaagagctagtgaatttaagctcaaaagatgagtccctaactaaacagataaaagatttggtagaaaaacaaagtgcagatagtataaaactagatgagctaaaacaaagttttgaaaaagctttaaaagaaaacgactttatctcaattgaagagtttgaaaaagcacttttatcaaaagatcaaagagaagaactaaaccaaatatgtaaaactatagaagagagatactctcaaatacaaactctaaaaatagaccctcagcgataa

SEQ ID NO: 16882 - protein, 269 aa, Unknown
  Obtained from environmental sample
  misc_feature (1)..(269): Xaa is any amino acid
MVKQREQKELLLARRESLQKELNTKQTLLSNKEQEIYKLKTSIEQLQTDKMQNTTKQQELQNELSKLYTKYKLVFDESFEDNFRLLVDKKDQFIKNESLKKECDTKLQTIAVELKELETKISSKETNLKEQNEQLQSLIQELKELEQKSKAILDIQDIDTFEKEITNSFNVINENYNNLSKELVNLSSKDESLTKQIKDLVEKQSADSIKLDELKQSFEKALKENDFISIEEFEKALLSKDQREELNQICKTIEERYSQIQTLKIDPQR

SEQ ID NO: 16883 - DNA, 642 bp, Unknown
  Obtained from environmental sample
  misc_feature (1)..(642): n is a, c, g, or t
atgaaaatattgttactagaagatgatgtaatactcaatgaacttatagaagagtttctagttagtttagggtatgaagtggattctttttatgatgggcaagaggctttagatactttatacgatgaaagttttgatttgttgcttcttgatgtgggcgttccctctttagatggttttagtgtattaaaaagtattaaagaggctaaaattgatattcctgcaatatttataacttcattgaacacaacggatgatttacaaaaaggttttgatgtgggttgtgatgattatataaaaaaaccttttgaactcaaagagttagagataagaataaatcatattaaaaagataaaacatatcgagtcttctgatactgtaaagatttatgaaaatatccaatatgacttttcaaatcataaaatcaaaaaagagaatgaaacaatagagttatctaataaagaagcaaaaatatttgagtattttatanaaaataaaaatagaattataagcacagaagagttggtatcaaatatttgggaatatgatgcaacaccatccaatgcaactataagaacttatatcaaaaatttacgaaagattttaaataatgatatggatagtaacagtaaaaggggatag

SEQ ID NO: 16884 - protein, 213 aa, Unknown
  Obtained from environmental sample
  DOMAIN (146)...(212): Transcriptional regulatory protein, C terminal
  misc_feature (1)..(213): Xaa is any amino acid
MKILLLEDDVILNELIEEFLVSLGYEVDSFYDGQEALDTLYDESFDLLLLDVGVPSLDGFSVLKSIKEAKIDIPAIFITSLNTTDDLQKGFDVGCDDYIKKPFELKELEIRINHIKKIKHIESSDTVKIYENIQYDFSNHKIKKENETIELSNKEAKIFEYFIXNKNRIISTEELVSNIWEYDATPSNATIRTYIKNLRKILNNDMDSNSKRG

SEQ ID NO: 16885 - DNA, 540 bp, Unknown
  Obtained from environmental sample
  misc_feature (1)..(540): n is a, c, g, or t
atgaaattactattattactttttttagtactattgaatgtgaatgcaaaaactttagatagtacacaagtattcaataaaacaacagttaaggtacaaaaacaaacattaggcttatcaaaagagttttatgctgatattgtacttgatgaaacagatatcaaagatattacactaagatttgatggttttatccaaaagttgtatcaagacaaaaaatatagctatatcaatagtggtgaaaaactatttagtatctattcaaatgaagtatatacttcactgcaagagtttttaactatagacctaaccaatcaaagaagatataaaagttatatggataagtttaaaaatcttgatatagatacaaaacaaatagtcaacatcttaaaatcaaaagagatgagagaaaatatagatatttattctccatatagcggatatcttataacaaaacaaatcaatacaggaagtgccgtaaaaaaagnggcagcttctttttcaaatagcaagtatgaaacagctttggggaaaagttaa

SEQ ID NO: 16886 - protein, 179 aa, Unknown
  Obtained from environmental sample
  SIGNAL (1)...(16)
  misc_feature (1)..(179): Xaa is any amino acid
MKLLLLLFLVLLNVNAKTLDSTQVFNKTTVKVQKQTLGLSKEFYADIVLDETDIKDITLRFDGFIQKLYQDKKYSYINSGEKLFSIYSNEVYTSLQEFLTIDLTNQRRYKSYMDKFKNLDIDTKQIVNILKSKEMRENIDIYSPYSGYLITKQINTGSAVKKXAASFSNSKYETALGKS

SEQ ID NO: 16887 - DNA, 537 bp, Unknown
  Obtained from environmental sample
  misc_feature (1)..(537): n is a, c, g, or t
ttgttattgttaatcccaattcaggaaaaaaatattgtaaaaattctaaaggagattaactctctgaatccaaaaatttcgaatattgtaacacataacgttgaggaactggaaagtgtgttccaattaaatattaataaatacaaagctttcataatagttggaggagatggctccgttagtgaagtagtaaaatatttacacaacagaaatgacaaacttttaggtgttttaccctcaggttcggggaatggttttgccagagaacttggttttaaaaaatcgattcactcattaattcaggatactaaaaaaggtgaaacacttgatattgatgtactatcggtaaacggaattaattgcatcaatgcggcaggtttgggttttgatagttttgtagctcacgattttcaaaaaagaaatagcaggggtttaaaaacctatgttatttctgtaataaaatcgctgtttgtttttaaagcttttagggcaactttatttgttggacaagaaaaatcccaggtcgatttccgatga

SEQ ID NO: 16888 - protein, 178 aa, Unknown
  Obtained from environmental sample
  DOMAIN (9)...(119): Diacylglycerol kinase catalytic domain (presumed)
  misc_feature (1)..(178): Xaa is any amino acid
MLLLIPIQEKNIVKILKEINSLNPKISNIVTHNVEELESVFQLNINKYKAFIIVGGDGSVSEVVKYLHNRNDKLLGVLPSGSGNGFARELGFKKSIHSLIQDTKKGETLDIDVLSVNGINCINAAGLGFDSFVAHDFQKRNSRGLKTYVISVIKSLFVFKAFRATLFVGQEKSQVDFR

SEQ ID NO: 16889 - DNA, 420 bp, Unknown
  Obtained from environmental sample
  misc_feature (1)..(420): n is a, c, g, or t
atgaataatggtaagtcaagtttaaaacaactcaaaacaaaatcaatactttatattgaagatgaaaaaaatatacgaaaagagttaacatcaacattacaattgttgtttaacgaagtgttttcattttcaagtgcagaacaaggactagattttttttcaaaaacaaaaccagatatgatacttagtgatataagcttagatggtttaagtggattagagtttgcaaaaacaatacgacaatcagataaaaaaataccaatcatactactctcggcacatacagatacaagctttttacttcaagctgcaaaattaaaactagtagagtatcttaccaaaccaataacatatgatgaattgacatcatcactactcttagcactagaagagatagagtcaaataaaactcggccataa

SEQ ID NO: 16890 - protein, 139 aa, Unknown
  Obtained from environmental sample
  DOMAIN (14)...(133): Response regulator receiver domain
  misc_feature (1)..(139): Xaa is any amino acid
MNNGKSSLKQLKTKSILYIEDEKNIRKELTSTLQLLFNEVFSFSSAEQGLDFFSKTKPDMILSDISLDGLSGLEFAKTIRQSDKKIPIILLSAHTDTSFLLQAAKLKLVEYLTKPITYDELTSSLLLALEEIESNKTRP

SEQ ID NO: 16891 - DNA, 393 bp, Unknown
  Obtained from environmental sample
  misc_feature (1)..(393): n is a, c, g, or t
atgccaaaatttttaagaaatacttttactattgtacttatattttttactatacttcttgcaagtatgcctgtaaatatttcattggaccaacttcttaaaatagagaaaaagtatggtgtaaaagcaaaaaagagagttctgttatgggatcaaatgcttcaaagtgcaaaaggtaaaaataccttagaaaaacttaaaatagtaaatgacttttttaatcaaataacttataaaagagatagtgtacattggaaacaaaatgactattggggctcaccttttgagtttttaggaactggtgctggggattgtgaagattatgctattgcgaaatattttgcactaaagacacttgggattcctgatgaaaaacttaaaatacctatgtaa

SEQ ID NO: 16892 - protein, 130 aa, Unknown
  Obtained from environmental sample
  misc_feature (1)..(130): Xaa is any amino acid
MPKFLRNTFTIVLIFFTILLASMPVNISLDQLLKIEKKYGVKAKKRVLLWDQMLQSAKGKNTLEKLKIVNDFFNQITYKRDSVHWKQNDYWGSPFEFLGTGAGDCEDYAIAKYFALKTLGIPDEKLKIPM

SEQ ID NO: 16893 - DNA, 669 bp, Unknown
  Obtained from environmental sample
  misc_feature (1)..(669): n is a, c, g, or t
atgaatgatatgtcaagtaaaatagagggagttataaaaaaacttaatgcaaatttagaatcaatgactcagaagctctcccttgatgagttaactggacttcatttacgacaaacatttgaaaccgatatgaaaaaaatgtttatttcaaaagagacaggatatgtatttatagtaaaaattgatgatttaagttcttatgcaaaaaatcatacaaataaagaggtagataaatttttaatctattttacaaatatattaaagaacctatctcctaaagtaacagcatatagattttatggttctgagtttgctatgatagcaaaaaacatagaagaaaatgagataaaacaggtaattcatagactaaaaattgctttagaatcatttgctataacatttaacattactgatgtagcacatattgggggaactccttttaaccctataggtacaactcctggtataattgcaagtgccaacgaagcttatgaaaaagccaaattaattggtgcaaatgaagcttttataagagatgacaatgatttagcaagagatatgaatgaatggagagatttagtttttgatatcatagataatcaaaaatttaatattagttatattggacaagcttattgtttagatatgaaagagcaaaatcttgtgtaa

SEQ ID NO: 16894 - protein, 222 aa, Unknown
  Obtained from environmental sample
  DOMAIN (22)...(174): GGDEF domain
  misc_feature (1)..(222): Xaa is any amino acid
MNDMSSKIEGVIKKLNANLESMTQKLSLDELTGLHLRQTFETDMKKMFISKETGYVFIVKIDDLSSYAKNHTNKEVDKFLIYFTNILKNLSPKVTAYRFYGSEFAMIAKNIEENEIKQVIHRLKIALESFAITFNITDVAHIGGTPFNPIGTTPGIIASANEAYEKAKLIGANEAFIRDDNDLARDMNEWRDLVFDIIDNQKFNISYIGQAYCLDMKEQNLV

SEQ ID NO: 16895 - DNA, 618 bp, Unknown
  Obtained from environmental sample
  misc_feature (1)..(618): n is a, c, g, or t
gtggacgatggttaccagcacagaaaacttcaccgcgatttagatattgtaacttatgatgccggagtcaaagaaaaattgaataaactgtttccttatggtgttctaagggaacccaaaaaatgtttggacagagccgatataataattattactcgttctgaatttcatcctaatattaattctttaaaaaatgatctagatagttatagcaaaaaatcggaaaaatatattgcccgtttttcatcatcagaaattattggaaatagccaaagccaccagattaagtatttagaagataaatcggtttttctttttgccggtatcggtaattttagaatgcttaaaaaacaagtttcttcgttgtgtgctgacttggattatgccttggagttatcagatcatcaggcatatgatataaatcttttaaattcaataaaacagcttgccgaaaagtacgattccgatttaattctaacaaccggcaaagatatggttaaaataggaaactttgattttggtcgggaattttattatcttaatcagacaatagatttagatcccggtgaggaaaaattgatagcatttattaaagataaaatccaaaaacaggcataa

SEQ ID NO: 16896 - protein, 205 aa, Unknown
  Obtained from environmental sample
  misc_feature (1)..(205): Xaa is any amino acid
MDDGYQHRKLHRDLDIVTYDAGVKEKLNKLFPYGVLREPKKCLDRADIIIITRSEFHPNINSLKNDLDSYSKKSEKYIARFSSSEIIGNSQSHQIKYLEDKSVFLFAGIGNFRMLKKQVSSLCADLDYALELSDHQAYDINLLNSIKQLAEKYDSDLILTTGKDMVKIGNFDFGREFYYLNQTIDLDPGEEKLIAFIKDKIQKQA

SEQ ID NO: 16897 - DNA, 603 bp, Unknown
  Obtained from environmental sample
  misc_feature (1)..(603): n is a, c, g, or t
atgggccctgccgggattatcaaccctgaattcaacaatgaccaacctgtaacaatacccagggagcaggtaatgtcgccaattgataaatgctgcctggataaagacatcagcgttgaagtcatcttgagtaaccctattttgtatgaaaatccagagaacagcacccaaatttcgattgatgatgttaatgtaaaaaaacaagaagaattccgtcccgggggtataaaatcggaacgagggaaacgaaaatatatacacaacacaattgcccatatctccaaaaaagacgtgggtaaatatatattaaatggccatggcataaaaaacgttttgttatttttaatagcttttctgtttcataatgggttgatcagtgatcggatccaatttttcacggatggtcataaaatgttaaatgatacaattctcaagtgtttcagctggtataagaatattgggattattctggactggtatcatttggaaaagaaatgtaaagaacaattgagcctggcattgaaaggacgattcatccacaacgagattcttgacaagctcatgccattattaacgacaaatggtttgaaacgaagggcttaa

SEQ ID NO: 16898 - protein, 200 aa, Unknown
  Obtained from environmental sample
  misc_feature (1)..(200): Xaa is any amino acid
MGPAGIINPEFNNDQPVTIPREQVMSPIDKCCLDKDISVEVILSNPILYENPENSTQISIDDVNVKKQEEFRPGGIKSERGKRKYIHNTIAHISKKDVGKYILNGHGIKNVLLFLIAFLFHNGLISDRIQFFTDGHKMLNDTILKCFSWYKNIGIILDWYHLEKKCKEQLSLALKGRFIHNEILDKLMPLLTTNGLKRRA

SEQ ID NO: 16899 - DNA, 738 bp, Unknown
  Obtained from environmental sample
  misc_feature (1)..(738): n is a, c, g, or t
atggataaagagtctaaaataatgtttgattttgataaacttgctttaaatgagatatgcggatttagagatgatgagatgtttacttgtgcaatatcatctacaacttctacagaaaaagagacaaaaactttgcgacaacaacttccctatgtaagtggttgtgattttttagagacaaataagttcatagaagatacttataaaaaaacctgtagttatgagtgtaaagatattgaaaatcctttattttttgataatatacccaaagaacaacttaaaagtattattgtaaatcgtcgttcaattcgagcttttagagaaatacctatagaagaaaatgatttttcttttatcacccaaaatatttttacttttgcaacaacacacaatattgatatattttatacagttcatagaataaatggcatgactcaaggattatataaaaatggaactcttcaaagtgttggcgactttagtgctaaatcaagatatttaagtttagaacaaaatataggtggacaaagtgcagtaacattctacttcacttcaaatgaaaatgaggcttatcaaaaagtaaatattttaagtggatttatcgctcaaatcatatatctaaaatcagaactcaaacaggtaggttgtagtggtattggagcttattatgatcaagagaccaaaaagtttttaaagacagaaaataacattctttacctacttgctattggcaagtaa

SEQ ID NO: 16900 - protein, 245 aa, Unknown
  Obtained from environmental sample
  misc_feature (1)..(245): Xaa is any amino acid
MDKESKIMFDFDKLALNEICGFRDDEMFTCAISSTTSTEKETKTLRQQLPYVSGCDFLETNKFIEDTYKKTCSYECKDIENPLFFDNIPKEQLKSIIVNRRSIRAFREIPIEENDFSFITQNIFTFATTHNIDIFYTVHRINGMTQGLYKNGTLQSVGDFSAKSRYLSLEQNIGGQSAVTFYFTSNENEAYQKVNILSGFIAQIIYLKSELKQVGCSGIGAYYDQETKKFLKTENNILYLLAIGK

SEQ ID NO: 16901 - DNA, 819 bp, Unknown
  Obtained from environmental sample
  misc_feature (1)..(819): n is a, c, g, or t
gtgattcccaaaaagagatacaagaaaaatttctttaaaaaaggatacacaatactctctcgaacaatagatcaaaaaacagcaaaagagttaaaaacattagcttataaattaagagttttagatgtatttgtccctatgaagagaaatgggaatagttatttgcatggattagatatctatgaaacaggggaggagagaatttatccttatgaagataccttaaccccagtacttgggtatataaaagagcaaaattcaaagcaagggaaacaaagagtcagaggtttaaatgggatagaaagagagtttgataagcagctcaataattttcaagatgggttactagagggggagaaagatatcctttcttacataatctttaacaaagattcgaaaatcataaaaagaaaagatggggataacattcaaattactattccattaaaattacaaaaaaatattgagttgatgttagataggtataaaaaggagtttgaagcccaagagatactggtatctgttatggatagtactacaggaaaaattttatcactagctagttcaaatcgatataacccttctcatataaaacaaaatgagatagaacatttaaaaataaatgcaattgaatataattttgaaccaggttcagttataaaaccattagcaatatctttagcaattgatgcaaataaaataaaaaaagatgaactcttttttgctcataatgttgggaaaaagaataaaaaaggggagttcccaagaggaaagtataaaataggaagatatactattaaagatgatcatagggtttga

SEQ ID NO: 16902 - protein, 272 aa, Unknown
  Obtained from environmental sample
  misc_feature (1)..(272): Xaa is any amino acid
MIPKKRYKKNFFKKGYTILSRTIDQKTAKELKTLAYKLRVLDVFVPMKRNGNSYLHGLDIYETGEERIYPYEDTLTPVLGYIKEQNSKQGKQRVRGLNGIEREFDKQLNNFQDGLLEGEKDILSYIIFNKDSKIIKRKDGDNIQITIPLKLQKNIELMLDRYKKEFEAQEILVSVMDSTTGKILSLASSNRYNPSHIKQNEIEHLKINAIEYNFEPGSVIKPLAISLAIDANKIKKDELFFAHNVGKKNKKGEFPRGKYKIGRYTIKDDHRV

SEQ ID NO: 16903 - DNA, 576 bp, Unknown
  Obtained from environmental sample
  misc_feature (1)..(576): n is a, c, g, or t
ttgagttgtatagattgtcataaaaatagcaaagataaaaaatgggaagatactgtgaattgtaaatcttgtcatagtgatatttcaaaacaaaatcatcaagagtatcataccaatatttcgtgtagtgcttgtcatagttcttggaatattagcaactatgaactcaatgttttaagagatgatacaaaaaactataaacagtggaaaaggctcactgttcaagaggataaatatttagaaaactttcttaaacttgctctaaaaaacccagatacaaaacctcaaatgccagactatctaaccaacaaattagaggatggtgtttggtatagtggttggaggtttaaaaggtgggagaacttctttttagtaaatgatgagagtggaaaaattaaaatagcaatacctagatatcaatatagaatcagttttaaaaatgaaaaaggggagatgatttttgatgatatatcacaaattgatgataaaaaactagaggcatttatcccaacatcccctcatactgtcacaaaaaaacaaaatcatgtgagatgtgtcatgaaaaccaaattatga

SEQ ID NO: 16904 - protein, 191 aa, Unknown
  Obtained from environmental sample
  misc_feature (1)..(191): Xaa is any amino acid
MSCIDCHKNSKDKKWEDTVNCKSCHSDISKQNHQEYHTNISCSACHSSWNISNYELNVLRDDTKNYKQWKRLTVQEDKYLENFLKLALKNPDTKPQMPDYLTNKLEDGVWYSGWRFKRWENFFLVNDESGKIKIAIPRYQYRISFKNEKGEMIFDDISQIDDKKLEAFIPTSPHTVTKKQNHVRCVMKTKL

SEQ ID NO: 16905 - DNA, 756 bp, Unknown
  Obtained from environmental sample
  misc_feature (1)..(756): n is a, c, g, or t
atgattgtaggtacaagaggtgaaaacttatctttatcttacaaaaaagtattacaaaaagctaagtttgatgagttttttgcaaaatatggtgaagaaccagaagatgttgtagttgaaggtacagttgtatctgtaaaaccaagagcaggttttgtagtacaagatgatgaaggtatggaatactttatgcctatggcacaaggtttcttaaaagcacatggtgcagttggaaagaaaattaaagcagcagtacttaaagcaaaaccagaaacatcaagtattgtaatctctagaagaaaacttatcgaagaatcgcaaaaaaataaagaagaaaaaatagcacaacttatggaaaacaatgagccaagaactggtatcgttaaaaaaatcacaagttatggtatgtttgttgatttaggtggaattgatggacttgttaactataatgaaattagctataaaggaccagtgaatccatcagcatactttaaagagggtgatgagattactgctgtaatgaaatcatacgataaagagaaaggtcacttatcattatcaattaaagatgcactagcaaatccttgggaagagatgagagatgctttagatgtaggtgatacaattactgttacagtttctaactttgaatcttatggtgcatttgttgatttaggaaatgatatcgaaggtttattacatatttcagaaatcagtcacaataaaaatgttaaaaatcccaaaagattactttag

SEQ ID NO: 16906 - protein, 251 aa, Unknown
  Obtained from environmental sample
  DOMAIN (117)...(189): S1 RNA binding domain
  misc_feature (1)..(251): Xaa is any amino acid
MIVGTRGENLSLSYKKVLQKAKFDEFFAKYGEEPEDVVVEGTVVSVKPRAGFVVQDDEGMEYFMPMAQGFLKAHGAVGKKIKAAVLKAKPETSSIVISRRKLIEESQKNKEEKIAQLMENNEPRTGIVKKITSYGMFVDLGGIDGLVNYNEISYKGPVNPSAYFKEGDEITAVMKSYDKEKGHLSLSIKDALANPWEEMRDALDVGDTITVTVSNFESYGAFVDLGNDIEGLLHISEISHNKNVKNPKRLL

SEQ ID NO: 16907 - DNA, 714 bp, Unknown
  Obtained from environmental sample
  misc_feature (1)..(714): n is a, c, g, or t
atgcccaacaagaatacagatcctctttttcagattattaaatcgcttaccaaagcagaaaaaaggtattttaaattacacgttaataaacaaacggctggcgaggatactaaatttttaaaattatttgatttaatcgataaacaaaaagattatgatgaatcaaaaattttagaaaaggaaaaatgtataaagagccagcaattatcgaatttaaaagctcatttatacaagcaagttcttcaaaacttacgaaacttaaattccgatgaagatatagatttacgcattcgtgaattaattgatcactctaccattttatacaacaaatgtctttacgatcagtgtgttaaaatgctcgataaagcaagaaacttagctgtaaaatacgataaaaatatactgatattaactattaccgaatttgaaaaaagacttgttacaaaatttataaaatcgaacattgaagataaagttagtatgctgattaaagcttctgatcaaatcaatgaaaaaattaaaaacattaatactttttcaaatcttactataaagctttattcattctatcttaaaatcggatttttaaggaatcataaggattttgaattggtaaatagtttcttgtattctacactgccagtttttcaggaagagcaactttcgttcgatgaaaaaatgtatttatacaatccttgtggatatatttcctga

SEQ ID NO: 16908 - protein, 237 aa, Unknown
  Obtained from environmental sample
  misc_feature (1)..(237): Xaa is any amino acid
MPNKNTDPLFQIIKSLTKAEKRYFKLHVNKQTAGEDTKFLKLFDLIDKQKDYDESKILEKEKCIKSQQLSNLKAHLYKQVLQNLRNLNSDEDIDLRIRELIDHSTILYNKCLYDQCVKMLDKARNLAVKYDKNILILTITEFEKRLVTKFIKSNIEDKVSMLIKASDQINEKIKNINTFSNLTIKLYSFYLKIGFLRNHKDFELVNSFLYSTLPVFQEEQLSFDEKMYLYNPCGYIS

SEQ ID NO: 16909 - DNA, 777 bp, Unknown
  Obtained from environmental sample
  misc_feature (1)..(777): n is a, c, g, or t
atggtattggcaagagagcttagtttaattcaagtaaaaagtattacagacggtattaaaaaagaaaatattacaggtccttcgggcaacttggtagaaatagaaatttttgcccacggagccttatgtatggctgtttcaggaaaatgttatttaagtttacacaccaataattcatctgccaacagaggtgcttgcgtacaaaattgccgtagaacttacgaagtaaaagatgaagaaggcaacgaattgttaattgacaatgaatacattatgtctccaaaagatttatgtaccattggctttattgatgatataattaatgctggcgtaaaagtattaaaaattgaaggtagaggaagagctcccgaatacgttaaaacagttacggaatgctaccgagaagctgccgatgcatacttagatggcacttattctaaagaaaaaattgaaggctggaaccaacgtttagcaacagtttataacagaggtttttgggatggttattatttaggccaggagttgggagaatggtcagaaggacatggttcgcaagcaactactagaaaaaaattcttaggtcaagggattaaatattttcctaaaattaatatcgctgaatttagaattgaaactcactcgttgagtgttggtgataaaattttaattaccggaccaacaacaggcgtaattgaaacaactgttaaagaacttcgagtagatgataaatctgttgaaaaaggggagaaaggagtaaacttttcctacccctattga

SEQ ID NO: 16910 - protein, 258 aa, Unknown
  Obtained from environmental sample
  DOMAIN (2)...(176): Peptidase family U32
  misc_feature (1)..(258): Xaa is any amino acid
MVLARELSLIQVKSITDGIKKENITGPSGNLVEIEIFAHGALCMAVSGKCYLSLHTNNSSANRGACVQNCRRTYEVKDEEGNELLIDNEYIMSPKDLCTIGFIDDIINAGVKVLKIEGRGRAPEYVKTVTECYREAADAYLDGTYSKEKIEGWNQRLATVYNRGFWDGYYLGQELGEWSEGHGSQATTRKKFLGQGIKYFPKINIAEFRIETHSLSVGDKILITGPTTGVIETTVKELRVDDKSVEKGEKGVNFSYPY

SEQ ID NO: 16911 - DNA, 426 bp, Unknown
  Obtained from environmental sample
  misc_feature (1)..(426): n is a, c, g, or t
atgtcggaaagagatattttgtataaagtattgttcgatttaaaagatgatgtgaatgagttgaaaaaattggtttttggaattattagcaatggaaacacaaaacaaccattggtttccgattctgaagaaaatacttctatgataaacagcataaaaagattatatgctaaaagtgatgatttagatacggaaaagcctttatctccagaagtatataaacctcaaattattactgcggatgatgatttttcagaacacgaagaagtagaggaagaatctttatctttggctgataaagaaaaagaaatgattgttaaagccttgagaaaacacaataataagcgaagaaaagcttctgaagagctgggtatttctgaaagaacactttacagaaaaattaaagaatacgatattaatgaataa

SEQ ID NO: 16912 - protein, 141 aa, Unknown
  Obtained from environmental sample
  DOMAIN (97)...(137): Bacterial regulatory protein, Fis family
  misc_feature (1)..(141): Xaa is any amino acid
MSERDILYKVLFDLKDDVNELKKLVFGIISNGNTKQPLVSDSEENTSMINSIKRLYAKSDDLDTEKPLSPEVYKPQIITADDDFSEHEEVEEESLSLADKEKEMIVKALRKHNNKRRKASEELGISERTLYRKIKEYDINE

SEQ ID NO: 16913 - DNA, 786 bp, Unknown
  Obtained from environmental sample
  misc_feature (1)..(786): n is a, c, g, or t
atgcaaaaaaactctattcaaatgctttctgaagagtttagaaattattttggttttaagaagaataattatacagagcatgattatgagaaaatgtctaattattctagtatttttgcaaatgaagttaataagatgttatctcattatatagataaacaaggtttaaaactaatagttaaaagttcagagaatgaaggttttactgaaactagtatttcaaatagattagcaactataaaatatttacctgatgtgcttaagtgtgaattggtatatttaacagcaatagatgatataagtatttttcctaataatgaaccaatagaagtaccaagtttaataacacataataaagaagtttcacatttttcttgtgtaaaacatactgataaaaatacaataaagtttttatctcctgtagaactattaaatcgtattttaaaatattatggttcttttgaattagaaaaaatagggataggtaaagatatagaatataaattacatagagaatttaaatttattgaattgtttgataagagagaacttgctggaacaattacaacaatatatttagagaagttcgatattaaaatacaacttacttttaatttgataaatgagaagagtgcagagataatcaaaagtataaaggaacagtgtacattagaaaatgataatttctttaaaaaaacaattgaagaaaagttggtatacatttttaatgaaacatattttgataatttaatgacggtatatgagtatattcaaaaattcatttga

SEQ ID NO: 16914 - protein, 261 aa, Unknown
  Obtained from environmental sample
  misc_feature (1)..(261): Xaa is any amino acid
MQKNSIQMLSEEFRNYFGFKKNNYTEHDYEKMSNYSSIFANEVNKMLSHYIDKQGLKLIVKSSENEGFTETSISNRLATIKYLPDVLKCELVYLTAIDDISIFPNNEPIEVPSLITHNKEVSHFSCVKHTDKNTIKFLSPVELLNRILKYYGSFELEKIGIGKDIEYKLHREFKFIELFDKRELAGTITTIYLEKFDIKIQLTFNLINEKSAEIIKSIKEQCTLENDNFFKKTIEEKLVYIFNETYFDNLMTVYEYIQKFI

SEQ ID NO: 16915 - DNA, 711 bp, Unknown
  Obtained from environmental sample
  misc_feature (1)..(711): n is a, c, g, or t
atggccgtttttgcctaccacttttatagactcattcagcgtgcagaaaacattacacttatctacaatggactttcggaaggattggggagtggtgagccaagtcgcttcataaagcagttggaatacgaattgccaaaggccaatcgcagagtaaagtttgaatatctcaacccgacttttgaggtgaagattgaagagaaaaatgctaccgatatttctaaaactccagccatcatggagcgattgaaggaaatggcggtgaagggtttttcagcaaccgctataaccgattatataaatgacccggtagagttttacaaaaagcgtgtgctgaatttgcaagaagctgatgaggtggaagaagtggcgggctatgacaagcagggaaatgtggtgcacaatattctggagcgcctgtattcggtgatggatggtgatgacattgtgaagtgcaaaagtgtgctaaaaccaagtgaccccgcttttgcgctaagcgaagaagaaatacgaagcttggtggtagatgaactgcgcaaagaagccaagcttgccgatttggacgttggtaaaaaccttctgattagagaaatattggtgggcatgctagtcaactttctccgtaaggaaaaagaagaactggaaatactggaagccaataaccaggtgctttccttgctgggattggagcttgacctgaattgccaatga

SEQ ID NO: 16916 - protein, 236 aa, Unknown
  Obtained from environmental sample
  misc_feature (1)..(236): Xaa is any amino acid
MAVFAYHFYRLIQRAENITLIYNGLSEGLGSGEPSRFIKQLEYELPKANRRVKFEYLNPTFEVKIEEKNATDISKTPAIMERLKEMAVKGFSATAITDYINDPVEFYKKRVLNLQEADEVEEVAGYDKQGNVVHNILERLYSVMDGDDIVKCKSVLKPSDPAFALSEEEIRSLVVDELRKEAKLADLDVGKNLLIREILVGMLVNFLRKEKEELEILEANNQVLSLLGLELDLNCQ

SEQ ID NO: 16917 - DNA, 321 bp, Unknown
  Obtained from environmental sample
  misc_feature (1)..(321): n is a, c, g, or t
ttggtaacaaacccatttataattaaagtaaatctgttggaagagctacataagtataaaccatattttgcagatgcacttagaatttatcgtaatcgtgctttagatcatntgagttgtgattatgagtcaaatagttcaaaaaaaacagcacagcttaagattactatagattcagattattgggaaagtgtatatgaagagattgtgaacatatcaaaatcaaatgtgaaaggagaagaagcattaaataaaataaatacaactgttttactaaacaacataatgagtaccttaattggtattgaacaatataattaa

SEQ ID NO: 16918 - protein, 106 aa, Unknown
  Obtained from environmental sample
  misc_feature (1)..(106): Xaa is any amino acid
MVTNPFIIKVNLLEELHKYKPYFADALRIYRNRALDHXSCDYESNSSKKTAQLKITIDSDYWESVYEEIVNISKSNVKGEEALNKINTTVLLNNIMSTLIGIEQYN

SEQ ID NO: 16919 - DNA, 804 bp, Unknown
  Obtained from environmental sample
  misc_feature (1)..(804): n is a, c, g, or t
gtgcttaatttgtctaaaatatatttaaagattttaaaaccaaaaacaagaccaatacaaatcgagccttggttttttagatatttaaatgagggacaattaaaagtattgagtgcaattttggctcatgctgattataaaaatagacaagataattcatttgcatcaaatagaactattgcattttatgcagggtttggaactataagaccaggttcaaaagaggaaaaggaatttttaaaattaagtgaagatgaacaaaaaaaacttaaagaaaaaaaacttaaaaatgcaattcaaacagctaaaaacactaaaacacaacttgaaaaattaggagtaattacacgagagatagttggagataaatcttatgcggttgtagatttagagtggagtaaagaaagatatttaaaagagtttgatgaatatttcaatgataaaaaagatacaaataaatcaaccgatgaagatataaaagtagaacttaaaaaactagcaaaattatcagaagatggaaatatatctaaagaaagtttagtaaaaagattagaagatgttacagataaattaattgataacaaatcaaataatgacaatacttcagtactaaatgaagatatagatttagttgtagagcatattattaatagtgataaaattaaatcaaaaataactactggagagattcctaaccctactgngtataaacgaaaaattaaaagattaattgaagaaaataaatataatggaatagaaaaatatattgaagatttgaaaaatattcaaatgtataatctttaa

SEQ ID NO: 16920 - protein, 267 aa, Unknown
  Obtained from environmental sample
  misc_feature (1)..(267): Xaa is any amino acid
MLNLSKIYLKILKPKTRPIQIEPWFFRYLNEGQLKVLSAILAHADYKNRQDNSFASNRTIAFYAGFGTIRPGSKEEKEFLKLSEDEQKKLKEKKLKNAIQTAKNTKTQLEKLGVITREIVGDKSYAVVDLEWSKERYLKEFDEYFNDKKDTNKSTDEDIKVELKKLAKLSEDGNISKESLVKRLEDVTDKLIDNKSNNDNTSVLNEDIDLVVEHIINSDKIKSKITTGEIPNPTXYKRKIKRLIEENKYNGIEKYIEDLKNIQMYNL

SEQ ID NO: 16921 - DNA, 648 bp, Unknown
  Obtained from environmental sample
  misc_feature (1)..(648): n is a, c, g, or t
atgacagaatggctgagactaaaccttacaggtatttttagagtccatgatgaaccttcatcttcaaaaataaaaaaacttcttgatgatgtaagtgcattaggtataaaagcacaactcaaagatgacatccatgcaacaattattagcattcaacaaaaagccgctaatgtagggctaggacaagaagtagatgatctcatcattcaagcacaacaacaagctagctatagtagtttaaaaagagaacattttggacttggatttaaagattattcacatttcacctcccctataagaagatatgcagacttagtacttcaccgtattttaaaaacaaataagataccacaaaatattgaagaggtatgtgaatatgtaagtacaaaagagcgagagattgcaactcttgtttgggattatgaggatagaaaatatgcaagatatttaagtaatcacatacacaaaacttttgaagctactttggtggatactgataatagtattgtaaaacttgataatgaggtaaaaggtgcaagagtttatatagataattacgcgggagaaaaactattctcaaaattacatatcaaaatagtaagtagtgatattatctctaaaaaaatcataggaactattcaaagataa

SEQ ID NO: 16922 - protein, 215 aa, Unknown
  Obtained from environmental sample
  misc_feature (1)..(215): Xaa is any amino acid
MTEWLRLNLTGIFRVHDEPSSSKIKKLLDDVSALGIKAQLKDDIHATIISIQQKAANVGLGQEVDDLIIQAQQQASYSSLKREHFGLGFKDYSHFTSPIRRYADLVLHRILKTNKIPQNIEEVCEYVSTKEREIATLVWDYEDRKYARYLSNHIHKTFEATLVDTDNSIVKLDNEVKGARVYIDNYAGEKLFSKLHIKIVSSDIISKKIIGTIQR

SEQ ID NO: 16923 - DNA, 522 bp, Unknown
  Obtained from environmental sample
  misc_feature (1)..(522): n is a, c, g, or t
atgtttaaaaatttatcaacaaaaactaagctgttaagttttccagtactcataattttagctatgctaattttaggggcagtgttttcttattataatagtttagtaaattcaagagttgctgcggcttcgcagactgatgtttttatacaacaagtattaaaagggagaatttctgtttaccaatttttaagaggaccaagtactcaaaaagcagataaagtaagagaagattttaaaatgcttgatacacaagtatctactttaaaacctcatttaagtttaaaagaaaatagagatatttgtgatgagatattatcactttctcaaaactatatcaaatattttgatgattttgcgcagttaaggataaatgattttgataatggaatagagaaagaatcaaaaaatgtctcttctattataggtaaaatggcaagtactggacttgttttagaaaaaaaactagcacttattaataaaagtgctatagagctaaaagaggatgctcaaagtgaataa

SEQ ID NO: 16924 - protein, 173 aa, Unknown
  Obtained from environmental sample
  misc_feature (1)..(173): Xaa is any amino acid
MFKNLSTKTKLLSFPVLIILAMLILGAVFSYYNSLVNSRVAAASQTDVFIQQVLKGRISVYQFLRGPSTQKADKVREDFKMLDTQVSTLKPHLSLKENRDICDEILSLSQNYIKYFDDFAQLRINDFDNGIEKESKNVSSIIGKMASTGLVLEKKLALINKSAIELKEDAQSE

SEQ ID NO: 16925 - DNA, 678 bp, Unknown
  Obtained from environmental sample
  misc_feature (1)..(678): n is a, c, g, or t
atgatacaaagtaacttttctattttatatgtagaggatgatgcaactttacgaagtatatatgtagaattattacaattacattttaaacatgtttatgaagctagtgatggaaaagaggctattgaaaaatattctctacatcaacctagtgttgtaatattagatataaatattccgaagataaatggtttgaaagttgctaaaattatacgggataaaaatccagatgttattctaatcatgttaactgcttattctgatacccaaaaacttctagaggcaatggagttaaaactaaccaagtatcttataaaacctataaaaacttttgaactagaaaatatactcaatcaaactatatcaatactcaaagaaaaagaaaaagatgaaaatatcctccctcttgagtgtaactattattgggacaaaaagaaaaagcaactttgcattacaaacaatcaccaaattaaacttacaaaaaaagagtatttacttgttgaactattttgtaccaataaacacaaaatattttctaatgaagatattttagactatatttgggacgaatgtgaagagaattataatcccaataagttacgaattatattctctaagctcaaagcaaaactctcttgncatcttttgattctatttataatggtggatataaattaa

SEQ ID NO: 16926 - protein, 225 aa, Unknown
  Obtained from environmental sample
  DOMAIN (154)...(218): Transcriptional regulatory protein, C terminal
  misc_feature (1)..(225): Xaa is any amino acid
MIQSNFSILYVEDDATLRSIYVELLQLHFKHVYEASDGKEAIEKYSLHQPSVVILDINIPKINGLKVAKIIRDKNPDVILIMLTAYSDTQKLLEAMELKLTKYLIKPIKTFELENILNQTISILKEKEKDENILPLECNYYWDKKKKQLCITNNHQIKLTKKEYLLVELFCTNKHKIFSNEDILDYIWDECEENYNPNKLRIIFSKLKAKLSXHLLILFIMVDIN

SEQ ID NO: 16927 - DNA, 369 bp, Unknown
  Obtained from environmental sample
  misc_feature (1)..(369): n is a, c, g, or t
ttgttcaagtttttnttctatatcatcaacggagatatcattgcgatccaattctcttgcacagttgtaaaactcactactgcgataattagcccgagtagtcgtcatgcgaaacacaataaaaataaatcgctctatccgcctgaaaataaaaatgcgtttatctttgtcttgctcatttttgagaatcgccataataagcggcctaaaatataccattccaatttgattaagcttgccaatccattgtttttcttcatcttcaatatcatcagccatatgtggatgaaaagaattgaaccaatgaacagaagactccttcaggctatttataaaatctcgaatttctgttggctggagctgtgctga

SEQ ID NO: 16928 - protein, 122 aa, Unknown
  Obtained from environmental sample
  misc_feature (1)..(122): Xaa is any amino acid
MFKFXFYIINGDIIAIQFSCTVVKLTTAIISPSSRHAKHNKNKSLYPPENKNAFIFVLLIFENRHNKRPKIYHSNLIKLANPLFFFIFNIISHMWMKRIEPMNRRLLQAIYKISNFCWLELC

SEQ ID NO: 16929 - DNA, 789 bp, Unknown
  Obtained from environmental sample
  misc_feature (1)..(789): n is a, c, g, or t
atgattaaaagtgatttatctgaccttggtgtagagtttgacacttttatcagtgaaaaatcactctacgacaaatgggatgaaacaaaagcagttcttgaatcaactggaagtatctacaataaagatggaaaagatttcatccgttcaactgatcatggagatgatagcgatagagttgttgtacgtgaaaatggcattccaacatatctagctggagatattatataccacaaacacaaatatgatagaaactatgataagtatatcaatatttggggtgcagatcaccatggatatatcaaaagggtaaaagctgctattgaatttcttgggaatgattcgagtaaactagagattattttatctcaaatggttgcactgcttcaaggtggacaaccatacaagatgagtaaacgagcgggaactgtaatcttaatgagtgatattgttgaggagattggtgcagatagtttacgatttgtatttttaacgaaaaanagtgatacacacctagagtttgatatagatttattaaaaaacaatgactcatcaaatccagttttttatatcaattatgctcacgcacgaatcaatcagttatttaaaaaagcagaacttactgtagaagatgtaaaagatgcctcaatagaaagtatcaatcaagatgccacagacttagtatatggagcacttctttttaggtactgttttaaaatgaaagcttttgataaaagagatatgcaaaaaaaccacagaaccatttacataagtttagccgccttccgt

SEQ ID NO: 16930 - protein, 263 aa, Unknown
  Obtained from environmental sample
  DOMAIN (1)...(176): tRNA synthetases class I (R)
  misc_feature (1)..(263): Xaa is any amino acid
MIKSDLSDLGVEFDTFISEKSLYDKWDETKAVLESTGSIYNKDGKDFIRSTDHGDDSDRVVVRENGIPTYLAGDIIYHKHKYDRNYDKYINIWGADHHGYIKRVKAAIEFLGNDSSKLEIILSQMVALLQGGQPYKMSKRAGTVILMSDIVEEIGADSLRFVFLTKXSDTHLEFDIDLLKNNDSSNPVFYINYAHARINQLFKKAELTVEDVKDASIESINQDATDLVYGALLFRYCFKMKAFDKRDMQKNHRTIYISLAAFR

SEQ ID NO: 16931 - DNA, 663 bp, Unknown
  Obtained from environmental sample
  misc_feature (1)..(663): n is a, c, g, or t
ttgcgcagaataccaggatatatcagggcgttacgcactcatattttaaacttgaataaaattttctccgaaaatgggtttgtaaaaactattgcatgtagcgaatatgtagctgatgaactaaagaaggagcctcctgggtctgttgttgttgtgaacaattttattgatcaaactaaattcgttagtaaatctgaactaagagttaaaaatagggttctggcattaccaagaaagaatattgatgatattaaggcagtaattaaattagttgacggaataggttacgaatttgtttttgctgacggattatctgaagcagatcttataaatgaatatcacaaagcagatatatttttagctagtggttatcctgaaggatttggtttacctccactggaagctatggcatgtggagctgtagtagtgggatttacaggtggtggtgccaatgaatttatgatacataaaaaaacatcacttgtagctacagatggtgatgttgaatcagtcgcggaatatttaattcaactattaaataatgatgaacttaaagaaagtattcgaaaacaaggtatcaacatatcaagtaaatacattgaagaaagaacggcagagcaacttgatggtttctttaaaaccttaaataaagagttgatatga

SEQ ID NO: 16932 - protein, 220 aa, Unknown
  Obtained from environmental sample
  DOMAIN (57)...(195): Glycosyl transferases group 1
  misc_feature (1)..(220): Xaa is any amino acid
MRRIPGYIRALRTHILNLNKIFSENGFVKTIACSEYVADELKKEPPGSVVVVNNFIDQTKFVSKSELRVKNRVLALPRKNIDDIKAVIKLVDGIGYEFVFADGLSEADLINEYHKADIFLASGYPEGFGLPPLEAMACGAVVVGFTGGGANEFMIHKKTSLVATDGDVESVAEYLIQLLNNDELKESIRKQGINISSKYIEERTAEQLDGFFKTLNKELI

SEQ ID NO: 16933 - DNA, 771 bp, Unknown
  Obtained from environmental sample
  misc_feature (1)..(771): n is a, c, g, or t
atgtctacattctcatcaaatcttcaccgtgtggcacaagctattcaatgtggacttgattatggaagaaaagtttgtgtaattggtagaagtatggaaaagaaccttgatattgcacttacattaggatatttaaaatttccaaaagataagtttatagatgctcatgaggtaaataaatatcttgataaagaggtacttatcattacaacaggaagccaaggtgagcctatgagtgctttatttagaatgtcaattcatgagcatagacatatcaagattaaacctgaggatactgtagtattatcagctaaagcaattcctggaaatgaagcaagtgtatctgagataatcaatcaaatacaaaaagcaggggcacatgttgcatatcaaaactatactgatattcatgtatctggacatgctgcacaagaggaacaaaaacttatgcttagacttctaaagccgaagtttttcttaccaattcatggtgaatacaaccatgtagtaagacatattcaaacaggtatagagtgtggagtattagagagaaacacttatattttaagtgatggagaacaggttgaaatatctcctaaatttcttaaaaaagtaaaaactgttaaaactggaaaaacatatattgataaccaaagaaatagaaaaattggtgatgatgttgttattgatagacaaactatggcaaacgagggtgttattatgattgtggcacaaataacagaaagtgatagaaaagttgtagtcctctga

SEQ ID NO: 16934 - protein, 256 aa, Unknown
  Obtained from environmental sample
  DOMAIN (127)...(167): RNA-metabolising metallo-beta-lactamase
  misc_feature (1)..(256): Xaa is any amino acid
MSTFSSNLHRVAQAIQCGLDYGRKVCVIGRSMEKNLDIALTLGYLKFPKDKFIDAHEVNKYLDKEVLIITTGSQGEPMSALFRMSIHEHRHIKIKPEDTVVLSAKAIPGNEASVSEIINQIQKAGAHVAYQNYTDIHVSGHAAQEEQKLMLRLLKPKFFLPIHGEYNHVVRHIQTGIECGVLERNTYILSDGEQVEISPKFLKKVKTVKTGKTYIDNQRNRKIGDDVVIDRQTMANEGVIMIVAQITESDRKVVVL

SEQ ID NO: 16935 - DNA, 429 bp, Unknown; identical to SEQ ID NO: 13745
  Obtained from environmental sample
  misc_feature (1)..(429): n is a, c, g, or t

SEQ ID NO: 16936 - protein, 142 aa, Unknown; identical to SEQ ID NO: 13746
  Obtained from environmental sample
  misc_feature (1)..(142): Xaa is any amino acid

SEQ ID NO: 16937 - DNA, 420 bp, Unknown
  Obtained from environmental sample
  misc_feature (1)..(420): n is a, c, g, or t
atgtctagaatatacgctgtaaattttgataaatcctttcctaaaattctcttcgataagaaagtaagtttagttttttcaacttatcaagcgggtagattaattgttttgggaagtttagatgggaatcatctacatcaaattccagttggattcaaaaaaccaatgggaattgctttatctgagaacaaattagctatagccagtttagacagcttgtattttttttcaaatcgtgagaacgttgtagatacgatccgtttaaatgataaaaactttgatactgtatatttacagcgggcaaaatatacgattagtacgttagacgttcatgatattgcgtttggaaaaggaatcttttggggtggaaacacccaggttctcttgccaaagggttttttgaaaataaccccattttaa

SEQ ID NO: 16938 - protein, 139 aa, Unknown
  Obtained from environmental sample
  misc_feature (1)..(139): Xaa is any amino acid
MSRIYAVNFDKSFPKILFDKKVSLVFSTYQAGRLIVLGSLDGNHLHQIPVGFKKPMGIALSENKLAIASLDSLYFFSNRENVVDTIRLNDKNFDTVYLQRAKYTISTLDVHDIAFGKGIFWGGNTQVLLPKGFLKITPF

SEQ ID NO: 16939 - DNA, 558 bp, Unknown
  Obtained from environmental sample
  misc_feature (1)..(558): n is a, c, g, or t
atgatagatgataaagttagatggaatgagaagtataaaacatatcccatggatcaaaatatttctaaaatagtaaaaaagtatgttaaaaaaggtgacggcttaaaagcacttgatatcgcctgtggaaaaggtagaaatactacccacatagcagagtgtggttatgtagtagatggtgtagatatttcagattttgcactctcttgcattagtgagcataaaaatataaacaaacaagagatagatctagacagttttataatcgagccaaatagttatgatctgatcgtaaatatcaactatctcgatagaagactgtttccatacataaaagcagcacttaaaagtggaggagttgttatttttgagacatatttggaagtgagtgatgataaagagtaccatcaaccctcaaacagagattttttacttcgctcaaatgaacttttaggtgcctttttgggactgcgtatcatctactatgaagagagagaagatataaatatacgtgatgagagagtaaaaattgcctctcttgttgcacaaaaaatatag

SEQ ID NO: 16940 - protein, 185 aa, Unknown
  Obtained from environmental sample
  DOMAIN (2)...(157): Tellurite resistance protein TehB
  misc_feature (1)..(185): Xaa is any amino acid
MIDDKVRWNEKYKTYPMDQNISKIVKKYVKKGDGLKALDIACGKGRNTTHIAECGYVVDGVDISDFALSCISEHKNINKQEIDLDSFIIEPNSYDLIVNINYLDRRLFPYIKAALKSGGVVIFETYLEVSDDKEYHQPSNRDFLLRSNELLGAFLGLRIIYYEEREDINIRDERVKIASLVAQKI

SEQ ID NO: 16941 - DNA, 345 bp, Unknown
  Obtained from environmental sample
  misc_feature (1)..(345): n is a, c, g, or t
atgatagatgataaagttagatggaatgagaagtataaaacatatcccatggatcaaaatatttctaaaatagtaaaaaagtatgttaaaaaaggtgacggcttaaaagcacttgatatcgcctgtggaaaaggtagaaatactacccacatagcagagtgtggttatgtagtagatggtgtagatatttcagattttgcactctcttgcattagtgagcataaaaatataaacaaacaagagatagatctagacagttttataatcgagccaaatagttatgatctgatcgtaaatatcaactatctcgatagaagactgtttccatacataaaagcagcacct

SEQ ID NO: 16942 - protein, 115 aa, Unknown
  Obtained from environmental sample
  misc_feature (1)..(115): Xaa is any amino acid
MIDDKVRWNEKYKTYPMDQNISKIVKKYVKKGDGLKALDIACGKGRNTTHIAECGYVVDGVDISDFALSCISEHKNINKQEIDLDSFIIEPNSYDLIVNINYLDRRLFPYIKAAP

SEQ ID NO: 16943 - DNA, 348 bp, Unknown
  Obtained from environmental sample
  misc_feature (1)..(348): n is a, c, g, or t
atgattaaacaatttataaattggattagaagtcttggttcaacgaaaactaaagatgttaaaaaagcatattttgaaattgaatattgtgatgacgaaccagatgttgtagataattataaaacatacttaatgggtagtaattataaatactggttggtgtcattaaaatgtccatgtggttgtaatgaagaaattcatttaaacctaataaaaagtagctacccttattgggatgttgtcattgagtcaaactctttaactataaaaccatctgtatggagaacaaaaggatgtaagagtcatttttttattgaaaaaggagtaattaaatggattgattattaa

SEQ ID NO: 16944 - protein, 115 aa, Unknown
  Obtained from environmental sample
  misc_feature (1)..(115): Xaa is any amino acid
MIKQFINWIRSLGSTKTKDVKKAYFEIEYCDDEPDVVDNYKTYLMGSNYKYWLVSLKCPCGCNEEIHLNLIKSSYPYWDVVIESNSLTIKPSVWRTKGCKSHFFIEKGVIKWIDY

SEQ ID NO: 16945 - DNA, 882 bp, Unknown
  Obtained from environmental sample
  misc_feature (1)..(882): n is a, c, g, or t
atgaacttcccgaatgctaaaggtggtttaaatattaacttaaatgcctttgatgaaacagagatgattaaaatattgtttagtgaaaacccgggtgtaatcattcaagtaaatcatgatggacataaaatagtttctgaattaggtaaaaaaggtattcatgcttcaattattggaagtatcacaaacgaaagaaaattaaatatacgtttaaaagaagctcaactttcgttagatattgatgaattaagagatgtttggtttaaaacttcttatcttttagatagcaatcaaacaaaaaaagagttagccaaacaacgttttgaaaactataaaaaagacttattagaattctccttccctactcattttactggcaaactagctgattatggcattactcacggaagaaaggaaagcacaggaattaaagctgctattattagagaaaaaggagtaaatggagatagagaaatggcttattctttatttctagcaggttttgatgttaaagacattcacatgacagacttgattgctggaaaagaagatttaagcgatgtaaacatgatagtttttgtgggaggtttctctaattcagatgtgttgggttctgcaaaaggttggacaggagcatttttatacaatccaaaagccaaagaagcgttggataatttctacaaaagagaagacacgctaagtttgggtgtttgtaatggctgtcagttaatgatggaattgggactaatttcctctaaaggaaaaacacaagcaatggctcataatgagtctggaaaatttgaatcgacttatttaaatgttgaaagttctaaaaaacactccattatgctttcaacacttagaaataatacgcctggaata

SEQ ID NO: 16946 - protein, 294 aa, Unknown
  Obtained from environmental sample
  misc_feature (1)..(294): Xaa is any amino acid
MNFPNAKGGLNINLNAFDETEMIKILFSENPGVIIQVNHDGHKIVSELGKKGIHASIIGSITNERKLNIRLKEAQLSLDIDELRDVWFKTSYLLDSNQTKKELAKQRFENYKKDLLEFSFPTHFTGKLADYGITHGRKESTGIKAAIIREKGVNGDREMAYSLFLAGFDVKDIHMTDLIAGKEDLSDVNMIVFVGGFSNSDVLGSAKGWTGAFLYNPKAKEALDNFYKREDTLSLGVCNGCQLMMELGLISSKGKTQAMAHNESGKFESTYLNVESSKKHSIMLSTLRNNTPGI

SEQ ID NO: 16947 - DNA, 462 bp, Unknown
  Obtained from environmental sample
  misc_feature (1)..(462): n is a, c, g, or t
atgaacctatctaaatccctctacacaaaaggcatccaatgccccaaagcactttggcttaaaaaatataagccaattgtactaacaccacctgatgaacaagcgcaagctgtatttgaaactggaaatatagtaggagatttagcttgccagctttttcctgatggtaaagaagtgccatacactaaaaactatgatgagatgatagctactacaaaagagtggatggaagagggtgtatcaaatatctacgaagctacttttaactatgagggtatacttatcatggtagatattctaaaagtagagagtgatggtgtatctatctatgaggttaaaagttctactgaggtaaaagatatctatcttcatgatgtatctattcagtattatgtgcttgaaaacttaggcttttgtataaaaagntgcaagtgtagtacatataaaccaatgagtatgtaa

SEQ ID NO: 16948 - protein, 153 aa, Unknown
  Obtained from environmental sample
  misc_feature (1)..(153): Xaa is any amino acid
MNLSKSLYTKGIQCPKALWLKKYKPIVLTPPDEQAQAVFETGNIVGDLACQLFPDGKEVPYTKNYDEMIATTKEWMEEGVSNIYEATFNYEGILIMVDILKVESDGVSIYEVKSSTEVKDIYLHDVSIQYYVLENLGFCIKXCKCSTYKPMSM

SEQ ID NO: 16949 - DNA, 393 bp, Unknown
  Obtained from environmental sample
  misc_feature (1)..(393): n is a, c, g, or t
ttggaaaaagaaaaagagatttttgagaaacatgaaaaaggtcactttttacataaaattgaatatattgatgaaaaagaaaatacttatttaatcgtgtatgatcaagatggatgtggtcataatttacaacctttagttaaaaaatggaaagaaaactcaaataaatatgttttagattatgtatatgattcatatcccattgaaaaaaatcatttacttaataatttaaaattaattggaaatcaaatattttttaatatttatgatgtagatgctgaatataatgatattaacgaaataataaaaatctcaaataataaagaaaaaagtttttataaactgaatgaaaactatgttgtaaatgatttagtagaacttaatttggaataa

SEQ ID NO: 16950 - protein, 130 aa, Unknown
  Obtained from environmental sample
  misc_feature (1)..(130): Xaa is any amino acid
MEKEKEIFEKHEKGHFLHKIEYIDEKENTYLIVYDQDGCGHNLQPLVKKWKENSNKYVLDYVYDSYPIEKNHLLNNLKLIGNQIFFNIYDVDAEYNDINEIIKISNNKEKSFYKLNENYVVNDLVELNLE

SEQ ID NO: 16951 - DNA, 726 bp, Unknown
  Obtained from environmental sample
  misc_feature (1)..(726): n is a, c, g, or t
gtgtataaagttaaaaatctagtagaagaaattgtatatgatttaaatctaataaagttaaatataaaatcttttagtaaattagatttatatgatttaaataaatattcagaagattttttttgtaagttattaaatataattaatgacttacacttaaaaaacttaaatatagaagatagaaacattgttgcaattgatttaggggatttagaacaaggtatatgttatcaaataactagtacaagtgaaaatactaaaataaagaataccattcaaaagtttgaagagtataaactttatcatacttataaaaaactatttattttaatactaaatgataaaaaaaactataaaactgcttttcaaacaaacggaaagtatcaatttaaaaatgatcatatacttgatttaaatgatttaattaaaattataaaatctttagataatgaaaaagtattaaatatatatgaatttattaaaaaaaatatatgtatttttcaatcacttagtttgaaaaataacaaaaatggattaagaacagatattagtaatatattattagatataaaagaagatgcaattgaaaagtatagtataaaggaagagttagttaaaggtattttagactatcttaagtcaaaaacttatggtaactatgagatatctaaagaaaacttgagatctatttataatattaacttactttttttcatcaatatctga

SEQ ID NO: 16952 - protein, 241 aa, Unknown
  Obtained from environmental sample
  misc_feature (1)..(241): Xaa is any amino acid
MYKVKNLVEEIVYDLNLIKLNIKSFSKLDLYDLNKYSEDFFCKLLNIINDLHLKNLNIEDRNIVAIDLGDLEQGICYQITSTSENTKIKNTIQKFEEYKLYHTYKKLFILILNDKKNYKTAFQTNGKYQFKNDHILDLNDLIKIIKSLDNEKVLNIYEFIKKNICIFQSLSLKNNKNGLRTDISNILLDIKEDAIEKYSIKEELVKGILDYLKSKTYGNYEISKENLRSIYNINLLFFINI

SEQ ID NO: 16953 - DNA, 633 bp, Unknown
  Obtained from environmental sample
  misc_feature (1)..(633): n is a, c, g, or t
atgtttaggacggtttttcttctgtacccttacgaaaatattgtatttttgaatactatgaaaaaagtactgacatttttagtagttgtaactctactgatttcgtgtaataaaaataatccggttgtaattattgaaactgattttggagtaattgaggttgagctttataaaaataaggctccaataacatcagataactttattaaatatattcaggaaaacagaaatgaaggagctaccttttacagagttgtaaagcaagataatcagccaaaaagcaaggttaagattgaagttattcaaggtggtttgtatgaagataatcaccctcaaaatttagctccaattgttcatgaaagcactaaactaactggaattaagcatcttgatggtgttatttcaatggcgcgatatgagcccggaactgcaactttcgaattttttatttgtgtgggtgatcagccatcgcttgattttggtggtagtgaatataaagataataatggatttgccgcttttggaaaggttataaagggaatggatgtggtttgggaaatacaaagacaaccagaaaaagatcaatatctaactcccagaattccgattactagtatggagattataccttaa

SEQ ID NO: 16954 - protein, 210 aa, Unknown
  Obtained from environmental sample
  DOMAIN (42)...(209): Cyclophilin type peptidyl-prolyl cis-trans isomerase
  misc_feature (1)..(210): Xaa is any amino acid
MFRTVFLLYPYENIVFLNTMKKVLTFLVVVTLLISCNKNNPVVIIETDFGVIEVELYKNKAPITSDNFIKYIQENRNEGATFYRVVKQDNQPKSKVKIEVIQGGLYEDNHPQNLAPIVHESTKLTGIKHLDGVISMARYEPGTATFEFFICVGDQPSLDFGGSEYKDNNGFAAFGKVIKGMDVVWEIQRQPEKDQYLTPRIPITSMEIIP

SEQ ID NO: 16955 - DNA, 351 bp, Unknown
  Obtained from environmental sample
  misc_feature (1)..(351): n is a, c, g, or t
gtggttcatccaagaaattttgaagcagttattttggcttggaatttatctttaacacctgatgctagatctatttggcatagcaatagtaataaaaaaggtggatttaattttgtgggatatcaaaatagtgaagtagataaacttatagaacaagcagaaagaaccatagataaaaaagagtttggcaagatttataaaaaaatttataaatatataagtgatgatttaccatatctttttttatttgtacctaatagcattacaagtgttaataaaaatataaaaaatgtaacaccagcacttataggtattacacataatcaagaggagtggataaaaagtgaataa

SEQ ID NO: 16956 - protein, 116 aa, Unknown
  Obtained from environmental sample
  misc_feature (1)..(116): Xaa is any amino acid
MVHPRNFEAVILAWNLSLTPDARSIWHSNSNKKGGFNFVGYQNSEVDKLIEQAERTIDKKEFGKIYKKIYKYISDDLPYLFLFVPNSITSVNKNIKNVTPALIGITHNQEEWIKSE

SEQ ID NO: 16957 - DNA, 471 bp, Unknown
  Obtained from environmental sample
  misc_feature (1)..(471): n is a, c, g, or t
gtgaataacaaaaagataacaatactatttgatttagatggtactttaatagatagtacagaagcaatattagaatcatttcattatgcttttagaaaacaaggttttaattttagtggagatgatgaggagataaaaagtcatatagggtatccattggatattatgtttgctaatttaggagttgaacaaagtagagttatggattttgtagagagttataaagaaaattatagagaaatttcagaagagaagacaattttactagaatctgcaaaggaatcagtccaagaagcagcaaaatttgcaagacttggagtggttactacaaaaactacacaatatagtataccattgttaaaaaatttgggtgtttttgaatattttgagacaataattggtcgtcaagaggtgaaaaatccaaaacctgacccagaacccgatcaagttgcactaaaaacatgggaataa

SEQ ID NO: 16958 - protein, 156 aa, Unknown
  Obtained from environmental sample
  misc_feature (1)..(156): Xaa is any amino acid
MNNKKITILFDLDGTLIDSTEAILESFHYAFRKQGFNFSGDDEEIKSHIGYPLDIMFANLGVEQSRVMDFVESYKENYREISEEKTILLESAKESVQEAAKFARLGVVTTKTTQYSIPLLKNLGVFEYFETIIGRQEVKNPKPDPEPDQVALKTWE

SEQ ID NO: 16959 - DNA, 384 bp, Unknown
  Obtained from environmental sample
  misc_feature (1)..(384): n is a, c, g, or t
atgaaagatatatgtgtccaaaactttgtatttgttatagatccaggattagctttttcagataatataactgaggattgtgatgaaaatacaaaatatattattacaacacatcttgacaaaaatgaattaatatcacttatccctgcacttcaggggaaagaagatagtgtttatacattagattgtttaaaaatagcacaagagacaattggtagaccaataccaaatacaccggtacttggtgcatttatgaaaattagtggaatgttccctattgaagactttaaactagcaatgaaaaaagtacttaaaaaacttcctgaaaaaattattgatgcaaatatgttggctattcagcgagcatatgatgaagtgaaatag

SEQ ID NO: 16960 - protein, 127 aa, Unknown
  Obtained from environmental sample
  DOMAIN (1)...(124): Pyruvate ferredoxin/flavodoxin oxidoreductase
  misc_feature (1)..(127): Xaa is any amino acid
MKDICVQNFVFVIDPGLAFSDNITEDCDENTKYIITTHLDKNELISLIPALQGKEDSVYTLDCLKIAQETIGRPIPNTPVLGAFMKISGMFPIEDFKLAMKKVLKKLPEKIIDANMLAIQRAYDEVK

SEQ ID NO: 16961 - DNA, 828 bp, Unknown
  Obtained from environmental sample
  misc_feature (1)..(828): n is a, c, g, or t
atgaaggaagataaaattgcgtttatcaatcaaatatttgaggataacactgatttaaagagttattatgcgacagatgaagattgtcgattgcaaagtgataaggggaaaatacgacctggatacaatccacagactgcagttgacgatgaaaacaaacttatagtggttgctgatgtaacaaatgaacaaaatgataaaaagcagttaactcccatgatagcgcaggtaaagaaacagaaagaaggactatgtatagaagataaaacaacaggaattgctgatgcaggttatttttctgaaaaggaaataataaataataaggatgatgaagatttttcgatagttgtttctccctccgcagaagaacgtactactgtagccagtaaaaatggaaaaggaaataaaattcctggagccggatatgaggctgataattttgtctatgatgaggaaaaagatgtttatatctgtccagaaaacaaagaactcaaaaagataacaaaaacttcaattacagatcgtcatggtagaaaagcaaataagtatcgatgtgattctgatgtttgctcagtatgtccgaaaagaggagtgtgtacgaaaagtaaaaatgggagaatgttattggtttcagtaaatcagaaagagattcttaactacattaaaagtttgaaggataagaaaaacagtagttttataagcaaacgcaaagagattgtggagcatccttttggtactattaaacgttcttttcgctatacgtattttcttttgaagggaatagaaaaagtaaaaggagaattcagtttgatatgttttacatcataa

SEQ ID NO: 16962 - protein, 275 aa, Unknown
  Obtained from environmental sample
  misc_feature (1)..(275): Xaa is any amino acid
MKEDKIAFINQIFEDNTDLKSYYATDEDCRLQSDKGKIRPGYNPQTAVDDENKLIVVADVTNEQNDKKQLTPMIAQVKKQKEGLCIEDKTTGIADAGYFSEKEIINNKDDEDFSIVVSPSAEERTTVASKNGKGNKIPGAGYEADNFVYDEEKDVYICPENKELKKITKTSITDRHGRKANKYRCDSDVCSVCPKRGVCTKSKNGRMLLVSVNQKEILNYIKSLKDKKNSSFISKRKEIVEHPFGTIKRSFRYTYFLLKGIEKVKGEFSLICFTS

SEQ ID NO: 16963 - DNA, 528 bp, Unknown
  Obtained from environmental sample
  misc_feature (1)..(528): n is a, c, g, or t
ttgtctcttagaatagatacaattagaaacaaacctgaaaattcaatatcacctacagaatcagttccagaactcaagccatggattgcaaaaaggcaaagcatgatgatgatgatgatcaaaaagcgtgggcttcagttaagtcttaaaaatcgggtatacctggtcaatgccattctggtgtgcatcaccctgatcggggccatgctcatgatctggtatacctataaaactgaaaaaatattcagggaaatcattgatcgaaatgttgtgatttttcaatctgccgaagccctttccacctcccttgtcaatcaaaagggctttatctcctattatctgctggatggagacccggcctggattgatgatctgaaacaatacatgtccctttttgagaaacacctggcaacggtgaggtccctggttcaggagaaatgggaaagggatgccgtggccccgaattcatccaaatatgactatggcgtcatgaccaaaaacaaggggctggagctcctcgatgctggt

SEQ ID NO: 16964 - protein, 176 aa, Unknown
  Obtained from environmental sample
  misc_feature (1)..(176): Xaa is any amino acid
MSLRIDTIRNKPENSISPTESVPELKPWIAKRQSMMMMMIKKRGLQLSLKNRVYLVNAILVCITLIGAMLMIWYTYKTEKIFREIIDRNVVIFQSAEALSTSLVNQKGFISYYLLDGDPAWIDDLKQYMSLFEKHLATVRSLVQEKWERDAVAPNSSKYDYGVMTKNKGLELLDAG

SEQ ID NO: 16965 - DNA, 300 bp, Unknown
  Obtained from environmental sample
  misc_feature (1)..(300): n is a, c, g, or t
atgaaacaaatagatcctaatcaccattctggacaaatattaaataatatagacttagatacaacttttaagtatggatttttaaaaaaaagtcttgtaagagttgcatcttggtatatgggaaaaaagacaaaattttttttagattttcaatatactcaagaatcaatcatcccaccaaaatccaataaaaataaaaaatatcttttatatctccacatccctttttgtaagacattgtgtccttattgctcttttcataagtttaaattgaagaggaaaaagcaagagagtacttaa

SEQ ID NO: 16966 - protein, 99 aa, Unknown
  Obtained from environmental sample
  misc_feature (1)..(99): Xaa is any amino acid
MKQIDPNHHSGQILNNIDLDTTFKYGFLKKSLVRVASWYMGKKTKFFLDFQYTQESIIPPKSNKNKKYLLYLHIPFCKTLCPYCSFHKFKLKRKKQEST

SEQ ID NO: 16967 - DNA, 765 bp, Unknown
  Obtained from environmental sample
  misc_feature (1)..(765): n is a, c, g, or t
atgaaaccaacaaaattattattcgggcttttcatcttgatttttacatttaccacaagctgtcagaaagaaaatgatttcatggaaaaccctatttatcagagtaatgcaaaactgaaacgtattctaggatattctactattgattcagacaaaccaataagtatcgttgaagaatatgaatatgatgaaaaaggaagaatcaataaagtttcttctccaatgtatcaggacggagaaattgtgggtaccataaagtatgatttatatgagtacaattcgcaaggacaattaataaaaattgaaaattataattcgaatagcaactctcccactggatttatcaatctgaagaattatatatacacatattcggaagatggtaaaatcgaaaaagttgaagtctctaatgaatattccctttacaaatacagtaaaaacaaattatcaagaattgaaaactttggaaatactgatgaattggaaagatatacggtatatgactataataactcaggaaacttagttagagaaactgcttatggagcagacaatcaaccttattcgtacacacaacattcgtatgaaaaaggactaaacattcaatcagatatttttggtggagagggtatgaaaatacatgcacgtngaatatttaaaacctacgatgaaaataataatttaatcattaaagaatccaatgaactattatcatatagctcatcgctaagtttatgtttacgatatgaatattttggagaataa

SEQ ID NO: 16968 - protein, 254 aa, Unknown
  Obtained from environmental sample
  SIGNAL (1)...(20)
  misc_feature (1)..(254): Xaa is any amino acid
MKPTKLLFGLFILIFTFTTSCQKENDFMENPIYQSNAKLKRILGYSTIDSDKPISIVEEYEYDEKGRINKVSSPMYQDGEIVGTIKYDLYEYNSQGQLIKIENYNSNSNSPTGFINLKNYIYTYSEDGKIEKVEVSNEYSLYKYSKNKLSRIENFGNTDELERYTVYDYNNSGNLVRETAYGADNQPYSYTQHSYEKGLNIQSDIFGGEGMKIHARXIFKTYDENNNLIIKESNELLSYSSSLSLCLRYEYFGE

SEQ ID NO: 16969 - DNA, 444 bp, Unknown
  Obtained from environmental sample
  misc_feature (1)..(444): n is a, c, g, or t
atgagttttaacgctgaaaacctaaaaaagatagatgagttaaaaacaagatatccaaaacctcaggcactctctctgcctctgctttggatgtcgcagtatcaagatggatttatttcacttgaagccataaaagagattgcagaacattgtgaagttccacccatggagatctacaaggttgctactttttacactatgtttaatcttgaaaaagttggaaagtatcatattcagctctgtaaaacactctcatgtaaactaaactcaaaagatgagatactgagctccataaaagagatgctaaacattgaggtaggcaacacaacggatgataatctcttcactctcaatcaagttgagtgtttaggctcatgtgggagcgcacctgtcatgcagataaatgatatctactatgagaatctcacgccacacaaagtagaa

SEQ ID NO: 16970 - protein, 148 aa, Unknown
  Obtained from environmental sample
  DOMAIN (1)...(148): Respiratory-chain NADH dehydrogenase 24 Kd subunit
  misc_feature (1)..(148): Xaa is any amino acid
MSFNAENLKKIDELKTRYPKPQALSLPLLWMSQYQDGFISLEAIKEIAEHCEVPPMEIYKVATFYTMFNLEKVGKYHIQLCKTLSCKLNSKDEILSSIKEMLNIEVGNTTDDNLFTLNQVECLGSCGSAPVMQINDIYYENLTPHKVE

SEQ ID NO: 16971 - DNA, 300 bp, Unknown; identical to SEQ ID NO: 16629
  Obtained from environmental sample
  misc_feature (1)..(300): n is a, c, g, or t

SEQ ID NO: 16972 - protein, 99 aa, Unknown; identical to SEQ ID NO: 16630
  Obtained from environmental sample
  misc_feature (1)..(99): Xaa is any amino acid

SEQ ID NO: 16973 - DNA, 513 bp, Unknown
  Obtained from environmental sample
  misc_feature (1)..(513): n is a, c, g, or t
atgatcgcttggattaggttttttggtttcgatgagataaccaaaaatctacaaactacaaatatcacaaatcacaacttcaaagcagaagtgaaaaaaaaccttacaaatatctatgcaaaaccgttaacatatatgaatgacagtggaagttcaattataaatatcgtagagtattataatattgaaaatagcaatgttataatagtacacgatgatttagatttgccatttggtacagttaagtttaaattagggggtggacatggtggacataatggacttcgttcaattgattcacatatagggaaagattatttacgagtaagaattggtataggaaaacccgtagaaaaaaatgatgtagcaaattatgtattgtcaaatttcacaaaagaggaactaaaagcattagaggatataatatctcatactattaaagcaatagagtctctaaagacactatcacttgaagaggttaaatcaaaatacacaataaaagctgatatatga

SEQ ID NO: 16974 - protein, 170 aa, Unknown
  Obtained from environmental sample
  DOMAIN (9)...(165): Peptidyl-tRNA hydrolase
  misc_feature (1)..(170): Xaa is any amino acid
MIAWIRFFGFDEITKNLQTTNITNHNFKAEVKKNLTNIYAKPLTYMNDSGSSIINIVEYYNIENSNVIIVHDDLDLPFGTVKFKLGGGHGGHNGLRSIDSHIGKDYLRVRIGIGKPVEKNDVANYVLSNFTKEELKALEDIISHTIKAIESLKTLSLEEVKSKYTIKADI

SEQ ID NO: 16975 - DNA, 660 bp, Unknown
  Obtained from environmental sample
  misc_feature (1)..(660): n is a, c, g, or t
gtgatggaaaaatcaaatatctttttaaaatataatgactattttatctactttaaaaagctctatcctttagaaaaaaaggctgaagatatccatatttttaaaactaaaaaccatgatattgttgaaatcatagtagcaaaaaaagcatactttcaaaataatagatggtatgtaatagatacaaaaattacaaaaaaaccagaagttattaactggagtcaatcaaaaataactacaactaatgaaaagtttttatacacactagaaggttttgaaccaaaaattataaacaatgtatataaaggagaaacacaattttccattatagatgcagtaagaaccatactactacttgagaatcaagactttaatacaaataagataaaaactatactttattctcaaatctttatgcctttttttgttatacctttgattgtaataatatttttatttacaaatcctagtagtagatttttcaatactgctgcttttacctctgtaacaatttttactacactgataacttggggagtgttatttttacttcaaaagcttgcatatggaggaatagttttaggtgaatttgctataataatgccattggttatcttatttgttataacctattatatttataataaaaaagtcatataa

SEQ ID NO: 16976 - protein, 219 aa, Unknown
  Obtained from environmental sample
  misc_feature (1)..(219): Xaa is any amino acid
MMEKSNIFLKYNDYFIYFKKLYPLEKKAEDIHIFKTKNHDIVEIIVAKKAYFQNNRWYVIDTKITKKPEVINWSQSKITTTNEKFLYTLEGFEPKIINNVYKGETQFSIIDAVRTILLLENQDFNTNKIKTILYSQIFMPFFVIPLIVIIFLFTNPSSRFFNTAAFTSVTIFTTLITWGVLFLLQKLAYGGIVLGEFAIIMPLVILFVITYYIYNKKVI

SEQ ID NO: 16977 - DNA, 402 bp, Unknown
  Obtained from environmental sample
  misc_feature (1)..(402): n is a, c, g, or t
ttgcctgagtcatactcccaaaaagatgagatattgaaaaaaatcatgaaaaatcaagatgtagaagttttattatttatagaaaatacctatgcttcagagcttcgtatctattaccatatgtatgatcctttcgatgataaatattatgatagagcaagattgcatttaagggttagattattaaaaatagatagtgatgaaaaactacaagaaatttctagtgtagtttatgctcaaaatgagtttgacttaaaagataatggaaaaaaacttgagtcaaatgaagataaagagtatgtgagaaagactctgttacaaaagttagaacctattttaaaaaaagcagtattaaaaagaactctcaaagctctagaaattattcaagttgttgataattga

SEQ ID NO: 16978 - protein, 133 aa, Unknown
  Obtained from environmental sample
  misc_feature (1)..(133): Xaa is any amino acid
MPESYSQKDEILKKIMKNQDVEVLLFIENTYASELRIYYHMYDPFDDKYYDRARLHLRVRLLKIDSDEKLQEISSVVYAQNEFDLKDNGKKLESNEDKEYVRKTLLQKLEPILKKAVLKRTLKALEIIQVVDN

SEQ ID NO: 16979 - DNA, 765 bp, Unknown
  Obtained from environmental sample
  misc_feature (1)..(765): n is a, c, g, or t
gtggatgcacttcttgtttgtattgaaaatattcaaactataataaataactcaaatataacatatactcttgatgatccagtgtatgaaatacttttagaattaaaagatactgaaaaaacagttgaacttataaattcctatcaaggattaactataatccaagagggatatataaaagatataaatagtaaaacaattactattgagacaacaaatactcaatatcatttgataaaaggggaaaaaagaactataattgttattgataatatagcaataagagcaaatctacaatatgttgataaagaaaaccgacagttggttttaaaaaaatttgaaactcttgatagaacaccaaaagatagaaaagtttcacgagttataccagctaaggactttaccctttcaagatattataaatgtgaaacttttagttatgatgtgctttcgttatcaattaattcaatttcagtaaaaacttcagcacttgataaaagtttcagtgataattcccatgcagatttgattttaggttttcaagttgggtattctaaacacaataacacttcccatagagaaaatttattaaaacctgtaaaaatacgatctaaatctttaatatataaaatagataaacttgtagatggtagtacaaaaatcgtatttgttcttgacttaacggcagaggggaaaaaattacttgaacagtatattattcaaagagagattgatattttaaataaactacaagagatagcttaa

SEQ ID NO: 16980 - protein, 254 aa, Unknown
  Obtained from environmental sample
  misc_feature (1)..(254): Xaa is any amino acid
MDALLVCIENIQTIINNSNITYTLDDPVYEILLELKDTEKTVELINSYQGLTIIQEGYIKDINSKTITIETTNTQYHLIKGEKRTIIVIDNIAIRANLQYVDKENRQLVLKKFETLDRTPKDRKVSRVIPAKDFTLSRYYKCETFSYDVLSLSINSISVKTSALDKSFSDNSHADLILGFQVGYSKHNNTSHRENLLKPVKIRSKSLIYKIDKLVDGSTKIVFVLDLTAEGKKLLEQYIIQREIDILNKLQEIA

SEQ ID NO: 16981 - DNA, 489 bp, Unknown
  Obtained from environmental sample
  misc_feature (1)..(489): n is a, c, g, or t
atggagtacttgctaagtattgataagaactatatgagtaaaattgataaaaatgataggtatagaatggaaaaagcattggaaattatttatgagacagatttatctcctagtgagttttttcaacaaaacaagccagaacctactataaaagatttacaaatttttcaaatagatacggaagttgagcttttaagaaaaaggataactcaaagaacaaaatcgatgatagaaaaaggaattatagatgaggtgatatatttagaaaaaaaatatacaagagcaccaaattgtatgaaatctataggaattatcgaggtgttagaatatctagatgggaaaatagataaaacaaaacttgaagagcttatctctatacatacagcacaactagctaaaaggcaaagaacttttaacaaatcacaattcacaaatatcacaaaagataacctagaaaatttagaaaatcttatcctaaaagcattttag

SEQ ID NO: 16982 - protein, 162 aa, Unknown
  Obtained from environmental sample
  DOMAIN (1)...(149): IPP transferase
  misc_feature (1)..(162): Xaa is any amino acid
MEYLLSIDKNYMSKIDKNDRYRMEKALEIIYETDLSPSEFFQQNKPEPTIKDLQIFQIDTEVELLRKRITQRTKSMIEKGIIDEVIYLEKKYTRAPNCMKSIGIIEVLEYLDGKIDKTKLEELISIHTAQLAKRQRTFNKSQFTNITKDNLENLENLILKAF

SEQ ID NO: 16983 - DNA, 495 bp, Unknown
  Obtained from environmental sample
  misc_feature (1)..(495): n is a, c, g, or t
gtgataaaacacttatgggttaaagcaagcctcagcctgtttatttttatttttttaccaaacgcgcacgcaatcgaatgcaatgccgaatcacccaacctgaaaaaacagggtgaggcatactatgacatcaagagccccgcccctttaacccatagccagaaaactaaaatagcccgcttattctcccggctcaacggtgaacagcttgaaggcaagggcacttttacggaatgcactggacctgaacgtatcgccagaaaacagagccgagatgaaacaatcaaaggcgaggccagcaaagactctaccggtgaaattactttcagactggaagcgtatcanatcgacaaaaaaaccacccggctcgaaacactccgctatttcggcaatctgaacccgcaccacatcagcgagctcgcgagcaacaagctggtcgtttatttaaaactgagaaagaaatatatatttgttgaggagaaagcggatttaatt

SEQ ID NO: 16984 - protein, 165 aa, Unknown
  Obtained from environmental sample
  misc_feature (1)..(165): Xaa is any amino acid
MIKHLWVKASLSLFIFIFLPNAHAIECNAESPNLKKQGEAYYDIKSPAPLTHSQKTKIARLFSRLNGEQLEGKGTFTECTGPERIARKQSRDETIKGEASKDSTGEITFRLEAYXIDKKTTRLETLRYFGNLNPHHISELASNKLVVYLKLRKKYIFVEEKADLI

SEQ ID NO: 16985 - DNA, 621 bp, Unknown
  Obtained from environmental sample
  misc_feature (1)..(621): n is a, c, g, or t
atgattgatattctgaaaaaacggggacataatatcctctctgctccacgccttttaacntcagataacaaagaagccacnatagttgtgggctccaatgttcctattatcacagagcgtttgaccgacagcagtagcctttctcaatccgtttcagtagagcgtaaagatgttgctctgacgttacgctttacccctcagataatcgaagataatctggttaagctagatattttccaggaaattacagaccttgcagcgacgagtgttggtgacgttgaccaagttggccccaccttgacgaagagactcatccagaacactattctggcacagagtcagcacacggttgttctcggaggtcttatcggcacaaattctcaggaaactgtgtcaaaagttccatttttgggagatatccctggcttgggctggttgttcaagcacaaaagcataaccgagcagaaaaccaatttactcattttcatcactccaagcatcattaactccccggaggatctgctcgctattacgtcaaaaaataaaaactcagcaaaacaatttgtgccagaaaaattacaagatacattctctaagcaagtattagatagcgacaaataa

SEQ ID NO: 16986 - protein, 206 aa, Unknown
  Obtained from environmental sample
  DOMAIN (1)...(169): Bacterial type II and III secretion system protein
  misc_feature (1)..(206): Xaa is any amino acid
MIDILKKRGHNILSAPRLLTSDNKEATIVVGSNVPIITERLTDSSSLSQSVSVERKDVALTLRFTPQIIEDNLVKLDIFQEITDLAATSVGDVDQVGPTLTKRLIQNTILAQSQHTVVLGGLIGTNSQETVSKVPFLGDIPGLGWLFKHKSITEQKTNLLIFITPSIINSPEDLLAITSKNKNSAKQFVPEKLQDTFSKQVLDSDK

SEQ ID NO: 16987 - DNA, 783 bp, Unknown
  Obtained from environmental sample
  misc_feature (1)..(783): n is a, c, g, or t
atgaatgtcaaattttcaatttcctcaaaccttaaagacttcgtaaaacttgataaaatatctatgatgattacaccagaaactttttcaaatttaaaagttacaatatatggaacaccagaaataggaaattatgaaggagtaataatattgtcaggagatttaaatcaagaaattccaataaaaataaaaataattgacaaacaattttcagtagaagtattattgatggatgtaagtgtttttcaagaagtagtaagaacaaattcaaaattaaaatacaaattgaatttacagaatttattaagaaatcaagattataaaatatttctcacaacaagggtaaaaaatttaataggaaatgaaacttattttaaagaggaatataacgtgaatatggatagtgcgacatccttatttaaagaagcaacaattccagaaaatcttaccaccggagattatatactagaaataacagctaaatatcttaatagaatttctacatccacaacaccctttgtaatatcaaaaccaatttatatgtattcttttttcggtgtaccactttggattatgtcagtaattgtatcttttctgtctttcgtgggattaaacttattcgcatacaaaagatattccgatcgtaaaaaaagatataaaatatctgtagattacaccacattaccacaaccaggaaaaagggtagtaagactaggacatattgcagaaacaaaaaaacctgcatattatgagctggatagattaacaacgcagcgattctga

SEQ ID NO: 16988 - protein, 260 aa, Unknown
  Obtained from environmental sample
  misc_feature (1)..(260): Xaa is any amino acid
MNVKFSISSNLKDFVKLDKISMMITPETFSNLKVTIYGTPEIGNYEGVIILSGDLNQEIPIKIKIIDKQFSVEVLLMDVSVFQEVVRTNSKLKYKLNLQNLLRNQDYKIFLTTRVKNLIGNETYFKEEYNVNMDSATSLFKEATIPENLTTGDYILEITAKYLNRISTSTTPFVISKPIYMYSFFGVPLWIMSVIVSFLSFVGLNLFAYKRYSDRKKRYKISVDYTTLPQPGKRVVRLGHIAETKKPAYYELDRLTTQRF

SEQ ID NO: 16989 - DNA, 849 bp, Unknown
  Obtained from environmental sample
  misc_feature (1)..(849): n is a, c, g, or t
ttgacaattgagaagacctatattaatacaaggcaaggtaaatatattttatttggtgttttgatatctattttttgtgcatttattgtttctaagactataagtggtaatgaagtatccaacttacttgatgctcgctatcaaaactacacagataatattacaaatgagataaaaattcttcttgaaaacaaaaaagaggttatgctatttattgctctttctttatcaaatgatcaaaatattataaatgctttaaaaatagacgacaacagtaccataaaattaaaagagttttctgaaaaacttcaaaataccactacttataaaaatatatggtttcaaatcattgataaagaaggtaagagcttttacagaagttggacagataaatatggtgataatatgcttgaggtaagagctgatattgcaaaaatgataaaaaaacctaaaactatgtcaactataagtacagggaaatatgcaatgactgtaaagtcaatggtgcctatatatgataaagagaaatttataggtatatttgagataataacacattttaatactttacatcataaactacaacaaaaaaatgtagaaacagtttttatcgttgataagtcttataaaggacaaattacaaaaccatattaccctttatttattgataattattatatttcaatggataaaccaaatgcaaatatcatcaaaatactgcagacgaatggtatagaaagatatattaataatagaaactatatgattgataaagagaatgaacatattattacaacatatactcttaaagatattgatgataaaaaaatgggttatattataacattc

SEQ ID NO: 16990 - protein, 283 aa, Unknown
  Obtained from environmental sample
  misc_feature (1)..(283): Xaa is any amino acid
MTIEKTYINTRQGKYILFGVLISIFCAFIVSKTISGNEVSNLLDARYQNYTDNITNEIKILLENKKEVMLFIALSLSNDQNIINALKIDDNSTIKLKEFSEKLQNTTTYKNIWFQIIDKEGKSFYRSWTDKYGDNMLEVRADIAKMIKKPKTMSTISTGKYAMTVKSMVPIYDKEKFIGIFEIITHFNTLHHKLQQKNVETVFIVDKSYKGQITKPYYPLFIDNYYISMDKPNANIIKILQTNGIERYINNRNYMIDKENEHIITTYTLKDIDDKKMGYIITF

SEQ ID NO: 16991 - DNA, 525 bp, Unknown
  Obtained from environmental sample
  misc_feature (1)..(525): n is a, c, g, or t
atgagagagatgtctcaagtaacttcatcagttaaagagaagtcaaatctttattcaacgcttataacaatacttcgattgataaataaccgttcaaaacatatatctagaatatatataaatgatgaactgtttgatgtacaattagcagataaggagaaatataaatttttcacttatcttaataagcaaaaaattgaacaagtttggacaattatcattaataatgctttagatgaacttataaaaattgatgattatgaaaaaagaaaattatctattaacattagttcagataacaatacaattaaaataacatttcaagataatgcaggtggtatcaatgaaggtataattgacaatatctttgaaccttttataagtactaaactctcacatggtataggaattggtcttaatgtagctaaaaagatactagatgagcatgaggcagagattgaagtaagaaatcaaaatagtggtgctttgtttgagattagatttaaaattataaaaactaattag

SEQ ID NO: 16992 - protein, 174 aa, Unknown
  Obtained from environmental sample
  DOMAIN (61)...(171): Histidine kinase-, DNA gyrase B-, and HSP90-like ATPase
  misc_feature (1)..(174): Xaa is any amino acid
MREMSQVTSSVKEKSNLYSTLITILRLINNRSKHISRIYINDELFDVQLADKEKYKFFTYLNKQKIEQVWTIIINNALDELIKIDDYEKRKLSINISSDNNTIKITFQDNAGGINEGIIDNIFEPFISTKLSHGIGIGLNVAKKILDEHEAEIEVRNQNSGALFEIRFKIIKTN

SEQ ID NO: 16993 - DNA, 423 bp, Unknown
  Obtained from environmental sample
  misc_feature (1)..(423): n is a, c, g, or t
atgttccggtacatcgtatttaactgcctcatcggtaatggtgatgctcatttgaaaaattntgcgttgctatactcacaggatatgtctaggatttttgtatctcctccatttgatatcactcatacgcttatctacgacaccatagataacaaaatggcgcttaaacttgctggcagtaaaacattccctgatgagtctcacttgctgaaattagctgagggtaaggaatttcggatcagaaaggctaaggaaattattgagtccatcagtgatggcatcatggactatttgaagcgttctgaggaagtgcggttatttagtggattgcgagagtctattgaacaatcgatatcaagtgctatgaacccaacttataccacaaaaaattaccgtcatgatcgcaagaagaagtttgagtga

SEQ ID NO: 16994 - protein, 140 aa, Unknown
  Obtained from environmental sample
  misc_feature (1)..(140): Xaa is any amino acid
MFRYIVFNCLIGNGDAHLKNXALLYSQDMSRIFVSPPFDITHTLIYDTIDNKMALKLAGSKTFPDESHLLKLAEGKEFRIRKAKEIIESISDGIMDYLKRSEEVRLFSGLRESIEQSISSAMNPTYTTKNYRHDRKKKFE

SEQ ID NO: 16995 - DNA, 333 bp, Unknown
  Obtained from environmental sample
  misc_feature (1)..(333): n is a, c, g, or t
atgaaaaaagatattgaaacagaaaaatatatgaatgtctttgaacatttgagagaactaagaaaaagagttgttgtttcatctattgtatttggaatatttgttgtttttgcctttgcaatgcacagttacatagctaatttatttattcaattttattcaaatattcctagtagtggggaaaataagctatttgttaattctataattgaagggatgacaactaaaattaaagtatctttaattgcaggacttatcctttctctaccattgcatctatacaatatagttgcatttgttttccctgctcttgaaaaaaaagaaaaagatatt

SEQ ID NO: 16996 - protein, 111 aa, Unknown
  Obtained from environmental sample
  misc_feature (1)..(111): Xaa is any amino acid
MKKDIETEKYMNVFEHLRELRKRVVVSSIVFGIFVVFAFAMHSYIANLFIQFYSNIPSSGENKLFVNSIIEGMTTKIKVSLIAGLILSLPLHLYNIVAFVFPALEKKEKDI

SEQ ID NO: 16997 - DNA, 633 bp, Unknown
  Obtained from environmental sample
  misc_feature (1)..(633): n is a, c, g, or t
atgattacttcaaaattagatgtagtgttaaatatgaatcatcaaaaaaaaaacataatcctttttgtttttctatttttattaagcattaaatctttctcacaaattaacgaaaagcataacaacaaatgcttagtgattattggtgtagaacatcgttatactcaagttacaaatacaaaaagttcaactcaagtagtaatagataacattaattctgtgatcgaaaaaattaatcccgataatatcgtttatgtatattctgttcataaggcactttatttaactaaaaaaggatctaaaactggtttagattccattggaatgattcgagatgaaagattacaccgagtgaatagtaacatcatccttaaaaaggaagtaaatgcctttgcagataaagagtttattaaattcttgcaaaaaaataaatcaaaagagataattatagtaggcctaagtgctgaatattatataaaagaagccctactcagtggtaaagagttagggtataatatgtattttattccagaggcaataatgggaaaatctgtaaaaaagaaagaaataattctaaataaattgaagaaaaatggaattaaagaattaccaataaatcagctaatcaactaa

SEQ ID NO: 16998 - protein, 210 aa, Unknown
  Obtained from environmental sample
  misc_feature (1)..(210): Xaa is any amino acid
MITSKLDVVLNMNHQKKNIILFVFLFLLSIKSFSQINEKHNNKCLVIIGVEHRYTQVTNTKSSTQVVIDNINSVIEKINPDNIVYVYSVHKALYLTKKGSKTGLDSIGMIRDERLHRVNSNIILKKEVNAFADKEFIKFLQKNKSKEIIIVGLSAEYYIKEALLSGKELGYNMYFIPEAIMGKSVKKKEIILNKLKKNGIKELPINQLIN

SEQ ID NO: 16999 - DNA, 711 bp, Unknown
  Obtained from environmental sample
  misc_feature (1)..(711): n is a, c, g, or t
atgtatgattatacactaaaagttgaacaagaaggaagagatggcaaacttaatagtcaatggaaggatggtgttttatttagtccatggttagatgatttcaaaaatatacttaacaaaaacttgggcaagttacctacaagcattgaatataatgataaagtaatgacagccattgaattttcagaaaacattctaaatattccgtttaatgattatataaaaatcacatcatattcatatttggagtttgacaaaccaggtgaactattagttgatggtaactggttgcataaaaaggatttttataatattagattagatgaatatattaagcttattgattatgctcttaataatggatttacgctaaccggagatttccatataactgaagaatcatatagaggtaatctgggttatgccgattttgaaatagacagcaccaatacaataattgaccaagatactcgtgacaatctttatgagaattggaaaacaaccgatgtccataatgtgcagattatcggaattgcaaaagatgagaagggcaataaatattataagataaaagattcaagctataaaaaacacttcccaaattcaccgatatatttttcagaaaattattttcgtgcaagagttttatccattatgcttcataaggatggcatcccacctaatattataaaccgtttaaaaataaaataa

SEQ ID NO: 17000 - protein, 236 aa, Unknown
  Obtained from environmental sample
  misc_feature (1)..(236): Xaa is any amino acid
MYDYTLKVEQEGRDGKLNSQWKDGVLFSPWLDDFKNILNKNLGKLPTSIEYNDKVMTAIEFSENILNIPFNDYIKITSYSYLEFDKPGELLVDGNWLHKKDFYNIRLDEYIKLIDYALNNGFTLTGDFHITEESYRGNLGYADFEIDSTNTIIDQDTRDNLYENWKTTDVHNVQIIGIAKDEKGNKYYKIKDSSYKKHFPNSPIYFSENYFRARVLSIMLHKDGIPPNIINRLKIK

SEQ ID NO: 17001 - DNA, 681 bp, Unknown
  Obtained from environmental sample
  misc_feature (1)..(681): n is a, c, g, or t
ttgacaagaaaagatggatatagaaatttatttagcttttatcttggtttaaagtcaatgccaactaatatacttaatgatactaatttagaagaattaattgaaaataagtcagtagatgtgatttatgaaattttttgttttttttctatagtaaatattttgtcagatatatacaaagtggattcaaagcaattaaaatataatgtggataaagatgaatttaagaagtcattatctaaagaaaataacaaaaattgttttatttttaagagaaatgataattttcctaaaataaaagtacattataataaaacttatacaaacccttttagttattcaaaatcatttgaccctgatatttctatagagatttttaatgaaaatgactatctcaaaagtatatatatttttgatgcaaaatttaaagtgaatattaataaagataataatctaaaagaaaacaaaaaatataaatatgatgatataacaaaaatgcatgcatataaagatgcaattcttttagtacaaggagcttttattttataccctggtagtaaaaatgaagtatatagggaaaatacttctataaagaatagtgtaggtgcatttaatctaaatattaataatattgatgaacaaacattaataaaagaagtaataattaaattattaatctaa

SEQ ID NO: 17002 - protein, 226 aa, Unknown
  Obtained from environmental sample
  misc_feature (1)..(226): Xaa is any amino acid
MTRKDGYRNLFSFYLGLKSMPTNILNDTNLEELIENKSVDVIYEIFCFFSIVNILSDIYKVDSKQLKYNVDKDEFKKSLSKENNKNCFIFKRNDNFPKIKVHYNKTYTNPFSYSKSFDPDISIEIFNENDYLKSIYIFDAKFKVNINKDNNLKENKKYKYDDITKMHAYKDAILLVQGAFILYPGSKNEVYRENTSIKNSVGAFNLNINNIDEQTLIKEVIIKLLI

SEQ ID NO: 17003 - DNA, 741 bp, Unknown
  Obtained from environmental sample
  misc_feature (1)..(741): n is a, c, g, or t
atgggatatgatcttgtaactaatgagctcttagacccctactctggatatgaagatcttcaaaataaaaaactctctatcgtagataaaaatagtttcattgaagatcctctaagattttttagagccgtgcagttttgtgcaaggtttgagtttaaacccgacactcagctcatagagatttgccaaaacatgattaaaacagatgttttacatgaactcccatgtgagagaatcgaagaggagttaaaaaaactatttttaaaatctaaaaaaccatctataggcttagcagttttaaaaacatttaacggttttgagttttttagagagtttaaaactttagatgagaagagctacacaaacacgctcgaagcagtagataagataaaaaattttctaacacaaacagataaaagatcactaacactcatctacacttcactcttctcaaactttgaaaacattactctaatagactcatttttagaaaaaattacatcagataaagagctgataaaaaatataaaactcctcttntacggttataagaaaataacaaaaacaaaaaaattcacagattttgagctaaagaaatttagactagaggtagattttagtgatctgattttagttataaaagcaaactctaaaacactcctagcaaatgagctacatgaaagaggcacaaaactaaatattttaaaaactccaccatccccactcattcaaggaacgtga

SEQ ID NO: 17004 - protein, 246 aa, Unknown
  Obtained from environmental sample
  DOMAIN (2)...(118): Poly A polymerase family
  misc_feature (1)..(246): Xaa is any amino acid
MGYDLVTNELLDPYSGYEDLQNKKLSIVDKNSFIEDPLRFFRAVQFCARFEFKPDTQLIEICQNMIKTDVLHELPCERIEEELKKLFLKSKKPSIGLAVLKTFNGFEFFREFKTLDEKSYTNTLEAVDKIKNFLTQTDKRSLTLIYTSLFSNFENITLIDSFLEKITSDKELIKNIKLLXYGYKKITKTKKFTDFELKKFRLEVDFSDLILVIKANSKTLLANELHERGTKLNILKTPPSPLIQGT

SEQ ID NO: 17005 - DNA, 822 bp, Unknown
  Obtained from environmental sample
  misc_feature (1)..(822): n is a, c, g, or t
ttgaagatagtaaatcaagtaaaaaggaaaacagtaatgaaagctagaatgacgattaaaaaacagttgattatagcacttttagttgttggtattacaccatttatagttatgggaatcacttcatacttgaagtcaagtagtgccttggatatagaagcgcactctaaaatggagatggcaagggatttaaagaaaaatgaattaattagttattttgagatgttggaaaactctatggaaaatatggcagaaaatagacagatacatcttctttatgatgaattggtggaactacataaaaaatatgaggttggtgagagtgatcctttcgctatcattgacaaacaagatgtaaagagtacatatgccaaatttgacacttatttcagtcagtatgtgaaaaaaaatcatctttatgatgtatttttaatatgtgcaaaacatggacacattatgtactctgcttccaaagagtctgatttaggtcagaatctgaatacaggtgagctacgtaactctaaactgcatgaagcctgggtaacggccattagagagaaaggagctcatatgacagatatggcaccttatgcaccatctaacggtgatcctgcgatgtttatgtctgtacctattatagaaggtggtgtagttgagggtgttatagttgtacagattgatcctgtttcaatcaacaacattatgcaagaccgtacggggatgggtgagactggagaaacttaccttgtagggcaggataaacttatgcgtagtgacaactatgttgaccctaaaaaatcactctttgatagcctcgtttaa

SEQ ID NO: 17006 - protein, 273 aa, Unknown
  Obtained from environmental sample
  misc_feature (1)..(273): Xaa is any amino acid
MKIVNQVKRKTVMKARMTIKKQLIIALLVVGITPFIVMGITSYLKSSSALDIEAHSKMEMARDLKKNELISYFEMLENSMENMAENRQIHLLYDELVELHKKYEVGESDPFAIIDKQDVKSTYAKFDTYFSQYVKKNHLYDVFLICAKHGHIMYSASKESDLGQNLNTGELRNSKLHEAWVTAIREKGAHMTDMAPYAPSNGDPAMFMSVPIIEGGVVEGVIVVQIDPVSINNIMQDRTGMGETGETYLVGQDKLMRSDNYVDPKKSLFDSLV

SEQ ID NO: 17007 - DNA, 354 bp, Unknown
  Obtained from environmental sample
  misc_feature (1)..(354): n is a, c, g, or t
atgagtaaaattctaatattaggaaaagagagtagattgagggatgaaatagaaaactatttaataactaatggttatgagagtatctcaatttcacctgacaaattagatttaactcattgccacagttgggattattcacattgtgttataattcacgaattccctgtttttaggaactttgaaacaatggagaaaataatgaaactaaattgtagtaagatgataattatcacttctgattactctttaaaattcaagcaagagattactaagtgtggaaatgctgaagtaatctatagaccttttttaccacagcaattaattgcaagtttaacacaaaacaaacactaa

SEQ ID NO: 17008 - protein, 117 aa, Unknown
  Obtained from environmental sample
  misc_feature (1)..(117): Xaa is any amino acid
MSKILILGKESRLRDEIENYLITNGYESISISPDKLDLTHCHSWDYSHCVIIHEFPVFRNFETMEKIMKLNCSKMIIITSDYSLKFKQEITKCGNAEVIYRPFLPQQLIASLTQNKH

SEQ ID NO: 17009 - DNA, 522 bp, Unknown
  Obtained from environmental sample
  misc_feature (1)..(522): n is a, c, g, or t
atgaagttaaatatagtcgaatacccagataaaaaattacgtgaaatttccaaagagattacttccttcaattcagaactacaccagttgcttgacgcgatgtatccagttatgatagagactaacggcattggcttagcggctattcaagttgctcatcctgttcgcgctcttattttaaatgtacctgatgaagagggtgagcaacatcttgagaaccttttagaaatcattaatcctgtgataacacacaaaaatggagagactgtttatcaagaagggtgtttgagcgtaccgaaattttatgaagacgttagtcgttatgagagtataactcttaactatcaagatagagatgggaataccaaaacacttgaagcggatgggcttttaagcatcgctattcagcatgaaatagatcacttggaaggcatactcttcattgacaaacttccatatggacgccgtaaaaagtttgaaaaagagtataaacgcatgcaaaaagagagaaaacaggcataa

SEQ ID NO: 17010 - protein, 173 aa, Unknown
  Obtained from environmental sample
  DOMAIN (2)...(157): Polypeptide deformylase
  misc_feature (1)..(173): Xaa is any amino acid
MKLNIVEYPDKKLREISKEITSFNSELHQLLDAMYPVMIETNGIGLAAIQVAHPVRALILNVPDEEGEQHLENLLEIINPVITHKNGETVYQEGCLSVPKFYEDVSRYESITLNYQDRDGNTKTLEADGLLSIAIQHEIDHLEGILFIDKLPYGRRKKFEKEYKRMQKERKQA

SEQ ID NO: 17011 - DNA, 489 bp, Unknown
  Obtained from environmental sample
  misc_feature (1)..(489): n is a, c, g, or t
atgataccaaatatcaatatttatagtgtagaaacattagctgatgcgatacttttttttcaatcacaagataaagaactttataaaataagtaataaaacttatgaatataaatcgataactattaacaatcaaaactatttttatcaaaaaaattataaagtagattttcaagatgtaaaagggcaaaaaattgcaaaaagagcagcacaattaagtgcagcaggtggacacaatattatctttgagggaagtccaggatgtggaaaaagtatgattgcaaaacgattacaatatattacaccacctatggaacttgaagagattttggatattgcaaagatggagtctttgcaactaanacagcctacctttatccctcanagaacttttatctctccacatcacagctcaacaaaagctccaatcgtaggtgggacacaaataaggggaggtagctttatcaaatcatggggtactgttttttga

SEQ ID NO: 17012 - protein, 162 aa, Unknown
  Obtained from environmental sample
  misc_feature (1)..(162): Xaa is any amino acid
MIPNINIYSVETLADAILFFQSQDKELYKISNKTYEYKSITINNQNYFYQKNYKVDFQDVKGQKIAKRAAQLSAAGGHNIIFEGSPGCGKSMIAKRLQYITPPMELEEILDIAKMESLQLXQPTFIPXRTFISPHHSSTKAPIVGGTQIRGGSFIKSWGTVF

SEQ ID NO: 17013 - DNA, 495 bp, Unknown
  Obtained from environmental sample
  misc_feature (1)..(495): n is a, c, g, or t
atgccaaggataaatccggcacgcagatggggcgaggagaactattttgcctggaaatgttttcaggcattggggcttgtctcgccatcggatgacgatgatcttgctgataacagcgagaccaatttttatgaaaatcaatccaatacgatcatcaaggcgttaagtgacagtatttcgattgtcaaatcggttatcgagatcaagcctgttcttgaaggtctgatcgaagcgtcccgttcaaaagggcagttcgcagataaatcggccaaagacaaaatgggggcgccggaggtaaaggcatctaatgatacggatgtcgatgatctgaaatggtcgcccgaaaaaatgatcgaaattcacaatatctgcacggaaagccgtcttgcaaatcgggtcagcccgaataccagcaaaaaatacaaagacaatgtggatggcgaccgcaaaccggaacgtccggttgtccggcggtatgatccgcataagaactag

SEQ ID NO: 17014 - protein, 164 aa, Unknown
  Obtained from environmental sample
  misc_feature (1)..(164): Xaa is any amino acid
MPRINPARRWGEENYFAWKCFQALGLVSPSDDDDLADNSETNFYENQSNTIIKALSDSISIVKSVIEIKPVLEGLIEASRSKGQFADKSAKDKMGAPEVKASNDTDVDDLKWSPEKMIEIHNICTESRLANRVSPNTSKKYKDNVDGDRKPERPVVRRYDPHKN

SEQ ID NO: 17015 - DNA, 666 bp, Unknown
  Obtained from environmental sample
  misc_feature (1)..(666): n is a, c, g, or t
atgcgaactttaaactttaatttgcataagatgataaaagaagatattaaaaaatatgccgaagagcacacaagtcatgaaaatgagttattgtataatttaaatcgagaaactcatttaaaaacaatacacccccgaatgatttccggacatttacaaggcaaatttttggaaatgctaagtgcgatgattaagcctaggcaagtattagaaataggaacttttactggttactcagccatttgtctttcgaagggtattacgctcgacggttgcatccataccattgaaaaaaaccctgagttggaattgattgccaaaaatgcttttaaaaatgcaggaatcgaaaatcaaattaattattataccggtaatgctctggatataattccaaccatcaatgaaaaatttgatctaatatttttagatgcagacaaagaaaactacctgaaatattatcatttgatattcgacaaattaaaagtgggtggttttcttttagccgacaatgctctttggggtggaaaggtggttgaagaaatagtagcttcagataaagacaccaaaagtttaatggcctttaatgattttattcatcaagataaacgggtcgaaaatgtattgctcccgctcagagatgggattatgatggttcgaaaaatatag

SEQ ID NO: 17016 - protein, 221 aa, Unknown
  Obtained from environmental sample
  DOMAIN (21)...(221): O-methyltransferase
  misc_feature (1)..(221): Xaa is any amino acid
MRTLNFNLHKMIKEDIKKYAEEHTSHENELLYNLNRETHLKTIHPRMISGHLQGKFLEMLSAMIKPRQVLEIGTFTGYSAICLSKGITLDGCIHTIEKNPELELIAKNAFKNAGIENQINYYTGNALDIIPTINEKFDLIFLDADKENYLKYYHLIFDKLKVGGFLLADNALWGGKVVEEIVASDKDTKSLMAFNDFIHQDKRVENVLLPLRDGIMMVRKI

SEQ ID NO: 17017 - DNA, 504 bp, Unknown
  Obtained from environmental sample
  misc_feature (1)..(504): n is a, c, g, or t
atggctcctaatcttcttaacaataactttacatcgtcagcttccaggaagaagttatcaacagatgtgagttatatagagtgtactgatggatggttatatctatcagcagttaaagatctctttaacaatcaaattatagcacataatacatcagatagaaataatcttgatttagcaatcaaaacaattaaacaattacctaaaggaaatggaattattcattccgatcaaggagcattgtattatagtcacgagtatatagaacgcactcaaaaaaaaggatatacaagaagcatgtctagacaaggcgcgtgttgggaaaactctcctatagagaattggttctcacaaataaaacaagaacacatctatccattaggaaaaattactaagaagcaaatgaaaaaggagataaaaaaatacgttcagtggtataacactgaacgtattcaaaagtctttaaattggttatctcctatcaaattcgcattacaatattag

SEQ ID NO: 17018 - protein, 167 aa, Unknown
  Obtained from environmental sample
  DOMAIN (11)...(165): Integrase core domain
  misc_feature (1)..(167): Xaa is any amino acid
MAPNLLNNNFTSSASRKKLSTDVSYIECTDGWLYLSAVKDLFNNQIIAHNTSDRNNLDLAIKTIKQLPKGNGIIHSDQGALYYSHEYIERTQKKGYTRSMSRQGACWENSPIENWFSQIKQEHIYPLGKITKKQMKKEIKKYVQWYNTERIQKSLNWLSPIKFALQY

SEQ ID NO: 17019 - DNA, 423 bp, Unknown; identical to SEQ ID NO: 8191
  Obtained from environmental sample
  misc_feature (1)..(423): n is a, c, g, or t

SEQ ID NO: 17020 - protein, 140 aa, Unknown; identical to SEQ ID NO: 8192
  Obtained from environmental sample
  DOMAIN (2)...(127): Chorismate synthase
  misc_feature (1)..(140): Xaa is any amino acid

SEQ ID NO: 17021 - DNA, 321 bp, Unknown
  Obtained from environmental sample
  misc_feature (1)..(321): n is a, c, g, or t
atgaaaacaataattgttcatatatgtattgattattttagaaagaataaaaaggagaatcgtcatcagaatattgatgactttgaagatttaccttctaccgattattcaatactaaatgaaatgtcggcaaaagaaattatggaacttattcaaactcttccacaaggctacaggattgtttttaatttatttgccattgaaggctatagccataaagaaattgctcaaaaactagatgtcactgaaagcacatcaaaaagtcaagtgcgtaaggctcgtatttggttgatgaagaaactaaagaataactacgattaa

SEQ ID NO: 17022 - protein, 106 aa, Unknown
  Obtained from environmental sample
  DOMAIN (50)...(99): Sigma-70, region 4
  misc_feature (1)..(106): Xaa is any amino acid
MKTIIVHICIDYFRKNKKENRHQNIDDFEDLPSTDYSILNEMSAKEIMELIQTLPQGYRIVFNLFAIEGYSHKEIAQKLDVTESTSKSQVRKARIWLMKKLKNNYD

SEQ ID NO: 17023 - DNA, 438 bp, Unknown; identical to SEQ ID NO: 9347
  Obtained from environmental sample
  misc_feature (1)..(438): n is a, c, g, or t

SEQ ID NO: 17024 - protein, 145 aa, Unknown; identical to SEQ ID NO: 9348
  Obtained from environmental sample
  DOMAIN (29)...(143): Protein of unknown function (DUF1486)
  misc_feature (1)..(145): Xaa is any amino acid

SEQ ID NO: 17025 - DNA, 396 bp, Unknown
  Obtained from environmental sample
  misc_feature (1)..(396): n is a, c, g, or t
ttgagtcgtgttgctgaaattatcggcatgccgtataaagagctaaaaaagctaaaccgtcatctgaagcatgattttatgccgccatatgtaaaaagctatgatgtttatattccatatataaaattatcagaatttagacaaaagtatattccacgagcaatagagcagatttcagtcgtacataatgtacagcagggtgataacttatcaaatatagggaaaaaatatggtgttaagtataatgttattaaagattacaataatttaaaaagtaactttttatcacttaatcaaaaattgattattcctatttcaaataaaaaatttaaaaaagcatcttcttatatcgttaagtcaggtgatacactaaaatcaatcatctcaaacttttaa

SEQ ID NO: 17026 - protein, 131 aa, Unknown
  Obtained from environmental sample
  DOMAIN (62)...(104): LysM domain
  misc_feature (1)..(131): Xaa is any amino acid
MSRVAEIIGMPYKELKKLNRHLKHDFMPPYVKSYDVYIPYIKLSEFRQKYIPRAIEQISVVHNVQQGDNLSNIGKKYGVKYNVIKDYNNLKSNFLSLNQKLIIPISNKKFKKASSYIVKSGDTLKSIISNF

SEQ ID NO: 17027 - DNA, 417 bp, Unknown
  Obtained from environmental sample
  misc_feature (1)..(417): n is a, c, g, or t
ttgaaaatcaaacccttgatgttgatctctttcagcaaccactcgctcagggtgcattactcgccatggaccctcacactggcttcgtcaaagcaatggtggggggatacgattttgccacaagtcagtttaatcgggtacttccaatcaaatcgcctgcccggttcagccatcanaccccttatttactctgctgcaatcgacaagggctacactgctgcttcagtcattcttgatacacctctgatctacaaagatacaacagcagacggtaaagaacgtgagtggaaaccaaaaaattatggcaataaattttccggccccaactctttacgtaaagcactgacccactcttacaatataatcaccatcaaattattgaataatattggcattggttacctgcccgctatttaa

SEQ ID NO: 17028 - protein, 138 aa, Unknown
  Obtained from environmental sample
  misc_feature (1)..(138): Xaa is any amino acid
MKIKPLMLISFSNHSLRVHYSPWTLTLASSKQWWGDTILPQVSLIGYFQSNRLPGSAIXPLIYSAAIDKGYTAASVILDTPLIYKDTTADGKEREWKPKNYGNKFSGPNSLRKALTHSYNIITIKLLNNIGIGYLPAI

SEQ ID NO: 17029 - DNA, 459 bp, Unknown
  Obtained from environmental sample
  misc_feature (1)..(459): n is a, c, g, or t
atgcaatttgatgtaaatgaaatgagaaagcctttcattgagcacgaaaagctagaatgtatcgatgatttatttacgttttactatgacgagtcaaataatattagaaaattgcatttgacaagcaagggattaaatgttgacaaagcatgcaacttcgttttagcaggaattgttcacaagggtgagactcactgcgctgacttcgatgcactaagaagaagtttgaacatacaattgtcagcgaaagagataaagctaaaacatattggaacaggctcgtttgagaacatacttaaatcgaaaaaactgggtgtattattaaagtggctgatagataacaatttttacttgcactattttaacttgaacgttttgtactggtctattgttgatatcatagattcaataattgataatctaaaatatcctgataatatttcctcgagccgattctga

SEQ ID NO: 17030 - protein, 152 aa, Unknown
  Obtained from environmental sample
  misc_feature (1)..(152): Xaa is any amino acid
MQFDVNEMRKPFIEHEKLECIDDLFTFYYDESNNIRKLHLTSKGLNVDKACNFVLAGIVHKGETHCADFDALRRSLNIQLSAKEIKLKHIGTGSFENILKSKKLGVLLKWLIDNNFYLHYFNLNVLYWSIVDIIDSIIDNLKYPDNISSSRF

SEQ ID NO: 17031 - DNA, 633 bp, Unknown
  Obtained from environmental sample
  misc_feature (1)..(633): n is a, c, g, or t
atgagctacgaagatacatttaaaccttacgtgaaaacatctgaggctgttatttcagatcagataaatatctccctcagtgaggaaattgaatctgttgagaacttcatgataattactgctgattctttgcagaaagaagtcccggttattgcttttgataaagcaagcaccggtgatgaaaaagagataatggtaaatattctctcaaatgatcttgatactttaaaatactatcttgtatcagaaaatatcaaagaccttaaaggtaatattacaaaaatagatacaattctaattaggggtatggcaattgttgatactaccggaccggaaatcatcagttcttacccacgaaatggtgctagcctgaaaaaggctaaacccgagattaggataatctttgatgaaataattctgactgctaatatcaatatatcgctaacaggtttggaagacgatagagatattgccttggatgtgattaaaggtaattcaactgttctgattttgaaacccgctgagaagctgaggaatttaagctcttatcgtttagacctgaatgctggggatcaaaaaggtaataagctaaaagaaccatttcaactagattttatcatcattcaacgataa

SEQ ID NO: 17032 - protein, 210 aa, Unknown
  Obtained from environmental sample
  misc_feature (1)..(210): Xaa is any amino acid
MSYEDTFKPYVKTSEAVISDQINISLSEEIESVENFMIITADSLQKEVPVIAFDKASTGDEKEIMVNILSNDLDTLKYYLVSENIKDLKGNITKIDTILIRGMAIVDTTGPEIISSYPRNGASLKKAKPEIRIIFDEIILTANINISLTGLEDDRDIALDVIKGNSTVLILKPAEKLRNLSSYRLDLNAGDQKGNKLKEPFQLDFIIIQR

SEQ ID NO: 17033 - DNA, 807 bp, Unknown
  Obtained from environmental sample
  misc_feature (1)..(807): n is a, c, g, or t
ttgactgaattattagagatatatccgtttataaaagatgcaaaagatagttttgaacaacagaataaaaatctaaacaaggtaacacttacaggtaagatcagctctctagatattgcggagaatctttttatatttattgaagagactatgaataattttattagtttaaaagataaatttattttaagtcttgtagaagagaacctcaaaaagagtaaaagtgaattaggctctaaagcccaagtagcaatagatattttgattcgtaacctttttgaaagaactgcagatgtgggctttttggctacagataatgtaattattgattttttaaataaaaaagtagaaaaaaaaaatattgtagatagattagtcgaatatacaaaaaagtacagtgtatacaatgagatagtgatattttatcctgatggaaaagtcgctacaaatatgaattcaaataatcagatcaaattctctaatgacccaataatagcacaatctttagcgactgatgaatatattgagcaatactcatatacagatatattcaagtcacaaaagcagactctggtttatgcacaaagaatagtagaaaaccgtgacattataggagtattgtgtttatgttttaagtttgatgatgaactcaatcttatctataaaaatcttataagtgattctcaaaaggtgatattgttagaaaattctcaagtaattgcgacaaacagtaaaaactttgcctcattgggtagcacatttgcattaaaaaataaattatcatatcatctttataaaaacatgtag

SEQ ID NO: 17034 - protein, 268 aa, Unknown
  Obtained from environmental sample
  misc_feature (1)..(268): Xaa is any amino acid
MTELLEIYPFIKDAKDSFEQQNKNLNKVTLTGKISSLDIAENLFIFIEETMNNFISLKDKFILSLVEENLKKSKSELGSKAQVAIDILIRNLFERTADVGFLATDNVIIDFLNKKVEKKNIVDRLVEYTKKYSVYNEIVIFYPDGKVATNMNSNNQIKFSNDPIIAQSLATDEYIEQYSYTDIFKSQKQTLVYAQRIVENRDIIGVLCLCFKFDDELNLIYKNLISDSQKVILLENSQVIATNSKNFASLGSTFALKNKLSYHLYKNM

SEQ ID NO: 17035 - DNA, 795 bp, Unknown
  Obtained from environmental sample
  misc_feature (1)..(795): n is a, c, g, or t
atgatgaaaaaatatataattgccttaataagcacttttttatatgccgatactacttctattgtagtagaaaatgatgctcttattggtaaagacaaccactatacaaatggtttttactatacatggatgagtgaaaacaacagtaattacattgatatgttaccttttatagatttacctcaaaagaatgtagcattttctctctctcatgcagtttttacacctaaaaataaagatttaagggctaaagatttaaatgatctgccttatgcaggatatctggattttaactttttagcatacaaatcatccccaaactattttcatgaattgggaattaatattggtattgtaggagatgcagcacaagcagactggtttcaaaaaagatttcatgactccatagggcatgacaaaccaaatggctgggacaatcaattaagtaaccactttatctatggtatttcatacaaaatcggatacaaaacagaccccgtagatatatatgatttaaaacttgatctaacaacaaatttagaaggtgatatcggaaacttctatagtggcgctttagttggtgcggcgctgagattgagcagcatatctttagatagttttaatacagcaggaaaatttataggaacaaatgagagtctgcttttaaattataaagagatagaaaaatttaactactcactctcattcggtctattttataataaatttaacagatactacttagtagataaagcaatcgatgagggctacaacaagctaaaatctcagccataa

SEQ ID NO: 17036 - protein, 264 aa, Unknown
  Obtained from environmental sample
  SIGNAL (1)...(16)
  misc_feature (1)..(264): Xaa is any amino acid
MMKKYIIALISTFLYADTTSIVVENDALIGKDNHYTNGFYYTWMSENNSNYIDMLPFIDLPQKNVAFSLSHAVFTPKNKDLRAKDLNDLPYAGYLDFNFLAYKSSPNYFHELGINIGIVGDAAQADWFQKRFHDSIGHDKPNGWDNQLSNHFIYGISYKIGYKTDPVDIYDLKLDLTTNLEGDIGNFYSGALVGAALRLSSISLDSFNTAGKFIGTNESLLLNYKEIEKFNYSLSFGLFYNKFNRYYLVDKAIDEGYNKLKSQP

SEQ ID NO: 17037 - DNA, 858 bp, Unknown
  Obtained from environmental sample
  misc_feature (1)..(858): n is a, c, g, or t
atggctcggagtattanaaaagcattgcaaataagaactgaatccaatgatttggaaggtcaagcaattttgtataacaatttaggtagtgtttatatttcattaaacaaaaatgatagtgcggtttattttttcaaaaaaagtaatgagtttactaccttaattggttataaagaagctactagagacaattacttaggattagcaacagcttatgataaattagggaaatataaagaagcatttgaagcacataaaaatcaccttgtctataaagactccttatttaatgaagaatcaaataaacaaattgaggaaattagaacgcaatatgaaacagagaagaaagaaaaacagctaatagaacaagaagttattattacaaaagaacaattacgggtacgacaaaggaattacactcttgtaggtttggctttagtgctaatatttattgttatccttagcgtttatatctacaaacaacaaaaatttaagcagcaaaaactaattgaagaaaataggttgaaagatgaaatagctaaaatcacacttcaaaatgaattacatgaagaacgaataagaatatcaagggatttacatgacaacataggttctcaactaacttttatcatttcttcggtagataatatgggttatttatttaaaacagcagacgaaaaacttagagaaaaactacacggcattgctgattttagtagaacaaccattacccaactaagagatactatttgggcattaaataaagatgaaataagttttgaagatttaaaatcgagattatataattacattgaaacagctaaaattgttaaagaaaacattacttttaatttttga

SEQ ID NO: 17038 - protein, 285 aa, Unknown
  Obtained from environmental sample
  misc_feature (1)..(285): Xaa is any amino acid
MARSIXKALQIRTESNDLEGQAILYNNLGSVYISLNKNDSAVYFFKKSNEFTTLIGYKEATRDNYLGLATAYDKLGKYKEAFEAHKNHLVYKDSLFNEESNKQIEEIRTQYETEKKEKQLIEQEVIITKEQLRVRQRNYTLVGLALVLIFIVILSVYIYKQQKFKQQKLIEENRLKDEIAKITLQNELHEERIRISRDLHDNIGSQLTFIISSVDNMGYLFKTADEKLREKLHGIADFSRTTITQLRDTIWALNKDEISFEDLKSRLYNYIETAKIVKENITFNF

SEQ ID NO: 17039 - DNA, 549 bp, Unknown
  Obtained from environmental sample
  misc_feature (1)..(549): n is a, c, g, or t
ttgtttgcaccgacattcagtcagagatggaaatcggcgagtaatctattgccatacctgaatgacaccattaaagaggatgaaatctggctgattaaattccatgaattgatgagtctgaagaagatccaacaccagtttagagaattaactgatcaggttcgtattgttgaagatattgatattactccgtatctacacatggctgacgttctagtctccgatacttcttccgtgaattatgaattcatgatactggggaaacctattgttacctatagaacattgagtcgatttgataaaggcataaatataactgaaccagaagaattacgaagcgctgttgacacagctttgtatagcccagcagataccaaatataatcgtattgtccaacttaatgagattcatccctacaatgacctgggtgtggcaaaacgaattgttgaagtactggaaaagtattataacaagaaagtaccatcaaaattgaggtatattagtttcctcagaagatttaaaacattgaaattagtttatcgatcataa

SEQ ID NO: 17040 - protein, 182 aa, Unknown
  Obtained from environmental sample
  DOMAIN (1)...(154): CDP-Glycerol:Poly(glycerophosphate) glycerophosphotransferase
  misc_feature (1)..(182): Xaa is any amino acid
MFAPTFSQRWKSASNLLPYLNDTIKEDEIWLIKFHELMSLKKIQHQFRELTDQVRIVEDIDITPYLHMADVLVSDTSSVNYEFMILGKPIVTYRTLSRFDKGINITEPEELRSAVDTALYSPADTKYNRIVQLNEIHPYNDLGVAKRIVEVLEKYYNKKVPSKLRYISFLRRFKTLKLVYRS

SEQ ID NO: 17041 - DNA, 873 bp, Unknown
  Obtained from environmental sample
  misc_feature (1)..(873): n is a, c, g, or t
atgcttcaccccctcaagaagatcactcagtcatatgctcagataaaaaaagctttggtttctttggatcgcatctcagtaatattagaaagagattctgagcttaaagagtcggtagatgctgtttcaaaagatgattttacaagcgtaatagaatttaaagatgttcacttctcttatgataaaaaatccaatgttctctctgagatagatcttgttattagcaaaggggaacaagttgctcttgttggcagtagcggatctggtaaaacaacattagttaatcttcttacaagaatgtacgatcacaataagggtgatatcacgattgatgggattcctattgaatcaattaaactaaggaatttaaggtctctatttggaactgttacccaggaatcaattctatttagtgatacagttaagaataatattagttatggatcattaaaagagcttaaagaatctgaaataataaaagcagctgaaatagcatatgctgatgaatttattattcaattacctgacacatataatcacatgttgaatgtcaaggcttcaaatctttccggaggtcagaaacaaagattatgtatagccagagccattgttggtaatccaccaatcctgattttcgatgaagccaccagtgctttggattctgaagctgagacaaatgttcaaaaagctatagaacaagcgactaagaacaggacagtaattgtaatagctcatagattatcaactattttagcatcagataaaattgttgtgatggataaaggcaaaatcgtaggcatggggaaacataaagatcttttagtaagctgttcccgctataagttgctttatgatttacagttcgcagacgag

SEQ ID NO: 17042 - protein, 291 aa, Unknown
  Obtained from environmental sample
  DOMAIN (77)...(262): ABC transporter
  misc_feature (1)..(291): Xaa is any amino acid
MLHPLKKITQSYAQIKKALVSLDRISVILERDSELKESVDAVSKDDFTSVIEFKDVHFSYDKKSNVLSEIDLVISKGEQVALVGSSGSGKTTLVNLLTRMYDHNKGDITIDGIPIESIKLRNLRSLFGTVTQESILFSDTVKNNISYGSLKELKESEIIKAAEIAYADEFIIQLPDTYNHMLNVKASNLSGGQKQRLCIARAIVGNPPILIFDEATSALDSEAETNVQKAIEQATKNRTVIVIAHRLSTILASDKIVVMDKGKIVGMGKHKDLLVSCSRYKLLYDLQFADE

SEQ ID NO: 17043 - DNA, 675 bp, Unknown
  Obtained from environmental sample
  misc_feature (1)..(675): n is a, c, g, or t
ttggtacttgaggacgggtgggttactaccatttcaggaaaagaaaatggggatgtttacaataacattagagaacgtttaaagaataaagtaggcaaactaagagacttaggtgttgagtaccttttttaccgacttatagatactacggtagattattatttttacgtctccgactttttaagtgaagaaattcaggaaatggaaaataaagtactacatgaatttgatagtaaattattggaagatattcaattgcttaaaaaagaagtaaacaaactgaagcgaatcattatacccactaaagaagctatttctcttttagaaaaagacagtgaaagtttcttaaaaaagcaaaccaaacgttttttaaaagacgttcacgaacatattgtacatttgaatgatgcggtggacttacaacgagacaacattagttctgttatggagtcctaccaatttggtgtaaataacaaaaccaataatgtaatgcagttgcttaccattatttccaccatctttattccactaacatttattgcaggagtgtacggaatgaactttgaaaacatgcccgaacttagttggaaatacagctactttgttatttggggattaatgttattcattttcatcatcatgctgatttatttcaaaagaaaaaaatggctttaa

SEQ ID NO: 17044 - protein, 224 aa, Unknown
  Obtained from environmental sample
  DOMAIN (3)...(224): CorA-like Mg2+ transporter protein
  misc_feature (1)..(224): Xaa is any amino acid
MVLEDGWVTTISGKENGDVYNNIRERLKNKVGKLRDLGVEYLFYRLIDTTVDYYFYVSDFLSEEIQEMENKVLHEFDSKLLEDIQLLKKEVNKLKRIIIPTKEAISLLEKDSESFLKKQTKRFLKDVHEHIVHLNDAVDLQRDNISSVMESYQFGVNNKTNNVMQLLTIISTIFIPLTFIAGVYGMNFENMPELSWKYSYFVIWGLMLFIFIIMLIYFKRKKWL

SEQ ID NO: 17045 - DNA, 585 bp, Unknown
  Obtained from environmental sample
  misc_feature (1)..(585): n is a, c, g, or t
ttgaataaacagagtttaacattagaaaaaagttattcagaacattttaatttattcacttatccgattatgatagttaatgatgacaactatccgctttggtttaacaaaaaaatgagatcatttattgttgatgatataactacacagataaaattacaaaaattgctaactctatcattaagcagtgatgaactaattttgcaaaaagatcatattgattactattatcagccgttcatatcacgtataaaattatatgaaaaaaaatattatttagtcagcttatttaatatatcanagcgaaaagaacttcaatatcagctaaaagaggagcacgcaaaatttaagcttttaagtgaaaatttacccgaaagtattgtccttgaacaggataagatagtttattcaaatccaacatttgaaaaattagttggcttaaatggaaagaaactattaaataaaaagcttattgatatcatagcttctgacaaccnatcactatttcaaaataacattacaaaattactctcagatagaaactcttgtgttgataccacactcaaaatactaaaattcaaaaaa

SEQ ID NO: 17046 - protein, 195 aa, Unknown
  Obtained from environmental sample
  misc_feature (1)..(195): Xaa is any amino acid
MNKQSLTLEKSYSEHFNLFTYPIMIVNDDNYPLWFNKKMRSFIVDDITTQIKLQKLLTLSLSSDELILQKDHIDYYYQPFISRIKLYEKKYYLVSLFNISXRKELQYQLKEEHAKFKLLSENLPESIVLEQDKIVYSNPTFEKLVGLNGKKLLNKKLIDIIASDNXSLFQNNITKLLSDRNSCVDTTLKILKFKK

SEQ ID NO: 17047 - DNA, 762 bp, Unknown
  Obtained from environmental sample
  misc_feature (1)..(762): n is a, c, g, or t
atggaaatatcatatctatcatcgatgcactccgtaatgctgactatgaagcaaaagatgcaagctaacaatctagataacaaactcataaaatctcacgtgaccaataagtcacgtgaatttttgatcatgcatccagaatacaagatgactccgttacaaaaaataaaatataatagactcattaaaaaacgtgcagttggaatcccactcgcatacctcaccggacataaagaattttttgaattagatttttttgtaaacaaacacacactcgtaccacgtccagataccgaactcatggtagaagaagcaatcaaaaaaataacaaaaaaaactactatcattgatattggtactggatcaggatgtattcctatttctattttgaaaaatataaaacaaaaaaacatacaaacatttgccacagatatttctcgtggcgcattacgtatcgcaaaaaagaatgcaaaaaaacataatgtagatattacttttttacatggcaatttattggaaccaattatacctaaaataaaaactcaaaatactgagctcgtgatcactgcgaatcttccatacctcgatgaatcctggtacgatgaatcaccgtcaatcaaatacgaaccaaagtcagcattagtagcaaaagaaaaagggacagcactctatcgtgaactactagaacaaatagataaaacaaaatcatctgccatagtaatgatggagatagacccacggcaggtagatgatatgaaaaaa

SEQ ID NO: 17048 - protein, 254 aa, Unknown
  Obtained from environmental sample
  misc_feature (1)..(254): Xaa is any amino acid
MEISYLSSMHSVMLTMKQKMQANNLDNKLIKSHVTNKSREFLIMHPEYKMTPLQKIKYNRLIKKRAVGIPLAYLTGHKEFFELDFFVNKHTLVPRPDTELMVEEAIKKITKKTTIIDIGTGSGCIPISILKNIKQKNIQTFATDISRGALRIAKKNAKKHNVDITFLHGNLLEPIIPKIKTQNTELVITANLPYLDESWYDESPSIKYEPKSALVAKEKGTALYRELLEQIDKTKSSAIVMMEIDPRQVDDMKK

SEQ ID NO: 17049 - DNA, 354 bp, Unknown
  Obtained from environmental sample
  misc_feature (1)..(354): n is a, c, g, or t
atgtcccaagactttaaaatttntaaaggcaatgatatcttttcgaatatcagtaattataacgtaagaaatcacccagcagtattttcatgggtgtatttaggttcggttacttttaaagattttttaatatgccctcagcctaaatatacaaaaatatcgaccaaagtaataattcccaaaacggttttaccaagaataatatattatataaaaaatgataaatatttaaaaaaaagtcgtgtttctattttcttaataagtttagcgacagctatatattttgtatggatttttttattggttttttttatgaataaaggtcttcatgcaattgaggccggagatgagtga

SEQ ID NO: 17050 - protein, 117 aa, Unknown
  Obtained from environmental sample
  misc_feature (1)..(117): Xaa is any amino acid
MSQDFKIXKGNDIFSNISNYNVRNHPAVFSWVYLGSVTFKDFLICPQPKYTKISTKVIIPKTVLPRIIYYIKNDKYLKKSRVSIFLISLATAIYFVWIFLLVFFMNKGLHAIEAGDE

SEQ ID NO: 17051 - DNA, 318 bp, Unknown
  Obtained from environmental sample
  misc_feature (1)..(318): n is a, c, g, or t
atgcaaattgagcaattacgaaatgagataaaagaaaatgatgctgttatggtatattttagcggtgaaaactgtggtgtttgtaaagtgattcaaccaaaaataaaaaaactatttagtgaagagtttcctaaaataaaacagatttttattggggcagataagttccccacaactgctgcacaatacaatgtgttgactataccaacagttatagtattttttgattcaaaagagtttataagagaaagtcgccatatctcaatggaccaaattgagcaacaccttaatcgaacttaccatttattttttacctaa

SEQ ID NO: 17052 - protein, 105 aa, Unknown
  Obtained from environmental sample
  DOMAIN (2)...(101): Thioredoxin
  misc_feature (1)..(105): Xaa is any amino acid
MQIEQLRNEIKENDAVMVYFSGENCGVCKVIQPKIKKLFSEEFPKIKQIFIGADKFPTTAAQYNVLTIPTVIVFFDSKEFIRESRHISMDQIEQHLNRTYHLFFT

SEQ ID NO: 17053 - DNA, 606 bp, Unknown
  Obtained from environmental sample
  misc_feature (1)..(606): n is a, c, g, or t
atggaaaaaaaagatttttttgaaaacaagtcaaaaacctatagtaaagatagtaaaagagtacgaaatgtacaaactatagcaaatggtattttagacaaagtaaactatacaaaagatatgcatattatggattttggtagtggtacaggtcttttatccatagaaattgcgccttatgtggggaaaatcacaggtatagatatgtcaaaatctatgaatgaagagttagaagcaaacaaagacttagttgattgtgatttggaaattttagaacttgatctatcaaaaagtgatattaataaaaaatttgatggaattatctcatccatgactttacatcatgtggaagatatcgtagagctattaaaaaaatttcataatatgctagatgagggaggaactattgctttatcagatttatacacagaagatggaacttttcactcagaagatacgggtgtgtttcattttggatttgatgaagaatttatagttcaatgtgctaaaaaagctggatttagacaactagagatttctcaagtaagtgttgctaaaaagccacataaagagtttcctatatttttactcactgggttaaagtaa

SEQ ID NO: 17054 - protein, 201 aa, Unknown
  Obtained from environmental sample
  misc_feature (1)..(201): Xaa is any amino acid
MEKKDFFENKSKTYSKDSKRVRNVQTIANGILDKVNYTKDMHIMDFGSGTGLLSIEIAPYVGKITGIDMSKSMNEELEANKDLVDCDLEILELDLSKSDINKKFDGIISSMTLHHVEDIVELLKKFHNMLDEGGTIALSDLYTEDGTFHSEDTGVFHFGFDEEFIVQCAKKAGFRQLEISQVSVAKKPHKEFPIFLLTGLK

SEQ ID NO: 17055 - DNA, 534 bp, Unknown
  Obtained from environmental sample
  misc_feature (1)..(534): n is a, c, g, or t
atgaaagtaaatgtaaattatagttcccgttttagaatcctaaaaggtgggaaagtaagtctagtagatgactctaagtacaaaggtgtcgccaagctgttagccttttttacaaatctggctataagacgaggaggggatgagtttaaaggtctagagtataataaagcatctatgactatagacacttttataggcatgccaaaaccatttgaaaaaaaaccttttgctcaaacaggcatgaaagccggcatgagagctcgtttggagtctctacctgataacatatcgctagaagctccagagtacccagagcatgtgctgaagatttctgatatgcaaacagatcaagtaatgccgcctcaaaaagaagtcatggatagggtggaaagaattgtgaaactgatagaagacattgagcaacgagaaaacaaagttaagaaaattaaaagagattcgtctaatatttttggcttcactagagcaaacttaataaaaatgctaacagaacaaattctcgaaaatcaaaattaa

SEQ ID NO: 17056 - protein, 177 aa, Unknown
  Obtained from environmental sample
  misc_feature (1)..(177): Xaa is any amino acid
MKVNVNYSSRFRILKGGKVSLVDDSKYKGVAKLLAFFTNLAIRRGGDEFKGLEYNKASMTIDTFIGMPKPFEKKPFAQTGMKAGMRARLESLPDNISLEAPEYPEHVLKISDMQTDQVMPPQKEVMDRVERIVKLIEDIEQRENKVKKIKRDSSNIFGFTRANLIKMLTEQILENQN

SEQ ID NO: 17057 - DNA, 828 bp, Unknown
  Obtained from environmental sample
  misc_feature (1)..(828): n is a, c, g, or t
ttggcatataaacaaaaagtaactatagtaaaaacaggtgcaaagaaagaagagaaaaattttcttggatatgaatttagtaatagaagaggaagtgaaggtatacatccaattcaaagaggaaaaagcatagatgaatgcacatcactgtatgatgaaaattcttatacaaatagtttaaaggcaaacagttatatctatagttcatttgatggtaaagaaaaagagatagatgagagcttaaaagataatatctcttatattgatttggtagatataatgagttttgatggaattctttttgaaaagaacatatctttaaatgctaaaaaaaaagtaaaatttgagagtaagtggcaattcattactttaggtgatatactgtatgaagaaaaaaaatcaaaaattcaagttggaatagcaaaagaaacaaaaaatggcttatataattttttcacaagtggtgaaaatatttataaatttgatagctttttagttgatggaaaaaatatttatttatcaacaggtggtaatgcaattgtaaaatactataatggcaaagcatcttattcaactgatacttttgtagttaatagtaaagatgaagaaaaaataaaaacagagtttatattttatttattagacaatataattgatttgataaacaataattattttaaaggcgttggtttaaaacatctgcaaaaaaaagatttcagaaatataaaaataccattaccacctaaatatattcaagaacaaattataaaagatattgaagtattggaaactattgnacagaaatataagaaaagtattgaaaaatta

SEQ ID NO: 17058 - protein, 276 aa, Unknown
  Obtained from environmental sample
  DOMAIN (119)...(264): Type I restriction modification DNA specificity domain
  misc_feature (1)..(276): Xaa is any amino acid
MAYKQKVTIVKTGAKKEEKNFLGYEFSNRRGSEGIHPIQRGKSIDECTSLYDENSYTNSLKANSYIYSSFDGKEKEIDESLKDNISYIDLVDIMSFDGILFEKNISLNAKKKVKFESKWQFITLGDILYEEKKSKIQVGIAKETKNGLYNFFTSGENIYKFDSFLVDGKNIYLSTGGNAIVKYYNGKASYSTDTFVVNSKDEEKIKTEFIFYLLDNIIDLINNNYFKGVGLKHLQKKDFRNIKIPLPPKYIQEQIIKDIEVLETIXQKYKKSIEKL

SEQ ID NO: 17059 - DNA, 477 bp, Unknown
  Obtained from environmental sample
  misc_feature (1)..(477): n is a, c, g, or t
atgaaagcaggtagttttgttgctgcttcagatatcagtgatgaaaaagacactgacaactatccttgttatggtggaaatggtcttagaggctacactaaaacatttacacatgagggaacttattctttagtaggaagacaaggtgcattgtgtggaaatgtacataaagtaagtggaaagtttcatgctacagaacatgccttagttgtgacaccatgtgatgatatagataaaaattggttagattacaaactaaaagagatgaacttaaatcaatatgcaacaggtgccgcacaaccaggtctttcagtaaaaaatcttataaatatttctgtatcagtaccttcattagatgagcaaaaaaagatagttactcaaatagaggcaatagaacaacaaatagaaataaaagagaatgaaatagcaaatatacctaaacaaaaagaggatatattaaataaatatttgaaataa

SEQ ID NO: 17060 - protein, 158 aa, Unknown
  Obtained from environmental sample
  DOMAIN (4)...(133): Type I restriction modification DNA specificity domain
  misc_feature (1)..(158): Xaa is any amino acid
MKAGSFVAASDISDEKDTDNYPCYGGNGLRGYTKTFTHEGTYSLVGRQGALCGNVHKVSGKFHATEHALVVTPCDDIDKNWLDYKLKEMNLNQYATGAAQPGLSVKNLINISVSVPSLDEQKKIVTQIEAIEQQIEIKENEIANIPKQKEDILNKYLK

SEQ ID NO: 17061 - DNA, 810 bp, Unknown
  Obtained from environmental sample
  misc_feature (1)..(810): n is a, c, g, or t
ttgtatatctatggaaaccgtcagtggaagatgggaactattagcaaggctgaaccatttaagcagatacctcttacttatgagagagcttttggtggagagagttacgataaaaatcctttaggcagaggttatggagatagtgactcacttccaaatatagaaaatcccaaacatttaatagccactaaaaaagagtctgtaaatcctgcaggttttatgccttatgatatctcatggcctcagtgtgcaagtaaactcggcacttatgacgataagtggaaaagagatctatggcctgggtttgcagcaaatatggactacagctattttaatcgtgctccagatgatcaacaattagatagtttttttgaaggtggtgagaacatagagcttataaatatgcatccagagcatcaacttataatttctactatacctgagatgaatataaggtgttttgcaacttctatagaaaaagatgaagaagaaaagtttcaagagatagttatgaagagagatactctttggctatttcctgaaatccaaagaggaattgtcatctttagaggtaccatagagatagaagatgaggaatacactaaccttaaatacttaaatcttaaggccttaagagctgatgagactccaaaacctctcggtgaacagtatgaactgcaaaaaaaagagttaaatagaagtgctgagatagacaaagcttctatgcaagaagcacaagcaaaaatcaaagaggctaagaaaaagatttttgatatacctaggcaggtcanagaatcagacctccaagca

SEQ ID NO: 17062 - protein, 270 aa, Unknown
  Obtained from environmental sample
  misc_feature (1)..(270): Xaa is any amino acid
MYIYGNRQWKMGTISKAEPFKQIPLTYERAFGGESYDKNPLGRGYGDSDSLPNIENPKHLIATKKESVNPAGFMPYDISWPQCASKLGTYDDKWKRDLWPGFAANMDYSYFNRAPDDQQLDSFFEGGENIELINMHPEHQLIISTIPEMNIRCFATSIEKDEEEKFQEIVMKRDTLWLFPEIQRGIVIFRGTIEIEDEEYTNLKYLNLKALRADETPKPLGEQYELQKKELNRSAEIDKASMQEAQAKIKEAKKKIFDIPRQVXESDLQA

SEQ ID NO: 17063 - DNA, 579 bp, Unknown
  Obtained from environmental sample
  misc_feature (1)..(579): n is a, c, g, or t
gtgtacggccctggccctatggcagaggccattgaccgtctttctgactcaaacctgtttggctccatccatgtgccggacccggtaaaaacacccaaaggtgttaaggtccggtttgagttggttccctacgggcgaattaaggatatcaaaatttacaatgcgtttcccatgtttgaaaaggaagtgctcaatgtcatgaccctttacaatggagatgcctttttagaagagattctcggggagcaggaggaacgggtggtcaccctgttcaaaaaacagggatttattgatcccaatgttgtcctgtctgccaaaaaagaggagggtgatggaaactatgtggtgtcggtggatattgacaagggagcgtttctccgggtgaatgaggtgcagatcaaggggaatgcccagatttcttcatcccggttgaaaataaggattaaaacctggaaagcctctgtcctgttcggcagcgccggtcgattttatcagaaggagctggacgagaatgtaaaaattttatccncttttatcggaaaaaagggtttgccaatgccgtttgttaccgcaaaatga

SEQ ID NO: 17064 - protein, 192 aa, Unknown
  Obtained from environmental sample
  misc_feature (1)..(192): Xaa is any amino acid
MYGPGPMAEAIDRLSDSNLFGSIHVPDPVKTPKGVKVRFELVPYGRIKDIKIYNAFPMFEKEVLNVMTLYNGDAFLEEILGEQEERVVTLFKKQGFIDPNVVLSAKKEEGDGNYVVSVDIDKGAFLRVNEVQIKGNAQISSSRLKIRIKTWKASVLFGSAGRFYQKELDENVKILSXFIGKKGLPMPFVTAK

SEQ ID NO: 17065 - DNA, 780 bp, Unknown
  Obtained from environmental sample
  misc_feature (1)..(780): n is a, c, g, or t
atgaagcactttcttctttgtagcgtcttgcttcttggtgttcttgatgcacaggagttggatttagacccttatatatcaggacttaaacataaagagttcaattatgattatgagaagtctgttcttgaaaagaagaaattgcgggactcgtggatacagcccctgcaattgcgctatagcatctccaaaagcaacccgtataatgagcaggacgcttcttcgcagcagacgcaaaatgctgccattgtcatggatcagcctattttcaaaagcggcgggatctattacgggataaagtttgctcaggcctcgtatgagtataacaaatacagcatcgatgtagccaagcgaaaactgatcaaagaagcggtgcagctgctgatacagatcaaacaaaatgaacttaacctgcacaaacaagagcttcagatagacaactctcgcatcaatcttgaactcaaacaggaacaatacctgaacggtcagcttgactcggggtttctcaacaatgctgttatcgagaaaaacaaggtgacacaggtgctttttgatcttcagacaaaccatgaacgtctgatatctcagtttgagtcgatcagcgatcttgactataaagaagcgacgactccgcatcttcggttggtgagctcggaacagtttttggaacacaatattgatgtcaaacagcttcaaagtgaaggtgagagaaacctctacaataaaaatgtcaccatagctaaatatcttccgacagtaagccttaccgcccgggtataa

SEQ ID NO: 17066 - protein, 259 aa, Unknown
  Obtained from environmental sample
  SIGNAL (1)...(17)
  misc_feature (1)..(259): Xaa is any amino acid
MKHFLLCSVLLLGVLDAQELDLDPYISGLKHKEFNYDYEKSVLEKKKLRDSWIQPLQLRYSISKSNPYNEQDASSQQTQNAAIVMDQPIFKSGGIYYGIKFAQASYEYNKYSIDVAKRKLIKEAVQLLIQIKQNELNLHKQELQIDNSRINLELKQEQYLNGQLDSGFLNNAVIEKNKVTQVLFDLQTNHERLISQFESISDLDYKEATTPHLRLVSSEQFLEHNIDVKQLQSEGERNLYNKNVTIAKYLPTVSLTARV

SEQ ID NO: 17067 - DNA, 465 bp, Unknown
  Obtained from environmental sample
  misc_feature (1)..(465): n is a, c, g, or t
atggtagaagatgatatttcaatattaaaaagtggacctcaattaacatttacattaagagaaggtctctttaatcttgaattgatagaacaaaatcatcctgatgctaaaaaaaatgaattatcaaattttagagatactctggaaaaagttatgttttctcaacccaacttttgggaaaaacattatcatggagatgacgctgaattaaaatattcttgtgcttttagttttagtgatagaagtagatattatctatcaaataatgaaataaaaaattctattgaaaagcttttagaaaatttaacaaaatggggaattccattacctttattgattcaatttttaccaatgcaatataaaaaagttactgaatgttctttggaaaataatccaaaagtaattttattagatttaattgtagatgttttagaatgttatcatagagccactagagtaatttaa

SEQ ID NO: 17068 - protein, 154 aa, Unknown
  Obtained from environmental sample
  misc_feature (1)..(154): Xaa is any amino acid
MVEDDISILKSGPQLTFTLREGLFNLELIEQNHPDAKKNELSNFRDTLEKVMFSQPNFWEKHYHGDDAELKYSCAFSFSDRSRYYLSNNEIKNSIEKLLENLTKWGIPLPLLIQFLPMQYKKVTECSLENNPKVILLDLIVDVLECYHRATRVI

SEQ ID NO: 17069 - DNA, 876 bp, Unknown
  Obtained from environmental sample
  misc_feature (1)..(876): n is a, c, g, or t
atgacaattactgaaaaagaaatttactctcaacccgaggctttggaccaaacatttgaatatttaattgaacaaaaagaatatataaaagaaactatattaaattttaaaaaaactaaaattatattttttggatgtggttctagttatatgctagctaaaactgcaaaagatctatttaaccgtgatggtaaatggcaaacctttgcaattgctggaggagattatattgtttctccacaagagtatagcgaaattttaaaagatagtattgttgtttttttaacaagatctgggttaaccactgagattttaaaagctgcaaaatatattagtaaaaatgatgatgttgatattatatcaataactatggaagaaaaaaacgggttaaaagaattctcaaaaattaaccttattatgccatgggcctatgattatagtgtttgtcaaacaagaactgtaactaatttctatgtttctttattattattacattcctttttaaataataacaatgacctaataacagagataaaagaagctatagaatatcaaaaagtatttccaaaggacttcagaaagcaagcaattaaaattgccaaacaagattttagcaatgtaattgttttagctgatggcgttttagaaggcttagctgaagaaggttctttagtatttactgaaatagcaatgattagaggtcaatattttcatttactagattatcgtcatggacctaaagtattaaatgattcaacatcattaaatattgttattctaagaccaaatgaacaaaattatcaaaatgcaatggtgaaagatttgaaaggtatgaatagtactttagttactgtaagtagtgaaaaagtagaatga

SEQ ID NO: 17070 - protein, 291 aa, Unknown
  Obtained from environmental sample
  DOMAIN (31)...(165): SIS domain
  misc_feature (1)..(291): Xaa is any amino acid
MTITEKEIYSQPEALDQTFEYLIEQKEYIKETILNFKKTKIIFFGCGSSYMLAKTAKDLFNRDGKWQTFAIAGGDYIVSPQEYSEILKDSIVVFLTRSGLTTEILKAAKYISKNDDVDIISITMEEKNGLKEFSKINLIMPWAYDYSVCQTRTVTNFYVSLLLLHSFLNNNNDLITEIKEAIEYQKVFPKDFRKQAIKIAKQDFSNVIVLADGVLEGLAEEGSLVFTEIAMIRGQYFHLLDYRHGPKVLNDSTSLNIVILRPNEQNYQNAMVKDLKGMNSTLVTVSSEKVE

SEQ ID NO: 17071 - DNA, 495 bp, Unknown
  Obtained from environmental sample
  misc_feature (1)..(495): n is a, c, g, or t
atgtctgcgcgcatattagataccgaaaataaaaaatacctgcttgccgttacccaggatgtcacagaattcaaagaaaatgaaaagaaacggatcgaccttgaaaatcgtctacaacaagctcaaaagatggaatccataggtaccctgacaggcggtattgcccatgattttaataatttgctctatatgattgttggaaacacggaaatggcacttgaagacattccaaagtggaatccagcatatacaaaccttgaagagatcaaatcagccagccatagggcagcaggtattgtaaaacaactacttacctttagccgcaagacggatcaaaaactgatgcccatagaagctgtgacagttattaaggactccttaaaatttttgcggtcaactatccccaccaccatagaaataatagaacacatgccggacgatgacatagtgattctttctgattcaacccagatcaatcaaataatgatgaaacct

SEQ ID NO: 17072 - protein, 165 aa, Unknown
  Obtained from environmental sample
  DOMAIN (46)...(112): His Kinase A (phosphoacceptor) domain
  misc_feature (1)..(165): Xaa is any amino acid
MSARILDTENKKYLLAVTQDVTEFKENEKKRIDLENRLQQAQKMESIGTLTGGIAHDFNNLLYMIVGNTEMALEDIPKWNPAYTNLEEIKSASHRAAGIVKQLLTFSRKTDQKLMPIEAVTVIKDSLKFLRSTIPTTIEIIEHMPDDDIVILSDSTQINQIMMKP

SEQ ID NO: 17073 - DNA, 615 bp, Unknown
  Obtained from environmental sample
  misc_feature (1)..(615): n is a, c, g, or t
gttatactcgctattgcaggacttgaatctggatatggaagtggttatgtatctaaaataactggaaatatactaagccttggtgcaaataaaaatgacatacaattaccagcactcactatcccttattgcaaaacagacaaaaataaaaaagcattatttgatccaaaagagcaaaagaaatgtcaagaacttatctggaaaaaaagaccaaaaagtttaaaaaaagattatagacccaaaaatattgcaggtaaaactacaaatttagagttttttaaatataacccaaatcaatttaaaaaagcaaaactacaatctgtggatgattttttaactaaatggctaagagaaaaccacaaatatgcaccatttagagaaacaaaattatggctagaaaataaagtagcaaaagaaggtatcgatacactttttacacttgaaacaaatctagagtttgcttcaaaaataggtggaagagataactcttttaactatagagatacttggcctaaaaaagtaaaatatattctcaaaaaaacaggcttaacagagctttgttcaactatatattataaaaaagttccatttaatattgcatggaaacaacactaa

SEQ ID NO: 17074 - protein, 204 aa, Unknown
  Obtained from environmental sample
  misc_feature (1)..(204): Xaa is any amino acid
MILAIAGLESGYGSGYVSKITGNILSLGANKNDIQLPALTIPYCKTDKNKKALFDPKEQKKCQELIWKKRPKSLKKDYRPKNIAGKTTNLEFFKYNPNQFKKAKLQSVDDFLTKWLRENHKYAPFRETKLWLENKVAKEGIDTLFTLETNLEFASKIGGRDNSFNYRDTWPKKVKYILKKTGLTELCSTIYYKKVPFNIAWKQH

SEQ ID NO: 17075 - DNA, 723 bp, Unknown
  Obtained from environmental sample
  misc_feature (1)..(723): n is a, c, g, or t
atgctacacaccacaagcagtaaagaagaagtagttcggctatccaaaacttggaaacttgctggactaattcttgtatgggtgcccaagaatattggggaaattatttttaacaatgttgaaagccctgtagtatttattgactctcattttaatgatgaagaaaaaaaatatcataatattggactccaagatgaacagggaggatatttaataactcgctatctcatatctatgggacacaccaatgtagtatttcttgctaatgatatactttttactggtactgacttaaatcgttttaaaggatgtcaaaaggcttttgaacaagaaggactaacctttgatgaaaataaacatataccactacccaaagaaagaagtgaaagatataaaatatatacacaattcaccaaaaaagacaacaaatacaccgctcttatcttctcctctgattactatgcaactgaagcaatgagtttcttacaggattgtggaattaatataccccaggatatctctgtaacaggttttgatgataatatctttgctcgtataattcgtccccaccttacaacgattcatcaaaatcctagtgagaaaggaaaagttgcagtatcgatgctcatgaaacttattcaaaagaaaaccatagaagaaccaaatgtaaaattaaaggtggaactcaaaattcgagactcagtgaaaaatattaacaagtaa

SEQ ID NO: 17076 - protein, 240 aa, Unknown
  Obtained from environmental sample
  misc_feature (1)..(240): Xaa is any amino acid
MLHTTSSKEEVVRLSKTWKLAGLILVWVPKNIGEIIFNNVESPVVFIDSHFNDEEKKYHNIGLQDEQGGYLITRYLISMGHTNVVFLANDILFTGTDLNRFKGCQKAFEQEGLTFDENKHIPLPKERSERYKIYTQFTKKDNKYTALIFSSDYYATEAMSFLQDCGINIPQDISVTGFDDNIFARIIRPHLTTIHQNPSEKGKVAVSMLMKLIQKKTIEEPNVKLKVELKIRDSVKNINK

SEQ ID NO: 17077 - DNA, 585 bp, Unknown
  Obtained from environmental sample
  misc_feature (1)..(585): n is a, c, g, or t
atgctgccaattggttggaggctcattaatatttttaactacccaatgaaaatatttgctgagacagaaagactaatacttagagaaattcttcctacagatattgaaggactgtttgaactcgactctgatcctgaagtgcataaatatttaggaaataaacccgtaaaggataaaaaacaaattgctgatattataaattttatacgtcaacaatatattgacaacggcataggtcgttgggctattattgataaagaaacgaaccattttatgggttggacaggactaaaatttgttactgaagaaataaataaacacaaaaactaccacgaccttggatacaggttaatccaaaaatattggggcaaaggcttcgcaacagaaagtgcaatagcttcattaaattatggttttagtacattaaatttaaatgaaatttatgccgcagccgatatagataacatcggttccaacaaaattttaacaaaactggggtttaattttatcgagagatttacctatgatggagccatccataattggtataaaattgaaaaaagtacttggatagacaaaaagtaa

SEQ ID NO: 17078 - protein, 194 aa, Unknown
  Obtained from environmental sample
  DOMAIN (83)...(168): Acetyltransferase (GNAT) family
  misc_feature (1)..(194): Xaa is any amino acid
MLPIGWRLINIFNYPMKIFAETERLILREILPTDIEGLFELDSDPEVHKYLGNKPVKDKKQIADIINFIRQQYIDNGIGRWAIIDKETNHFMGWTGLKFVTEEINKHKNYHDLGYRLIQKYWGKGFATESAIASLNYGFSTLNLNEIYAAADIDNIGSNKILTKLGFNFIERFTYDGAIHNWYKIEKSTWIDKK

SEQ ID NO: 17079 - DNA, 525 bp, Unknown
  Obtained from environmental sample
  misc_feature (1)..(525): n is a, c, g, or t
atgccacgaatcgatagtgaaaaattttatacttcagctataaatatgcacggggtaaccgctaaaggtgtaaactggaactcaaaagaatctcagcacatcagatttaatatcatcttaaaaatgcttccgaaagacctctcatcacttaccttagtagatgctggttgtggttttggagacttgtacctttatactgaaaaaaagaagagtactcctaaaaaatatattggtatagatgctgtgattgatatgtactccatagcatctgaacgaactggttgtgaaataattatcgctgatatttgtaaagatgaactccatcgtgcttcttactatgtttgcagtggtgctatgaacgtactaaatacttttgaaacacatctttttatgcgcaattgttacgaagcatctgagaaaggatttattttncatatcctacatggaaccaaggagagtgagactttacactacctaacaacatcccaaataagacgtatggcatctgagcttggaggtaaagat

SEQ ID NO: 17080 - protein, 175 aa, Unknown
  Obtained from environmental sample
  misc_feature (1)..(175): Xaa is any amino acid
MPRIDSEKFYTSAINMHGVTAKGVNWNSKESQHIRFNIILKMLPKDLSSLTLVDAGCGFGDLYLYTEKKKSTPKKYIGIDAVIDMYSIASERTGCEIIIADICKDELHRASYYVCSGAMNVLNTFETHLFMRNCYEASEKGFIXHILHGTKESETLHYLTTSQIRRMASELGGKD

SEQ ID NO: 17081 - DNA, 486 bp, Unknown
  Obtained from environmental sample
  misc_feature (1)..(486): n is a, c, g, or t
atggctgggacgttcgttgtgaaatgcaataaatttttagtttgtcgtgccggttggatgatgggctcaggccctaagaaggataaaaagtttatacaaaaaatcatgcaacaaattaaagcaggtaaaaaggagctctttattgtcaatgataaagatggcacaccaacttatacacaagattttgcaaaaaatgtaaaactcttaattgagaaagaatactgggggttatataatatggtttgtgggggagagacttcacggtttgaagtagctcaagaacttataaatatacttggcaagcaaaacgaaattaaaataacagaagtcacatctgactattttgccaaagaatattatgcagatcgtcctccttgtgaaagattgtataatcgcaaacttaatatcagaggtttaaatattatgcgtgattggaaagtagcattgaaagaatacattgacaattattatcagaactacttgtaa

SEQ ID NO: 17082 - protein, 161 aa, Unknown
  Obtained from environmental sample
  DOMAIN (10)...(149): RmlD substrate binding domain
  misc_feature (1)..(161): Xaa is any amino acid
MAGTFVVKCNKFLVCRAGWMMGSGPKKDKKFIQKIMQQIKAGKKELFIVNDKDGTPTYTQDFAKNVKLLIEKEYWGLYNMVCGGETSRFEVAQELINILGKQNEIKITEVTSDYFAKEYYADRPPCERLYNRKLNIRGLNIMRDWKVALKEYIDNYYQNYL

SEQ ID NO: 17083 - DNA, 402 bp, Unknown
  Obtained from environmental sample
  misc_feature (1)..(402): n is a, c, g, or t
atggaaaaaaaacgaaaggttgcaattattggcactgtaggcctgcctgccaattatggcggtttcgaaaccatgatcaaatatttaacattacaaaaaaataaagatcttgatattactgtatactgccaaaaaacgccaaaagaaaagcaattaaaagaatataatgggtgtaaacttgtttatcttccatttctagctaatggtccacaaagtattatttacgatattacagcaataataatcagttggtttaagttcgattctttactaattttaggaacacctggttgtatcattctgcctattatgcgaatcttcaagaaaagcagaacgattgtcatttttggtggtttggaatgggcaagagataaatggggcgctttaggtaaaaatacctga

SEQ ID NO: 17084 - protein, 133 aa, Unknown
  Obtained from environmental sample
  misc_feature (1)..(133): Xaa is any amino acid
MEKKRKVAIIGTVGLPANYGGFETMIKYLTLQKNKDLDITVYCQKTPKEKQLKEYNGCKLVYLPFLANGPQSIIYDITAIIISWFKFDSLLILGTPGCIILPIMRIFKKSRTIVIFGGLEWARDKWGALGKNT

SEQ ID NO: 17085 - DNA, 834 bp, Unknown
  Obtained from environmental sample
  misc_feature (1)..(834): n is a, c, g, or t
ttgcctctttttccaaatgctatcgagagttttgatttaagtagttatgatttgattattagcagttcttgggcagttgctaagggaattagaaaaaataaaaaacagcttcacatttgctattgtcatacacccatgcgatacgcttggaatttgtatgatgaatatacttcaagcttaatgggactaaaaaagttgttagtacaagtaactttaaaaagattaaaaaaatgggatattgatactcttgatagagttgattattttatagctaattccaattttgttcaagagagaataagaagaatatataaaagagattctgttgttatataccctcctgttgatgtcaagaaatttacgctaaatgaggcaaaagaagatttttacttaacagtttcaagactcgtaccttacaaaaaaactaaacttatagtagaaacatttaataatatgccaaacaaaaaactcttagtaattggtgatggagaagaatatgataagattaaaaaaattgcaaaatcaaatatagaagttttaggttatcaaaatgatgatgtattaaaaagtacaatgcaaaatgcaaaagcttttgtttatgctgcagtagaagactttggtatagttcccatagaagctatggcatgtggaacacctgtgatagcactagataatggtggtacacacgagacagtatctcacaaattaaatggtatccattttaaagaacagactgtaaatgatttagtagatgctgtaacagagtttgaatcattagtgtttaatgcaaaagatatatctgaaaaagcacaaacttttcaacagagagattaa

SEQ ID NO: 17086 - protein, 277 aa, Unknown
  Obtained from environmental sample
  DOMAIN (115)...(273): Glycosyl transferases group 1
  misc_feature (1)..(277): Xaa is any amino acid
MPLFPNAIESFDLSSYDLIISSSWAVAKGIRKNKKQLHICYCHTPMRYAWNLYDEYTSSLMGLKKLLVQVTLKRLKKWDIDTLDRVDYFIANSNFVQERIRRIYKRDSVVIYPPVDVKKFTLNEAKEDFYLTVSRLVPYKKTKLIVETFNNMPNKKLLVIGDGEEYDKIKKIAKSNIEVLGYQNDDVLKSTMQNAKAFVYAAVEDFGIVPIEAMACGTPVIALDNGGTHETVSHKLNGIHFKEQTVNDLVDAVTEFESLVFNAKDISEKAQTFQQRD

SEQ ID NO: 17087 - DNA, 564 bp, Unknown
  Obtained from environmental sample
  misc_feature (1)..(564): n is a, c, g, or t
atgcacaaaaaactacttataaatgcttttgacaaagccgaagaagaaattagttccgataaagtatttccaagagcacgattgctttctgattttatagttaatgatagtaaagaaccttatggtgaaaaaatcttaagtttaaaatataagtccattttaaatgaatcaacagaaacaatccgcttaaagaaacatgcagcagattcactaagtcgttatttgggatatgaaaattatctagaatatgttagaaaaaacggatcgcaagatccagtagaagagcataagcctaatttctcanaataccgaaacgcaattataattaccattatattgatttcacttgctagcataaccacttataactatgcaacgagacagcgttggatgatatggaatgaagatcattatgtagaagtaaattttgatgtcaataagtataatgtcaatctgataaaaatttttaaagaggagcgtatagaatttttcaaaaaagtgacacttaagtgtgaagatcaattctttaatgataacggtgtggtaagaatttggatggtaaag

SEQ ID NO: 17088 - protein, 188 aa, Unknown
  Obtained from environmental sample
  misc_feature (1)..(188): Xaa is any amino acid
MHKKLLINAFDKAEEEISSDKVFPRARLLSDFIVNDSKEPYGEKILSLKYKSILNESTETIRLKKHAADSLSRYLGYENYLEYVRKNGSQDPVEEHKPNFSXYRNAIIITIILISLASITTYNYATRQRWMIWNEDHYVEVNFDVNKYNVNLIKIFKEERIEFFKKVTLKCEDQFFNDNGVVRIWMVK

SEQ ID NO: 17089 - DNA, 792 bp, Unknown
  Obtained from environmental sample
  misc_feature (1)..(792): n is a, c, g, or t
gtggaacaggatggcaaaaaagtgcatcaggttagtagtgatatcttatccatctcagcttctgcagagttcgctccatctcttttctccctaaaactaaagggacaggagtggctggatacatcttttccaactccgggacctaaaagttggtggaaaccgtggattggtggaatttatacaacacctgaacacatcgcgatgaattctattcttaaggaaaaatataaagtatattttgttaagaagagtgataacttcgggaacgaatgggaagggatttccattaagatgaagattgaggagtccgaaaagtataaaggtttaatttttgagcaacttttcctgattcaagctggcgttcctgtgcttctgcatacaaccagaatctggcaaaatacaggtagattgttcaagggagaaccattcgaaaccggtcacttcattaagcctgaggttgatatcaaggattgcagctttatctctaaaaacagagtgggcgaaacgatggtgcacaaagctggtattcgtgccacggattacagtccgaaaagccaaattgttttcgctggcgagaaccaagctgattatctgcaggttttcacaccaggtcgcaaaacttggaagtggctctgtcctgacctgttcgtgatgaatgcctggattggtgacaacatcaccagtgaagcaggagaagagagatatctccccaatcgcttctatatcttcaccgatgaaattctggaagatgccatgatgcaggatctgaagaatataaagtttgaaatataa

SEQ ID NO: 17090 - protein, 263 aa, Unknown
  Obtained from environmental sample
  misc_feature (1)..(263): Xaa is any amino acid
MEQDGKKVHQVSSDILSISASAEFAPSLFSLKLKGQEWLDTSFPTPGPKSWWKPWIGGIYTTPEHIAMNSILKEKYKVYFVKKSDNFGNEWEGISIKMKIEESEKYKGLIFEQLFLIQAGVPVLLHTTRIWQNTGRLFKGEPFETGHFIKPEVDIKDCSFISKNRVGETMVHKAGIRATDYSPKSQIVFAGENQADYLQVFTPGRKTWKWLCPDLFVMNAWIGDNITSEAGEERYLPNRFYIFTDEILEDAMMQDLKNIKFEI

SEQ ID NO: 17091 - DNA, 645 bp, Unknown
  Obtained from environmental sample
  misc_feature (1)..(645): n is a, c, g, or t
atgatcggggaaaggctaagtgctggagtacaaatgaagttcctgttttcgaatttagaacagtatagtgcttttggtttgggactggatcttggactaagctatcatattgaagaagagtatttgaccgcttcttttgttatgaaaaatattggatatcaaatgacttcctattatgataatggcgacaaatctaatttgccttttaatattcagttaggagtatcaaagagaatgaagcatgcaccattcaggctttcactggttttagataaccttcagaaatgggatctgacttatatagaccctaacctaattggtaaaagggatccgcttacaggagaccctattgagattaaaccaagttcttttggtgataaattaatgaggcatgtaattttcggaggtgagattcttatcggtgaaacaattcaaattcagttagcttataattatagaagacgaaaggaattgaaattaataaatagcccagggatgtcgggtttgtctttcggtgtaggagcaaagatcaaatccgtaaatgtaaattatgccttttccaattatacccgagctgcaaattcacatcagtttaccctatctcttcgatttaatgacatgaagaaggaaaaaacgttaaattag

SEQ ID NO: 17092 - protein, 214 aa, Unknown
  Obtained from environmental sample
  misc_feature (1)..(214): Xaa is any amino acid
MIGERLSAGVQMKFLFSNLEQYSAFGLGLDLGLSYHIEEEYLTASFVMKNIGYQMTSYYDNGDKSNLPFNIQLGVSKRMKHAPFRLSLVLDNLQKWDLTYIDPNLIGKRDPLTGDPIEIKPSSFGDKLMRHVIFGGEILIGETIQIQLAYNYRRRKELKLINSPGMSGLSFGVGAKIKSVNVNYAFSNYTRAANSHQFTLSLRFNDMKKEKTLN

SEQ ID NO: 17093 - DNA, 609 bp, Unknown
  Obtained from environmental sample
  misc_feature (1)..(609): n is a, c, g, or t
ttggttgcaatagttgattataatatgggaaatttagcaagtgtttataatgcttgtaagctaatagatgcagatgctacaatagtaaaagacccaactaaattaaaagattttaatagaataatacttccaggtgttggtgcttttggagatgctatggaacatttaaaatctacagggatgtacgatgcagtaaaagagtttgcatctagtggaaaaccaattattggtatctgtttaggtatgcaattattatttgaaagtagtgaagagtttggcgatacacaaggtttaggactaattcctgggaaagttgtaccatttgataaatcaagaatggatatggatgaccacaaagtaccacatgtgggctggaataagatattcaataaaccaaataaactttttgaaggattggaaaatccatatctgtattttgtacattcatttcatgcggtaacagaagaaaaatatactattggtacaacacattatggatatgattttgtaagtgcagtacaaaaagataatatctacggatttcaaccacatccagaaaaatcacacgataatgggatacagatattaaaaaactttatgaaattataa

SEQ ID NO: 17094 - protein, 202 aa, Unknown
  Obtained from environmental sample
  DOMAIN (31)...(159): CobB/CobQ-like glutamine amidotransferase domain
  misc_feature (1)..(202): Xaa is any amino acid
MVAIVDYNMGNLASVYNACKLIDADATIVKDPTKLKDFNRIILPGVGAFGDAMEHLKSTGMYDAVKEFASSGKPIIGICLGMQLLFESSEEFGDTQGLGLIPGKVVPFDKSRMDMDDHKVPHVGWNKIFNKPNKLFEGLENPYLYFVHSFHAVTEEKYTIGTTHYGYDFVSAVQKDNIYGFQPHPEKSHDNGIQILKNFMKL

SEQ ID NO: 17095 - DNA, 639 bp, Unknown
  Obtained from environmental sample
  misc_feature (1)..(639): n is a, c, g, or t
ttgattttttcgtcgggtgcgggagtttatgattggaaaaataagaaactaattcattctcaatttattcctaagattgaagtaaaacaaatttcagaaattctgataaatcactctgtagattttatgattcatgagataattcctgagaaccataaatttgtttatcacagaacaggaaatcataatcctgattttgagcgaagaattaaggtttataatgattttgctgttaagcttgatctaaaatcagaagaatacaaacatgcatgtcagattattgctgtgtttccgaataacattaatctctttgatgaaataaaacaaaaatttagtgatataaagattattcgaacaacctcgccccttgatggagattctatttggatggagatttttcctgagaaagtttcaaaagcttatggaatagattggttatgtaacaaattaaaaattgatagcaacaaaacaattagtgttggcaatgattataacgatattgatatgcttgaatatactgccaagaaatttatagtaagtaatgctcctgaggatttaaaagaaatgtttcctatttgcaaaagtaatcaggaaagtggatttactgatgttgcatcacagttttttgatattttttga

SEQ ID NO: 17096 - protein, 212 aa, Unknown
  Obtained from environmental sample
  misc_feature (1)..(212): Xaa is any amino acid
MIFSSGAGVYDWKNKKLIHSQFIPKIEVKQISEILINHSVDFMIHEIIPENHKFVYHRTGNHNPDFERRIKVYNDFAVKLDLKSEEYKHACQIIAVFPNNINLFDEIKQKFSDIKIIRTTSPLDGDSIWMEIFPEKVSKAYGIDWLCNKLKIDSNKTISVGNDYNDIDMLEYTAKKFIVSNAPEDLKEMFPICKSNQESGFTDVASQFFDIF

SEQ ID NO: 17097 - DNA, 561 bp, Unknown
  Obtained from environmental sample
  misc_feature (1)..(561): n is a, c, g, or t
atgacatttgaagaaaaaataaaaaacaatataagattaaactatgaagatgcaataaaactttatgatatggatttattacaattaggagagatggcctcaaaaatacgggaagataaatttggaagaaaaacctactataatgtaaatcgacatataaatccaacaaacatttgtaaagatgtatgtcaattttgtgcttatagtgcaagtagaaaaaatcctaatcaatatacaatgacccacaacgagattttagatacagttgataatagtgtaaaaaatgggataaaagaggtacatatagtttctgcacacaatcctaacactggtcttgaatggtaccttgaagtatttaaaaaaattaaagacaaatatccatcacttcatgtcaaagcactcaccgctgctgaaattcattttttaagtgaggaatataacaagtcttatgaagagataatcaaccttatgattgattatggtgtagattctatgccaggtggtggtgcagaaatctttgatgaaagaggtgagaaaagagagtttgtggagggaaagtaa

SEQ ID NO: 17098 - protein, 186 aa, Unknown
  Obtained from environmental sample
  misc_feature (1)..(186): Xaa is any amino acid
MTFEEKIKNNIRLNYEDAIKLYDMDLLQLGEMASKIREDKFGRKTYYNVNRHINPTNICKDVCQFCAYSASRKNPNQYTMTHNEILDTVDNSVKNGIKEVHIVSAHNPNTGLEWYLEVFKKIKDKYPSLHVKALTAAEIHFLSEEYNKSYEEIINLMIDYGVDSMPGGGAEIFDERGEKREFVEGK

SEQ ID NO: 17099 - DNA, 753 bp, Unknown
  Obtained from environmental sample
  misc_feature (1)..(753): n is a, c, g, or t
atgattaaaataaataacttacatgccagtattgatggtaaagaaatcttaaaaggaattaaccttgaagtaaaagccggtgaggtacacgctataatgggaccaaatggttcaggaaaaagtacattatctagtgttttagctggaagagaagaatatgaagttactgaaggttcagtagagtttgatggtaaagatttattggatttagctcctgaagatagagctagagagggattatttttggcttttcaatatccggtagaaattccgggagtaagcaacatcaactttctaaaaacagctattaacgaaaaaagagcttactttaaccaagagcctgtttctgctaaagagtttttagggatggtaaaagaaaaatctgcattagtagagttagattcaaaattggctaatcgttcggtaaacgaaggtttttctggtggtgagaaaaaaagaaacgaaattttccaaatggcaatgttaactccaaaactttccattttagatgaaactgattctggattagacattgatgcgttaagaattgttgccaatggcgtaaataaattgaaatcgccaaataatgctactattgttattacgcattatcaaagattgttagattatattgttcctgattttgtacatgtattatatgatggaaaaattgttaaatctggtggaaaagaattagcaatagaactagaagaaaaaggatatgattggataaaagatgagttaaaagtttaa

SEQ ID NO: 17100 - protein, 250 aa, Unknown
  Obtained from environmental sample
  DOMAIN (27)...(222): ABC transporter
  misc_feature (1)..(250): Xaa is any amino acid
MIKINNLHASIDGKEILKGINLEVKAGEVHAIMGPNGSGKSTLSSVLAGREEYEVTEGSVEFDGKDLLDLAPEDRAREGLFLAFQYPVEIPGVSNINFLKTAINEKRAYFNQEPVSAKEFLGMVKEKSALVELDSKLANRSVNEGFSGGEKKRNEIFQMAMLTPKLSILDETDSGLDIDALRIVANGVNKLKSPNNATIVITHYQRLLDYIVPDFVHVLYDGKIVKSGGKELAIELEEKGYDWIKDELKV

SEQ ID NO: 17101 - DNA, 879 bp, Unknown
  Obtained from environmental sample
  misc_feature (1)..(879): n is a, c, g, or t
gtgaaaagtatatttaaaagtcgtatatttgttatattattttttataattcttagttttacaatatatttcatcatcaattatttaaaaaacagtgaaatagatagatacaaaaaagacacatatagagagaaagttttagaatcaaaagtttatcttaatacacttatcaaagagaaagaaaatgccacatcaactatcgctttaggattatcacgaaatagtgatattattgctgctttaaaagatataaaaatcaatcctactttactcaaagattactcaaagcaactaaaaataaatactgattttaaaaatgtttggtttcaacttattacaaaagatgggatatcagtacagagaagttggacagagtataaaaatgataagataataacatcaagagtagatttacaaaaagtactcaaagataaaaaaatattgaacagtattagtgttggtaaatttgatatgacttttaagtctagtgttcctgtatttgatgaagataatacaacatttctaggtgttgttgaggtgataactcactttaattcaattgcaaaaaaactagaagaaaaaaaagtaaatacaattatactagcagataaacgctataaaaaacaactcacacacgcttttagtaagatatttattaatgattattatgtagcanacttagatgcgaaaaaatctttggtacactatcttcaaaaatatgggatagataactattttgacaatctgacagtagatgatttttatatagactataaccttaatagtatagtgagttattataaactaaatactcaatttcatgataaaacattaggacatattttacttttacaaagtattggaaaaaatagatattag

SEQ ID NO: 17102 - protein, 292 aa, Unknown
  Obtained from environmental sample
  misc_feature (1)..(292): Xaa is any amino acid
MKSIFKSRIFVILFFIILSFTIYFIINYLKNSEIDRYKKDTYREKVLESKVYLNTLIKEKENATSTIALGLSRNSDIIAALKDIKINPTLLKDYSKQLKINTDFKNVWFQLITKDGISVQRSWTEYKNDKIITSRVDLQKVLKDKKILNSISVGKFDMTFKSSVPVFDEDNTTFLGVVEVITHFNSIAKKLEEKKVNTIILADKRYKKQLTHAFSKIFINDYYVAXLDAKKSLVHYLQKYGIDNYFDNLTVDDFYIDYNLNSIVSYYKLNTQFHDKTLGHILLLQSIGKNRY

SEQ ID NO: 17103 - DNA, 795 bp, Unknown
  Obtained from environmental sample
  misc_feature (1)..(795): n is a, c, g, or t
atgtacgaaaattaccaaaatacaatgtgtgttgatcaagaggtgttctataagcatttaagcctaatgacataccatcagtttcaacatgcttgcagaaaagatagaaaaggtaatatatccttaacccgaattagaacaaaaggtagaggacgtacaggtttgattacatggaagtctatagacgaaacaatgaagcagttgatcatcaaagccttcggcaacccatacctcaaagatgatcgtgaaacgttcacaaatcaacttgctacagatcacgatgctattgagttttacaagcaataccaatacgaagatggtcgcggcataccaaacaacaaacaagcgcaatacatctgcgaagctgagatactaaacatttataattccattatagaaaactacgatgctaaagtaaagcagcaacgtagaaaatctaaaaaaggtgagcttaaaaagaaactatctacagttatcaacgatcttaaaaccgagtgctttccaaatacgacaactaaaaaatatccgcacaacctaccttctaatgtgcgtgcgctagacagaaaagctaacggttacagtaaagaaagttacgattttctagtccataaaaacgcaggtaataaagcggctcanaaaattaaaggcgacaatgctaaatggttactagcgcaattctcaatgccaaacaaaatagtagtaccggttttacattccatgtacaaccgtgaagctgctaaacgcaattggccagagttgagtgaatcggcaatatacaaatggttatacgagcct

SEQ ID NO: 17104 - protein, 265 aa, Unknown
  Obtained from environmental sample
  misc_feature (1)..(265): Xaa is any amino acid
MYENYQNTMCVDQEVFYKHLSLMTYHQFQHACRKDRKGNISLTRIRTKGRGRTGLITWKSIDETMKQLIIKAFGNPYLKDDRETFTNQLATDHDAIEFYKQYQYEDGRGIPNNKQAQYICEAEILNIYNSIIENYDAKVKQQRRKSKKGELKKKLSTVINDLKTECFPNTTTKKYPHNLPSNVRALDRKANGYSKESYDFLVHKNAGNKAAXKIKGDNAKWLLAQFSMPNKIVVPVLHSMYNREAAKRNWPELSESAIYKWLYEP

SEQ ID NO: 17105 - DNA, 885 bp, Unknown
  Obtained from environmental sample
  misc_feature (1)..(885): n is a, c, g, or t
atgaacgagataattcaaataaaaactattagtgaaatacatcgttttctgaacgtagaaaaaccattacacccattaatatcagtttgtaaacatataccagaaatgaatctggaaattacgaatgtaaaagtatcttttgatttctatatcatttctttaaagtcggatataaaaggaagtgtaaattatggaaggaacacctacgattttgaagaaggaacactgttgttttcagctccaggtcaggtatttaacattactaatgaaccaataatagacataaagggctggacgctttttattcatcctaaattactgtcaaaatctattcttcaccaaactattcagcaatacaacttcttttcttatgacgtgaatgaagcattacatatttcagaaaaagaaaaagtgattttaactgaattcgtaagtaatatcaacaatgaaatctctcaaaacctagaccgccatagccaagatttgattatacataatattgaatccatcttaaaatatagcgaacggttttacgatagacaatttttaactcgtacaaacaaaaacaaagattttataagtcagtttgagctatatctaaaaaattattttaattcagagagcatagcaagtattggaatgcctacaacagaacagtgtggaaaagcattgaatatgtctgggcattatttaagtgatttattaaaactagaaactggaaaaacaatcaaagaacatatccatttaaaactgatagataaagcaaaacaccaattactaaattctacgatttctgtaaaatcattagcctatgatttagggtttgaatatcctcaatactttagtagaatatttaaaaaccaaaacgggaatgagcccgagtga

SEQ ID NO: 17106 - protein, 294 aa, Unknown
  Obtained from environmental sample
  misc_feature (1)..(294): Xaa is any amino acid
MNEIIQIKTISEIHRFLNVEKPLHPLISVCKHIPEMNLEITNVKVSFDFYIISLKSDIKGSVNYGRNTYDFEEGTLLFSAPGQVFNITNEPIIDIKGWTLFIHPKLLSKSILHQTIQQYNFFSYDVNEALHISEKEKVILTEFVSNINNEISQNLDRHSQDLIIHNIESILKYSERFYDRQFLTRTNKNKDFISQFELYLKNYFNSESIASIGMPTTEQCGKALNMSGHYLSDLLKLETGKTIKEHIHLKLIDKAKHQLLNSTISVKSLAYDLGFEYPQYFSRIFKNQNGNEPE

SEQ ID NO: 17107 - DNA, 690 bp, Unknown
  Obtained from environmental sample
  misc_feature (1)..(690): n is a, c, g, or t
atggtgaaaattaaaatcacatatatnttagggattatatcgttgctttattcctgtaaatcaagtcagaattcaaatcctcaagagcagaatattgttaaggaggacacaattaagtcaaacgatacaatacaaccttctgaaacaaatgataataagatagtatataatgatactattgagttaataaaaacacttgaattaattaaaactgcagccaaaaacgaagactattctgcatttagcaatagtattcaccctcaatatggatgttatattatttatcgtcctggttctcaaggtaattatggtagaattgatagtttaacagaagatgtttatgacaaatatctcgtcgatattgataatctttttcgtgctcttacatcatcaacagtaaaatttgaggaatggccaatatatgtggattgtggatatgatggtttttcaaaagacggagcatacgctgaaaaaattgacgattttaaaggattaagcgaccttatttcagcagccaaagcatcattctacaatatagaaactaaggaagaacaagacagcattcataaatttgagagcctagtcaagtataaagtaatctggacagatccttctgtcataattacttttcttaaatctcaaaataagtggtatatcgcaactatggaggtagggtttgattgttcttga

SEQ ID NO: 17108 - protein, 229 aa, Unknown
  Obtained from environmental sample
  misc_feature (1)..(229): Xaa is any amino acid
MVKIKITYXLGIISLLYSCKSSQNSNPQEQNIVKEDTIKSNDTIQPSETNDNKIVYNDTIELIKTLELIKTAAKNEDYSAFSNSIHPQYGCYIIYRPGSQGNYGRIDSLTEDVYDKYLVDIDNLFRALTSSTVKFEEWPIYVDCGYDGFSKDGAYAEKIDDFKGLSDLISAAKASFYNIETKEEQDSIHKFESLVKYKVIWTDPSVIITFLKSQNKWYIATMEVGFDCS

SEQ ID NO: 17109 - DNA, 822 bp, Unknown
  Obtained from environmental sample
  misc_feature (1)..(822): n is a, c, g, or t
gtgaatcgcggatacactaaatctgaacttatcggtaagcctcactctatagtccgtcatccatcaatgcctagttcgatatttaaggaactttgggatgtaataaaagagaaacgtgcatggcatggtgtaatcacaaatatgaaaaaagatggacgtaagtatgtagtggactctacggtcatacctattttggatgttgatggagatatagtcgaatatattgctatacgacatgatgtaacagagtttgagcagacaaaagagcagctaggtacgctaaatcgtgctatgaaaaataaggtggatgagctatattccatgactgcaacattggaagaagaagcctctatagatgcattaacaggtgcatttaatcgttcaaaatttgagaaattttttgatcttgagatagagaaagctcagatgagccaaaatgtattgactatgatagtcttagatatagaccattttaaattaattaatgataattatggacatcacgttggtgatgatgttttaaaaaatatcgcatctcttgtgagtaaagctctaaaaaggacagatgtatttgctagatggggaggcgaagagtttgttgtacttctaccaggaactgatcttgaaggtgctgctattttagctgaaaagttaagaaaactgatcgaagagagtgatttttctattgcaggacagataacatccagttttggtgtaggtctgcataaagatgaagagaataaaaaagagttttttgagagagtggataagtttttatatgaggctaaaaagagtggtagaaatagagttgtatcagaataa

SEQ ID NO: 17110 - protein, 273 aa, Unknown
  Obtained from environmental sample
  DOMAIN (42)...(84): PAC motif
  misc_feature (1)..(273): Xaa is any amino acid
MNRGYTKSELIGKPHSIVRHPSMPSSIFKELWDVIKEKRAWHGVITNMKKDGRKYVVDSTVIPILDVDGDIVEYIAIRHDVTEFEQTKEQLGTLNRAMKNKVDELYSMTATLEEEASIDALTGAFNRSKFEKFFDLEIEKAQMSQNVLTMIVLDIDHFKLINDNYGHHVGDDVLKNIASLVSKALKRTDVFARWGGEEFVVLLPGTDLEGAAILAEKLRKLIEESDFSIAGQITSSFGVGLHKDEENKKEFFERVDKFLYEAKKSGRNRVVSE

SEQ ID NO: 17111 - DNA, 684 bp, Unknown
  Obtained from environmental sample
  misc_feature (1)..(684): n is a, c, g, or t
atgcttaatagctcaattagctcagcatatataaagttattcattttttcaacagaaactattaataaatattttaatcaactagattatattgatcaacttaaaaaatccaatgagatgaatcttcagtataaatctatgtatgagaaaaaagttcaagagatagttgaattaaataaaaatttgaatttgagtttagataaagaggtacagtatgaaaaagttaaagttttatcatattatagttttgataatcactcaaaagttcttatagataaaaacaatattgtaccagataaaatatatccacttattacacttgatggttttagtgcaggtatagttttaacaaaaaatgaaaaatcagttgcttatttaaatgaaaataaaaaatgtaattacacagtttttataggaaaaaatgatactcctggaattacctctggggcaaatgatgatggaaatataattataaaatatgtaccaatttggaaagagatagaaatgggtaatgaggtaattacaagtagtatggattctattttcccatatggagttaaagttgggactgtagtagatattcaagtatttgaaaatacaaaagaggttttagtaaaaccttatgcaaaaacattagggatgcgaaacttttttataacacacgatacaaactctagtatctag

SEQ ID NO: 17112 - protein, 227 aa, Unknown
  Obtained from environmental sample
  DOMAIN (75)...(224): rod shape-determining protein MreC
  misc_feature (1)..(227): Xaa is any amino acid
MLNSSISSAYIKLFIFSTETINKYFNQLDYIDQLKKSNEMNLQYKSMYEKKVQEIVELNKNLNLSLDKEVQYEKVKVLSYYSFDNHSKVLIDKNNIVPDKIYPLITLDGFSAGIVLTKNEKSVAYLNENKKCNYTVFIGKNDTPGITSGANDDGNIIIKYVPIWKEIEMGNEVITSSMDSIFPYGVKVGTVVDIQVFENTKEVLVKPYAKTLGMRNFFITHDTNSSI

SEQ ID NO: 17113 - DNA, 759 bp, Unknown
  Obtained from environmental sample
  misc_feature (1)..(759): n is a, c, g, or t
gtggctggtgaaattttttcaatagaaaaacatccgaacgcaacaaagttagtgatttgttctgtaaatatcgggaacgaagtaaaaacaatcatcactggtgatccaactgtgaaagttggtcatgttgttcccatagccattgataacgtcaaattattcaatggcaccataattaaaacttcagagttgagaggcgttagatccgagggtatgatgtgttcacttgaagaaatcggacttgaagaaaaatcaacagcggtatataaacttccaaacgacgtaaaagctggatgcaatctttatgaatatttcaatctggaagattccatattcgatttagaaataactgcaaataggccagatgagttatctatgattggtgtagcacgcgagttacaaacattattcagaggaaaagaaacaataaaattaccaaatacaaaatacaaagaatcagaagaaaaaacaaaggattcaattaacattatcatagacaaaccagaagaatgtacaagatacatgtcattggtacttagaaacattgaggttgcaaagtcaccattatggcttagaagacaccttgtttctattggtcttagacctatcaatgttatcgtagatgctacaaattttgtattgatggaaactggacatccggttcatgcttttgatttgaataaattgtcacaaccacaaattgtggtcagacacgcaaaaaaagaagaagaaatgttgcttctcaatggaagtaaatga

SEQ ID NO: 17114 - protein, 252 aa, Unknown
  Obtained from environmental sample
  DOMAIN (170)...(251): B3/4 domain
  misc_feature (1)..(252): Xaa is any amino acid
MAGEIFSIEKHPNATKLVICSVNIGNEVKTIITGDPTVKVGHVVPIAIDNVKLFNGTIIKTSELRGVRSEGMMCSLEEIGLEEKSTAVYKLPNDVKAGCNLYEYFNLEDSIFDLEITANRPDELSMIGVARELQTLFRGKETIKLPNTKYKESEEKTKDSINIIIDKPEECTRYMSLVLRNIEVAKSPLWLRRHLVSIGLRPINVIVDATNFVLMETGHPVHAFDLNKLSQPQIVVRHAKKEEEMLLLNGSK

SEQ ID NO: 17115 - DNA, 669 bp, Unknown
  Obtained from environmental sample
  misc_feature (1)..(669): n is a, c, g, or t
ttgatgagttcacgtcggctgataattaaaggtaataaaaccaccgactccgaagactatggttttttactcaattttatcacggaatcaacatttgaaaataatgacattaaagacgtttggactaaaccagaaaataaagtgttgggtcgagacggaaagggcttgtttgtttataactcaggttacaacaccattaaaaataatcgtgttgatacggctgaaattggtattcatttaaccgcgggctcagagaatatcaaaatttacggtaatagttttattaataatccggtacaagtgaaatatgtttccaataaaaaacaagagtggagctttgagggtcgaggcaattattggagtaattatttaggctgggatatgaatggcgataatattggtgatgttatttttgagccaaatgacggcattgatcagcttatttggcaatacccagaaatgaaaatgatcatggatagtccggtggtattgatattacgttggatacaaaaagagtttccggttttaaaaccgccaggcgttaaagatagctttccgctcatgcaaccatcagcagcgccaaagagagtaagtcagatcgcgtcatcgcttcaagtaagtgatgaacagtcagaagttcatgcgaataaggcaagtaaaccacaatga

SEQ ID NO: 17116 - protein, 222 aa, Unknown
  Obtained from environmental sample
  DOMAIN (1)...(188): Periplasmic copper-binding protein (NosD)
  misc_feature (1)..(222): Xaa is any amino acid
MMSSRRLIIKGNKTTDSEDYGFLLNFITESTFENNDIKDVWTKPENKVLGRDGKGLFVYNSGYNTIKNNRVDTAEIGIHLTAGSENIKIYGNSFINNPVQVKYVSNKKQEWSFEGRGNYWSNYLGWDMNGDNIGDVIFEPNDGIDQLIWQYPEMKMIMDSPVVLILRWIQKEFPVLKPPGVKDSFPLMQPSAAPKRVSQIASSLQVSDEQSEVHANKASKPQ

SEQ ID NO: 17117 - DNA, 552 bp, Unknown
  Obtained from environmental sample
  misc_feature (1)..(552): n is a, c, g, or t
atggagcaaaagtttgagacggagatcaagggcattgtatcgggtaaattgtcagaagaggaaatagaacagctgacgtttttttttaagcaggcagtttcccatgccatggatcaagatgatgatgatttttataaatcaatgaccttggatatgactggcagtgtcaaagaccttgccttggtattggttgatttcagaaaggattttacgttaaaaattcgcccgcatatcgaagatattgcaataaaatatattccccagacggcggatcaactggaaggaatcatcgaaaccacagagcaggctgccaataccatcatggacaatctggatcgcatgaacctcttgatgggggaaaataaaaaattttattctgcccttaaaaaagggaatatttatgtccccgattgttctggtgaagaaaaaatgcatataaatgaagatattattgcacagctcatgcccactgttgcatccatggaatccaatattgaagaaaatgtggcattgatttcagacacctttacccaattgagttccaggatataa

SEQ ID NO: 17118 - protein, 183 aa, Unknown
  Obtained from environmental sample
  misc_feature (1)..(183): Xaa is any amino acid
MEQKFETEIKGIVSGKLSEEEIEQLTFFFKQAVSHAMDQDDDDFYKSMTLDMTGSVKDLALVLVDFRKDFTLKIRPHIEDIAIKYIPQTADQLEGIIETTEQAANTIMDNLDRMNLLMGENKKFYSALKKGNIYVPDCSGEEKMHINEDIIAQLMPTVASMESNIEENVALISDTFTQLSSRI

SEQ ID NO: 17119 - DNA, 420 bp, Unknown
  Obtained from environmental sample
  misc_feature (1)..(420): n is a, c, g, or t
atggtaaaaattgacactaaaggtttagaatctttcatcccagaacaagagatatttgatttattagaaacaacagctaatccaacttcagaacgagttcaagagattattgagaaatcattaaataaaaatagacttagtccagaagagacagctactcttatcaactgtaatgatccaaaactcattgagcaaatatttgctggtgcgagagctcttaaaaagaaaatttacggtaatagaattgttatatttgcaccactttatgttggaaacgaatgtattaatgattgtgcttattgtggttttagaatctctaacaaagagactcatagaaacactttaactatggatcaattaggtgaagaaattgcagctttggaagctaaaggtcataaaagacttatcatggtttatggc

SEQ ID NO: 17120 - protein, 140 aa, Unknown
  Obtained from environmental sample
  misc_feature (1)..(140): Xaa is any amino acid
MVKIDTKGLESFIPEQEIFDLLETTANPTSERVQEIIEKSLNKNRLSPEETATLINCNDPKLIEQIFAGARALKKKIYGNRIVIFAPLYVGNECINDCAYCGFRISNKETHRNTLTMDQLGEEIAALEAKGHKRLIMVYG

SEQ ID NO: 17121 - DNA, 309 bp, Unknown
  Obtained from environmental sample
  misc_feature (1)..(309): n is a, c, g, or t
aaagctcatggcaacaaaagcaagattttacagagtagctttaaaaaatggatatggttcaacggtaaatattttcctgctcaaagaggtgatgacttaaatagtgttgttgcatccaataatatcaaagttgaaaatattgactatttaggttggtatgacattactattatacaagcaattgatgaaatatatttttcagcgaatgtccttggtactgttatagaagtatatactggagatgttggatatgaatatttattaaatcaatttagaccaatatacaataaagttgagacacaatattga

SEQ ID NO: 17122 - protein, 102 aa, Unknown
  Obtained from environmental sample
  misc_feature (1)..(102): Xaa is any amino acid
MAHGNKSKILQSSFKKWIWFNGKYFPAQRGDDLNSVVASNNIKVENIDYLGWYDITIIQAIDEIYFSANVLGTVIEVYTGDVGYEYLLNQFRPIYNKVETQY

SEQ ID NO: 17123 - DNA, 654 bp, Unknown
  Obtained from environmental sample
  misc_feature (1)..(654): n is a, c, g, or t
atggaaaatgagagtgaagtaaaagagtggaatgatgaatataaaaatcatccaagtaaacagatgagttcactagcttcaaaatatggtgatatggttgacaagagacctgatgaattattgaatgatagaaaagtagctagagagtttgtaaggaactatacaaaagatcttttacaatatgcaggagatgctagaaaatctctttataaaatacaaaatgtaaaacaaaaacaatttaaaaatgaatttaaagaagagagaattaccaaaaatagttttgatacagagtttaagagattagatagtttacaaaacagactgatacaaggaaaagagataaacgagggaagtctcaaaagatacaacatagatacaagcatattttcaacagatgctaaaactatcgaacttgatggaataaatttaaaagagcaggatagtgaagtaagaaaaaatgtgatatctaaaattaatgatcataaagaaaatttagataagagactggaagataaaataattgatgaagaatatcacanaacttatatcaaaaaagcaactgcattaaactatgtggtatctaaagcggataatattagtatatctgctttagaaaatattggattagatggagagaccgatttaaagatctaa

SEQ ID NO: 17124 - protein, 217 aa, Unknown
  Obtained from environmental sample
  misc_feature (1)..(217): Xaa is any amino acid
MENESEVKEWNDEYKNHPSKQMSSLASKYGDMVDKRPDELLNDRKVAREFVRNYTKDLLQYAGDARKSLYKIQNVKQKQFKNEFKEERITKNSFDTEFKRLDSLQNRLIQGKEINEGSLKRYNIDTSIFSTDAKTIELDGINLKEQDSEVRKNVISKINDHKENLDKRLEDKIIDEEYHXTYIKKATALNYVVSKADNISISALENIGLDGETDLKI

SEQ ID NO: 17125 - DNA, 777 bp, Unknown
  Obtained from environmental sample
  misc_feature (1)..(777): n is a, c, g, or t
ttgatgaagaatatcacaaaacttatatcaaaaaaagcaactgcattaaactatgtggtatctaaagcggataatattagtatatctgctttagaaaatattggattagatagagagacagatttaaaagatctaaaaattgaaaaggtacaaactgaactaaaaataattaattttaaagatacagatatagaaaatagttacattgatattctaaaggctgaaagtgaaaataaattaaaaccactcaatcatcaaatgcaaaaaatagcagctattgaaaataatttaaaagtaaaagcagataattttagtcttacgaattataaagatgcaaataaatttatagatacatacaaagaattagaaacatcaaatcaaatcgaacgagtacctgatataaatatcactcaagaaaattacacaaaagtttttgatgagttgataaaccaaatagaaaactctacagaacctatacaaaccaatacaaatgaattttacacattaatgagttttgctatagaagataagaatattgagatgatggataagctttatactactgatactacacatagtaatgataaagatctattagagttaaaatttcaatcttatgctgctgcttttgagattgacaaagacgaaatttatggaaagttattagaaaagcattttgactttacaaatgaagagttagaaaagatagatgatcatgaaaaagtatttgatacaaatttagagttctcttcaattggtaaagaaaatgagttttag

SEQ ID NO: 17126 - protein, 258 aa, Unknown
  Obtained from environmental sample
  misc_feature (1)..(258): Xaa is any amino acid
MMKNITKLISKKATALNYVVSKADNISISALENIGLDRETDLKDLKIEKVQTELKIINFKDTDIENSYIDILKAESENKLKPLNHQMQKIAAIENNLKVKADNFSLTNYKDANKFIDTYKELETSNQIERVPDINITQENYTKVFDELINQIENSTEPIQTNTNEFYTLMSFAIEDKNIEMMDKLYTTDTTHSNDKDLLELKFQSYAAAFEIDKDEIYGKLLEKHFDFTNEELEKIDDHEKVFDTNLEFSSIGKENEF

SEQ ID NO: 17127 - DNA, 387 bp, Unknown
  Obtained from environmental sample
  misc_feature (1)..(387): n is a, c, g, or t
tttttcccaatagctgatatctatcaaacagttaatttaaaagggaaaagagtacctagaacatcaaaacatactttaaatatcactgttgactttagaccaattgatgggcttactatatcaccagaacttatagcaaaaagtagttactatgcagatgaattaaacaaatacaaacaacctggttatgaaattataaatttaagatcagaatacaaaataaataaatctctagaaatttttgctaaaatagaaaaccttttagataagaactacaatcagtttgtaaatgtaagctcaagtgatattgcaaataatatggaagacgcaacaatccgtgttgcaccacctagagcatattatgctggacttagatacaagttttaa

SEQ ID NO: 17128 - protein, 128 aa, Unknown
  Obtained from environmental sample
  misc_feature (1)..(128): Xaa is any amino acid
MFPIADIYQTVNLKGKRVPRTSKHTLNITVDFRPIDGLTISPELIAKSSYYADELNKYKQPGYEIINLRSEYKINKSLEIFAKIENLLDKNYNQFVNVSSSDIANNMEDATIRVAPPRAYYAGLRYKF

SEQ ID NO: 17129 - DNA, 315 bp, Unknown
  Obtained from environmental sample
  misc_feature (1)..(315): n is a, c, g, or t
atgaaacaaatagaacattttaaacaactcatcaaagagcaaaaatattatgaagcccatgaagtattagaagatatttggtttcctattagacatagtaaaagtgactgtagtcttgtgctaaaaggctttataaatggagcagtttctttagagcttaaaaaaagagacaaactaatacaaagtaaaaatgtttataacacttatttaaaatatataacaaatgagagaattaaaatcacaaataataaagaacaatttcaaagtttaaagagttttatggataaagaacttgaagaaatatttaaaagctag

SEQ ID NO: 17130 - protein, 104 aa, Unknown
  Obtained from environmental sample
  DOMAIN (2)...(90): Domain of unknown function (DUF309)
  misc_feature (1)..(104): Xaa is any amino acid
MKQIEHFKQLIKEQKYYEAHEVLEDIWFPIRHSKSDCSLVLKGFINGAVSLELKKRDKLIQSKNVYNTYLKYITNERIKITNNKEQFQSLKSFMDKELEEIFKS

SEQ ID NO: 17131 - DNA, 318 bp, Unknown; identical to SEQ ID NO: 11951
  Obtained from environmental sample
  misc_feature (1)..(318): n is a, c, g, or t

SEQ ID NO: 17132 - protein, 105 aa, Unknown; identical to SEQ ID NO: 11952
  Obtained from environmental sample
  misc_feature (1)..(105): Xaa is any amino acid

SEQ ID NO: 17133 - DNA, 756 bp, Unknown
  Obtained from environmental sample
  misc_feature (1)..(756): n is a, c, g, or t
ttggcggaacttctgcactgccgaactctaacaccactaatcaactcggatataactgttatattaacctttgaaaaattgggaactcatgactcttttcatacaaacagtgtgagcttaaaagaggaaaaatatggagtagaatccacattcttttccataaataaaaatgaagaaccatcttttttagcggcttatctaaaagctcttaaaagcgtaaaagtagatgaaaaatcaaatatattaaatcttggtataaatagaggtgatgaatttgaattgattaaaaaaatcgttcctcttaaaagattaagtgagataaatttcataggagtagatcactcaaaaagtgccataaagtttgctaaaaacagatttgatggggagaatttcaacttttacactcatgatataaacgctctccatgaactaaatcttccacgatcagaccttattatcagcataggaactttacaaagttctacgcttgattttaaaaagttgtttatgtctcttgttcaagagtacttaacaaaagatggtgccataattttaggatttccaaactgtagatggatagatggggagatgatttacggtgctaaagctccaaactacccctactccgaactctctattgttataaaagatatctacttttgtaaaaaatatcttcaacaacataaatttagagtgacaatcacaggtaaaaactatctttttctcactgctacctcgatagcaaaacagtcataa

SEQ ID NO: 17134 - protein, 251 aa, Unknown
  Obtained from environmental sample
  misc_feature (1)..(251): Xaa is any amino acid
MAELLHCRTLTPLINSDITVILTFEKLGTHDSFHTNSVSLKEEKYGVESTFFSINKNEEPSFLAAYLKALKSVKVDEKSNILNLGINRGDEFELIKKIVPLKRLSEINFIGVDHSKSAIKFAKNRFDGENFNFYTHDINALHELNLPRSDLIISIGTLQSSTLDFKKLFMSLVQEYLTKDGAIILGFPNCRWIDGEMIYGAKAPNYPYSELSIVIKDIYFCKKYLQQHKFRVTITGKNYLFLTATSIAKQS

SEQ ID NO: 17135 - DNA, 612 bp, Unknown
  Obtained from environmental sample
  misc_feature (1)..(612): n is a, c, g, or t
atgcaagattacacaacaaaattaacaacacacagagaactttatcctatacttgaccttgattggtctgtggagagtgatagaggtcgtatcatctcttcaccctcttttagacggttacaaaaaagaacgcaagtatttgcactagagctaaatgctgctatacgaagtcggcttactcattcacttgaagtatctcaaacatcacgatttatcgctaaaactatcttaaaaaagctcgatgataaaaacctcaaagagatggaaaatgcttttgtttcaactgctgagatggctagtttacttcatgatataggcaatccaccttttggtcactttggtgaaacggctattaatgaatggatggataaggtgtgtgataaatactttatgaacatagaaggtgacaaaactcttaaaaatcaattgaaaaaagatctttcctcttatgatggaaatgcccaagctataagaatcatacataaactacaacgccttaacctttcctatacacaaaccgcttcagtattaaaataccacaggagtgcttttgaaaataagataatgacgaatccctttcatactttaagaaaaagctgggtattactatag

SEQ ID NO: 17136 - protein, 203 aa, Unknown
  Obtained from environmental sample
  DOMAIN (58)...(153): HD domain
  misc_feature (1)..(203): Xaa is any amino acid
MQDYTTKLTTHRELYPILDLDWSVESDRGRIISSPSFRRLQKRTQVFALELNAAIRSRLTHSLEVSQTSRFIAKTILKKLDDKNLKEMENAFVSTAEMASLLHDIGNPPFGHFGETAINEWMDKVCDKYFMNIEGDKTLKNQLKKDLSSYDGNAQAIRIIHKLQRLNLSYTQTASVLKYHRSAFENKIMTNPFHTLRKSWVLL

SEQ ID NO: 17137 - DNA, 834 bp, Unknown
  Obtained from environmental sample
  misc_feature (1)..(834): n is a, c, g, or t
gtggaaacagaggaatttagtatagatgatggtcgtatttttaaatcccgtacctttcctgcaatggataagaatggaaattacaattacggtatccatctgttcgaagatattactgagtctaaacagcaggaacaaaaaattatagaactcaataaaacccttcgccttataagtcagtgtaacgagatattggttcgaagtgtggacgaaatcatattggcaaaagatatatctaaagaaattgttaaaaggcaggaatacaattttaccggtgtttttttcgtacgggaaaatactgatatctgggactactacacatttgatgaaaagaaagattttattttgaagaagatcaatgttacggatgaacactttaagaacagtcctgtcaatttatgtgaaaaagaaaacagagttatttgtataaatgacattgtgcatgatccaatgtggacagagctgttaaaggccaatattaacttatctcctataaaccattacgatatgcagggatctgtgctgattcttccacttaataatggaaaaagtatcggtgctatgattatttactcaaagtctccagacatgtttaatgagaaaaaagttgcacttttcaaggaactttcagacgatatggcctatggcatctctactatcagactccgctgtactctcgaagaatcgaattataaaaatgaaaaaatgcttgtgcaacttcatgagaatcttgacgggataatccgttccattgcaaagatgtcagaggcccgtgatccatatacggcaggacatcaacaacgtgtattccccccttgcccgtgccatcgctaa

SEQ ID NO: 17138 - protein, 277 aa, Unknown
  Obtained from environmental sample
  misc_feature (1)..(277): Xaa is any amino acid
METEEFSIDDGRIFKSRTFPAMDKNGNYNYGIHLFEDITESKQQEQKIIELNKTLRLISQCNEILVRSVDEIILAKDISKEIVKRQEYNFTGVFFVRENTDIWDYYTFDEKKDFILKKINVTDEHFKNSPVNLCEKENRVICINDIVHDPMWTELLKANINLSPINHYDMQGSVLILPLNNGKSIGAMIIYSKSPDMFNEKKVALFKELSDDMAYGISTIRLRCTLEESNYKNEKMLVQLHENLDGIIRSIAKMSEARDPYTAGHQQRVFPPCPCHR

SEQ ID NO: 17139 - DNA, 576 bp, Unknown
  Obtained from environmental sample
  misc_feature (1)..(576): n is a, c, g, or t
atgcagaaactagtctttgcaaccaataataaacataagattgaagaagtggcgccattgattcagtctcattttcaacttttaagcttagctgatattcaatgctttgaagaaatagaagagccacatgatactttaaaagacaatgcttttgagaaagctcattttgtttttaatcgatacaactacaattgttttgccgatgataccggattagagattgacgctttgggcggaagacccggtgtatattctgcgcgctatgccggagaaagttgctcttttcaggataatgtaaagaaagttctaaaggaaatgaaaggcaagaagaatcggtcggcccgtttcaaaaccgttattgctcttatcatcgatgggaaagaatataatttcgaaggggtggttgaaggagaaattatcgatcaacaaagtggatcggatggatttggttacgatccaatatttcggccattaggctataaagaaacctttgccgaaatgcctttagaagagaaaaataagattagtcaccgaggcttagccagtaaaaagcttattgaatttctaaacaaataa

SEQ ID NO: 17140 - protein, 191 aa, Unknown
  Obtained from environmental sample
  DOMAIN (4)...(189): Ham1 family
  misc_feature (1)..(191): Xaa is any amino acid
MQKLVFATNNKHKIEEVAPLIQSHFQLLSLADIQCFEEIEEPHDTLKDNAFEKAHFVFNRYNYNCFADDTGLEIDALGGRPGVYSARYAGESCSFQDNVKKVLKEMKGKKNRSARFKTVIALIIDGKEYNFEGVVEGEIIDQQSGSDGFGYDPIFRPLGYKETFAEMPLEEKNKISHRGLASKKLIEFLNK

SEQ ID NO: 17141 - DNA, 630 bp, Unknown
  Obtained from environmental sample
  misc_feature (1)..(630): n is a, c, g, or t
ttgactaaagctgagtttgatgtgcatgtttgtcatgatggtagacacgccgtattagaaacaaaaacaataaatccaaatctgattctccttgacctgatgttaccgtttgttgatggactttcgatttgtaaagaattgaaatacgaaagtgaacttaaaaatattccaataataatagtttctgcaaaaggtgaggaaagcgatgtcattaaaggtttaaacctgggtgctgatgattatgtgaaaaaacctttttcgccccatgaattggttgccagggtgaaatcagttcttcgcagagtatcaggcgcaatgaagtctgaaagtaatttattaagtctggagtcggtgacattggattcgaccagcagagaagttaggattgatggattaaaaattgaattgagtgcctcggagtttgatacgttgctgatgctgatgaggaatccagatagagtttttactagaaatcagattatagataatgttcatggtgaagactatgtagtaactgatagatcaatcgatgtattagtttcaggactcagaaaaaaattgggcaattcaagaaaactcatcaaaactatctggggggttggatataggtttggagcgcaggatgaatag

SEQ ID NO: 17142 - protein, 209 aa, Unknown
  Obtained from environmental sample
  DOMAIN (2)...(103): Response regulator receiver domain
  misc_feature (1)..(209): Xaa is any amino acid
MTKAEFDVHVCHDGRHAVLETKTINPNLILLDLMLPFVDGLSICKELKYESELKNIPIIIVSAKGEESDVIKGLNLGADDYVKKPFSPHELVARVKSVLRRVSGAMKSESNLLSLESVTLDSTSREVRIDGLKIELSASEFDTLLMLMRNPDRVFTRNQIIDNVHGEDYVVTDRSIDVLVSGLRKKLGNSRKLIKTIWGVGYRFGAQDE

SEQ ID NO: 17143 - DNA, 693 bp, Unknown
  Obtained from environmental sample
  misc_feature (1)..(693): n is a, c, g, or t
atggaaaacgaaaaagtagagacatttaaagaaatcaaaaaattagaatttgatgatataaaaaaagagattttagatgatgaggatattaaaaatcaattaaatgagattagaactaatgtcaatattaaatatggtgaagaaataagtgatataaaaaacacttacatagaattaaaaacaacttttggaacatataaaaaagctacagagctattttataatgatgaaacctcaaggaaatatttatatctttcaataataacttttatagctttgttgcttggtggagcctatatagataagacttggtcttatatggggtcttttattggaattgtaattagtggaagtagatttttgaaagattatttaaaaaagatcgaacccattactataactttagaaaagtttattaaaaaatgtgaagataagaatcgtgaaatacaaaagcaaaaagaagatgaaaaaatagaattacaaaaaaatattaatgatgcaaatttacaaattagagatataaagtcccagttacaagtagagaaaaataaaattatcagtataaaaaaagagataaataaaataaagtcaggggaatatttagcaaattttatagctgatagaagtagtagtactgattataaacaacaccttggattagtttctgttatccgtgaggattttgataaataa

SEQ ID NO: 17144 - protein, 230 aa, Unknown
  Obtained from environmental sample
  misc_feature (1)..(230): Xaa is any amino acid
MENEKVETFKEIKKLEFDDIKKEILDDEDIKNQLNEIRTNVNIKYGEEISDIKNTYIELKTTFGTYKKATELFYNDETSRKYLYLSIITFIALLLGGAYIDKTWSYMGSFIGIVISGSRFLKDYLKKIEPITITLEKFIKKCEDKNREIQKQKEDEKIELQKNINDANLQIRDIKSQLQVEKNKIISIKKEINKIKSGEYLANFIADRSSSTDYKQHLGLVSVIREDFDK

SEQ ID NO: 17145 - DNA, 666 bp, Unknown
  Obtained from environmental sample
  misc_feature (1)..(666): n is a, c, g, or t
ttgaaagcctgggatgaggtcgattttagtttgatttatatcgaacaaaaatacaaattaggaattaaaatgaaagtagctgtattatgtgagtattcaggaatagtaagagacgcattcatgaaagcgggtcacactgctgtatcatgtgatattttgccgactaaatcgccgggaaaccatattcaagatgatctattcaaccgtgattggagcggttatgatcttgtaattgcacatcctccctgtacgtacttaacagtaacagcgaatagggcatttctgagtaatccggaaaggtggcaaaaaaggcttgacgctgtaaaatttgtatggaaattaatgcatctggatgttgaaaaaatatgtattgaaaaccctaaaggcgttatctcttcatatattcggaaaccagatcagtatatacagccctatgaacacggtcaccccgattcaaaaatgacggggttatggctaaaaaatcttcctttgattaaaccaacaaaaatagttgatccagaatgggtttaccctaaatcaggaagcggaaaaagaatgtcaaaaacccacgcaaataaccctagtacaaatagcgcaaaaaactcaatgttgaggtcaaaaacttatcaaggtattgctgatgccatggcttcgcaatggtcttga

SEQ ID NO: 17146 - protein, 221 aa, Unknown
  Obtained from environmental sample
  misc_feature (1)..(221): Xaa is any amino acid
MKAWDEVDFSLIYIEQKYKLGIKMKVAVLCEYSGIVRDAFMKAGHTAVSCDILPTKSPGNHIQDDLFNRDWSGYDLVIAHPPCTYLTVTANRAFLSNPERWQKRLDAVKFVWKLMHLDVEKICIENPKGVISSYIRKPDQYIQPYEHGHPDSKMTGLWLKNLPLIKPTKIVDPEWVYPKSGSGKRMSKTHANNPSTNSAKNSMLRSKTYQGIADAMASQWS

SEQ ID NO: 17147 - DNA, 651 bp, Unknown
  Obtained from environmental sample
  misc_feature (1)..(651): n is a, c, g, or t
gtgggtttggagatattatacggatgtgggatagagaggaaaactttatctctccggatgatttttaccagcagcttcaagatatcaacttatggcagagatagatgttttgtactttggacatatttagaaagtgtcacaaaagataaaaatcatatagaaaaacttcattcagcccacataaatctagctggttcaagtctaaataatccagattttcaagcaaaagtaaaagaggctgttacacattttgattttccatgggaaaagttagagttagaggtaacagaaagctcagcaattggaaatttcaatagagcgaatgagtttatactgtggttaaaaagtaaaaaaatagggttagctcttgatgactttggtacaggtatggcttcatttgagtatctaaaaagcttaccttttgatgtggtgaaaatagatggaagttttgtaaaagatatgcacaaagatcctattgataatgcagttatccgatatatccaagagatagctcagcttaaagggcaagaaacggttgctgagtatgtagaggcaaaagaggatgttgatgctttaagagagattggtatcacttatggacaagggtactttttaggaaaaccaagaccacttagctcttggctagagtag

SEQ ID NO: 17148 - protein, 216 aa, Unknown
  Obtained from environmental sample
  DOMAIN (12)...(208): EAL domain
  misc_feature (1)..(216): Xaa is any amino acid
MGLEILYGCGIERKTLSLRMIFTSSFKISTYGRDRCFVLWTYLESVTKDKNHIEKLHSAHINLAGSSLNNPDFQAKVKEAVTHFDFPWEKLELEVTESSAIGNFNRANEFILWLKSKKIGLALDDFGTGMASFEYLKSLPFDVVKIDGSFVKDMHKDPIDNAVIRYIQEIAQLKGQETVAEYVEAKEDVDALREIGITYGQGYFLGKPRPLSSWLE

SEQ ID NO: 17149 - DNA, 675 bp, Unknown
  Obtained from environmental sample
  misc_feature (1)..(675): n is a, c, g, or t
ttgagcaagattatcggatacataagagtctctacagacaaacaaaaccttgagaaccaaaagcataaaatactctcttatgctcacgatcataaaattacagttgatgagtttgtagagattgaaatatcaagtaagggtgaacaaaaaaagaggcttatcgatactctttttgataagctaaaaaaaggtgacacattgatttgtacagagttatcacgtcttggtagaaatatgctagagatattaaatctaatagagcgatttagtagtgctggtataaagcttatctttgtaaatcaacctgagctatcaactaatcaaaatagtgctctcagtagtctcttattagctatttatggctattttgcgcaaacagaacgagagataatttcagaacgcacaaaacagggtttagcagctgcacgtaaaagcggcgtaaagcttggtcgccctaaaggtgcaaaagcaaagataagagttttagatccatataatttagagatactagagttgttaaatatggacgttgctcaaagcagcattttaaagattattaacaacaagcttgacaagccaattactataacatcacttcgttatcatattgagcacatacctgatcttaaaaaagctagagataattttaaaaatggaagcttattaaaaaaatag

SEQ ID NO: 17150 - protein, 224 aa, Unknown
  Obtained from environmental sample
  DOMAIN (4)...(148): Resolvase, N terminal domain
  misc_feature (1)..(224): Xaa is any amino acid
MSKIIGYIRVSTDKQNLENQKHKILSYAHDHKITVDEFVEIEISSKGEQKKRLIDTLFDKLKKGDTLICTELSRLGRNMLEILNLIERFSSAGIKLIFVNQPELSTNQNSALSSLLLAIYGYFAQTEREIISERTKQGLAAARKSGVKLGRPKGAKAKIRVLDPYNLEILELLNMDVAQSSILKIINNKLDKPITITSLRYHIEHIPDLKKARDNFKNGSLLKK

SEQ ID NO: 17151 - DNA, 393 bp, Unknown
  Obtained from environmental sample
  misc_feature (1)..(393): n is a, c, g, or t
ttggcaagtttatacatagaacaaacgcataaaactcccgaaattgatttcaacctttctacaggaaaattatcaatttcaggagtgtctgtgccagaaaatgcacatgagttctattttcctgttattgagtggctacaaaaaaatatagctgaatttgcttgtaaaaattgtgagttagattgtaagattagttatcttaataccagttccttacagtttttgggagatattttctttctggtagatagtttaaagtctaatatttctgaaaaatcaattaacatcaattggtattacgatttttttgatagtgatatgaaagaaaccggtgcagattttaaagatgtggtagatgttaattttaatcttaaggaagtaaaaattacttaa

SEQ ID NO: 17152 - protein, 130 aa, Unknown
  Obtained from environmental sample
  misc_feature (1)..(130): Xaa is any amino acid
MASLYIEQTHKTPEIDFNLSTGKLSISGVSVPENAHEFYFPVIEWLQKNIAEFACKNCELDCKISYLNTSSLQFLGDIFFLVDSLKSNISEKSININWYYDFFDSDMKETGADFKDVVDVNFNLKEVKIT

SEQ ID NO: 17153 - DNA, 510 bp, Unknown
  Obtained from environmental sample
  misc_feature (1)..(510): n is a, c, g, or t
atggctcagatagcttataggcaaatagttaataataacgattttcaaaaaagacaattttctatgagtgagacttctaagttactaaaaaataataaatttcatagagatgagttaaacaaaattatagattattctaacttaagccaaaaaagagagcctatttctgtagaggaaatacataaattaatatgcataagtgatgaaaaaggaaactatggaaataagccataccaaatgtcagaggatggaaaaaagattaggtctcatatgactggacttttaaataattttgaacagttaggtataggaatattgcacaatacattagatgaagatattatgaaagatggttttgatgcaatcatagatgacaattatactttttattcaagttatataaaacatattcgatcagatgaaaataaatcagattttgcagaaaactttgaatggcttcagaaacgatggaatgattcgtcatcccataataagacagttagagactag

SEQ ID NO: 17154 - protein, 169 aa, Unknown
  Obtained from environmental sample
  misc_feature (1)..(169): Xaa is any amino acid
MAQIAYRQIVNNNDFQKRQFSMSETSKLLKNNKFHRDELNKIIDYSNLSQKREPISVEEIHKLICISDEKGNYGNKPYQMSEDGKKIRSHMTGLLNNFEQLGIGILHNTLDEDIMKDGFDAIIDDNYTFYSSYIKHIRSDENKSDFAENFEWLQKRWNDSSSHNKTVRD

SEQ ID NO: 17155 - DNA, 495 bp, Unknown
  Obtained from environmental sample
  misc_feature (1)..(495): n is a, c, g, or t
ttgatggccgagaaccaaattaaaggttttggagcatttttaggtctttcatttagctacttttcagatcatattagaaaacgatttacttacttcaaaggtattagggtcgctgttcacacaggagatatgcataaatttttagatattttaggtaatcctaactttgtaggagagggtttaaacaagtgtgctcgttatgtagataaaaaagcaccttcggaaaatagcatagtaatctctgattatgcgtttgatgctctaaacctatttttcaaaaaatatccggattttgaagctctactgcatgaacaaggttatgagtactctgaggagttcagctttaacgacaaacatgacaacctacattatggatattttgttaatctacgtaaaggcgggattataaatccaccaaaactaaatctcaaagcaaaagctcaagacataatccctaaagatcttctagatgagtggtttgatagtaactactga

SEQ ID NO: 17156 - protein, 164 aa, Unknown
  Obtained from environmental sample
  misc_feature (1)..(164): Xaa is any amino acid
MMAENQIKGFGAFLGLSFSYFSDHIRKRFTYFKGIRVAVHTGDMHKFLDILGNPNFVGEGLNKCARYVDKKAPSENSIVISDYAFDALNLFFKKYPDFEALLHEQGYEYSEEFSFNDKHDNLHYGYFVNLRKGGIINPPKLNLKAKAQDIIPKDLLDEWFDSNY

SEQ ID NO: 17157 - DNA, 774 bp, Unknown
  Obtained from environmental sample
  misc_feature (1)..(774): n is a, c, g, or t
atgaagatattgttaatcgttattttatttatcagctcactttttagtgctaagcttgtagaacctagagaagtttttaaagctagtggtagagttgttgatattgtgcataaaaatgataagttatatgctgcaacaaatgcaggttgtgtagatgtttttgatatgaaaacaaaagagataataagtaaaataaaaattgatcctataactgactttatgggagacgtgatcgaatcgaaagtttattctgttgatttagctggtgataggatattacttctttctcaagataagaagggctatagaagagttcacatttttgaggataacaagggtgaacttattatcagttataaagataagttgtctattgctaaagccaagtttattgatgaaaacaatgttctttttgcactcttaagtaatgaactgatctcatatgatataaaaaataaaaaagagaattggacagttcaagtctcaggttcaaagttttctaattttgtattaagtgaagataaatctgaggtagtagttgccgatgagagtggtgatttgaaaatacatagtacaaaagatggctcttttattaaaaaactgagtgagcaaaatctggataatgtttttcaggtggattataaaaactccataattgcaactgcaggacaagatagaagagtagttatttatgatctgaaaagatcatcagcatactataaaagctctgattttttatctatagtgttggactatcaccaagtggagatttag

SEQ ID NO: 17158 - protein, 257 aa, Unknown
  Obtained from environmental sample
  SIGNAL (1)...(16)
  misc_feature (1)..(257): Xaa is any amino acid
MKILLIVILFISSLFSAKLVEPREVFKASGRVVDIVHKNDKLYAATNAGCVDVFDMKTKEIISKIKIDPITDFMGDVIESKVYSVDLAGDRILLLSQDKKGYRRVHIFEDNKGELIISYKDKLSIAKAKFIDENNVLFALLSNELISYDIKNKKENWTVQVSGSKFSNFVLSEDKSEVVVADESGDLKIHSTKDGSFIKKLSEQNLDNVFQVDYKNSIIATAGQDRRVVIYDLKRSSAYYKSSDFLSIVLDYHQVEI

SEQ ID NO: 17159 - DNA, 666 bp, Unknown
  Obtained from environmental sample
  misc_feature (1)..(666): n is a, c, g, or t
ttgaaaaattcaatgaaaaatatcgacatagatacaagctctctagaaaacttagaaaaacagctaactatctcaaaaacttcttatcaaactgtatttgatactcaacaaaatattgataaacatctaaaacttatgcatcaatcaaaaaatatgataaaagagatatttcaaaaagtgtatgattataaacttataaaatatatgatgcaacttgaactttacgaaaaaacattttttcttactaatactattgatttaaaagagtttggaaaaacacattttaaaatgagaagatcagtaaggggaagtgaaaattttacagaaaataaacctatgcaaaaaaaaatcaatggggaacttcttcaatataaagatatgtttgaaattgttgtagatggacaaaaaaacattgatatactccagcagcaactaaataaaaattttgctatcacattacaaatattaaaaactaataatcaaattataagtgatgagatagaaaaaagcagtgataatttactctatatgattttaactatctcaattattataggacttattgagtttatcatagctaccgttatttcaaaaagaaatagttcaaaaatccaaagcttaggttcatcaggggaattaaatgaactttttttgaagggaaattag

SEQ ID NO: 17160 - protein, 221 aa, Unknown
  Obtained from environmental sample
  misc_feature (1)..(221): Xaa is any amino acid
MKNSMKNIDIDTSSLENLEKQLTISKTSYQTVFDTQQNIDKHLKLMHQSKNMIKEIFQKVYDYKLIKYMMQLELYEKTFFLTNTIDLKEFGKTHFKMRRSVRGSENFTENKPMQKKINGELLQYKDMFEIVVDGQKNIDILQQQLNKNFAITLQILKTNNQIISDEIEKSSDNLLYMILTISIIIGLIEFIIATVISKRNSSKIQSLGSSGELNELFLKGN

SEQ ID NO: 17161 - DNA, 633 bp, Unknown
  Obtained from environmental sample
  misc_feature (1)..(633): n is a, c, g, or t
gtgagttttnctataaacaaaggtgaaaaagtagctattttaggaagaatcggttcaggaaaaagtactattgcaaaactattactaaaactttatgagcctcaaagtggttctattttaatagatggcattgatataaaacaactagacccagcagatttaagaaaaagtataggatatatacctcaagagattcatctttttcaaggtactataaaagaaaatattttgaataactatagatactacacagatgaagagatgttagaagtttctaaaattggtggggttgatgagtttgtaaagacccatcctcttggctatgagatgcctataggggaaagaggtgttggactctcgggaggacaaaaacaaacagtaggaattgctagggcattgctatcagatgcaaacaccttactttttgatgagcctacaaatgctatggatcaaactacggaaacaaatacaataaataaattaaaaccagtaattgaagataaaacattatttctcgtaactcaaaaaatgagtactttagagttatgtaatagaattatcgtttttaatcaaggtgttaaaatcatggatggaccaaaagatgagattataaaacagttggcatcaaaatga

SEQ ID NO: 17162 - protein, 210 aa, Unknown
  Obtained from environmental sample
  misc_feature (1)..(210): Xaa is any amino acid
MSFXINKGEKVAILGRIGSGKSTIAKLLLKLYEPQSGSILIDGIDIKQLDPADLRKSIGYIPQEIHLFQGTIKENILNNYRYYTDEEMLEVSKIGGVDEFVKTHPLGYEMPIGERGVGLSGGQKQTVGIARALLSDANTLLFDEPTNAMDQTTETNTINKLKPVIEDKTLFLVTQKMSTLELCNRIIVFNQGVKIMDGPKDEIIKQLASK

SEQ ID NO: 17163 - DNA, 648 bp, Unknown
  Obtained from environmental sample
  misc_feature (1)..(648): n is a, c, g, or t
atggagcattgctcttcagaagaacagatgaaaatgttagagcgtggctggagaaggtttggaaatatgcactttgtccctgagtgtaaaaattgtaatgaatgtaaaacaattagaatagatgttaaaaattttaaattttctaaaaatcaaaaaagaattatgaaaaaaaatatcgatacacaagtttatattcaaaaaccaactgtaacttatgaacatattgatctttttaataaatatcatagacatatgcaagagaaaaaagattggcaagaaaatattatagatgtacaagagtatcataactcttatgttaatggagcacatgattttgggaaagaattactctactttagagataacaaacttgtagccgttgctctaagtgatatactaaagcatggtgtttcagctgtttattgttactatgaccatgaatataaagatttatctttagggaagttttcaattcttgcacaaataagtattgcaaaacaagcaaatataccttatctttatctaggatattggatagaagatcattttagtatgggttataaagagagatacaaaccttttgaagtattagaaaatagaccaaaactaacagaagaaacaatatggagttaccatgagcgaaaatag

SEQ ID NO: 17164 - protein, 215 aa, Unknown
  Obtained from environmental sample
  DOMAIN (3)...(61): Arginine-tRNA-protein transferase, N terminus
  misc_feature (1)..(215): Xaa is any amino acid
MEHCSSEEQMKMLERGWRRFGNMHFVPECKNCNECKTIRIDVKNFKFSKNQKRIMKKNIDTQVYIQKPTVTYEHIDLFNKYHRHMQEKKDWQENIIDVQEYHNSYVNGAHDFGKELLYFRDNKLVAVALSDILKHGVSAVYCYYDHEYKDLSLGKFSILAQISIAKQANIPYLYLGYWIEDHFSMGYKERYKPFEVLENRPKLTEETIWSYHERK

SEQ ID NO: 17165 - DNA, 798 bp, Unknown
  Obtained from environmental sample
  misc_feature (1)..(798): n is a, c, g, or t
ttggggtgcaaattgattagtagattttacttagaaaactatttgtcatttgaacaaatagagttagagtttcaaaaaggtttagtagtatttacaggacctagtggtgctggaaaatcagttttgatgagttcaattttagctttatttggtgcaactgattctaaagctcttgtaagtgaagtattacttgaagatttaaaaattgaagatgaaggatatgggatagaaaatgaggatgatataattatcaaacaaaacacctctacaaaaactagatattttttaaataatcaaatcatctcaaagaaaaatctcaaagatttcacaacaactttttctaaacaccttcacctaaaagatacaagtgattttgatagtgagaagattattgcatttttggattttttaacctctgtaaatgatagttcttatagagcaattttaaatgaatttcaaacaaaatatgaggaatatcatactttacaaaagaagtttacaaaaatacaaaatgatgaaaaagaacttgatgatttaatagaatatacaaaattcgagatagagaaaattgtaaaacttgatccaaaagaggacgagtatgaagagcttaaacatatcanagacaacctttcaaaaaaagataaagtagatgaagttctaagtgagatacaaccatatttaaacaatactcacaaaatatcaagtgctttacatctaatagatgaagatagtaccttttttgatgaagctatncatgaagtaataatatctttggaaagtttttatgacagaattgct

SEQ ID NO: 17166 - protein, 266 aa, Unknown
  Obtained from environmental sample
  misc_feature (1)..(266): Xaa is any amino acid
MGCKLISRFYLENYLSFEQIELEFQKGLVVFTGPSGAGKSVLMSSILALFGATDSKALVSEVLLEDLKIEDEGYGIENEDDIIIKQNTSTKTRYFLNNQIISKKNLKDFTTTFSKHLHLKDTSDFDSEKIIAFLDFLTSVNDSSYRAILNEFQTKYEEYHTLQKKFTKIQNDEKELDDLIEYTKFEIEKIVKLDPKEDEYEELKHIXDNLSKKDKVDEVLSEIQPYLNNTHKISSALHLIDEDSTFFDEAXHEVIISLESFYDRIA

SEQ ID NO: 17167 - DNA, 543 bp, Unknown
  Obtained from environmental sample
  misc_feature (1)..(543): n is a, c, g, or t
atgatactccctgaaaatctaaatgctattaataaagagtttatcgggatcgatggcgaactatatagagttaaaattgaattggtccattttaatgagtttacttcttctaccaaatacaaacttcaatcgttacttgactccgatttattagcccaggtatcactcgatcagttggacattaccaatgaggaagatcgccttcataagttttctatttgccgttttggaggctttgatgacaaggctgatatagcaggatcaaatcatactaatgagtattatgattgtggttttcgtggtaaatgccctgttgagggcaaactatgccgccatgtttcaaccggtaatggctatttaactccacgcgaaattgatgtaattaaacttattgcatccgatttggccgataaacaaattgccgataaacttaatataagtgtgaatactgcaaaccaacaccgggttaatattcaaaaaaaaattggatgttcttcaaaggttggtatttgccgttttgctgtcgaaaaacgaattgtataa

SEQ ID NO: 17168 - protein, 180 aa, Unknown
  Obtained from environmental sample
  DOMAIN (117)...(174): Bacterial regulatory proteins, luxR family
  misc_feature (1)..(180): Xaa is any amino acid
MILPENLNAINKEFIGIDGELYRVKIELVHFNEFTSSTKYKLQSLLDSDLLAQVSLDQLDITNEEDRLHKFSICRFGGFDDKADIAGSNHTNEYYDCGFRGKCPVEGKLCRHVSTGNGYLTPREIDVIKLIASDLADKQIADKLNISVNTANQHRVNIQKKIGCSSKVGICRFAVEKRIV

SEQ ID NO: 17169 - DNA, 552 bp, Unknown
  Obtained from environmental sample
  misc_feature (1)..(552): n is a, c, g, or t
atggatcagaattcggctgagaatttttggactttatatagagagaagtggtatcaatatgtaacaattgcatctattatacaaaaagaatctgcttcaaaagaggagatgcaccttgtttctagtgttatacataaccgtatcaacaaaggtatgaaacttcaaatggatggaacattaaattatggaaaaaattcacatattactgttacaccacagatgatcaaaaatgatacttcacaatataatacctacaaaagaaaaggggtaccagataatccaatttgtgctattgagtttgaagcaattcgctcagcaatttttccaacaaaaacaagttatctctattttatgagatctacagatggaaatagtcataatttttcctcgtcttacaaagagcatatagcaaatattagaaatgtacaaaagaacaatagaagtcctaaaaagaaacaaactagtataaatcaaacaaaaaaaatcaaacagaaacaacaaacagttgaaaagtcagtttttaaaagggatttaaaagcattatggaaataa

SEQ ID NO: 17170 - protein, 183 aa, Unknown
  Obtained from environmental sample
  DOMAIN (1)...(145): Aminodeoxychorismate lyase
  misc_feature (1)..(183): Xaa is any amino acid
MDQNSAENFWTLYREKWYQYVTIASIIQKESASKEEMHLVSSVIHNRINKGMKLQMDGTLNYGKNSHITVTPQMIKNDTSQYNTYKRKGVPDNPICAIEFEAIRSAIFPTKTSYLYFMRSTDGNSHNFSSSYKEHIANIRNVQKNNRSPKKKQTSINQTKKIKQKQQTVEKSVFKRDLKALWK

SEQ ID NO: 17171 - DNA, 726 bp, Unknown
  Obtained from environmental sample
  misc_feature (1)..(726): n is a, c, g, or t
atgcagcagactcctcagagtataaaggaaaatatcattgaagaagcatatgaatgtgttgatgcgattatcgaggaagatagcaaacatgtttgtgaggaattaggagatctttacctcttaactacctttgcatctatcatgtacgaagagagtacagacttttcgataaatgatgtttttgaaggtatttgcagcaaactcatccggcgtcacccccacgtttttgccgacagtcaggcggatactcctgatgaggttgtacatcaatgggaagaaattaaagataaggtcgaaggccgcattcatgacgattccgtaatggactcggttcccaaacattacccacctctgcttaaggcacaaaagattcaaaaaaaagctgttaaatctaattttgactggaaatgcattgaagatgtagttttgaagcttgatgaagaggttgaagaatttaaagtagccttaagcaataatagtcaaactgagattgaagaagaactcggtgatatactttttactattgtaaatatttccagatatctttctattgattcatctgcggcattgtcaaagacgaataataaatttatcaaaagatttaagttcatagagaaaagtataaagaatcaggggaaaaaaatgcaggaaactgatatcgagagccttgaaaactatggcagggagcaaagaaacattattttacaacctccgcgtctattttga

SEQ ID NO: 17172 - protein, 241 aa, Unknown
  Obtained from environmental sample
  DOMAIN (136)...(201): MazG nucleotide pyrophosphohydrolase domain
  misc_feature (1)..(241): Xaa is any amino acid
MQQTPQSIKENIIEEAYECVDAIIEEDSKHVCEELGDLYLLTTFASIMYEESTDFSINDVFEGICSKLIRRHPHVFADSQADTPDEVVHQWEEIKDKVEGRIHDDSVMDSVPKHYPPLLKAQKIQKKAVKSNFDWKCIEDVVLKLDEEVEEFKVALSNNSQTEIEEELGDILFTIVNISRYLSIDSSAALSKTNNKFIKRFKFIEKSIKNQGKKMQETDIESLENYGREQRNIILQPPRLF

SEQ ID NO: 17173 - DNA, 606 bp, Unknown
  Obtained from environmental sample
  misc_feature (1)..(606): n is a, c, g, or t
atgcagttgaatgtaaatattggtacatttattcctaaacctcatacaccctttcaatggtcatttcagctaactgaagcgcagggttatgaaaaaataatgaagataaaacgtgctctgcctgatcgattcttcaaggttggctatcaagcaccattcatgtctttcatcgagggtattattagtcgaggtgatgagagagcgggagatcttataattgaagcattcaaacgtggcgcccgccttgatgcctgggaagaataccttgataagcaattatggcatgatgttattgctgaagcggattgggatgtagaaaaagagacatgttcgccatctgacgacctcgaagttgatcttccatgggatggtttaaatctgaatacagggaagaaatttctaaaggatgaactgaaaaaggccttcgagggtgaattaacatcagcctgtgtcgatgattgtagtcatcaatgtggtgcatgtaatgaccaggataaggttattgttaacaagaaacctatcgatgttgagagttatatcttaaataatccaccggcagaaacgatagagacccggaaggataaggtcccttttttcatttactaa

SEQ ID NO: 17174 - protein, 201 aa, Unknown
  Obtained from environmental sample
  misc_feature (1)..(201): Xaa is any amino acid
MQLNVNIGTFIPKPHTPFQWSFQLTEAQGYEKIMKIKRALPDRFFKVGYQAPFMSFIEGIISRGDERAGDLIIEAFKRGARLDAWEEYLDKQLWHDVIAEADWDVEKETCSPSDDLEVDLPWDGLNLNTGKKFLKDELKKAFEGELTSACVDDCSHQCGACNDQDKVIVNKKPIDVESYILNNPPAETIETRKDKVPFFIY

SEQ ID NO: 17175 - DNA, 804 bp, Unknown
  Obtained from environmental sample
  misc_feature (1)..(804): n is a, c, g, or t
acacaagagtcccataaagccatacttattattttagataaagatatcaaaattgtttttgcacataaatttttagataaaaataaaaagagtgagataagagcacttcaagagatacttgatgataaactttttagtggtgagggtcaaatcttctcatntgatgcactattaacacaatcaaacattctcaatactatcaattcccaaggaaatagatatattgctaaactcaaagataatcaagataacctaaaacaaaaagctgttgagacagttgaagcgtttgaaactccaaatgatagttatgatgacaaagatgggtatcttaatgaaaacaataaaagagttactagaacagtagaggtatatcaaaataaaaattgtaacttagtgatgcatcatgagagatttgataatattcaatcgctaattaaagtcactaagcaattaacgaatcctatcactggagaacatacacaaacagtgcaatacttaatggctaatttcaaaactacagcagaagatttctaccaaaagatactgcaacattggcggatagaaacttaccactatcatttggatatgttagtagaagaagatcaacatattgcatacaaagagcctttctctatggcaatactcagaagttttgcaattaatctttatcagttatttttgaatgctaacaaagataaaaaaattctaccaactggaaaaacaacaatggcagagattaaaagaaattgcctatatcgcgatgattttactgctgatctgtttgagcaggaaggtgttaattaa

SEQ ID NO: 17176 - protein, 267 aa, Unknown
  Obtained from environmental sample
  misc_feature (1)..(267): Xaa is any amino acid
MQESHKAILIILDKDIKIVFAHKFLDKNKKSEIRALQEILDDKLFSGEGQIFSXDALLTQSNILNTINSQGNRYIAKLKDNQDNLKQKAVETVEAFETPNDSYDDKDGYLNENNKRVTRTVEVYQNKNCNLVMHHERFDNIQSLIKVTKQLTNPITGEHTQTVQYLMANFKTTAEDFYQKILQHWRIETYHYHLDMLVEEDQHIAYKEPFSMAILRSFAINLYQLFLNANKDKKILPTGKTTMAEIKRNCLYRDDFTADLFEQEGVN

SEQ ID NO: 17177 - DNA, 498 bp, Unknown
  Obtained from environmental sample
  misc_feature (1)..(498): n is a, c, g, or t
atgggtggaagtaccattcagtattgggcaaataaaaatttattaaaaaaattgcaaataaatcaagttcatatttatgatagcgatattggttcagatgaaccaaataaatatagtaaatattttgattctatcaatagtcaaggactaaataactttacatttgaaacaaaaaaaagagagatggaaaactatattcaccacaatattatcaatgatacttatgaagggttttctataatatatagtgaagaatgggatacattagatttaggagaagaagttgcaaaatatgttcataataattcagaaaattcagaaatagaatgggatgagattgaagataaagataaaaagaaaaagaaagttagtcgtgtaaaacaaagatttaatgaagagttatcaaaacaaattacaaaacaacatcttgaagagctagaagcttttgaagagataaaagaatggtttgaaaaaatcaaggaagctacaagaggataa

SEQ ID NO: 17178 - protein, 165 aa, Unknown
  Obtained from environmental sample
  misc_feature (1)..(165): Xaa is any amino acid
MGGSTIQYWANKNLLKKLQINQVHIYDSDIGSDEPNKYSKYFDSINSQGLNNFTFETKKREMENYIHHNIINDTYEGFSIIYSEEWDTLDLGEEVAKYVHNNSENSEIEWDEIEDKDKKKKKVSRVKQRFNEELSKQITKQHLEELEAFEEIKEWFEKIKEATRG

SEQ ID NO: 17179 - DNA, 771 bp, Unknown
  Obtained from environmental sample
  misc_feature (1)..(771): n is a, c, g, or t
atgtcagttgaatttcaaaataacaaaatagaagctttactttatagtatggaaaatcaaataaatatagaattagaccaattaatacatgaagctagttcactacatgataaagtggaaagctatttaacctctatcaaaaatatattaagagatttagatgatgatttagcttccattaattcggagattgaagagagcgtagatactaccaattacactttagaaccttatttatctaaaatagaatcttattgtgatagattttctgatttaattagaattagtgaagaaaaaaaagctttaaatcaaaagcttttttcattaagagctatgatacttcaaaataacgatgactatttagtggacttcttaatagaaaatcaagacaatatagcatttacattagatgaaagaattatctttgttccaaatgaagagatcgatttaactaaaatgacgaatctactaaaaagtgttttatcaattcctaaacctaagataaggaaaacaatcactaaaaaagtttctacaactagaaatatcatctatattgatgaagagaaaattataaatgatttagaagaaaatgggtgtgatgatttatatacttttttattaaaacatccagaaataaaaaaattagaatcttcaaaacaagatgtagaagcatttagaatatttatgttgttttgtataaataaagaatatcctttattaaaaagtatagattttaatagttctaatattaggagagtgtcttggcattga

SEQ ID NO: 17180 - protein, 256 aa, Unknown
  Obtained from environmental sample
  misc_feature (1)..(256): Xaa is any amino acid
MSVEFQNNKIEALLYSMENQINIELDQLIHEASSLHDKVESYLTSIKNILRDLDDDLASINSEIEESVDTTNYTLEPYLSKIESYCDRFSDLIRISEEKKALNQKLFSLRAMILQNNDDYLVDFLIENQDNIAFTLDERIIFVPNEEIDLTKMTNLLKSVLSIPKPKIRKTITKKVSTTRNIIYIDEEKIINDLEENGCDDLYTFLLKHPEIKKLESSKQDVEAFRIFMLFCINKEYPLLKSIDFNSSNIRRVSWH

SEQ ID NO: 17181 - DNA, 738 bp, Unknown
  Obtained from environmental sample
  misc_feature (1)..(738): n is a, c, g, or t
atgaaagtaacgattgcgacagggatatttataccagagttgggtggtccggccacctatgctgttaagattgccaaagagtttttggaattaggaaatcaagtgaatattattacttattctgacactgattattatgaactggacaaaaatttaaattataaagttactagaataaaacgaggtaataaattattgaattactggcgttattataaagccctaaaaaaatatgctaaagattcagatattatctatgcttttgatcattttagtgctggcatgccagctgccaagttttgtaaaaaatataataaacctttatatatcagagtaggtggtgattttatctgggaacgtcatttagatttagtgcaaaatttagttactttgcgaggattttatgaaaaaaatcttcatcaaacagctgaggccaaaagatttaaaataatcaaatgggtttttagtcaagctaaaaatatcatttttaccacagattttcaaaaagatatatttaaagaattttataatctagattctaatanattagatattattaataatccaatagatgttccagaacaaaaaattgttagaacagaaattaataaagagattattttttccggacgttttataaataaaaataatattataaatttgatcaaagcttttgctaatgcagatactaagtcttattcattggttttaataggcgaaaggactatacaaagctaa

SEQ ID NO: 17182 - protein, 245 aa, Unknown
  Obtained from environmental sample
  misc_feature (1)..(245): Xaa is any amino acid
MKVTIATGIFIPELGGPATYAVKIAKEFLELGNQVNIITYSDTDYYELDKNLNYKVTRIKRGNKLLNYWRYYKALKKYAKDSDIIYAFDHFSAGMPAAKFCKKYNKPLYIRVGGDFIWERHLDLVQNLVTLRGFYEKNLHQTAEAKRFKIIKWVFSQAKNIIFTTDFQKDIFKEFYNLDSNXLDIINNPIDVPEQKIVRTEINKEIIFSGRFINKNNIINLIKAFANADTKSYSLVLIGERTIQS

SEQ ID NO: 17183 - DNA, 873 bp, Unknown
  Obtained from environmental sample
  misc_feature (1)..(873): n is a, c, g, or t
gtgaaaaaaactgcaaagaatagcgtcatgataattatattgatttccatctttcttcttactggtttttttatcattaagttatatgttcaaaatagagaatctgaggaaatatctagacttttcattacaatactagcaccacaactagctgtattcattggtatcttcgctatactgaaagatgtaaatattactgacaccattccaataggatgtcagtatcattccgaaacacttaccccttttgagatagttaattttacgaatcaacttaaaaatgaaccatttcaaatgacaatgcctttaggtttcaggcttaattatcttttgtatattcaagaatataagaaacacaattggatacctgatagtattgaagaacctattaaatcatcttctaaagtttattttgaaatattgcttagaaaaattgtcgatgatattgtgatgcaatcgcatcttggttggaatgactttaatagttccgaaagcaactcggagatttataaaagaagaatgcttgatgatgaattttctgaagctaaaatttttaatgtactactagaaggcccatcaagctttatgttgcctaaaaagactgtaacaacagttacaatagactggaaatttcaaaaagcagaaattttatttgaaaataagtattcatccctaaacattaaacttctatttaaatcttcaggttttggcttaggagaaattggattattacataaaatatctccattactagctcaggaacaatatatttcaacagattttttcatagaaataaatggaaaaaataacaagtattattctcatcatccaaatacaaaatataatacgaattggataaatagaaacatttaa

SEQ ID NO: 17184 - protein, 290 aa, Unknown
  Obtained from environmental sample
  misc_feature (1)..(290): Xaa is any amino acid
MKKTAKNSVMIIILISIFLLTGFFIIKLYVQNRESEEISRLFITILAPQLAVFIGIFAILKDVNITDTIPIGCQYHSETLTPFEIVNFTNQLKNEPFQMTMPLGFRLNYLLYIQEYKKHNWIPDSIEEPIKSSSKVYFEILLRKIVDDIVMQSHLGWNDFNSSESNSEIYKRRMLDDEFSEAKIFNVLLEGPSSFMLPKKTVTTVTIDWKFQKAEILFENKYSSLNIKLLFKSSGFGLGEIGLLHKISPLLAQEQYISTDFFIEINGKNNKYYSHHPNTKYNTNWINRNI

SEQ ID NO: 17185 - DNA, 636 bp, Unknown
  Obtained from environmental sample
  misc_feature (1)..(636): n is a, c, g, or t
ttggtgttaggtttgagtctaacaacatccctctatgcaaaagattctgggttctacataggtggtttgattgggaaatctaaaacaatagattctggaaaagagacttttaccgctacanatatagatagtggttatagccaaaatattgaaaaaattgatttgatttatggtggagtacttgggtatgatcaatattttgataatttcttaattggattagaatttgatggttataaagttgattcagatgaaaaaaaagatattcaagcaggaggtgcaaatccttggcagtacacatcagaaattaataaagttgcttctttaaagttacgactgggttatttaataaatgaagaaaatttattttatatttctcttggtaaagcaaaagcagatattacaagaaaaatgtatggtactaatggtataacactacttaaagaattaaatgatagtgtagatggaaatttatatggtcttggtcttgaacattttctacagaataatctttcaattcaaatagattttaggtatatagagtatgatcaggtatcatttatagtacaagataaaacagaatatgaagatttaactgaaaaggctttgactttatcttttaagtataaattctaa

SEQ ID NO: 17186 - protein, 211 aa, Unknown
  Obtained from environmental sample
  misc_feature (1)..(211): Xaa is any amino acid
MVLGLSLTTSLYAKDSGFYIGGLIGKSKTIDSGKETFTATXIDSGYSQNIEKIDLIYGGVLGYDQYFDNFLIGLEFDGYKVDSDEKKDIQAGGANPWQYTSEINKVASLKLRLGYLINEENLFYISLGKAKADITRKMYGTNGITLLKELNDSVDGNLYGLGLEHFLQNNLSIQIDFRYIEYDQVSFIVQDKTEYEDLTEKALTLSFKYKF

SEQ ID NO: 17187 - DNA, 468 bp, Unknown
  Obtained from environmental sample
  misc_feature (1)..(468): n is a, c, g, or t
atgaacagtatgcaaacgataacccctgaaaaaaacacagttgtttcaggtctcgctttttcttttgacaacaaagagatctttatcggcacacagaagaaaagagttcttcgatacaatcttaaaaccggcaaactttcaaagatcaatggtcatataggagcagttgtaaaaatttcaacttcaaagaacggaaaatactttgccactgcatctaacgacctttcagtaaaactgtggaacactaaggacagcaaacctattctcactattccgacatcaaaaactccgggctgccttttcttcacagaggactctgaatttatcggaatttgcgacagcggacaaatcaagttctttcctgtcagatctcctgacatgaaaattacacctcttgagctgcttggaaaaatggaaaaagaatcaggcatgaaactaaaggatttctatctcgaagcaggacagtaa

SEQ ID NO: 17188 - protein, 155 aa, Unknown
  Obtained from environmental sample
  DOMAIN (44)...(81): WD domain, G-beta repeat
  misc_feature (1)..(155): Xaa is any amino acid
MNSMQTITPEKNTVVSGLAFSFDNKEIFIGTQKKRVLRYNLKTGKLSKINGHIGAVVKISTSKNGKYFATASNDLSVKLWNTKDSKPILTIPTSKTPGCLFFTEDSEFIGICDSGQIKFFPVRSPDMKITPLELLGKMEKESGMKLKDFYLEAGQ

SEQ ID NO: 17189 - DNA, 405 bp, Unknown
  Obtained from environmental sample
  misc_feature (1)..(405): n is a, c, g, or t
atgatgggaaagttaatgagcaaggatggggaaataatagaagttattttgacacaaagtgagatagaaaatttgattaagaaattaaatattgttaaggaagataaaaaccatattcattttaatatagatggtgataatgaattaatgataagtcatgaggattgtgaattaaataagtattatgagagggatgttgttagtgaaattagaaaattgtctaaagaaaagatagatgatttgttttatgcttgtgagtggattgatgagaataagggaaaaaataaagctttgtttgatgaaaagattagggagataaagaaaggggatagtaaattaattgatagttttattcaggaaactgggattgagaaaattaaaagggagttggagagattgaaatga

SEQ ID NO: 17190 - protein, 134 aa, Unknown
  Obtained from environmental sample
  misc_feature (1)..(134): Xaa is any amino acid
MMGKLMSKDGEIIEVILTQSEIENLIKKLNIVKEDKNHIHFNIDGDNELMISHEDCELNKYYERDVVSEIRKLSKEKIDDLFYACEWIDENKGKNKALFDEKIREIKKGDSKLIDSFIQETGIEKIKRELERLK

SEQ ID NO: 17191 - DNA, 516 bp, Unknown
  Obtained from environmental sample
  misc_feature (1)..(516): n is a, c, g, or t
gtgaaatttataaaacataaaaaatactctaattgtatgaggttaagaaaattcttattaaaggatacaaaagctttacaaaatttatttctcaatgaaaaaaatctaaaggataccggagtaaatgtaaatcataataaaataaccttaaaatttatgagagattggttaaaagaacgcattgaagcgcctaattctaaaaatccttcatctattgtatatgcaataattaataataaaaataatattattggaactattggtcttggaaatattaactataaaagtaagtccgcatttattggatattggatttcagaaaaatattctggaaagggtaattgtacttttgcaataaaaatttttcttgaaaagattccaaaattatttgatcttaaaaagattacttcagaagtttctgaaaagaatattgcttcatataaagttcttaagaaaaatagttttaaggttagaaaaaagttaaagggaaaccttcttttagaaaaagaactttaa

SEQ ID NO: 17192 - protein, 171 aa, Unknown
  Obtained from environmental sample
  DOMAIN (75)...(156): Acetyltransferase (GNAT) family
  misc_feature (1)..(171): Xaa is any amino acid
MKFIKHKKYSNCMRLRKFLLKDTKALQNLFLNEKNLKDTGVNVNHNKITLKFMRDWLKERIEAPNSKNPSSIVYAIINNKNNIIGTIGLGNINYKSKSAFIGYWISEKYSGKGNCTFAIKIFLEKIPKLFDLKKITSEVSEKNIASYKVLKKNSFKVRKKLKGNLLLEKEL

SEQ ID NO: 17193 - DNA, 531 bp, Unknown
  Obtained from environmental sample
  misc_feature (1)..(531): n is a, c, g, or t
ttgggtgtggatgaattaagtatggctgatctaactttattaaacgctactatttataatgatcaaagcggtaatattatggaaggtacttacagtcaaaaaatgaattcctttctaattcctgcattagcaaaatataaatttagaaataatatatatgcagaagcaggattacaatttagctggatgtataactcatggattcaatttgattctaatatagagggaaatacaacacgaattaaagaaaaaaataaagacataaccaactggtttgatatgggagtggtcgcaggagcaggatatagattattaaatggatatggatggaccttaggagctcgttattattatggatttatggatgtttataccgatatttccggtacaaaaaacagcgctatattcttaagactcaatatcccttttggtgttggagaagaaactaaaaaagaggtcaaacgtcaaaaagaacatctaaaagagaaaaaagcaaaaagaaaagaagcaaaaaataaatctaaagaataa

SEQ ID NO: 17194 - protein, 176 aa, Unknown
  Obtained from environmental sample
  misc_feature (1)..(176): Xaa is any amino acid
MGVDELSMADLTLLNATIYNDQSGNIMEGTYSQKMNSFLIPALAKYKFRNNIYAEAGLQFSWMYNSWIQFDSNIEGNTTRIKEKNKDITNWFDMGVVAGAGYRLLNGYGWTLGARYYYGFMDVYTDISGTKNSAIFLRLNIPFGVGEETKKEVKRQKEHLKEKKAKRKEAKNKSKE

SEQ ID NO: 17195 - DNA, 915 bp, Unknown
  Obtained from environmental sample
  misc_feature (1)..(915): n is a, c, g, or t
atgaaaaacagtgaaataaaattatcaaattctacagataaaaaaaatattgagctactgaaaaaatctatacaaaataagattgatagtaaaggtgataaaaattatcttatagaaaaaatgcaaattaactccatattacttgatatatattttgataaattaattgtaaatatacagcagtatcaaaaagagtttcatactcaaaaagagtatcgaaaagtatttacaacgtatagagatagtgtaaactttaataatgaagagtttgatacttactatgaatattctatcaatattcaagataaaagtgaaattgaaaaagagtttataaaaatatatgaacattatattgcaaagcaacatctctataataagatactttttaaacaaatcaaagaagatatatataacattgtcagtagtaatgaaattttgagtttttttaaaatagagagagctatcaactatttcgataatttagatatcttgaaaaatattacacctctttttgaagagattgttggtgttactattggtcaactgattttatcagttttgatatttttctctattgttatttttaaatttttatttgttccttttttactaaatagagtagagaatttttttattaaaaacagttctaataaaaaagataacagcagagtgattttgaaaaaatatttggaagattcattaaaagaacctatctctatattaatctctattgctgctttagatatctctttaagagtcttgtttatgagatatngacaagtgattattgttagttacaatgaactcacatatatactgctgcttatttggacgctttttaggttaataaataactttgtagggacttactctaccttgaacttaaccgatatccgaaggttccagcctaaatgg

SEQ ID NO: 17196 - protein, 305 aa, Unknown
  Obtained from environmental sample
  misc_feature (1)..(305): Xaa is any amino acid
MKNSEIKLSNSTDKKNIELLKKSIQNKIDSKGDKNYLIEKMQINSILLDIYFDKLIVNIQQYQKEFHTQKEYRKVFTTYRDSVNFNNEEFDTYYEYSINIQDKSEIEKEFIKIYEHYIAKQHLYNKILFKQIKEDIYNIVSSNEILSFFKIERAINYFDNLDILKNITPLFEEIVGVTIGQLILSVLIFFSIVIFKFLFVPFLLNRVENFFIKNSSNKKDNSRVILKKYLEDSLKEPISILISIAALDISLRVLFMRYXQVIIVSYNELTYILLLIWTLFRLINNFVGTYSTLNLTDIRRFQPKW

SEQ ID NO: 17197 - DNA, 666 bp, Unknown
  Obtained from environmental sample
  misc_feature (1)..(666): n is a, c, g, or t
atggctatccaacggactaaaggtgatgagattaataaattatctcatattatgattattgctgactcttttgacgccatgacaacaagcagaatttataagagtagaaaaaatgttgctcaggcgatagaagagattaaaaacttgagtgctaaacagtttcatccaaaagttgccagtcacgctgtaaatgttctagccaatatagagattgataacagtatagatcagtttcctcaaggagaattagagcatgaacgatttgtctatttttttaatgatagaatcacaggtctgtttaatcaagattatttgaatatcacttttttaaaaaataaatataataaagttaataattgtatttatattatctctttacataattttaaagatttcaattctgaaaaaggttgggagagtggtaataaactacttcataattttgcaaacaaattaaaagatcattttaaaggtcatatgctttttagaatacacgccaatgattttataatattgagccaagaacccatagatattgacactgcattttttgaagatattgctttcttagaaagagaagatataacgtattcagtaaagcagatatacaatgaagacgacaatattgaaacgcttcaagatgttgaaagacagatgtacatgtaa

SEQ ID NO: 17198 - protein, 221 aa, Unknown
  Obtained from environmental sample
  misc_feature (1)..(221): Xaa is any amino acid
MAIQRTKGDEINKLSHIMIIADSFDAMTTSRIYKSRKNVAQAIEEIKNLSAKQFHPKVASHAVNVLANIEIDNSIDQFPQGELEHERFVYFFNDRITGLFNQDYLNITFLKNKYNKVNNCIYIISLHNFKDFNSEKGWESGNKLLHNFANKLKDHFKGHMLFRIHANDFIILSQEPIDIDTAFFEDIAFLEREDITYSVKQIYNEDDNIETLQDVERQMYM

SEQ ID NO: 17199 - DNA, 333 bp, Unknown
  Obtained from environmental sample
  misc_feature (1)..(333): n is a, c, g, or t
atgattttttatgcttcattanctatattacttattaatagtttagtattagtatttaataaagagttatatatatttgtagataatcctgaaaaacattttgcttatcgtgctcatgttgcaaaagagttagcaaaagagctgcaacaaagagatattcattgtattgatttaaaagatatggaaatgcagcagagagttgaattttatggaattgaattttgtgaagagtttcaagcagtagatgaaagtagtaaagagttggaaagtgtaactattagttacaatggtaaaaaagtatatcaaatatatgtaactaaactacacaattag

SEQ ID NO: 17200 - protein, 110 aa, Unknown
  Obtained from environmental sample
  misc_feature (1)..(110): Xaa is any amino acid
MIFYASLXILLINSLVLVFNKELYIFVDNPEKHFAYRAHVAKELAKELQQRDIHCIDLKDMEMQQRVEFYGIEFCEEFQAVDESSKELESVTISYNGKKVYQIYVTKLHN

SEQ ID NO: 17201 - DNA, 609 bp, Unknown
  Obtained from environmental sample
  misc_feature (1)..(609): n is a, c, g, or t
atgggttttggcaaaaaattttgggaaggggtagtgatatcaaaggatgaaatagaaatcattttaaaaaggaaattccaagcaaaatttatgtttggttccatcgagaaacgttatttcatcaatgcactgggaattggatttgatgccagtgttgcacaatatgctgcgggaatcaaatattttaacggtcttcctcgctacttgttagctttgataaaagcagctatgaagctaaaaaatcatcatctatttttaaaagtaaatgaccgactaatggatttatcaacgttacttgtatcaataggtaatggcctctcaacaggtggtggatttcttttaacaccacatgccaaagttgatgatggaaagttcgatgtttgcgtaataaaagctgttaaattgagtagaatccctaagatattaactcgtgttctagcagccaaacatctgaatttacctgaggtagaaattatccagactgataaaattgagatttgttccgataaaatcgttccaatctattatgatggtgaattacctcaattgcaagatccttataaaatgacgatacaactacatcctggaaaaataaatttgatctgttaa

SEQ ID NO: 17202 - protein, 202 aa, Unknown
  Obtained from environmental sample
  misc_feature (1)..(202): Xaa is any amino acid
MGFGKKFWEGVVISKDEIEIILKRKFQAKFMFGSIEKRYFINALGIGFDASVAQYAAGIKYFNGLPRYLLALIKAAMKLKNHHLFLKVNDRLMDLSTLLVSIGNGLSTGGGFLLTPHAKVDDGKFDVCVIKAVKLSRIPKILTRVLAAKHLNLPEVEIIQTDKIEICSDKIVPIYYDGELPQLQDPYKMTIQLHPGKINLIC

SEQ ID NO: 17203 - DNA, 762 bp, Unknown
  Obtained from environmental sample
  misc_feature (1)..(762): n is a, c, g, or t
atgggattagaagaatgggaagctccaactgaattacctgcagaaattaaatctgcttttaatgaaactagtgcttctataactatcgacaatagaaccatttatttttctagtaaccgacctggtggttatggtggaaaagatatttataaagctactaagttacccgatggtacttgggggaaagcccaaaatttaggaccaattataaatacacagtttgatgaagatttcccctttatttttagtgatggtaaaaccttatactttagtagtaagggacatcaaaacatgggcggttttgatttatttgtttctaccgtttcaaacgaatcgtggtctaatcctgaaaatttaggaacaccaataaactctgttagagatgaattttctatagttttagctgccgatggaaaaaatgcatttttttcttctactcgtgaaggtggaattggaggtatagacatttacaaggcttttattaatgaccctccaactaatttattggttttaaaaggaattggatacgataaagactcaaacaaatccatacctgttaaagcaactttaatggaagacaacaaaactattgttggtatttacaatgcaaaagcaagtactggagaatttgtaatgattattgctccagaaaaaaattacaatatattagttgaggctgaaggttatcatcctattgctgaaaacatagattttaatataaaaaaccaaaagccaatcgtatttttattaaataaaaaataa

SEQ ID NO: 17204 - protein, 253 aa, Unknown
  Obtained from environmental sample
  DOMAIN (120)...(158): WD40-like Beta Propeller Repeat
  misc_feature (1)..(253): Xaa is any amino acid
MGLEEWEAPTELPAEIKSAFNETSASITIDNRTIYFSSNRPGGYGGKDIYKATKLPDGTWGKAQNLGPIINTQFDEDFPFIFSDGKTLYFSSKGHQNMGGFDLFVSTVSNESWSNPENLGTPINSVRDEFSIVLAADGKNAFFSSTREGGIGGIDIYKAFINDPPTNLLVLKGIGYDKDSNKSIPVKATLMEDNKTIVGIYNAKASTGEFVMIIAPEKNYNILVEAEGYHPIAENIDFNIKNQKPIVFLLNKK

SEQ ID NO: 17205 - DNA, 318 bp, Unknown
  Obtained from environmental sample
  misc_feature (1)..(318): n is a, c, g, or t
atggttctattgtcgatagttatagaagcactagtttcattaaaagcagatttaatttctgcaggtaattcagttggagcttcccattcttctaatcccatttgtgcgacttgtaagttgccagcaattaaaaaatttattatttcggctgaaaaaacaaggtttgtccatcaactgacataccttctgccaaactcctgttgtttttgggtaaaaaggaatggtttaatttttcctacagaagaattttttttaatggaaatcaccttatttgaaaaatatcaaagatataatttttcctttttagaaaaaaaataa

SEQ ID NO: 17206 - protein, 105 aa, Unknown
  Obtained from environmental sample
  misc_feature (1)..(105): Xaa is any amino acid
MVLLSIVIEALVSLKADLISAGNSVGASHSSNPICATCKLPAIKKFIISAEKTRFVHQLTYLLPNSCCFWVKRNGLIFPTEEFFLMEITLFEKYQRYNFSFLEKK

SEQ ID NO: 17207 - DNA, 699 bp, Unknown
  Obtained from environmental sample
  misc_feature (1)..(699): n is a, c, g, or t
ttggacaatatgggaaacgccattaataccctggcaagaccggtggatgccatcaaacaccaggcaaaaaccgttactgtggggaccagccggatcagcgaggtctttgaaggcaccatatttgatgaacttgcggccaatgatatccagatatcccagttgaccaataaaaatgtattggtcatcaaaaacctccaggaagtgatctcaaatgttaagggaggtcttttataccagatatcagggctcagcctgttaggagaggtcaccccggaaacaaaaatcagggtcatgggcaaaaccggttctctcacacaggaaacctcccgggtggaaaatgacccccgcctcaagggaaccaaaaatatcattgtcagagaaggcaatgtctatattggaaagggaagaaaagacaataaaagcatattggtgattccggtcatctccaaatcaccctcaacccccaacatcattgaatatatcctctctttaaatgtggtctttaaaacacccggggaagtctctcttttgaaaaaaataaaggccctgggagggaaatatacccggttaaaggattgggttcttgaaagtgaaaacatccaatgggatgataacttcttaaatctggttgcagtggacaccttgtttggtgatacggcagaacaggtggtggaaaccattcttaaaaagatcaaataa

SEQ ID NO: 17208 - protein, 232 aa, Unknown
  Obtained from environmental sample
  misc_feature (1)..(232): Xaa is any amino acid
MDNMGNAINTLARPVDAIKHQAKTVTVGTSRISEVFEGTIFDELAANDIQISQLTNKNVLVIKNLQEVISNVKGGLLYQISGLSLLGEVTPETKIRVMGKTGSLTQETSRVENDPRLKGTKNIIVREGNVYIGKGRKDNKSILVIPVISKSPSTPNIIEYILSLNVVFKTPGEVSLLKKIKALGGKYTRLKDWVLESENIQWDDNFLNLVAVDTLFGDTAEQVVETILKKIK

SEQ ID NO: 17209 - DNA, 804 bp, Unknown
  Obtained from environmental sample
  misc_feature (1)..(804): n is a, c, g, or t
ttgtctcgcaacgccatatttgagtccaagaccattgtgcatccggggccagacccgaggatttcttcccatacaactgccaaagaggagttacccatcatagaaatgtcagaagactntgatacatttaaacaaaacaaccagaccttgattgatagaattttgtacaaggaatttcagcaccagaaacgaaattttgcggttgaggccatggagcggtttgattttaatacccaaaaaattttgatttccggggtatccgtggggttgccaggcaaggcccgtaaggtgtttgcaaaggataattttgatgccattctcaatggtgaaaattttattgagcccctctcggcagatgccatggacctattgacggataaaaatatcaccaagcttttcaaagagcccgacggcaatgcccggtttgtccagatcaccaaaaccgaggatgtcatccatctggccggacaattgggatattttaacctcacggacgaatacggcatcaaggaacaatatgacatggtcatggccatgggcatcgccgcagggatcgaagccctgaaagatgccaatatcccattggtcatgcagtataagaaaatgaagggtggcaagaccatgatacccgcaggctttgcactaccagaagagatgcaggaggaaacaggtgtcattgtcacctccctgtggcccaatgcagaaactctgatcgatgagcttgaaaaatattattatgaaaaattgttcctcaagccctatgaggaatttgaaaagatctattattatctcatgaaaaggtag

SEQ ID NO: 17210 - protein, 267 aa, Unknown
  Obtained from environmental sample
  misc_feature (1)..(267): Xaa is any amino acid
MSRNAIFESKTIVHPGPDPRISSHTTAKEELPIIEMSEDXDTFKQNNQTLIDRILYKEFQHQKRNFAVEAMERFDFNTQKILISGVSVGLPGKARKVFAKDNFDAILNGENFIEPLSADAMDLLTDKNITKLFKEPDGNARFVQITKTEDVIHLAGQLGYFNLTDEYGIKEQYDMVMAMGIAAGIEALKDANIPLVMQYKKMKGGKTMIPAGFALPEEMQEETGVIVTSLWPNAETLIDELEKYYYEKLFLKPYEEFEKIYYYLMKR

SEQ ID NO: 17211 - DNA, 321 bp, Unknown
  Obtained from environmental sample
  misc_feature (1)..(321): n is a, c, g, or t
atggcagaaattagagatagtgaattggttcagtacaaagacaaaaaagttcaattaaaaaagtcaccggacaagggtgagaatatatctgtatatgttcgacctggagatgaagttgattttaatcttaagggtgtcaatgtaaacgacctacagtataagttagtaggtggtgatattattatcgatatcccaaagcaaggttcatttacatttgtatcaatggccttaatgggatacagcgataccccctcatttttttacttaantggtggtacaaaactctctttagatagtattcttactgccatagaagaataa

SEQ ID NO: 17212 - protein, 106 aa, Unknown
  Obtained from environmental sample
  misc_feature (1)..(106): Xaa is any amino acid
MAEIRDSELVQYKDKKVQLKKSPDKGENISVYVRPGDEVDFNLKGVNVNDLQYKLVGGDIIIDIPKQGSFTFVSMALMGYSDTPSFFYLXGGTKLSLDSILTAIEE

SEQ ID NO: 17213 - DNA, 462 bp, Unknown
  Obtained from environmental sample
  misc_feature (1)..(462): n is a, c, g, or t
ttgaccaatatttataatcgacactattttgatatcgaaatagaaaagaaatttaatgaagttcaacgtagtggaaatcatctgtctcttattttatttgacattgatcactttaaattaataaatgataagtatgggcatattattggtgatgattcattaatatttttatcaaatctaattaaaaatcatataagaatatacgatacattttgcagatggggtggagaagagtttatgataattacacaaaattcattagaagaaaccatcaaaattgctgaacatcttagaaaaatagttgatgatgaaactaaaaatgaagataaggtaccacacttcagctgtagttttggaattgtgacattaaatgaatttgataacattagagatgctatcaacaaagttgacaaactactttataagtcaaaagaaaatggcagaaatatggtaagttattaa

SEQ ID NO: 17214 - protein, 153 aa, Unknown
  Obtained from environmental sample
  DOMAIN (1)...(150): GGDEF domain
  misc_feature (1)..(153): Xaa is any amino acid
MTNIYNRHYFDIEIEKKFNEVQRSGNHLSLILFDIDHFKLINDKYGHIIGDDSLIFLSNLIKNHIRIYDTFCRWGGEEFMIITQNSLEETIKIAEHLRKIVDDETKNEDKVPHFSCSFGIVTLNEFDNIRDAINKVDKLLYKSKENGRNMVSY

SEQ ID NO: 17215 - DNA, 324 bp, Unknown
  Obtained from environmental sample
  misc_feature (1)..(324): n is a, c, g, or t
atgaaaagaaataatataaaaatactttatgtagattcagatagtttatatgcaaaaaaatatctgcattttcttattgaaaaaagttacgatgtaaagtatgttaatacaattaaaagtgcacttattgagtatctatatgtcaagcctgatatagttatatttgatgaaaatattcaagatggaagtggactaaccttcatcaaanagattaaaaaataccatgataaattcaaaactatcctattaacacatgattctactaaagatattttattagaagccttatctcttaagatagataaatttatagaaaaaagtgat

SEQ ID NO: 17216 - protein, 108 aa, Unknown
  Obtained from environmental sample
  misc_feature (1)..(108): Xaa is any amino acid
MKRNNIKILYVDSDSLYAKKYLHFLIEKSYDVKYVNTIKSALIEYLYVKPDIVIFDENIQDGSGLTFIKXIKKYHDKFKTILLTHDSTKDILLEALSLKIDKFIEKSD

SEQ ID NO: 17217 - DNA, 612 bp, Unknown
  Obtained from environmental sample
  misc_feature (1)..(612): n is a, c, g, or t
atgttggatattgaatacaaacagagttttagcctaataacagatgtaaaatattatataaataaagctataccttttgttatgcttactcccgaaagtagaagttatgagttagtaagagaagcatataaacatgaagctagtgaatgtttaagaaaacctatatttgcagaagagtttatattgaaaatagaccagcttattgagcaatcaaaacttatatctgaattaacagaacaaaaagagcttatggagtcttatcaacaaatagtagataaaactacaattgtttcaaaaactgataaaaatggaataataacttatataaatgagatgtttagtaaagtatccggttattcacaacaagaacttatcggcaagcctcataacataataaggcatccagatactcctaaaaatgtttttgaagatatgtggagtactataaaaaaagataaaaaaacttggaacggcattattaaaaataaaacaaaagatggtaacgactatattgttaagacctacatcaaaccaatatttgatcaagatgatgaagtaatagaatatattgcattaagaagcgatattacagatattttcaagaacaagtga

SEQ ID NO: 17218 - protein, 203 aa, Unknown
  Obtained from environmental sample
  DOMAIN (85)...(147): PAS domain
  misc_feature (1)..(203): Xaa is any amino acid
MLDIEYKQSFSLITDVKYYINKAIPFVMLTPESRSYELVREAYKHEASECLRKPIFAEEFILKIDQLIEQSKLISELTEQKELMESYQQIVDKTTIVSKTDKNGIITYINEMFSKVSGYSQQELIGKPHNIIRHPDTPKNVFEDMWSTIKKDKKTWNGIIKNKTKDGNDYIVKTYIKPIFDQDDEVIEYIALRSDITDIFKNK

SEQ ID NO: 17219 - DNA, 513 bp, Unknown
  Obtained from environmental sample
  misc_feature (1)..(513): n is a, c, g, or t
gtgattcgaaatattgaaataaaagcaaaatcaacaaatcatcaattcattagagaaattctaattaaacataatgcgtattttaaaggagaggattatcaaatagacacttattttaatgtgcaatttggacgacttaaattacgagaaggtcaaattgaaaataatttgattcattataatcgttcagatattgaaggtccaaaacaatctgatgtaatattatttcaagcaaaattagactctacactcaagcaaattttgataaaatcattgggcattttggtcgtagttgaaaaaaaaagagaaatattttttatagataacgttaaatttcatttagatactgtagaaaatttggggacttttgttgaaattgaagttattgacaaagaaggaataattggaaaggaaaaattgaacgaacaatgtcatttctttttgaaactctttaaaattgatgataaagatttaattgctcagtcgtatagtgatttattaatgaaaaaataa

SEQ ID NO: 17220 - protein, 170 aa, Unknown
  Obtained from environmental sample
  DOMAIN (2)...(169): CYTH domain
  misc_feature (1)..(170): Xaa is any amino acid
MIRNIEIKAKSTNHQFIREILIKHNAYFKGEDYQIDTYFNVQFGRLKLREGQIENNLIHYNRSDIEGPKQSDVILFQAKLDSTLKQILIKSLGILVVVEKKREIFFIDNVKFHLDTVENLGTFVEIEVIDKEGIIGKEKLNEQCHFFLKLFKIDDKDLIAQSYSDLLMKK

SEQ ID NO: 17221 - DNA, 768 bp, Unknown
  Obtained from environmental sample
  misc_feature (1)..(768): n is a, c, g, or t
ttggaaaaaattagttcagatgatattttagctaattcaataaatattactattgaaaaaatttcagagagaactaaaacaagacaggtagctcttgaagttaaagaacgaagtgactggataaatgaaggattaaatgttattcacgaggtttccagaattaatgaaaattctattgaaatattgacagatagaataaataaaaaaataagtgagtattctggtgcttttttaacttccttttttatttattacaaagatgaagaaacagaagaagaatgtttaaaatctgtttctacatttggacttgatagaagtagagcctataataaaacaattaaaataggagaaggtgtagttggttcggttgcaattgaacggaaaaaacaatattatgagaaaatcccttctgattatcacattattgtatctggtttgagtgaaatgaaaccaataagtattcttgtgcagcctctcgaatatgaaggtgaattttatggtattttagaaattgcatttttgaaaaaattgcaagtttttgaacttgatttttttgaagctgtttcaaaagaaattgcactttcgataaaaaatattttgaataatatttctactaaaaagcttattgagaaaatgcaatttcaaactactgaaattgaaaaaactcaaaaaatgcttcaaactaaggtgaaagaaattacgattaaagaaaaagaagctcacgaaagagaggttgcattgaaaagggaacttgaaggctgtaaataa

SEQ ID NO: 17222 - protein, 255 aa, Unknown
  Obtained from environmental sample
  misc_feature (1)..(255): Xaa is any amino acid
MEKISSDDILANSINITIEKISERTKTRQVALEVKERSDWINEGLNVIHEVSRINENSIEILTDRINKKISEYSGAFLTSFFIYYKDEETEEECLKSVSTFGLDRSRAYNKTIKIGEGVVGSVAIERKKQYYEKIPSDYHIIVSGLSEMKPISILVQPLEYEGEFYGILEIAFLKKLQVFELDFFEAVSKEIALSIKNILNNISTKKLIEKMQFQTTEIEKTQKMLQTKVKEITIKEKEAHEREVALKRELEGCK

SEQ ID NO: 17223 - DNA, 864 bp, Unknown
  Obtained from environmental sample
  misc_feature (1)..(864): n is a, c, g, or t
atgtttaaaatcaatagtttaaaaacaaatattgtaatttttcttatactatttacatccatacctttaattatagcatcttctcttattttatataccacttatgaatcaaaaaaagaagcactatttagtaaacatttacaagtattaaaacaagttgaagaggatattaatagcaatattatgaatattgaacaacttggagaatttgttagaaaaaattttatcaaaagaaaaaataaaatacttgaagggcttatagggacacaaaaaactataaaagagatttatattttagacagagaaggcttagtaaaagattttcaaacgagagtaaaatctaatctttttattggatatgatttttcaaatacaaaatattatatggagataaataatggtaagttgaaatattggtcagatgtatatctatcaaatacaacaaatacaccagtgatatcttatagtgtaaaaatagatgatgataatattattgtttttgttcttgatcttgccatgctaaacacatttgcacagaagtttcagagtggagatggttcaactatggttagaattatggataacaatggtgtctttttagcaaatcccgataagccagagtttgtatttcagcaaaaaaatatcttaaatcttggattgtataaaaattttatttcaaagggatataaataccgacaaataacatttcaaatgcagctaaaaatctttgaaacatattggagtatatggcgtaacaaaaaaaacttcatggtatgtagtagtaaaaggagatatgagtatatatttcaaacatattttaaaattatggaattttcctggggctatttaatgttgggaggatag

SEQ ID NO: 17224 - protein, 287 aa, Unknown
  Obtained from environmental sample
  misc_feature (1)..(287): Xaa is any amino acid
MFKINSLKTNIVIFLILFTSIPLIIASSLILYTTYESKKEALFSKHLQVLKQVEEDINSNIMNIEQLGEFVRKNFIKRKNKILEGLIGTQKTIKEIYILDREGLVKDFQTRVKSNLFIGYDFSNTKYYMEINNGKLKYWSDVYLSNTTNTPVISYSVKIDDDNIIVFVLDLAMLNTFAQKFQSGDGSTMVRIMDNNGVFLANPDKPEFVFQQKNILNLGLYKNFISKGYKYRQITFQMQLKIFETYWSIWRNKKNFMVCSSKRRYEYIFQTYFKIMEFSWGYLMLGG

SEQ ID NO: 17225 - DNA, 546 bp, Unknown
  Obtained from environmental sample
  misc_feature (1)..(546): n is a, c, g, or t
atgctgatgatttttatggaaaaaaatgcttttaaattatgggtggtttttttgtcagaaaccaaaaatgattcttctgattatgcaatggttggatataaacttgaaaatactctatcagaaaatggtagtgtatcaagaggtatatgtcagtcggaaaaagattttcttactgatgttgtagaacgaacaagcattatgcataaagatgaaaatattgtttttactgaggatggaaaaactgaaacaattaccggtaattcagtagtatcaatgaacttctgggggttctctcctcttttcttcaaacaacttgaaagtgatttcattgattttattaatgaaaaatcgcatgaactaaaagctgaattttatatcccaacagttgccaacaatctaattgaaagcaaggatgctacaataaaggtgcttacaagcgacgaccgctggtttggagttacatatcaggaagataaagaaactacaatcaaggaagttaagaaacttgtagattcaggctactatcctaaaaaactatgggattaa

SEQ ID NO: 17226 - protein, 181 aa, Unknown
  Obtained from environmental sample
  misc_feature (1)..(181): Xaa is any amino acid
MLMIFMEKNAFKLWVVFLSETKNDSSDYAMVGYKLENTLSENGSVSRGICQSEKDFLTDVVERTSIMHKDENIVFTEDGKTETITGNSVVSMNFWGFSPLFFKQLESDFIDFINEKSHELKAEFYIPTVANNLIESKDATIKVLTSDDRWFGVTYQEDKETTIKEVKKLVDSGYYPKKLWD

SEQ ID NO: 17227 - DNA, 528 bp, Unknown; identical to SEQ ID NO: 16259
  Obtained from environmental sample
  misc_feature (1)..(528): n is a, c, g, or t

SEQ ID NO: 17228 - protein, 175 aa, Unknown; identical to SEQ ID NO: 16260
  Obtained from environmental sample
  misc_feature (1)..(175): Xaa is any amino acid

SEQ ID NO: 17229 - DNA, 705 bp, Unknown
  Obtained from environmental sample
  misc_feature (1)..(705): n is a, c, g, or t
atgggtggatttcatattgtttgtgatgctaccaatgatgacacaatcactaagttaagagcgtataaaaatcgtccagcaaaaccttttgctattatgtgtaaagatttagaacaaattcaaactattggaaaagttaatactacagaagaaaaacttcttatctcaaaagaagctccaatcgtagtgcttgacaagcttcaaaattctagtataagtgattttatcgctcctcatattactaaaattggatgttttttaccttatacacctattcattatttgcttttcgaacatcttgatacccctatagttgcaactagtgcaaatatgggtggggaaccaatcatcatatcaaaagaggagattgagtcaaagttaccttttatagattttattgttgattttaacagagatattgtcaatgctgttgatgatagtgtagtacaagttattaacaataaagtacaaactttacgactctctcgtggttatgctccaaaggttattaaacttccttttaaaattgataaaaagatactttgtgttgggggcaacaataaaagtagtatcaccatagcttttgaagatactttaattttgagtgcccatattggagatttggacaatattaaagcatttgaatattttacgagaactatagaaacttttaaaagttttatgactttaccccagatattatag

SEQ ID NO: 17230 - protein, 234 aa, Unknown
  Obtained from environmental sample
  DOMAIN (1)...(162): yrdC domain
  misc_feature (1)..(234): Xaa is any amino acid
MGGFHIVCDATNDDTITKLRAYKNRPAKPFAIMCKDLEQIQTIGKVNTTEEKLLISKEAPIVVLDKLQNSSISDFIAPHITKIGCFLPYTPIHYLLFEHLDTPIVATSANMGGEPIIISKEEIESKLPFIDFIVDFNRDIVNAVDDSVVQVINNKVQTLRLSRGYAPKVIKLPFKIDKKILCVGGNNKSSITIAFEDTLILSAHIGDLDNIKAFEYFTRTIETFKSFMTLPQIL

SEQ ID NO: 17231 - DNA, 612 bp, Unknown
  Obtained from environmental sample
  misc_feature (1)..(612): n is a, c, g, or t
atgaaacttttaggaggggagaaagcgataaaagaaccacgaagagttgcaatggcacttttatttgagaactatacattagaggagattatgaagtttaatcttcctattacaaaaacattttcacaaatagaactgtcacttctctatcaaagttttgaaaaaaatatcaatagttttgatacaacttctgttgggagattatttgatgctattgcatccttttgtgatctgtctcagattttatcctatgagggggagagtggacttctcttagaatcttattatgaagaaagtattactaaaacttttgagtgggatattgtaaataatattatagatataaaaatagtggattttattcttcataatagttatgatacaaaactattatcctctatgcttattaatactttgtctggaattattgtagaactctcactaaaacatagttttgatgttattctttcaggtggggtatttcaaaataaaacactccttcaaaaagttctagtagatttaaaagtaaacaataaaaaataccatataaatgaaaaaaccccaccaagtgatggcggggttagtttaggtcaagtgctcagccgattctga

SEQ ID NO: 17232 - protein, 203 aa, Unknown
  Obtained from environmental sample
  misc_feature (1)..(203): Xaa is any amino acid
MKLLGGEKAIKEPRRVAMALLFENYTLEEIMKFNLPITKTFSQIELSLLYQSFEKNINSFDTTSVGRLFDAIASFCDLSQILSYEGESGLLLESYYEESITKTFEWDIVNNIIDIKIVDFILHNSYDTKLLSSMLINTLSGIIVELSLKHSFDVILSGGVFQNKTLLQKVLVDLKVNNKKYHINEKTPPSDGGVSLGQVLSRF

SEQ ID NO: 17233 - DNA, 642 bp, Unknown; identical to SEQ ID NO: 7099
  Obtained from environmental sample
  misc_feature (1)..(642): n is a, c, g, or t

SEQ ID NO: 17234 - protein, 213 aa, Unknown; identical to SEQ ID NO: 7100
  Obtained from environmental sample
  misc_feature (1)..(213): Xaa is any amino acid

SEQ ID NO: 17235 - DNA, 819 bp, Unknown
  Obtained from environmental sample
  misc_feature (1)..(819): n is a, c, g, or t
gtgaaatggtattataccattaccatgataacaaaagactcaatagaaaacttaaaatctcaccttgatgttgttgacattatatctcagtttattgagttaaaaaaaagtggagcaaattttaaagcgtgttgccctttccacggggaagatacaccttcatttgttgtaagtccacaaaagcagatttaccactgttttggttgtggtgtgggtggagattctataaagtttgtgatggagtatgaaaaactttcctacccagaagctatagagaaattagcttccatgtcaaatgtatcattacaatatgataatgatgcaaaaaaagtagacttatcaattattacaaaagtaaataatcactatcaaaaacttttagtatatcatccaaatgctatggattatttaaaacaaaggggagtatcttcctcttcaattgaaaagtttgagatagggtacgctagtagttcacaagatactatcaattatctcaaaacaaattttttaaaccttgcagatgcaaaagagtttgggataattgatacaggacaaaatggactatatgctagatttatagagaggatcacatttccaatatatacaattaatggaaatattgtaggatttggtggaagaacaataactggacacaatgcanaatatgtaaattcgccacaaacaaaatttttcaataaatcaaggcttctttatggatatnatattgcaaaaagagttatctataaacaaaaaaccattatagtaacagaaggatatctgatgtggtatgcttcatcagcaggatttacaatactgtag

SEQ ID NO: 17236 - protein, 272 aa, Unknown
  Obtained from environmental sample
  DOMAIN (10)...(107): CHC2 zinc finger
  misc_feature (1)..(272): Xaa is any amino acid
MKWYYTITMITKDSIENLKSHLDVVDIISQFIELKKSGANFKACCPFHGEDTPSFVVSPQKQIYHCFGCGVGGDSIKFVMEYEKLSYPEAIEKLASMSNVSLQYDNDAKKVDLSIITKVNNHYQKLLVYHPNAMDYLKQRGVSSSSIEKFEIGYASSSQDTINYLKTNFLNLADAKEFGIIDTGQNGLYARFIERITFPIYTINGNIVGFGGRTITGHNAXYVNSPQTKFFNKSRLLYGYXIAKRVIYKQKTIIVTEGYLMWYASSAGFTIL

SEQ ID NO: 17237 - DNA, 303 bp, Unknown
  Obtained from environmental sample
  misc_feature (1)..(303): n is a, c, g, or t
atgtttgcttccccaattcttttcataatgcagtgcagtgcagacgtttgttgcaaaaggaaacgaaatcttttgttgcaatcggccatcttcagtgtcttcaaaaactatgaccggctttcgaagcatccatccaacatgtgctgcagatggtccaactctggcaacaaaaagatcaggtttaaatttgcgagcatgcttccagaggcggtaatctcgcacaatgagttcttttcccaagtttacaagtcctgctcctggatgttggctcaaacaagaatattccaggccccaggcatctaa

SEQ ID NO: 17238 - protein, 100 aa, Unknown
  Obtained from environmental sample
  misc_feature (1)..(100): Xaa is any amino acid
MFASPILFIMQCSADVCCKRKRNLLLQSAIFSVFKNYDRLSKHPSNMCCRWSNSGNKKIRFKFASMLPEAVISHNEFFSQVYKSCSWMLAQTRIFQAPGI

SEQ ID NO: 17239 - DNA, 726 bp, Unknown
  Obtained from environmental sample
  misc_feature (1)..(726): n is a, c, g, or t
atgtctaaaaaatctgatgcaatatcaactaaaaagattgacgaagctatagaacaaatttttacacacttaaataaggatcatagaaatcttaatgagttttttaatgctcttggatctaaaacatcagatgatgatgttgtagcaaatattgatagttgggtaaatggtagcaataaaagattttttaataataaacaagacagtttatcttttgaaaatagaattacggtttttgctatggatacaatttttcaaaatcctgatgctcctgcattagttgcactttatatttttcaaaaattaaagcagcttggaaaaccattattaatatttattgatgagatagtgagctatttaaaaaattatgcatttgctagtcaaattttagaaattttacttgaaattagaaaaaaagatggagctttattattagcagcacaagactataaattttttctcaataatgaaattggtaaagagatactcggttcatcattagctaatctgattttatttccagattccgtagatgaagattatcaaaaggctttaaatcttactaataaagaatatgaatatatcaaaacagcaacaaataaaagacatgtgttactaaaaagagttcagcacggaacatctacagtattaaatgttgatttatctagtcttgaagaaaatgtaaaattatttgatagttctagtaatgttgttagaaagagttaa

SEQ ID NO: 17240 - protein, 241 aa, Unknown
  Obtained from environmental sample
  misc_feature (1)..(241): Xaa is any amino acid
MSKKSDAISTKKIDEAIEQIFTHLNKDHRNLNEFFNALGSKTSDDDVVANIDSWVNGSNKRFFNNKQDSLSFENRITVFAMDTIFQNPDAPALVALYIFQKLKQLGKPLLIFIDEIVSYLKNYAFASQILEILLEIRKKDGALLLAAQDYKFFLNNEIGKEILGSSLANLILFPDSVDEDYQKALNLTNKEYEYIKTATNKRHVLLKRVQHGTSTVLNVDLSSLEENVKLFDSSSNVVRKS

SEQ ID NO: 17241 - DNA, 834 bp, Unknown
  Obtained from environmental sample
  misc_feature (1)..(834): n is a, c, g, or t
gtgaatttaatagattttccaaaatataataaagaaccagtttttgctttcgatagagatggtaatctttgttcttcaaatgaacctaaaaaagaaaaattaccttttattgtaaaatataaccaattatttaaagatgatacaatcaaagatatatataatataattgataataatatggaaaaaaatacaattgtaatagaagataatagatactattctctaagattaattggttctaaagatgctaataaaattttagtatatgggtatgatataacacaaataaagaaaaatgaacaacagttaagagaacaatcaaaacttgcagctcttggggagatgataggaaatattgctcatcaatggagacaaccattatctgttatatcaacagcagcaacaggaatgaagatacaaaaggagtttaatcttttaaaagacgatgattttaattcagcttgtgacatgatagatgagtatgctcagtatctgtcaaaaacaattgatgattttagggattttataaaaggggatacaaaaaatgttcgctttaatttaaaagaggagatagaatcttttttgaaattagttgagtctgatataaaaacatatcatattgaggttataaatagttgtgaagataatattataatcaatggtcatccaaatgaattaaaacaatgttttataaatatctttaataatgcanaagatgcatttttacaaaattctcatcttgaagagagatatttttttataacactaaaaaaagacaagaatcgggttacaatctccttttgtgacaatgctggccgggataccaaaggatgt

SEQ ID NO: 17242 - protein, 278 aa, Unknown
  Obtained from environmental sample
  DOMAIN (111)...(181): His Kinase A (phosphoacceptor) domain
  misc_feature (1)..(278): Xaa is any amino acid
MNLIDFPKYNKEPVFAFDRDGNLCSSNEPKKEKLPFIVKYNQLFKDDTIKDIYNIIDNNMEKNTIVIEDNRYYSLRLIGSKDANKILVYGYDITQIKKNEQQLREQSKLAALGEMIGNIAHQWRQPLSVISTAATGMKIQKEFNLLKDDDFNSACDMIDEYAQYLSKTIDDFRDFIKGDTKNVRFNLKEEIESFLKLVESDIKTYHIEVINSCEDNIIINGHPNELKQCFINIFNNAXDAFLQNSHLEERYFFITLKKDKNRVTISFCDNAGRDTKGC

SEQ ID NO: 17243 - DNA, 804 bp, Unknown
  Obtained from environmental sample
  misc_feature (1)..(804): n is a, c, g, or t
atgatagtagaaatagtatttgctgcaggatgtttttggggagtagagaaacattttgaatcgcaagatggtgttatagatgtaaagtcaggttatacaggtggaagttacccaaaccctacatataaagatgttttaaaatatagatgggtcgaagatgataaaaaaattattaaccatacagaagctgtaaaggtaaagtttgataatgaaaaaataagtgccaatgagcttattaaatcattttgggaattacatgatccaactactaaagataaacaaggtaatgatataggtaataactatagaagtgctattttttatactaatgaaaatcaaaaaaatattgcttataatacaaaagctatttatcaaacactcttacaagaacatgggtttggagatatcgttacccagattcaaccactcaagaagttttatgatgctgagcaatatcaccaagattatttaactaaaaatccaaatggatattgtcctaatcatagtacgggtgtaaagtttgaaaaacaaaatgatgataaaaaaagagatacaattgttccaatagggggtaaagagatagtggtaattgaagctgaagtattttgcccctattgtgaaaagtttaaagaagaggtaagtagctcttataaaggaactttacctttacgaacagtatatagttctcaactaaaaggttttgatattaagacaaaactagatgcaacaccaactatactttttattgaaaatggaaaagagattttgcacatagaggtttttaaatanctcagccgattctga

SEQ ID NO: 17244 - protein, 267 aa, Unknown
  Obtained from environmental sample
  DOMAIN (3)...(170): Peptide methionine sulfoxide reductase
  misc_feature (1)..(267): Xaa is any amino acid
MIVEIVFAAGCFWGVEKHFESQDGVIDVKSGYTGGSYPNPTYKDVLKYRWVEDDKKIINHTEAVKVKFDNEKISANELIKSFWELHDPTTKDKQGNDIGNNYRSAIFYTNENQKNIAYNTKAIYQTLLQEHGFGDIVTQIQPLKKFYDAEQYHQDYLTKNPNGYCPNHSTGVKFEKQNDDKKRDTIVPIGGKEIVVIEAEVFCPYCEKFKEEVSSSYKGTLPLRTVYSSQLKGFDIKTKLDATPTILFIENGKEILHIEVFKXLSRF

SEQ ID NO: 17245 - DNA, 630 bp, Unknown
  Obtained from environmental sample
  misc_feature (1)..(630): n is a, c, g, or t
atgaaatttaaaataaaaagcaagatagacaataaagacggtttcatattgtatcgagaatatgagcactcttttgattgtgagccaaatgttaatactgatatcatgataatgatacagtatttaactcttggctttgattctgaagatatgtacgcaaaagaaatttatggctataacccaaaaggtggctggttgataaaaaatcttaaaacacctatatattccataggcaatttaattttagaaagtgatgtcgaaccaggcctgtcagagcgacttcctggaagtgaaagctggagcacttattatgataaagacagcggttgggtgtgcatgggggactgcgatctagccgatgattatgttgcagtagagtttatccaaaatgctctagtagtattatacaatgacaaattagtatctttgtggcttaaaccaaactttattgcaaacagcattgaagaatacaatgctatggcagaatcagatccaaaagagacgaggctattttgggagagaatcgaaagactcaaaaaagagaaaaatcacaaacaagtgttagaaaaattaacatctataattgaagataagcttacacctcaagcagccggccgattgggcaaatga

SEQ ID NO: 17246 - protein, 209 aa, Unknown
  Obtained from environmental sample
  misc_feature (1)..(209): Xaa is any amino acid
MKFKIKSKIDNKDGFILYREYEHSFDCEPNVNTDIMIMIQYLTLGFDSEDMYAKEIYGYNPKGGWLIKNLKTPIYSIGNLILESDVEPGLSERLPGSESWSTYYDKDSGWVCMGDCDLADDYVAVEFIQNALVVLYNDKLVSLWLKPNFIANSIEEYNAMAESDPKETRLFWERIERLKKEKNHKQVLEKLTSIIEDKLTPQAAGRLGK

SEQ ID NO: 17247 - DNA, 711 bp, Unknown
  Obtained from environmental sample
  misc_feature (1)..(711): n is a, c, g, or t
atgaccactgatgccagaaagcgtatttccgctttagaacaatttactgaattgggtagcggatttaacattgccatgaaagatttagaaattagaggcgctggagatattttaggtggagaacaaagtgggtttattaatgatataggttttgatacgtatcaaaaaatactaaatgaagccattgaggaattaaaggaaactgaattttcagatttatataaagacgacctcaagcctaaagcatatgtaaaggatattactattgatactgattttgaattattatttccagacgattatatcaataatattaccgagcgtttaaacctttataccaaactcaacgacattaaaacagaagaagaactcgctaaatttgaaaccgaaattatcgacagatttggcgaattacctattcaagtttcagacttattagatagtgtacgcttaaaatggattgccacaaaaatgggaatagaaaaactcattatgaaacaaggtaaaatgattggttattttgtacaagaccagcaaagtggtttttatcaaagtgatgcatttacaaaagtgttacagtttgtacagttaaatgctcataaatgtaaaatgaaagagaaacaaactagaaaaggtttacgtttgcttcttaccttcgaaaatataacatctaccaaacaagcactggcagcattatccgatattaaatga

SEQ ID NO: 17248 - protein, 236 aa, Unknown
  Obtained from environmental sample
  DOMAIN (90)...(204): TRCF domain
  misc_feature (1)..(236): Xaa is any amino acid
MTTDARKRISALEQFTELGSGFNIAMKDLEIRGAGDILGGEQSGFINDIGFDTYQKILNEAIEELKETEFSDLYKDDLKPKAYVKDITIDTDFELLFPDDYINNITERLNLYTKLNDIKTEEELAKFETEIIDRFGELPIQVSDLLDSVRLKWIATKMGIEKLIMKQGKMIGYFVQDQQSGFYQSDAFTKVLQFVQLNAHKCKMKEKQTRKGLRLLLTFENITSTKQALAALSDIK

SEQ ID NO: 17249 - DNA, 357 bp, Unknown
  Obtained from environmental sample
  misc_feature (1)..(357): n is a, c, g, or t
atggatataaccatcatatcacaacgatacgctaaagcattgttcgatcttgcccttgaaatgaaaaaactcgagcgcattaaagaagatgtcgaattggtgctgtcagtaacaaaggaaaatccggagttcatgcgtttgctgaaaagtccgaccattccggccggaaaaaagaatacaattattgcagctatttttaagggtaatttggatgaattgacctttaaatttctgcaattggttacccgcaaagagcgtgaggtttttctggctgatatttgtttatcctttgttaaactttataaagtacatcataatattgtaagtatcaagctaaacctcctcccgaaaaaatga

SEQ ID NO: 17250 - protein, 118 aa, Unknown
  Obtained from environmental sample
  DOMAIN (6)...(114): ATP synthase delta (OSCP) subunit
  misc_feature (1)..(118): Xaa is any amino acid
MDITIISQRYAKALFDLALEMKKLERIKEDVELVLSVTKENPEFMRLLKSPTIPAGKKNTIIAAIFKGNLDELTFKFLQLVTRKEREVFLADICLSFVKLYKVHHNIVSIKLNLLPKK

SEQ ID NO: 17251 - DNA, 558 bp, Unknown
  Obtained from environmental sample
  misc_feature (1)..(558): n is a, c, g, or t
atggatataaccatcatatcacaacgatacgctaaagcattgttcgatcttgcccttgaaatgaaaaaactcgagcgcattaaagaagatgtcgaattggtgctgtcagtaacaaaggaaaatccggagttcatgcgtttgctgaaaagtccgaccattccggccggaaaaaagaatacaattattgcagctatttttaagggtaatttggatgaattgacctttaaatttctgcaattggttacccgcaaagagcgtgaggtttttctgcttgatatttgtttatcctttgttaaactttataaagtacatcataatattgtaagtatcaagctaacctcctccgaaaaaattgatgaagaaaccaggaagagcctgattaaactccttagcgatgacacgaattctgttgtggatcttactgaggaaattgataaaagtattatcggtggttttgtactcacaatggatgataaaaagtatgatgcaagcattaagcatcagcttgaaaagctgggtaaaacattcgataaaaacctttacattaaaggattttag

SEQ ID NO: 17252 - protein, 185 aa, Unknown
  Obtained from environmental sample
  DOMAIN (6)...(176): ATP synthase delta (OSCP) subunit
  misc_feature (1)..(185): Xaa is any amino acid
MDITIISQRYAKALFDLALEMKKLERIKEDVELVLSVTKENPEFMRLLKSPTIPAGKKNTIIAAIFKGNLDELTFKFLQLVTRKEREVFLLDICLSFVKLYKVHHNIVSIKLTSSEKIDEETRKSLIKLLSDDTNSVVDLTEEIDKSIIGGFVLTMDDKKYDASIKHQLEKLGKTFDKNLYIKGF

SEQ ID NO: 17253 - DNA, 345 bp, Unknown
  Obtained from environmental sample
  misc_feature (1)..(345): n is a, c, g, or t
ttggatatccctagatttgcctttgtaggtgaagtaaatattgcacataagttaagatataaaactttggatgtaaaatggtatgagccaaaagaattcncaaaagatggaattttacgaagagttcatgcacaagttgatccaaaatataaaactttgaagttgtatattacaaaagagggttggcgagatgtggaagtaaaaaatggtatagtagacgaaaaattaaatatttatcttaaaaaagcacgaactagaattatgttaggaagtgatgtatttacaatatcaaataaaatactaaataaaattaaaactaataaaggagaagagaatggtaaatga

SEQ ID NO: 17254 - protein, 114 aa, Unknown
  Obtained from environmental sample
  misc_feature (1)..(114): Xaa is any amino acid
MDIPRFAFVGEVNIAHKLRYKTLDVKWYEPKEFXKDGILRRVHAQVDPKYKTLKLYITKEGWRDVEVKNGIVDEKLNIYLKKARTRIMLGSDVFTISNKILNKIKTNKGEENGK

SEQ ID NO: 17255 - DNA, 510 bp, Unknown
  Obtained from environmental sample
  misc_feature (1)..(510): n is a, c, g, or t
ttgaaaaagactaatattacatttaatcaaattgaacctgtagagaatttatcgtctgtacttaaagacacattcgatatcaatcttgatgtaagtggtggttggggatatgacaataaaagtgcagtagaagtaaatagtcttgatatacctattgatcaatttttacatatgtttgctacagtgagagcaaccatagagatgaatctaatgcaagaggaagagaatagacatagtggtattaatgttgcttttttagagggggagcaatttgaaatagaaaatacgatttatgatcatattacttttgaaataacagctatgaatgaaaaaaaatatgctgaatttatccaagagtataaagataattatggaaaaaatgaagcttttgatatggataagcatttcaaaaaaagagctgaaaatactataactttaaagagtgattattggttttgtggtttagaaaaatactattatgataatcaaacacaagagtctatagtttaa

SEQ ID NO: 17256 - protein, 169 aa, Unknown
  Obtained from environmental sample
  misc_feature (1)..(169): Xaa is any amino acid
MKKTNITFNQIEPVENLSSVLKDTFDINLDVSGGWGYDNKSAVEVNSLDIPIDQFLHMFATVRATIEMNLMQEEENRHSGINVAFLEGEQFEIENTIYDHITFEITAMNEKKYAEFIQEYKDNYGKNEAFDMDKHFKKRAENTITLKSDYWFCGLEKYYYDNQTQESIV

SEQ ID NO: 17257 - DNA, 819 bp, Unknown
  Obtained from environmental sample
  misc_feature (1)..(819): n is a, c, g, or t
ttacaactttgcccaccactctttcctactccaaactcacaaaaagtagcacaagagattcttttctatataaatgatgaggggtactttgaaggaaatattgaaaaaattgccctaaagtgtaatgtatataaagagtttgttgaaactattcgtcaacgatttgcatatcttgagccaattggagttggtgcatatgatttaaaagaatcattcttatttcaacttaatgaactagaaattgatgaagaactatacaattttattaaaaaaataatagctaatttaaaaaatatagataaatattgtacacaccatagatttgaagatgctaaagagataattaaaaaatttaaaactccacctgctattgaatatcttgcagatcaaccttatataatacctgatttttttgtggaagttgatgatgatattcgtataaaaatcaacaatgattattatccagatataattgttagcgatccttttaaaacaaaaaatgaagagataaagaaaaaacttaaagaagctagagatttggtaaatcttttagaacttagaaaatcaactctctataaattaattttaataatcgttgaaaaacagattgctttttttataggaagtgaacttaagcctcttactatgtcagaagttgcaaatgaacttggatttgaagagtctacaattagtcgtgctgtatcaaataagtatatcaaatgtgctagaggaacctatcctttaaaatatttttttacaaatgcagtatcaaaaaatttatcatcttctgagataaaaaattatctctcttctgtgtag

SEQ ID NO: 17258 - protein, 272 aa, Unknown
  Obtained from environmental sample
  DOMAIN (1)...(154): Sigma-54 factor, core binding domain
  misc_feature (1)..(272): Xaa is any amino acid
MQLCPPLFPTPNSQKVAQEILFYINDEGYFEGNIEKIALKCNVYKEFVETIRQRFAYLEPIGVGAYDLKESFLFQLNELEIDEELYNFIKKIIANLKNIDKYCTHHRFEDAKEIIKKFKTPPAIEYLADQPYIIPDFFVEVDDDIRIKINNDYYPDIIVSDPFKTKNEEIKKKLKEARDLVNLLELRKSTLYKLILIIVEKQIAFFIGSELKPLTMSEVANELGFEESTISRAVSNKYIKCARGTYPLKYFFTNAVSKNLSSSEIKNYLSSV

SEQ ID NO: 17259 - DNA, 372 bp, Unknown
  Obtained from environmental sample
  misc_feature (1)..(372): n is a, c, g, or t
gtggaacctgttaaagtggttgaaaaaagtttcaataagttacaagaggaatacaagtatcactttgcatcgttagcaggtttttcaagtgatattggtgattttgggactcaattaacttatgatccaaaatgtaaaattcaatattttaataaattatatgggaaaagtagttgtagtggatttaaaggtgcatcgggtggacctgttgttttaacaacatctaaagataaaaaaacaatagaatattattttgtagggataatttctcattttcgaggaaacaagtataataagatatattttgcaccacaccatattttttatcaatcattaaaaaaagcaatagaaatatataataataaagaataa

SEQ ID NO: 17260 - protein, 123 aa, Unknown
  Obtained from environmental sample
  misc_feature (1)..(123): Xaa is any amino acid
MEPVKVVEKSFNKLQEEYKYHFASLAGFSSDIGDFGTQLTYDPKCKIQYFNKLYGKSSCSGFKGASGGPVVLTTSKDKKTIEYYFVGIISHFRGNKYNKIYFAPHHIFYQSLKKAIEIYNNKE

SEQ ID NO: 17261 - DNA, 567 bp, Unknown
  Obtained from environmental sample
  misc_feature (1)..(567): n is a, c, g, or t
atggcattaaaagtagcagtcaacggaacaggacgaataggtttaatagtaacaaagatagttacacaaagagatgatttagaattagtagcaataaattcaacagcagatatggatatgttacaatatttattaaaatatgattcagttcataaaggggtagaagcccaaatcgttgatgatacaactatgaaaatcaatggaaaagatgtaaaaatattttctactagaaatcctgatgagttaggttttggtgcttgtggagctaaagttgttatagagtgtactggtgcatttttaacgactgaaaaatgtaaagcatatctcanagatggtgtagagaaagttgtaatgagtgcacctgctaaagatgatacacctacttatgttttanatatcaatacagataactataaaggtgaagagataatatcaaatgcttcttgtactancaactgtttagctcctatttgtaaagttttagatgaagagtttggaattgtaaatgggttgatgacaactatccattcatacacaaatgaccaaaatattttagatgtaaaacac

SEQ ID NO: 17262 - protein, 189 aa, Unknown
  Obtained from environmental sample
  DOMAIN (3)...(149): Glyceraldehyde 3-phosphate dehydrogenase, NAD binding domain
  misc_feature (1)..(189): Xaa is any amino acid
MALKVAVNGTGRIGLIVTKIVTQRDDLELVAINSTADMDMLQYLLKYDSVHKGVEAQIVDDTTMKINGKDVKIFSTRNPDELGFGACGAKVVIECTGAFLTTEKCKAYLXDGVEKVVMSAPAKDDTPTYVLXINTDNYKGEEIISNASCTXNCLAPICKVLDEEFGIVNGLMTTIHSYTNDQNILDVKH

SEQ ID NO: 17263 - DNA, 735 bp, Unknown
  Obtained from environmental sample
  misc_feature (1)..(735): n is a, c, g, or t
atgagtagaactgatgcagatgtatggctgaattatctaaatgctgttggaatactattacattttcctgatgttgatggtctagaagatattattattttaaatcctaattgggctaggataatggcatataaagtattagactcggaattggttattactaatggtggtgaatttacaaaagatgattgtgatacaatttggccaaatagcaatatacattttcagcttatttctctattaaaaaaaattgagttatgttatgaaataaaaatcaatttcgaaataaaatatttagtaccagctttgttcccaaatgattatcctgataaattccctgcaattgaaaaattaagcggtattgattcattgagtaaagtaaacattgaatgtttatttagcccaattataccaccaggattgctgtatagattaatatttaggcaacattcatttatatataagttatttcgcagtaagaaaggcgtggtgttttttttagaaaatgaaaatacattttcagagataaaagaacattggaaagataattcaatatcaatttgtttacatggatcaagagttgattttctagtagaattaatattaaatgaaattcagttgataattaaagaaataaaaaagaatccatattttactagtttgaaatattcaataaatgtattgtgtaactgtgaaaaaagacagaaaaatgtaaatatgattatattaaaatga

SEQ ID NO: 17264 - protein, 244 aa, Unknown
  Obtained from environmental sample
  misc_feature (1)..(244): Xaa is any amino acid
MSRTDADVWLNYLNAVGILLHFPDVDGLEDIIILNPNWARIMAYKVLDSELVITNGGEFTKDDCDTIWPNSNIHFQLISLLKKIELCYEIKINFEIKYLVPALFPNDYPDKFPAIEKLSGIDSLSKVNIECLFSPIIPPGLLYRLIFRQHSFIYKLFRSKKGVVFFLENENTFSEIKEHWKDNSISICLHGSRVDFLVELILNEIQLIIKEIKKNPYFTSLKYSINVLCNCEKRQKNVNMIILK

SEQ ID NO: 17265 - DNA, 612 bp, Unknown
  Obtained from environmental sample
  misc_feature (1)..(612): n is a, c, g, or t
gagtatgagtttttaagtgatgaagagtttattacaatatgtgatgctattaatgaaaatgcacaatatctatcagaaacgatagatgattttagaaattttataaaaggtgatagggtaaaagagattttcagtttagaagaaaatataaactcatttattcatctagtagaaggtgcaataaaaacaaacgatatcaaacttactttaaagctagaaaaggatatcaaaataaatggttataataatgaacttatacaatgttttataaatatctttaataatgcaaaagatgctctaaaagagcatactacacacgatagaatgataaaagtaaccacttattctcaaaataatcatgctgtaatagagatgctagacaatggtggaggtatacctgaaaatattacagataaagtatttgaaccttactttaccactaaacataaatcaaaaggtactggacttggtcttagtatgacatacaaatttattgttgatggtatggatggaacaattgcagttcacaataaagagtttgaatatgaacataaaaaatacagagggacagaaataaaaatagtattgcctcttcaagtaactataccttag

SEQ ID NO: 17266 - protein, 203 aa, Unknown
  Obtained from environmental sample
  DOMAIN (80)...(199): Histidine kinase-, DNA gyrase B-, and HSP90-like ATPase
  misc_feature (1)..(203): Xaa is any amino acid
MYEFLSDEEFITICDAINENAQYLSETIDDFRNFIKGDRVKEIFSLEENINSFIHLVEGAIKTNDIKLTLKLEKDIKINGYNNELIQCFINIFNNAKDALKEHTTHDRMIKVTTYSQNNHAVIEMLDNGGGIPENITDKVFEPYFTTKHKSKGTGLGLSMTYKFIVDGMDGTIAVHNKEFEYEHKKYRGTEIKIVLPLQVTIP

SEQ ID NO: 17267 - DNA, 567 bp, Unknown
  Obtained from environmental sample
  misc_feature (1)..(567): n is a, c, g, or t
ttgtacncaaaagattcaatgatagagttaaataatgaagcagtatctttatatattaaagtaaagataacaagtgatgaaattttaaataaagttttgtttgaaaaagagttaaagttacttcaatcaattgacatgaaatacttaatacctcttaataaagctattaataaattgtttgatattcaaatctctctagttattaatcgtatacttatagatgataaatttatgaatagtgacacaatagaaagttattacttcaaaatttctaaaaaaatagataaactgtttaaagtcactaagatagcagaatataaatatgatagtgaatgtagggtatcattactgttatatacttttaattatatgattgaacaatttaaaacagaaataacaaaaggtaatcatgataaagattcacatttttacaaaggtttaaaagcgattatattatattgtgaggatataaatagtgagtactataaaagaagaaaagagaatagtgcacttctgttttttcatagaaaaatattaaaatttggtcatcaaactataataggataa

SEQ ID NO: 17268 - protein, 188 aa, Unknown
  Obtained from environmental sample
  misc_feature (1)..(188): Xaa is any amino acid
MYXKDSMIELNNEAVSLYIKVKITSDEILNKVLFEKELKLLQSIDMKYLIPLNKAINKLFDIQISLVINRILIDDKFMNSDTIESYYFKISKKIDKLFKVTKIAEYKYDSECRVSLLLYTFNYMIEQFKTEITKGNHDKDSHFYKGLKAIILYCEDINSEYYKRRKENSALLFFHRKILKFGHQTIIG

SEQ ID NO: 17269 - DNA, 729 bp, Unknown
  Obtained from environmental sample
  misc_feature (1)..(729): n is a, c, g, or t
ttgaacgttgccgtattaaaaaatgtactcaaggaaccccagggcatcaagaccgatgacctttttccaagcattgcagacctggaccgcatacaacaatacatgttcaaggagatggggataggctcccccattgatgtaaataaatttgtggatatccgttttgcccaaaaagcctgtgccaagtacgcccatagccgacaccaaagtgtattccatgacatcaaaaaatcggtacagactgtactgaatcgggataccaagggggattccacaaaagtccgtcttgacagggagggaaaatacctgattttttcactgtgtgatcaggagtacggcatcggcatccagtcggtggtggagatcatacacatggttcccttccactccatcccccagagtcctccctttgtaaaaggtgtcatcaacctccgggatcaggtgattcccgttatggaccttcgcctccggtttaacaaggaagagactgaatacaacgaccgcacctgcatcatcatccttgaacagtcatcccaaggggagaaaagtaaaattggcattattgtggacaccgtttctgaagtattgcccatcatggctgatgatattgaagatgttccctcttttggcgttgctgaaaatgcaagttgtctccttggcatggccaaaatagaccagaccatcaaaattcttattgatgccccatctctgctcaggggggagggatag

SEQ ID NO: 17270 - protein, 242 aa, Unknown
  Obtained from environmental sample
  DOMAIN (101)...(242): CheW-like domain
  misc_feature (1)..(242): Xaa is any amino acid
MNVAVLKNVLKEPQGIKTDDLFPSIADLDRIQQYMFKEMGIGSPIDVNKFVDIRFAQKACAKYAHSRHQSVFHDIKKSVQTVLNRDTKGDSTKVRLDREGKYLIFSLCDQEYGIGIQSVVEIIHMVPFHSIPQSPPFVKGVINLRDQVIPVMDLRLRFNKEETEYNDRTCIIILEQSSQGEKSKIGIIVDTVSEVLPIMADDIEDVPSFGVAENASCLLGMAKIDQTIKILIDAPSLLRGEG

SEQ ID NO: 17271 - DNA, 876 bp, Unknown
  Obtained from environmental sample
  misc_feature (1)..(876): n is a, c, g, or t
ttgattttttactctgctcacattcaatacaattccaaagggattctaaaacaagtaaaccttggcgattaccaaattaaatttggacaagggttaagtctatggtccggattaggtggcggaaaatcctctttcacaactcatcatgctaataaatctcaaggaataaaaaactataaatctactgatgaaaatcaatttcaaagaggaatatcaatagtcatcgaacctcttaaaaatattaactttgcagtatttacctcctacaaaaagaaggatggaagtattgactccgactctattaatcctggcatatccagcattgtaaatacaggatttcaccgcaacaaaaacgaatttgagaagaaacataatttagaagaaaaggttttgggctcatatttatcagctaatttgaacaatattgaattgggaatttcctatttacaatccaattactctcccgaaataagaggagccattgccccttacaattattacaactacaaaggaaatgcaaacagaaatattagcatttattatgagagcctatttcgatccatctatttatttggagaaattgcacaaagtaaatctggaggaatggcattactacaaggcgcaaacattcaagctcatccacagttaaactttgagttgatctatcgaaaatacgacccagattatcatgctttattttcaaatgcatttgcagaacaaagtaaaacccaaaacgaagaagggatttacatgggcgtggaatttcatccttatccaaaatggacagtaaaggcttattacgatcagtttaaattcccttggttaagatattcagccaactcgccaagcgaaggacacgaatatcctcagcgataa

SEQ ID NO: 17272 - protein, 291 aa, Unknown
  Obtained from environmental sample
  misc_feature (1)..(291): Xaa is any amino acid
MIFYSAHIQYNSKGILKQVNLGDYQIKFGQGLSLWSGLGGGKSSFTTHHANKSQGIKNYKSTDENQFQRGISIVIEPLKNINFAVFTSYKKKDGSIDSDSINPGISSIVNTGFHRNKNEFEKKHNLEEKVLGSYLSANLNNIELGISYLQSNYSPEIRGAIAPYNYYNYKGNANRNISIYYESLFRSIYLFGEIAQSKSGGMALLQGANIQAHPQLNFELIYRKYDPDYHALFSNAFAEQSKTQNEEGIYMGVEFHPYPKWTVKAYYDQFKFPWLRYSANSPSEGHEYPQR

SEQ ID NO: 17273 - DNA, 918 bp, Unknown
  Obtained from environmental sample
  misc_feature (1)..(918): n is a, c, g, or t
ttgaagcagaggatcagatggctcagtaaggtggatacaagactatctcgttcaaaagaacaaaatctaattaacttacaaaaagaacatgacaatttagtaagtaaacttcgagctgaagcacattggatgcaacatggtgtaacagctagaagaaaaagaaatgttttaagaaaagataattactttgaactcaaagagaaagtgaaatcaaatccagcaaaaataaataaaatgcaactagatatccaaagagaacaaaaatcttttaataatggtgacactcaaaataaaaagaaaatgctctttgaactagacaatgtatatttaactttaggaaataaaccactcataaaagactttacagcacgaattttacaaaaagatactatagcaatagttggtccaaatggaagtggaaaatcaagtattttaaaagtctttttagagagaatcaaaatagataaaggctcctttaaaaaaggtgattttaaagttggatattttgatcagcatagagagatgatagatgaaagtaaaactattatgcacctattttgtccaaatggtggagatagagttgagcttaatgatggaagaaatatgcatgtatttggatatcttaaaaactttttatttcccaaagaatatcttgataaaactgtaggagttttaagtggtggagagaaaaatagactagccctcgccctactctttactagaaaatttgatgtattgattatggatgagcctacaaatgatttagatatcccaactattaatatactagagcaatacttangcaatttccaaggtgcattaatctttgtaagtcatgatcgatattttgttgataaaattgccaaaaaactttatatatttaaaggagatggcctactagaggaaagctatcaaaaa

SEQ ID NO: 17274 - protein, 306 aa, Unknown
  Obtained from environmental sample
  DOMAIN (128)...(297): ABC transporter
  misc_feature (1)..(306): Xaa is any amino acid
MKQRIRWLSKVDTRLSRSKEQNLINLQKEHDNLVSKLRAEAHWMQHGVTARRKRNVLRKDNYFELKEKVKSNPAKINKMQLDIQREQKSFNNGDTQNKKKMLFELDNVYLTLGNKPLIKDFTARILQKDTIAIVGPNGSGKSSILKVFLERIKIDKGSFKKGDFKVGYFDQHREMIDESKTIMHLFCPNGGDRVELNDGRNMHVFGYLKNFLFPKEYLDKTVGVLSGGEKNRLALALLFTRKFDVLIMDEPTNDLDIPTINILEQYLXNFQGALIFVSHDRYFVDKIAKKLYIFKGDGLLEESYQK

SEQ ID NO: 17275 - DNA, 357 bp, Unknown
  Obtained from environmental sample
  misc_feature (1)..(357): n is a, c, g, or t
atgctatttactctttatatacgtaaattaatttatagcgtggctgagcaagataatatttttgagctatcagaaaccctaaaatggggcgaacctagttatatttcaaaaataggcagtgctattagatttgattggaaacccaaggatgcagaccagtacggtatttatttcaactgtaaaacatcgttgattgagacgtttaaaattgtttacggcgatacgtttacctatgagggtaatcgagccattatatttaactgtaaacaacagatacccgttagagaattatctcattgtatttcaatggctctacgttataaaaaaattaaacatttgaacttacttggcgcataa

SEQ ID NO: 17276 - protein, 118 aa, Unknown
  Obtained from environmental sample
  misc_feature (1)..(118): Xaa is any amino acid
MLFTLYIRKLIYSVAEQDNIFELSETLKWGEPSYISKIGSAIRFDWKPKDADQYGIYFNCKTSLIETFKIVYGDTFTYEGNRAIIFNCKQQIPVRELSHCISMALRYKKIKHLNLLGA

SEQ ID NO: 17277 - DNA, 717 bp, Unknown
  Obtained from environmental sample
  misc_feature (1)..(717): n is a, c, g, or t
ttgcctgtgaatgagtttatgtctagggtaaaagaagaacagtttgaacttaactactatgtggattttacagaaaaagattttgcaaaaagtttagtcgatgagataaataacaaatccgaagcaaaaatcgttgaaaatccaactaaactaacagatgatttagtagatattatacttcaaaactataatgagtatgaaaataaaaatgaattgtgtaaagcattggttacagaaggaattatagactttggtttagacttcgtcgacggtggatatgaaaaattaaaagaaaaactccctgcaatcgttgtatccagtgatggacttaaaggcaataaaatacgcaatggcaatgaacagaagaaaaaaacaaccattcgtacaggtaaatatcatgaacttaaagaactctgggagaccatcaatcagaaagttgtattagagtacaaaatagaaaatgaagagaagttccataatttactaaaagactatttaaaagataatgttaaaaagtttaaagagcaaggtgtagagacccataagagaagtattgagtttgaaaacagtgtagcatactataaagagatagaatcacttaatgatgagattttgccaatttcatatatgaaatataatgagtttttaatagagttagcgactgtacttaaagtcaatctcaataccctacataaagttttttatggactaaaagat

SEQ ID NO: 17278 - protein, 239 aa, Unknown
  Obtained from environmental sample
  misc_feature (1)..(239): Xaa is any amino acid
MPVNEFMSRVKEEQFELNYYVDFTEKDFAKSLVDEINNKSEAKIVENPTKLTDDLVDIILQNYNEYENKNELCKALVTEGIIDFGLDFVDGGYEKLKEKLPAIVVSSDGLKGNKIRNGNEQKKKTTIRTGKYHELKELWETINQKVVLEYKIENEEKFHNLLKDYLKDNVKKFKEQGVETHKRSIEFENSVAYYKEIESLNDEILPISYMKYNEFLIELATVLKVNLNTLHKVFYGLKD

SEQ ID NO: 17279 - DNA, 789 bp, Unknown
  Obtained from environmental sample
  misc_feature (1)..(789): n is a, c, g, or t
atggctggaagaaacaaagatgtaagatcatctatagcgataattgctatgatagaaaaggtcttggatatcaagtatcgattaaaacctgatagtgattataaaggtcttaaggaactaaaaaaacttgaaaaagattcaattgaggttacttctaaggagtatgaaaagcttgagaaaaaaagagaacaatatttaaaaatttatgaagaaggcattcgtgttttaaaaaacaaatattacatacattacgatcaaaataaagtgaatataccagagatagaaaacccattcaaagagaaagattttagtggtatgtctcttgatgaaattgaagatgagttttctgatgcattaagttcaccgatgatgaagcatatctcaggagaaattgggaaatttttacatggagaagagtatccacattataaatctgaccattacatatatgaaggttttgtaactgcaagaggaattaatccaatgtgtaaaacttttgatatttctagtataaatacacattttcagagaaaaatttatgatacaaaccaagtaaatgtagctttaaatatgtctttaccagaagatgaactagttgagtatatcaagcatataaaaaaaactttatcagatgaaaactctaaagaattaaagtcaccaaataaactactgggtaaatatgttcaagaagttgaaaagacaaaatattatcctaaaaaacaaactgcaacaaaaatagctgatatgttttttgtatatgattatgtaactgcaccgatagaagaacat

SEQ ID NO: 17280 - protein, 263 aa, Unknown
  Obtained from environmental sample
  misc_feature (1)..(263): Xaa is any amino acid
MAGRNKDVRSSIAIIAMIEKVLDIKYRLKPDSDYKGLKELKKLEKDSIEVTSKEYEKLEKKREQYLKIYEEGIRVLKNKYYIHYDQNKVNIPEIENPFKEKDFSGMSLDEIEDEFSDALSSPMMKHISGEIGKFLHGEEYPHYKSDHYIYEGFVTARGINPMCKTFDISSINTHFQRKIYDTNQVNVALNMSLPEDELVEYIKHIKKTLSDENSKELKSPNKLLGKYVQEVEKTKYYPKKQTATKIADMFFVYDYVTAPIEEH

SEQ ID NO: 17281 - DNA, 906 bp, Unknown
  Obtained from environmental sample
  misc_feature (1)..(906): n is a, c, g, or t
atgactgttaatgctattttgcaatcctcaccacatgtacttgtgagtttaaaatcttcaggaattcaatctatcaaagatttaaaaaataaaaaatataatacattctcaaatgatccaaataaagaagtaacaattaaaagtatgcttttttcacaaaatatcactcttgataatatgattcaaacacaatataaatataatatcaataatcttatagagggaaaagcagatgttgtttctgcttatagtagtaatgagctttatcatttaaagaacaaaaacttagactataatatatgggatcctaaagattatggatttgatttttatgaaaatattcttttcacttctaaaaaaacattaaataaaaacccaaagttagtacaagattttcaacaagcatctataaaaggatgggaatacgcttttgatcatattgaagaaactgtagaggttatattaaaaaaatacaataccctaaataaaacaaaagaagccttagtctatgaagcaaataccttaaaaaaactagccttttacaaaacagatacaattgggaaaatagaagagtcaaaaattcaaagaatcatcgatatatacaatctaatgggtcttctaaaaaacagtattgacctagataaatttatttatcaaccaactcaaacaaacttaaatgatacaaataaaaacaataaaataaaaacaagttttttaactgaagagcaaaaaaattatcttaaagataaaaaacaaataactatgtgtattgaccctgcatggatgccttttgaaagttttgaaaatggtcagcatataggtatgacagcagattattttaaatatttacagaaaaatttaagtaccaataaaagtataaaaaacactacatggatgcaatctatg

SEQ ID NO: 17282 - protein, 302 aa, Unknown
  Obtained from environmental sample
  misc_feature (1)..(302): Xaa is any amino acid
MTVNAILQSSPHVLVSLKSSGIQSIKDLKNKKYNTFSNDPNKEVTIKSMLFSQNITLDNMIQTQYKYNINNLIEGKADVVSAYSSNELYHLKNKNLDYNIWDPKDYGFDFYENILFTSKKTLNKNPKLVQDFQQASIKGWEYAFDHIEETVEVILKKYNTLNKTKEALVYEANTLKKLAFYKTDTIGKIEESKIQRIIDIYNLMGLLKNSIDLDKFIYQPTQTNLNDTNKNNKIKTSFLTEEQKNYLKDKKQITMCIDPAWMPFESFENGQHIGMTADYFKYLQKNLSTNKSIKNTTWMQSM

SEQ ID NO: 17283 - DNA, 825 bp, Unknown
  Obtained from environmental sample
  misc_feature (1)..(825): n is a, c, g, or t
gtgcaccaaagaacacgagaattaaatgaatcaaaaattaaattaaatgaatcatataatgagataaaacatattttaaactctactatggaagcaatttttatttttgaaaatggtgaatgtattgatgttaatgatgaggcattaagactatattgttatcctgataaaagctctatgataggaaaaaaagcgatagaatttgttacagatgaacatatcaatatcgtctcaaaaaatatacaaaacaactacacaaaaccatatgaaatagagatgaaaaaatatgatggaacaacttttccatcttttgtacgaggtaataactttacaagagataataagcttataagggttactactgtattagatttaactgaattaaaatctaaagaaacattgttaatacaacaatcaaaaatggccgcactaggtgagatgatagcaaatatttctcatcaatggagacaacctttaagtataataagtaccgtagctagtggtataaagctgaaacttgaatacaatatatttaacaaagatgaagagataaaaaacttagatattcttatagactctactagctacctatcaagtacaattgatgattttaaaaactttctaaatcctgaaaaaataaataaggtttttagtataaaaaaagttattgataaaacaattacaatgtttggtaaaaatttttctagtaacaatattgagattattacaaatactcaagatatagagattgttggaaatgaaaatgaactactccaagttattatcaatataattaacaattcaaaagatctcagccgattctga

SEQ ID NO: 17284 - protein, 274 aa, Unknown
  Obtained from environmental sample
  DOMAIN (143)...(213): His Kinase A (phosphoacceptor) domain
  misc_feature (1)..(274): Xaa is any amino acid
MHQRTRELNESKIKLNESYNEIKHILNSTMEAIFIFENGECIDVNDEALRLYCYPDKSSMIGKKAIEFVTDEHINIVSKNIQNNYTKPYEIEMKKYDGTTFPSFVRGNNFTRDNKLIRVTTVLDLTELKSKETLLIQQSKMAALGEMIANISHQWRQPLSIISTVASGIKLKLEYNIFNKDEEIKNLDILIDSTSYLSSTIDDFKNFLNPEKINKVFSIKKVIDKTITMFGKNFSSNNIEIITNTQDIEIVGNENELLQVIINIINNSKDLSRF

SEQ ID NO: 17285 - DNA, 888 bp, Unknown
  Obtained from environmental sample
  misc_feature (1)..(888): n is a, c, g, or t
atggatccgatttatcgcatcaaattttatggagatgagcaaatcttgttttcatcggatttatgcaaaatgcaaaaacaacttgaaacggttgaaccggggagctacgagaaattcctgaaatacatgtacgagagtttccgtacctataaactttcgatgaagcatattatcgaccgaaactacaacaatgctttccagtttttcaaccttaaaaaccttttgcttctttttaagctcaaggcttttaataatcattacagccataccaaaaagttttttaagagcgatttcctccggtccgtttttacattccaaaatatttatgtggggcaaaacccctttgaagcttctgcaatttttgccatgcttccttttttggaactaaccgatggcgtttggttcccaaaagggggcatgtttaaaatcgttgagaatttagtgtccatcgccactgaattaggtgtggaattcgagtacaacaaagcagttagtaaaattacaatagaaggaaaaaaaacatcgggcattcaatttgaaaacggacaaattgaaaaagcagatttggtaattgcaaatgcagatttgccttacgtttacgattcgcttttgcccgataaaagagtagcctcaaaaatcaagaaacttgactatacctgctcggcatttatttttcattttgcaatggataagacctatccaaaatttgagcaacacaatgtttttgtttcgaataactatcgcgacaatattcaggctgtttttaaagaaaagaaaatcccatcggatgtaagtttttatgttcatgcgcccgccaggcacgatagcagcgctgcacctacgggtcaggacagcattaccataatttgtacctgttggccgctatga

SEQ ID NO: 17286 - protein, 295 aa, Unknown
  Obtained from environmental sample
  misc_feature (1)..(295): Xaa is any amino acid
MDPIYRIKFYGDEQILFSSDLCKMQKQLETVEPGSYEKFLKYMYESFRTYKLSMKHIIDRNYNNAFQFFNLKNLLLLFKLKAFNNHYSHTKKFFKSDFLRSVFTFQNIYVGQNPFEASAIFAMLPFLELTDGVWFPKGGMFKIVENLVSIATELGVEFEYNKAVSKITIEGKKTSGIQFENGQIEKADLVIANADLPYVYDSLLPDKRVASKIKKLDYTCSAFIFHFAMDKTYPKFEQHNVFVSNNYRDNIQAVFKEKKIPSDVSFYVHAPARHDSSAAPTGQDSITIICTCWPL

SEQ ID NO: 17287 - DNA, 483 bp, Unknown
  Obtained from environmental sample
  misc_feature (1)..(483): n is a, c, g, or t
ttggagagatgctgctattttaaatatcacctcaagacattcaaaattagaagtacttattacgaaaaacctgaacaatcttttactattacaaaaaaagatactttgtttataatgacagataagaataatcaagaagtaaaagctcctgctaacagaattttagaatatttagaacgctacgaaaaaatttattacgaaatggttgatactgaatcgacaccagaactaattgattctgtgcttaattcccaaccttttataagaatttcggttactgatgttgatggagaaattaatgaagttgtagcttaccacatgcctaatttcagagaaacattagaccctgtaacaggcgatctttttgaatatgatgtagatagaatgtatgccaacattaacaaagaattgtttgtttacatccaatttgctacttttgatgaaattaccattaaaaaagacgactttttaattaaaaattag

SEQ ID NO: 17288 - protein, 160 aa, Unknown
  Obtained from environmental sample
  misc_feature (1)..(160): Xaa is any amino acid
MERCCYFKYHLKTFKIRSTYYEKPEQSFTITKKDTLFIMTDKNNQEVKAPANRILEYLERYEKIYYEMVDTESTPELIDSVLNSQPFIRISVTDVDGEINEVVAYHMPNFRETLDPVTGDLFEYDVDRMYANINKELFVYIQFATFDEITIKKDDFLIKN

SEQ ID NO: 17289 - DNA, 759 bp, Unknown
  Obtained from environmental sample
  misc_feature (1)..(759): n is a, c, g, or t
atgaaaaaagtgcttacacatagatatcccttagctaaaatgatacttataccaaccctcgttcaaggtgaaggtgcaaaagagagtattgtaagagggataaaaaaagcagatcaattagcacaaaatattcacaataaatctataataatagtaggaagaggtggaggaagtattgaagatctttgggcttttaatgaagagatagttgcagatgcaatttttactgcaactacacctattgttagtgcggtagggcatgaaaatgattttgtaatttctgattttgtggcagatattcgtgcaagtacaccttcaaatgctatagagataacagtacctgatataaatgaattaagaatgtatgcagatactatattaaatgattttaaccaaaaattaaaaacaatactttatcaaaaagagcaatatattaaacatacaaaaagtagttttgaacaacactctttgaaaaaaagatttgaatttgttcaagcaactattagtcagttacaacaacagtttaatagtacatatttacaaacacttaaagtaaaaaaagatgatcttaatagattacaaaatagcttttttattaatagtccagaaaaaaaagataaaaaaggctttgtacaattaactaaagataataaaattatagatatttcaaatatagagttaaaagatatcattacactggaaagttcaaaatgtactgtagaatgcgaagtaatcaataaaaaagttattaaagcttaa

SEQ ID NO: 17290 - protein, 252 aa, Unknown
  Obtained from environmental sample
  DOMAIN (47)...(199): Exonuclease VII, large subunit
  misc_feature (1)..(252): Xaa is any amino acid
MKKVLTHRYPLAKMILIPTLVQGEGAKESIVRGIKKADQLAQNIHNKSIIIVGRGGGSIEDLWAFNEEIVADAIFTATTPIVSAVGHENDFVISDFVADIRASTPSNAIEITVPDINELRMYADTILNDFNQKLKTILYQKEQYIKHTKSSFEQHSLKKRFEFVQATISQLQQQFNSTYLQTLKVKKDDLNRLQNSFFINSPEKKDKKGFVQLTKDNKIIDISNIELKDIITLESSKCTVECEVINKKVIKA

SEQ ID NO: 17291 - DNA, 744 bp, Unknown; identical to SEQ ID NO: 14859
  Obtained from environmental sample
  misc_feature (1)..(744): n is a, c, g, or t

SEQ ID NO: 17292 - protein, 247 aa, Unknown; identical to SEQ ID NO: 14860
  Obtained from environmental sample
  DOMAIN (1)...(232): RmuC family
  misc_feature (1)..(247): Xaa is any amino acid

SEQ ID NO: 17293 - DNA, 450 bp, Unknown
  Obtained from environmental sample
  misc_feature (1)..(450): n is a, c, g, or t
atgggtaacctactattaaaacttgcctattttttagaaggctctcacaaatattatacctttaaacattttgtttatgaatttttggaagacactagttctaaaaagaaaaaatattttgactttttgatgatatttttagtacttagtactgtaggtatcatgatatatgaagtaaatcatgtaacactcccatggcttagtacttatgaaactgtagctattattatttttatttatgagtggttaggaagattttggggtatctcccatgctcatagacaaatcgtagaagactatgaaaaaagtcgtcttataatcaaactttttcaaataaagaatctgttaaactatcataaaagagaactacgatccgaatttcccctatgtctattaaaacttacttgcatttttccctatatgacccataagaattctagaattctatgc

SEQ ID NO: 17294 - protein, 150 aa, Unknown
  Obtained from environmental sample
  misc_feature (1)..(150): Xaa is any amino acid
MGNLLLKLAYFLEGSHKYYTFKHFVYEFLEDTSSKKKKYFDFLMIFLVLSTVGIMIYEVNHVTLPWLSTYETVAIIIFIYEWLGRFWGISHAHRQIVEDYEKSRLIIKLFQIKNLLNYHKRELRSEFPLCLLKLTCIFPYMTHKNSRILC

SEQ ID NO: 17295 - DNA, 906 bp, Unknown
  Obtained from environmental sample
  misc_feature (1)..(906): n is a, c, g, or t
atgatcgccggaatacttttatatgaatttaaagaaaaaattaatcaaagtccagtaactataagatttgctagtgataatcctagaaacattgctaatcaagcaacaaaaaaagaatcagaacttttacgaaagtttaataataaagagatcttggaatatagtgaaataattaagaaagatggaaaacctatcttatattatgtattacctacaaaaccaacaacagataagtgtatgcgatgtcattctgatcctagtttagcaccaaaagatttaattgatatttatggagataaaaatggattttatgagcaagttgggattgttagggctgtactttcaacctcttatccattagataatgattttaaaagtgctaatcacacatttttaatgataacttttatcacttttataatttttgcatttttattgattttagtttacttttttataagaaaaattcatgaagcaaatattacattagataagaaagtgatacaaagaacaaaagaacttaaagaggaaaaagagcatataaaagcaattttagatattaatccaaatataattattgttattttaaatgataaaattcttagtgcaaataaacagttttttaaattctttaagattaattctctagaagagtttgttgaaaaatataaaacaattggtagttttatagtacaagttgataaaaagccattaccaaaagacaataaaatagaagggctactatggtacgagtatttagcanaaatagaaaaaaaagtacatcatgtagcaattgattttaatgatataacaagttgttttctaacaagtgcaatatattttaaacaatcagaagagatattaattacttttaatgatataacagaacaggatgataaagantag

SEQ ID NO: 17296 - protein, 301 aa, Unknown
  Obtained from environmental sample
  misc_feature (1)..(301): Xaa is any amino acid
MIAGILLYEFKEKINQSPVTIRFASDNPRNIANQATKKESELLRKFNNKEILEYSEIIKKDGKPILYYVLPTKPTTDKCMRCHSDPSLAPKDLIDIYGDKNGFYEQVGIVRAVLSTSYPLDNDFKSANHTFLMITFITFIIFAFLLILVYFFIRKIHEANITLDKKVIQRTKELKEEKEHIKAILDINPNIIIVILNDKILSANKQFFKFFKINSLEEFVEKYKTIGSFIVQVDKKPLPKDNKIEGLLWYEYLAXIEKKVHHVAIDFNDITSCFLTSAIYFKQSEEILITFNDITEQDDKX

SEQ ID NO: 17297 - DNA, 741 bp, Unknown
  Obtained from environmental sample
  misc_feature (1)..(741): n is a, c, g, or t
gtgctgcttcatgcaacatcattttcacgtgctaacgagtatgcagtaaatataaaaaacacatcgcagtacttaaaacccacaactgacctcttttttacatataaaaatagatatatatattttggaaaacttcaaccacttacacaaattgcatcagatatacgaatgtttgagcttgataagtacaatttaaaatctgttttagttgcaagtaaagcaaagtttatagatgattattggcatattaagagagctaacttaatcactaaacctgaagatattgactttaagagtgaaggaataagcataatcgatgaagagaatatccagattttaaaaggttttaaacctaaaattttagatcaagtctatgaaggtaaagtgaacttctctatcattgatgccatagatgcactaaagcttctaaatgatcaaaatatcaacactgatagaataaaaagtgctctatttaaaatttttgtttatccactgtttgttcctagtatggttattattattttcttctttgtacctgtatcacaaagatttttaaatgtctcactttttagctttggcgccctattagcaactcttcttatttggggtgttttatttaccatgatagagctttcaaacactaaagtagtatctcctgaagttggtattgcacttcctgtattagtgctaatgaccatctcgattctcctctggagaacacagcacaaaaagagctcataa

SEQ ID NO: 17298 - protein, 246 aa, Unknown
  Obtained from environmental sample
  misc_feature (1)..(246): Xaa is any amino acid
MLLHATSFSRANEYAVNIKNTSQYLKPTTDLFFTYKNRYIYFGKLQPLTQIASDIRMFELDKYNLKSVLVASKAKFIDDYWHIKRANLITKPEDIDFKSEGISIIDEENIQILKGFKPKILDQVYEGKVNFSIIDAIDALKLLNDQNINTDRIKSALFKIFVYPLFVPSMVIIIFFFVPVSQRFLNVSLFSFGALLATLLIWGVLFTMIELSNTKVVSPEVGIALPVLVLMTISILLWRTQHKKSS

SEQ ID NO: 17299 - DNA, 807 bp, Unknown
  Obtained from environmental sample
  misc_feature (1)..(807): n is a, c, g, or t
ttgccaatacgaaagatgtttttcatttgtcgcgattactttgcgtcaaagagcgacattcagatgcatacacatgattatgcagagattttttggatgagaaaaggggaaggttttcatttaataaatggagatgaaatcaagatttcaccgggctatttatgcactgttcgaccatcagataagcatacttttattgcaaaaacggcaaagcaaggcataacaattaccaaccttgcatttcatcaggatacattagaatatcttaaaaacagatatttcctaaatacaaatctctatttttggagtgaaagtcagcttccttttagcattagaatggatgaaaaaggtttgaagttgcttcgaaataaggcaaatcaggtaattactcaatcgaagaataatattcatcttgatcgatttttactgtttatttttgagattattaccccaataggcggaaatgagaattcagatatgccatactggatgcagacttctttggaaaaatacaactccccgttgtatttcaaacagggagttgatggatttttatctttgacaaatagatccttggatcattgcaatcggattcttaagaaaggtaccggtaaaacattaaccgagactttaaatttagcaaaattgacctatgctgccagattgttaatcatgactgatgcttccattaaggcaatagtttcagattgtggatacaacaatatgggctatttttatcgggtttttaaaactcaattcaacatgtcgccaaaagattatcatgtatccaataagaagattatttaa

SEQ ID NO: 17300 - protein, 268 aa, Unknown
  Obtained from environmental sample
  DOMAIN (218)...(262): Bacterial regulatory helix-turn-helix proteins, AraC family
  misc_feature (1)..(268): Xaa is any amino acid
MPIRKMFFICRDYFASKSDIQMHTHDYAEIFWMRKGEGFHLINGDEIKISPGYLCTVRPSDKHTFIAKTAKQGITITNLAFHQDTLEYLKNRYFLNTNLYFWSESQLPFSIRMDEKGLKLLRNKANQVITQSKNNIHLDRFLLFIFEIITPIGGNENSDMPYWMQTSLEKYNSPLYFKQGVDGFLSLTNRSLDHCNRILKKGTGKTLTETLNLAKLTYAARLLIMTDASIKAIVSDCGYNNMGYFYRVFKTQFNMSPKDYHVSNKKII

SEQ ID NO: 17301 - DNA, 900 bp, Unknown
  Obtained from environmental sample
  misc_feature (1)..(900): n is a, c, g, or t
ttgttattgaatgctaaagaaaatattagcatggtagattatgaagccattacagctattgatggaagaaggttaattggttttggaagatatgctggagtggttggttgttacaatagttttatggcttatggtaaaagagaaaaaactttcgatttaaaaagagcttatttgtgtgatgatagaaaagaaatggaagcagaacttaaaaaagtgaaactcccagaaagttataaaattgtaataacaggtggaggaagagtagctggtggtattattgaaattttagaagttatcggaataaaaaaagtaactccagacgagtttttaaatcaatcatttaatgagccagtatatacgcagctaaatgttcatgattataataaacggaaagacggaaaaacgtttgattctcaagatttttttgataatcctactgaatttgaaggtgattttttccggtttgctaaagttgccgacatgtacatttcaggtcatttttgggatgaagaagctccgtttatcttttctcgtgaagatgcaaaatctcctgactttaatataaaagttgttggcgatgttagttgtgacattgatgggcctgtggcttgtacattaagaccatctaccattaaagaaccactttatggttaccatcctcaacaagaaaaagaagtagcttttgatagtgctgatgccattaccgttatggcagtagataatcttccttgtgaattacctaaagatgcttctgctgattttggtagagaatttatagataatgttttacctcacttanatgatgacaaactaaacattattaaaaatgctaccatttgcaaaaatggcgatttaaccgagccttacgagtactttagagattatggtgaagggaaatag

SEQ ID NO: 17302 - protein, 299 aa, Unknown
  Obtained from environmental sample
  DOMAIN (60)...(277): Alanine dehydrogenase/PNT, C-terminal domain
  misc_feature (1)..(299): Xaa is any amino acid
MLLNAKENISMVDYEAITAIDGRRLIGFGRYAGVVGCYNSFMAYGKREKTFDLKRAYLCDDRKEMEAELKKVKLPESYKIVITGGGRVAGGIIEILEVIGIKKVTPDEFLNQSFNEPVYTQLNVHDYNKRKDGKTFDSQDFFDNPTEFEGDFFRFAKVADMYISGHFWDEEAPFIFSREDAKSPDFNIKVVGDVSCDIDGPVACTLRPSTIKEPLYGYHPQQEKEVAFDSADAITVMAVDNLPCELPKDASADFGREFIDNVLPHLXDDKLNIIKNATICKNGDLTEPYEYFRDYGEGK

SEQ ID NO: 17303 - DNA, 408 bp, Unknown
  Obtained from environmental sample
  misc_feature (1)..(408): n is a, c, g, or t
atggaaatttatgcttggtgtttaatgacaagtcatgttcatctaatatttaagtctttacaagtaaaaccaaaagaattaatacgagatttaaaaacatatacctcaaaagaattaatttcattaattaccaatcatccacaagaaagcagaaaagaatggatgttaaatgcttttaaaaaagcagcactaaataactcaaataacagtattaataagttttggcaacaacataataaaccaataaagttatggagtaacactgtaattgaccaaaaaattgattacgtacataacaatcctttagtagcaggtttcgttgagaaacctcaagattggaaatatagtagtgcaaaagatttttgtaatgaaaaaggtttggtatatttatgtttgataaaaaaatga

SEQ ID NO: 17304 - protein, 135 aa, Unknown
  Obtained from environmental sample
  misc_feature (1)..(135): Xaa is any amino acid
MEIYAWCLMTSHVHLIFKSLQVKPKELIRDLKTYTSKELISLITNHPQESRKEWMLNAFKKAALNNSNNSINKFWQQHNKPIKLWSNTVIDQKIDYVHNNPLVAGFVEKPQDWKYSSAKDFCNEKGLVYLCLIKK

SEQ ID NO: 17305 - DNA, 699 bp, Unknown
  Obtained from environmental sample
  misc_feature (1)..(699): n is a, c, g, or t
atgataaataaacaacaaataaaaacactccatcctagaaatcttcataatacaagatatgactttgaggcactttgccaaacaaatcaagagctcaagcaatatgtagctttaaataaatatgatgatttatccatagattttgccaatccaaaagcagtattgtgtttaaataaaacacttttacaacaccattataatatacaaaactgggccattccacaagactatctttgtccaccaattcctggacgggctgattatatacactatattgctgatttattaggaaaaaaagagaatatccatggtcttgatataggggtaggggctaattgtatctatcctattattggagtgtcggtttataattggaagtttacagtatcagatatagacccagttgctattgaaaatataaaagagattttaagttcaaataaaaagattgtagataacatcactgtcaaattacaacaaaacaaaaactatatctttgatggtattattgataaaagtgataaatttgattttacgatgtgtaatcccccttttcataaatcaagtatcgatgctcaaaatggaagcaatagaaaagtatcaaatcttacaaagaaaaaaactaataatgccacactcaacttcgctggacaatcaaatgaactttggtgtcaaggggagagtgctcagccgatctga

SEQ ID NO: 17306 - protein, 232 aa, Unknown
  Obtained from environmental sample
  DOMAIN (4)...(230): Protein of unknown function (DUF890)
  misc_feature (1)..(232): Xaa is any amino acid
MINKQQIKTLHPRNLHNTRYDFEALCQTNQELKQYVALNKYDDLSIDFANPKAVLCLNKTLLQHHYNIQNWAIPQDYLCPPIPGRADYIHYIADLLGKKENIHGLDIGVGANCIYPIIGVSVYNWKFTVSDIDPVAIENIKEILSSNKKIVDNITVKLQQNKNYIFDGIIDKSDKFDFTMCNPPFHKSSIDAQNGSNRKVSNLTKKKTNNATLNFAGQSNELWCQGESAQPI

SEQ ID NO: 17307 - DNA, 618 bp, Unknown
  Obtained from environmental sample
  misc_feature (1)..(618): n is a, c, g, or t
atgaagatgcaaaaagagtatgatttattaactgatgatatttttaatgatacttgtgatgtgattaataaaaatgcacagtatctctctacaacaatagatgattttagaaactatattaaaggggatagagagaaaaaagtttttaatctcaaaaaagatattaatagttttatccatcttgtagagggttcaattcataaatataatataaatatagttttggatttagatgaatctatagagattaatggatatgaaaatgaacttacccagtgttttatcaatattttcaataatgctaaagatgttttagtagagatagaaaatagttctgaacgatatttgtttatatctacaaatatagaaaatgatagagtgctaataaaaattaaagataatggtggtgggatacaagaagatataatgccaaaaatatttgaaccatatttcaccactaaacatcaatctcaaggtacaggacttggtcttcatatgacttatagtcttatagttgaggggatgaatggtactattgaggcaaaaaatatttgttttgattatgaagataaaaactataatggagtagagattacaataacacttccatctgaatag

SEQ ID NO: 17308 - protein, 205 aa, Unknown
  Obtained from environmental sample
  DOMAIN (85)...(205): Histidine kinase-, DNA gyrase B-, and HSP90-like ATPase
  misc_feature (1)..(205): Xaa is any amino acid
MKMQKEYDLLTDDIFNDTCDVINKNAQYLSTTIDDFRNYIKGDREKKVFNLKKDINSFIHLVEGSIHKYNINIVLDLDESIEINGYENELTQCFINIFNNAKDVLVEIENSSERYLFISTNIENDRVLIKIKDNGGGIQEDIMPKIFEPYFTTKHQSQGTGLGLHMTYSLIVEGMNGTIEAKNICFDYEDKNYNGVEITITLPSE

SEQ ID NO: 17309 - DNA, 612 bp, Unknown
  Obtained from environmental sample
  misc_feature (1)..(612): n is a, c, g, or t
atggggatagataaaagtaatattcgctttgtagtacatacctctatgccaaaaactatggagaacttttatcaagagataggacgagctggaagagatggacttgattctcatacactattactttatacaaaagcagaccaaataagtaagttagcacaaatagatgatagtattagtggtgagtatagaactgtattagaagataaattacaaaaaatctatcagtttagtgcttcaactggctgtcgtcatcaaattattgcaaaatattttgatgatgcaatagagccatgtaaaacaatgtgtgataactgtactaaagagaaagttgaacaattagatataagtgtagaggcgcaaaaatttttatcagctgtttataggtcaaatcaaagttttggacaaaatcatattatagatatattacgaggttcaaataatcaaaaagtatttcagtttaatcacaatgagttaagtgtttacggtataggaaaaagcaaaagtaaaaatgagtggaatgctatagttgatagactttttgatattgaagccattgaagttggtgagtatagagctattaagattacaccttatggtatggaagtttaa

SEQ ID NO: 17310 - protein, 203 aa, Unknown
  Obtained from environmental sample
  misc_feature (1)..(203): Xaa is any amino acid
MGIDKSNIRFVVHTSMPKTMENFYQEIGRAGRDGLDSHTLLLYTKADQISKLAQIDDSISGEYRTVLEDKLQKIYQFSASTGCRHQIIAKYFDDAIEPCKTMCDNCTKEKVEQLDISVEAQKFLSAVYRSNQSFGQNHIIDILRGSNNQKVFQFNHNELSVYGIGKSKSKNEWNAIVDRLFDIEAIEVGEYRAIKITPYGMEV

SEQ ID NO: 17311 - DNA, 666 bp, Unknown
  Obtained from environmental sample
  misc_feature (1)..(666): n is a, c, g, or t
ttgaagaggatgatcagatggctgagaatctttgaccgttgttcaaactcttgggagtgtttaaccactgaggcatcattgccgaaaggagaagaggccatactgattatcaaagatcttatcaaatgcttaagtgggtataggaataaattgcccacagactaccgtaggatccgacgtgttgttgatttaagtgaagactattgtcttgaattacgaaacgagttccactttgaggccaccaaactcatagaagccctagaaaaacaagctgaagatgataatgtcaagttagagacattgggagatatgaaccagatcagtcaggtctacctcatgggacctttccaaaaactattccaccggttacataattggggcattcttgcagcgcaaaaatatgcccttgatacgaactgtgaatccaagactgggctaagtgtattaggtgaaaaacaatgggtaaaaatcggacttcaccagcttatagactttgatattgcagaggagaatttgcgtttaagttcaaaatttgaattcggaaaagtgcagctaaaaaactataatattaccgtgagcctttttcgcgctgttggttcagccgcagaagcgggttactactcgacggttgaggtatgtgttccaaggggtttttttaaaatttaa

SEQ ID NO: 17312 - protein, 221 aa, Unknown
  Obtained from environmental sample
  misc_feature (1)..(221): Xaa is any amino acid
MKRMIRWLRIFDRCSNSWECLTTEASLPKGEEAILIIKDLIKCLSGYRNKLPTDYRRIRRVVDLSEDYCLELRNEFHFEATKLIEALEKQAEDDNVKLETLGDMNQISQVYLMGPFQKLFHRLHNWGILAAQKYALDTNCESKTGLSVLGEKQWVKIGLHQLIDFDIAEENLRLSSKFEFGKVQLKNYNITVSLFRAVGSAAEAGYYSTVEVCVPRGFFKI

SEQ ID NO: 17313 - DNA, 471 bp, Unknown
  Obtained from environmental sample
  misc_feature (1)..(471): n is a, c, g, or t
atgagaattgcccaacaactgcaagcacagcttgggatgggtgagttcaacgatttcaatactctaactaaaaatgtaaacagaactcttaaaacattaaacctgaaaatatccaaaagtgaactgaaactgattttggatgcggtaagttggaaagctgaagaagcagaaccggttattaagaagaaagaaaaaaacggtaccattgtttatgaaacagacagcgatttaagagatagcgaaaatgtgcctttagctgaaaacattgaagagtattttgccagagaagttctaaaatatgtccctgatgcctggatagatcataccaaaaccaagattggctacagcatttcttttacccgctatttctataactatgtacctccccgctctctggaagatatagctaaagatatagaaaaaattcaagatgagactgaaggtctgcttgaggagtttttgaaggattaa

SEQ ID NO: 17314 - protein, 156 aa, Unknown
  Obtained from environmental sample
  misc_feature (1)..(156): Xaa is any amino acid
MRIAQQLQAQLGMGEFNDFNTLTKNVNRTLKTLNLKISKSELKLILDAVSWKAEEAEPVIKKKEKNGTIVYETDSDLRDSENVPLAENIEEYFAREVLKYVPDAWIDHTKTKIGYSISFTRYFYNYVPPRSLEDIAKDIEKIQDETEGLLEEFLKD

SEQ ID NO: 17315 - DNA, 600 bp, Unknown
  Obtained from environmental sample
  misc_feature (1)..(600): n is a, c, g, or t
atgttaaatattaatgaaataattgaaaagttaagagatgtactttcaagtgaaaaaaaccatggaaaaatttttgacaaagatattgctaatgctttagaattaacaagtgtaaatttcgcaacaatgaaaaaaagaaatagtgtaccattttctaatatacttgatttttgtgctataaaaaagatatctattaattggcttttatatggacaagacccaagtagtttagttgatagtacagatagatattggataaagtattttccaacagtaagtgttagtgctggtggtggtgcatatgatggtgaagatgattttgagaaattagatttaccagatttttttgtaaatataattggaggggaagaaaacctaaaaaatattgaagctataaatgttacaggagatagtatggaaccaacactaaataatggtaatataatatttatagatagaacaaaaagtgataccgcaaaagatggcatctatgcttttgtaaatgaaaatggtttatttgtaaagcgtattcaaaaaacgatagatggttctcttgatattatttccgataataaagaatttcctatgcaaatagcttag

SEQ ID NO: 17316 - protein, 199 aa, Unknown
  Obtained from environmental sample
  DOMAIN (133)...(197): Peptidase S24-like
  misc_feature (1)..(199): Xaa is any amino acid
MLNINEIIEKLRDVLSSEKNHGKIFDKDIANALELTSVNFATMKKRNSVPFSNILDFCAIKKISINWLLYGQDPSSLVDSTDRYWIKYFPTVSVSAGGGAYDGEDDFEKLDLPDFFVNIIGGEENLKNIEAINVTGDSMEPTLNNGNIIFIDRTKSDTAKDGIYAFVNENGLFVKRIQKTIDGSLDIISDNKEFPMQIA

SEQ ID NO: 17317 - DNA, 393 bp, Unknown
  Obtained from environmental sample
  misc_feature (1)..(393): n is a, c, g, or t
atgataatttcggcaaaaaaatatttctttcttaaactttttctttttttaagtattcttatttcgcttgagagtttttcttttaaacctaacgattttaataaaaaagataattcagtattgtgcgattcaggaaatataaagacaactattttaaactacgaaaaagccttagataattaccggcaaacgaaagatttagagggtattgcatcggccatgtgtggtcttggtaaaatatattctgataaaggagactttgaaaatgcacttgagtatttcctcaacagccttgcaattgagaaagaactagataacaacaaaaacatagccaacctttatgaaaaacttgctggcgtttacaatagatctggaaattcaagaaaggcatga

SEQ ID NO: 17318 - protein, 130 aa, Unknown
  Obtained from environmental sample
  DOMAIN (71)...(104): TPR Domain
  misc_feature (1)..(130): Xaa is any amino acid
MIISAKKYFFLKLFLFLSILISLESFSFKPNDFNKKDNSVLCDSGNIKTTILNYEKALDNYRQTKDLEGIASAMCGLGKIYSDKGDFENALEYFLNSLAIEKELDNNKNIANLYEKLAGVYNRSGNSRKA

SEQ ID NO: 17319 - DNA, 861 bp, Unknown
  Obtained from environmental sample
  misc_feature (1)..(861): n is a, c, g, or t
ttgaatatgtctacaaataaaattaaaaaactatgggaaattaacccagccttaatgaatagcgactacacccctgttaattctttaattattgatgataaaaacaaatgcttttacaccttactatttccacacgaacaatacaacacctatttaagagttataaaatcatcattagataaaccacaaataaattggattggagacagtataccctatttatttaaagatactgaatcttttgcagacctatattactcaaaatttagaaattctctaattgcaattaccctacataaagaaaatgaaagtcattatattttcgacttatttacgctaaaacaccctcctattgatgcagaatatttgtttttaaataaaagcaaatcctataccttagaaattgtgcttacccttgcttgctttttacttttatttattttagctatatattatctctacaaaaaaagaaaacacaaagctcaaacaccagttatagatgaagatgtttcaaatattgaatcggaaccactaagttataataaaacaaacagtgtgtttttatttggtggctttcaagtttttgacaaaaatggaaccgatattagttatcgatttagtccaacgttaaaagatttatttttattaattcttatttacactgccgaaaaagaaaaaggtatttcctcattaaaaattcaagaatttctttggcctgacaaatctgaagaaaaagcaaaaaacaacagaggagttaatattaaaaaactacgcgaaatacttgaagatattgatggttttgatatcgattatcaaaacacatattggaaactccttttatctgatactgtttttttgcga

SEQ ID NO: 17320 - protein, 287 aa, Unknown
  Obtained from environmental sample
  misc_feature (1)..(287): Xaa is any amino acid
MNMSTNKIKKLWEINPALMNSDYTPVNSLIIDDKNKCFYTLLFPHEQYNTYLRVIKSSLDKPQINWIGDSIPYLFKDTESFADLYYSKFRNSLIAITLHKENESHYIFDLFTLKHPPIDAEYLFLNKSKSYTLEIVLTLACFLLLFILAIYYLYKKRKHKAQTPVIDEDVSNIESEPLSYNKTNSVFLFGGFQVFDKNGTDISYRFSPTLKDLFLLILIYTAEKEKGISSLKIQEFLWPDKSEEKAKNNRGVNIKKLREILEDIDGFDIDYQNTYWKLLLSDTVFLR

SEQ ID NO: 17321 - DNA, 927 bp, Unknown
  Obtained from environmental sample
  misc_feature (1)..(927): n is a, c, g, or t
gtgatatacacttggttaaaagagttgaaatctaaactaaaacaagctcaaataaaagcttctataaaagtaaatacagtattgctagagttttactgggaacttggcaatgagatagttgagaaacaaaaaaacagcacttggggaagtgggttcttacagcaacttagtgatgatttgatggcagaatttcccgatatgaaaggattttcttatagaaatttaagggcgataaaacaatggtatatgttttattcaaattggccacaacttgtggccaaattagaaaatgaaaaagggcaacaagctgttgcccttttagacaatgaaaatacgaaacaagttgtttctcaattgacacaaatcccatggggacataatagagccataatctcaaaatgtaaagatacccaagaagcacttttttatgtaaacaaaaccatagaaaatggttggagtagaagtgtcttagtacaccaaatagagagtgacctatatacaagaagtggcaaagctatatcaaactttgaagtaactttgccaaaagaacaatcagacttagcccatgaacttataaaagacccatataactttgactttttaactctaagtgaaaatttcaaagagaaagaactcgaatcgggcttattggaacatatcacaagttttttattagaacttggaagtggatttgcttttgttggaaaacaaaaaaatcttaaagtcggtcaaaaagatttttacattgacttgcttttctatcatataagaatgcattgttatgttgtagttgagctaaaaactgttgattttgaaccagagtttgcaggggaactaaacttttatattaaagccattgatgaccagataaaaacaaaagaggataaacctactatgggtatattattatgtaagagtaaagattaa

SEQ ID NO: 17322 - protein, 308 aa, Unknown
  Obtained from environmental sample
  DOMAIN (5)...(308): Protein of unknown function (DUF1016)
  misc_feature (1)..(308): Xaa is any amino acid
MIYTWLKELKSKLKQAQIKASIKVNTVLLEFYWELGNEIVEKQKNSTWGSGFLQQLSDDLMAEFPDMKGFSYRNLRAIKQWYMFYSNWPQLVAKLENEKGQQAVALLDNENTKQVVSQLTQIPWGHNRAIISKCKDTQEALFYVNKTIENGWSRSVLVHQIESDLYTRSGKAISNFEVTLPKEQSDLAHELIKDPYNFDFLTLSENFKEKELESGLLEHITSFLLELGSGFAFVGKQKNLKVGQKDFYIDLLFYHIRMHCYVVVELKTVDFEPEFAGELNFYIKAIDDQIKTKEDKPTMGILLCKSKD

SEQ ID NO: 17323 - DNA, 414 bp, Unknown
  Obtained from environmental sample
  misc_feature (1)..(414): n is a, c, g, or t
atgcgctcagaaaaagttatcgaaaatttattaagatcattttttaaagtcccagctaaaaaaagagttatagaccttcttataaaatctcctcaaatactctttgatgcagattctgcagtaaaagagaaaagatttgatcaatactttgctatgtgcaaactaaatcctattttacaagagtcatccctatatgaaaatgtcataaatttagcaaataatgttgttattcagctagaccttggcatagaaaattttgatacggctgaagtagaaaaattatctgattttttagaagattttccgatgtatcaatatgcagcaaaaaaaggtaaaatatttctgtctgatcttaaaaaatatgagagttgtcttgataaaaaagattactcaactttcgcacataaaacctaa

SEQ ID NO: 17324 - protein, 137 aa, Unknown
  Obtained from environmental sample
  misc_feature (1)..(137): Xaa is any amino acid
MRSEKVIENLLRSFFKVPAKKRVIDLLIKSPQILFDADSAVKEKRFDQYFAMCKLNPILQESSLYENVINLANNVVIQLDLGIENFDTAEVEKLSDFLEDFPMYQYAAKKGKIFLSDLKKYESCLDKKDYSTFAHKT

SEQ ID NO: 17325 - DNA, 390 bp, Unknown
  Obtained from environmental sample
  misc_feature (1)..(390): n is a, c, g, or t
ttgcaggccaaagatattttagccacttataaaaagagatggaatattgaacaagggtataaagacttgagaaatttatttggcttaggaaaagaagaaaatcgtatctatgaagcaatcattgcaaaaatcacactttctatgtttgcctacaatatcgtaagctacataaaccgtatgaaaaatgaacctcaaactctaggagaactttttagagatttagaatgtgaacttgaaactctcgcaatatcgatgcagctttttattcaaatattgacaaaaatctctgaaattcaaaatgttgtcaaggagaataaagatttacttactatccttgctgtactaagtgcttacactcaaaaagagttaggttttatgtgcgaaagttga

SEQ ID NO: 17326 - protein, 129 aa, Unknown
  Obtained from environmental sample
  misc_feature (1)..(129): Xaa is any amino acid
MQAKDILATYKKRWNIEQGYKDLRNLFGLGKEENRIYEAIIAKITLSMFAYNIVSYINRMKNEPQTLGELFRDLECELETLAISMQLFIQILTKISEIQNVVKENKDLLTILAVLSAYTQKELGFMCES

SEQ ID NO: 17327 - DNA, 771 bp, Unknown
  Obtained from environmental sample
  misc_feature (1)..(771): n is a, c, g, or t
atggctcagatgattaatattgtatctcttaattatgcagattcacactcaacgtttcagctagacttttctataaaaatgaatgatagtcgtcgtaaagatatatccgagttcacttcagttgtacatcatcgtagtaatacttatatgcgtcaaatcgaatctctaaaaggtaaaaatattttagctattgagatgcttgagagagcgttggaacaaggcattgatgcagattacttactcatagatagctggtatgctaaaccaaactttatacatcaagctaatgagctaggtatgcccgtaatcgcaagacttccaaacaataaactcatttggaactttaaaggcaaacataaaactataaatgcaatgtatgacaatatgaaaaattctcgtcataaaagcagtggcaaacacggaaaaatatcttacaaattcttcgatgttattgtagaacatgcaactctaggcaaagtaaaactcgtcttcttacacacaggtaaagagttactggtttttatctccacagacataacgatagcaggcaaagatattttagcaacttataaaaagagatggaatattgaacaagggtataaagacttgagaaatttatttggcttaggaaaagaagaaaatcgtatctatgaagcaatcattgcaaaaatcacactttctatgtttgcctacaatatcgtaagctacataaaccgtatgaaaaatgaacctcaaactctaggagaactttttagagatttagaaatgtga

SEQ ID NO: 17328 - protein, 256 aa, Unknown
  Obtained from environmental sample
  misc_feature (1)..(256): Xaa is any amino acid
MAQMINIVSLNYADSHSTFQLDFSIKMNDSRRKDISEFTSVVHHRSNTYMRQIESLKGKNILAIEMLERALEQGIDADYLLIDSWYAKPNFIHQANELGMPVIARLPNNKLIWNFKGKHKTINAMYDNMKNSRHKSSGKHGKISYKFFDVIVEHATLGKVKLVFLHTGKELLVFISTDITIAGKDILATYKKRWNIEQGYKDLRNLFGLGKEENRIYEAIIAKITLSMFAYNIVSYINRMKNEPQTLGELFRDLEM

SEQ ID NO: 17329 - DNA, 495 bp, Unknown
  Obtained from environmental sample
  misc_feature (1)..(495): n is a, c, g, or t
ttgcaaggtttattcttatttgaaaatgattatgatttagatacaataaaacgaaattttgatttttacgaaccaatgacagtgcatgaatcttctctttctgcaagtgtttattcaattatggcttcaaaaattggcaatgagcaaaaagcttatgacctttatttgagaactgcacgacttgatttagatgactataataatgaagtaaaagacggcttacatattacaagcatggctggaacttggatgagtgttgtgcatggttttggaggaatgcgaataaaaaatggaaaaatttcattcaatccgtttttaccaaaaaaatggaatagttattcttttaaaatcatttttagagattggaatttgaaaataaatgtttcaaaaaccgaaactattattaataatttgtcagacaaaccaataagtttgcttatttttgacaaagaatatttaattaaagcaaatgatattatagatcttgatatataa

SEQ ID NO: 17330 - protein, 164 aa, Unknown
  Obtained from environmental sample
  DOMAIN (104)...(156): Glycosyl hydrolase family 65, C-terminal domain
  misc_feature (1)..(164): Xaa is any amino acid
MQGLFLFENDYDLDTIKRNFDFYEPMTVHESSLSASVYSIMASKIGNEQKAYDLYLRTARLDLDDYNNEVKDGLHITSMAGTWMSVVHGFGGMRIKNGKISFNPFLPKKWNSYSFKIIFRDWNLKINVSKTETIINNLSDKPISLLIFDKEYLIKANDIIDLDI

SEQ ID NO: 17331 - DNA, 456 bp, Unknown
  Obtained from environmental sample
  misc_feature (1)..(456): n is a, c, g, or t
atgcttaaaaaattattaattttaacttttattaccacaataagttttgcaaacattttaaaaataggagatacacttacaccatttagtattcctgatcaatttgatgaattacatactattaatagtgaaaaataccaaacagttatagtctcattttcaaaagaaagttcaactaaagtaaatgattttctacaaaaacaagaaaaacactttttaaaaaataataatattgtctatatatctgatattcataaaatgccatcaattataacttggctttttgctttaccaaaaatgaaaaaatttaattataaagttatgcttctttataaggaaaatacagtttttccacaaaacaataacgatttaagtataattagatttaaaaataataaagtaagttcaatagagtttataaaagaaaatgaaagcatcgattcaattttcaattaa

SEQ ID NO: 17332 - protein, 151 aa, Unknown
  Obtained from environmental sample
  SIGNAL (1)...(17)
  misc_feature (1)..(151): Xaa is any amino acid
MLKKLLILTFITTISFANILKIGDTLTPFSIPDQFDELHTINSEKYQTVIVSFSKESSTKVNDFLQKQEKHFLKNNNIVYISDIHKMPSIITWLFALPKMKKFNYKVMLLYKENTVFPQNNNDLSIIRFKNNKVSSIEFIKENESIDSIFN

SEQ ID NO: 17333 - DNA, 693 bp, Unknown
  Obtained from environmental sample
  misc_feature (1)..(693): n is a, c, g, or t
gtgacagttactttagataatcatagttttgaacttatacacagaacaaacaaaaaaataaaacgggtaagtctctctttagaaaataaaaatgagataattgtaaaaacaccattgaagttcaaatcacatatgataaaagaggtggtgtatgatcataaagattggattttacgaactataaacaaagtgccacctaaaaatagttttgattttgtttcagggggagtggtcccatttttagggaaaaattatcccatagagcttaaagaagatgagcgtatcaaaaatgtgaagtatacttttgaaaatgatacttttgtagtacagtacaaccaacaaaaacaatcctatgaagattttgtagagggactaaaaaagttttatcaatacaatgctataaagataatagacccaatctttgatgagtggtgttttaaaactaagctttaccctcaaaatattagctatcgatttaataaagggagatggggaagttgtagttttgaaaataatatctctataaattataagcttttacagtttgagaaaaaagctatagagtatgtagttttacatgagttgtgtcatattgaggagaaaaatcactcancaagattttggaatctggtgagtttatatatgcctgattataaaagaggtggaaaaaacttaaaatctaagttgttttag

SEQ ID NO: 17334 - protein, 230 aa, Unknown
  Obtained from environmental sample
  DOMAIN (12)...(230): Protein of unknown function DUF45
  misc_feature (1)..(230): Xaa is any amino acid
MTVTLDNHSFELIHRTNKKIKRVSLSLENKNEIIVKTPLKFKSHMIKEVVYDHKDWILRTINKVPPKNSFDFVSGGVVPFLGKNYPIELKEDERIKNVKYTFENDTFVVQYNQQKQSYEDFVEGLKKFYQYNAIKIIDPIFDEWCFKTKLYPQNISYRFNKGRWGSCSFENNISINYKLLQFEKKAIEYVVLHELCHIEEKNHSXRFWNLVSLYMPDYKRGGKNLKSKLF

SEQ ID NO: 17335 - DNA, 921 bp, Unknown
  Obtained from environmental sample
  misc_feature (1)..(921): n is a, c, g, or t
atgctcagnaatcggctgagccttatttggctgatactagaagaattcatgcaactctctaaatctctctatacaaaagcaatccagtgtccaaaagcattttggttaaagaagtataaaaaatatgtacttacacctccagatgcaactgcattagcaagatttgaaactggtaatgtagttggggaattagcttgtaaactttttccaaatggaaaagaagttatttatactcctgacgattttaacggtatggtagagactactacagaatggatagaggagagcttagagtatatttatgaagctacttttctttataatggaatcttagttttagtagatgttttaaaagtgactcctgatggattagagatatatgaagtaaaaagttctagtagtgttaaagatatttatttacatgatgtttcgatacagttgtatgtacttcaacagcttggatacagtgtaattagtagtaatgttgtacatattgacagttcttatgttcgaggtgatgagcttgatttaaatgggctattgaagattgtggatgttagtgatgaaataaatgctttacaagtagatattcctaaaagacttgaagagtttgaagcatatctagccgatatagataatgagccagacattgatattggaagtcattgtaacaagccttatgaatgtgatgcaaaagagtactgctggaaagttcagagaagtatacctgagtactcattgttcaatatttttaatcttggcagtaagaagcagataaaactttatgaacaaggcatagttaatatagaagatattcctgagagttatgctatgacagctatacaaaaacaaaaagttcaaaactggaaagatcaactaacttttggagatgaagataatataaaagatttttcttacccc

SEQ ID NO: 17336 - protein, 307 aa, Unknown
  Obtained from environmental sample
  misc_feature (1)..(307): Xaa is any amino acid
MLXNRLSLIWLILEEFMQLSKSLYTKAIQCPKAFWLKKYKKYVLTPPDATALARFETGNVVGELACKLFPNGKEVIYTPDDFNGMVETTTEWIEESLEYIYEATFLYNGILVLVDVLKVTPDGLEIYEVKSSSSVKDIYLHDVSIQLYVLQQLGYSVISSNVVHIDSSYVRGDELDLNGLLKIVDVSDEINALQVDIPKRLEEFEAYLADIDNEPDIDIGSHCNKPYECDAKEYCWKVQRSIPEYSLFNIFNLGSKKQIKLYEQGIVNIEDIPESYAMTAIQKQKVQNWKDQLTFGDEDNIKDFSYP

SEQ ID NO: 17337 - DNA, 375 bp, Unknown
  Obtained from environmental sample
  misc_feature (1)..(375): n is a, c, g, or t
ttgtataaagtagcagattttttttgtggtggtggtggtttttccgagggcttcaaattagctggatttgaaattatttttgctgttgatagatggcaacctgctgtaacaacacaccatgcaaatcatccaaatgcaaatacaagacttgatgatgtaattcgaatatcaaatttagatgaagaagagtttcacaagattgttccagatacagaaataattataggatctcctccttgtacatctttttcaaattcaaataaatcaggtaaagcggataaatcactaggtatacagcttattgaagcttatttaaagattattgcaagaaaaccgttaaaaaaaagaatcattattaaaaccatggggttttag

SEQ ID NO: 17338 - protein, 124 aa, Unknown
  Obtained from environmental sample
  misc_feature (1)..(124): Xaa is any amino acid
MYKVADFFCGGGGFSEGFKLAGFEIIFAVDRWQPAVTTHHANHPNANTRLDDVIRISNLDEEEFHKIVPDTEIIIGSPPCTSFSNSNKSGKADKSLGIQLIEAYLKIIARKPLKKRIIIKTMGF

SEQ ID NO: 17339 - DNA, 666 bp, Unknown
  Obtained from environmental sample
  misc_feature (1)..(666): n is a, c, g, or t
atgaaatcaaaagatataatggatcatcattatattatggaaattgcagatttcgaatggaaaaaagcacaaagacaaaagcaagacaaaggatatatgggaagaatgtcatttcctgaaaactttgaaaagccatcaagaacagtaatggcaactatgtcttgctcgtcaagagaatccatgatttatccttataaacaaaaagaagataggtacagactaccaacagtcagagagattgcttgtcttatgagttaccctttggattatagattttacgggaagagtaaaagtattaaatacaaacttgttggaaactctgtacctccaaaaatgtcttttgcaattgctaatgcaatatcaattgcaaataatttaaaaacacttaataaatatcaaccaattgagtttgacgatagccaggaagattttaaaaatttaaatggagatatttttcatattaatatagaaaaagaaaaaagacccatagcgaaatttaaatatcacattccgtatttaattataaatgcttttagagttgagttaactaataaatattctgattttgagaatttacagttcaaatggaatgttgagattcacaaaagtcaaggacaaaatgcaaaaacatatatccaaaaactgactgaactcgagccgatctga

SEQ ID NO: 17340 - protein, 221 aa, Unknown
  Obtained from environmental sample
  misc_feature (1)..(221): Xaa is any amino acid
MKSKDIMDHHYIMEIADFEWKKAQRQKQDKGYMGRMSFPENFEKPSRTVMATMSCSSRESMIYPYKQKEDRYRLPTVREIACLMSYPLDYRFYGKSKSIKYKLVGNSVPPKMSFAIANAISIANNLKTLNKYQPIEFDDSQEDFKNLNGDIFHINIEKEKRPIAKFKYHIPYLIINAFRVELTNKYSDFENLQFKWNVEIHKSQGQNAKTYIQKLTELEPI

SEQ ID NO: 17341 - DNA, 300 bp, Unknown
  Obtained from environmental sample
  misc_feature (1)..(300): n is a, c, g, or t
atgggcactaaatcgggagataaactcctgaagttcttttttcttatcctccggcccttttgtttagcctttgttagttgtcttagggcccagctggctactttgataccagaagctgtagttgcccgcaaacaattgaatcttattaaaatctatatccagagtgtgtgtggaaatagcatccagaaaatgcctatcatgactaacaacaagaacagtattctgataatttatcaggtaattttcaagccaagttactgtatcaaggtcaaggtcgtttgttggctcatcaagcagtag

SEQ ID NO: 17342 - protein, 99 aa, Unknown
  Obtained from environmental sample
  misc_feature (1)..(99): Xaa is any amino acid
MGTKSGDKLLKFFFLILRPFCLAFVSCLRAQLATLIPEAVVARKQLNLIKIYIQSVCGNSIQKMPIMTNNKNSILIIYQVIFKPSYCIKVKVVCWLIKQ

SEQ ID NO: 17343 - DNA, 813 bp, Unknown
  Obtained from environmental sample
  misc_feature (1)..(813): n is a, c, g, or t
atgaacaaagaaggtgatgtcttaggtgtaatttctatggtgatgactatggatgatattaaacaaatgagtgtaaaaattattgcattaacctcttttatatcattatttttaattttatttattatttggtttgtaaaacgacttattgtaccttatctttcaatatttgattcaattaaagatgtaatgaaacgagcacatacaggtgattatagtgcgagaattgatgaatttaatagtggtgaagcaaaaaatgtttcacattggataaatgagcatatgagtaaattgcaaaaaagtttagtaactattgaagataaaattgatatattcctaactgcacataaatcagaaactgtggaagaccctatgatggatgttcaaaatacagttgcaagactagcagatatttataagtttagaaaaacaatagaacatgatgaaagtattagtgatgtttataaaagaattgcaacggtacttgaggataaatttaaactagatgattttaatttcctagaagctgacactacaaataaaaaagttgaagttgtttatgttcataaagcactccaatgtgacccattagctaaaggatgtagagctgatagaacaaatacattagtagactcttgtcaattcaaaaaagtatgtagtgcaaataacgaggaaaatacttatctatgtatcccttattctatatctaatgatatggattttgttataactataaatacgcaatcaagagaggaaaatgaaaaattaagaagaaaaattaccttttatacaagattatgtagatgctgctaa

SEQ ID NO: 17344 - protein, 270 aa, Unknown
  Obtained from environmental sample
  misc_feature (1)..(270): Xaa is any amino acid
MNKEGDVLGVISMVMTMDDIKQMSVKIIALTSFISLFLILFIIWFVKRLIVPYLSIFDSIKDVMKRAHTGDYSARIDEFNSGEAKNVSHWINEHMSKLQKSLVTIEDKIDIFLTAHKSETVEDPMMDVQNTVARLADIYKFRKTIEHDESISDVYKRIATVLEDKFKLDDFNFLEADTTNKKVEVVYVHKALQCDPLAKGCRADRTNTLVDSCQFKKVCSANNEENTYLCIPYSISNDMDFVITINTQSREENEKLRRKITFYTRLCRCC

SEQ ID NO: 17345 - DNA, 525 bp, Unknown
  Obtained from environmental sample
  misc_feature (1)..(525): n is a, c, g, or t
atgcaaattcttgaaaaaaatgctagcaccgatcctttaactggattatttaatagaaaatatttagaaagatatattgatggttctttatatagtggtatatataaaaatgtaccgtgtggactgatgatggttgatatagatttctttaaacttattaatgataattatggacatgatattggagatattgcaattaaaactatcgcaaatacacttatagacactacaacagacaaagatgtagttatacgatttggaggagaagagtttattgttatattaaatgattgtaatgaagaaaaacttcacgatacagctgaaaaaattagaatagctttttctcaacaaaaaattcaagcaggttctgaaatttttagtaaaactattagtataggtacagcattattcccgaataaagatcatagtttttggaaatatattaaacaaagtgatgtagcactgtatcaagccaaacattcgggtagaaataaagttgttagatatgaagaggggatggaataa

SEQ ID NO: 17346 - protein, 174 aa, Unknown
  Obtained from environmental sample
  DOMAIN (4)...(165): GGDEF domain
  misc_feature (1)..(174): Xaa is any amino acid
MQILEKNASTDPLTGLFNRKYLERYIDGSLYSGIYKNVPCGLMMVDIDFFKLINDNYGHDIGDIAIKTIANTLIDTTTDKDVVIRFGGEEFIVILNDCNEEKLHDTAEKIRIAFSQQKIQAGSEIFSKTISIGTALFPNKDHSFWKYIKQSDVALYQAKHSGRNKVVRYEEGME

SEQ ID NO: 17347 - DNA, 486 bp, Unknown
  Obtained from environmental sample
  misc_feature (1)..(486): n is a, c, g, or t
atgtcaaaaataattatcctaattttaagctttttaatcgcaaatgctgatacttttaacttcacagaacttagatatagtgacgcattaaacaagactatggagcttaacggtgaaatcagtttttttcaaaacggtttatccatcaagtataaaaagagtaaaaaatctctgcatctacaagatggaatacttatatataaagaagacggcgaacaaatcgccatgaatgagacacaagctcaaagagtcactcaatactttgaaatcatacttctacttcatagcggagataaagaactgctagagagcatgttcgaggtagataatagctcacaaagggctgttcttagacccaaaggtagcctaagccacttcgttacttttatagagttgcgtaaacatgaggacaaaccaaaagagataaaactttttttaagtaacagcgacaatatcattataaaaattaacgatgaaatacgctaa

SEQ ID NO: 17348 - protein, 161 aa, Unknown
  Obtained from environmental sample
  SIGNAL (1)...(16)
  misc_feature (1)..(161): Xaa is any amino acid
MSKIIILILSFLIANADTFNFTELRYSDALNKTMELNGEISFFQNGLSIKYKKSKKSLHLQDGILIYKEDGEQIAMNETQAQRVTQYFEIILLLHSGDKELLESMFEVDNSSQRAVLRPKGSLSHFVTFIELRKHEDKPKEIKLFLSNSDNIIIKINDEIR

SEQ ID NO: 17349 - DNA, 303 bp, Unknown
  Obtained from environmental sample
  misc_feature (1)..(303): n is a, c, g, or t
atgctagaggaagatagaaatgtagtttttttcgtagagggaactcgtggcagtggcaaaaaactagagagatttaaaaagggtgcttttagattggctgtaaaaatgaacaagcctattatccctattatcatagagggttcagcagatattctctcaaaaggaaacttctgtttttcaactacaaagaaaaaaaagataaccgtacggatgctagatgcaatctaccccgataagttttcaaatgagagtgatatgctaaaatacacatacaatattatgagtgagtcatgtcaaaaataa

SEQ ID NO: 17350 - protein, 100 aa, Unknown
  Obtained from environmental sample
  misc_feature (1)..(100): Xaa is any amino acid
MLEEDRNVVFFVEGTRGSGKKLERFKKGAFRLAVKMNKPIIPIIIEGSADILSKGNFCFSTTKKKKITVRMLDAIYPDKFSNESDMLKYTYNIMSESCQK

SEQ ID NO: 17351 - DNA, 903 bp, Unknown
  Obtained from environmental sample
  misc_feature (1)..(903): n is a, c, g, or t
atgtggtcagctaggccgattactagaatcgtattattctatatctgtggaatactatcagttaggtattttccattcttgattggaattcctgaaacattcttactagcatcagtagcaatattactagttataagcattttctttatagtaactaaaatccctcacaaattcacttggattacgggagttatattaggactgtcaatctcattatcagcagtatatattacaaagcataatacagcaatctacgacgaatattatattactagcaaggatattcctaccataggtaatgttgttggtaatccggtagaaggtaaaaactccataaaagcaacacttctattaaatcgtataaccgaaaatagttacaacagtaataaagttcaaaaggtgatgtgctattttgagaaagatagcaatagtagcaaactcaaatacggtgacataatactaatatcctctattctatccatccagtcatcaccaaaaaatccttatgaattcgactatcaaaaatatctaaaacaaaacaacatcctctatacctctttcattaaaaaaaataaatggaaagttatcgacaataagcctaaaaacagagttatagcatatgctggaaaaataaggaagtcgttactaaatacactatcagaaaatggccttaaaggcaataattatgatgtagcagcagcaatactccttggttttgatgatggaatggaaccagagcttaaacaagattttgtaatggctggagctatgcatattctttgcgtttcaggattacatgttggaaatatttatctcgtatttaactacctattgagttttctaaaacatacaaaaaccacaatatatttaggctacatactctttttcacgtttggatgtatg

SEQ ID NO: 17352 - protein, 301 aa, Unknown
  Obtained from environmental sample
  misc_feature (1)..(301): Xaa is any amino acid
MWSARPITRIVLFYICGILSVRYFPFLIGIPETFLLASVAILLVISIFFIVTKIPHKFTWITGVILGLSISLSAVYITKHNTAIYDEYYITSKDIPTIGNVVGNPVEGKNSIKATLLLNRITENSYNSNKVQKVMCYFEKDSNSSKLKYGDIILISSILSIQSSPKNPYEFDYQKYLKQNNILYTSFIKKNKWKVIDNKPKNRVIAYAGKIRKSLLNTLSENGLKGNNYDVAAAILLGFDDGMEPELKQDFVMAGAMHILCVSGLHVGNIYLVFNYLLSFLKHTKTTIYLGYILFFTFGCM

SEQ ID NO: 17353 - DNA, 444 bp, Unknown
  Obtained from environmental sample
  misc_feature (1)..(444): n is a, c, g, or t
atgaaattaaagtatctactaatcattataattattacgctaggccagtttgtaattgcctcaaccatccctgatcttataaaagatgcaggatgcagcaaggattatcccaatagtaacctgcttattattttcgacagtacagatgtagatgttcaggaatcaggtttaagttatataaatacacataccttgtataaagtgctaactacagaaggtgcaaaaaaactccacattatcaaatttggctatgatcctttatctgcatatgtcgatattttgggtgttaccatataccgtaaaaatggaagtaaggaagaaataaatgttagtgatgtatatgactatcctgctcctgccagaatgatttactggggtgccagtgaaaaaatggttgaagttggcagattagaacctggcgatgctgtagaagttttttcttaa

SEQ ID NO: 17354 - protein, 147 aa, Unknown
  Obtained from environmental sample
  SIGNAL (1)...(20)
  misc_feature (1)..(147): Xaa is any amino acid
MKLKYLLIIIIITLGQFVIASTIPDLIKDAGCSKDYPNSNLLIIFDSTDVDVQESGLSYINTHTLYKVLTTEGAKKLHIIKFGYDPLSAYVDILGVTIYRKNGSKEEINVSDVYDYPAPARMIYWGASEKMVEVGRLEPGDAVEVFS

SEQ ID NO: 17355 - DNA, 480 bp, Unknown
  Obtained from environmental sample
  misc_feature (1)..(480): n is a, c, g, or t
ttggggcacgtggaagcgatcatggatttattaagtcttgatcatgatttctttatgaccaatttacaagatgaaaatgtgtactataaatataccttgggcaataattacaaagaacatgtagatcaattaaataaaaataaagaaggtataataaacacttgggctgtgtattggcatagtacaatttattttaatgatggtttatgtttatatcncaataaatccatggttcagaatattggatttgatagtactggagttcattgcgaagatgataacgatttatttaaggttaatctaaaaaagttcatcagtgtaaaaaaaagagaactattggaatcgaaattatccctaaattattataaatgcttttacaggtatggaaaaataagtatactaaaaatacttgtaatcaacttacgtagggaagtgttaaatgtgcgtatttatatagcgagaaaaaggggcaggatataa

SEQ ID NO: 17356 - protein, 159 aa, Unknown
  Obtained from environmental sample
  misc_feature (1)..(159): Xaa is any amino acid
MGHVEAIMDLLSLDHDFFMTNLQDENVYYKYTLGNNYKEHVDQLNKNKEGIINTWAVYWHSTIYFNDGLCLYXNKSMVQNIGFDSTGVHCEDDNDLFKVNLKKFISVKKRELLESKLSLNYYKCFYRYGKISILKILVINLRREVLNVRIYIARKRGRI

SEQ ID NO: 17357 - DNA, 330 bp, Unknown
  Obtained from environmental sample
  misc_feature (1)..(330): n is a, c, g, or t
atgagagattttgaaaaagcgcctatagtattgtttgtttataaccggcccattcatactgaaaagacattgtatgcactgtcaagaaacgtcggttcaaaagatagtattttgtatgtattttgtgatggtccaaaagaaaatgcaancatagatgaagttaataatatagctcanacccgaaaaataattgaaaaacagtcatggccaaaacagcttatagtaaaaacttttatcaaaaacaggggtttaaaaacatctattttggacggagaaacggaaagtgtcaataaatatggtaaaattattgtattggaggatgatattgtt

SEQ ID NO: 17358 - protein, 110 aa, Unknown
  Obtained from environmental sample
  misc_feature (1)..(110): Xaa is any amino acid
MRDFEKAPIVLFVYNRPIHTEKTLYALSRNVGSKDSILYVFCDGPKENAXIDEVNNIAXTRKIIEKQSWPKQLIVKTFIKNRGLKTSILDGETESVNKYGKIIVLEDDIV

SEQ ID NO: 17359 - DNA, 516 bp, Unknown
  Obtained from environmental sample
  misc_feature (1)..(516): n is a, c, g, or t
atgaaaatcaaacattttattttactgtttttattctctttaattgctctttattcatactcacaaagggtaaaaaacaattctgtaagcagggaagttattattgagttacctgattctttaataaaatgccgtgtattgaattataaacctgatattgatattgaagataatttggtttattattggtattattccgggaaaatacataaaaactccggacattatgctggttatcttttacatgacaattacatagttttagactcagaaaaaaacatgcttaccaaaggaactttttttaaaggaacaaaacacggcatttggaaaacatggtatcccaaaggaggattaaaaagctcaaaagaatggaaaaaaggattgccacacggcaaatggactttttacgatgccacaggaaatttaattaaacaagaatattacaaagaaggaaaaaaaacaacagccgaagaaaattctaatgaaggtatttttaggaggttttttaaagattaa

SEQ ID NO: 17360 - protein, 171 aa, Unknown
  Obtained from environmental sample
  SIGNAL (1)...(19)
  DOMAIN (129)...(150): MORN repeat variant
  misc_feature (1)..(171): Xaa is any amino acid
MKIKHFILLFLFSLIALYSYSQRVKNNSVSREVIIELPDSLIKCRVLNYKPDIDIEDNLVYYWYYSGKIHKNSGHYAGYLLHDNYIVLDSEKNMLTKGTFFKGTKHGIWKTWYPKGGLKSSKEWKKGLPHGKWTFYDATGNLIKQEYYKEGKKTTAEENSNEGIFRRFFKD

SEQ ID NO: 17361 - DNA, 588 bp, Unknown
  Obtained from environmental sample
  misc_feature (1)..(588): n is a, c, g, or t
ttgtcgaacaaaaaacagttaaaaaaagagcagataattcagtgtgctctagagcttttctctaaaaaagggttttatactactaccattccagatattgcggcatcacttaagatgagtgtcggaaatatgtataactactttaaatcaaaagatgttttggcaaaagagattattagatttatctcatcatatttaggtaaaaaactaaaagagataaatgaatcagatctctcaacacaggagaaaacaagaaaaattatagagatctattttcaaacagctctagcaaaacctgaaatgattgactactttttaagaatatatctatcaaatcgtgaagttttccgtgatggctgtgagggcatgatctgtgtaaatgagtttgttacagagatcatgatctactttgaagagggtgtaaggtgcggtgatcttcgtgatcaggacttttttagtgcctttggtcttttcatgggataccttggcggtatggtatttttaaaaggtgaagatattttgcctcgtgacttagattactacatagacgacatctcatacaacatatatcaagctttgagaaaatga

SEQ ID NO: 17362 - protein, 195 aa, Unknown
  Obtained from environmental sample
  DOMAIN (12)...(58): Bacterial regulatory proteins, tetR family
  misc_feature (1)..(195): Xaa is any amino acid
MSNKKQLKKEQIIQCALELFSKKGFYTTTIPDIAASLKMSVGNMYNYFKSKDVLAKEIIRFISSYLGKKLKEINESDLSTQEKTRKIIEIYFQTALAKPEMIDYFLRIYLSNREVFRDGCEGMICVNEFVTEIMIYFEEGVRCGDLRDQDFFSAFGLFMGYLGGMVFLKGEDILPRDLDYYIDDISYNIYQALRK

SEQ ID NO: 17363 - DNA, 585 bp, Unknown
  Obtained from environmental sample
  misc_feature (1)..(585): n is a, c, g, or t
gtgaatagttatcaaataattgttaaaggggtagtccaaggagtcggatttcgtccttttatatttaatcttgcagagcaattaaagattaatggaaatgttagtaatgactctttaggcgttactataaatgttacaacatcaaaagagatgttagatctttttactacacatatatctttaaaaaaaccgcctctttcaaagattgactccattgatgtgaaagatgtagcatataaagagtatgaaaaatttgagattatccagagtcagcggagtatatcaggctttactattatgccatcagatatctccatatgtgaggagtgcgaaaaagagttaaacgataaaagcaacagaagatttgcttatccgtttatcacctgtacaaattgcggacctagatatacaattatagagactcttccctacgatagaaaaaatacatccatgggtgagtttaagatgtgtacagattgccaaaaagagtatgaagatccacatgacagacgctaccatgctcagcctataggttgtcataaatgtggacctgaaatctctctttttacacaattggtgagatag

SEQ ID NO: 17364 - protein, 194 aa, Unknown
  Obtained from environmental sample
  DOMAIN (1)...(87): Acylphosphatase
  misc_feature (1)..(194): Xaa is any amino acid
MNSYQIIVKGVVQGVGFRPFIFNLAEQLKINGNVSNDSLGVTINVTTSKEMLDLFTTHISLKKPPLSKIDSIDVKDVAYKEYEKFEIIQSQRSISGFTIMPSDISICEECEKELNDKSNRRFAYPFITCTNCGPRYTIIETLPYDRKNTSMGEFKMCTDCQKEYEDPHDRRYHAQPIGCHKCGPEISLFTQLVR

SEQ ID NO: 17365 - DNA, 447 bp, Unknown
  Obtained from environmental sample
  misc_feature (1)..(447): n is a, c, g, or t
ttgcaaatgaaatcctattttaaattgatttccggaactatactctttgaaggcctgcccgaacatcatattgatgaattactcaagattgcgcgagaaaaagaatttaataaaaacgagctggttttttcagaaggggatgacggaagcggtttttacatcaatatcgatggtctggtaaaaattttcaagctttcagctgaaggcaaagagcagatcctgcatatattcggcccaggtgaaccgtatggtgaggtgccggtgttttccggccagacatttccggccaatgcagaaaccctcagtaaatgccgtgctttgttttttccacgtaaatcctttataaatttgattacgggaaaatcctccattgctttgaatatgctggcggtgctttctttacggctgccgccggttacccgtaccagtggaaaacctgtcccttaa

SEQ ID NO: 17366 - protein, 148 aa, Unknown
  Obtained from environmental sample
  DOMAIN (30)...(123): Cyclic nucleotide-binding domain
  misc_feature (1)..(148): Xaa is any amino acid
MQMKSYFKLISGTILFEGLPEHHIDELLKIAREKEFNKNELVFSEGDDGSGFYINIDGLVKIFKLSAEGKEQILHIFGPGEPYGEVPVFSGQTFPANAETLSKCRALFFPRKSFINLITGKSSIALNMLAVLSLRLPPVTRTSGKPVP

SEQ ID NO: 17367 - DNA, 486 bp, Unknown
  Obtained from environmental sample
  misc_feature (1)..(486): n is a, c, g, or t
atgaaaaaatcaaagatattatttttactactaacccttttaatcattatgggtattggttgtggtgttgttttttatgattggagttatttaactttattaaaagtagatcgtaatttaccagccgatgctatagaaacttatgaaactagattaaatgatggaatgaatatgttaagtgaggttagagcagaaggggatgttgaaaaagaatataatgttttgcataatgtagcagctcaatattatggtttaggaaatcttagaaatgcttttaagtattataaacttgcatcagaattggattctaataattttatagctttaaaagaaatgtcaaaagttatgagtgaagctggtaattatgaaaaatctttagaatatataaataaggcaatagagattgaatctagtaatgtaaattcttggattagtaaattaacattagttgaggcaaataataaagataattatgatttgcattga

SEQ ID NO: 17368 - protein, 161 aa, Unknown
  Obtained from environmental sample
  SIGNAL (1)...(20)
  misc_feature (1)..(161): Xaa is any amino acid
MKKSKILFLLLTLLIIMGIGCGVVFYDWSYLTLLKVDRNLPADAIETYETRLNDGMNMLSEVRAEGDVEKEYNVLHNVAAQYYGLGNLRNAFKYYKLASELDSNNFIALKEMSKVMSEAGNYEKSLEYINKAIEIESSNVNSWISKLTLVEANNKDNYDLH

SEQ ID NO: 17369 - DNA, 810 bp, Unknown
  Obtained from environmental sample
  misc_feature (1)..(810): n is a, c, g, or t
ttgattacggtacctatctttacaaaagatggtatttattataaatggtcacataaatcattgcagggatattttgctgcacaatttattttcatagactcaaaagaaattcaaagagacattttaaagcacattgctttccatgaaaataatctttcctatttcaatgttcttgacctataccggagtatggatccgttgggttttgacggtgcaattactcttctcttattaactaaattcctagattatatagaaaacagttatgaaaactttgaaggtgaagagaagctagttcgtcaagagttaacttttggatatgatgtttacttaattagaattcgttttaattttaaatctaaatctgaagaagaccatccgtctgagctttttaaaattcttaagaagcatttcaaaataaaatttccgagaatgtcaattggaattaatgttgttaaagatgaagaagatatttcgtgcataaaagtgcctgaaattaagaaacctgaacaaaaccttatagattatcataaaagtttaaattacgactttattaaagaaattaaaacttcggaagtcaaaaataaaatcaaattgaatttagctaaacgaaagccttttcatgttactgatagaaaaaattccattttgaacaagccagaaaatttctctaaggtcaatgatttaatgaagttatatcttggcagtcggtctattctcacaatagataaagacttggcttcagaatatttagaatcaactaatcagaggcttaaaaagtcacgaaaaaatgatttactaaatttctga

SEQ ID NO: 17370 - protein, 269 aa, Unknown
  Obtained from environmental sample
  misc_feature (1)..(269): Xaa is any amino acid
MITVPIFTKDGIYYKWSHKSLQGYFAAQFIFIDSKEIQRDILKHIAFHENNLSYFNVLDLYRSMDPLGFDGAITLLLLTKFLDYIENSYENFEGEEKLVRQELTFGYDVYLIRIRFNFKSKSEEDHPSELFKILKKHFKIKFPRMSIGINVVKDEEDISCIKVPEIKKPEQNLIDYHKSLNYDFIKEIKTSEVKNKIKLNLAKRKPFHVTDRKNSILNKPENFSKVNDLMKLYLGSRSILTIDKDLASEYLESTNQRLKKSRKNDLLNF

SEQ ID NO: 17371 - DNA, 513 bp, Unknown
  Obtained from environmental sample
  misc_feature (1)..(513): n is a, c, g, or t
atgactattttaataacaggaattagtagttatgtaggtaactacttaggtaactattatttaagtaaaaactataaagttataggagtatctaggactaatcctaacattacacatgataatttcacttttttacaatttgatttagaaaatagtattttaaacgtagtctgtgatttacttatacattctgcaggagaagcaagacttaatttaccatttgaagactattatgaaaaaaatatacaaatatcttataacataaaaaaatatattgaagtatataaaataaaagcattcttgttctcaacacataaagtatatggtataaataattccccatttatagaagaaactagtgatattataaccccttgtaaatatggtttaagtaaacttgtagcagagaagattttagaaaacaatgctgtaatattacgggtacctgcattaaatgcaaaaagctctaatggttggatatataaaactatacaaagtttaaattttaaataa

SEQ ID NO: 17372 - protein, 170 aa, Unknown
  Obtained from environmental sample
  misc_feature (1)..(170): Xaa is any amino acid
MTILITGISSYVGNYLGNYYLSKNYKVIGVSRTNPNITHDNFTFLQFDLENSILNVVCDLLIHSAGEARLNLPFEDYYEKNIQISYNIKKYIEVYKIKAFLFSTHKVYGINNSPFIEETSDIITPCKYGLSKLVAEKILENNAVILRVPALNAKSSNGWIYKTIQSLNFK

SEQ ID NO: 17373 - DNA, 519 bp, Unknown
  Obtained from environmental sample
  misc_feature (1)..(519): n is a, c, g, or t
atgcatcctaaggtaagtataattattccatgttataatagtgaaagtacactagaagaaaccttacaatctgttttagatcaaagttatgataattgggaagctattatggtgaatgatggctcactagataatttagaagtgattgctttacaatgggtagaacaggataatagatttaagtactttaaaaaagaaaacggtggtttaggtagtgctagaaattttggtattggaaaagcatctggtacgtatattctacctttggattctgataataaggtcagacctggatttttgaaaagcgccattcatattatggataatcaaaaagatattgatgtcgttcatggtaatgctctgtattttggtgaaaaatctggaatatggcaagttgaatcttataattatgaaaaaattctaattaaaaattttattgatgcttgtgctgtttttagaaaaaaaatatgggaacaagttggaggctatgatattaaaatgccttatcaagggaaatga

SEQ ID NO: 17374 - protein, 172 aa, Unknown
  Obtained from environmental sample
  DOMAIN (6)...(161): Glycosyl transferase
  misc_feature (1)..(172): Xaa is any amino acid
MHPKVSIIIPCYNSESTLEETLQSVLDQSYDNWEAIMVNDGSLDNLEVIALQWVEQDNRFKYFKKENGGLGSARNFGIGKASGTYILPLDSDNKVRPGFLKSAIHIMDNQKDIDVVHGNALYFGEKSGIWQVESYNYEKILIKNFIDACAVFRKKIWEQVGGYDIKMPYQGK

SEQ ID NO: 17375 - DNA, 924 bp, Unknown
  Obtained from environmental sample
  misc_feature (1)..(924): n is a, c, g, or t
ttgagctacagaataacagatattgaatatactccagatttaaattcatttcatgagctaattagaattggtagtatccgaatagaaaaaattttaaaacacaaaaatggctataaagtttttgtggatctggttgcagtgaaactatctgagaaaaaatatatggcattttgtgttgatataacggaaaaaaaacaactggaaacacaactgcatcaatcacaaaaactggaatcaattggcaatctatcggctggaatagctcatgattttaataatcttcttactgttattatggggaatgcagatttgttgaaacataaattatcctctgatggatttctaaaagaattgattgatgatattattttggcatctgacaaagcatctcaattaacaagaaaaatgcttctctttagtcgtaaagaaacaatgatttttcaaccggtaaatttaaataattgtataatggatataatgaaaattttaaaccgattaattggtgcgaatataaagattgatttagaactggaaaaagatttaaacattataaatgcggacagaaacaatatcgaacaggtaataatgaatattgtatctaattcaagtgatgcaatgcaacaaggtggaaatctgcatatttctacaaataatattacaattgatgaagagattcaagcactgattcctcattcgaaaattggtgaatttgtgattttgaatattgaagattatggatgtggaatagatcagaaaatattggaaaatgtttttgatccttttttcacaacaaaagaagtgggcaaaggaactggaatgggactttncgtagtttacggtattgtaaaaaaacataacggctggataaacatttactcagaaattgataatggaaacagtattcgaatctacttaccgatttca

SEQ ID NO: 17376 - protein, 308 aa, Unknown
  Obtained from environmental sample
  DOMAIN (79)...(145): His Kinase A (phosphoacceptor) domain
  misc_feature (1)..(308): Xaa is any amino acid
MSYRITDIEYTPDLNSFHELIRIGSIRIEKILKHKNGYKVFVDLVAVKLSEKKYMAFCVDITEKKQLETQLHQSQKLESIGNLSAGIAHDFNNLLTVIMGNADLLKHKLSSDGFLKELIDDIILASDKASQLTRKMLLFSRKETMIFQPVNLNNCIMDIMKILNRLIGANIKIDLELEKDLNIINADRNNIEQVIMNIVSNSSDAMQQGGNLHISTNNITIDEEIQALIPHSKIGEFVILNIEDYGCGIDQKILENVFDPFFTTKEVGKGTGMGLXVVYGIVKKHNGWINIYSEIDNGNSIRIYLPIS

SEQ ID NO: 17377 - DNA, 909 bp, Unknown
  Obtained from environmental sample
  misc_feature (1)..(909): n is a, c, g, or t
atggaattatttaaaaacagggaatctctgattaaagaactaggatccgagtattttnctaaaataaatacagaggaaattaataatttactttccaacattgataatgaagaagaaatatcattcgagaaattaatagaaaatttacaagataccaatgagtataatgaattcaaatcaattcataaaagtgctctaaattttttagtaaaattaccacataaattagcatacgatgaaatggattgctatggagatcttgataaattaaaaaaaagagcatctcataaaagatttgtatcactccaagatttaataaagcagttcttaaataaagaattatcttgggagagaaataaatctactattaagtcaactcatttaggagttacagcaaacttcatcggtatttggaaaatagatggtcgagaattcaattacaacgaactctcaaatggtgaaaaatccttattcgcatatattctgcttttcttccttttagaccaaaatccgaaactaaaatttaaagaaagtattattgtaatagatgaacccgaacttcatcttcatcccgattcggaagttgatcttataaatggaatcagaaacattattggtgataagggacaattatggattgcaactcattctattaacattcttgctgagttaaactataatgaaattttcatgatacaaaaaggtagaataaagcatccctctcaatcaaccccaggtgagtcattaaatgagcttatgtctatagaaaatagagttttcaaactttcagaatttatcacatctatttcagattgggcttatgtcaatttcatggcacaatgctttacgagtcccgatgtaattacttgtgcaaatgagaatgacccacaaatctcagccgaattctga

SEQ ID NO: 17378 - protein, 302 aa, Unknown
  Obtained from environmental sample
  misc_feature (1)..(302): Xaa is any amino acid
MELFKNRESLIKELGSEYFXKINTEEINNLLSNIDNEEEISFEKLIENLQDTNEYNEFKSIHKSALNFLVKLPHKLAYDEMDCYGDLDKLKKRASHKRFVSLQDLIKQFLNKELSWERNKSTIKSTHLGVTANFIGIWKIDGREFNYNELSNGEKSLFAYILLFFLLDQNPKLKFKESIIVIDEPELHLHPDSEVDLINGIRNIIGDKGQLWIATHSINILAELNYNEIFMIQKGRIKHPSQSTPGESLNELMSIENRVFKLSEFITSISDWAYVNFMAQCFTSPDVITCANENDPQISAEF

SEQ ID NO: 17379 - DNA, 681 bp, Unknown
  Obtained from environmental sample
  misc_feature (1)..(681): n is a, c, g, or t
atgcatcataattcgatcttgaagttttatgtgaaagatactggcattggtattcctgaagagaaaagagaattaatttttgatgttttcaggcaagtggaggattcgaataaacgcttgtatggaggaacaggaattggtttatcaatatcaaaaaaaataaccgagcttttaggaggtgagatttggcttgaatccgaggaagggaaagggactattttttattttacaattcctctgaaacggaaaggtgattctgaagaattaattgaggatgttgaaagtgaatctgagctaaagaaaaatagtctggaaaagcaaacgatactgcttgttgaggatgtagaggagagtttggaattgttagaaattttagttggagggtatgggtataaaaccctaaaagctagaaatgggcaggaagctgttaatatatgtaaagaagatgaaagcattgatttggttttgatggatgttaatatgcccattatgaatggctatcaagcaactaaggaaataaagaaatttaggccaaaacttccaattatctctcaaacggcttatgctacgatgggtgataaagagaaatcattggatgctggttgtgatgactatatttcgaaaccgataaaacgagagaatctaatagagaagattgaacaattattaacttgtaaatag

SEQ ID NO: 17380 - protein, 226 aa, Unknown
  Obtained from environmental sample
  DOMAIN (1)...(81): Histidine kinase-, DNA gyrase B-, and HSP90-like ATPase
  misc_feature (1)..(226): Xaa is any amino acid
MHHNSILKFYVKDTGIGIPEEKRELIFDVFRQVEDSNKRLYGGTGIGLSISKKITELLGGEIWLESEEGKGTIFYFTIPLKRKGDSEELIEDVESESELKKNSLEKQTILLVEDVEESLELLEILVGGYGYKTLKARNGQEAVNICKEDESIDLVLMDVNMPIMNGYQATKEIKKFRPKLPIISQTAYATMGDKEKSLDAGCDDYISKPIKRENLIEKIEQLLTCK

SEQ ID NO: 17381 - DNA, 774 bp, Unknown
  Obtained from environmental sample
  misc_feature (1)..(774): n is a, c, g, or t
atggagattgttgtcaaaaaaattatcgtaaacggaagtactggaccaaatacctctattagatcaaaaattgctactgtttatggtcaaactcataaaacatcttttattgaggctgatgatcttaagcttaacgttcataaaggtatagctaaggcaaaaaatgcagttattacaagattagagcatggaactattaccgctgatatagctcatgtagaacaagcgttaggcggaaccattatcgctaaaactatcacaattgatcatttaggctcacatgtgactatgattgcttctgataaaatagaagtaaaaaagatgcaaggaagtgaaaacagttttattattgatccggtactaaaagatgaatcaaaacagactctaggtaaagatgaagttcttataagaaaagcaaatagaaaaattgagttgattgaagaagagttagtaaaatatagaactaggttgcttgagggaattgatctgtttaagagtgttaaatctaaattaaatcagctaagaaaagctaaaaaagagatccctgtagctctgaaaaaaaagtataaacagttcagtaatgttgaagagcatatcananatttagaagaagaacttagtgaacagaaatattncattgagcatttaacggttaagcatgaagcatttcaagagaatattttaaattcaagtatcataaattatgacatatggcatggacataacaatattatttttaaaatattaaatcctgaacaagaaattttatatgtc

SEQ ID NO: 17382 - protein, 258 aa, Unknown
  Obtained from environmental sample
  misc_feature (1)..(258): Xaa is any amino acid
MEIVVKKIIVNGSTGPNTSIRSKIATVYGQTHKTSFIEADDLKLNVHKGIAKAKNAVITRLEHGTITADIAHVEQALGGTIIAKTITIDHLGSHVTMIASDKIEVKKMQGSENSFIIDPVLKDESKQTLGKDEVLIRKANRKIELIEEELVKYRTRLLEGIDLFKSVKSKLNQLRKAKKEIPVALKKKYKQFSNVEEHIXXLEEELSEQKYXIEHLTVKHEAFQENILNSSIINYDIWHGHNNIIFKILNPEQEILYV

SEQ ID NO: 17383 - DNA, 495 bp, Unknown
  Obtained from environmental sample
  misc_feature (1)..(495): n is a, c, g, or t
gtgatctatgaagtctttatatctctaaatacatattcacagatacagagtgataaggtagagctttttacatcacacattattcgtgaagatgcccagttactttacggcttttatgagcagagtgaaaaagttatgtttgaaagactaataaaaatcagcggtgtgggaccaaaagttgctatggcaatatgctcaacatttagttcatcacaatttgcagagttaattaattcaaatgatattacacttctgaaaaaagttccgggtattggtccaaagagtgcagggcgcattttggtagagttaagtggttttgcagatacacttgtaaatcattcacaatcacaaaattctaatgtcagtgatgcatcacttgcactagagtcacttggatttaaaaaagagcatatatcaaaagtattgagtagttgtgagagtgaagagactgctgcacttgtaaaagaagcacttaaaaaattacaaaaattataa

SEQ ID NO: 17384 - protein, 164 aa, Unknown
  Obtained from environmental sample
  DOMAIN (1)...(37): RuvA N terminal domain
  misc_feature (1)..(164): Xaa is any amino acid
MIYEVFISLNTYSQIQSDKVELFTSHIIREDAQLLYGFYEQSEKVMFERLIKISGVGPKVAMAICSTFSSSQFAELINSNDITLLKKVPGIGPKSAGRILVELSGFADTLVNHSQSQNSNVSDASLALESLGFKKEHISKVLSSCESEETAALVKEALKKLQKL

SEQ ID NO: 17385 - DNA, 801 bp, Unknown
  Obtained from environmental sample
  misc_feature (1)..(801): n is a, c, g, or t
atgactacaatagttgattatttaaataagtggtcaaaaaaaactccagataaaatttttataagtgaagatgataaatattggacttntaagacatttcaagaagaggtactcaaattatcttcattttttaaaagtaaaggtataaaaaaaagtgcttgtgtagtagttcatctagagaaaaaaagtgaacatctactctcttacatggcactactaaatattggtgctatttgtgtacatctgtatcctgagagagagtgtgaatatgtaaaatttgcggcttctcactgtgatgccaaggcaattattagtaacaaatttaaagataatctatctgagattttaattttaaacactcttgaatatgaagagtgtgaaccactaatccatggagatacaggtgaaatagcctatataatgtttacaagcggtacaacatcaattccaaaagctgtacaaaccacgcatgagaatctactttttgtcacaaatactttaattgatctagccgacatgcaagaacaaaaagagagagaaataattttcatgcctttaggttccacaggtggtttaggacattttcatgcctctttaatactgggaaatcatataagactatttcctggtttatactctcaaactaccactcaagatatggaaaatatgttttgtaccattgaaaaggagagtattacggggatgcttttaacacctgggttgatactgagaatattacaaaatcataaaaaaagattgaagttgtggaaaaaatctaactatctctgcagccggcgataa

SEQ ID NO: 17386 - protein, 266 aa, Unknown
  Obtained from environmental sample
  misc_feature (1)..(266): Xaa is any amino acid
MTTIVDYLNKWSKKTPDKIFISEDDKYWTXKTFQEEVLKLSSFFKSKGIKKSACVVVHLEKKSEHLLSYMALLNIGAICVHLYPERECEYVKFAASHCDAKAIISNKFKDNLSEILILNTLEYEECEPLIHGDTGEIAYIMFTSGTTSIPKAVQTTHENLLFVTNTLIDLADMQEQKEREIIFMPLGSTGGLGHFHASLILGNHIRLFPGLYSQTTTQDMENMFCTIEKESITGMLLTPGLILRILQNHKKRLKLWKKSNYLCSRR

SEQ ID NO: 17387 - DNA, 573 bp, Unknown
  Obtained from environmental sample
  misc_feature (1)..(573): n is a, c, g, or t
atgtctaaaatagaaaaaagcaactctctatacctgccatttagaaaaacatctagttgtttaaaagagatgcttactcatttagatgagtatattgatcttttaaataatgaggtaaatatcagagcagactctaaagagatagtttctgatcaaagttttcaatctagtctgtttaactacgctccgttaacatctagtagtacccatattcttttattaggtgggatgggtccattagctggtatttatggaatgaaagatagtctcgccgtcttccaagagcgttactccatcactctttttcaagcctgttttataccaagaagagataaagacaaggatattacgatcaacctttatgatgctctaaatatagcactgcaaaattgccctaaagataaagagatagaacttattgttctatgtaacagtgcccatgtttttatggatggggtcatggagttatttcatagagagagtctctttaaagatataaaaatacgatttaactctcttaaactatccgttgaaaaaaatatagatcaattttatgaaaaagagtgtattgct

SEQ ID NO: 17388 - protein, 191 aa, Unknown
  Obtained from environmental sample
  misc_feature (1)..(191): Xaa is any amino acid
MSKIEKSNSLYLPFRKTSSCLKEMLTHLDEYIDLLNNEVNIRADSKEIVSDQSFQSSLFNYAPLTSSSTHILLLGGMGPLAGIYGMKDSLAVFQERYSITLFQACFIPRRDKDKDITINLYDALNIALQNCPKDKEIELIVLCNSAHVFMDGVMELFHRESLFKDIKIRFNSLKLSVEKNIDQFYEKECIA

SEQ ID NO: 17389 - DNA, 636 bp, Unknown
  Obtained from environmental sample
  misc_feature (1)..(636): n is a, c, g, or t
atgttagctattttgtttgcaaacaatgaaacagcaatatattcacttagcacaaaagagatgatatttaaagaagaggcaactgcacctatcgctcttgatgcacgtatagctaatccttatatatttaatgatctggtaatatttttatctttagatggaaaaattcaaattgtcaactcaaaaagtaaaaaagtgcttcgctcgattacacttggtaaaaaagagtattttgatgacataatctactttaatatgataaataacatcatggtagcagcaacaagtcatacaattctctcttttggtattaaagaatttcgccaaaattatgatattcgtgatgtagtatataatgaagatggaatctgggttactaccaagcagggtgaagtgattgcactggatccggctcttgaagtaaaagcttcaaaaaagtttccatttgctcattttttgngaatgattgttagaaatgacaaagtttatgtaattgaaaaagagggttatctgatcgttttagataaagatcttaaagagcataaaatttatgatgcagatgtaggtgacggatttgtatttgtaagtgatgatgtattttttaatgacaactcttacataaatgttaaaaagtaa

SEQ ID NO: 17390 - protein, 211 aa, Unknown
  Obtained from environmental sample
  misc_feature (1)..(211): Xaa is any amino acid
MLAILFANNETAIYSLSTKEMIFKEEATAPIALDARIANPYIFNDLVIFLSLDGKIQIVNSKSKKVLRSITLGKKEYFDDIIYFNMINNIMVAATSHTILSFGIKEFRQNYDIRDVVYNEDGIWVTTKQGEVIALDPALEVKASKKFPFAHFLXMIVRNDKVYVIEKEGYLIVLDKDLKEHKIYDADVGDGFVFVSDDVFFNDNSYINVKK

SEQ ID NO: 17391 - DNA, 822 bp, Unknown
  Obtained from environmental sample
  misc_feature (1)..(822): n is a, c, g, or t
atggatataaaaaataaaaatataaaagagttagagcaagtagcacaagatataagagatagaattatagatgtagtctctagaaatgggggacattttagttcaacattaggtgctgttgagttaactatagggatgcataaagtatttgattgtgagtttgatccttttatatttgatgtatcacatcagtgttacccacataagcttatcacttctagatgggaagagtttgaaactttacgacaatttaatggaataagtggatttacaaaaccaaaagaatcaaaagcagactattttgtagcaggtcatagttcaacttcaatttcactagcagttggtgcagcaaaagcagcacagcttgaacaaaatggaaaagtgcctgttgtgatgataggtgatggaagtatgagtgctggtatggtatatgaagcacttaatgagcttggggatataaaattaccagttgtaattatccttaatgacaatgagatgagtatcgcaaaaccaattggtgcaatatcaaaacatttaagtaaagttcttgcaggtaaagggtatcaaaaattcaaagatagagttgataagtttataaaaaacaatatgccagagggtgctacatatatagcaaaaagaatggaggagagtttaaaacttataactcctggaatcatctttgaagagatgggaatagattatataggacctattgatgggcatgacatagctgaagttatagatacattagagttagctaaaaattttgggaaaccagtaattgttcatgccagaacagtaaaggaaaagggtataaggagc

SEQ ID NO: 17392 - protein, 274 aa, Unknown
  Obtained from environmental sample
  misc_feature (1)..(274): Xaa is any amino acid
MDIKNKNIKELEQVAQDIRDRIIDVVSRNGGHFSSTLGAVELTIGMHKVFDCEFDPFIFDVSHQCYPHKLITSRWEEFETLRQFNGISGFTKPKESKADYFVAGHSSTSISLAVGAAKAAQLEQNGKVPVVMIGDGSMSAGMVYEALNELGDIKLPVVIILNDNEMSIAKPIGAISKHLSKVLAGKGYQKFKDRVDKFIKNNMPEGATYIAKRMEESLKLITPGIIFEEMGIDYIGPIDGHDIAEVIDTLELAKNFGKPVIVHARTVKEKGIRS

SEQ ID NO: 17393 - DNA, 642 bp, Unknown
  Obtained from environmental sample
  misc_feature (1)..(642): n is a, c, g, or t
ttggatataaaagttcacagtggtatttgtgaagtaggtggaataaaatcagaacaaattgattttgagtatgcaaaaggtagtgaaatttttgcactagatgaaattaaagaacagatgcaaaaagatgcaataaaagaagcgatgtcaaaccatgactcaataggtggagttgttttactaaaggcaactggagtacctgctggtttaggagaacctatgtatcataaactcgatggtcaaatagctaatgctatgatggggttaaatgctgtaaaagctgtagagataggtgatggtatggagtctagtagatctaaaggtagtttaaataatgatcaaatcagatctcaaggatttcaaactaatcatagtgggggaatattaggggggattagtaatggtgatgagattattacaaaagtttatttcaaacctacaccttcaatttttactgaacaaaaaactgttgatgtaaataatattgaccaagtctacaacttaaaagggagacatgatccatgtgttgcattaagaggtagtgtggtttgtgaatcaatgatgagtttaattttagcagatatggtattacttaatatgaatagtaatataaaaaacataaaaaaagtttattctaaatag

SEQ ID NO: 17394 - protein, 213 aa, Unknown
  Obtained from environmental sample
  DOMAIN (1)...(200): Chorismate synthase
  misc_feature (1)..(213): Xaa is any amino acid
MDIKVHSGICEVGGIKSEQIDFEYAKGSEIFALDEIKEQMQKDAIKEAMSNHDSIGGVVLLKATGVPAGLGEPMYHKLDGQIANAMMGLNAVKAVEIGDGMESSRSKGSLNNDQIRSQGFQTNHSGGILGGISNGDEIITKVYFKPTPSIFTEQKTVDVNNIDQVYNLKGRHDPCVALRGSVVCESMMSLILADMVLLNMNSNIKNIKKVYSK

SEQ ID NO: 17395 - DNA, 639 bp, Unknown
  Obtained from environmental sample
  misc_feature (1)..(639): n is a, c, g, or t
atgaaattgtataataaaactcttaaattttatatattaaaagagtttttattgaagattatactattatttgttttatcagctattattagcttcgcttcttatgtgcaagaagatgtttggtggaaaggggaaaccctccttactttttttgacaaacatcaaatttcaaaaaatgtttattttgacctttcaaaaacagataaagaactttgtagtgagatatacgcaggtataccatttcaaatgatgtatgatgataaaaataaattagaacaagcacttatacctattagtgaagagatgcaaatacatatttttaaaaatttagctggtctatatgagctagatattattcctatacaatacaaagaaattaaacaaaatatcaatataaatataaccacttccccgtatcaggacatagtagaaactactgggaataaagccttagcaaatgagtttatactagcatttaaaaaatcggtgaactttaaaagacttcaaaaaaatgatattgtttctattgtcttcaaacaaaaaattagagaggggagatattttggtactcctgaaatacttggagcttctgttgtaatgaaaagaaaaactcattatattttcaaaacccagatataa

SEQ ID NO: 17396 - protein, 212 aa, Unknown
  Obtained from environmental sample
  misc_feature (1)..(212): Xaa is any amino acid
MKLYNKTLKFYILKEFLLKIILLFVLSAIISFASYVQEDVWWKGETLLTFFDKHQISKNVYFDLSKTDKELCSEIYAGIPFQMMYDDKNKLEQALIPISEEMQIHIFKNLAGLYELDIIPIQYKEIKQNININITTSPYQDIVETTGNKALANEFILAFKKSVNFKRLQKNDIVSIVFKQKIREGRYFGTPEILGASVVMKRKTHYIFKTQI

SEQ ID NO: 17397 - DNA, 783 bp, Unknown
  Obtained from environmental sample
  misc_feature (1)..(783): n is a, c, g, or t
ttgatggctcgaggtacatcaccncttattgataaaaatcatcaccatacattgatgacggaactacatgaagtagccggagaccgtgttcctgatgacagtgtcagagtttcttttgaacgtatattcgccggaaccaatgtgaatgtagttcaggatgaaattattgaacttgattcgggttcaaaaaaattgatatcggcaacgggtgagtatgaatatgactatctgcttatgtgtacgggcggtgattcttcagatttcggaattcccggtgttaaagagcactctcttccgctgtggagttttaataacgctgttcatatccgcgaacatgttcaggaaatgttttataaagctgcccatgagaaagattctgagaaacgtaaagtgtatctgacctttgtcgttgcgggttcaggttttacgggtgttgaaatgctgggagagcttatagagaatattcctctgctggctgaagaatataaaattgataaagatgaagtgcagcttattaatgtagaagggctgggcaccatcctgaatatgatacctgaaaaacccagggcgaaagctcagcggtatctggaaaagaaaggcgtaaagattctgctgaactctctcatagtcaaggccgaaaaagaatcatttaccttaaaagatggaacagaattcaagtgcggaacacttatatggacatgcggtattaaaggcggttctttcggcaagacctcgaagctgactatcggccctgttgatcggttaaagttgacaagacaatga

SEQ ID NO: 17398 - protein, 260 aa, Unknown
  Obtained from environmental sample
  DOMAIN (2)...(260): Pyridine nucleotide-disulphide oxidoreductase
  misc_feature (1)..(260): Xaa is any amino acid
MMARGTSPLIDKNHHHTLMTELHEVAGDRVPDDSVRVSFERIFAGTNVNVVQDEIIELDSGSKKLISATGEYEYDYLLMCTGGDSSDFGIPGVKEHSLPLWSFNNAVHIREHVQEMFYKAAHEKDSEKRKVYLTFVVAGSGFTGVEMLGELIENIPLLAEEYKIDKDEVQLINVEGLGTILNMIPEKPRAKAQRYLEKKGVKILLNSLIVKAEKESFTLKDGTEFKCGTLIWTCGIKGGSFGKTSKLTIGPVDRLKLTRQ

SEQ ID NO: 17399 - DNA, 402 bp, Unknown
  Obtained from environmental sample
  misc_feature (1)..(402): n is a, c, g, or t
atgctcgaaattaaaagtttattgccagaagctcctccattttacgataaagaccaactaaccgataagcccgaaaaattctttgtagcagaaattattcgtgagaaaattttaatgcactaccaaaaagaaattccttactcttgcgaagttgttattgaagaatttaaagaagagcctaacattatcagaattagagcggtaataatggtaattagagaaagtcagaagggaataattatcggacatcaaggaaaagatttaaagcgtgtgggcactttagcccgtaaggaaatggagcaatttttcgagaaaaaagtctttttagaaatgtatgttaaagtaaacaaagactggagaaacaacgaaagacagttgagaaacttcggttatttgaattaa

SEQ ID NO: 17400 - protein, 133 aa, Unknown
  Obtained from environmental sample
  DOMAIN (67)...(131): KH domain
  misc_feature (1)..(133): Xaa is any amino acid
MLEIKSLLPEAPPFYDKDQLTDKPEKFFVAEIIREKILMHYQKEIPYSCEVVIEEFKEEPNIIRIRAVIMVIRESQKGIIIGHQGKDLKRVGTLARKEMEQFFEKKVFLEMYVKVNKDWRNNERQLRNFGYLN

SEQ ID NO: 17401 - DNA, 651 bp, Unknown
  Obtained from environmental sample
  misc_feature (1)..(651): n is a, c, g, or t
atgatggccgagcactctcatgctttagggttaacaatacaaaaaataaaaatgtattatgaagaagatatgttatctcaagaagaactggataaggcagtagataaaagtaaagttctgattactaaaatgtcaacaactatagatgattttagaaatttttttagaatagataaaacaaaacaacaatttaatataaaagatgccatacaagatacaatgggtttagtagatgctagtctaaaaaatcatcatatttttattgatataactaaaacaaataatgatattgattttttagggtataaaaatgaattagaacaggtattattaaatcttattaataatgccaaagatgctttagtggaaaataatattgaaaatccaaaaatatctatagaaagttttctacaaaataactatatatttatagaaatacaagataatgcaggtggaatttctaatgaaattattgcaaatatatttgatccatattttactacaaaagagcaaggaaaaggtacgggaataggtttatatatgtcaaaaatgataatacaaaataatatgagtggaaatatcacagtagaaaataaactagatggtgcttgttttagtataaagttaaatcaggaaaaaataaatgaataa

SEQ ID NO: 17402 - protein, 216 aa, Unknown
  Obtained from environmental sample
  DOMAIN (101)...(212): Histidine kinase-, DNA gyrase B-, and HSP90-like ATPase
  misc_feature (1)..(216): Xaa is any amino acid
MMAEHSHALGLTIQKIKMYYEEDMLSQEELDKAVDKSKVLITKMSTTIDDFRNFFRIDKTKQQFNIKDAIQDTMGLVDASLKNHHIFIDITKTNNDIDFLGYKNELEQVLLNLINNAKDALVENNIENPKISIESFLQNNYIFIEIQDNAGGISNEIIANIFDPYFTTKEQGKGTGIGLYMSKMIIQNNMSGNITVENKLDGACFSIKLNQEKINE

SEQ ID NO: 17403 - DNA, 468 bp, Unknown
  Obtained from environmental sample
  misc_feature (1)..(468): n is a, c, g, or t
atgaatttaaaaaatagagtattaaaaaataaaattccaaaccatattgctattattcttgatggaaatggacgttgggctaagaaaagaaaattacctcgaactctcggacataaagttggttctgaaaacctaaacaaaactgcgattaattgtagtaaattaggaataaaagtactaagtgtttatgcttttagtacagaaaactggagtcgtcctaaagaagaggttgattacttaatgaagttacctcttgaatttgagaaatcatataaagggaactttaaagaacatgatattaaagttatattttcaggtagaagagatagatttagtaaagaaaatatagaacttttaaacaagatagaagaaaaaactaaagatagattaggattaattctaaatatttgttttgattatggtagttatacagaaatgttgacagctacaaaagagatatgtaagtga

SEQ ID NO: 17404 - protein, 155 aa, Unknown
  Obtained from environmental sample
  DOMAIN (19)...(155): Putative undecaprenyl diphosphate synthase
  misc_feature (1)..(155): Xaa is any amino acid
MNLKNRVLKNKIPNHIAIILDGNGRWAKKRKLPRTLGHKVGSENLNKTAINCSKLGIKVLSVYAFSTENWSRPKEEVDYLMKLPLEFEKSYKGNFKEHDIKVIFSGRRDRFSKENIELLNKIEEKTKDRLGLILNICFDYGSYTEMLTATKEICK

SEQ ID NO: 17405 - DNA, 681 bp, Unknown
  Obtained from environmental sample
  misc_feature (1)..(681): n is a, c, g, or t
atgatgtatttaaaaaagggtgtattctcatcttatgaaatttctaaaaaagtactatctaattttactcaagatgaaaacttatataaaaaattagaaaagatattggatcatgagggaattaatgttaattcaacattggaagatattgttagaaaactagaatctaatcaacaaacaataactataattaacaacattcaaaatattcaaaatatacatggtcataataatacaattaataattactatgaaaataagaaaaagaaaaattttatattagagcctgtggaagaaagatttagaaattttggtgttgatttttactttggtttcttaacattctttttagggttgtcattactaacagtttttagactaccttttctttattctttactaatatgtattgctttaatcagtttttatcttttttatttatcaagagtatttcctattatgtatattgatgtatatgaaaatcgattagtttatttaggaaataaaaatattatgtatgaggatataagaaactttaggccacatactaatcattttaagtttagactcaaacaatctgcaaaatattataatttaattttatttaatgatgataaggctcattttatagatgatgcaataagaagatatagtattgctacaaattcattgagggaataa

SEQ ID NO: 17406 - protein, 226 aa, Unknown
  Obtained from environmental sample
  misc_feature (1)..(226): Xaa is any amino acid
MMYLKKGVFSSYEISKKVLSNFTQDENLYKKLEKILDHEGINVNSTLEDIVRKLESNQQTITIINNIQNIQNIHGHNNTINNYYENKKKKNFILEPVEERFRNFGVDFYFGFLTFFLGLSLLTVFRLPFLYSLLICIALISFYLFYLSRVFPIMYIDVYENRLVYLGNKNIMYEDIRNFRPHTNHFKFRLKQSAKYYNLILFNDDKAHFIDDAIRRYSIATNSLRE

SEQ ID NO: 17407 - DNA, 423 bp, Unknown
  Obtained from environmental sample
  misc_feature (1)..(423): n is a, c, g, or t
gtgatagaaacaaatactcaagagaaacaaaaaatccaagagagagtaaatcactataagttggataacaaaacaataattttagaaaactacacaaatattgatgaactatttattgcagcagatatgtttatattaccaacaaaacaaaaactctttgccctcaatgtactcaaagctatgtattttaaaaatgctgtatttgtaagtagtgataatgcatcttcagagataatagattcattttctttaatattaggggaaaaggatagaaatacaccttttaaagttgatgcacttcttggaaataaaaaggagctaaaaaagatacaaaaagagaattatcaggtggtgaaaaatattaaatttgatacttatatggaagagttagagtatattatttcagataattttgacttttaa

SEQ ID NO: 17408 - protein, 140 aa, Unknown
  Obtained from environmental sample
  misc_feature (1)..(140): Xaa is any amino acid
MIETNTQEKQKIQERVNHYKLDNKTIILENYTNIDELFIAADMFILPTKQKLFALNVLKAMYFKNAVFVSSDNASSEIIDSFSLILGEKDRNTPFKVDALLGNKKELKKIQKENYQVVKNIKFDTYMEELEYIISDNFDF

SEQ ID NO: 17409 - DNA, 453 bp, Unknown
  Obtained from environmental sample
  misc_feature (1)..(453): n is a, c, g, or t
atggctgagtggagttggatggagtcgcgtttactttttcgcaccgccaatatcgaggacaaagaagaacaattgaaaattgcaattaacattttaacatccaaagttgaagaagatgggaatttcgcccatatcaatgaagttaaactgcatcaaataatctcagttgaatcttccaaatcttatcttaaccagcacgtagatgatgaaaacaaacacggtgtattttcatcttataaaaatattgtcggaagagtgagcgacataatgttagcaataaacccaaagtttgattacccaaatatgctgacgtcaacaataatagaaggagcacaccttcaacgttttttcgcagaacatttacctggattaacgaaccaaactaaaaacaaggacgatatagagtcattctatactgctcttgcactaaacgcattaaaaaaagataaataa

SEQ ID NO: 17410 - protein, 150 aa, Unknown
  Obtained from environmental sample
  misc_feature (1)..(150): Xaa is any amino acid
MAEWSWMESRLLFRTANIEDKEEQLKIAINILTSKVEEDGNFAHINEVKLHQIISVESSKSYLNQHVDDENKHGVFSSYKNIVGRVSDIMLAINPKFDYPNMLTSTIIEGAHLQRFFAEHLPGLTNQTKNKDDIESFYTALALNALKKDK

SEQ ID NO: 17411 - DNA, 828 bp, Unknown
  Obtained from environmental sample
  misc_feature (1)..(828): n is a, c, g, or t
ttggaagctagagaaaagcactttaaagtccttgtcagtcaatatagccttctcgttgtattcaaaatattggtcgctacaggtcttttagctattggtggtgttcttgttatggaacaagaaatgaatatcggtcaattcgtggcagctgaaattattattgtaatgattattaattccgttgaaaaactcattcgaaatcttgaaatagtttacgatgtactcacagcaatagaaaaagtagctcaagttacagatttagaacttgaaaaaggggatggacttgatataaacaataactccaatggtaatggactatcaataaaattaaatgatgttactttcaagtatccaaagagcaagtttgagacaataaaaggagtctcattagacatcaaagaaaacgaaagagttgtggttgctggaaaaaatggctcaggaaaaagtactttactccatcttatcgctgggttatatgacttgccaaaaggaacgatttcttataataatctaccgttggggaatctaaacctggaatcattaagaaatgtaattggtgctaacttaaatcatgaggatttgttctatggaactattctagaaaatatttccatgggtagaaaaaaagcaacatttgaaaatgtcgaatgggcaattgaaaaagtagggttaacggatttcatccaacaattaccaaatggttatgatacattgattttaccaaatggtaaaaccttacccaaaagcgtcgttcaaaaactactgattgttaggagtatagttgataaacctaaaattttgcttctcgaatactctctgaacacctaa

SEQ ID NO: 17412 - protein, 275 aa, Unknown
  Obtained from environmental sample
  DOMAIN (135)...(275): ABC transporter
  misc_feature (1)..(275): Xaa is any amino acid
MEAREKHFKVLVSQYSLLVVFKILVATGLLAIGGVLVMEQEMNIGQFVAAEIIIVMIINSVEKLIRNLEIVYDVLTAIEKVAQVTDLELEKGDGLDINNNSNGNGLSIKLNDVTFKYPKSKFETIKGVSLDIKENERVVVAGKNGSGKSTLLHLIAGLYDLPKGTISYNNLPLGNLNLESLRNVIGANLNHEDLFYGTILENISMGRKKATFENVEWAIEKVGLTDFIQQLPNGYDTLILPNGKTLPKSVVQKLLIVRSIVDKPKILLLEYSLNT

SEQ ID NO: 17413 - DNA, 843 bp, Unknown
  Obtained from environmental sample
  misc_feature (1)..(843): n is a, c, g, or t
gtgtggcatggaaaagtaaaaaacagaaaaaaagatggtggttcgtatacggtggatgcaactatctttcctatcaagaatgataatggagttactgttgagtatattgctattcgttatgatataacagagtttgaagagctaaaagagcttttaacaaaagagctaagcagctcaaatcagtcccttaaagataagatgaatctgctactccagtatgagaaaacgatagagagtgctgcttcatttacaagaacggatttaaaaggtgttattacatatttaaatgagactcatgagaaaattacaggatataaaaaagaggagttgataggacacagacatactccatttttaagagattacagtgttcctcgtggattttacagagagttatgggagaccataaaatctaaaaaaagctttaagggtgtaattacaaatatagcaaaagatggtaaaactatctatcttgatacgctagttgttcctattttagattcagatgaaaatatagttgaatatatgagcatacagtatgacatatcagatatggtgaatatgcataaagagatagaagatactcaaagagaagtaatctataaaatgggtgaaataggtgaatctcgttcaaaagagacaggtaatcatgtaaaacgtgttgcagagtactctaaacttttagctataaagtatggcttagatgctanagaagctgaacttttatatgacgcttcaccaatgcatgatataggtaaagtaggaatacccgatagtgttttgaaaaaacctgggaagctggatgagggtgagtggaaaattatgagaactcattcagaatag

SEQ ID NO: 17414 - protein, 280 aa, Unknown
  Obtained from environmental sample
  DOMAIN (71)...(134): PAS domain
  misc_feature (1)..(280): Xaa is any amino acid
MWHGKVKNRKKDGGSYTVDATIFPIKNDNGVTVEYIAIRYDITEFEELKELLTKELSSSNQSLKDKMNLLLQYEKTIESAASFTRTDLKGVITYLNETHEKITGYKKEELIGHRHTPFLRDYSVPRGFYRELWETIKSKKSFKGVITNIAKDGKTIYLDTLVVPILDSDENIVEYMSIQYDISDMVNMHKEIEDTQREVIYKMGEIGESRSKETGNHVKRVAEYSKLLAIKYGLDAXEAELLYDASPMHDIGKVGIPDSVLKKPGKLDEGEWKIMRTHSE

SEQ ID NO: 17415 - DNA, 846 bp, Unknown
  Obtained from environmental sample
  misc_feature (1)..(846): n is a, c, g, or t
atgcagtgggatttgactattgcagagtgtccaattaagatgaagtttttgaaaatattaaatgatcatggtgtgacaccatttgatctgttttatatctttatgnctctaaaaaatagtatagcaactctattttatgaaaatatgtttctctcttttgcattacaaaaagatttagagactatttcactaaatatttcaaaagatatctttgtaacatatgagcagatacaaaaaaatgagataaatttttcagatgttcactctaacttacttaatgagtacaaaaaagccgttgatatcagtaatattgtttcaaaatcaaatacaaaagggatcattacatatgttaatgataaattttgtgaaatcagcggatacactaaatctgaacttatcggtaagcctcactctatagtccgtcatccatcaatgcctagttcgatatttaaggaactttgggatgtaataaaagagaaacgtgcatggcatggtgtaatcacaaatatgaaaaaagatggacgtaagtatgtagtggactctacggtcatacctattttggatgttgatggagatatagtcgaatatattgctatacgacatgatgtaacagagtttgagcagacaaaagagcagctaggtacgctaaatcgtgctatgaaaaataaggtggatgagctatattccatgactgcaacattggaagaagaagcctctatagatgcattaacaggtgcatttaatcgttcaaaatttgagaaattttttgatcttgagatagagaaagctcagatgagccaaaatgtattgactatgatagtcttagatatagaccattttaaataa

SEQ ID NO: 17416 - protein, 281 aa, Unknown
  Obtained from environmental sample
  DOMAIN (93)...(155): PAS domain
  misc_feature (1)..(281): Xaa is any amino acid
MQWDLTIAECPIKMKFLKILNDHGVTPFDLFYIFMXLKNSIATLFYENMFLSFALQKDLETISLNISKDIFVTYEQIQKNEINFSDVHSNLLNEYKKAVDISNIVSKSNTKGIITYVNDKFCEISGYTKSELIGKPHSIVRHPSMPSSIFKELWDVIKEKRAWHGVITNMKKDGRKYVVDSTVIPILDVDGDIVEYIAIRHDVTEFEQTKEQLGTLNRAMKNKVDELYSMTATLEEEASIDALTGAFNRSKFEKFFDLEIEKAQMSQNVLTMIVLDIDHFK

SEQ ID NO: 17417 - DNA, 399 bp, Unknown
  Obtained from environmental sample
  misc_feature (1)..(399): n is a, c, g, or t
atgtttaaatatctttattacttattggctttagttttatatattttagctatcccctatctacttttaaaatcaagaaatccaaaatactcaaaagcaattccagcaaagttttttttacgagataatccaaagtttccagaagataaaatatggtttcatagttgctcccatggggaaactgtggctttaaaacctatttttgaaaagtttagcanagaggatataaacttatctgttatcactaatacaggatttgaacaaggtttaaaacttgtagacaatgtacggtatttgccttttgaattgttcttgcctttttggataaaaaaacaaaaagtgttagtagtgatggaagcgaaactttggtatatgttggtttttaggtgccaaagataa

SEQ ID NO: 17418 - protein, 132 aa, Unknown
  Obtained from environmental sample
  DOMAIN (30)...(132): 3-Deoxy-D-manno-octulosonic-acid transferase (kdotransferase)
  misc_feature (1)..(132): Xaa is any amino acid
MFKYLYYLLALVLYILAIPYLLLKSRNPKYSKAIPAKFFLRDNPKFPEDKIWFHSCSHGETVALKPIFEKFSXEDINLSVITNTGFEQGLKLVDNVRYLPFELFLPFWIKKQKVLVVMEAKLWYMLVFRCQR

SEQ ID NO: 17419 - DNA, 666 bp, Unknown
  Obtained from environmental sample
  misc_feature (1)..(666): n is a, c, g, or t
ttgatacaaggagttattatgttaaaaaaagtacttataatatgcagttatttttttactgtaacctacctatatgcccaagaagagataaatgtgggtatctaccaaaatgctccaaaaatatttatggataatagtgataagccatcaggattttttgttgatatcttggatgaaatagcactaaaagagaattggaaacttaactatatcccttgtgtttggtctgagtgtttagttatgcttgaaaatggtaaaattgatattatgcctgatgtagcatatacacttgaacgaaaaaagaaatttttatttactgatgaaagcatcatctcaagttggtctgtactttttagacataaaaatgtacctatagagtctatatttgatttagaagataaaaatatagctgtattagaaaatactattcaatctactgcaataaaagaatcaatgaaaaaatttaatattcaccctcatagttatattgaggtatcagattatgaagagggttttaaacttttaactgataaaaaagttgattgtgttctagtgaatcgcttttatgaactaaatcataaatttgcagatactattattaaaacaaatattgtacttgagccttctgtgatgaaatatgcatttaatttatcacgaagtgattag

SEQ ID NO: 17420 - protein, 221 aa, Unknown
  Obtained from environmental sample
  DOMAIN (30)...(221): Bacterial extracellular solute-binding proteins, family 3
  misc_feature (1)..(221): Xaa is any amino acid
MIQGVIMLKKVLIICSYFFTVTYLYAQEEINVGIYQNAPKIFMDNSDKPSGFFVDILDEIALKENWKLNYIPCVWSECLVMLENGKIDIMPDVAYTLERKKKFLFTDESIISSWSVLFRHKNVPIESIFDLEDKNIAVLENTIQSTAIKESMKKFNIHPHSYIEVSDYEEGFKLLTDKKVDCVLVNRFYELNHKFADTIIKTNIVLEPSVMKYAFNLSRSD

SEQ ID NO: 17421 - DNA, 417 bp, Unknown
  Obtained from environmental sample
  misc_feature (1)..(417): n is a, c, g, or t
atgattatctcagcaaacttatatgtatttggtaaactatttatccctacagagatatactataaaagcaatattttaacaaaagaggagatagatatgattagagctatcccttatttttcatattcaattctttcctcagtttttggatttgatgatattgcaaaattatgctctacatataatgaaagattggatggaacaggaactccttatgagttagaagcctcaaatcttagtttaaaagagagattattagctatattagttatctaccaagcactattagaaaaaaaagtttatagagaagcatttagtcatgaagaggcgattgtgatattaaaagaggagggatcaaaaaataagattgatctttctattgtagaagacttagatatgaaatttaaaaaagaatag

SEQ ID NO: 17422 - protein, 138 aa, Unknown
  Obtained from environmental sample
  misc_feature (1)..(138): Xaa is any amino acid
MIISANLYVFGKLFIPTEIYYKSNILTKEEIDMIRAIPYFSYSILSSVFGFDDIAKLCSTYNERLDGTGTPYELEASNLSLKERLLAILVIYQALLEKKVYREAFSHEEAIVILKEEGSKNKIDLSIVEDLDMKFKKE

SEQ ID NO: 17423 - DNA, 843 bp, Unknown
  Obtained from environmental sample
  misc_feature (1)..(843): n is a, c, g, or t
ttggcaaataagtatgatataccgactgtagtgctgacaggggcactaaataaagatattagagagaccatgcagaagatggatatcatgagttatatacttaaagataaaccatcaagtatagaactggctgtaaaaacagttaagatggcactaaaaaatagtgatagagtggtgctgatcgtagatgattcaagaacaatcagagtaatgctgcgtgatatacttcaaaaaataaatcttaatgtattagaagcaaaaaatggtgaagaggctttggctatattaaaagacaaaaagcaaaatatatctctacttataacagataatgaaatgcctgttatgaacggtttagatttgactattaaaaccagagaaatatataataaggatgagcttggtatcattgtaatcagtgcggcctccgacaaggatattgttgatgattttctaacatttggggctaatgattttatcggtaaaccatttaggtcaagtgaagttatagcgagggtaaattcaaatttagagttgatttgtctctttgctcagattacagatttagcaaatagagactatatgacagaactctataacagacgctatttttatgatagcggaaatagtatttttttaaaagctaaacgtaaaaaaagctctattgcagtagttatgatcgatattgataaatttaaaagtatcaatgacacgtatggtcatgattctggtgatatagcaataaaagaagtagcggtggtattgaagagaaattacgctcttcggatcttatatcgcgttttggaggggaagagttttgtgtacttcttgaagatataccagtag

SEQ ID NO: 17424 - protein, 280 aa, Unknown
  Obtained from environmental sample
  DOMAIN (185)...(280): GGDEF domain
  misc_feature (1)..(280): Xaa is any amino acid
MANKYDIPTVVLTGALNKDIRETMQKMDIMSYILKDKPSSIELAVKTVKMALKNSDRVVLIVDDSRTIRVMLRDILQKINLNVLEAKNGEEALAILKDKKQNISLLITDNEMPVMNGLDLTIKTREIYNKDELGIIVISAASDKDIVDDFLTFGANDFIGKPFRSSEVIARVNSNLELICLFAQITDLANRDYMTELYNRRYFYDSGNSIFLKAKRKKSSIAVVMIDIDKFKSINDTYGHDSGDIAIKEVAVVLKRNYALRILYRVLEGKSFVYFLKIYQ

SEQ ID NO: 17425 - DNA, 654 bp, Unknown
  Obtained from environmental sample
  misc_feature (1)..(654): n is a, c, g, or t
gtgaaaaatcaaaacattaacttttacattgcttcaaaaaactataaaagttttgaatcttataaattgattttaggtgaaattagtgatataactattgagtattgtgattttaatgattttttacctttatttgaaaaaagtgtaaattctatatttttaatagatattactacacaatcagatattatgtttttaaaagatattattaaaaataaaacttctaagttgatttttattaccccttttgagaaaaattttttaaacttctcttctactttagatgcttgtgttgattttgtggttataaaacctttaaattttaaaaaattcttaagtattgtaaatatttgtatctattctatcaataagataaactacctaaaaaccaaagaaaaattgctctcactagccatagatagttctgtattgcgttttgctgtatttgataaaatgggagaacttatctatgctaataatgcctatcttaaagagaataatatagatactatagcaaaaaatactttttttgaagactttacaaaatgtgatattgaatttaaaactatcatccaaaatcttaaaaaacattcctcatttactatagagagagaacaaaatgagatatggtatagatcggtatttaccctatga

SEQ ID NO: 17426 - protein, 217 aa, Unknown
  Obtained from environmental sample
  misc_feature (1)..(217): Xaa is any amino acid
MKNQNINFYIASKNYKSFESYKLILGEISDITIEYCDFNDFLPLFEKSVNSIFLIDITTQSDIMFLKDIIKNKTSKLIFITPFEKNFLNFSSTLDACVDFVVIKPLNFKKFLSIVNICIYSINKINYLKTKEKLLSLAIDSSVLRFAVFDKMGELIYANNAYLKENNIDTIAKNTFFEDFTKCDIEFKTIIQNLKKHSSFTIEREQNEIWYRSVFTL

SEQ ID NO: 17427 - DNA, 945 bp, Unknown
  Obtained from environmental sample
  misc_feature (1)..(945): n is a, c, g, or t
ttggacgcgcagacagatcggctcggaaggtttacagagtatcttaatctcttaactgataataaagaagagatatcaaatctttatcaagatatccttataggtgttacagaattttttagagacacaaaagattttgaagttttaaaagagaatataaaaaagattattgagaaaaaagagcaaggggaagagatacgattttggagtattgggtgttctactggggaagaagcatactctatagcgatacttgtatcagagattttagaagacaaacttgacaaatacaaaatcaaaatttttgcaacagatattgatgaagaggcactaaaaattgcacgagctggattatattcagaaacaagtttacttggcgttgataaaaaacttattcaaagatatttctccattcaaaagaatcattatgaggtaaaaaaatctataagagagttaataatattttcaagacacaatattgtcgctgattccccttttttaagactcgacttagtgagttgtagaaatttattaatctactttgaccaagcgttacaaaataaatttttcccaatagttcattatgcacttaaagataatggaatattgtttttaggaaaatctgagtctataagtcaacatcttgatatctttcaaccacttgataaaaatacaaaaattttcaaagcacaatacacagggataaaagaaccaccaaaactttataacttctcttctagttacaaagcatatgaagaaccaaagttaaaacactataaaaatgaagaggagcttttagaggaaaaacttatagaggctatccnaagaagtatcttaaatcaatgtgctattataaatagttcaaatgatattatctatatcaaaggggatataccttatttacgacactcagatgggagacttacaaataatatttttaaagct

SEQ ID NO: 17428 - protein, 315 aa, Unknown
  Obtained from environmental sample
  DOMAIN (35)...(228): CheR methyltransferase, SAM binding domain
  misc_feature (1)..(315): Xaa is any amino acid
MDAQTDRLGRFTEYLNLLTDNKEEISNLYQDILIGVTEFFRDTKDFEVLKENIKKIIEKKEQGEEIRFWSIGCSTGEEAYSIAILVSEILEDKLDKYKIKIFATDIDEEALKIARAGLYSETSLLGVDKKLIQRYFSIQKNHYEVKKSIRELIIFSRHNIVADSPFLRLDLVSCRNLLIYFDQALQNKFFPIVHYALKDNGILFLGKSESISQHLDIFQPLDKNTKIFKAQYTGIKEPPKLYNFSSSYKAYEEPKLKHYKNEEELLEEKLIEAIXRSILNQCAIINSSNDIIYIKGDIPYLRHSDGRLTNNIFKA

SEQ ID NO: 17429 - DNA, 591 bp, Unknown
  Obtained from environmental sample
  misc_feature (1)..(591): n is a, c, g, or t
ttggaaactattgaacagatnaataagaaaagtattgaaaaattaaaacatgaaattggaaatgtacttttatttgagacaagtagagaaaaaatattaggtgaaatatgtaaaatgaaagcaggtagttttgttgctgcttcagatatcagtgatgaaaaagacactgacaactatccttgttatggtggaaatggtcttagaggctacactaaaacatttacacatgagggaacttattctttagtaggaagacaaggtgcattgtgtggaaatgtacataaagtaagtggaaagtttcatgctacagaacatgccttagttgtgacaccatgtgatgatatagataaaaattggttagattacaaactaaaagagatgaacttaaatcaatatgcaacaggtgccgcacaaccaggtctttcagtaaaaaatcttataaatatttctgtatcagtaccttcattagatgagcaaaaaaagatagttactcaaatagaggcaatagaacaacaaatagaaataaaagagaatgaaatagcaaatatacctaaacaaaaagaggatatattaaataaatatttgaaataa

SEQ ID NO: 17430 - protein, 196 aa, Unknown
  Obtained from environmental sample
  DOMAIN (28)...(171): Type I restriction modification DNA specificity domain
  misc_feature (1)..(196): Xaa is any amino acid
METIEQXNKKSIEKLKHEIGNVLLFETSREKILGEICKMKAGSFVAASDISDEKDTDNYPCYGGNGLRGYTKTFTHEGTYSLVGRQGALCGNVHKVSGKFHATEHALVVTPCDDIDKNWLDYKLKEMNLNQYATGAAQPGLSVKNLINISVSVPSLDEQKKIVTQIEAIEQQIEIKENEIANIPKQKEDILNKYLK

SEQ ID NO: 17431 - DNA, 549 bp, Unknown
  Obtained from environmental sample
  misc_feature (1)..(549): n is a, c, g, or t
ttgataaacaataattattttaaaggcgttggtttaaaacatctgcaaaaaaaagatttcagaaatataaaaataccattaccacctaaatatattcaagaacaaattataaaagatattgaagtattggaaactattgaacagaataataagaaaagtattgaaaaattaaaacatgaaattggaaatgtacttttatttgagacaagtagagaaaaaatattaggtgaaatatgtaaaatgaaagcaggtagttttgttgctgcttcagatatcagtgatgaaaaagacactgacaactatccttgttatggtggaaatggtcttagaggctacactaaaacatttacacatgagggaacttattctttagtaggaagacaaggtgcattgtgtggaaatgtacataaagtaagtggaaagtttcatgctacagaccatgccttagttgtgacaccatgggatgatatagataaaaattggttagattacaaactaaaagagatggactttaatccatatgcaacagggtgccgcacacccaggtct

SEQ ID NO: 17432 - protein, 183 aa, Unknown
  Obtained from environmental sample
  misc_feature (1)..(183): Xaa is any amino acid
MINNNYFKGVGLKHLQKKDFRNIKIPLPPKYIQEQIIKDIEVLETIEQNNKKSIEKLKHEIGNVLLFETSREKILGEICKMKAGSFVAASDISDEKDTDNYPCYGGNGLRGYTKTFTHEGTYSLVGRQGALCGNVHKVSGKFHATDHALVVTPWDDIDKNWLDYKLKEMDFNPYATGCRTPRS

SEQ ID NO: 17433 - DNA, 405 bp, Unknown
  Obtained from environmental sample
  misc_feature (1)..(405): n is a, c, g, or t
ttgttgccaatgagtgcaattggattaatggacaaagaattgaaatatcagggggagtattgttataacatgaaaaaagaattaaaacaattaatcactttagttcaaacgcaagaaataaaagatggtgtaaatgatacaaatatcccatctttgaaaatttttaaatcatcacatctaactcaacattgtttaccaacagtgtatgaaccatcattgatttttattctacaaggttcaaagcttgtaatagtaggtaataaaacaattgagtatgactcctcatcatatttaatttcatcttcttttatgcctgtatcagggaaaataactcaagctaatgaagaagaaccctatatagcattaaaaataatattcacattagaacaaatattgaagctatga

SEQ ID NO: 17434 - protein, 134 aa, Unknown
  Obtained from environmental sample
  DOMAIN (47)...(134): AraC-type transcriptional regulator N-terminus
  misc_feature (1)..(134): Xaa is any amino acid
MLPMSAIGLMDKELKYQGEYCYNMKKELKQLITLVQTQEIKDGVNDTNIPSLKIFKSSHLTQHCLPTVYEPSLIFILQGSKLVIVGNKTIEYDSSSYLISSSFMPVSGKITQANEEEPYIALKIIFTLEQILKL

SEQ ID NO: 17435 - DNA, 891 bp, Unknown
  Obtained from environmental sample
  misc_feature (1)..(891): n is a, c, g, or t
atgggagcatactggcgaggaacatacaataatttcattgatgtcacnccaagcgaaaaacaagctcctttgatgggtagctggaatgaaaaataccatggtgctatgttagaaaaaggagaaaacagaaatgtgtcatgggtttggaaaagcgggcaaaatcctacaagtgtctgcgtgcctagtttagacggcagtgatatggctgaatgggaaaagaaccttatgcctgttgtaaaaagcctaggtaagaaaaatttcaatacaacaggagacttcaactacaaaacattcaaaggtggtttttatactattggtcacagcatagctcgcaccgaagaacaaccttgcgagggggcaagcgatgagaatctggcaaacattttttcagcatgtattgccctacctgatgataaatcggtactatatatccacagagcagaaatgataggtagattttatgttacagaactcaaagatttctgcttgaaaatccctaacgatatctttaatgataataaaagaacatatactgcaaataataatcaaaaatttactcttgatggatacggatctaaaaaagagttaataaatacaaattctaattggcttaatattgacaacaaaattggcgtattttctctaactaaagataaagatttgtttattaacagacctggagaaagaaaagcatcaattaaatatatgttttctctaaagggaaatctctttgctgatgaaattgtctctcaaatttctgaaaaaactcaaatttttccaaaagataaagaaatattaacatctgcaatacttattcgaatagaaaatgcagaagaatctagaaaatctgcagatacggtaaacataatatatttgaaagagcgacgataa

SEQ ID NO: 17436 - protein, 296 aa, Unknown
  Obtained from environmental sample
  misc_feature (1)..(296): Xaa is any amino acid
MGAYWRGTYNNFIDVTPSEKQAPLMGSWNEKYHGAMLEKGENRNVSWVWKSGQNPTSVCVPSLDGSDMAEWEKNLMPVVKSLGKKNFNTTGDFNYKTFKGGFYTIGHSIARTEEQPCEGASDENLANIFSACIALPDDKSVLYIHRAEMIGRFYVTELKDFCLKIPNDIFNDNKRTYTANNNQKFTLDGYGSKKELINTNSNWLNIDNKIGVFSLTKDKDLFINRPGERKASIKYMFSLKGNLFADEIVSQISEKTQIFPKDKEILTSAILIRIENAEESRKSADTVNIIYLKERR

SEQ ID NO: 17437 - DNA, 957 bp, Unknown
  Obtained from environmental sample
  misc_feature (1)..(957): n is a, c, g, or t
atgatcgctcagtatgagttcttttttccaattgataatgtacgagaagagaaagctgtagcttatttggtatcttatgataaagatccatatatttatgatatatatagaagttattctattataaatatagtattatttgtaggtttggcaacactattttactttatctatagaaatttaaattataaaaaagagctagaggaagaggtctctataaaaacgaaagatctacaaaaagttagtaaaaacctaaaagatttaaatgaaaatttagaacaaaaaatagtttttgaagttgaaaaaagtaaagctatggagagcaaactattccagtctgaaaaaatggcctctatgggagaaatgataggaaatatagcacatcaatggagacaaccactttctgtaatatctacaggtgtaacaggtatgaagatgcaaaaagagtatgatttattaactgatgatatttttaatgatacttgtgatgtgattaataaaaatgcacagtatctctctacaacaatagatgattttagaaactatattaaaggggatagagagaaaaaagtttttaatctcaaaaaagatattaatagttttatccatcttgtagagggttcaattcataaatataatataaatatagttttggatttagatgaatctatagagattaatggatatgaaaatgaacttacccagtgttttatcaatattttcaataatgctaaagatgttttagtagagatagaaaatagttctgaacgatatttgtttatatctacaaatatagaaaatgatagagtgctaataaaaattaaagataatggtggtgggatacaagaagatataatgccaaaaatatttgaacccatattcaccactaaacatcaatctcaaggtacaggacttggtcttcatatgacttatagtcctatagttgaggggatgaag

SEQ ID NO: 17438 - protein, 319 aa, Unknown
  Obtained from environmental sample
  DOMAIN (118)...(188): His Kinase A (phosphoacceptor) domain
  misc_feature (1)..(319): Xaa is any amino acid
MIAQYEFFFPIDNVREEKAVAYLVSYDKDPYIYDIYRSYSIINIVLFVGLATLFYFIYRNLNYKKELEEEVSIKTKDLQKVSKNLKDLNENLEQKIVFEVEKSKAMESKLFQSEKMASMGEMIGNIAHQWRQPLSVISTGVTGMKMQKEYDLLTDDIFNDTCDVINKNAQYLSTTIDDFRNYIKGDREKKVFNLKKDINSFIHLVEGSIHKYNINIVLDLDESIEINGYENELTQCFINIFNNAKDVLVEIENSSERYLFISTNIENDRVLIKIKDNGGGIQEDIMPKIFEPIFTTKHQSQGTGLGLHMTYSPIVEGMK

SEQ ID NO: 17439 - DNA, 489 bp, Unknown
  Obtained from environmental sample
  misc_feature (1)..(489): n is a, c, g, or t
atgacaaatgaaacgtatcatcgcaaaggattgattctggacctgagatataataccggtggcaatgtccatgatgcggttctgaattttctaagtcagcgtccctactcatattggaagtaccggagtggtgcatatgccaatcaaccgcattttgcccccgcggtaaaaccgatcattatcctgattaatgaacagaccttaagcgacggagaaatggtgactgccggttttaaagcattgaaactggggaaggtgatcggaaccgagacttatcggtggatcatttttacatccgggaaaggtctggttgatgggtcattttacagactgccatcctggggttgttataccctggataaaaaagatcttgaagtccatggtgttgcgccggacatctatattaaaaataccttaaaagacagacttacaggcagggacccgcagttgaatgctgcgataaaagagatccttaaaaaaattaaatag

SEQ ID NO: 17440 - protein, 162 aa, Unknown
  Obtained from environmental sample
  DOMAIN (2)...(135): Peptidase family S41
  misc_feature (1)..(162): Xaa is any amino acid
MTNETYHRKGLILDLRYNTGGNVHDAVLNFLSQRPYSYWKYRSGAYANQPHFAPAVKPIIILINEQTLSDGEMVTAGFKALKLGKVIGTETYRWIIFTSGKGLVDGSFYRLPSWGCYTLDKKDLEVHGVAPDIYIKNTLKDRLTGRDPQLNAAIKEILKKIK

SEQ ID NO: 17441 - DNA, 714 bp, Unknown
  Obtained from environmental sample
  misc_feature (1)..(714): n is a, c, g, or t
atggtgattctgcctacaagttctggcgatgtgactattccacaaattaacatagattggttagatacaaacacatcaaccataaaaacagcatcactacctgcaaaaacaatcacgataatgccacctctaactaaagaaaaaccaatttcagagcctgcgattgacgatagtttattaagcattgtaaaactttggttttttgaaaatacagaatttatcatcaccccaataaaggacatgtatcttgatttagagcaagaatatggctggcatttctatttagcactagctttaatttgtttgattattttaaaaagaatagatgttctaattgtccctaaaagagaaagtttttctgacaaggaaaaagataatttagctcttttagaaaaagaatttttaaaagcatgtaaatcgtcagattataaattagcaagagatgcattcttgctatgggggcaagcaacattcaaaaaagataagccttcaaacatagcaatggttgcaaacctcctagattcagttgttatgtatgaaatgacagaagaactaaacgcattcctatatggtaacgcaacaggctcatggaacggcaaacccatgcgcaaggccttcataaaaactatgaaagccaaaaaacaaagccaaaaagttggnaagaaagaagaagaagaccaagacgacgagttgccagctttgtatccgagttag

SEQ ID NO: 17442 - protein, 237 aa, Unknown
  Obtained from environmental sample
  misc_feature (1)..(237): Xaa is any amino acid
MVILPTSSGDVTIPQINIDWLDTNTSTIKTASLPAKTITIMPPLTKEKPISEPAIDDSLLSIVKLWFFENTEFIITPIKDMYLDLEQEYGWHFYLALALICLIILKRIDVLIVPKRESFSDKEKDNLALLEKEFLKACKSSDYKLARDAFLLWGQATFKKDKPSNIAMVANLLDSVVMYEMTEELNAFLYGNATGSWNGKPMRKAFIKTMKAKKQSQKVGKKEEEDQDDELPALYPS

SEQ ID NO: 17443 - DNA, 564 bp, Unknown
  Obtained from environmental sample
  misc_feature (1)..(564): n is a, c, g, or t
gtgtcaaaatctgtacttcttaaaattgcacgagaatccatagaagaggttattcttgctaaaaatagtatagataagagagcactgttagaaacttatcctgtgctgggtgaaaaagttgctacatttgtcaccataaatctaaataataaactaagaggatgtatcggctcacttatagctcaaaaacctctgctagaagatattatctacaatgcaaaagctgcagcatttcatgatcctcgtttttcgccgataacaacttcagactacattcactcttcgatcgaaatttccattttaacagaacctaaagaggttaaatatagttcaatagatgagttaaagtctataattaacgtaggagaagatggtgttatcttgatatatgaagataaacaagcaacattcttaccgcaagtttgngatgagctaccaacatttgaagagtttttttcacatctgcttcaaaaagcaagtttgagcgaaaacactttagctctaagtccagtcatatacacttaccaagtagcaaaagagagggatgaacctattgttaaatga

SEQ ID NO: 17444 - protein, 187 aa, Unknown
  Obtained from environmental sample
  DOMAIN (1)...(182): AMMECR1
  misc_feature (1)..(187): Xaa is any amino acid
MSKSVLLKIARESIEEVILAKNSIDKRALLETYPVLGEKVATFVTINLNNKLRGCIGSLIAQKPLLEDIIYNAKAAAFHDPRFSPITTSDYIHSSIEISILTEPKEVKYSSIDELKSIINVGEDGVILIYEDKQATFLPQVXDELPTFEEFFSHLLQKASLSENTLALSPVIYTYQVAKERDEPIVK

SEQ ID NO: 17445 - DNA, 507 bp, Unknown; identical to SEQ ID NO: 8361
  Obtained from environmental sample
  misc_feature (1)..(507): n is a, c, g, or t

SEQ ID NO: 17446 - protein, 168 aa, Unknown; identical to SEQ ID NO: 8362
  Obtained from environmental sample
  misc_feature (1)..(168): Xaa is any amino acid

SEQ ID NO: 17447 - DNA, 783 bp, Unknown
  Obtained from environmental sample
  misc_feature (1)..(783): n is a, c, g, or t
ttgaagtatcgcctctatccatcagaggcaaacaaaatactgattcttatacatggttcagcttggcatagtagttatttactacctctttcgaaatatattagttctgaaaatcttgcaaaagtatatacacctgatttaagaggtcatgggataaatccaattaatagaggcgatataaattatataaatcaattagaagatgatttagctgatttcatttctatggttaaaaaagaaaatccatcagcaactgttattctaggaggacattcttctggaggtggtttagttatacgttttgcaggaagcaaatataaaaaaatggcagatgcatacatgcttcttactccatatttgaaatataatgccccgacaattaatacaaattcagggaactgggctttcccgcatacacctagaataatcggattaactatgctaaataacctaggtattacttggttaaattatttatccgtaatcgattttaatatgccaaaagaatttcgagatggtagtgaaactttaagctattcctttaggcttaatacagggtttgcccccaaagattataaaaaagatttaagtaaaatagagcaaaaaactttggttttagtaggaacatctgatgaatctaatatagctaaagaatttttacctgaaatttcaaaatataaaaaagatgccagcatagtgcttgttgaaaaagtaacacacatgggaattgtcgtaggaaatgaagtacgtccaattataaaagattggatatctaagccttga

SEQ ID NO: 17448 - protein, 260 aa, Unknown
  Obtained from environmental sample
  misc_feature (1)..(260): Xaa is any amino acid
MKYRLYPSEANKILILIHGSAWHSSYLLPLSKYISSENLAKVYTPDLRGHGINPINRGDINYINQLEDDLADFISMVKKENPSATVILGGHSSGGGLVIRFAGSKYKKMADAYMLLTPYLKYNAPTINTNSGNWAFPHTPRIIGLTMLNNLGITWLNYLSVIDFNMPKEFRDGSETLSYSFRLNTGFAPKDYKKDLSKIEQKTLVLVGTSDESNIAKEFLPEISKYKKDASIVLVEKVTHMGIVVGNEVRPIIKDWISKP

SEQ ID NO: 17449 - DNA, 468 bp, Unknown
  Obtained from environmental sample
  misc_feature (1)..(468): n is a, c, g, or t
atgggggtagttgaatttatgaatttaaaagatagcagtatagaagatgatccagatttaaaaaatagattaagtaaaatccaatatgatgtaacacaaaatgcagctacagaagctccctttagtaatgaatatcataatagtgatgaaaaaggattatatgtagatatagtttcaggcgagccattatttttatctagtgataaatttgatagtggttgtggatggccaagctttagtaaaccaatatctgaggaaaatattaaatataatgacgatataacttatggtatgaacagagtagaagtgaaatctgaaatagctgattctcatctaggtcatttatttgaagatggtccaaaagaattaggtggactcagatattgtattaatggcgcttcgcttaaatttataccttttgacaatctaaaagatgcggggtatgaagaatatattaaattattttaa

SEQ ID NO: 17450 - protein, 155 aa, Unknown
  Obtained from environmental sample
  DOMAIN (17)...(140): SelR domain
  misc_feature (1)..(155): Xaa is any amino acid
MGVVEFMNLKDSSIEDDPDLKNRLSKIQYDVTQNAATEAPFSNEYHNSDEKGLYVDIVSGEPLFLSSDKFDSGCGWPSFSKPISEENIKYNDDITYGMNRVEVKSEIADSHLGHLFEDGPKELGGLRYCINGASLKFIPFDNLKDAGYEEYIKLF

SEQ ID NO: 17451 - DNA, 840 bp, Unknown
  Obtained from environmental sample
  misc_feature (1)..(840): n is a, c, g, or t
ttggatatcaatttagagttagcaaaaaattttgatacaagttttatatctgttttaaatggtaaagataaaacttatacacaattactggaagatatagcaatagaggaatcaaatataaaacatagtgggtcattacattttgctactttttataatagggtaaacaaagaatatatagaagatatagaaagtagtaaaaatgactatttattgtactgtatagaggagatacaagaattatcagctttaactatttgggatatacaaaatagacttaatgctcaagttgtttttgaggtgccagaatatttgcacagaaatatagataatataaaagtagcagctatgagttttgacaattatattaaatatattcaaccaaatgatcttatcatagttcctgcagatagaagtgatatagttgtgggctcaattgctgctgttcattctaaaacaatacctagtattagttgtatacttttaactggtgatatgaaactcaaaaagccaatcaaagaacttttaaaaggatttaatgagcatatcccaatattaaaagtggaagagaatacttttaatattgcaaaaaaagtatcagatattaaagctataataaaagcagataataaaagaaaaacatctttaattgaagggctttttaactcttctgtagatatagatgaaattgaaaaacatctattagtagatacaaatcatataatgacacctttgatgtttgaatactctcttttaaaaagagcaagggaaaataaacaaacaattgtattgccagaagcaaaagatgaaagaatactcaaagctacccaaaacttctaa

SEQ ID NO: 17452 - protein, 279 aa, Unknown
  Obtained from environmental sample
  DOMAIN (88)...(202): DRTGG domain
  misc_feature (1)..(279): Xaa is any amino acid
MDINLELAKNFDTSFISVLNGKDKTYTQLLEDIAIEESNIKHSGSLHFATFYNRVNKEYIEDIESSKNDYLLYCIEEIQELSALTIWDIQNRLNAQVVFEVPEYLHRNIDNIKVAAMSFDNYIKYIQPNDLIIVPADRSDIVVGSIAAVHSKTIPSISCILLTGDMKLKKPIKELLKGFNEHIPILKVEENTFNIAKKVSDIKAIIKADNKRKTSLIEGLFNSSVDIDEIEKHLLVDTNHIMTPLMFEYSLLKRARENKQTIVLPEAKDERILKATQNF

SEQ ID NO: 17453 - DNA, 732 bp, Unknown
  Obtained from environmental sample
  misc_feature (1)..(732): n is a, c, g, or t
atgaaattaaaatcactttacatatcacctcaagagatagaatcaggggccgttgttatatcttttggtttaatggcacttttaaagcgaaaatatgagaaagtagcgttttttagaccaatagtatcacaagttccaaacaacgatatagacctaatagtaaataattttaaactagaaattgataaaaaagattgctttggggttgatataaaaagagcgaaagagcttatatcagcaaataaagtagataaactttatgagatacttatagaaaaatatgaaaagcttaaagcaaattatgattttgtattgatacaaggggtgagtacagatagtttatctgttatttcagattttgatatcaatttagagttagcaaaaaattttgatacaagttttatatctgttttaaatggtaaagataaaacttatacacaattactggaagatatagcaatagaggaatcaaatataaaacatagtgggtcattacattttgctacttttattaatagggtaaacaaagaatatatagaagatatagaaagtagtaaaaatgactatttattgtactgtatagaggagatacaagaattatcagctttaactatttgggatatacaaaatagacttaatgctcaagttgtttttgaggtgccagaatatttgcacagaaatatagataatataaaagtagcagctatgagttttgaccattatattaaatat

SEQ ID NO: 17454 - protein, 244 aa, Unknown
  Obtained from environmental sample
  misc_feature (1)..(244): Xaa is any amino acid
MKLKSLYISPQEIESGAVVISFGLMALLKRKYEKVAFFRPIVSQVPNNDIDLIVNNFKLEIDKKDCFGVDIKRAKELISANKVDKLYEILIEKYEKLKANYDFVLIQGVSTDSLSVISDFDINLELAKNFDTSFISVLNGKDKTYTQLLEDIAIEESNIKHSGSLHFATFINRVNKEYIEDIESSKNDYLLYCIEEIQELSALTIWDIQNRLNAQVVFEVPEYLHRNIDNIKVAAMSFDHYIKY

SEQ ID NO: 17455 - DNA, 363 bp, Unknown
  Obtained from environmental sample
  misc_feature (1)..(363): n is a, c, g, or t
atgcaaaaacaaaatataatatcatcatacaaagtaagaataatcttattattttcatttatattatttgttgtaatattattaggagctttgcgtgcttataatttagtaaaacaaaatgcaacagaaaaaatattttctgagatgcagaaagatttatacgataatacatttgaattgaaaaatattatcgaaagtaatgcggagttgactganaatatgtcgacaattattggaggttattcagatatattaaaagataatagacgaacattttaccaaaataatttattgaaattaatcgaggacaattatcatnattattcaattttgacagtttttaaaccttataccaatgaatga

SEQ ID NO: 17456 - protein, 120 aa, Unknown
  Obtained from environmental sample
  misc_feature (1)..(120): Xaa is any amino acid
MQKQNIISSYKVRIILLFSFILFVVILLGALRAYNLVKQNATEKIFSEMQKDLYDNTFELKNIIESNAELTXNMSTIIGGYSDILKDNRRTFYQNNLLKLIEDNYHXYSILTVFKPYTNE

SEQ ID NO: 17457 - DNA, 867 bp, Unknown
  Obtained from environmental sample
  misc_feature (1)..(867): n is a, c, g, or t
atgattcctcaggactttaattctattattgttaaagatggtgatacgcttgatcttgaaaacaaaactctacaatttattgctgctccaaatttgcattggcccgatagtatttacacatacattgttgaagataaaatacttttcacttgtgattcttttggtgctcatttttgtacagaagaaatgtttgatgatttgactgaagattatcaggactcatttaagtattattttgatgtaatattgaaaccttttagtaagttcatgcttaaggctatagagaaaatcgaaaacttagatattgatattattgctcctgggcatggtccgattctaagaagtacttggcaagagaaagttttacaatccaaaacatggtctgaagagtttttagcagcaaatacacatgatgaaaaatctgtgttgattacttatgtgtcggcatatggttatactcgagagatggccgaacatattgctgaaggaattaaaagtgtaggtattagtaaaattacattgctcgatattgagactatagatttaggtgaacttgatgctaatattgttgcaaacgatgctttattggtagcttgtccaacaattaatcagaatattttgatgcctgtttataaaatgtttgcggtaattaatccaattcgagaccgtggtaaatttgccgctgcttttggatcttttggatggagtggggaaggaccaaaaattatagaggctgtacttaaatccttaaaacttaatgtggttcaggattctttaggaatgaaatttcgtcctacaaataagaatgttgaagaattaaattcttttgggaaagcgtttgccgaaaaattgcaaaataaaaaatag

SEQ ID NO: 17458 - protein, 288 aa, Unknown
  Obtained from environmental sample
  DOMAIN (144)...(277): Flavodoxin
  misc_feature (1)..(288): Xaa is any amino acid
MIPQDFNSIIVKDGDTLDLENKTLQFIAAPNLHWPDSIYTYIVEDKILFTCDSFGAHFCTEEMFDDLTEDYQDSFKYYFDVILKPFSKFMLKAIEKIENLDIDIIAPGHGPILRSTWQEKVLQSKTWSEEFLAANTHDEKSVLITYVSAYGYTREMAEHIAEGIKSVGISKITLLDIETIDLGELDANIVANDALLVACPTINQNILMPVYKMFAVINPIRDRGKFAAAFGSFGWSGEGPKIIEAVLKSLKLNVVQDSLGMKFRPTNKNVEELNSFGKAFAEKLQNKK

SEQ ID NO: 17459 - DNA, 687 bp, Unknown
  Obtained from environmental sample
  misc_feature (1)..(687): n is a, c, g, or t
atgataataatagatcattatagtataggctttgattttgaaaaacaactctcaaccctcaattctcaaccttcaattatggtactagatgatacatatgaaaaacactattgtgatatattgttaaaccataatataagtgcagataaaaagagatataaaaatttagtaccaaaaaactgtgaactacgatgtggaagtaaatatacacttctaagggaagaattctataaagaaaaaaaaaaaatcaaaagaaaaaagcaattctcaaatccaaattctcaaatctcaatttttatagctatgggtggtgcagatacagcaaaactaaatattcctatcttaaaaattttaaaaaaacttgacaatataaaggtaactttagtaaccacatcatcaaacaataatttaaatatcctacaaaactattgtaaaaataaaaaatggatcaatttacatatagattcaaacaaaattgcaaaacttatgagaaaaagtgattttggaataattacacctagtgttactgcaaacgaactttattttatgaacattccatttgttgctattaaaacagcagataatcaaaaagatatggttaaatttttaaaaaataaaaaatatcttactatgggtaagtttaataaaggtaaattaacacaatctttaacaaagttaataaaatga

SEQ ID NO: 17460 - protein, 228 aa, Unknown
  Obtained from environmental sample
  misc_feature (1)..(228): Xaa is any amino acid
MIIIDHYSIGFDFEKQLSTLNSQPSIMVLDDTYEKHYCDILLNHNISADKKRYKNLVPKNCELRCGSKYTLLREEFYKEKKKIKRKKQFSNPNSQISIFIAMGGADTAKLNIPILKILKKLDNIKVTLVTTSSNNNLNILQNYCKNKKWINLHIDSNKIAKLMRKSDFGIITPSVTANELYFMNIPFVAIKTADNQKDMVKFLKNKKYLTMGKFNKGKLTQSLTKLIK

SEQ ID NO: 17461 - DNA, 903 bp, Unknown
  Obtained from environmental sample
  misc_feature (1)..(903): n is a, c, g, or t
atgattcaatttgaaaaatttaccctcactaatggtttaaaagttattgttcataaggatatttccacacctattgttgcttttaatgtgttatataatgtgggtgcaagagatgaagatgaaaaacacactggttttgctcacttatttgaacacttaatgtttggcggttctgtaaacattccaaactttgatgaaccactccaaaaagtaggaggagaaaataatgcttttacttctaatgatattaccaattattacattacgcttcctaaagaaaatttagaaaccgctttttggttagaatcagaccgaatgcttagtctagcttttactgataaaagccttgaagttcaacgtcaggtagtaattgaagagtttaaacaaaattatttaaaccaaccttatggcgatgtttggcttttacttaggcctttagcctatgaagttcacccttacaaatgggccactattggaaaagaaattagccacattgaaaatgctactatgcaggatgtaaaagacttttttaatacttattatactccaaataatgctattctatctgttgccggaaatattgaattagatgaaataaaacaacttaccgaaaagtggtttggaggcatctcatcaggaaataacaacaagagaaatttaccaaaagaacctttgcaaaaagaagcaagaagattagaagtaaaaagaaaagtgcctgcaaatgctatttataaagcttacaaaatgtgtagcaaaacacatcctgatttttatgctaccgacttactttacgatattctatctttaggaaactcatctaaactttatatttctctcaataaagaaacaaaaacttttttaaccaatattaaatgcgtatgtttttgggaaatttttgaatga

SEQ ID NO: 17462 - protein, 300 aa, Unknown
  Obtained from environmental sample
  DOMAIN (167)...(299): Peptidase M16 inactive domain
  misc_feature (1)..(300): Xaa is any amino acid
MIQFEKFTLTNGLKVIVHKDISTPIVAFNVLYNVGARDEDEKHTGFAHLFEHLMFGGSVNIPNFDEPLQKVGGENNAFTSNDITNYYITLPKENLETAFWLESDRMLSLAFTDKSLEVQRQVVIEEFKQNYLNQPYGDVWLLLRPLAYEVHPYKWATIGKEISHIENATMQDVKDFFNTYYTPNNAILSVAGNIELDEIKQLTEKWFGGISSGNNNKRNLPKEPLQKEARRLEVKRKVPANAIYKAYKMCSKTHPDFYATDLLYDILSLGNSSKLYISLNKETKTFLTNIKCVCFWEIFE

SEQ ID NO: 17463 - DNA, 786 bp, Unknown
  Obtained from environmental sample
  misc_feature (1)..(786): n is a, c, g, or t
atgaaaatcggaatagtttgttacccaacctttgggggaagtggtgttgtagccacagagctagggaaagcacttgctgcaaaaggaaataaagttcattttatatcttatcaacaaccatttaaattagatcttttctccgaaaatattttttatcacgaagtaaaagttaccaactaccctttatttgactatcaaccatacgaactagtattaacaagcaaattagtagatgttataaaatttgaaaaattagatatacttcatgttcactatgctattccacatgcttctgcagcttatatggctcaacatattttaaaatctgaaggcataaacataccttttattaccaccttgcacggcacagacattacccttgtgggaaaagataaatcatttgctcctgtaattacctttgctattaatgagtctaatatcgttacagcagtttctgaaagtttaaaacaagatactttagctcattttaatgttaaaagagaaattaaagttattcccaacttcatttgtttttcagattatgaaaacttaggagatacttctaatataagaaaaagttttgctcctaataatgagaaaattttaattcacgtttctaacttccgaaaagtaaaaagagttcaggatgtttttaaggtttttattaaagtaaatgaaaaaatacctgccaaattattattagttggtgatggaccagaaaggtatcaattagaagagttttgccgtgaacaagggggtttgcgacaaagttcattttttaggtaa

SEQ ID NO: 17464 - protein, 261 aa, Unknown
  Obtained from environmental sample
  misc_feature (1)..(261): Xaa is any amino acid
MKIGIVCYPTFGGSGVVATELGKALAAKGNKVHFISYQQPFKLDLFSENIFYHEVKVTNYPLFDYQPYELVLTSKLVDVIKFEKLDILHVHYAIPHASAAYMAQHILKSEGINIPFITTLHGTDITLVGKDKSFAPVITFAINESNIVTAVSESLKQDTLAHFNVKREIKVIPNFICFSDYENLGDTSNIRKSFAPNNEKILIHVSNFRKVKRVQDVFKVFIKVNEKIPAKLLLVGDGPERYQLEEFCREQGGLRQSSFFR

SEQ ID NO: 17465 - DNA, 498 bp, Unknown
  Obtained from environmental sample
  misc_feature (1)..(498): n is a, c, g, or t
atggaagaagattttatagagaatattacattattaattgaatataaattaatagaagcagatatcaaagtagataaatatattccagaaatagagagtattactatcacaccatatggggaatattttattagttcattaatacactttttttcatatttagatttaatctgttcagattgtgaagtttatgatgaacaaacagcaaatagtattactaaatctgcagaagaagaatataaattgttttcaaagcaaaaaaaaggttatagactaattcatagaatatctaaaactgatgcttttctaaaatatctggttatgcaagaaaaagaagagaaagaagcatataatttagatgaaaagcatttagttgtaaatgatattattttaaaatatcaagaggatattaaaaaagtaagacatagtgcatcaaaacaagcatttattggaaatgatgagttaagtagtttagataatttctttgataaagtatag

SEQ ID NO: 17466 - protein, 165 aa, Unknown
  Obtained from environmental sample
  misc_feature (1)..(165): Xaa is any amino acid
MEEDFIENITLLIEYKLIEADIKVDKYIPEIESITITPYGEYFISSLIHFFSYLDLICSDCEVYDEQTANSITKSAEEEYKLFSKQKKGYRLIHRISKTDAFLKYLVMQEKEEKEAYNLDEKHLVVNDIILKYQEDIKKVRHSASKQAFIGNDELSSLDNFFDKV

SEQ ID NO: 17467 - DNA, 525 bp, Unknown
  Obtained from environmental sample
  misc_feature (1)..(525): n is a, c, g, or t
atgttaaatatgatggcagaattattaggaaatagtaaaaaaactatttatagatggaaagatgagaatagacctataatatcattattagaaaaatattttactaaagaaaatgtgaaagagtttttaggaacacaccagatagagaaattagaattaataaaaaattacacattagaagaattaaaactaaaattaaatagtaaatctactgattcagttaaagaaattgaagattatttaattgtaaatataagatataaaattgaaaaccatataaagaaatcaattttaaaaaatattcttaaaaaagttctaagtgaaaataatttaatagacacagcaaatgatatcaatgcaaaagcacaactaataaaagctatacaaaactataaaatatcaattacaaaattagagtttaaagactggaaaactgacactatacaatttattactgattatcttattagtgatgaagtatttttgattattaaatatcctgataaatttttagaagacaaataa

SEQ ID NO: 17468 - protein, 174 aa, Unknown
  Obtained from environmental sample
  misc_feature (1)..(174): Xaa is any amino acid
MLNMMAELLGNSKKTIYRWKDENRPIISLLEKYFTKENVKEFLGTHQIEKLELIKNYTLEELKLKLNSKSTDSVKEIEDYLIVNIRYKIENHIKKSILKNILKKVLSENNLIDTANDINAKAQLIKAIQNYKISITKLEFKDWKTDTIQFITDYLISDEVFLIIKYPDKFLEDK

SEQ ID NO: 17469 - DNA, 756 bp, Unknown
  Obtained from environmental sample
  misc_feature (1)..(756): n is a, c, g, or t
gtgcttgaattgtttcatggaccaacattagcctttaaagattttggcgctaggtttatggctcgtacaatgagtcactttctgcaagattcagatgaagttgtaaatattctggtagctacatcgggtgatacgggaagtgctgttgcatctggattttatggcgttgaaggagtgaatgtttatctcctttatccaagcggaaaagtgagtgacattcaggagatgcagcttactacatttgataagaacatcattgcgcttgaaattgatgggacttttgatgattgccaagcacttgtaaaatctgcttttgttgatgatgatataaattctaaaattaaattgtcttcagccaattcaattaatattgctcgtcttattccacaatcattttacttttttaatgcatacaaggaattgaaagataaatccaaagatgtttacatctccgttccatctggtaatcttggtaacttaactgctggtttattggcaaagaaaatgggtttaccaatcaagaaattcattggagctacaaattcaaattctgtttttactgagtttattgcttctggaaaatatgaaccacgttcatctgttaaaactctttctaatgctatggacgttggtgcaccgagtaatcttaatagaattcaaacactatacgatgaccattcaattgtcttaaaagacattacatcaaatactcataacgataatccgacggtcgagaaaataaaagagaacctttga

SEQ ID NO: 17470 - protein, 251 aa, Unknown
  Obtained from environmental sample
  DOMAIN (2)...(241): Pyridoxal-phosphate dependent enzyme
  misc_feature (1)..(251): Xaa is any amino acid
MLELFHGPTLAFKDFGARFMARTMSHFLQDSDEVVNILVATSGDTGSAVASGFYGVEGVNVYLLYPSGKVSDIQEMQLTTFDKNIIALEIDGTFDDCQALVKSAFVDDDINSKIKLSSANSINIARLIPQSFYFFNAYKELKDKSKDVYISVPSGNLGNLTAGLLAKKMGLPIKKFIGATNSNSVFTEFIASGKYEPRSSVKTLSNAMDVGAPSNLNRIQTLYDDHSIVLKDITSNTHNDNPTVEKIKENL

SEQ ID NO: 17471 - DNA, 588 bp, Unknown
  Obtained from environmental sample
  misc_feature (1)..(588): n is a, c, g, or t
atgtttaccatcctccgttccattttggtaaatctgggtaacttaacctgctggtttattgggcaaagaaaaaggggtttaccaatcaagaaattcattggagctacaaattcaaattctgtttttactgagtttattgcttctggaaaatatgaaccacgttcatctgttaaaactctttctaatgctatggacgttggtgcaccgagtaatcttaatagaattcaaacactatacgatgaccattcaattgtcttaaaagacattacatcaaatactcataacgataatcagacggtcgagaaaataaaagagacctttgaaaaatataattatattattgacccacatggagcagttggcttgcttgcattagagcaatttattgctgaagaaaaaatcaaaaaatattctggagttattcttgaaactgctcacccagcaaagtttaaggatactgttgatgttgctttagatagtaatatcaaaattccagaatcactacaaaagtctatttcaaaaaagaaagagagtacaatgctttctaaagaatattctgaatttaagaaatatttattaagtagataa

SEQ ID NO: 17472 - protein, 195 aa, Unknown
  Obtained from environmental sample
  misc_feature (1)..(195): Xaa is any amino acid
MFTILRSILVNLGNLTCWFIGQRKRGLPIKKFIGATNSNSVFTEFIASGKYEPRSSVKTLSNAMDVGAPSNLNRIQTLYDDHSIVLKDITSNTHNDNQTVEKIKETFEKYNYIIDPHGAVGLLALEQFIAEEKIKKYSGVILETAHPAKFKDTVDVALDSNIKIPESLQKSISKKKESTMLSKEYSEFKKYLLSR

SEQ ID NO: 17473 - DNA, 765 bp, Unknown
  Obtained from environmental sample
  misc_feature (1)..(765): n is a, c, g, or t
gtgagttttttagaactttttaagcgtccatgtcttatcggagcacatcgaggttctcgctcaacacatccagaaaacactctatccgctcttaaaaatagcattggtcattgtgacttcattgaagttgatgtgcagttaagtcgtgatggaatcacagtaattatgcacgatgaaaccttagagcgaacaaccaatgtcaaagaaaaagaagcctataaaacacgtattccttacaaacttactgattttacatatgccgagttgacaagtcttgattatggaagttggttctatattgataaaaaaaagcctgagccattactgacacttaaaaaagtattggagtttgtaaaagaaaacaaactttttattaatatagagataaaagacttacatcatcattttagcgacaagcaagttctatcaactgttctcaaagagatcaataattctggagcgaaagagttgattttgctctcttcctttagacatgagtacatgattctctccaataagatgcaagctgatatacctacagcagcattagtttataataagcatccagcatctctgctacaatatttaaaatcattaaacgtagatgcatatcactttaacgataaacttgccgataaacaaacaattagaaaattaagagatgcaggggtttttgtaaatatatacactgttaacgatttaaaaagacgtcaacagctttttaatatgggcgtaaatggagtatttacccgatatttagagtag

SEQ ID NO: 17474 - protein, 254 aa, Unknown
  Obtained from environmental sample
  DOMAIN (16)...(254): Glycerophosphoryl diester phosphodiesterase family
  misc_feature (1)..(254): Xaa is any amino acid
MSFLELFKRPCLIGAHRGSRSTHPENTLSALKNSIGHCDFIEVDVQLSRDGITVIMHDETLERTTNVKEKEAYKTRIPYKLTDFTYAELTSLDYGSWFYIDKKKPEPLLTLKKVLEFVKENKLFINIEIKDLHHHFSDKQVLSTVLKEINNSGAKELILLSSFRHEYMILSNKMQADIPTAALVYNKHPASLLQYLKSLNVDAYHFNDKLADKQTIRKLRDAGVFVNIYTVNDLKRRQQLFNMGVNGVFTRYLE

SEQ ID NO: 17475 - DNA, 486 bp, Unknown
  Obtained from environmental sample
  misc_feature (1)..(486): n is a, c, g, or t
gtgattgaaaatattacagatatattttctgaagaggaattacaagaagtagataagttaattgaaaaatatggtaaaaaaccaggaggtttaatacctttacttgaagaagcgcaaggtgtacttggttatttgccggtatgctttcaaaatagagttgcagaaaaaacagaaattcctgcaaatagaatatacggagtcgtttcattttattcattttttacaatgaaaaaaaaggcaagacatagaattcaagtatgtcttggaactgcttgttatgttaagggtggaaatgaaattgctaaaaaaattgaaaatgattacaatataaaattaggagaaagtaccgaagatggaagatttacatatgaaaaagctagatgctttggtacatgtggtcttgctccagttatagcagttgatgggaaaatatatggaaaagtaactgttgaaagtattgatgaaattttagaccagtataaatga

SEQ ID NO: 17476 - protein, 161 aa, Unknown
  Obtained from environmental sample
  DOMAIN (9)...(161): Respiratory-chain NADH dehydrogenase 24 Kd subunit
  misc_feature (1)..(161): Xaa is any amino acid
MIENITDIFSEEELQEVDKLIEKYGKKPGGLIPLLEEAQGVLGYLPVCFQNRVAEKTEIPANRIYGVVSFYSFFTMKKKARHRIQVCLGTACYVKGGNEIAKKIENDYNIKLGESTEDGRFTYEKARCFGTCGLAPVIAVDGKIYGKVTVESIDEILDQYK

SEQ ID NO: 17477 - DNA, 696 bp, Unknown
  Obtained from environmental sample
  misc_feature (1)..(696): n is a, c, g, or t
ttggggatgtattacttgaaattgaaacagcagagtagttcatttgtaacatcaacaagtaataatccatggttcaatttggcgattgaagaatttttagttgagaatgtaaaagatgatgaaataattttatatctttggcaaaacaaagatactatagttatagggagtaatcaaaatccatggaaagaatgtaatgttaaagaaattaagaatgatggaattaagctagctagaaggttatcaggtggtggagcggtttatcatgatagtggtaatttgaattttacatttataatgggaaaagaactatatgatcttgaaaaacagctgggtgtaattcttaggtcagttaattcttttggatttaatgggaaattctcaggaagaaatgatatggaaatagatggtaaaaagttttcaggaaatgcatattattttggtgattgctcaacctaccatcatggaacaatacttgtaaacgctagcttatcaaaattatcaaaatatcttacaccctcaaaacaaaaaattgtttcaaagggtgtcgattctgttaaatccagagtcgtaaatcttaggtcaattaatagtgatataagtattgaaaaaataaaagttgaaataattaaatcttttcaagagtgttatggaaaatttttaaaaactaatatatttactgaaggaatgatttaa

SEQ ID NO: 17478 - protein, 231 aa, Unknown
  Obtained from environmental sample
  DOMAIN (55)...(166): Biotin/lipoate A/B protein ligase family
  misc_feature (1)..(231): Xaa is any amino acid
MGMYYLKLKQQSSSFVTSTSNNPWFNLAIEEFLVENVKDDEIILYLWQNKDTIVIGSNQNPWKECNVKEIKNDGIKLARRLSGGGAVYHDSGNLNFTFIMGKELYDLEKQLGVILRSVNSFGFNGKFSGRNDMEIDGKKFSGNAYYFGDCSTYHHGTILVNASLSKLSKYLTPSKQKIVSKGVDSVKSRVVNLRSINSDISIEKIKVEIIKSFQECYGKFLKTNIFTEGMI

SEQ ID NO: 17479 - DNA, 846 bp, Unknown
  Obtained from environmental sample
  misc_feature (1)..(846): n is a, c, g, or t
atgaaggcatatcaaggttatcaaagaaagcgtgcgcaggtagccgataaaacaataatcggcatagatcctggcaagagtcgacatcaagcagtgatcatagatgcaaatgggataccgacaggtaagacattttcttttgcagtgaaccataacggttatcatgagaaattatggaatgagctcaataagcagatatcgtcttattcatccttagacttgttatttgccgtggaagcatcctgcaatctctggcaaacgctaagccattatcttcgtacagctggttatacagttgttcttgtcagccctatgtctactaaacaatcccgagtaatgctgaataataatttttccaaaacagatcccaaagatgcactcttggtagctttaaatgcccagcgggggtattattttgagatgagagattattctgagaaatccaataatatgcataccttaagtattgcctataataaactaaggaaggatcacagccgttacagaggacgcctccgagcagcgatagaacttatttttccggagtttttggaagtgataactcttggaaccaagacaagtttctatctcttgggaaaatacctgtttcctgaagaatatattaatctgaatattgaatttgaagctttacaaattggccgtatctcacgcagcagctatggaaaaaatcaacttcagaagctgcagaaactggncaagcatacgataggaatttcttccccatatgagcaatgtgaacgaagcatagtattaagctggctggaaagtatgaaagagacagaagcttgtatgaaagatattccggnnatcactcataaaccttag

SEQ ID NO: 17480 - protein, 281 aa, Unknown
  Obtained from environmental sample
  DOMAIN (92)...(189): Transposase
  misc_feature (1)..(281): Xaa is any amino acid
MKAYQGYQRKRAQVADKTIIGIDPGKSRHQAVIIDANGIPTGKTFSFAVNHNGYHEKLWNELNKQISSYSSLDLLFAVEASCNLWQTLSHYLRTAGYTVVLVSPMSTKQSRVMLNNNFSKTDPKDALLVALNAQRGYYFEMRDYSEKSNNMHTLSIAYNKLRKDHSRYRGRLRAAIELIFPEFLEVITLGTKTSFYLLGKYLFPEEYINLNIEFEALQIGRISRSSYGKNQLQKLQKLXKHTIGISSPYEQCERSIVLSWLESMKETEACMKDIPXITHKP

SEQ ID NO: 17481 - DNA, 468 bp, Unknown
  Obtained from environmental sample
  misc_feature (1)..(468): n is a, c, g, or t
atgcattatatttttaatgagttaacttatatatgtagaagttataaaagtgtggcagttttaattggttatgagttagagttatcaagacttcttaaaaaaggtgctgatatttggctcaatactccaagaatcacaagggaagctagtggtacaagtggtatgagtgctgctatgaatggagcaattaatttttcaatagcagatggttggcatccagagttttgtaaagaggaaaagaatagttttacaattttaggagcagatgctagtttaagtgttgaaaatcaagatcaagtagacaacaaaagtatgatggatatacttgaagaaaaaatcatcccaacttattatgaaaatgaaaaagagtggatagagttgatgaaaaactctatgagtgatgtattatttgaatttgattcaggttctatggctcacaaatattatgaaaaaatgtataaattctag

SEQ ID NO: 17482 - protein, 155 aa, Unknown
  Obtained from environmental sample
  misc_feature (1)..(155): Xaa is any amino acid
MHYIFNELTYICRSYKSVAVLIGYELELSRLLKKGADIWLNTPRITREASGTSGMSAAMNGAINFSIADGWHPEFCKEEKNSFTILGADASLSVENQDQVDNKSMMDILEEKIIPTYYENEKEWIELMKNSMSDVLFEFDSGSMAHKYYEKMYKF

SEQ ID NO: 17483 - DNA, 342 bp, Unknown
  Obtained from environmental sample
  misc_feature (1)..(342): n is a, c, g, or t
atgatgttaagtaatattgaattgatgcaaacagtaaagtctttaaaagatatagatataaaagataaaagagttttaataagagttgattttaatgtacctttagattcacataacaatataacagatgacaatcgtatcaaagaagcgcttcatactataaatcattgtattgataatgaagctaaaaatatagttttagtaacacatcttggaaaaccaaaaaatggatatgaagagaagttctcattaaaacatatagttaaaagattggaaagattacttgatagaaaagttgatttaatcgataacttttatggagcaaaaagatactttaaatag

SEQ ID NO: 17484 - protein, 113 aa, Unknown
  Obtained from environmental sample
  misc_feature (1)..(113): Xaa is any amino acid
MMLSNIELMQTVKSLKDIDIKDKRVLIRVDFNVPLDSHNNITDDNRIKEALHTINHCIDNEAKNIVLVTHLGKPKNGYEEKFSLKHIVKRLERLLDRKVDLIDNFYGAKRYFK

SEQ ID NO: 17485 - DNA, 855 bp, Unknown
  Obtained from environmental sample
  misc_feature (1)..(855): n is a, c, g, or t
gtgcttattttgactaactacagtaaacctcacttaacttatcaggaacaagtcgaccttttaaagaagagaaatctaattgtaactaatgaagcttatgctttggaaaaattaaaacatattagttattatagattaagtgcatattttttacctttttgtatttctaaaaatcaatttattacgggtactagatttgaagatattattgagctttatcattttgataaagagcttagaatattaacttttagcgtgatagaaaagatagagatatttttaagaacttcaatagcttataatttttcaaaaaatcatgaagtatttgcatataataataaacaaaatttttgttgtaaagaaaaagattttatctggttaaataatgatattcaaaaagaaacaagtcgttcaaaagaaacttttgtaaaacattttaaagaaaattacacaggtgatcatttgccaatttggatgatagtagaaatcatctcttttgggtcactatcaaaactttatacaatgctccgccctgaaacagaaagagagattttaaatggtataaagttaccatcatttgtatttaaaaattggcttcatgttttttcgtatgtacgaaatatatcagctcaccatagtcgactttggaatagacagtttgttataaaagcaaaaataccaaaacacaaaaaagagttcaaaggtctgatgaatgataaatactatacatttgcagttatgacacactatgttttaactgctattaatgatacttttgattttaaagatgagttgaaaagtttgtttgagaaatatcctaatattgataaaaaggctattgggttttgcggatga

SEQ ID NO: 17486 - protein, 284 aa, Unknown
  Obtained from environmental sample
  misc_feature (1)..(284): Xaa is any amino acid
MLILTNYSKPHLTYQEQVDLLKKRNLIVTNEAYALEKLKHISYYRLSAYFLPFCISKNQFITGTRFEDIIELYHFDKELRILTFSVIEKIEIFLRTSIAYNFSKNHEVFAYNNKQNFCCKEKDFIWLNNDIQKETSRSKETFVKHFKENYTGDHLPIWMIVEIISFGSLSKLYTMLRPETEREILNGIKLPSFVFKNWLHVFSYVRNISAHHSRLWNRQFVIKAKIPKHKKEFKGLMNDKYYTFAVMTHYVLTAINDTFDFKDELKSLFEKYPNIDKKAIGFCG

SEQ ID NO: 17487 - DNA, 897 bp, Unknown
  Obtained from environmental sample
  misc_feature (1)..(897): n is a, c, g, or t
atgctttccctcaaaaaatgggaggatgtatttcattattatgtagcaataaagcttttactagataataatagttggaataaatgtcaaattgagcaatttggcgatatagctttatttgaccaagatgataagcaaatctataacattgaagtaaaacatcacgaaagtcaaaatgaattaaaaatttatgaagaagaatttttgaaaactttatcaaactggtttgatataaaaaatctttttaatgaaaatactaaactaattttgatgacaacttctactatatcatcaggtaatcctcttcaatattggaacttagttaattcagataaaaaatttaaaactatacaagagaatcaaactaagaatgatggaacttattatgccaatatcagtaaatatttttttaaaataaataaaaatattgacgaattgaaaaatgttttagataaatttgatattcaacactctttacataatatattagacattagaaatgaaataaagaaaacaagtcattttagactttttggagatagcgaagaaaaaaaagataaagttattggtgaattatacgctttaattggggaaggcttagaaagtaaagataaatgggaaattaaaaaaagtgaatttgatcaaaaacttaaagaatcaacagcacttatccaagataaaattttaagaacaaataacagtgtaagtacaaaaaatatagatacaaatatttcaagttataaagataaacaatttataaaaaagcttgaaaatattgagtttaaagaagatgtttttcaatcagcaatagatgattatgcaaaaacaattattgaagttgcagaaagaatgaatttaagttcttctttggagtatgatgaacgattagaaaattag

SEQ ID NO: 17488 - protein, 298 aa, Unknown
  Obtained from environmental sample
  misc_feature (1)..(298): Xaa is any amino acid
MLSLKKWEDVFHYYVAIKLLLDNNSWNKCQIEQFGDIALFDQDDKQIYNIEVKHHESQNELKIYEEEFLKTLSNWFDIKNLFNENTKLILMTTSTISSGNPLQYWNLVNSDKKFKTIQENQTKNDGTYYANISKYFFKINKNIDELKNVLDKFDIQHSLHNILDIRNEIKKTSHFRLFGDSEEKKDKVIGELYALIGEGLESKDKWEIKKSEFDQKLKESTALIQDKILRTNNSVSTKNIDTNISSYKDKQFIKKLENIEFKEDVFQSAIDDYAKTIIEVAERMNLSSSLEYDERLEN

SEQ ID NO: 17489 - DNA, 645 bp, Unknown
  Obtained from environmental sample
  misc_feature (1)..(645): n is a, c, g, or t
atgttattttttcatcttttcctaatctactttatatcactccaaattatgatacaagctgtacgaaactcactatcaaaaaaaggtaatacaatttataatttagggatgggaaataataatcttttgcaaaaactaaaaaaacatacaaaatcagaacttattgatctggtaatgggaattcatactgttggtgataaaaaaatacaagcaatgatagaagtggaacagtcagagtccagtcattttttctcaggaggagatataatcgacttacttgtaatccgtcctttaaacacagccttaagatgtagaattttaagcaccggcgaacttgtaacctttagaaaaaacctctttgagattccgggagataccataaccgttgaagtatcgaagcactggaaaaataacaatacaagctatatttccggtaaaagaataaaacagaaatttattctttccaatttaaatctgaaacctattcaaataaagaaatatgatacaatctccctgtcagagtgtcttcttgacgatgaacatcctaaaaatatcctagcaatatacaatagaatctttactcaaaaagaatacggcagctatgaaatggaaaatatatccagctcgagccatcatccnnnntaa

SEQ ID NO: 17490 - protein, 214 aa, Unknown
  Obtained from environmental sample
  misc_feature (1)..(214): Xaa is any amino acid
MLFFHLFLIYFISLQIMIQAVRNSLSKKGNTIYNLGMGNNNLLQKLKKHTKSELIDLVMGIHTVGDKKIQAMIEVEQSESSHFFSGGDIIDLLVIRPLNTALRCRILSTGELVTFRKNLFEIPGDTITVEVSKHWKNNNTSYISGKRIKQKFILSNLNLKPIQIKKYDTISLSECLLDDEHPKNILAIYNRIFTQKEYGSYEMENISSSSHHPX

SEQ ID NO: 17491 - DNA, 837 bp, Unknown
  Obtained from environmental sample
  misc_feature (1)..(837): n is a, c, g, or t
atgagtgaaaaaattaggaaagctttagattatcactttcagaatcatcgactaatattttggtatgatgagggtggtgagatgaaggatgattttaatgattttaacgagcttggaatcgaaaaaattgaaattgataatgatgagttttatatacgctataaagtacaaaggatagatcctgagcaaaagttccttatatactcaacaaaaccaaagccggaagacaagcataactggctactggatctcaattttacaggatttgtttttgcatctgataagtcctcacttattctccaggaactggatcttgatataaaattccttccccttattcaggaacactcagatttttttaaaaataagaaggatcgcctgataccgttcaaaagtattattaacagttctacagaggacgaagattctctacttttggcaatgatttctatattagccagcaatacgatggaaaataaactaaatcgaaaagaattcccggaaattgctcttaatatatttcttaacagttttcttgatgaagaaggttcctggtgggattccattgaaaagtatcacctggattcagttttctgggaacttgcagataatgagtgggcctataacaaaaataactctgacctggaaggtttgttaaattatatacttcagaatgcactcgattttcaattgaaaattgtgactggtaaaaatcagcggaatatttttgtgcttatagatgaatggagaaataaccttaagtacagtgaacgctttaaggaattgtggataagcgagaaaaagctcgagccgattctgaccatgtnnnnnnnntga

SEQ ID NO: 17492 - protein, 278 aa, Unknown
  Obtained from environmental sample
  misc_feature (1)..(278): Xaa is any amino acid
MSEKIRKALDYHFQNHRLIFWYDEGGEMKDDFNDFNELGIEKIEIDNDEFYIRYKVQRIDPEQKFLIYSTKPKPEDKHNWLLDLNFTGFVFASDKSSLILQELDLDIKFLPLIQEHSDFFKNKKDRLIPFKSIINSSTEDEDSLLLAMISILASNTMENKLNRKEFPEIALNIFLNSFLDEEGSWWDSIEKYHLDSVFWELADNEWAYNKNNSDLEGLLNYILQNALDFQLKIVTGKNQRNIFVLIDEWRNNLKYSERFKELWISEKKLEPILTMXXX

SEQ ID NO: 17493 - DNA, 918 bp, Unknown
  Obtained from environmental sample
  misc_feature (1)..(918): n is a, c, g, or t
atggctcagacattgatatatggagaaactggaacgggaaaagagttatttgctcagttaatgatttctgaaagtggagtttcaaaaaaatcagtggttacacagaattgtgcggcagtaccagataacttaatagaatcaatattatttggaacgaagaaaggtgcatacactggtgcagaaaatactagggggctctttcaagaagctgatggtggaatattatttttagatgagctctcagccatgccttatcatgtgcagggaaagcttttacgcgttattcaggaagggactttcaggcctgttggtagtaatgaagaaatacatgttgatgttaaaattattgctgctatgaatattgatccaatagaagcaatggatcaaaaaataatcagaaaagacttattctatagatttagtagctgcatgattgggttaccacctttaagagaaagagtggaagatattgaattttatgttaagcattttaaagataaatatgttaaattatataataagaaaataaatcaaattgatgatgagttaatggaaatgtttaaatcatacagttgggaaggcaatgtaagagaacttaagcatttgatagaatttatggttagtgtttctaatgaagaaactttaaataataaagttcttccaacctatgttttagaaaaaattgaaaatgaaaataaaacctacgtcaaagatagaataattggtgcagagtttgataagggaatagattattgtgctgataattttaatttgagaaatgctctnaaagcacaagaaatggaaattataaatgcggttttagacctatgtaatggcaacaaatctaaggctagtngaaaacttggaaatccaagacnaactttaaattataaactgaaagaaattgaaaaaaaataa

SEQ ID NO: 17494 - protein, 305 aa, Unknown
  Obtained from environmental sample
  DOMAIN (262)...(302): Bacterial regulatory protein, Fis family
  misc_feature (1)..(305): Xaa is any amino acid
MAQTLIYGETGTGKELFAQLMISESGVSKKSVVTQNCAAVPDNLIESILFGTKKGAYTGAENTRGLFQEADGGILFLDELSAMPYHVQGKLLRVIQEGTFRPVGSNEEIHVDVKIIAAMNIDPIEAMDQKIIRKDLFYRFSSCMIGLPPLRERVEDIEFYVKHFKDKYVKLYNKKINQIDDELMEMFKSYSWEGNVRELKHLIEFMVSVSNEETLNNKVLPTYVLEKIENENKTYVKDRIIGAEFDKGIDYCADNFNLRNALKAQEMEIINAVLDLCNGNKSKASXKLGNPRXTLNYKLKEIEKK

SEQ ID NO: 17495 - DNA, 603 bp, Unknown
  Obtained from environmental sample
  misc_feature (1)..(603): n is a, c, g, or t
ttgatcggctgnagacactatcccangcttgttatgtattcagtctggtgttttatattcgtttttaatattatatttcttgttaacttgcaaaatggggttactggtcatgaagttacagctcaaaaattatcaaatctaaaatcacctggtaatattttgttatcgtgttggaatgatgcggacttaatttttcgctatagatgccagccccataatttcaaaaggcaattaataagaggggaccgtaccttggcaatcagagtttcatcttatgccggtatacaacccaaaaaaatagctgaaaattatcaagacgtgataaacatcattgaaaaaggttttattcgctatctggtaacatgttctgctaaaagcaaatatgatgatgaccgctctgaagaaatggttcttgcacatgaaattgcggtttcaaaaccagcattattcactctgttagataaaacagaaatcatttttgatttaacatacaagagaagcgctgaaatatacatctggcgttatgaaggtaaattaaaagaaaccaaaagcagactacctattataataccaacggcaaaattaaaatttcaaaattcctaa

SEQ ID NO: 17496 - protein, 200 aa, Unknown
  Obtained from environmental sample
  misc_feature (1)..(200): Xaa is any amino acid
MIGXRHYPXLVMYSVWCFIFVFNIIFLVNLQNGVTGHEVTAQKLSNLKSPGNILLSCWNDADLIFRYRCQPHNFKRQLIRGDRTLAIRVSSYAGIQPKKIAENYQDVINIIEKGFIRYLVTCSAKSKYDDDRSEEMVLAHEIAVSKPALFTLLDKTEIIFDLTYKRSAEIYIWRYEGKLKETKSRLPIIIPTAKLKFQNS

SEQ ID NO: 17497 - DNA, 600 bp, Unknown
  Obtained from environmental sample
  misc_feature (1)..(600): n is a, c, g, or t
atggnnnnnnccatggatcagatcggctcgagatcttacagaaaaccaattattgcacttttgcctggtagtagagagcaggaaattttgaagattttgcctgtaatgattgaaataaccaaacattttgtagattatcaatttgtaattgctggagtttctgcgttacctgtttctctttataaatctattttgaaagatactgaaattaattttattgttgataaaacttacgaattgcttaaagtttcggttgtggcagtcgtaacttctggtactgcaacactcgaaactgcattatttaatgtgccacaggtggtttgttacaaaacaagtaaactttcttatgcaataggaaaaacttttgtgaaaattgattatttttctcttgtaaatattttaatggaaaaagaagtagtaaaagaattattacaaaatgatttagcagaggatattatcgtagaattacataaaattttaaaaaattctgattataaaattaagatgcttaatgattataaaaaacttgcggaattacttggcaatagtggatcgccagagcgaacagcaaagattatttctgataattttgatgtttaa

SEQ ID NO: 17498 - protein, 199 aa, Unknown
  Obtained from environmental sample
  DOMAIN (1)...(193): Lipid-A-disaccharide synthetase
  misc_feature (1)..(199): Xaa is any amino acid
MXXXMDQIGSRSYRKPIIALLPGSREQEILKILPVMIEITKHFVDYQFVIAGVSALPVSLYKSILKDTEINFIVDKTYELLKVSVVAVVTSGTATLETALFNVPQVVCYKTSKLSYAIGKTFVKIDYFSLVNILMEKEVVKELLQNDLAEDIIVELHKILKNSDYKIKMLNDYKKLAELLGNSGSPERTAKIISDNFDV

SEQ ID NO: 17499 - DNA, 465 bp, Unknown
  Obtained from environmental sample
  misc_feature (1)..(465): n is a, c, g, or t
atgacaaatgaaaagatattattagttgatgatgagcaagacatccttacctttattagctataatttaaaaaaagaaggttttgaagtactaacagctttatcaggaaaagaagcgatacaaattgcacaaaaagaaaaacccgatttaattgttattgatgtgatgatgcccgaaatggacggcatagaaacttgtcacgaattaagagccatagacgagctaaaagatacacttattacttttttaagtgctcgtgccgaagattactcacaagttgcaggttttgatgccggtgccgatgattacattgcaaaacctataaaaccaagattgttggttagcaaaataaaagctattcttagaagaaaaaacaatatttctgaaccagttggcgaacttgaaatagaagtgggcaacattaagatagaccgtgaaaaatacttgttntcgagccgattctga

SEQ ID NO: 17500 - protein, 154 aa, Unknown
  Obtained from environmental sample
  DOMAIN (4)...(125): Response regulator receiver domain
  misc_feature (1)..(154): Xaa is any amino acid
MTNEKILLVDDEQDILTFISYNLKKEGFEVLTALSGKEAIQIAQKEKPDLIVIDVMMPEMDGIETCHELRAIDELKDTLITFLSARAEDYSQVAGFDAGADDYIAKPIKPRLLVSKIKAILRRKNNISEPVGELEIEVGNIKIDREKYLXSSRF

SEQ ID NO: 17501 - DNA, 408 bp, Unknown
  Obtained from environmental sample
  misc_feature (1)..(408): n is a, c, g, or t
atgaaattgaataacttaatgaaacaactgataaaaggagcatcaaactcaaattttgataaacaaagagttgatttgaaaagaagtgaaaaagtgataaataaaatatataaagaaataataaaaaaactattctcttgcattatgtatgataaatgtgaaattgattataaaattttaaaaaaaaattttacagatcttacaggatatgaatgcagtaaaagtgaatttagaattaatgatatatcaaatgagattaatcatttagtaaagaaagatatgaattttggtattgtattttcgttagatgtaattgaaactttaaaggaaaaactaaaaactgaattttctactattgagttttatattataatgagctgtagtataataagaaatttggagattcca

SEQ ID NO: 17502 - protein, 136 aa, Unknown
  Obtained from environmental sample
  misc_feature (1)..(136): Xaa is any amino acid
MKLNNLMKQLIKGASNSNFDKQRVDLKRSEKVINKIYKEIIKKLFSCIMYDKCEIDYKILKKNFTDLTGYECSKSEFRINDISNEINHLVKKDMNFGIVFSLDVIETLKEKLKTEFSTIEFYIIMSCSIIRNLEIP

SEQ ID NO: 17503 - DNA, 327 bp, Unknown
  Obtained from environmental sample
  misc_feature (1)..(327): n is a, c, g, or t
atgttgaataataatttagaaaaaatttggaagagtgtggctaacgatttagatattactacaatagccccattttctttacaattatcaccgaatgtttttattgaagcagaatttctcttgaaagattttggagcaaaaaagggcatgttagtttttaaagatttcaagaaaatcgaatccaatgttgataaattagttgaaatgggttatggtttttctattttagaagagcctgaagaaaatatatatataagagaagattttattgaattgctaaaagattggggatggagtggtggaaagaacaagccagcttggtactaa

SEQ ID NO: 17504 - protein, 108 aa, Unknown
  Obtained from environmental sample
  misc_feature (1)..(108): Xaa is any amino acid
MLNNNLEKIWKSVANDLDITTIAPFSLQLSPNVFIEAEFLLKDFGAKKGMLVFKDFKKIESNVDKLVEMGYGFSILEEPEENIYIREDFIELLKDWGWSGGKNKPAWY

SEQ ID NO: 17505 - DNA, 813 bp, Unknown
  Obtained from environmental sample
  misc_feature (1)..(813): n is a, c, g, or t
atgatgtatgatgataaaaataaattagaacaagcacttatacctattagtgaagagatgcaaatacatatttttaaaaatttagctggtctatatgagctagatattattcctatacaatacaaagaaattaaacaaaatatcaatataaatataaccacttccccgtatcaggacatagtagaaactactgggaataaagccttagcaaatgagtttatactagcatttaaaaaatcggtgaactttaaaagacttcaaaaaaatgatattgtttctattgtcttcaaacaaaaaattagagaggggagatattttggtactcctgaaatacttggagcttctgttgtaatgaaaagaaaaactcattatatttttcaaaacccagatgataaaagatattataatgaagatgggaaaagtcttactagctttttattaaagatacctcttcaatataaaagaatatcaagtagatttacccaaaaaagatggcatcctatcttaaaaagatatagagctcacttgggagttgacttcgcagcccctacaggaagaaaaatatttgcaactgctgatggaagagtgattcacaaagggagaaaaggtggttatggaaaaactgttatgatacgacatagtaatggtttaaaatcactctatggacacctcaatagctacagcaatataaaagttggttcttggattaaacaaggtacttttattggaagagttgggagtacaggacgaagtacaggacctcacctacactttggcctttataaaaagtgggagagncaattaatccattaa

SEQ ID NO: 17506 - protein, 270 aa, Unknown
  Obtained from environmental sample
  DOMAIN (173)...(268): Peptidase family M23
  misc_feature (1)..(270): Xaa is any amino acid
MMYDDKNKLEQALIPISEEMQIHIFKNLAGLYELDIIPIQYKEIKQNININITTSPYQDIVETTGNKALANEFILAFKKSVNFKRLQKNDIVSIVFKQKIREGRYFGTPEILGASVVMKRKTHYIFQNPDDKRYYNEDGKSLTSFLLKIPLQYKRISSRFTQKRWHPILKRYRAHLGVDFAAPTGRKIFATADGRVIHKGRKGGYGKTVMIRHSNGLKSLYGHLNSYSNIKVGSWIKQGTFIGRVGSTGRSTGPHLHFGLYKKWEXQLIH

SEQ ID NO: 17507 - DNA, 789 bp, Unknown
  Obtained from environmental sample
  misc_feature (1)..(789): n is a, c, g, or t
atgaaattgtataataaaactcttaaattttatatattaaaagagtttttattgaagattatactattatttgttttatcagctattattagcttcgcttcttatgtgcaagaagatgtttggtggaaaggggaaaccctccttactttttttgacaaacatcaaatttcaaaaaatgtttattttgacctttcaaaaacagataaagaactttgtagtgagatatacgcaggtataccatttcaaatgatgtatgatgataaaaataaattagaacaagcacttatacctattagtgaagagatgcaaatacatatttttaaaaatttagctggtctatatgagctagatattattcctatacaatacaaagaaattaaacaaaatatcaatataaatataaccacttccccgtatcaggacatagtagaaactactgggaataaagccttagcaaatgagtttatactagcatttaaaaaatcggtgaactttaaaagacttcaaaaaaatgatattgtttctattgtcttcaaacaaaaaattagagaggggagatattttggtactcctgaaatacttggagcttctgttgtaatgaaaagaaaaactcattatatttttcaaaacccagatgataaaagatattataatgaagatgggaaaagtcttactagctttttattaaagatacctcttcaatataaaagaatatcaagtagatttacccaaaaaaagatggcatcctatcttaaaaagaatagagctcacttgggagatgacttcgca

SEQ ID NO: 17508 - protein, 263 aa, Unknown
  Obtained from environmental sample
  misc_feature (1)..(263): Xaa is any amino acid
MKLYNKTLKFYILKEFLLKIILLFVLSAIISFASYVQEDVWWKGETLLTFFDKHQISKNVYFDLSKTDKELCSEIYAGIPFQMMYDDKNKLEQALIPISEEMQIHIFKNLAGLYELDIIPIQYKEIKQNININITTSPYQDIVETTGNKALANEFILAFKKSVNFKRLQKNDIVSIVFKQKIREGRYFGTPEILGASVVMKRKTHYIFQNPDDKRYYNEDGKSLTSFLLKIPLQYKRISSRFTQKKMASYLKKNRAHLGDDFA

SEQ ID NO: 17509 - DNA, 507 bp, Unknown
  Obtained from environmental sample
  misc_feature (1)..(507): n is a, c, g, or t
atgtttgaaaaatttttaagattttttgttgataatgcaaggatgaactatgttctttttgttttaattttttctattggtatttactcttatatgaaaatgccaaaagagatattcccaacatttgatatggatatgatctcgattagtggttcttacactggtgctagtgttgatatacttgataaaatggccgttacagagatagaagacaatgtaaaatctttagaaggtgtgattgaaactactacagtaataagtcctgggaaattttctattattttagagctacaaaaagggaaagatagatataacatagctgataaagttaaggatgcagtagctttaactaaaggagaccttcccattgatatggatgaaccaactgtaagtgtaatagatagaagtagagatcttataaatatctcgcttacttctgaaaaactcaatgtagatcaaatgaaaaaatttgcagatgatttaaaagtgaaatctcagccgatctga

SEQ ID NO: 17510 - protein, 168 aa, Unknown
  Obtained from environmental sample
  misc_feature (1)..(168): Xaa is any amino acid
MFEKFLRFFVDNARMNYVLFVLIFSIGIYSYMKMPKEIFPTFDMDMISISGSYTGASVDILDKMAVTEIEDNVKSLEGVIETTTVISPGKFSIILELQKGKDRYNIADKVKDAVALTKGDLPIDMDEPTVSVIDRSRDLINISLTSEKLNVDQMKKFADDLKVKSQPI

SEQ ID NO: 17511 - DNA, 618 bp, Unknown; identical to SEQ ID NO: 16473
  Obtained from environmental sample
  misc_feature (1)..(618): n is a, c, g, or t

SEQ ID NO: 17512 - protein, 205 aa, Unknown; identical to SEQ ID NO: 16474
  Obtained from environmental sample
  misc_feature (1)..(205): Xaa is any amino acid

SEQ ID NO: 17513 - DNA, 354 bp, Unknown
  Obtained from environmental sample
  misc_feature (1)..(354): n is a, c, g, or t
ttgattttacgcgcaaaaattattttgaaacgtactaacaaagagtttaaagtgttgaaacataatgttgtttataaagatatgcaaattgatctaaatatgaatcaggtttttatagaagatgcaagcatatcacttacaaatttagaaacaacacttctgaaagtttttgtatcaaacattggtaaagttttagatagagaatttttactaatgaatgtatggaaagatacagaaaatactcgcactaaaacagttaatgtagctataaaaagattaaaagagaagatagatcccttaaagaacaaagagtacataaaaacagttagaggtgttggatatttacttgcctga

SEQ ID NO: 17514 - protein, 117 aa, Unknown
  Obtained from environmental sample
  DOMAIN (41)...(116): Transcriptional regulatory protein, C terminal
  misc_feature (1)..(117): Xaa is any amino acid
MILRAKIILKRTNKEFKVLKHNVVYKDMQIDLNMNQVFIEDASISLTNLETTLLKVFVSNIGKVLDREFLLMNVWKDTENTRTKTVNVAIKRLKEKIDPLKNKEYIKTVRGVGYLLA

SEQ ID NO: 17515 - DNA, 858 bp, Unknown
  Obtained from environmental sample
  misc_feature (1)..(858): n is a, c, g, or t
atgaacaagattaaaattttaattattaaacttggttattctgaaactttagattcagaaataggacgatatgtaagtttaggagatgtactccgtacaacacctatattgtcagcattaaaagacaaatatacaaattcaagtatttcatggttagtatctcaatcagcagaaccattaatacatggaaatgaatatattgatagaattttagtatgggatgaatttattgcttatcaattactagctgaaaaattcgatcttgtaataaatttagaaaaaattcctggtgtttgtgcattaagcgacagaattgaagcttggaataaatatggatttagatttaacagtgaaacaggcaactatgatggatatgaacaaggttcagaatttattgattatattaatcaaaaaaatatagggaatacttcaaatgattgctggcaaaaatcattaatagaattaattggactaaaatggaataatcaaaactatatcttaggatataaaccaaaaagtaaagtagaatttgatgttggattaaattatgaggtgggcaaaaaatggccactaaaagcaatgccaataaaaaaatggaagaagttatcacacaagctagaaaataagaacattaaagtttcatggcaagagggactaaatagtatttatgattatatagagtggataaattcttgtgacaccataatcactcaagatagtctaggacttcacttggccttggcattaaacaaaaaagtaatagctcttttcggtcccacatcttcaaaagaagtttgttttcataaaaataattatatcataaatgcaccaagtaaagatatgcataatattgattaa

SEQ ID NO: 17516 - protein, 285 aa, Unknown
  Obtained from environmental sample
  misc_feature (1)..(285): Xaa is any amino acid
MNKIKILIIKLGYSETLDSEIGRYVSLGDVLRTTPILSALKDKYTNSSISWLVSQSAEPLIHGNEYIDRILVWDEFIAYQLLAEKFDLVINLEKIPGVCALSDRIEAWNKYGFRFNSETGNYDGYEQGSEFIDYINQKNIGNTSNDCWQKSLIELIGLKWNNQNYILGYKPKSKVEFDVGLNYEVGKKWPLKAMPIKKWKKLSHKLENKNIKVSWQEGLNSIYDYIEWINSCDTIITQDSLGLHLALALNKKVIALFGPTSSKEVCFHKNNYIINAPSKDMHNID

SEQ ID NO: 17517 - DNA, 810 bp, Unknown
  Obtained from environmental sample
  misc_feature (1)..(810): n is a, c, g, or t
atgcatgcagaccacgtaactggtcttcctggtatccttatgctatcatctcaagttgatagagtagaacctttgtatatatatgggccaaagaaattaaaagaatatattgattcatcaagaaaaatattagatatgtatattaactatgaaattatttttgttgaagtcaacgaaggcatcattatagacaatgatgaatattcaattactgctattaaattaaatcacacaaaaccttgttttggttatgtaatgagagaaaaagatagacctggtgaattctttcctcaaaaggctatagaatataaaattaaacctggacctgattttgggaaaatacaaagaggcgaaactgttatcaacactgatggagttagtattacatcacaaatggtaatgggagagagtagaagaggaagatcctttggctatatcacagatactctttatatgccctcaattgctgaagcagtaaaagaggtagatttattattatgtgaaggcatgtttgaatcaggaatggaagaagtagctaaagataagaaacatatgtgtgtaacccaggctgcacaaattgcaaaagatgcaaatgtaaaatatctagcactaatgcactatagccctcgatataatgattttgagttaaaagctttaaaataccaagcccgtgaaatatttgaaaatacaatattaactagagataggatgattttttcaattccaaatgacggagctcaattggagattacaaaggaaagaagaaaatattatagtattgaaagagtccctgttataccaaaagtataa

SEQ ID NO: 17518 - protein, 269 aa, Unknown
  Obtained from environmental sample
  misc_feature (1)..(269): Xaa is any amino acid
MHADHVTGLPGILMLSSQVDRVEPLYIYGPKKLKEYIDSSRKILDMYINYEIIFVEVNEGIIIDNDEYSITAIKLNHTKPCFGYVMREKDRPGEFFPQKAIEYKIKPGPDFGKIQRGETVINTDGVSITSQMVMGESRRGRSFGYITDTLYMPSIAEAVKEVDLLLCEGMFESGMEEVAKDKKHMCVTQAAQIAKDANVKYLALMHYSPRYNDFELKALKYQAREIFENTILTRDRMIFSIPNDGAQLEITKERRKYYSIERVPVIPKV

SEQ ID NO: 17519 - DNA, 927 bp, Unknown
  Obtained from environmental sample
  misc_feature (1)..(927): n is a, c, g, or t
atggtcagaatcggctcgagaataaaagcaattatctctaacgataccgaatatatgataccttgcgaacaatctgtgcttattgaaccagatgctgaggaattttctacctttaattttgacaataacaaagaactgataagaattggttatgaagctacgcttaaaaagatagaacacataaaaagtaatgtttcgagaagaaacgatagctcttatgtagcagaaaaaagaaaaaaatacaaagaaaatttgcccaggcttatatttgataatattcaggtgcaaggacttagaacttctcaaaacacttacataaaaaactcaattcgcttaaaaaaagatacccttaatgctgaagatttaaaatctgaatacattaaagtttcttctgatgacaaaattaaatcactttatccagaagctgtttttaataatgagactaacaagtttagcttattacttaaagcaaaaaaagaaagaaactttattgtatcatttggaggtgtattttcttctcgaccaataaacacaggttatttggggcttcaatacaatattttaagaaaaaaagcttactcatttatagcgaatacctattttggaaaactccataactcggttagtgttggttttagaattgattttcctaaacccttaccattttattgggttactacatttaataatgataggtgggattattttaagagtaactctactttttttgaagataccagaccttcctttttacgtagttctgatttatatgcaaaaacagaattaggtgttcctgttgcttataaaggaaaaatagtaattggtgctactgctggcgaaatagataatgagtattatcaaaccagacaatttatttctacagatactacagataaaacaagttttagaaatgcctttggattataa

SEQ ID NO: 17520 - protein, 308 aa, Unknown
  Obtained from environmental sample
  misc_feature (1)..(308): Xaa is any amino acid
MVRIGSRIKAIISNDTEYMIPCEQSVLIEPDAEEFSTFNFDNNKELIRIGYEATLKKIEHIKSNVSRRNDSSYVAEKRKKYKENLPRLIFDNIQVQGLRTSQNTYIKNSIRLKKDTLNAEDLKSEYIKVSSDDKIKSLYPEAVFNNETNKFSLLLKAKKERNFIVSFGGVFSSRPINTGYLGLQYNILRKKAYSFIANTYFGKLHNSVSVGFRIDFPKPLPFYWVTTFNNDRWDYFKSNSTFFEDTRPSFLRSSDLYAKTELGVPVAYKGKIVIGATAGEIDNEYYQTRQFISTDTTDKTSFRNAFGL

SEQ ID NO: 17521 - DNA, 417 bp, Unknown
  Obtained from environmental sample
  misc_feature (1)..(417): n is a, c, g, or t
ttggtattggttgaaggcgtctgtcttgaacttgatcctaaattcaatcttatcgatgatgcaaaaatgttgataaagatggtgatgatgaaacgatattcaccatttaatgcagcagaatatttccttctggggggtgacagatatcttgatatcttcaagaacctgccacaagggatcaatgatgttatcgagacgatcagaggttatcgttttgagaaacttgaagaaaagaccaaggagatcaaacacgataaaatgttagattctcttgcaaaatacgttttcctttcaataatacttgtttcttctgcctatcttgcaacacagcaggatactaatctggcaaatcttgggattgtcggtttcgttgtggcgttgttcctgttcggagtgctgttcctaaaacatcagtaa

SEQ ID NO: 17522 - protein, 138 aa, Unknown
  Obtained from environmental sample
  misc_feature (1)..(138): Xaa is any amino acid
MVLVEGVCLELDPKFNLIDDAKMLIKMVMMKRYSPFNAAEYFLLGGDRYLDIFKNLPQGINDVIETIRGYRFEKLEEKTKEIKHDKMLDSLAKYVFLSIILVSSAYLATQQDTNLANLGIVGFVVALFLFGVLFLKHQ

SEQ ID NO: 17523 - DNA, 735 bp, Unknown
  Obtained from environmental sample
  misc_feature (1)..(735): n is a, c, g, or t
ttgtcagactttgtaggtgttaaaattgaacaacttcttattacacaaggatcagaacaagcaatagaatttgtctttagagtttttgtaaatgaaaatgatgaagttgtatatctaaatccaagttttgcaatgtttgatgtatattcatatattcaaaaagcaaaaataaaatatataaattttgaagataatatatcattaaaaattgaatcagtgataaattcaattacagaaagtacaaaattatttgttttggctaacccaaataatccaacaggtacctcttttagtttggaagaattagatcttattgctaaacatacagaaaaaacaaatactatttttttgctagatgaagcgtattttcatttttataatattgatagtatcgaacttattaataagtataaaaatttaattataacaagaacattttcaaaagcattaggaattgcaggtgctagagtaggatatgcaatatcacaaatgaataatatagatttattaagaaaaataaaacctattgatgaaataaatcaattatcaaatatattagcaaaaaaagttatagatcattcacaaatgattttaaaaaaaaatatagatcaagtgaataaatggaaaaagaaatttgaaaatactgattttactaatctagaatatattcctactgaaggaaattttattttattgaaatctacaaactatgaatatcataaaaaaatcttntag

SEQ ID NO: 17524 - protein, 244 aa, Unknown
  Obtained from environmental sample
  DOMAIN (3)...(244): Aminotransferase class I and II
  misc_feature (1)..(244): Xaa is any amino acid
MSDFVGVKIEQLLITQGSEQAIEFVFRVFVNENDEVVYLNPSFAMFDVYSYIQKAKIKYINFEDNISLKIESVINSITESTKLFVLANPNNPTGTSFSLEELDLIAKHTEKTNTIFLLDEAYFHFYNIDSIELINKYKNLIITRTFSKALGIAGARVGYAISQMNNIDLLRKIKPIDEINQLSNILAKKVIDHSQMILKKNIDQVNKWKKKFENTDFTNLEYIPTEGNFILLKSTNYEYHKKIX

SEQ ID NO: 17525 - DNA, 612 bp, Unknown
  Obtained from environmental sample
  misc_feature (1)..(612): n is a, c, g, or t
atgaataatagatttatagataagagcactgatcgtaaaaaagagatagttaaagataagttatcagtaattgatggtgtacctgtattttcaattattgaatttaatataacaggatcttgtaacagagattgtactttttgtccagtatcaaatcctgatgtttatactaaaacaaaagatggcataaagcctcaactatttgaaaaaatagttcaagatttacaagaaattaattataaagggaaaattctattttcagcattttctgaacctttacttcataaacaggttgaagaactaatatatattgcaaaaaaatacttaccagaggtacgacttgaaatggtttccaatggtgatttattaacagttaaaaaattaaaaaaactttatgccgctggtttagatacaattaatgtaagcatgtatgatggtgcacatcaaattgagcattttaataaattgttcatgaatcagaagttcccaaagagactgtcatcacaagaagacgctattttgaaaatggaaattatggtattactatttcgaatagaacaggttttagttaattctaatgatatagagatgaaaatgnaccggcagttgtag

SEQ ID NO: 17526 - protein, 203 aa, Unknown
  Obtained from environmental sample
  DOMAIN (35)...(203): Radical SAM superfamily
  misc_feature (1)..(203): Xaa is any amino acid
MNNRFIDKSTDRKKEIVKDKLSVIDGVPVFSIIEFNITGSCNRDCTFCPVSNPDVYTKTKDGIKPQLFEKIVQDLQEINYKGKILFSAFSEPLLHKQVEELIYIAKKYLPEVRLEMVSNGDLLTVKKLKKLYAAGLDTINVSMYDGAHQIEHFNKLFMNQKFPKRLSSQEDAILKMEIMVLLFRIEQVLVNSNDIEMKMXRQL

SEQ ID NO: 17527 - DNA, 444 bp, Unknown
  Obtained from environmental sample
  misc_feature (1)..(444): n is a, c, g, or t
ttggaagagcaaactataggatataaagataatttagcagtgtgggtaatcaaagagttattaaataaaaatagttcttttaatagctctttaaaagaactgtttaaagatattttactgaaaacttttggtgatgatatttatctttttgtagattcaaatgagactttagagtatacactacattttggcttaaaaggtattaaagcaagagagctaatacgaacacttgctctagatgagatacttattacaaatggggaagggtgttcattaggattatcaaaaccttcaagagtaattcaagagatggggtatacccaagatcagagtagaaatgctatatcaatatcttttagtgaagatatgacagaggcagagataatagaagttgtagaattgatgtttaaaagatataaacaaataaggatattaaatgactaa

SEQ ID NO: 17528 - protein, 147 aa, Unknown
  Obtained from environmental sample
  misc_feature (1)..(147): Xaa is any amino acid
MEEQTIGYKDNLAVWVIKELLNKNSSFNSSLKELFKDILLKTFGDDIYLFVDSNETLEYTLHFGLKGIKARELIRTLALDEILITNGEGCSLGLSKPSRVIQEMGYTQDQSRNAISISFSEDMTEAEIIEVVELMFKRYKQIRILND

SEQ ID NO: 17529 - DNA, 681 bp, Unknown
  Obtained from environmental sample
  misc_feature (1)..(681): n is a, c, g, or t
atgataaagttaaatacccatcaatacccagtaccgaaagatatagcagtatctgctgattttgcattggatatattaaaaaataatgatacctatttaaaattagaggctgatttattaaggtcatttaactttggagatttaaaatcattttcatttaatagtgatggatttttaagcttactgtgtcatttaggattgcaagggaaaattgccattagtgtaggtgaaacagaggcactatatgaagcaggtaaactttatgaatctttagggtttgatgttgtttggattggtttaaagcaagatggacatatagatattgatagtataaaaaatagtaatttagattttatatttatctcttcatatacagtagatacttatgtaaaaaatgatttagaaagtcttaaaaaaataacaaacggaaaaattatctctaacggaagctttgatatatcaactaaaagtgatgcgttgtattttgacccatataagttaagtggttttgcaatatctggaataatattagcaaatggtttatttgaagagcaaactataggatataaagataatttagcagttgtggtaatcaaagagttattaaataaaaatagttcttttaatagctctttaaaagaactgtttaaagatattttactgaaaacttttgggggatga

SEQ ID NO: 17530 - protein, 226 aa, Unknown
  Obtained from environmental sample
  misc_feature (1)..(226): Xaa is any amino acid
MIKLNTHQYPVPKDIAVSADFALDILKNNDTYLKLEADLLRSFNFGDLKSFSFNSDGFLSLLCHLGLQGKIAISVGETEALYEAGKLYESLGFDVVWIGLKQDGHIDIDSIKNSNLDFIFISSYTVDTYVKNDLESLKKITNGKIISNGSFDISTKSDALYFDPYKLSGFAISGIILANGLFEEQTIGYKDNLAVVVIKELLNKNSSFNSSLKELFKDILLKTFGG

SEQ ID NO: 17531 - DNA, 579 bp, Unknown
  Obtained from environmental sample
  misc_feature (1)..(579): n is a, c, g, or t
atgagtgctgcttatgttttagatcttgagaagttggaagatttttcatcaaaagcatatataaaagttgatgataaagatgaaaacctagtacttaagaaaacaaataagaagccaaatattgggatttgttggagtgctagtgttacaggtgagagctatgatggaaaagtttttgatttaaaatactttgatgatttaataaatagtgaatcttttaatatctactcttttcaagttggtgaaggaagtagtgacataaaaaaatatggatatgaaaataaaataatagatttaacaaagcatctaacagacttcaaaaagagtgctatttttgctcaacaattagacttggtcattacatctgatacaagtgttgcacacctttgtggtgctttaggtgttaaaacctggactttattacaaaaatttcctgattggagatggaagaataaaggtgaaaagtcttatatgtatgattcaataaaattacttagacaaaagcatgacagaaattgggaaacagtttttcaatcattgaatgacaaaattcaaaaagagtttaaagtaaaattatag

SEQ ID NO: 17532 - protein, 192 aa, Unknown
  Obtained from environmental sample
  misc_feature (1)..(192): Xaa is any amino acid
MSAAYVLDLEKLEDFSSKAYIKVDDKDENLVLKKTNKKPNIGICWSASVTGESYDGKVFDLKYFDDLINSESFNIYSFQVGEGSSDIKKYGYENKIIDLTKHLTDFKKSAIFAQQLDLVITSDTSVAHLCGALGVKTWTLLQKFPDWRWKNKGEKSYMYDSIKLLRQKHDRNWETVFQSLNDKIQKEFKVKL

SEQ ID NO: 17533 - DNA, 924 bp, Unknown
  Obtained from environmental sample
  misc_feature (1)..(924): n is a, c, g, or t
atgtttattgatttctttttattactaaaaaacaacaaaattccggtaagcataaaagagtattttgatttattggaagctctaaatcaagaaattgcatcatacaatattgatgatttttactttttatgtcgttcagttttagtgaaaaatgaaatccatttagatacatttgatcaactttttggtttgtactttaaaggaattgaaaccatttctaccgaagatgttttaaacatccccgaagaatggttaaaaaaaaatggtgaaaagttcctctctaaagaagaaatggaaaagataaaagcatttggagatttagataaaattttagaccaactaaaagaattacttaaagagcagaaagaaagacaccaaggcggaagcaagtggataggaactggcgggacttcaccatttggagcctacggatataatccggaaggaataagaatagggcaagatgaaagccgacaccgaagagctataaaagtatgggataaaagaaactttcaaaacctaaatgaagaagaagagctgggttctcgcaacatgaaaatggcactaaaaaaactccgaaaattaagtagagaaggaaaagctgaagagttagatttgaataaaaccattactaaaacttcaaaaaatgcaggaatgttggaagtagaaatggtgccatcaaaaaaaaacacagttaaagtattgttgttttttgatattggaggctcgatggacgaccatatagaactatgttctcaattattttcagctgcaaaatatgaatttaaacatctttcgttttattattttcataattgtatttacgagtttttatggaaagataatgctagaagatggcacgaaaaaattcctacagatgaaatttttgatacctataatggagaattaccaaagtatttataa

SEQ ID NO: 17534 - protein, 307 aa, Unknown
  Obtained from environmental sample
  misc_feature (1)..(307): Xaa is any amino acid
MFIDFFLLLKNNKIPVSIKEYFDLLEALNQEIASYNIDDFYFLCRSVLVKNEIHLDTFDQLFGLYFKGIETISTEDVLNIPEEWLKKNGEKFLSKEEMEKIKAFGDLDKILDQLKELLKEQKERHQGGSKWIGTGGTSPFGAYGYNPEGIRIGQDESRHRRAIKVWDKRNFQNLNEEEELGSRNMKMALKKLRKLSREGKAEELDLNKTITKTSKNAGMLEVEMVPSKKNTVKVLLFFDIGGSMDDHIELCSQLFSAAKYEFKHLSFYYFHNCIYEFLWKDNARRWHEKIPTDEIFDTYNGELPKYL

SEQ ID NO: 17535 - DNA, 366 bp, Unknown
  Obtained from environmental sample
  misc_feature (1)..(366): n is a, c, g, or t
atgttaactacacatttaggagggaagtttatgtcgttaatgccaatcgaaaaactacagccattaatgattttatctgaagaactccgcgacaaaacggggagacttttagctgtaaaaggaacagtcctcacgaaaaaacacttcctggtatttaaaacttgggggattaaagaggtttccatcattgatgagaagagtcatgttccgaatgaaaatttcaccccagatgaggttatggctcagattaccgccacaatagaaaagctaaaaccactatttagcaacaccaaccttgaacaccctttcattgccgagatcatccgtttagctgctcaaaaaaaggttatgaataatgatgcttga

SEQ ID NO: 17536 - protein, 121 aa, Unknown
  Obtained from environmental sample
  misc_feature (1)..(121): Xaa is any amino acid
MLTTHLGGKFMSLMPIEKLQPLMILSEELRDKTGRLLAVKGTVLTKKHFLVFKTWGIKEVSIIDEKSHVPNENFTPDEVMAQITATIEKLKPLFSNTNLEHPFIAEIIRLAAQKKVMNNDA

SEQ ID NO: 17537 - DNA, 507 bp, Unknown
  Obtained from environmental sample
  misc_feature (1)..(507): n is a, c, g, or t
atgaaattcttttttatattacttatattatttatgtttaatgctctctctaaagagccgcaactttcacaatatatgatgagtttaaataactcaaatacaatttttaaacataatcagtcgtcttttcactgttatccgtatgggatttttacttttgacaagttattaaatactaaaggtcttgtcaaagagtgtaaaaacagtgtaaatatcttttatagaaaaaatccacaagctaaacctttttcaagagtacattttaaaaattatcagttttatcatcttgataaagtaaaagggaactgtattatatactcaagtggaactaaatcctactctgaagttcttttagaagagggctatgctatatatgattttcttcttgcagatgagttatggaaatataaatttattcgtgcacaaaaacgtgcacaggtattgaaaaaaggtatttggaaaggatggaaactatctacttcaatcgtgtatgaagaatctatatga

SEQ ID NO: 17538 - protein, 168 aa, Unknown
  Obtained from environmental sample
  SIGNAL (1)...(17)
  misc_feature (1)..(168): Xaa is any amino acid
MKFFFILLILFMFNALSKEPQLSQYMMSLNNSNTIFKHNQSSFHCYPYGIFTFDKLLNTKGLVKECKNSVNIFYRKNPQAKPFSRVHFKNYQFYHLDKVKGNCIIYSSGTKSYSEVLLEEGYAIYDFLLADELWKYKFIRAQKRAQVLKKGIWKGWKLSTSIVYEESI

SEQ ID NO: 17539 - DNA, 513 bp, Unknown; identical to SEQ ID NO: 10565
  Obtained from environmental sample
  misc_feature (1)..(513): n is a, c, g, or t

SEQ ID NO: 17540 - protein, 170 aa, Unknown; identical to SEQ ID NO: 10566
  Obtained from environmental sample
  misc_feature (1)..(170): Xaa is any amino acid

SEQ ID NO: 17541 - DNA, 510 bp, Unknown
  Obtained from environmental sample
  misc_feature (1)..(510): n is a, c, g, or t
atggaaattatttcatatgttattgaaggtacattgaagcacgaagatagcacgggcaatagttataaagttcccgcgggtgaaatacagcgtatgagcgccggacgtggagtaatgcattcagagtttaatgcttcaaagcaagataaagttaagtttttacaaatatggatccagcctaatatcaccggcattaaaccgagttaccagcaaaaaagtattcgccaaaaaggtaagttaacgacattagttgacccacaaggtaaaaacaatgctttatcaattaaccaagatgctcgcttatcacgtttaatattgaaaagtggcgaggattttacttttaataccgaacaacgcattggttatttacatattattaaaggtcgattaaaaacagacagtgaacaattttctgctggtgatggctttgctgttgagccagaacaaaagctcaaggtaatagctgactctgcaattgaagcactatggtttgacttaccagatgtttga

SEQ ID NO: 17542 - protein, 169 aa, Unknown
  Obtained from environmental sample
  DOMAIN (1)...(58): Pirin
  misc_feature (1)..(169): Xaa is any amino acid
MEIISYVIEGTLKHEDSTGNSYKVPAGEIQRMSAGRGVMHSEFNASKQDKVKFLQIWIQPNITGIKPSYQQKSIRQKGKLTTLVDPQGKNNALSINQDARLSRLILKSGEDFTFNTEQRIGYLHIIKGRLKTDSEQFSAGDGFAVEPEQKLKVIADSAIEALWFDLPDV

SEQ ID NO: 17543 - DNA, 645 bp, Unknown
  Obtained from environmental sample
  misc_feature (1)..(645): n is a, c, g, or t
atgttgaaactaaactgggtgttgacgggggaattcctattaaaatatgtagagtggttaaaaaataggattgaaacccatagacaaaatccaaactataaaccagtattacatattgatgtgtatggagttataggtgtagcgtttaacaatgatattgataaaatggtcgattacatgattaaactagaaaatgcagcttttccattggtcattagaattgaaggaccagtagatgctggtaataaaaaagatacaatctattatcttagagttttaagagaagaactagagaaaaaaggttctaaattagaaatagtagctgatgaatggtgtaatactttagaagacattattgatttcgcaaatgaaaaagcaggacacatgctacaaataaaaactcctgatttaggtggagttaataatgtaatagatgctattctttattgtaacaaaattggaattggaagttattgtggtggaacgtgtaatgaaactaacatttcatccgaagtatcaaccaatattgcaattgcttgtatggcaacacaatgtttagcaaaacctggtatgggtgtagatgctggatatatgattgtgaagaatgaaatgaatagagtattggcgagagctaatgggaggtaa

SEQ ID NO: 17544 - protein, 214 aa, Unknown
  Obtained from environmental sample
  DOMAIN (1)...(213): Methylaspartate ammonia-lyase C-terminus
  misc_feature (1)..(214): Xaa is any amino acid
MLKLNWVLTGEFLLKYVEWLKNRIETHRQNPNYKPVLHIDVYGVIGVAFNNDIDKMVDYMIKLENAAFPLVIRIEGPVDAGNKKDTIYYLRVLREELEKKGSKLEIVADEWCNTLEDIIDFANEKAGHMLQIKTPDLGGVNNVIDAILYCNKIGIGSYCGGTCNETNISSEVSTNIAIACMATQCLAKPGMGVDAGYMIVKNEMNRVLARANGR

SEQ ID NO: 17545 - DNA, 465 bp, Unknown
  Obtained from environmental sample
  misc_feature (1)..(465): n is a, c, g, or t
ttgaatagtaaaaatgaaataaccttccattcactagcgccaggaaaatacaatttaaaaataataggatcaaatagcgacggtctctggaatgaaaaaggaattgttttagatttgacaataattccagctttctggcagacctggtggtttaaggcaataatacttttaatacttattatgtttgtatatcatctttacaaaataagaataaataaaataaagaaacagttgaagaaagacatcgtgttggatatgttctttaagaactatcatatttcagaaaaggaaaaaacggtgaccctatttatacatgagggaaagagtaacaaagaaattgaagataaaatgtttatctcctacggtacagtcaaaaaccacgtctacagcatatacaaaaaactgaacatcaaaagaagggctcagttaattacaatgataaatgatataaaaaacagagaataa

SEQ ID NO: 17546 - protein, 154 aa, Unknown
  Obtained from environmental sample
  DOMAIN (90)...(147): Bacterial regulatory proteins, luxR family
  misc_feature (1)..(154): Xaa is any amino acid
MNSKNEITFHSLAPGKYNLKIIGSNSDGLWNEKGIVLDLTIIPAFWQTWWFKAIILLILIMFVYHLYKIRINKIKKQLKKDIVLDMFFKNYHISEKEKTVTLFIHEGKSNKEIEDKMFISYGTVKNHVYSIYKKLNIKRRAQLITMINDIKNRE

SEQ ID NO: 17547 - DNA, 507 bp, Unknown
  Obtained from environmental sample
  misc_feature (1)..(507): n is a, c, g, or t
atgaaaaatataatcacaatttacttatttatgttaatgtccctattcctattatccaatgaacggacaacagaatatggtcatatttcatacgttgaaccaaattcacaggtatatattcaaagactggatggcaaaaaagacaaggccatcatcaatcttccggttgttcccggtgacaagatcatttcagcaggaaaatcaagatgtgaaattcagtttaataatggtacaattatcagactgggccacaatacaattctaaaggtagtaacaatccttgcggaaactttgacaacaaaaaaaaatgtctctactctggaattatccgaaggaaaaatttatatcatgtcgcaggtatataataaggaaatattccagatcaaaacagataatacagctgcactctttaaaaagaatacagtcgctattctgcaacatagagataaaaaaacagatattgatgttttgaaaggttcaattcatgttattttggaaatgacataa

SEQ ID NO: 17548 - protein, 168 aa, Unknown
  Obtained from environmental sample
  SIGNAL (1)...(19)
  misc_feature (1)..(168): Xaa is any amino acid
MKNIITIYLFMLMSLFLLSNERTTEYGHISYVEPNSQVYIQRLDGKKDKAIINLPVVPGDKIISAGKSRCEIQFNNGTIIRLGHNTILKVVTILAETLTTKKNVSTLELSEGKIYIMSQVYNKEIFQIKTDNTAALFKKNTVAILQHRDKKTDIDVLKGSIHVILEMT

SEQ ID NO: 17549 - DNA, 444 bp, Unknown
  Obtained from environmental sample
  misc_feature (1)..(444): n is a, c, g, or t
atgaattattttttcgaaacaattagatgtgatgattttgaagtttttaatctccattaccacaatcaaagaatatcaagaacaataggacttaatattgatttacaagaatatatctatccaccaacagaccatcttcttagggtaaaagtaatttactcaaaaaacggtattgagaaaattgattactacaaatatacacctaaagagataaaagtgttgaaaatcattgaagatgataaaatagaatataattataaatatcttaatagagaatctatagataatctatattcaaaaaaaagtatagctgatgagataattatagtaaaaaacaagctagttacagatacctctatagcaaatattgncatatataaagaaaataggtggttaacaccaaagcaacccttactaaaagaaccactagagcaagattattag

SEQ ID NO: 17550 - protein, 147 aa, Unknown
  Obtained from environmental sample
  misc_feature (1)..(147): Xaa is any amino acid
MNYFFETIRCDDFEVFNLHYHNQRISRTIGLNIDLQEYIYPPTDHLLRVKVIYSKNGIEKIDYYKYTPKEIKVLKIIEDDKIEYNYKYLNRESIDNLYSKKSIADEIIIVKNKLVTDTSIANIXIYKENRWLTPKQPLLKEPLEQDY

SEQ ID NO: 17551 - DNA, 324 bp, Unknown
  Obtained from environmental sample
  misc_feature (1)..(324): n is a, c, g, or t
atgaatgttaacaaaccatttataattaaagtaaatctgtttgaagagctacataagtataaaccatattttgcagatgcacttagaatttatcgtaatcgtgctttagatcatttgagttgtgattatgagtcaaatagttcaaaaaaaacagcacagcttaagattactatagattcagattattgggaaagtgtatatgaagagattgtgaacatatcaaaatcaaatgtgaaaggagaagaagcattaaataaaataaatacaactgttttactaaacaacataatgagtaccttaattggtattgaacaatataattaa

SEQ ID NO: 17552 - protein, 107 aa, Unknown
  Obtained from environmental sample
  misc_feature (1)..(107): Xaa is any amino acid
MNVNKPFIIKVNLFEELHKYKPYFADALRIYRNRALDHLSCDYESNSSKKTAQLKITIDSDYWESVYEEIVNISKSNVKGEEALNKINTTVLLNNIMSTLIGIEQYN

SEQ ID NO: 17553 - DNA, 597 bp, Unknown
  Obtained from environmental sample
  misc_feature (1)..(597): n is a, c, g, or t
gtgcttaatttgtctaaaatatatttaaagattttaaaaccaaaaacaagaccaatacaaatcgagccttggttttttagatatttaaatgagggacaattaaaagtattgagtgcaattttggctcatgctgattataaaaatagacaagataattcatttgcatcaaatagaactattgcattttatgcagggtttggaactataagaccaggttcaaaagaggaaaaggaatttttaaaattaagtgaagatgaacaaaaaaaacttaaagaaaaaaaacttaaaaatgcaattcaaacagctaaaaacactaaaacacaacttgaaaaattaggagtaattacacgagagatagttggagataaatcttatgcggttgtagatttagagtggagtaaagaaagatatttaaaagagtttgatgaatatttcaatgataaaaaagatacaaataaatcaaccgatgaagatataaaagtagaacttaaaaaactagcaaaattatcagaagatggaaatatatctaaagaaagtttagtaaaaagattagaagatgttacagataaaattattgataaccaatccaataatgac

SEQ ID NO: 17554 - protein, 199 aa, Unknown
  Obtained from environmental sample
  misc_feature (1)..(199): Xaa is any amino acid
MLNLSKIYLKILKPKTRPIQIEPWFFRYLNEGQLKVLSAILAHADYKNRQDNSFASNRTIAFYAGFGTIRPGSKEEKEFLKLSEDEQKKLKEKKLKNAIQTAKNTKTQLEKLGVITREIVGDKSYAVVDLEWSKERYLKEFDEYFNDKKDTNKSTDEDIKVELKKLAKLSEDGNISKESLVKRLEDVTDKIIDNQSNND

SEQ ID NO: 17555 - DNA, 603 bp, Unknown
  Obtained from environmental sample
  misc_feature (1)..(603): n is a, c, g, or t
ttgggcacaattaaaaaaaacgaaatgaaattattattattattattattatcgacattattaatactgactctttcattttactcttatgcacaaacggactatttagatgaaggaaacacttatctgaatagtggagaatttgaaaaggcaaaagaaacatttaaagcaggaatcaaagctgaacctgaaaatttaatttatcaatgtcaacttggactaactctaattcaaaagaaagaatttaaagatgccgaaaaaacacttgaaaaagttctaaaaattgattcaactaatgttgctgctatctggtacagtggaattggtaatttcaaaggtgaacaatatagaaaagcaatcgaaagatttgaaaaagctctgactttactcgatgaaaatagtgggcaatatttttctgcgaattggtttattggcaaaagttattcagttctattacagacagaaggattaacatataatgaaaccgacagaatgtttgaatgttatgatgaatatcttcgattacaaccaaacgcagacgacgctcaaaaaataagagaatatgtcgaaagaaaaagaaaagacgaccttctgataatgtga

SEQ ID NO: 17556 - protein, 200 aa, Unknown
  Obtained from environmental sample
  DOMAIN (66)...(99): TPR Domain
  misc_feature (1)..(200): Xaa is any amino acid
MGTIKKNEMKLLLLLLLSTLLILTLSFYSYAQTDYLDEGNTYLNSGEFEKAKETFKAGIKAEPENLIYQCQLGLTLIQKKEFKDAEKTLEKVLKIDSTNVAAIWYSGIGNFKGEQYRKAIERFEKALTLLDENSGQYFSANWFIGKSYSVLLQTEGLTYNETDRMFECYDEYLRLQPNADDAQKIREYVERKRKDDLLIM

SEQ ID NO: 17557 - DNA, 744 bp, Unknown
  Obtained from environmental sample
  misc_feature (1)..(744): n is a, c, g, or t
atgactgaagaacaaacaattgataaaactatgaagcttgaagtcctagaattaaaattaggagctcagttattaaaacttgttcaaggggatagtgaacttctagataagattaaagggataagaaataaaatagcagcagaactaggttttgtaataccacaaattagaattagtgatgatacctctttacctatgaatgggtactcttttaacttaaaaagaataccaattgctacaggaaatgttgagttaaatcaacttttagcaatgggtggaattgcaggggcacaagtaaaagggaaaagagtaaaagaaccagtatttggtcttgaagctacctggattagtcctgatgataaagatgaagctttaaatagaggctttactattgttgatgctccaacaattatctcaacacatctttcagaattaattaaaaaacatgcagaagatattataacaagacaagatttagtggatattattgatagattaaaagctgattatcctataattgttgaagaggctatgaaagttactacatatggttcacttttaaaagtatgtaaagacttgttacatgaaaatattccattggttgatatgattacaatacttgaagcagtatcagatatagcagaacttacaaaatctcctgatatactacttgagcatgtgcgatcaaagctatttagacttattaccaataaatacccagccaccagatggttcaatgcataa

SEQ ID NO: 17558 - protein, 247 aa, Unknown
  Obtained from environmental sample
  DOMAIN (1)...(247): FHIPEP family
  misc_feature (1)..(247): Xaa is any amino acid
MTEEQTIDKTMKLEVLELKLGAQLLKLVQGDSELLDKIKGIRNKIAAELGFVIPQIRISDDTSLPMNGYSFNLKRIPIATGNVELNQLLAMGGIAGAQVKGKRVKEPVFGLEATWISPDDKDEALNRGFTIVDAPTIISTHLSELIKKHAEDIITRQDLVDIIDRLKADYPIIVEEAMKVTTYGSLLKVCKDLLHENIPLVDMITILEAVSDIAELTKSPDILLEHVRSKLFRLITNKYPATRWFNA

SEQ ID NO: 17559 - DNA, 402 bp, Unknown
  Obtained from environmental sample
  misc_feature (1)..(402): n is a, c, g, or t
ttgatcgctgagtcatccaactntatatgccacaactactctggtgaaaaaatagacaaacataatgtaaatgtatatctagtaaacacaggatggactggtggggcatacggtgttggtaaaagaatgagtatcaaaaatacacgagcttgtattaatggtattttagatggtaaaattgagaatagtgaatttgatacattacctatatttaacctttcaattccaaaaactcttgatggtgtggatacagaagtattaaacccaagaaacacttggcaagacaaatctcaatatgatgaaacagcaaaagaattagctgctatgtatattgaaaactttaaaaaatacttgacagaagatactagttttgatttcacatctgctggaccaaaactataa

SEQ ID NO: 17560 - protein, 133 aa, Unknown
  Obtained from environmental sample
  misc_feature (1)..(133): Xaa is any amino acid
MIAESSNXICHNYSGEKIDKHNVNVYLVNTGWTGGAYGVGKRMSIKNTRACINGILDGKIENSEFDTLPIFNLSIPKTLDGVDTEVLNPRNTWQDKSQYDETAKELAAMYIENFKKYLTEDTSFDFTSAGPKL

SEQ ID NO: 17561 - DNA, 471 bp, Unknown
  Obtained from environmental sample
  misc_feature (1)..(471): n is a, c, g, or t
atgacaaaaaaacaatttttagacgatattcaaaataactgtagtgagatactttatctaagtatgtctcatatgtataataaactttataaagaagatgatactcttttaaatactgatgaaaacagagaattcttatctaactacaaaaattttcatttgtatcttaatgattttgcagggacaatttatagtagatatgcttcaagtatagataatctttatattgagatgtgtaactatctagagattgatatagataacaaatataccttagaacacactataatgaaactagaaaaacaaactcctgagttaatactaggacttactgatgaagatatacaaatgcaaactattgagcattttgatgaaaagcttatagctatagatggttcaactccttataatgcaaacaaagaggagtttcaaccaagagttgaaaaactttcaaaacatattatcctataa

SEQ ID NO: 17562 - protein, 156 aa, Unknown
  Obtained from environmental sample
  misc_feature (1)..(156): Xaa is any amino acid
MTKKQFLDDIQNNCSEILYLSMSHMYNKLYKEDDTLLNTDENREFLSNYKNFHLYLNDFAGTIYSRYASSIDNLYIEMCNYLEIDIDNKYTLEHTIMKLEKQTPELILGLTDEDIQMQTIEHFDEKLIAIDGSTPYNANKEEFQPRVEKLSKHIIL

SEQ ID NO: 17563 - DNA, 345 bp, Unknown
  Obtained from environmental sample
  misc_feature (1)..(345): n is a, c, g, or t
atgggatatttaaaagcaatcatattattaagtgatggaaaaagtttatgtccatatatagagaactttaaatgcaccatttacgaaaatcgtcccactgtttgtaaagcttatcctcttagtacaaatattgacaatattgtatattatgatttaaattgtccaggtattagtgaaatgggaacaaatattgtaaaaaatggaaaaatttcaccctcctttgactcttatatttttgatgattatcaaacaagatatatcaatactcacaaaaaacttgaagaatttaataattttgatgattttgaactagtaacttcaatcaataataataaatttttataa

SEQ ID NO: 17564 - protein, 114 aa, Unknown
  Obtained from environmental sample
  misc_feature (1)..(114): Xaa is any amino acid
MGYLKAIILLSDGKSLCPYIENFKCTIYENRPTVCKAYPLSTNIDNIVYYDLNCPGISEMGTNIVKNGKISPSFDSYIFDDYQTRYINTHKKLEEFNNFDDFELVTSINNNKFL

SEQ ID NO: 17565 - DNA, 957 bp, Unknown
  Obtained from environmental sample
  misc_feature (1)..(957): n is a, c, g, or t
atgttcggtgactcaataaataaaaaaagaaaaattatattagatactatctctacaaaaaaaagacaatatggatttgaagttggaaaattaaaaatgacctataggatagtaactccaatctttcatgataataagcttgtgggggttattgaagttggaattgaaccagaatatatcactgaaaacatcaatcatttatttgaaatacaaacggcacttttaattaaaaaagaatctaaatctatatctttaaataaatcaaaaatggaaagtattgatgactttcttttagctaggggaagtgagttatttaaaaataacttatctactcttggattagatcataaaacaaatactattttctacaataatgaagaatatcaaataaatacaaacttaaatttgtatagccataaaaatgaaattgctgctaagatattactcgcatatagtatgaaagaatataatgaaaaattacatcgtcttattaaaaataatatattcatgaccatatttatattattgatattattgattgttttaaatattggattaaactattttatcaaaaagctacaaaaatttaatattgaaattattgaaaaagaccaaatgatgatacaacattcaaaaatggcagctatgggagagatgcttgaatctatcgctcaccaatggagacagcctttatctattatcactacttctgctagttctatcgtaatgagaaagaaacttggtgtttttgatgaagactctttagaacctacgtgtgatactatagtaagtagtgctaaacacttatctcatacaattgatgactttagaaacttttttaaagatgagaaagaaaaaagattttttcacntaaaaagaacttttagctctacttttagtctgataagctctaaatttaaaatagaaatattatcatcattgaagattttgaaagtt

SEQ ID NO: 17566 - protein, 319 aa, Unknown
  Obtained from environmental sample
  DOMAIN (215)...(285): His Kinase A (phosphoacceptor) domain
  misc_feature (1)..(319): Xaa is any amino acid
MFGDSINKKRKIILDTISTKKRQYGFEVGKLKMTYRIVTPIFHDNKLVGVIEVGIEPEYITENINHLFEIQTALLIKKESKSISLNKSKMESIDDFLLARGSELFKNNLSTLGLDHKTNTIFYNNEEYQINTNLNLYSHKNEIAAKILLAYSMKEYNEKLHRLIKNNIFMTIFILLILLIVLNIGLNYFIKKLQKFNIEIIEKDQMMIQHSKMAAMGEMLESIAHQWRQPLSIITTSASSIVMRKKLGVFDEDSLEPTCDTIVSSAKHLSHTIDDFRNFFKDEKEKRFFHXKRTFSSTFSLISSKFKIEILSSLKILKV

SEQ ID NO: 17567 - DNA, 381 bp, Unknown
  Obtained from environmental sample
  misc_feature (1)..(381): n is a, c, g, or t
atgataacatggatgcaaagacacaaaaaatggctgatagtaacaatctgggttagtacaatagcatttgtaggtgctggttttgttggttggggtagttacaattatggtaagtcagatagtgctgttgcagttgttggagataaagaggttccattagcagatttacaaagtgagtatagcaatctttattcacaatatcaaaatatgcttggtaaaaatttcaatcaagagttagcaaaacaatttaaacttgaagagatggcactacaaagagtgattcaaaaatatttatttttaaattatgcagatgaaattaggattaatgactacagatttagaggttgcaaaagaattagtaaagataccatccttttttaa

SEQ ID NO: 17568 - protein, 126 aa, Unknown
  Obtained from environmental sample
  misc_feature (1)..(126): Xaa is any amino acid
MITWMQRHKKWLIVTIWVSTIAFVGAGFVGWGSYNYGKSDSAVAVVGDKEVPLADLQSEYSNLYSQYQNMLGKNFNQELAKQFKLEEMALQRVIQKYLFLNYADEIRINDYRFRGCKRISKDTILF

SEQ ID NO: 17569 - DNA, 441 bp, Unknown
  Obtained from environmental sample
  misc_feature (1)..(441): n is a, c, g, or t
atgggggtaggattaaataaaaaaatacagccccaaattttaccgtttgaggatgttaatctcaaattaataaaaacatatcagggacaaaaaaacaaacaacttgaagagttagcacaaaaagagcttaaaaactttaatggtacagatatagggtatattacaagagcatctaatgttgagataaatggattaagtaatgaagaaacagcacaagtattacaaaatatttttaaatcatctaaaaaagagaattatatgaacttaggaacaaaagctgtgctgtttaaaattgaagatacaactatgccaacttttgatgaaaaaaatatagagatggttaagtcttcaattgaaggtgcaaaaacaaacgctatcacaagtttgtttttagaaaaactacaaaacaaatatgatgtaaaatcatacttaagcgagtaa

SEQ ID NO: 17570 - protein, 146 aa, Unknown
  Obtained from environmental sample
  misc_feature (1)..(146): Xaa is any amino acid
MGVGLNKKIQPQILPFEDVNLKLIKTYQGQKNKQLEELAQKELKNFNGTDIGYITRASNVEINGLSNEETAQVLQNIFKSSKKENYMNLGTKAVLFKIEDTTMPTFDEKNIEMVKSSIEGAKTNAITSLFLEKLQNKYDVKSYLSE

SEQ ID NO: 17571 - DNA, 429 bp, Unknown
  Obtained from environmental sample
  misc_feature (1)..(429): n is a, c, g, or t
ttgctgctaaaccccatagcagttggtgaaaaaattgtatcacacaacatttattttcagcccaatactcctgttttaaaagataaatcgaaagctgaattagaaaaaatcaaacaatttttaaaagaaaacgacaatattactattgagattcagggacacaccaatggaaatagaagaataaaaaaagacaggaggttttcacaccttaatggagaatggaattttagtggaacagctaaggagctttcgcagcttagagcagaaaaagtaaaaaaatacttggaagaaaatggagtaaatcctaatcagatgactgcaaaaggctatggtggtgataaaatgattgttgaaaatcctaaaaatatgaaagaagccatgaaaaacattagggttgaaattgtggtaattgaacaaataaagcaatga

SEQ ID NO: 17572 - protein, 142 aa, Unknown
  Obtained from environmental sample
  DOMAIN (18)...(129): OmpA family
  misc_feature (1)..(142): Xaa is any amino acid
MLLNPIAVGEKIVSHNIYFQPNTPVLKDKSKAELEKIKQFLKENDNITIEIQGHTNGNRRIKKDRRFSHLNGEWNFSGTAKELSQLRAEKVKKYLEENGVNPNQMTAKGYGGDKMIVENPKNMKEAMKNIRVEIVVIEQIKQ

SEQ ID NO: 17573 - DNA, 1002 bp, Unknown
  Obtained from environmental sample
  misc_feature (1)..(1002): n is a, c, g, or t
ttgannnnggttgatggccgagaactctttatattttcattgtttcttttagcaaattatattatttataatataactgccatcaatcaacaacaaagaattaatgtcactttagaaagtatttcaaatcaacttcaaacacattatgaactacaaatatatcatcaaactattacagcagatgctgcgtataaagccactattatgaaaaaaggtgttattgatattttaaaaaaagttcaaacagcctcaaaaaaagagaaagagactttacgaaaagaactttacgatttacttcttgaagagtatatccctttaaaaattcaaggtgttttacaatatcagtttaaccttaaagataataccgcttttttacgactccacaaaccatctaagtttgatgatgacttaacaaatataagatatagttacaactatgtgaataaataccataaaataatcagaggattagaacaagggaaaactacccatggatttagaaatgtatatccaatttttgatgaaaataaaaactatctgtgtgcagtggaaatatcttactctagtgaccttattcaacaaatgttaacagatgttagtaaaatacacacacactttattgtgaacaaaaaagttatagatgcaagagcttggaaaagtagtgattttgtttctgcatatagaccaagtgatgaaaatgaaaacttcatgatggcacaaatgaaagaacatactatcgctgaacattttgaccactataaagatatgctcaaacagcataaaaagcttatctcanaagcccttgttcaaggtgaaaagtttagtttttatgaaccttacgagaatgaatctcacataatctcattttacccaattaaaaatattaaagataaaaaaactgttgcttggcttgttgcctatcaaaaaaactcctttataaatgaaactctcacaaataccacttatattagagnattagcttttagggtaattaattttttt

SEQ ID NO: 17574 - protein, 334 aa, Unknown
  Obtained from environmental sample
  misc_feature (1)..(334): Xaa is any amino acid
MXXVDGRELFIFSLFLLANYIIYNITAINQQQRINVTLESISNQLQTHYELQIYHQTITADAAYKATIMKKGVIDILKKVQTASKKEKETLRKELYDLLLEEYIPLKIQGVLQYQFNLKDNTAFLRLHKPSKFDDDLTNIRYSYNYVNKYHKIIRGLEQGKTTHGFRNVYPIFDENKNYLCAVEISYSSDLIQQMLTDVSKIHTHFIVNKKVIDARAWKSSDFVSAYRPSDENENFMMAQMKEHTIAEHFDHYKDMLKQHKKLISXALVQGEKFSFYEPYENESHIISFYPIKNIKDKKTVAWLVAYQKNSFINETLTNTTYIRXLAFRVINFF

SEQ ID NO: 17575 - DNA, 720 bp, Unknown
  Obtained from environmental sample
  misc_feature (1)..(720): n is a, c, g, or t
atgagaattcttcaaagagaacgtataaaaaatggatctataaatatctatttttataaaattaatcactctctcatagaatccttagaaaatagaacaactaatatagatactatggcaatagctgttgattcaaatttatttatagatatttctcatgaaaaatatatagaactaaaaacttttgctattacttcattagataacttcaatctaccatcttcagtttttgatgattttgaattagattgtagaaattacaatataagttcacaagattggtgtggtgaatttatgaaatggcttagaaaaaaaattccatcttcttctcttgtagcgagtaaatctaaatttaaggagtctcttgatgagtacaaaccacctcgtgaagtcatagagataacaaaatattttatttcaaaattaaaagcaattgatcctcagtttatagagccatttaatgttttagaatgggcaaaacatgtaaataatcttcttactattaatggttatacaatgcaagatatagaacaaagtattaactggttatttagtgaaaaaggaaactggtatagaccaaatgttaaaaatacggaagatttaaataaaaagttttcatatatcatttcacatgttagaagctatcgtgatggagagagtaaactcccagctaatatagatctatttgaactaattagaaacaggaataaagagtcctaa

SEQ ID NO: 17576 - protein, 239 aa, Unknown
  Obtained from environmental sample
  misc_feature (1)..(239): Xaa is any amino acid
MRILQRERIKNGSINIYFYKINHSLIESLENRTTNIDTMAIAVDSNLFIDISHEKYIELKTFAITSLDNFNLPSSVFDDFELDCRNYNISSQDWCGEFMKWLRKKIPSSSLVASKSKFKESLDEYKPPREVIEITKYFISKLKAIDPQFIEPFNVLEWAKHVNNLLTINGYTMQDIEQSINWLFSEKGNWYRPNVKNTEDLNKKFSYIISHVRSYRDGESKLPANIDLFELIRNRNKES

SEQ ID NO: 17577 - DNA, 711 bp, Unknown
  Obtained from environmental sample
  misc_feature (1)..(711): n is a, c, g, or t
atggaagctggatgtgatgtaatggcagttattacaggacgaggtaaacgagctattacagatcactttgatatctcttatgagttagagcatcaaatcaaagggagtgctaaagaggagcttttaggagatatcagaaatatcatggataagtgtacttttacctatacaagacaaaatgagatgagaggtttaggagatgcaatttataaaggaaatgttcttgtaggctttcaaaatccatttgctgttatccttgcagatgatttatgtgtaaatcctgatggagatggtatcttaaaacagatggtagatctttatcacaaatataaatgttgtgttgtagcaactatggaagtacctaatgaagatgtacataaatatggagttattgaaggtaaagagatagaagatggagtatttatggtatcaaatatggtagaaaaaccagataatgataaagcaccgtcaaatttagctgtaattggaagatatattttaactccagatatttttgatatgattaaaaatacaaaacctggaaaaaatggggagttacaaattactgatgctttatgtgaacaagcaaaaaaagggatggtaatagcatataaatttaagggtaaaaggtttgattgtgggtcagttgatggatttgtagaagctacaaattatttttatgatcaagaaaaaaacaaaaataaaaagtag

SEQ ID NO: 17578 - protein, 236 aa, Unknown
  Obtained from environmental sample
  DOMAIN (8)...(230): Nucleotidyl transferase
  misc_feature (1)..(236): Xaa is any amino acid
MEAGCDVMAVITGRGKRAITDHFDISYELEHQIKGSAKEELLGDIRNIMDKCTFTYTRQNEMRGLGDAIYKGNVLVGFQNPFAVILADDLCVNPDGDGILKQMVDLYHKYKCCVVATMEVPNEDVHKYGVIEGKEIEDGVFMVSNMVEKPDNDKAPSNLAVIGRYILTPDIFDMIKNTKPGKNGELQITDALCEQAKKGMVIAYKFKGKRFDCGSVDGFVEATNYFYDQEKNKNKK

SEQ ID NO: 17579 - DNA, 921 bp, Unknown
  Obtained from environmental sample
  misc_feature (1)..(921): n is a, c, g, or t
atgtgtattgaaaacagacctgacaattgcacaaaaaaagatattgagcaaatgagagaatttggtacaacaagaatcgaaatcggagtacaaatattaaatgacgaaatttacaaaaagactaatagaggtcacaccgttcaagacgtagttgattctacaaaaagacttcgtgacgcaggattcaaaattgggtatcatataatgccaggaatgccttacagtaatccagagcttgacatgaaaagttttgatttattatttaatgactcccgatttaaacctgatcaattaaaattatatccatgccaaatagttgaagattctcctcttgcaaatgtgtataaaaaaattggatatgaaccatatcataatgaattgataaaagaaattttaactaaaatgctaaaaaaaattccaggatactgtcgtattatgagaatgatgagggagattccaaaagaaaaaatgaaggttgaagctgcatcaacttcaatgcgtggagatattcaatcgaacttagaaaaaaagggaatcaaagagattagaatgagagaaattgggtttggtggaaacgatgttgaccttaggacatcattaaagattatggaatatgatgcagcagatggaaaagaattttttctagaagttgtaaataaggatgatatcctatttggactacttagattgagatatccatcanaagacgtctttcttgaagaattaaaaaactgcgcaataattcgtgagcttcatgtttatggacaagctctaaagctagatgaagaaggttctttaaccatcaaaagggtaccccgaaagatttctctaaaaaatctttaccaagggcacaacataaaggaatgggaaaaagaacttatgaagcaagctgaaagtatgtcaaaaaaaagctggatataa

SEQ ID NO: 17580 - protein, 306 aa, Unknown
  Obtained from environmental sample
  misc_feature (1)..(306): Xaa is any amino acid
MCIENRPDNCTKKDIEQMREFGTTRIEIGVQILNDEIYKKTNRGHTVQDVVDSTKRLRDAGFKIGYHIMPGMPYSNPELDMKSFDLLFNDSRFKPDQLKLYPCQIVEDSPLANVYKKIGYEPYHNELIKEILTKMLKKIPGYCRIMRMMREIPKEKMKVEAASTSMRGDIQSNLEKKGIKEIRMREIGFGGNDVDLRTSLKIMEYDAADGKEFFLEVVNKDDILFGLLRLRYPSXDVFLEELKNCAIIRELHVYGQALKLDEEGSLTIKRVPRKISLKNLYQGHNIKEWEKELMKQAESMSKKSWI

SEQ ID NO: 17581 - DNA, 606 bp, Unknown
  Obtained from environmental sample
  misc_feature (1)..(606): n is a, c, g, or t
atgactttttcaaaaactgcttacttaccaacaaaatatgggaagttcaaaataaaagcatataaagatggttgccaagagcatttagccataatgagtgaagatttttctacgatggatattccaaatgtaaggattcattctgagtgtcttacgggagatactcttggaagtttgaagtgtgattgtaacaatcaactccatctagccttgatctatatagcagaacatggaggtgttgtcatttatcatagacaagaggggaggaatataggtcttgtgaataaaattaatgcttattacttacaagacaatggatataacactatagaagcaaatctaaaattggggtttaaagaggatgaaagagattatagttcggtaaagtttatcttaaaagatctacaaattaatagactcaatattatcacaaacaacccagataaaatagatttcttagaacaaaatggtatagaggttataaaacgaatttctgctattactccacataatttatacaataaacattatttacaaacaaaaaaagaatctatgggggcatttactttaaataaggggaaagtatgttnaaaccaggaccaataa

SEQ ID NO: 17582 - protein, 201 aa, Unknown
  Obtained from environmental sample
  DOMAIN (1)...(166): GTP cyclohydrolase II
  misc_feature (1)..(201): Xaa is any amino acid
MTFSKTAYLPTKYGKFKIKAYKDGCQEHLAIMSEDFSTMDIPNVRIHSECLTGDTLGSLKCDCNNQLHLALIYIAEHGGVVIYHRQEGRNIGLVNKINAYYLQDNGYNTIEANLKLGFKEDERDYSSVKFILKDLQINRLNIITNNPDKIDFLEQNGIEVIKRISAITPHNLYNKHYLQTKKESMGAFTLNKGKVCXNQDQ

SEQ ID NO: 17583 - DNA, 363 bp, Unknown
  Obtained from environmental sample
  misc_feature (1)..(363): n is a, c, g, or t
atgttaaaacaagaacaaataaaacaactaaaagaaagattactacaaagaaaagagcaattaatcttagaggtttcctcaagtcaaactattatcaaagatttgttaagtgaaaatacttttgatgaaattgattatgctgaagtttcttcagatagctttaatatgaatacattgagaaacaaacagattgaagagttaaaagagatagatatagttttggagaaaattaaaaataaaacatatggtatttgtgatatgtgtgatgaacaaataggtatcaaaaggttaaaagcaaaaccccatgcaagattttgtgttgattgtcgtcctatatatgaagaaagtttaaaagaaaagtaa

SEQ ID NO: 17584 - protein, 120 aa, Unknown
  Obtained from environmental sample
  DOMAIN (50)...(117): Prokaryotic dksA/traR C4-type zinc finger
  misc_feature (1)..(120): Xaa is any amino acid
MLKQEQIKQLKERLLQRKEQLILEVSSSQTIIKDLLSENTFDEIDYAEVSSDSFNMNTLRNKQIEELKEIDIVLEKIKNKTYGICDMCDEQIGIKRLKAKPHARFCVDCRPIYEESLKEK

SEQ ID NO: 17585 - DNA, 657 bp, Unknown
  Obtained from environmental sample
  misc_feature (1)..(657): n is a, c, g, or t
ttgtattgggaaataatcaccagaacaaacaaaaagaaaatgggaaatttaacagaagaaaaaacaataattgacaaatggattgatcttgtaagacttcattattattacgttactcgctatccaattggaaatattaaatatatagaagcagaaaacaggtatatgtatccagcacctttatttccattggattttttagaactaaaagacacgtatattaaatttttagaagattttaaaaagaaagaattagaatactcaaagaatgaaaatcaattaaaaatattttacagacaacttcaaggtgatttattgttttatttagataactatgtggaattttacaataatgaaattgaagaaataaacgaaatagaaaagcacaatccttatcctgatttattaattttcttcaacaaaacaaaagaattaataactcagaatgatattacaaaagctaatgataaaaccaatttttctccagacggtatttttgaaaactcagacagcaagaatttatttaatgcaattttagaaattttatcaaaattaattcataaaagaaaagccgttggttctaattcagaaaatgaaataaccgaacttatttgccttaatcttaacagtaaattaaaaccaagttatttcctttga

SEQ ID NO: 17586 - protein, 218 aa, Unknown
  Obtained from environmental sample
  misc_feature (1)..(218): Xaa is any amino acid
MYWEIITRTNKKKMGNLTEEKTIIDKWIDLVRLHYYYVTRYPIGNIKYIEAENRYMYPAPLFPLDFLELKDTYIKFLEDFKKKELEYSKNENQLKIFYRQLQGDLLFYLDNYVEFYNNEIEEINEIEKHNPYPDLLIFFNKTKELITQNDITKANDKTNFSPDGIFENSDSKNLFNAILEILSKLIHKRKAVGSNSENEITELICLNLNSKLKPSYFL

SEQ ID NO: 17587 - DNA, 468 bp, Unknown
  Obtained from environmental sample
  misc_feature (1)..(468): n is a, c, g, or t
atgaatacaatcaaaagctcgacaaaagagaaagtaaacttaagagaaatgatagaatcagttcttagacttatggatacagattttaataaaaataaaatcaaaatcatagacaactataagcaagatatagttctaatgacctatcaaaatcaactacgaaatcttttgatgatactggttgaaaatactataaaaacctttagaaatagagatataaaaaatccacaacttaaagtaagtactaccaaaaacggtaaaagtgtaaccataatagttgaagataatgcagggggaataatagaaaaacctatagataaaatctttgagagataccactctgcaagtgattctagcggtataggactttatttagcaaagtatgttttgatggaaaatttagatggagagataagtgttgaaaataatgatggtggggctaagtttattatgatactaaagtgttaa

SEQ ID NO: 17588 - protein, 155 aa, Unknown
  Obtained from environmental sample
  DOMAIN (48)...(155): Histidine kinase-, DNA gyrase B-, and HSP90-like ATPase
  misc_feature (1)..(155): Xaa is any amino acid
MNTIKSSTKEKVNLREMIESVLRLMDTDFNKNKIKIIDNYKQDIVLMTYQNQLRNLLMILVENTIKTFRNRDIKNPQLKVSTTKNGKSVTIIVEDNAGGIIEKPIDKIFERYHSASDSSGIGLYLAKYVLMENLDGEISVENNDGGAKFIMILKC

SEQ ID NO: 17589 - DNA, 687 bp, Unknown
  Obtained from environmental sample
  misc_feature (1)..(687): n is a, c, g, or t
atggccggagttggtatttttaaagaggggcaagatccagctgatatggttgtagcaaataagatggatgaacttaactctatgttttcaaatcctcagccttttatcccttttgttattgattatataacacaaaaatataatttagaaaatccacaagataagcaacaagcattaaaagaatcaaatgagtttttaaaaacactagatccaattttgcaagaggaatatcaaaatttagttgcacggaaattgaatgtcaattctcaacttgtgcaagtacaacactttaataatcaaagagttaatcaagtaaatctaacctctgtgaatatatcagaattaagtattattaaaacgattcttgacaatccaatgttattagaagtggtaaaaaatgagctacaacctgatatgtttgaaacacatgcacatgaatataatatgttattagaagatattaatgatccaaacttacatggactgatgctaaatgaacatataatttcatatacacaagaggagttagataatcaattaaaaatacttcttgttccttattataaaaaaagattacaacaattaaaatttgatgaaaccatagattttaaaataaaagctagaaaaactgttgaacttaaacataaactaattgaactaaatcaaaaaaaactcatagcggtttaa

SEQ ID NO: 17590 - protein, 228 aa, Unknown
  Obtained from environmental sample
  misc_feature (1)..(228): Xaa is any amino acid
MAGVGIFKEGQDPADMVVANKMDELNSMFSNPQPFIPFVIDYITQKYNLENPQDKQQALKESNEFLKTLDPILQEEYQNLVARKLNVNSQLVQVQHFNNQRVNQVNLTSVNISELSIIKTILDNPMLLEVVKNELQPDMFETHAHEYNMLLEDINDPNLHGLMLNEHIISYTQEELDNQLKILLVPYYKKRLQQLKFDETIDFKIKARKTVELKHKLIELNQKKLIAV

SEQ ID NO: 17591 - DNA, 672 bp, Unknown
  Obtained from environmental sample
  misc_feature (1)..(672): n is a, c, g, or t
gtgaaatggtattataccattaccatgataacaaaagactcaatagaaaacttaaaatctcaccttgatgttgttgacattatatctcagtttattgagttaaaaaaaagtggagcaaattttaaagcgtgttgccctttccacggggaagatacaccttcatttgttgtaagtccacaaaagcagatttaccactgttttggttgtggtgtgggtggagattctataaagtttgtgatggagtatgaaaaactttcctacccagaagctatagagaaattagcttccatgtcaaatgtatcattacaatatgataatgatgcaaaaaaagtagacttatcaattattacaaaagtaaataatcactatcaaaaacttttagtatatcatccaaatgctatggattatttaaaacaaaggggagtatcttcctcttcaattgaaaagtttgagatagggtacgctagtagttcacaagatactatcaattatctcaaaacaaattttttaaaccttgcagatgcaaaagagtttgggataattgatacaggacaaaatggactatatgctagatttatagagaggatcacattttccatatataccattaatggaaatattgtaggatttggtgggaaaaacataacctggacacaatggcaaaatatgtaa

SEQ ID NO: 17592 - protein, 223 aa, Unknown
  Obtained from environmental sample
  DOMAIN (10)...(107): CHC2 zinc finger
  misc_feature (1)..(223): Xaa is any amino acid
MKWYYTITMITKDSIENLKSHLDVVDIISQFIELKKSGANFKACCPFHGEDTPSFVVSPQKQIYHCFGCGVGGDSIKFVMEYEKLSYPEAIEKLASMSNVSLQYDNDAKKVDLSIITKVNNHYQKLLVYHPNAMDYLKQRGVSSSSIEKFEIGYASSSQDTINYLKTNFLNLADAKEFGIIDTGQNGLYARFIERITFSIYTINGNIVGFGGKNITWTQWQNM

SEQ ID NO: 17593 - DNA, 417 bp, Unknown
  Obtained from environmental sample
  misc_feature (1)..(417): n is a, c, g, or t
atgaaacatgtagtcccatttgaagcgtcattagcagaacaaggtacaatcattatcaaactctattttagcgttagtaaagacaaacaggcacaaagatttgagcaacgtcgtacagatccgctgagacaatggaaattgagtgaaatagatcttcaagctcaaagcatgtgggaacagttcacaaagactaaatacaatatgttaaaagatacaagtcatgaagatgctccatggcatgttattcgttcaagtgacaaacataaagctcgtttagagactatgaaacttattttaaatcagatcgattatgataacagaagcaaagagctaaactttgaacaagacagaaaaactgtttttactgcaaacgaagagctggcaatcatggatagagctgaaattaaaaaactataa

SEQ ID NO: 17594 - protein, 138 aa, Unknown
  Obtained from environmental sample
  DOMAIN (1)...(110): Domain of unknown function (DUF344)
  misc_feature (1)..(138): Xaa is any amino acid
MKHVVPFEASLAEQGTIIIKLYFSVSKDKQAQRFEQRRTDPLRQWKLSEIDLQAQSMWEQFTKTKYNMLKDTSHEDAPWHVIRSSDKHKARLETMKLILNQIDYDNRSKELNFEQDRKTVFTANEELAIMDRAEIKKL

SEQ ID NO: 17595 - DNA, 837 bp, Unknown
  Obtained from environmental sample
  misc_feature (1)..(837): n is a, c, g, or t
gtgggattttatgcaattataaacaaatgtttttgtcttttggtaatgacaggtggtgagcttactatgttacttcctcttttaggaaagaaaaaatatataactgattcaataataaaatgttttgagatcatgaatgcaaataacagttcacaatattatgctcgtattgattatgttcaaggctctatgattgatgaatttgtgcagtcaactgatgaagcacaaagtatgtttgagatgttagaacactacattgtagagaaaaaattggttgattatatttatgaagttgacagtttgattgatcttcgcggtaacagctatcacaccaaacgtacagagattaataaatttacaaaatcatactctgattatgtgattgaagtgcttgatagtgtaaaacacaaagatgaaattatgaaactatttaataagtgggtatctgatagagtcaaatatatgccacgtgaagaggcagaacactttcttgagggaatatatcaagagcgtcatgctgttaaaaagatgttagataattatgtagaactctctcttattggattagttatatatattaatggagagttaaaagggtttactgttggtgagcgtattagcactgatacggcaactgtaattatagaaaaaacagattttgaggttctaggatgtgctcaattcatttttcgtgagttctctaaaatgcttaaagagtattatggagttacatatattaatgttggtgatgacatgggctttgaaaaccttagaaaagttaagatgtcttatcgtccgtttaaacttgtaccaaaatatacaatttatcaaaaatga

SEQ ID NO: 17596 - protein, 278 aa, Unknown
  Obtained from environmental sample
  misc_feature (1)..(278): Xaa is any amino acid
MGFYAIINKCFCLLVMTGGELTMLLPLLGKKKYITDSIIKCFEIMNANNSSQYYARIDYVQGSMIDEFVQSTDEAQSMFEMLEHYIVEKKLVDYIYEVDSLIDLRGNSYHTKRTEINKFTKSYSDYVIEVLDSVKHKDEIMKLFNKWVSDRVKYMPREEAEHFLEGIYQERHAVKKMLDNYVELSLIGLVIYINGELKGFTVGERISTDTATVIIEKTDFEVLGCAQFIFREFSKMLKEYYGVTYINVGDDMGFENLRKVKMSYRPFKLVPKYTIYQK

SEQ ID NO: 17597 - DNA, 765 bp, Unknown
  Obtained from environmental sample
  misc_feature (1)..(765): n is a, c, g, or t
ttggtaaatactgcacagcaactaaaacagcaaggtcttgaaataaactttattcataagataattcttcgctcattatttttgctgtatctcgaagacaggaaagcaacagatgaaaagttttattccaaaattaagaaaggggcgacatcatattttgatattttggaggatgttgatgcaacttataatttatatgaaaaactagaaggacattttaatggtaatgtctttactgtagaaaaaggtgagaatatttctgttgaacaactacaaaccataaaaaaatgctttatcagtggtgacgacaatacatcacaaacaaaattgtttgaaaattggaggttgtttgattttagtattatacaaattgagttgctaagtgagatttacgaaaatttcttattcaaaacccatcctgaactaaagaaaaaaacaggaacatattacacgcccccttctttggtggagtttattttgaatgaaaaattaccagttgtcaaaaatgaaagaaattacaatgtaaaaattttagacccaagttgcggttcaggaattttcttggtggaaagcttccaacgtttagtgaaacgatatgaaaaccaaacacatgaaaaactaaccgattttgatacgctaaaaaaactcctaaccgataatattttccggaatgaattacacccgcaagctataaaagtagctgcttttagtttgtatctgggcttggtaaataacttaaagcctaaaactatttggcaatataaa

SEQ ID NO: 17598 - protein, 255 aa, Unknown
  Obtained from environmental sample
  DOMAIN (4)...(208): Type I restriction modification system, M protein
  misc_feature (1)..(255): Xaa is any amino acid
MVNTAQQLKQQGLEINFIHKIILRSLFLLYLEDRKATDEKFYSKIKKGATSYFDILEDVDATYNLYEKLEGHFNGNVFTVEKGENISVEQLQTIKKCFISGDDNTSQTKLFENWRLFDFSIIQIELLSEIYENFLFKTHPELKKKTGTYYTPPSLVEFILNEKLPVVKNERNYNVKILDPSCGSGIFLVESFQRLVKRYENQTHEKLTDFDTLKKLLTDNIFRNELHPQAIKVAAFSLYLGLVNNLKPKTIWQYK

SEQ ID NO: 17599 - DNA, 753 bp, Unknown
  Obtained from environmental sample
  misc_feature (1)..(753): n is a, c, g, or t
atgggaaatgttcgtcaaatgttcgtggaaaaaaaggaaaactttgatatagaagcaaaaggactccttttagaactaaaggaaagtttcggattaagtggacttgaaaatgtaagaatattaaatagatatcaaatagaaggtatagacgaaaatatttataatgaatctaaaggtacgatattttcagaacctacagtagatatagtatatgaagaaacatttgaagtaccagcagatactagatactttcttgttgaatttcttctaggccaatatgaccaaagagctgattcggcagcgcaatgtgttcaaattatcagtaaaaaagaaagacctattattaaatcagctaaactaattattgtcgaaggaaacatgacagattctgaatttatgaaaattaaagattactgcattaatccagtagattctcaagaaacagatttaacaatgcctcagtcactagatttaaagacagaagtccctgtagatgttgaaattatcggaggatttacagataagacagaagatgaactaaatatttataaaaatgaaatgggttttgcaatgacgcaagatgatattgttcatatacaaaaatattttaaaaatgaagaaaaaagaaacccaactattacagaattaaaagtattagatacttattggtcagatcattgtcgtcatactacctttatgacaaagataacagacgttgaatttgaagaaggttcatataanaaagaaatttga

SEQ ID NO: 17600 - protein, 250 aa, Unknown
  Obtained from environmental sample
  misc_feature (1)..(250): Xaa is any amino acid
MGNVRQMFVEKKENFDIEAKGLLLELKESFGLSGLENVRILNRYQIEGIDENIYNESKGTIFSEPTVDIVYEETFEVPADTRYFLVEFLLGQYDQRADSAAQCVQIISKKERPIIKSAKLIIVEGNMTDSEFMKIKDYCINPVDSQETDLTMPQSLDLKTEVPVDVEIIGGFTDKTEDELNIYKNEMGFAMTQDDIVHIQKYFKNEEKRNPTITELKVLDTYWSDHCRHTTFMTKITDVEFEEGSYXKEI

SEQ ID NO: 17601 - DNA, 348 bp, Unknown
  Obtained from environmental sample
  misc_feature (1)..(348): n is a, c, g, or t
gtgagtactataatattttatttatgtaccatagactggagaagaaaaagcagaagatgctctaaagccaaaatctacttttttaagatgccaaactttttgcttctaatggtcaaatctgtaatgtttgcaccatttctcatggataaaatattttcaacggcatcggcgatatctgaagctaaaagtgtttttatctcatcatttgagggtttgaaatttaactcactaaaaaagggtgtgtccgtcatgtcagggtttatgctgatgacatttacaccatctttacgaacctcttcaaataacgcttggctaaatgcacgaagcccactctttgtagcactgtag

SEQ ID NO: 17602 - protein, 115 aa, Unknown
  Obtained from environmental sample
  misc_feature (1)..(115): Xaa is any amino acid
MSTIIFYLCTIDWRRKSRRCSKAKIYFFKMPNFLLLMVKSVMFAPFLMDKIFSTASAISEAKSVFISSFEGLKFNSLKKGVSVMSGFMLMTFTPSLRTSSNNAWLNARSPLFVAL

SEQ ID NO: 17603 - DNA, 699 bp, Unknown
  Obtained from environmental sample
  misc_feature (1)..(699): n is a, c, g, or t
atggtaagaggaacactttttgccgcagttgaaaatacaatgaaatttattgtcagtcatttaaaggttgcatttgaaattacaggtaaaacaacacagaggacagaaatatttgaatatccgctaacagcattaagagaacttgttttaaatgctataatccacagagattatacaagtcctactgatattcaaatacgaatttttgataatgaaataactatttttaatccgggtaaattgtatggaaatctaactattgaagacttaaaaacagataattatcaagcccaaagcagaaataagctaattacggaagcattttaccttacaaaagatattgaaaaatatggcagcggataccgccgagtgcgaaaacaaatagcagattatccttcaatgtattttaattttgaagaaaattcaggtggctttttggtgaaaattggatataaagaacaaaaaataatagaaagattaaatgtcgggaaagatgtcgggaaagatgtcgggaaagatgtcgggaaagagcttttattactaatggaaaaatatccaaatattacaattccgcaaatgtcggaaataataaaagtaacacaacgaacaattgaaagacatatagcaaactataaaaaactgaataaattaaaacgtattggtggacgaaaaaatggactctggaaaattataaaataa

SEQ ID NO: 17604 - protein, 232 aa, Unknown
  Obtained from environmental sample
  misc_feature (1)..(232): Xaa is any amino acid
MVRGTLFAAVENTMKFIVSHLKVAFEITGKTTQRTEIFEYPLTALRELVLNAIIHRDYTSPTDIQIRIFDNEITIFNPGKLYGNLTIEDLKTDNYQAQSRNKLITEAFYLTKDIEKYGSGYRRVRKQIADYPSMYFNFEENSGGFLVKIGYKEQKIIERLNVGKDVGKDVGKDVGKELLLLMEKYPNITIPQMSEIIKVTQRTIERHIANYKKLNKLKRIGGRKNGLWKIIK

SEQ ID NO: 17605 - DNA, 678 bp, Unknown
  Obtained from environmental sample
  misc_feature (1)..(678): n is a, c, g, or t
atggaattgaaaattgcagagtttaccaattcgaaagggactcatattaaaatcctgaattatggtgccaaaatcatgtctataaaaaccctggatcggaattctgaacttggagaaattattcttggttacgacacttctgaagagtatttaaaagggaatccttattttggtgctacagtcggaagatgtgccaaccgaatttccaatgcgaaattttcaattggacctaaagtttatcgactcgaacaaaaccaaggtgaagatcatttacatgggggaacaggaggctttcatcaggtattttgggaaatgggtaacgttaaaaaagagactgataaacaaagtataacattaagttataccagcgccgatatggaggaaggctaccccggcgaattaaaggtatttcttacctacacactcaccaacgacaatgagttgatcattgattatttagccgaaagctccaaatcaaccatcgttaatctcacgcatcattcattctttaatttaaaaaatgggggaaagagttctgttaaaaatcatttaataaagattcatgctgataaatatacccctgtttgcgagaaggtaattccaacaggcgaaattaatttgggggctggaactccttttgactttcatcattttcaagaaaatggggagccccattga

SEQ ID NO: 17606 - protein, 225 aa, Unknown
  Obtained from environmental sample
  DOMAIN (5)...(225): Aldose 1-epimerase
  misc_feature (1)..(225): Xaa is any amino acid
MELKIAEFTNSKGTHIKILNYGAKIMSIKTLDRNSELGEIILGYDTSEEYLKGNPYFGATVGRCANRISNAKFSIGPKVYRLEQNQGEDHLHGGTGGFHQVFWEMGNVKKETDKQSITLSYTSADMEEGYPGELKVFLTYTLTNDNELIIDYLAESSKSTIVNLTHHSFFNLKNGGKSSVKNHLIKIHADKYTPVCEKVIPTGEINLGAGTPFDFHHFQENGEPH

SEQ ID NO: 17607 - DNA, 555 bp, Unknown
  Obtained from environmental sample
  misc_feature (1)..(555): n is a, c, g, or t
atgaaaatatcaggatctatctattcggataacaaaagacctttaaaagaaaccattgcagatttagaagctcatcaggtagatttattgcatgtagattgtaatgatgatattcgtgtttttgaggatattgctgatattagaacatggtgtaaactccctatagatttacatatcattaccaaaacgccagaaaagtatttcgatttattaagaaagcatcctgtggaatacgtcacttttcagtacgaagaattgccaacaggttttaaaatgccatctgatattaaagggcaaaaaggcttagcgataattacgcctactgatattactgctttcgatacctttagcgattttgatttcatcttaataatggcaactattccaggacaaagtggaggtgtttttgatcctatcaattttaaaaaaatcagaaatttcaaacaaaaatatccaaacaaaaatgtacatgttgatggtggtgtaaatggagaagtttcttttattttaagaaatatgggggtacatacttcggtttctggcagtttttgttaa

SEQ ID NO: 17608 - protein, 184 aa, Unknown
  Obtained from environmental sample
  DOMAIN (2)...(182): Ribulose-phosphate 3 epimerase family
  misc_feature (1)..(184): Xaa is any amino acid
MKISGSIYSDNKRPLKETIADLEAHQVDLLHVDCNDDIRVFEDIADIRTWCKLPIDLHIITKTPEKYFDLLRKHPVEYVTFQYEELPTGFKMPSDIKGQKGLAIITPTDITAFDTFSDFDFILIMATIPGQSGGVFDPINFKKIRNFKQKYPNKNVHVDGGVNGEVSFILRNMGVHTSVSGSFC

SEQ ID NO: 17609 - DNA, 726 bp, Unknown
  Obtained from environmental sample
  misc_feature (1)..(726): n is a, c, g, or t
ttggtttatcgctcggagattaacgatgcgcgtgaattgcagctatcgttacttcctcattgtgctagtaatattggcaatcttgaaatttgttttgacatgagaacggcatcagaagttggtggtgactattatgattatgaactttctgaagatggagaactttctattgttattggtgatgcaaccgaccatggaatgaaagccggaatgatggtatccatagtgaaaagcttatttcttgcaagagataaaaacattaaaattaaagagttttttaacaattgctctaaaacaattaagcagatgaagctaaaaaatctctttatggcgttaatgttcgttatagtaaaagaaggaaaactaatttcatcttcagctggaataccaccgtttttggtttacagaaagaaaaccaatgagattgaagaattgaaaactaagggaatgcctctcggtgccgtaaatagttttccttatcaaaccatagaaactgagcttggtgtcggagatgttgttcttttaatgacagatggattaatagaattgtttaatgaagaaaaaatccaatttggtgagcaaagaataaaggatatttttttgttgaatgcgcaattacctgtaactaaaataatagaaaaattattgcaggctggggaagaatggattggcaataataatcaaaatgacgatattacacttgttgcgtttagaatgacgaagtaa

SEQ ID NO: 17610 - protein, 241 aa, Unknown
  Obtained from environmental sample
  DOMAIN (51)...(240): Stage II sporulation protein E (SpoIIE)
  misc_feature (1)..(241): Xaa is any amino acid
MVYRSEINDARELQLSLLPHCASNIGNLEICFDMRTASEVGGDYYDYELSEDGELSIVIGDATDHGMKAGMMVSIVKSLFLARDKNIKIKEFFNNCSKTIKQMKLKNLFMALMFVIVKEGKLISSSAGIPPFLVYRKKTNEIEELKTKGMPLGAVNSFPYQTIETELGVGDVVLLMTDGLIELFNEEKIQFGEQRIKDIFLLNAQLPVTKIIEKLLQAGEEWIGNNNQNDDITLVAFRMTK

SEQ ID NO: 17611 - DNA, 867 bp, Unknown
  Obtained from environmental sample
  misc_feature (1)..(867): n is a, c, g, or t
atgatggctgagcggcaaattctggaagagttttcctggtacgttgatgatctgactttgaccggcaatggacagctcaaactggactgggactcagggtacgccgccaaagtaacgccgaaaaaaggatgcaatattgtttcagctcgtttatttggttttgatactatgataacttctaagcatccggcaatgcgtgaatatccaagagtacaaattcaaaatgccggggaccaggataaagtcgtaacgctgaaatttaaattaaaaactgaactgggtaaaatcacaaaacaatggcagcaaaagatatctgtcccgccgcattcatcagtaatgaaaaaaattacttttcccgttgccttgaaaaacgatatttatcatctttatgttaatggagccgggtttaatccttcgtttaacagtgaaaaacatttcatgtatattcagcgcaggaatgaacccgccggaccgaataaatttgctctccatcattttcatgcacgtgctcttggcgactggccggcccctctgccgataggaaaagtgaatcgttataatccctggggatacattgtggggcctgcatggattaaagactgggacggcaataacgggttgaatccagacactcctgcagagcaatggaactggcaagtagaaacagatatatcgattaaagctggaatagaaaccgcggtctgtttgatttctcagccattattggactggcaaagagaaaaaatatatgaaaaaagattaatgggcaaacttgcctggggattgcgtggaggcaagaccaacgcaaaaaaatacagaaggtttgtcaggggaattcgcgaaacgctacaaaggcaaagtgcatga

SEQ ID NO: 17612 - protein, 288 aa, Unknown
  Obtained from environmental sample
  misc_feature (1)..(288): Xaa is any amino acid
MMAERQILEEFSWYVDDLTLTGNGQLKLDWDSGYAAKVTPKKGCNIVSARLFGFDTMITSKHPAMREYPRVQIQNAGDQDKVVTLKFKLKTELGKITKQWQQKISVPPHSSVMKKITFPVALKNDIYHLYVNGAGFNPSFNSEKHFMYIQRRNEPAGPNKFALHHFHARALGDWPAPLPIGKVNRYNPWGYIVGPAWIKDWDGNNGLNPDTPAEQWNWQVETDISIKAGIETAVCLISQPLLDWQREKIYEKRLMGKLAWGLRGGKTNAKKYRRFVRGIRETLQRQSA

SEQ ID NO: 17613 - DNA, 915 bp, Unknown
  Obtained from environmental sample
  misc_feature (1)..(915): n is a, c, g, or t
ttggaaacgggtaattacaccgcaaggcgcatcaccatagaagagcctgtaagtcagaaaaaggtacaggagtacattaatgcaaacaaagcgccatttgttactacgagncaatggtggagacactgtttgagtgaatgggatgcttccaggagcctggtgacaaatgttacttacaattttctatcaggagtcagggattataccttttttggctgggcgacagcgccatctttagccaaaaacatgaagcatgccgcttatatattttcaactacaatagatgatcgcaatattcagaccccgaatctgcactcgctcgcggccggcgttatgaccgcacaattggaaggaatgatgcctggcacaggcagattagttaataaaaatgggattaagggaggtgtttttaagaaaaaaaatggcggagaagttggcgttttgtggagtcccaacggaaagaaaacggttctgcttgaatgtgcggatgccaagccggaagttgtttcaatttttggtcagtcccacgacgttattcaaatgaacactaaaggaaagaaatatctgcaactggaaataacaaaattacctttgtatatccatacagccattcccggactgaagctggtttctataatttctgatatttattccaagcggcttccggatattttatcgccgtcacttccaccgcttaagcgttataaggtttcatataaaattaccaattactacgattccaagtggaacggtacggttaaatctgaagctgggcaaggtggaaaagtagctaaaaggacaatcgatttctcgctgaacccgggggacagcacggtcatcgataataccttttttattccgcggaacagtgaaaataccaggttcatctggggcatgaactgtccatgcccctga

SEQ ID NO: 17614 - protein, 304 aa, Unknown
  Obtained from environmental sample
  misc_feature (1)..(304): Xaa is any amino acid
METGNYTARRITIEEPVSQKKVQEYINANKAPFVTTXQWWRHCLSEWDASRSLVTNVTYNFLSGVRDYTFFGWATAPSLAKNMKHAAYIFSTTIDDRNIQTPNLHSLAAGVMTAQLEGMMPGTGRLVNKNGIKGGVFKKKNGGEVGVLWSPNGKKTVLLECADAKPEVVSIFGQSHDVIQMNTKGKKYLQLEITKLPLYIHTAIPGLKLVSIISDIYSKRLPDILSPSLPPLKRYKVSYKITNYYDSKWNGTVKSEAGQGGKVAKRTIDFSLNPGDSTVIDNTFFIPRNSENTRFIWGMNCPCP

SEQ ID NO: 17615 - DNA, 438 bp, Unknown
  Obtained from environmental sample
  misc_feature (1)..(438): n is a, c, g, or t
atgtttggtataaataactcaaaggataaacttgaaattttagaatcagatttcaaaaaatttacagcaaatccattagatatttctttagctgaaaaaacttgttctgatgcttggcatatggcagattggctatttgaagaacaaaaacaagctgataaatcattaacaaaaaagatatttagagatagtctttttagcgaatgtcctgaaatgaaaatattgcatgatatcgctaatacttataaacataagacattggatagaccaaaagtttttatcaaaaaaactgaaaagcgtgaaggcggatttagctctggattttcaaaaggttttgatgtttctagacttgaagtttacttctctaataataagaaaatagatttggacgatttaattcatattgcaattgattattggaaatcaaaattatcgtga

SEQ ID NO: 17616 - protein, 145 aa, Unknown
  Obtained from environmental sample
  misc_feature (1)..(145): Xaa is any amino acid
MFGINNSKDKLEILESDFKKFTANPLDISLAEKTCSDAWHMADWLFEEQKQADKSLTKKIFRDSLFSECPEMKILHDIANTYKHKTLDRPKVFIKKTEKREGGFSSGFSKGFDVSRLEVYFSNNKKIDLDDLIHIAIDYWKSKLS

SEQ ID NO: 17617 - DNA, 846 bp, Unknown
  Obtained from environmental sample
  misc_feature (1)..(846): n is a, c, g, or t
atgatgccaattaaatcccttattgggacagggaaaaaacagattacctttgatctggttccttcaactcaagcagctgaatattcagttgaagatgtaattgtgacaataaaattgttccccatttatcagcaaaaaatgaaagaactggaactggaaactttgtatgattcaattgagctacctctttttagaacccttgctaagatggaagagaacggtgtgtttattgatacaggttttcttagtaagctatctaaaaaaaatcaaaagtatttggcagaacttaccagcggaatctatgaaatagccggaagccagttcaatcttaattctacccagcaattgggaaaggttctcttcgaagatcttggtattcctcctattaagaaaacaaaatcaggttactcaaccgatattactgtattggaaactctggctaaagagcatgagatagcaaggttattgatggattatcgtcagataacaaaaatggaatcaacctatatcaaagctctacctgtgcttatcaaccctgcaacaaatcgtattcactcctcttttaatcagacagttgcttcaactggtcgtctatccagttccaacccaaatatgcagaatatcccgataagaagtgaattaggaaaagagatccgcaaggcttttgttccccanagggatgataccgttctcgtagcatcagattattcccaaatcgaatttgaggtactggcgattccttcgaaagatcagaagttgattgaagcattccgtgataaaggtgatatccatagccagaccgcccgcattatctatgaaaaatctttagatggaggttaccactga

SEQ ID NO: 17618 - protein, 281 aa, Unknown
  Obtained from environmental sample
  DOMAIN (77)...(281): DNA polymerase family A
  misc_feature (1)..(281): Xaa is any amino acid
MMPIKSLIGTGKKQITFDLVPSTQAAEYSVEDVIVTIKLFPIYQQKMKELELETLYDSIELPLFRTLAKMEENGVFIDTGFLSKLSKKNQKYLAELTSGIYEIAGSQFNLNSTQQLGKVLFEDLGIPPIKKTKSGYSTDITVLETLAKEHEIARLLMDYRQITKMESTYIKALPVLINPATNRIHSSFNQTVASTGRLSSSNPNMQNIPIRSELGKEIRKAFVPXRDDTVLVASDYSQIEFEVLAIPSKDQKLIEAFRDKGDIHSQTARIIYEKSLDGGYH

SEQ ID NO: 17619 - DNA, 465 bp, Unknown
  Obtained from environmental sample
  misc_feature (1)..(465): n is a, c, g, or t
ttggaagtatgggtttattcggaaaaaaatgaaaaatatggtagtgcttccgttaaagatgggcttaacggaaaaattaaccaatttttcaaattggaacatggtagcaagtttacacgattcaatttaatgaaaatgaaaaattttataagattaaggtcagcgataacagtcgatgtggaagatgccgtcagtcttgccatgcgcaatttttttaataaacgtattgaaccgacggagcgcgtattaaaaaatacccgtcagatattaagtatatttagggcctatgatgtaaaagggactttttttatccttggcgaagtcgcggataagtatcccactttggttaaagaaatagacagggccgggcatgaaatcggcgtccatggactttcccatattgagttttttaaaatgacgccgggtaaagcatataatgaaataagcaagcaaaaaaccacataa

SEQ ID NO: 17620 - protein, 154 aa, Unknown
  Obtained from environmental sample
  DOMAIN (47)...(154): Polysaccharide deacetylase
  misc_feature (1)..(154): Xaa is any amino acid
MEVWVYSEKNEKYGSASVKDGLNGKINQFFKLEHGSKFTRFNLMKMKNFIRLRSAITVDVEDAVSLAMRNFFNKRIEPTERVLKNTRQILSIFRAYDVKGTFFILGEVADKYPTLVKEIDRAGHEIGVHGLSHIEFFKMTPGKAYNEISKQKTT

SEQ ID NO: 17621 - DNA, 672 bp, Unknown
  Obtained from environmental sample
  misc_feature (1)..(672): n is a, c, g, or t
ttgattttttcgaaagaaaagaaaaatatgaattttcctgttttatttttcctaatcaaaaacagttttaaatgggtatttaagcgtcggttggcatttcatgggaaaaatcaaatgggtggtaaagccggtaaaacccattcgtattttatcgggtttttttctaaagggcaagtggttcctgtagaaatcgataatgaatattccctatcacaagaactnttaggcgctatatcaaatgactgccaggcttttaatggttacataaaaatcaataggtctccgatgttctgtaattggagatattttaatcatccatcccgaaaatatggcatggtatttgtggataaagggtctaaaacatgtgcaggcattttcacgataacgcaaaagggtaaaaatcgtgaaatggtggtagtagatatcataggcccgccaaagtttatgccggaattgtttaaaaaattgatacaagcaggaaaaaaatctgaggtagattttattgctgtaatgaacaataatttttacaatactcaagaactttggaagtatgggtttattcggaaaaaaatgaaaaatatggtagtgcttccgttaaagatgggcttaacggaaaaattaaccaatttttcaaattggaacatggtagcaagtttacacgattcaatttaa

SEQ ID NO: 17622 - protein, 223 aa, Unknown
  Obtained from environmental sample
  misc_feature (1)..(223): Xaa is any amino acid
MIFSKEKKNMNFPVLFFLIKNSFKWVFKRRLAFHGKNQMGGKAGKTHSYFIGFFSKGQVVPVEIDNEYSLSQELLGAISNDCQAFNGYIKINRSPMFCNWRYFNHPSRKYGMVFVDKGSKTCAGIFTITQKGKNREMVVVDIIGPPKFMPELFKKLIQAGKKSEVDFIAVMNNNFYNTQELWKYGFIRKKMKNMVVLPLKMGLTEKLTNFSNWNMVASLHDSI

SEQ ID NO: 17623 - DNA, 384 bp, Unknown
  Obtained from environmental sample
  misc_feature (1)..(384): n is a, c, g, or t
atgaacattttgtttataaccatcagctggccccgggagggcgaaagaaacatctataccgacctgatggacgaatttattaaaaacgggcacactgtttttgtggtctgttcggacgaacagggtttgaataaatcgacgcgagtagccattgaaaaaaaactgcatatacttcaagtcaccagtggaaatataaaaaaagccccgtacataaaaaaaggcgtggccctgttactgcttggttggcaaatgaaaagcgcgattcgtagttattataaacacgctgattttgatttgattgtttgctccacgccgcccataaccctatctggtttagtcgcatatcttaaaaatagtatcaaatccctctgtatttgctgttaa

SEQ ID NO: 17624 - protein, 127 aa, Unknown
  Obtained from environmental sample
  misc_feature (1)..(127): Xaa is any amino acid
MNILFITISWPREGERNIYTDLMDEFIKNGHTVFVVCSDEQGLNKSTRVAIEKKLHILQVTSGNIKKAPYIKKGVALLLLGWQMKSAIRSYYKHADFDLIVCSTPPITLSGLVAYLKNSIKSLCICC

SEQ ID NO: 17625 - DNA, 483 bp, Unknown; identical to SEQ ID NO: 8127
  Obtained from environmental sample
  misc_feature (1)..(483): n is a, c, g, or t

SEQ ID NO: 17626 - protein, 160 aa, Unknown; identical to SEQ ID NO: 8128
  Obtained from environmental sample
  misc_feature (1)..(160): Xaa is any amino acid

SEQ ID NO: 17627 - DNA, 378 bp, Unknown
  Obtained from environmental sample
  misc_feature (1)..(378): n is a, c, g, or t
atgattaagcttcaaaatatttataaaagtttttcaaaaacaagagttttgcaagatataaatttagagataaaagagggtgaggtagtagttctaagtggagtaagtggaagtggaaaatcaactctactctcaataattggtgcaataatgaagccaagtagtggtttagtggaagttaatggagaaaatattgtaagtttaagtgatttttatttatctgaatatagaaatgcaagccttggttttataacacaatccttttatctttttgaaatgcttagtgttagagaaaatgtaattgcaccacttcttttaaataaattaaatcaaaaagagatacttgaaaaaaccgataaggctatgcaaaaagcgtga

SEQ ID NO: 17628 - protein, 125 aa, Unknown
  Obtained from environmental sample
  misc_feature (1)..(125): Xaa is any amino acid
MIKLQNIYKSFSKTRVLQDINLEIKEGEVVVLSGVSGSGKSTLLSIIGAIMKPSSGLVEVNGENIVSLSDFYLSEYRNASLGFITQSFYLFEMLSVRENVIAPLLLNKLNQKEILEKTDKAMQKA

SEQ ID NO: 17629 - DNA, 888 bp, Unknown
  Obtained from environmental sample
  misc_feature (1)..(888): n is a, c, g, or t
gtggagggaacattagagattaaactctatccaaaaaatacacttattccggcacttgctgtctttggcgcggcaagcagtggagagatagatgcatttcattctggtccatactactggaaaggcaaaaatagtgctttttcactctttagtggaattccatttggctttactgctgaggaaataaactcatggatgctctttggtggtggcatggagctttggcgtgagctttatgcaaaatataatctttatccttttctaggtggaaatacaaatattcagatgggtggatggttttctaaaccgatcaattcactaaaagatatgaatggcttaaaaatgcgtattccaggtcttggaggtgaagtattttcaaagatgggtgtaaaccctattttattgcctgcaggtgagatatatacatcactagagcgtggtgtgattgacgctactgagtgggtgggaccagcccttgacattaagatgggattttataaagttgcaccatattactattcaggttggcatgagcctggaagtgtattagagctgacatttaataaaaacttttttaacaagttagctaatgagcataaagcgattattgaagtctgctcatctgagatgaatgcaaatatgatgtatgagtttcactcagaaaatataagcgccctctcaaagttaaaagagttaggtgttactttagaaaaatatccacaagatgtaattatagctggtaaaaaagctctggttgaagtattagatgaacagagtaaattaaacagcgattttaaaaaagtagctgatcagattgagagtagattaatactatcaaaagcttgggatgatgtaagtttaaaagagtttttaaatactagaacataa

SEQ ID NO: 17630 - protein, 295 aa, Unknown
  Obtained from environmental sample
  DOMAIN (1)...(262): Bacterial extracellular solute-binding protein, family 7
  misc_feature (1)..(295): Xaa is any amino acid
MEGTLEIKLYPKNTLIPALAVFGAASSGEIDAFHSGPYYWKGKNSAFSLFSGIPFGFTAEEINSWMLFGGGMELWRELYAKYNLYPFLGGNTNIQMGGWFSKPINSLKDMNGLKMRIPGLGGEVFSKMGVNPILLPAGEIYTSLERGVIDATEWVGPALDIKMGFYKVAPYYYSGWHEPGSVLELTFNKNFFNKLANEHKAIIEVCSSEMNANMMYEFHSENISALSKLKELGVTLEKYPQDVIIAGKKALVEVLDEQSKLNSDFKKVADQIESRLILSKAWDDVSLKEFLNTRT

SEQ ID NO: 17631 - DNA, 969 bp, Unknown
  Obtained from environmental sample
  misc_feature (1)..(969): n is a, c, g, or t
ttgtcgtggtacatgtattacatgctattgagtgtttctcttgtaagtattatggtgtttatttataattttaaacaatttagtataaaaaacacaacagataaagcaataagcatagctcaaaatgtgagagatggtttaacagctcatatggtaaatggtactatggataaaagagcgctatttctagataatattgctaccaatcaaaaaatagaaaattttcatcttttaagagctccttctgttgtaaatcaatatggaatagggttttatggagagacaagaatatcttcactagaagaaaaagttgttaaaacagcaaaactacaaactaaacttattgaaactatagataatgtaatattaaaagtgagtattccatatattgcaagagcagatgcaaaacctaattgtctagagtgtcatactgctaaagagggtgatgttcttggggttattagtatggacttagaggtaagttcaacacgaatggaaggtgtatttatagcttctaagattttgtttatattgttagtaattttagttatctccatttttgtagcaaattattttataagaccatatataaaactttttgatgatttagaaaatgggatattacaagcatatagaggtgatttctcttataaagtggatactacacttaaaaatgaagctggaaaagttgcagatagacttaatgagttatctgaaatctataggtttaaaaagacaattgagttagatgaaaataaaatagtgatatataacagaattgttcatatacttcaaagtaaatttaaaataagtaaatttatattttttgagattaataataaaaataaaataagagaagttattttcgactccgctgatttaaacgggatagagntggatgaaaatgcaaatgtttgtagatcatttagaacttcaatcatgtatatttcagtgactttgatgatttaa

SEQ ID NO: 17632 - protein, 322 aa, Unknown
  Obtained from environmental sample
  misc_feature (1)..(322): Xaa is any amino acid
MSWYMYYMLLSVSLVSIMVFIYNFKQFSIKNTTDKAISIAQNVRDGLTAHMVNGTMDKRALFLDNIATNQKIENFHLLRAPSVVNQYGIGFYGETRISSLEEKVVKTAKLQTKLIETIDNVILKVSIPYIARADAKPNCLECHTAKEGDVLGVISMDLEVSSTRMEGVFIASKILFILLVILVISIFVANYFIRPYIKLFDDLENGILQAYRGDFSYKVDTTLKNEAGKVADRLNELSEIYRFKKTIELDENKIVIYNRIVHILQSKFKISKFIFFEINNKNKIREVIFDSADLNGIEXDENANVCRSFRTSIMYISVTLMI

SEQ ID NO: 17633 - DNA, 414 bp, Unknown
  Obtained from environmental sample
  misc_feature (1)..(414): n is a, c, g, or t
atgatagatgttgatttttttaaaaaagtaatgattagttttggacatgatgttggagatgaagttattaaagacctagcaaaaattatgaaagaatctactagaaattcagatatcgctgttagatatggtggtgaagagtttcttatattgttacaaaacaccacaaaagaaaaaactttaaaaattgcaaaaatgataaatgagaagtttaaatcagaggtttttagtgcaaattcaaccactttttcgaaaacattaagtgttggaatttcttattatccaagtgatgcagatacattatggaaagcgataaaatatgcagatgatgcactttacaatgcgaagaacaatggacgagataaagtggttgagtttgagctttttatgcatagtggaggagaagattactaa

SEQ ID NO: 17634 - protein, 137 aa, Unknown
  Obtained from environmental sample
  DOMAIN (1)...(122): GGDEF domain
  misc_feature (1)..(137): Xaa is any amino acid
MIDVDFFKKVMISFGHDVGDEVIKDLAKIMKESTRNSDIAVRYGGEEFLILLQNTTKEKTLKIAKMINEKFKSEVFSANSTTFSKTLSVGISYYPSDADTLWKAIKYADDALYNAKNNGRDKVVEFELFMHSGGEDY

SEQ ID NO: 17635 - DNA, 306 bp, Unknown
  Obtained from environmental sample
  misc_feature (1)..(306): n is a, c, g, or t
atgatggctcggaggaattttagggagaggacagcaagttatgtaaacaacaatattgacttaaaactaaatctaaaaacagaccttggaagcagcgtgtctaaaatacctgtagttggttatatactcttaggagaggacactatctcaacaaccatgaaaatcagcggaaagctgaacgaccctgaagtaaaaagtttaatagcaattgatatagccgtagcaccactaaatattataaaaagaactttgttgttaccgtttcatttgtttgaaagtgacgaggaagaagaaaagaaagagtag

SEQ ID NO: 17636 - protein, 101 aa, Unknown
  Obtained from environmental sample
  misc_feature (1)..(101): Xaa is any amino acid
MMARRNFRERTASYVNNNIDLKLNLKTDLGSSVSKIPVVGYILLGEDTISTTMKISGKLNDPEVKSLIAIDIAVAPLNIIKRTLLLPFHLFESDEEEEKKE

SEQ ID NO: 17637 - DNA, 666 bp, Unknown
  Obtained from environmental sample
  misc_feature (1)..(666): n is a, c, g, or t
ttgataagtgttatagaacttgctcgctatggtgtggtaaatatacgtaaggcttacggtaattggaaaaacgctaatttaaaaacttgggaagatgtgctgcatgagtatgcaattcaacccatccagcaattcgatttaactaaaggtaaaaacgccacagacatggcactggttattgatgttatggatgttttatatacaaaagatgtagatgttatttgtttagtctcatcagattgcgattttacccccttagtcactagagcactggctgatggtaaaaccatcatcgggtttggagagcgcaaagctcctatgccatttgtgaatagttgttctcgatttttatttctcgatgatgacccaagtgaagatattccattacctacagccactaaaagcttaaacaagaacacaaagctcatcagtttattgaggcaagctattgaagctgtagaggaagatgacggatgggcaatgttaggacctataggtactcatatttctaatcatgcctcctttgatcaacgtaattatggcttcaagaagctgagtgatttattcgcatctatagatctttttgatatgaaaaaaaccaacggctcagtcatttgggtaaaagacaaaaaaaggcataaaacggcaaacggtaaggggaaataa

SEQ ID NO: 17638 - protein, 221 aa, Unknown
  Obtained from environmental sample
  DOMAIN (7)...(124): Protein of unknown function DUF88
  misc_feature (1)..(221): Xaa is any amino acid
MISVIELARYGVVNIRKAYGNWKNANLKTWEDVLHEYAIQPIQQFDLTKGKNATDMALVIDVMDVLYTKDVDVICLVSSDCDFTPLVTRALADGKTIIGFGERKAPMPFVNSCSRFLFLDDDPSEDIPLPTATKSLNKNTKLISLLRQAIEAVEEDDGWAMLGPIGTHISNHASFDQRNYGFKKLSDLFASIDLFDMKKTNGSVIWVKDKKRHKTANGKGK

SEQ ID NO: 17639 - DNA, 522 bp, Unknown
  Obtained from environmental sample
  misc_feature (1)..(522): n is a, c, g, or t
ttgcaagacaatccaaattatgctttagtacattcgaattctataacagtggatgaaaatgataatgaaataggtacactagatatgagtaataaaaaaaatagtggagatatatttgagtctataatatatgggaaaggtggtattaatacaccttctcacttgtatagaacttctgtatataatattataggatattatgatcctagcttaaagtttgaagacacagatttttggcttagacttactaagcattttcaaataggatttataaataaaatgcattcatattatagatggcatggtgaaaatttaagtgatagtaaaaataagttaaagttttataatgatgagattataaaaatatttaaaaaaaatattgatgatgagttgttgaaaaaatatgcagtatcaaaaatgtatagaaagtcttttttaagagcattacgaacttttgaattagcttattttgttaaaaatttcataaagtttataaaatgtaaactttttaatagatgttaa

SEQ ID NO: 17640 - protein, 173 aa, Unknown
  Obtained from environmental sample
  misc_feature (1)..(173): Xaa is any amino acid
MQDNPNYALVHSNSITVDENDNEIGTLDMSNKKNSGDIFESIIYGKGGINTPSHLYRTSVYNIIGYYDPSLKFEDTDFWLRLTKHFQIGFINKMHSYYRWHGENLSDSKNKLKFYNDEIIKIFKKNIDDELLKKYAVSKMYRKSFLRALRTFELAYFVKNFIKFIKCKLFNRC

SEQ ID NO: 17641 - DNA, 678 bp, Unknown
  Obtained from environmental sample
  misc_feature (1)..(678): n is a, c, g, or t
ttggattatcgactagataatataggtatcaaattaaatgattttttcaaaaggttaattataggtcatataaaaaaccgagatataaagtgctatcttgctggttcttgtttgaagtcggataattttgctgatttagatctgtttttcccctcaaatgaagatagagagttaataaataatgctatgaataaagattattttgagtatgagaataattcatatacttatagatacaaaaatgatatatatcaacttgtttatagagaaaggtttaaaggagctactttaaaagagcttgtagatggttttgattttgactcaacgaagatagcttttgagtgtaattataatacgaaaaaaagactatttactattgttaaatgtgatatgagaatagagtttgtcgattatattaatacaaggatcaataatttatcgaaagtaagtttgaatccatttgtatcactacaacgagccatttacttcctaaaaagaggagatgatgttccctataatgtatttttacaagtgtgttctaaaatagctgatttaaaaatagaaaataatgaagatacctcttttcatttcaaaaacttacaaggaaatccaaataaattaacaaatattaaagatgcaattacacattatattgaagaccacaaagaggagaactaa

SEQ ID NO: 17642 - protein, 225 aa, Unknown
  Obtained from environmental sample
  misc_feature (1)..(225): Xaa is any amino acid
MDYRLDNIGIKLNDFFKRLIIGHIKNRDIKCYLAGSCLKSDNFADLDLFFPSNEDRELINNAMNKDYFEYENNSYTYRYKNDIYQLVYRERFKGATLKELVDGFDFDSTKIAFECNYNTKKRLFTIVKCDMRIEFVDYINTRINNLSKVSLNPFVSLQRAIYFLKRGDDVPYNVFLQVCSKIADLKIENNEDTSFHFKNLQGNPNKLTNIKDAITHYIEDHKEEN

SEQ ID NO: 17643 - DNA, 807 bp, Unknown
  Obtained from environmental sample
  misc_feature (1)..(807): n is a, c, g, or t
ttgtatctattggtctatactgcttatttatatttaggtttatatagtgttggaataccttttgatttaatcaaatcaattgaaagttttattgcaatgatatttatagtattcagtggattcattttaatattgacattggtagttccaattattgttagtattatttatttagacaataatacattaaatataataatagttatatttttaattgtaatagtaagttattatttaattactaaaacttataaatttgtctttttttatactttcctaaaatttttagttcttttcctttgtaatatattgtgtagaattatacctatagttactcttttaattttattgtcattaccatttgtttatgttttagaattgattttttcaaagaataaagcatatacaagtcaaccaacactattaataaacttatataaagatttttatggttatccaaatgttattgaagtaaaagataaaaaatatattttagttggtaaagatgagacaacatatcaagtatataatttgaataaaaccgttaactattattatataagtaataaagatagtaaagcaacaaaaaaactatgtattaatatagaagatataattcaaaataaggataaaaaagatgatatagcattaaaactattaatgttctctccgaataacaatattgataacgatttaaaatatttaaaaatcaatgatacaaacataactaaaaaatacgaatatagtgctaaaaatattgatttaaatactacattattgataaataattgtcaaggtataaattag

SEQ ID NO: 17644 - protein, 268 aa, Unknown
  Obtained from environmental sample
  misc_feature (1)..(268): Xaa is any amino acid
MYLLVYTAYLYLGLYSVGIPFDLIKSIESFIAMIFIVFSGFILILTLVVPIIVSIIYLDNNTLNIIIVIFLIVIVSYYLITKTYKFVFFYTFLKFLVLFLCNILCRIIPIVTLLILLSLPFVYVLELIFSKNKAYTSQPTLLINLYKDFYGYPNVIEVKDKKYILVGKDETTYQVYNLNKTVNYYYISNKDSKATKKLCINIEDIIQNKDKKDDIALKLLMFSPNNNIDNDLKYLKINDTNITKKYEYSAKNIDLNTTLLINNCQGIN

SEQ ID NO: 17645 - DNA, 606 bp, Unknown
  Obtained from environmental sample
  misc_feature (1)..(606): n is a, c, g, or t
atgacagatcggctgagatatagatttggtaaaacggctgatattggtattgaagatatttttttggaaaaagaagttttgaatgtaagaaaatcatctatattatctgatatttctgaaagaaatccagaattatttacatttaaaaggataaaaacttatcataaaaaatttgataaaaataataaacttgttggcaacactatttttgaacttgataatgaagaatcaattggaacaagaaagttttttaagatgtctgctcctattttagatacattgaaaaatggaaaaatattaattatagatgagttagattcaagtttacatcctatgttaacaaaatctttaattgagatgtttcatgacgaaaaaataaatacaaaaaatgctcaacttatttttgcaacacatgatacaaatttattaacaccaacactttttagaagagatcaaatttggttggctgaaaaggataaatatggtgctaccaatatctattcactagctcagtttaacgatgtaagagcaaaagaaaattttgagaaaaattatattcaaggtaagtatggtgcagttccatatcttggaaagtttgagttttaa

SEQ ID NO: 17646 - protein, 201 aa, Unknown
  Obtained from environmental sample
  misc_feature (1)..(201): Xaa is any amino acid
MTDRLRYRFGKTADIGIEDIFLEKEVLNVRKSSILSDISERNPELFTFKRIKTYHKKFDKNNKLVGNTIFELDNEESIGTRKFFKMSAPILDTLKNGKILIIDELDSSLHPMLTKSLIEMFHDEKINTKNAQLIFATHDTNLLTPTLFRRDQIWLAEKDKYGATNIYSLAQFNDVRAKENFEKNYIQGKYGAVPYLGKFEF

SEQ ID NO: 17647 - DNA, 468 bp, Unknown
  Obtained from environmental sample
  misc_feature (1)..(468): n is a, c, g, or t
atgtcggaagtggtttcggaaatttttgtaaaggagattgacatctctaaaatatcagttggcgatagcgcaacggtatctttcgatgcgctggagggtacaataataaccggcaatataaaaacaatagccagagtaggtgaaaatcataaagactttgatatgaaagtgtttaaggttttaattcatctccacgaaagtaatgaaggacttaaacctgcaatgacaagtaataacgatattattctagccaattacgacagtgccctatttgtgccactaaatactgttttcagggagaatggcaaaaagtacgtctatttaaaaacaccggatggagcaaaaaaacagaccattgttacaggtctggacaatgaagaatttattgtggtaaaaagtggaataaatgaaggagatcttctgttactggaaccaccaattaatccggaagaattagctataaattaa

SEQ ID NO: 17648 - protein, 155 aa, Unknown
  Obtained from environmental sample
  misc_feature (1)..(155): Xaa is any amino acid
MSEVVSEIFVKEIDISKISVGDSATVSFDALEGTIITGNIKTIARVGENHKDFDMKVFKVLIHLHESNEGLKPAMTSNNDIILANYDSALFVPLNTVFRENGKKYVYLKTPDGAKKQTIVTGLDNEEFIVVKSGINEGDLLLLEPPINPEELAIN

SEQ ID NO: 17649 - DNA, 792 bp, Unknown
  Obtained from environmental sample
  misc_feature (1)..(792): n is a, c, g, or t
gtgtttaattggctgcctgagcataaaaaattgtattccaaaaaatttgcttctgcggttttaaaaactcttttaaacaaatattcttgtgagcattttattccaaaacaacaattaactgaaatttgtacaaccaagcaggagattgaaaaattacttaaaaaatgggggaagataatgataaaagcaccctggagtagttcagggcgcggattacaacccattaccaaaacacccgttcacccaaaagtttgggataaaatacttgcaatagttaacgatcaggggtatgtaattgtagagccttatttaaacaaagcactcgaccttgcctttttgtttgaaataaaaaaggggaaaattaattttattggattgagcaattttactaccgattataaagggcaatacaacggaaataatttaaacggactgcctgacaaattagataccgaaattttagaatttgcccgttttataccaaagaaaattattccttcattaatcgagatattggaattaaccgagctggcgaaattttacgaaggtttttttggagtagatacacttatatacagaaacgcaaaaaatgagttaaaaataaatccctgcctcgaaattaatgttcgccaaagtatgggactactctctcttcagcttgaaaagtttgttcacccgagtaaaaaaggagtttataaaatgttttttaagcctggacaaacattttttcaattcaaaaaagtaatggaaggcaagaaccctttaaaaattactaatgctcagtcgatctga

SEQ ID NO: 17650 - protein, 263 aa, Unknown
  Obtained from environmental sample
  misc_feature (1)..(263): Xaa is any amino acid
MFNWLPEHKKLYSKKFASAVLKTLLNKYSCEHFIPKQQLTEICTTKQEIEKLLKKWGKIMIKAPWSSSGRGLQPITKTPVHPKVWDKILAIVNDQGYVIVEPYLNKALDLAFLFEIKKGKINFIGLSNFTTDYKGQYNGNNLNGLPDKLDTEILEFARFIPKKIIPSLIEILELTELAKFYEGFFGVDTLIYRNAKNELKINPCLEINVRQSMGLLSLQLEKFVHPSKKGVYKMFFKPGQTFFQFKKVMEGKNPLKITNAQSI

SEQ ID NO: 17651 - DNA, 300 bp, Unknown
  Obtained from environmental sample
  misc_feature (1)..(300): n is a, c, g, or t
atgagtaagttgagttatttagagaagctattggatggggttgaggttgagtggaaaaagttagctgatgtttttcagcttaaaaatggatatacaccatcaaaatcaaaaaaagaattctgggaaaatggaactgttccatggtttagaatggacgacatccgagaaaatggccaaatccttgatggttcgctacaaaaagtttcagagagtgcaatcaaaaggggaaagctatttcctgaaaattcaataataattgccccatcagcaactattggaaaacaccctttgaatccgggt

SEQ ID NO: 17652 - protein, 100 aa, Unknown
  Obtained from environmental sample
  misc_feature (1)..(100): Xaa is any amino acid
MSKLSYLEKLLDGVEVEWKKLADVFQLKNGYTPSKSKKEFWENGTVPWFRMDDIRENGQILDGSLQKVSESAIKRGKLFPENSIIIAPSATIGKHPLNPG

SEQ ID NO: 17653 - DNA, 651 bp, Unknown
  Obtained from environmental sample
  misc_feature (1)..(651): n is a, c, g, or t
atggttttgctagggataaggttttttgatgtttttataaaagaagatgactatatctgttttaaacttgtagatagtaaagatacctttgaaatctacccatttaattttgaactctatttagcatatagactaataaacaataagcttgaagtatcatataaagtagtaaacaaatctcaaaaagagatgcttttttctataggtgcacaccctgcttttaattggcccttaaaaaaagacaataaagaagactactattttgagtttgaaaagactaaagaattagaaagactgccactaacccaagatggaatatcagacaataaagagatagtagatttagaaaacagtaaattatatttaaatgaaaaactttttaaagatgatgccctagttattgaaaacttagaaaataaaactatcaatttaaaaaatactcaagacactagaagtataaagatgagttttgatggatttgattatcttggactttggtcaaaacctagtggtgcaccctttgtttgtattgagccttggcatggtattgctgattttataggacataacaaaaaactcgaagaaaaaaaaggaataatcactttacttgcaaatgagatatttgaaagtagttatactatttcaatataa

SEQ ID NO: 17654 - protein, 216 aa, Unknown
  Obtained from environmental sample
  DOMAIN (1)...(203): Aldose 1-epimerase
  misc_feature (1)..(216): Xaa is any amino acid
MVLLGIRFFDVFIKEDDYICFKLVDSKDTFEIYPFNFELYLAYRLINNKLEVSYKVVNKSQKEMLFSIGAHPAFNWPLKKDNKEDYYFEFEKTKELERLPLTQDGISDNKEIVDLENSKLYLNEKLFKDDALVIENLENKTINLKNTQDTRSIKMSFDGFDYLGLWSKPSGAPFVCIEPWHGIADFIGHNKKLEEKKGIITLLANEIFESSYTISI

SEQ ID NO: 17655 - DNA, 831 bp, Unknown
  Obtained from environmental sample
  misc_feature (1)..(831): n is a, c, g, or t
atgagtgtaaaagagagctacaaacaaaagtttgaccctaaaaatgagttggttgtcatcataggcacaattcaaagttttagaacaaacaacaaagatggtagaaagttttatgatgaaaatggaaactatcaagagctactaaaatcttatgatgttaaatactctttagaaaatgtcatgaagcattacaaacctatcattattctagatgaagctcataaatctagtacagggcttagtttagaaaatttattagcattaaaaccatcttttatattagaatttacagcaactccaataacaaaaacaagtaaagcaaaaagtatctatgcgagtaatattttatatagtgtaacagccacagaattaaaaaaagaaagtatgataaaactcccgattttgcttaagactcttgatgataaaaaagctatcttaaaagatggtattgaaaaaagaatgtatttagaagaattagctttgatggaagaaaatagtacaaacagatatatacgaccaataaatctaatacgagcggatgaagatagaggcgatgatgctttaacttatgataaaatcaaaactattttaatagaagaatttaatataaatgaagatgagatagctatccaaacaggaaataaaaaagagatagatggtattgatttattaagtcgtgattgtaagataagatatattataacagtagatgcactaaaagaggggtgggattgtcccttcgcttatgtgttgagtgttgtttcaaatatggaatctagtacggctatagaacaacttattggtagagttttaagaatgccatatgtttga

SEQ ID NO: 17656 - protein, 276 aa, Unknown
  Obtained from environmental sample
  misc_feature (1)..(276): Xaa is any amino acid
MSVKESYKQKFDPKNELVVIIGTIQSFRTNNKDGRKFYDENGNYQELLKSYDVKYSLENVMKHYKPIIILDEAHKSSTGLSLENLLALKPSFILEFTATPITKTSKAKSIYASNILYSVTATELKKESMIKLPILLKTLDDKKAILKDGIEKRMYLEELALMEENSTNRYIRPINLIRADEDRGDDALTYDKIKTILIEEFNINEDEIAIQTGNKKEIDGIDLLSRDCKIRYIITVDALKEGWDCPFAYVLSVVSNMESSTAIEQLIGRVLRMPYV

SEQ ID NO: 17657 - DNA, 912 bp, Unknown
  Obtained from environmental sample
  misc_feature (1)..(912): n is a, c, g, or t
ttggagtttgaggagggaattatattagattatattgatatatcagataaaaatcttatagagaatgctacattaaatattgatgagtttagtataaatgtaaatgaacacttaataataattgatattgagaataataaggtaagaaataaagagatagatacaaataaagcatctttatttgtcgaagaagaaaatgaagagatggcaaaaataatccatgaacataatattgaaattaacaatcctaaacttacagctaacctatcgaatatagtatcaaagattatcataaatgaaaatagagatattttaaatattttagattctaaacaacttaaagagtttatatcgttaataatcattaaattaacaaaaagagaagatattgatttgcatttacttgaaggtaagaaatatcaattaaaaagagcaattttaattaaaataaaagatatggtattaaaatctaaaaaacaaagttttaaaaagttatttgatagtgacaactttttgataaatagtgaaaacttatttatatttacacaaaataattatatcccaaatcctgatagtagaagtggtaattttaaaaaacataaatatgaaagtgtgcataaatttgatagtaaagaagaatatgatgttgcactttatattgataaaatgccaaatgttgccacatggataagaaatatagataaagattctattaattcattttggcttcaaactgcaataggaaagttttatcctgattttataatcaactttgataatggtaaaactgtagttgccgagtataagggagatgtatatattcctgaatatgaaaaaactaaaaaacctattggtgatgcttggggtatgttaagtgaaaattatgaatttatatcctcgagccgattctga

SEQ ID NO: 17658 - protein, 303 aa, Unknown
  Obtained from environmental sample
  misc_feature (1)..(303): Xaa is any amino acid
MEFEEGIILDYIDISDKNLIENATLNIDEFSINVNEHLIIIDIENNKVRNKEIDTNKASLFVEEENEEMAKIIHEHNIEINNPKLTANLSNIVSKIIINENRDILNILDSKQLKEFISLIIIKLTKREDIDLHLLEGKKYQLKRAILIKIKDMVLKSKKQSFKKLFDSDNFLINSENLFIFTQNNYIPNPDSRSGNFKKHKYESVHKFDSKEEYDVALYIDKMPNVATWIRNIDKDSINSFWLQTAIGKFYPDFIINFDNGKTVVAEYKGDVYIPEYEKTKKPIGDAWGMLSENYEFISSSRF

SEQ ID NO: 17659 - DNA, 771 bp, Unknown
  Obtained from environmental sample
  misc_feature (1)..(771): n is a, c, g, or t
ttgcctgcgggagattttttagaatggctgggagaagataaaaaggtcaatcttgaaacagatcaggaacgttctagaattgctcggctgtttatgaaaaagatgatcgtgactatgaagaaagttattattccaagattggatggtgactacacgaacccatacgataaggatactgtcaccctgccaaaagcacagattgaagaagcacctccagcacaatttcctcaagagatactcaagcaagtgacaaaagccaatagccctttagcaaaagatttacttgatgaatacatagcagagaaaaccaccagcggcttttggaaacacaatactatatctgactattcatctcatttttctttatttaaagagtgttttggagaaaagccaattaacgaaattatacgaaaagatattttgggttaccgagaaaatatacttaagagacttcctgccagaagaaatataataccacgcctaaagagaatgtctttagagcagcaattagccgatactcgatatccaaagataggcataaagactatcaatagttatttgggtacgattagcagctttttcatttggtgtatggatcaagctcatattttccataaccctgtgtcgaaacaaaatcttaaagacccaagaaatccacacacaatgagaccagcttactccaaacaagacttagagaaaattgttattggattaagcaaactaccacaaacagggatcaacagtcagaaaaatatctcgagccgatcttga

SEQ ID NO: 17660 - protein, 256 aa, Unknown
  Obtained from environmental sample
  misc_feature (1)..(256): Xaa is any amino acid
MPAGDFLEWLGEDKKVNLETDQERSRIARLFMKKMIVTMKKVIIPRLDGDYTNPYDKDTVTLPKAQIEEAPPAQFPQEILKQVTKANSPLAKDLLDEYIAEKTTSGFWKHNTISDYSSHFSLFKECFGEKPINEIIRKDILGYRENILKRLPARRNIIPRLKRMSLEQQLADTRYPKIGIKTINSYLGTISSFFIWCMDQAHIFHNPVSKQNLKDPRNPHTMRPAYSKQDLEKIVIGLSKLPQTGINSQKNISSRS

SEQ ID NO: 17661 - DNA, 384 bp, Unknown
  Obtained from environmental sample
  misc_feature (1)..(384): n is a, c, g, or t
atgtcaagtagatttgccaaaatagaggtacatagtttgtttaataagcaaatctctaaagcacaaacgataggtgaagttgagtctcaaaaagcatacaacgaattatatattccaaaactctcaacagggtataatatagcgcttgatgtattaggaaaacaaatagatagttttaagttcagtacacttttagaggataaaactacaatcaatttttttataggtggcgcatatggatttgatagaaattttttaaaaaaatgcgatagaactgtatctcttagccaactcacaatggcacataaagtagcaaacttagttttgtgtgaacaagtttttagatctctttgtatattgaataaccatccttatcataaataa

SEQ ID NO: 17662 - protein, 127 aa, Unknown
  Obtained from environmental sample
  DOMAIN (1)...(126): Uncharacterized ACR, COG1576
  misc_feature (1)..(127): Xaa is any amino acid
MSSRFAKIEVHSLFNKQISKAQTIGEVESQKAYNELYIPKLSTGYNIALDVLGKQIDSFKFSTLLEDKTTINFFIGGAYGFDRNFLKKCDRTVSLSQLTMAHKVANLVLCEQVFRSLCILNNHPYHK

SEQ ID NO: 17663 - DNA, 900 bp, Unknown
  Obtained from environmental sample
  misc_feature (1)..(900): n is a, c, g, or t
ttggatatattaaatttaaaagtaggagcaaacttaatgaaagtgttagtaataggaggcagtggatttattggcactcgattagttgatgtactgctagaacaaggacatgacgtttcaatattcgataaacaaattagcaaaaagtaccctacactcacagttcagggcgatgtaaggtcagttgaaaaactaaaacaagcaatggacggagtagattcattatttaatctagctgcagaacatcgtgatgacgtatcccctaaatctttatactcagaagtaaacatcgaaggcgcgaaaaatatagttttagccgccaaacaaacaaatgtcaaaaggattgtgttcacctctagcgtcgcgatctatggtttgaataaagaatcccctaccgaagagacagatgctgatccatttaatgagtatggaaggacaaaatggcaagctgaattaatattcagacattggcacagcgaagataatacacgaaatcttattatttttagaccagcagtcgtttttggtgaaggtaatcgcgggaatgtttacaacttaataagccaaatacaatccggtcggtttataatggtaggcaaaggtacgaataaaaagtcaatggggtatgttggaaacttagctcaaatacttgcatcgcaactctttaatactgggaacaaaacatacaattactgtgacaaacctgatttaaacagcaaagaaatcagtgacattatcgcaaatgaacttggagtagaattaccctcattctcaataccaatttcaattggcgtacttgcaggatacttttttgatataacagcgtatatgttaaaacggaaaattcccaatagtttaataagattaaaaagtttacggccgaaacacaataaatactag

SEQ ID NO: 17664 - protein, 299 aa, Unknown
  Obtained from environmental sample
  DOMAIN (15)...(253): short chain dehydrogenase
  misc_feature (1)..(299): Xaa is any amino acid
MDILNLKVGANLMKVLVIGGSGFIGTRLVDVLLEQGHDVSIFDKQISKKYPTLTVQGDVRSVEKLKQAMDGVDSLFNLAAEHRDDVSPKSLYSEVNIEGAKNIVLAAKQTNVKRIVFTSSVAIYGLNKESPTEETDADPFNEYGRTKWQAELIFRHWHSEDNTRNLIIFRPAVVFGEGNRGNVYNLISQIQSGRFIMVGKGTNKKSMGYVGNLAQILASQLFNTGNKTYNYCDKPDLNSKEISDIIANELGVELPSFSIPISIGVLAGYFFDITAYMLKRKIPNSLIRLKSLRPKHNKY

SEQ ID NO: 17665 - DNA, 957 bp, Unknown
  Obtained from environmental sample
  misc_feature (1)..(957): n is a, c, g, or t
atgactgatcatggaaatatgtttggagcaattgatttttacaagcaaatgaaagcggctgatataaagcctatcattggaatggaaggttacatacataacggcgaaacgttaggtgataaaagtactaaacagcgttttcatatttgtcttttagctaaaaataaaataggctatgaaaatcttatgtatttatcctctcaagcctatattgaaggtatgtactattttccacgtataaataaaaaggaactagctcttcatagtgaaggtctaatctgtacatctgcatgtctgcaaggagaagtaaactggcatcttaacttagccaatgaaagaaatgtaagaaatggtgctttaggttacgagggtgctaaagctgttgccttagagtacaaagagatatttggtgaagatttttacctagaacttatgagacacggtattggtgaccaactccatatagataatgatatacttaagatagctcaagagacagacataaaaataattgcaacaaatgacacgcactatacttacccaggagatgctcagtatcatgaagcatttatgtgtatcgggatgaataaactttatgatgatccaaatcgtatgcgtcactcggtacatgagttttatctaaaaagtcctgagcagatggctagactttttgctgatattcctgaagcaattacacatacacaagagatagtcgaaaaaatagaaaattttgtaccaattgtaaaaacaccgacacctccaaactttaaatttacaaaagagtatgctgcaaaaagaggtcttgacattgacttntcagatgaccctccattagcacctaatgcaagcgaagatgataagaaaagcatatgcttagtgctgataaaaacgatgccgagtatttttattataagtgtcgtgaaagggctaataaagcgtctaaaaatagtaaccaga

SEQ ID NO: 17666 - protein, 319 aa, Unknown
  Obtained from environmental sample
  DOMAIN (45)...(185): PHP domain C-terminal region
  misc_feature (1)..(319): Xaa is any amino acid
MTDHGNMFGAIDFYKQMKAADIKPIIGMEGYIHNGETLGDKSTKQRFHICLLAKNKIGYENLMYLSSQAYIEGMYYFPRINKKELALHSEGLICTSACLQGEVNWHLNLANERNVRNGALGYEGAKAVALEYKEIFGEDFYLELMRHGIGDQLHIDNDILKIAQETDIKIIATNDTHYTYPGDAQYHEAFMCIGMNKLYDDPNRMRHSVHEFYLKSPEQMARLFADIPEAITHTQEIVEKIENFVPIVKTPTPPNFKFTKEYAAKRGLDIDXSDDPPLAPNASEDDKKSICLVLIKTMPSIFIISVVKGLIKRLKIVTR

SEQ ID NO: 17667 - DNA, 429 bp, Unknown
  Obtained from environmental sample
  misc_feature (1)..(429): n is a, c, g, or t
ttggccaagatccctgatcagggcggcaaaatctggcaccggatgggggatcttggatggaaggattcaaagggaagaatatggttttgcggaagaaaaaaccacagggtcatcaccagagatgagacactgttcactatccctgtggaagccattttcaacaaccatgaaaacgtgttcagaagcgcccttacaggtgtgggccctaaacacatgcagacaccggttgtgtttatagagccctgttcaaaaatagaagataaaaatgactttatcaatgaactgctggaccttgcaaaatcaaaccctttaacggaaatgattgagcatatttttattgaaaaagcctttcctgttgacatccggcataactcaaagatattcagggaaaaacttgccgttaaagcaaataaaaaactgaatttataa

SEQ ID NO: 17668 - protein, 142 aa, Unknown
  Obtained from environmental sample
  misc_feature (1)..(142): Xaa is any amino acid
MAKIPDQGGKIWHRMGDLGWKDSKGRIWFCGRKNHRVITRDETLFTIPVEAIFNNHENVFRSALTGVGPKHMQTPVVFIEPCSKIEDKNDFINELLDLAKSNPLTEMIEHIFIEKAFPVDIRHNSKIFREKLAVKANKKLNL

SEQ ID NO: 17669 - DNA, 885 bp, Unknown
  Obtained from environmental sample
  misc_feature (1)..(885): n is a, c, g, or t
atgaccaattacatgattccggaaaactacttgaacaaaatgccggaagattttcattctcctgaacttgcagctcagattagaaaggatgataaacaggctttaattgaacaggtaatggattacgaggatgattttccagataaattcgggaaaatgagatattttgaagcgcatcgctttactataaaaagaaataatgccaagcctctactgtgcggtctttctgtggatattactaaacgcagaatggttgagaaaactcagaaagttcttttctccatcgccaatgcagtcaatacaaccaaagatttgaatgagctttacaacataatcagagaacagctgggaacaattttcgacaccaccaatttttttgtagctctggaaaatctccaaaatgataatatcaagctctcttataataaggatgaaagaaattccagtaatcaaatcaaaccacaagattctatttgctcttatgtgttaagaacaggagaacctcttctggttaaccaggagctaagagaaaaactgattgaacaaggcgaaactggtccaagcgattatcctgctaaaatctggatgggggtgcctctaaaaaatggtgataaagttgtgggggttgttgcagtgcatagctatacgaatcctgatttatacagtcagtcggacttggatattctgacttttgtttcggaagagatcgcgctggcaattgaacagaaacgtgctgatgatcagataaaaagtgatttggcagagaaagaaatccttataaaagagattcatcaccgggttaagaataatatgcagattatttccagaatgcctaaactaccatcacgatatatccatgatgaaaccgccctgggatctttttaa

SEQ ID NO: 17670 - protein, 294 aa, Unknown
  Obtained from environmental sample
  DOMAIN (104)...(240): GAF domain
  misc_feature (1)..(294): Xaa is any amino acid
MTNYMIPENYLNKMPEDFHSPELAAQIRKDDKQALIEQVMDYEDDFPDKFGKMRYFEAHRFTIKRNNAKPLLCGLSVDITKRRMVEKTQKVLFSIANAVNTTKDLNELYNIIREQLGTIFDTTNFFVALENLQNDNIKLSYNKDERNSSNQIKPQDSICSYVLRTGEPLLVNQELREKLIEQGETGPSDYPAKIWMGVPLKNGDKVVGVVAVHSYTNPDLYSQSDLDILTFVSEEIALAIEQKRADDQIKSDLAEKEILIKEIHHRVKNNMQIISRMPKLPSRYIHDETALGSF

SEQ ID NO: 17671 - DNA, 336 bp, Unknown
  Obtained from environmental sample
  misc_feature (1)..(336): n is a, c, g, or t
atgacaaaggaaacactcttcgggaaaaccctcagcgaattacagacgatcgtgctggatttaggtttacccaaattcaccgctggacaaatcgccgactggctctataaaaaggacatcacttcgatagatgaaatgagtaaccttgcgaaaagctcgcgtcaggttttaaatgaaaattttgaatttggactcactcccagctcaaaagttcaggaatcggttgacggaaacaagaagtatctttttccctgcggtcagcacaaaattattgaggcagcctatattcccaatgaaaatgaaaaaccctttgtgtttcttcccggtgggaagtaa

SEQ ID NO: 17672 - protein, 111 aa, Unknown
  Obtained from environmental sample
  misc_feature (1)..(111): Xaa is any amino acid
MTKETLFGKTLSELQTIVLDLGLPKFTAGQIADWLYKKDITSIDEMSNLAKSSRQVLNENFEFGLTPSSKVQESVDGNKKYLFPCGQHKIIEAAYIPNENEKPFVFLPGGK

SEQ ID NO: 17673 - DNA, 522 bp, Unknown
  Obtained from environmental sample
  misc_feature (1)..(522): n is a, c, g, or t
atgacagatgccatgatagaaaaagcccgtataaatgccgataagttagactttaacaatgttgaattcagaaaaggtgacattgaaaacttaccaataggaggcaacagtattgatgtggtggtgagtaattgcgtgttaaatttagttccagataaaaataaggcttttcaggaaacatttagagtgttaaaaccaggcggacatttttctgtttcggatgtggtactaaaaggaaacctgccagaaaagttaaaaaacgatgctgaaatgtatgctggctgcgtatcaggagccattcaattagatgaatatttagagattattaaaaatgcaggctttaaaaacattactgttcaaaaagaaaaaagcattgtattgcctaaagagattgttgctgaatatttatctgagcaagaactagcgaaatattacgaatctccagattttggtatttatagtgtaacggtttatgctgaaaaagccgaaagttgttgtgatccaagttcaaactgttgttaa

SEQ ID NO: 17674 - protein, 173 aa, Unknown
  Obtained from environmental sample
  misc_feature (1)..(173): Xaa is any amino acid
MTDAMIEKARINADKLDFNNVEFRKGDIENLPIGGNSIDVVVSNCVLNLVPDKNKAFQETFRVLKPGGHFSVSDVVLKGNLPEKLKNDAEMYAGCVSGAIQLDEYLEIIKNAGFKNITVQKEKSIVLPKEIVAEYLSEQELAKYYESPDFGIYSVTVYAEKAESCCDPSSNCC

SEQ ID NO: 17675 - DNA, 972 bp, Unknown
  Obtained from environmental sample
  misc_feature (1)..(972): n is a, c, g, or t
atgcttgaagatttttttggacaacatgatttagctgaaaaagagcagatgatatttttagcacttttaaaagaggaatatggtggaagtgatgaatcaattcgagatatgaactctttgatgncattggtttcaagtgatgattatgagaagataaagcacagaagtttactagaagagagtggaaatcttatctccaatggattgattgattatgacgaaatgttaacaccttttggtggaatcaatagaaacttttatattccagagtcaattttatataagatatcacatccagttaaaaaagagaaaagacaacaaaaaataaagcttgatatgctaatacaagatcaagagatgtttgaacttattgagcctaaaaaatctttagaagatgttgttttaaatgaaaaaacaaaaaaaactcttgatttgttattaagacaagttgataaagatgttgttgacagactgaaaaaatggggaataaaagataagaaaaaagggattgatgctagaattattttctatggagcagcaggtacagggaaaacaatcacagcattagctcttgcaaaatcactcaaaaaacaagttttaagttttgattgtagtaagattttatctatgtatgtgggtgagagtgaaaaaaatgtacgaaaaatatttgatgaatacaaagagttatgtacaaaaactaaaacagaaccagtactattgttaaacgaagcagatcagtttttaagtaatcgtgtaagtggacaaataagtggtagcgataaaatgcacaatcaaatgcaaaatatatttttagagcagattgagagatttgagggaatactagttgcaactactaatttattagatagtatagataaagcattttcaagaagatttaattacaaaattgagtttttaaaaccgagatttggagcaaagaaaaattttatggagaactctcctccacgataa

SEQ ID NO: 17676 - protein, 323 aa, Unknown
  Obtained from environmental sample
  DOMAIN (173)...(323): ATPase family associated with various cellular activities (AAA)
  misc_feature (1)..(323): Xaa is any amino acid
MLEDFFGQHDLAEKEQMIFLALLKEEYGGSDESIRDMNSLMXLVSSDDYEKIKHRSLLEESGNLISNGLIDYDEMLTPFGGINRNFYIPESILYKISHPVKKEKRQQKIKLDMLIQDQEMFELIEPKKSLEDVVLNEKTKKTLDLLLRQVDKDVVDRLKKWGIKDKKKGIDARIIFYGAAGTGKTITALALAKSLKKQVLSFDCSKILSMYVGESEKNVRKIFDEYKELCTKTKTEPVLLLNEADQFLSNRVSGQISGSDKMHNQMQNIFLEQIERFEGILVATTNLLDSIDKAFSRRFNYKIEFLKPRFGAKKNFMENSPPR

SEQ ID NO: 17677 - DNA, 645 bp, Unknown
  Obtained from environmental sample
  misc_feature (1)..(645): n is a, c, g, or t
ttggaaaatattaaacatttaagtggtgaggagtttataaagttattgtatgaagagtttccaaatctaaaaaaaatagtagtaggatatgactttcattttggacatcaagctaaatctaatattgataatttaaaaaagttatttaatggtgatgtggttgtagttgatgagtataaagtatcaaatatagcagtacactcaagggttataagagagtatttaagagatgggaatttagaagttgctaaggaacttttagggtataactatagcttacaagggaaccctatcgtaggacaaggattaggctcaaagcagtttgtcccaacaataaacatagatgtaaaagattttttaataccacaagagggtatttatgttactaaaactattctaaataatcactcttataaatcagtttcttttatagggcatagggtatctacagatgggaaatttgctgtagaaacacatatattagaagatatctcatcactagagattcctaaaaaggtagagattgtattttttaaaaaattaagagaaaataaaaagtatgaaaagtatgaagagttaaaagaacaaattttagaagatatagaacaggcaaaaagctggtttaaaaagagagaaaaaaattga

SEQ ID NO: 17678 - protein, 214 aa, Unknown
  Obtained from environmental sample
  DOMAIN (86)...(209): Riboflavin kinase / FAD synthetase
  misc_feature (1)..(214): Xaa is any amino acid
MENIKHLSGEEFIKLLYEEFPNLKKIVVGYDFHFGHQAKSNIDNLKKLFNGDVVVVDEYKVSNIAVHSRVIREYLRDGNLEVAKELLGYNYSLQGNPIVGQGLGSKQFVPTINIDVKDFLIPQEGIYVTKTILNNHSYKSVSFIGHRVSTDGKFAVETHILEDISSLEIPKKVEIVFFKKLRENKKYEKYEELKEQILEDIEQAKSWFKKREKN

SEQ ID NO: 17679 - DNA, 498 bp, Unknown
  Obtained from environmental sample
  misc_feature (1)..(498): n is a, c, g, or t
atggataacactttctctttaaagaatataatacaaaaattagatttttttcatagattgaatgaaaaacaaattaatagattaagtgaaatatccaccattgaaagttatgagagagattacatcttatcttatgaaaaaactaaaataaataaattgttttttttagttgaaggtttagcaaaagcttataaaattgataaatatgaaaatgaaatttttttatttcatatttatcaaaataatatgatttcagaaatattagatactaataatgatgaattggaatttttttcaaatatatcttttataaaagattctaaagtattaattgttgattataaaggcttcaaacatgagtttttagaacaaaatatacttaattctgagtttactaatcaaattgttttacaatctataaaattacaatcgcttattaatagagaatttatatatgatgcagtatctaaagttgccaaaatgataagtactgattag

SEQ ID NO: 17680 - protein, 165 aa, Unknown
  Obtained from environmental sample
  misc_feature (1)..(165): Xaa is any amino acid
MDNTFSLKNIIQKLDFFHRLNEKQINRLSEISTIESYERDYILSYEKTKINKLFFLVEGLAKAYKIDKYENEIFLFHIYQNNMISEILDTNNDELEFFSNISFIKDSKVLIVDYKGFKHEFLEQNILNSEFTNQIVLQSIKLQSLINREFIYDAVSKVAKMISTD

SEQ ID NO: 17681 - DNA, 312 bp, Unknown
  Obtained from environmental sample
  misc_feature (1)..(312): n is a, c, g, or t
ttggttcctagtcttgcacatcttgatgactatttaaaagagcaagtgatagtagaagcaaaatattatagatatgtagataaacaacaaaaacagatagaaaagatgaaaaagatgctaaatctaaaaataccagaagatttcatctacgataacttacctggactttcatcagaagttatcgaaaagcttaaaaagttcaaaccaccaacactttttaacgcttcacaaataagcgggattaccccaagtgcagtggatattatccatcttcatatagatatgaaaaataaaaaagttactgtacaataa

SEQ ID NO: 17682 - protein, 103 aa, Unknown
  Obtained from environmental sample
  misc_feature (1)..(103): Xaa is any amino acid
MVPSLAHLDDYLKEQVIVEAKYYRYVDKQQKQIEKMKKMLNLKIPEDFIYDNLPGLSSEVIEKLKKFKPPTLFNASQISGITPSAVDIIHLHIDMKNKKVTVQ

SEQ ID NO: 17683 - DNA, 732 bp, Unknown
  Obtained from environmental sample
  misc_feature (1)..(732): n is a, c, g, or t
atggctgggataaatgcaagtttagctattgaaaataaagagccttttgtattaagaagagatgagagttatattggagttttaatagatgaccttgtaacaaaagggacaaatgaaccatatagaatgttcacaagtagagctgaatacagacttcttttaagagaagagagtgccgatatgagacttatgggatatggacatgattttggacttatagatgatgatacttacaatacaatgactcacaaaaaacaaactatcaaagaatctgtagagtttatggaaaatgagtggttcacatcaaaaaaagaaaatctaacacttcttgaagagttaggtgaagacaaaatttcagaccaaattttacttgtagatttagtaggaagaaatactatcacaaaagaaaaatttgatagattggttcctagtcttgcacatcttgatgactatttaaaagagcaagtgatagtagaagcaaaatattatagatatgtagataaacaacaaaaacagatagaaaagatgaaaaagatgctaaatctaaaaataccagaagatttcatctacgataacttacctggactttcatcagaagttatcgaaaagcttaaaaagttcaaaccaccaacactttttaacgcttcacaaataagcgggattaccccaagtgcagtggatattatccatcttcatatagatatgaaaaataaaaaagttactgtacaataa

SEQ ID NO: 17684 - protein, 243 aa, Unknown
  Obtained from environmental sample
  misc_feature (1)..(243): Xaa is any amino acid
MAGINASLAIENKEPFVLRRDESYIGVLIDDLVTKGTNEPYRMFTSRAEYRLLLREESADMRLMGYGHDFGLIDDDTYNTMTHKKQTIKESVEFMENEWFTSKKENLTLLEELGEDKISDQILLVDLVGRNTITKEKFDRLVPSLAHLDDYLKEQVIVEAKYYRYVDKQQKQIEKMKKMLNLKIPEDFIYDNLPGLSSEVIEKLKKFKPPTLFNASQISGITPSAVDIIHLHIDMKNKKVTVQ

SEQ ID NO: 17685 - DNA, 810 bp, Unknown
  Obtained from environmental sample
  misc_feature (1)..(810): n is a, c, g, or t
atgaatccctctataagaaaaagtatcaacgatacagatacaaaaaacaatgcaatatttataaagtgtaaaaatcaattagacaaattaactctagaattaggtgcaagatatgactcaacaaaaatagatactaatggcgcagagcaagataataaatatactgattttagtggaaatattatggctacatataatagtgatgaaaatacaaagtattttattggattaggacaagctagccgtgttccagatgcaagagaattatattttgtagcttcaaatggtactagcgtaggaacagaagatttaaaagctacaacaaatagagagttagactttggaacagaacactattataaagatggaaaaattaaagcaaaatttttctatagtgatttaaaaaactatatctactatagagatacaggtgcagcaactaataagtttgaaaatattgatgctaagatatatggattagagcttagtggttcttattatatcaatgaacaatttacacttgatggtggatatacttacaaaattggtaaaaaagataaagccatagctggtcaaacagatacagatttagcagatattacaccagcaaaactaactcttgcacttaactatgattataataaccacacaaaatgcatgatagaatttatcaatgtatcatcatggaataaatatgatagtgataatggagagcaacatatatctggatacaatatagttaatcttaaagcacaaacaactgttgccaaaaattttgaaatcactgtagggatcgaataccttttttga

SEQ ID NO: 17686 - protein, 269 aa, Unknown
  Obtained from environmental sample
  misc_feature (1)..(269): Xaa is any amino acid
MNPSIRKSINDTDTKNNAIFIKCKNQLDKLTLELGARYDSTKIDTNGAEQDNKYTDFSGNIMATYNSDENTKYFIGLGQASRVPDARELYFVASNGTSVGTEDLKATTNRELDFGTEHYYKDGKIKAKFFYSDLKNYIYYRDTGAATNKFENIDAKIYGLELSGSYYINEQFTLDGGYTYKIGKKDKAIAGQTDTDLADITPAKLTLALNYDYNNHTKCMIEFINVSSWNKYDSDNGEQHISGYNIVNLKAQTTVAKNFEITVGIEYLF

SEQ ID NO: 17687 - DNA, 564 bp, Unknown
  Obtained from environmental sample
  misc_feature (1)..(564): n is a, c, g, or t
atggaaaaaaaagatttttttgaaaacaagtcaaaaacctatagtaaagatagtaaaagagtacgaaatgtacaaactatagcaaatggtattttagacaaagtaaactatacaaaagatatgcatattatggattttggtagtggtacaggtcttttatccatagaaattgcgccttatgtggggaaaatcacaggtatagatatgtcaaaatctatgaatgaagagttagaagcaaacaaagacttagttgattgtgatttggaaattttagaacttgatctatcaaaaagtgatattaataaaaaatttgatggaattatctcatccatgactttacatcatgtggaagatatcgtagagctattaaaaaaatttcataatatgctagatgagggaggaactattgctttatcagatttatacacagaagatggaacttttcactcagaagatacgggtgtgtttcattttggatttgatgaagaatttatagttccatgtgctaaaaaagccggatttaaacaactagagatttctcaagtaattgttgctaaaaaccca

SEQ ID NO: 17688 - protein, 188 aa, Unknown
  Obtained from environmental sample
  misc_feature (1)..(188): Xaa is any amino acid
MEKKDFFENKSKTYSKDSKRVRNVQTIANGILDKVNYTKDMHIMDFGSGTGLLSIEIAPYVGKITGIDMSKSMNEELEANKDLVDCDLEILELDLSKSDINKKFDGIISSMTLHHVEDIVELLKKFHNMLDEGGTIALSDLYTEDGTFHSEDTGVFHFGFDEEFIVPCAKKAGFKQLEISQVIVAKNP

SEQ ID NO: 17689 - DNA, 432 bp, Unknown
  Obtained from environmental sample
  misc_feature (1)..(432): n is a, c, g, or t
gtgaatagctataaaaatctttatgaggatcatatttcggaaaatccatccgatatagatgacgcccttttacatgaaaaagcttggaatataattgagccgtattttaataaaaaaagaatagaaaaactcgaagatttcanagagttgcacggaacagggaaagcaacctcagaccctgaattaataatgaagtctgcaattcaagggaaagtagactccttatttattgaaaatggagaagatatcttcggaaaatatgacccctccaacatggaaattgaaatagagaatgaacgtaaagcatccaacgtttcattgatgaatcgtatggctatgaaggttttcgaacttggcggagacgtttatttaacagagaaagaagatctaccagataactcttctaaaatgaacgcagtgctgagattctag

SEQ ID NO: 17690 - protein, 143 aa, Unknown
  Obtained from environmental sample
  misc_feature (1)..(143): Xaa is any amino acid
MNSYKNLYEDHISENPSDIDDALLHEKAWNIIEPYFNKKRIEKLEDFXELHGTGKATSDPELIMKSAIQGKVDSLFIENGEDIFGKYDPSNMEIEIENERKASNVSLMNRMAMKVFELGGDVYLTEKEDLPDNSSKMNAVLRF

SEQ ID NO: 17691 - DNA, 654 bp, Unknown
  Obtained from environmental sample
  misc_feature (1)..(654): n is a, c, g, or t
atgtcaaaaaaacttgatcctatggatttaaaacaaatactcagtttacatattgataagtatagcaatcgagctataagcaaaactctaggtattggtcgcaatacaattaacaactatattcatttatttaattcttgtgataaagatatgcacgagcttttagaacttgatgaatcagatttaacagagttattttcaaccaaaacaaccataaataacaatcgttatgacgggctaatgaaatacttagagtcagttaaacaggctcgcaatcatcctggatttacctttctttaccactatttagaatacaaatccagtgtagacaacccttatggctatacccagtttatggagcattataaccgtaaatacacaaagttaaagggttcaatgaagcttgagcataaaccaggtaatgagataatgattgattttgctggtaaacatcttcatattgccaataaagagtcaggagagctagttgctgttgaagtttttgtagcaatactaccttgtagtcaatatacttatgtagaggcatgtatgagtcaaaaacgtgaggatcttatttcatgtattgccaatgctctaactttttatggtggtgttcctagggctatagtgtcagataatttaaatctgctgtaa

SEQ ID NO: 17692 - protein, 217 aa, Unknown
  Obtained from environmental sample
  misc_feature (1)..(217): Xaa is any amino acid
MSKKLDPMDLKQILSLHIDKYSNRAISKTLGIGRNTINNYIHLFNSCDKDMHELLELDESDLTELFSTKTTINNNRYDGLMKYLESVKQARNHPGFTFLYHYLEYKSSVDNPYGYTQFMEHYNRKYTKLKGSMKLEHKPGNEIMIDFAGKHLHIANKESGELVAVEVFVAILPCSQYTYVEACMSQKREDLISCIANALTFYGGVPRAIVSDNLNLL

SEQ ID NO: 17693 - DNA, 609 bp, Unknown
  Obtained from environmental sample
  misc_feature (1)..(609): n is a, c, g, or t
atgttcaattcaaaacaagaaatagataattctgtttatggtaatgttaaagatttattttcagaccgcaataagattgtgatatatgatttaacaaacatgtattttgagggacaaatgctcggtagcgaaaaggctaaatttggacgctcaaaacaaaaacgaaatgatagaaggctgataggtttggctctatcgatagatagtcttggctttgtaagacacagccagttttatactgggaatgttagtgagcctgaaacattttctaatcttatagaagctgtatcagagcaattgtctcctgatggagaaaagcctttggtggtaatggatgctggtatttcaacagaagaaaacctaacattattaagaagcgacaagtataattacgactatgtatgtgtgagcagaactatacccaaagaatataataagttgtctgatgatgcaaaaataataacagataatagggatcataatattgagcttacaaaggtttctgtagaaggaaaagatgaccatttcttgcatgtaaaaagtgaccaaaagcagattaaagaagagtccatggatcagaaaatgacaatgaggcttgaagctcaataa

SEQ ID NO: 17694 - protein, 202 aa, Unknown
  Obtained from environmental sample
  misc_feature (1)..(202): Xaa is any amino acid
MFNSKQEIDNSVYGNVKDLFSDRNKIVIYDLTNMYFEGQMLGSEKAKFGRSKQKRNDRRLIGLALSIDSLGFVRHSQFYTGNVSEPETFSNLIEAVSEQLSPDGEKPLVVMDAGISTEENLTLLRSDKYNYDYVCVSRTIPKEYNKLSDDAKIITDNRDHNIELTKVSVEGKDDHFLHVKSDQKQIKEESMDQKMTMRLEAQ

SEQ ID NO: 17695 - DNA, 537 bp, Unknown
  Obtained from environmental sample
  misc_feature (1)..(537): n is a, c, g, or t
atgaaaaatatcagtatatttggtacaagttccgatgcaggaaaatcaacactcacttttgtaatagctaaaattatccaagagttaggctatagtgtggtcccttttaaagcacaaaatgtatcaaataactcaaaagtatgtgatgataacagtgagatagcaatagcacaacactttcaagcagaagtacttggagtcgaaacttcctatcatctcaatcctattttactcaaatctggtcgtggaagttctgcttcacttattgttgaggggaaagtagttcaagataaagatgtacgagaatattatagagatttggacttactaaaaccagctgttgatagatgttttaaatatcttgacagcaaatatgactgtgtcgtgtgtgaaggtgcgggaagtccagtcgaaacttaccttatggacaaagacctctcanatatctatatagcaaatacctatgatacaaaaataatccttgtagcagatatacaaaaaaggtggcgtatttgcttctatttggggggtatataa

SEQ ID NO: 17696 - protein, 178 aa, Unknown
  Obtained from environmental sample
  DOMAIN (4)...(177): CobQ/CobB/MinD/ParA nucleotide binding domain
  misc_feature (1)..(178): Xaa is any amino acid
MKNISIFGTSSDAGKSTLTFVIAKIIQELGYSVVPFKAQNVSNNSKVCDDNSEIAIAQHFQAEVLGVETSYHLNPILLKSGRGSSASLIVEGKVVQDKDVREYYRDLDLLKPAVDRCFKYLDSKYDCVVCEGAGSPVETYLMDKDLSXIYIANTYDTKIILVADIQKRWRICFYLGGI

SEQ ID NO: 17697 - DNA, 348 bp, Unknown
  Obtained from environmental sample
  misc_feature (1)..(348): n is a, c, g, or t
atgatgtttgagaatcttatagatgaactttgtattgaaaacaacatcccacttttagaggttggactcgtttttattgatgatgatatcatatttcaaaaagacaaggtgctaaaaagagaattatacagaatgtttaagaatgattacgaaggtttcgagatacaccaaggcattagtaaaaaatatccactgttttttgagaaagataatattaaagggacttttgttcatgggatttttgatgatgaaaaatttaaaacttataagaaaaaaacaattgataattttgtacaaactatgaaagagaagttagatatagataagattatatctagtataatatag

SEQ ID NO: 17698 - protein, 115 aa, Unknown
  Obtained from environmental sample
  misc_feature (1)..(115): Xaa is any amino acid
MMFENLIDELCIENNIPLLEVGLVFIDDDIIFQKDKVLKRELYRMFKNDYEGFEIHQGISKKYPLFFEKDNIKGTFVHGIFDDEKFKTYKKKTIDNFVQTMKEKLDIDKIISSII

SEQ ID NO: 17699 - DNA, 600 bp, Unknown
  Obtained from environmental sample
  misc_feature (1)..(600): n is a, c, g, or t
atggggatagattgtaaaagaaaaggtggtcatagtttttttgattcacgagagataaaagtgatactagatcttatggttttaatggtgaaacaaaatgatatgatggcatttatccatatagttgagtatggaaaaaatataggaaaagcaatagccaaagatatatttgaagcacttttacgaatagggcatggaaatatttttcatggacttttaaatcctgataacactattattaaaccctataaaagtaataaaacaaccaatgtacaacttggactttttgatgattttatagagatgggaagtactgcaaaatttaaagatttaggctgggaaacaaagtttttaaataactcaattttgaaacatccaaaactcactttagagggtgggatatttttatatgacttctatactttgttaaaagagttaaaaaggatancaaatccaaataatatgataaaacatatccaaaatcacaagttttttaaaactattctagatacaataacaactgctcgtgcaaaacaaaaagatggaacgatcaacgaaactataaaacaaagtgcctcttttaagccaattcgagagtag

SEQ ID NO: 17700 - protein, 199 aa, Unknown
  Obtained from environmental sample
  misc_feature (1)..(199): Xaa is any amino acid
MGIDCKRKGGHSFFDSREIKVILDLMVLMVKQNDMMAFIHIVEYGKNIGKAIAKDIFEALLRIGHGNIFHGLLNPDNTIIKPYKSNKTTNVQLGLFDDFIEMGSTAKFKDLGWETKFLNNSILKHPKLTLEGGIFLYDFYTLLKELKRIXNPNNMIKHIQNHKFFKTILDTITTARAKQKDGTINETIKQSASFKPIRE

SEQ ID NO: 17701 - DNA, 588 bp, Unknown; identical to SEQ ID NO: 13375
  Obtained from environmental sample
  misc_feature (1)..(588): n is a, c, g, or t

SEQ ID NO: 17702 - protein, 195 aa, Unknown; identical to SEQ ID NO: 13376
  Obtained from environmental sample
  misc_feature (1)..(195): Xaa is any amino acid

SEQ ID NO: 17703 - DNA, 582 bp, Unknown
  Obtained from environmental sample
  misc_feature (1)..(582): n is a, c, g, or t
ttgaaaccttatgctggagttcggatggaccatatcataaaaatagttgatacagcagggattagagaagcaagtgatgagatagaaaagatagggatagaaaaatcaaaagaagctattgaacaatcagatattgtagtagcactatttgatggaagtagagagtttgataatgaagataaaaaaatattaaatattataaatacaacagataaacaaactattgttatcataacaaaagcagaccttattcaaaaaataaacctttcagaacttaacgattcctacttaacccttaatacaaaagttgatatctcccctttaattaaaaaactagaaatgatattaaatcaaaatacaagtggagatgatatcactttgatatcaaaacaacaaatagtagaagttgaaaatacacttttaaatatacaaaaagcttacacaccactcaatagtggtgaattagagttttttgcacactatattaatgaagcgattgaaaacatctcaaatatcactagaccttatgaacatagtcaaatgttagatataatgtttggtgaattttgtttaggaaaataa

SEQ ID NO: 17704 - protein, 193 aa, Unknown
  Obtained from environmental sample
  misc_feature (1)..(193): Xaa is any amino acid
MKPYAGVRMDHIIKIVDTAGIREASDEIEKIGIEKSKEAIEQSDIVVALFDGSREFDNEDKKILNIINTTDKQTIVIITKADLIQKINLSELNDSYLTLNTKVDISPLIKKLEMILNQNTSGDDITLISKQQIVEVENTLLNIQKAYTPLNSGELEFFAHYINEAIENISNITRPYEHSQMLDIMFGEFCLGK

SEQ ID NO: 17705 - DNA, 345 bp, Unknown; identical to SEQ ID NO: 7227
  Obtained from environmental sample
  misc_feature (1)..(345): n is a, c, g, or t

SEQ ID NO: 17706 - protein, 114 aa, Unknown; identical to SEQ ID NO: 7228
  Obtained from environmental sample
  misc_feature (1)..(114): Xaa is any amino acid

SEQ ID NO: 17707 - DNA, 375 bp, Unknown
  Obtained from environmental sample
  misc_feature (1)..(375): n is a, c, g, or t
atgactagcaaagaagagagattgaaaactattggacagttcattgggcagaaaaaagtgctatcttttgagaaactcgtgcaatctgtgaatgtttcagacattacggttcggcgagatttgcgggcgttaaattatatgacgagttatactcatcgcgggcagttcatcacattgcccaagatcccctgttttgacaacaacggcatttggtttttccatgagattggtttttctcaatacggaaacagccttgagtctatcttaaagctgatcgacaaaagtaaacagggggtttccagagaagaattggaggacattcctaaaattggcatttccaaacaaatacagatcctgatcgggcagaaaagctga

SEQ ID NO: 17708 - protein, 124 aa, Unknown
  Obtained from environmental sample
  misc_feature (1)..(124): Xaa is any amino acid
MTSKEERLKTIGQFIGQKKVLSFEKLVQSVNVSDITVRRDLRALNYMTSYTHRGQFITLPKIPCFDNNGIWFFHEIGFSQYGNSLESILKLIDKSKQGVSREELEDIPKIGISKQIQILIGQKS

SEQ ID NO: 17709 - DNA, 321 bp, Unknown
  Obtained from environmental sample
  misc_feature (1)..(321): n is a, c, g, or t
atggttacagaaggtgctgttttaggtgttcctggaatttatctagacaataccagcaggacctatactaaagagttagaagaaaaatttaatttaatttacaacttcacggaaaataacaatgatcaagttttatccattcaaaaaggaatagaaatactaataaactacaaaaaagatgaatggttgcaaagaagaaaaaaattactatctgaaaaaatcaatttcactgcatttttagtatggtacatcgaaaactggccagaaagttttcatatcatgaaagaaaacccggattatcaaaatcgattttttttataa

SEQ ID NO: 17710 - protein, 106 aa, Unknown
  Obtained from environmental sample
  misc_feature (1)..(106): Xaa is any amino acid
MVTEGAVLGVPGIYLDNTSRTYTKELEEKFNLIYNFTENNNDQVLSIQKGIEILINYKKDEWLQRRKKLLSEKINFTAFLVWYIENWPESFHIMKENPDYQNRFFL

SEQ ID NO: 17711 - DNA, 744 bp, Unknown
  Obtained from environmental sample
  misc_feature (1)..(744): n is a, c, g, or t
ttgcatttatctaaaaaccaaatatatattgatacatacaaagaaatcgcatatttacatcctaattattttaatgcagataagaatatacttaacaaattgggtattaaaaaagatgaattagttattcttattcgttttgtttcttggaatgccactcatgattctggtcatcagggcatttctttggaaaataaaataaaggctgttaaggaattttcaaaatttggcagagtttttattagctcggaatttgaacttccaaatgaattaaaaaagtatctatttccattacccccagaagaaatacatcatttaatggcaaatgcatcattaatttttggcgaaagtgcaacaatggttacagaaggtgctgttttaggtgttcctggaatttatctagacaataccagcaggacctatactaaagagttagaagaaaaatttaatttaatttacaacttcacggaaaataacaatgatcaagttttatccattcaaaaaggaatagaaatactaataaactacaaaaaagatgaatggttgcaaagaagaaaaaaattactatctgaaaaaatcaatttcactgcatttttagtatggtacatcgaaaactggccagaaagttttcatatcatgaaagaaaacccggattatcaaaatcgatttttttttatatttatgacgctactaagaaataaatcatttacaaaattctttcaaaatgatttaataataaattcc

SEQ ID NO: 17712 - protein, 248 aa, Unknown
  Obtained from environmental sample
  misc_feature (1)..(248): Xaa is any amino acid
MHLSKNQIYIDTYKEIAYLHPNYFNADKNILNKLGIKKDELVILIRFVSWNATHDSGHQGISLENKIKAVKEFSKFGRVFISSEFELPNELKKYLFPLPPEEIHHLMANASLIFGESATMVTEGAVLGVPGIYLDNTSRTYTKELEEKFNLIYNFTENNNDQVLSIQKGIEILINYKKDEWLQRRKKLLSEKINFTAFLVWYIENWPESFHIMKENPDYQNRFFFIFMTLLRNKSFTKFFQNDLIINS

SEQ ID NO: 17713 - DNA, 816 bp, Unknown
  Obtained from environmental sample
  misc_feature (1)..(816): n is a, c, g, or t
atgcaagtttataaaaaatctataccaaaacagcataaaatagttacccaaaaaggaaatagtgccaaaggctttatggtaatagaattcaataacataaaagtaatccatatatataactcaatatctgaaatatttgttgaggatactaaaaaaaatgaaaatatgattattatacatggagtatttttagttttacttatctctcaaattcttttatatattagagtaaaaaaatctttaaatccattatctttaatgcaaaataaattacataatttagaagatggagatttaactcctcttcaattagactctagctatgacgagataaaacagatgattagttcttataataaatcaataggaaaaataaaatatattttagaaactagagagatgttcaataaaatatttatgcatgagatgaaaatgccaattgcaaaagggatgttttatctaaaacaagagccttctaaatatacacatgataaattcaatatcttactaaatagattgaataatgaactagatgaattttcagtaattgagagtttaatcgtatatcaaaataatatagaactaatacctcataatacccataatattttaaccttagctattgaaaaagttggcatggaaaacaaaaataatatattaatagaaaattgtgataattttgaaatacaaggtgataaagagttatggatattatgttttaaaaatttaattgacaatgctttaaaatatgcagatgataaaaaattaattataaaatgctcaaagaatagtatctcatttataatattgggataa

SEQ ID NO: 17714 - protein, 271 aa, Unknown
  Obtained from environmental sample
  misc_feature (1)..(271): Xaa is any amino acid
MQVYKKSIPKQHKIVTQKGNSAKGFMVIEFNNIKVIHIYNSISEIFVEDTKKNENMIIIHGVFLVLLISQILLYIRVKKSLNPLSLMQNKLHNLEDGDLTPLQLDSSYDEIKQMISSYNKSIGKIKYILETREMFNKIFMHEMKMPIAKGMFYLKQEPSKYTHDKFNILLNRLNNELDEFSVIESLIVYQNNIELIPHNTHNILTLAIEKVGMENKNNILIENCDNFEIQGDKELWILCFKNLIDNALKYADDKKLIIKCSKNSISFIILG

SEQ ID NO: 17715 - DNA, 315 bp, Unknown
  Obtained from environmental sample
  misc_feature (1)..(315): n is a, c, g, or t
ttgttgaataaaattaaaaattcacttttagcacaaacaagttttttatttgttctatcttttttatttattgttatattatggattgttttttatatccaacaaattcatcagcacaaagagcatactatggctagatattttagtgctgttagctctttacaaccattattagtacaatctatcccaataaataatgataatttaaaaatcttagatatgcaagtttataaaaaatctataccaaaacagcataaaatagttacccaaaaaggaaatagtgcccaaaggctttatggtaatagaattcaataa

SEQ ID NO: 17716 - protein, 104 aa, Unknown
  Obtained from environmental sample
  misc_feature (1)..(104): Xaa is any amino acid
MLNKIKNSLLAQTSFLFVLSFLFIVILWIVFYIQQIHQHKEHTMARYFSAVSSLQPLLVQSIPINNDNLKILDMQVYKKSIPKQHKIVTQKGNSAQRLYGNRIQ

SEQ ID NO: 17717 - DNA, 378 bp, Unknown
  Obtained from environmental sample
  misc_feature (1)..(378): n is a, c, g, or t
atgtttaagtgcatcgacaaagaaacaaactctgaactggtttccattgacgacgaatctgaggaaagaaaagattatctcaggaaaaaatcggaaaatgacgcactagtatgtcaaatttgcaaaatcaaagtgtttccaaggcttggtgagcaacgactttggcatttcgctcacgtaaaaagtgaaatagagtgcccgttaaaaagtgaagatccaaatttatttcaagcaagagcaatactttacaagtggctcaaatcaaaatttgacactgccgtttcaattgaaaaagaaatttcagaatacaatctaccccgccccattgattgctgggttgaagggcccaaagggaaaaagtttgcctactggctatga

SEQ ID NO: 17718 - protein, 125 aa, Unknown
  Obtained from environmental sample
  misc_feature (1)..(125): Xaa is any amino acid
MFKCIDKETNSELVSIDDESEERKDYLRKKSENDALVCQICKIKVFPRLGEQRLWHFAHVKSEIECPLKSEDPNLFQARAILYKWLKSKFDTAVSIEKEISEYNLPRPIDCWVEGPKGKKFAYWL

SEQ ID NO: 17719 - DNA, 789 bp, Unknown
  Obtained from environmental sample
  misc_feature (1)..(789): n is a, c, g, or t
atggatcagattcggctgagtatttccctggaagagatctatcagaaggtgatgacgcttatcccctgctcctggcagttcccggaaatcacctgtgcccggtgtattatccacggaagcatttaccagacagataattacaaagataccatctggaaacagtcggcggatattattgcctaccgggatgttattggtgttatcagtgtctgctatctggaaaaaatgccagacagccacgaggggccgtttctaaaggaagagcgctcccttatcaatgccattgccgaacgtctgggccgcaccagcgaacaaaaaaaagcggagaaagcgctatttgacagtgaacagcagttgaaaaatcagaatcagctccttaaggaaaagaacatcgccttaagagagatcatgaaccaggttatcatggaaaaaaagaatctggaagagcgggtcatggacaatgtggatcagtttcttctcccccttgtggataaattaaaaaacagcggttcccagattgatgtcggctatctcaccctgctggaggatacgctgaaacaattgacatctgcctttggaagcaacgttgcccggcggatgcccagactcaccccccgggaaaacgaaatttgcaacatgatacgttccggcctcagttcanaggaaattgccaaggtgcttaatatctcccaccgaagtgttgaaacctaccggaactatatccgtaagaaactgggaatcatcaatcagaaaattaatcttgccagctttctttcgacgctgaaataa

SEQ ID NO: 17720 - protein, 262 aa, Unknown
  Obtained from environmental sample
  DOMAIN (200)...(258): Bacterial regulatory proteins, luxR family
  misc_feature (1)..(262): Xaa is any amino acid
MDQIRLSISLEEIYQKVMTLIPCSWQFPEITCARCIIHGSIYQTDNYKDTIWKQSADIIAYRDVIGVISVCYLEKMPDSHEGPFLKEERSLINAIAERLGRTSEQKKAEKALFDSEQQLKNQNQLLKEKNIALREIMNQVIMEKKNLEERVMDNVDQFLLPLVDKLKNSGSQIDVGYLTLLEDTLKQLTSAFGSNVARRMPRLTPRENEICNMIRSGLSSXEIAKVLNISHRSVETYRNYIRKKLGIINQKINLASFLSTLK

SEQ ID NO: 17721 - DNA, 879 bp, Unknown
  Obtained from environmental sample
  misc_feature (1)..(879): n is a, c, g, or t
atgttaagatttgcagctagtcaaacaaaagatatgcaattaggagatttgcgggttgcgatatttaatcatatactatcaaaacaacttaatgttgaactactagttagaatagaagataccgataaagaaaaaaatatagagggaaaagataaagaagcactagagattttaggactttttagtatagatttttcaagagttgtatatcaaagtgagaatatcaaataccatacacaaatggctatgaaactattgcttgataaaaaagcttttaattgtttttgtagtgatgaagcgttagagcaagataaacaaaaagcaaaaaaagaaggaaaaccatatagctacggtggattttgtgaaacaatcagtgatgaaacaaaattcaactgtaatgctccatttgtagtaagacttaaaaaaccagaacatactataaagtttacagatcttataaaaggtgattgttcgtataagccaaatgaagtagatagttttgtaattttaaaacatgacaaatctcctacatataattttgcatctgctgttgatgatatgttgcatgatatttcaacagttattagaacagaggaacacttatctaatacacctaaacaaattcatgtgcgagagtctttaggatatgataaagagattcaatatatccatataccaagtatttctaaacttgaagaaaagaacaacttatctgtaaaataccttattgatgaggggtacttaccagttgctattgcaaattattgcgtacttcttggatataatactccacaagaaatatttactattgaagaggctattgagtggtttgatataaataaactctcccatgaacctgtagaatttgatattaaataa

SEQ ID NO: 17722 - protein, 292 aa, Unknown
  Obtained from environmental sample
  DOMAIN (3)...(292): tRNA synthetases class I (E and Q), catalytic domain
  misc_feature (1)..(292): Xaa is any amino acid
MLRFAASQTKDMQLGDLRVAIFNHILSKQLNVELLVRIEDTDKEKNIEGKDKEALEILGLFSIDFSRVVYQSENIKYHTQMAMKLLLDKKAFNCFCSDEALEQDKQKAKKEGKPYSYGGFCETISDETKFNCNAPFVVRLKKPEHTIKFTDLIKGDCSYKPNEVDSFVILKHDKSPTYNFASAVDDMLHDISTVIRTEEHLSNTPKQIHVRESLGYDKEIQYIHIPSISKLEEKNNLSVKYLIDEGYLPVAIANYCVLLGYNTPQEIFTIEEAIEWFDINKLSHEPVEFDIK

SEQ ID NO: 17723 - DNA, 600 bp, Unknown
  Obtained from environmental sample
  misc_feature (1)..(600): n is a, c, g, or t
ttgaaatgtgattacaaaagttcaatgaagaaaatattatttatagccattacattttttatgtttttgagtttatactcacaacaaagtttttatgatattgaaaatataaaaaaactatcatctaatcctgataaattatacggagtaactgtaatggatgctaaaataaggtcagctccaacgccagctgaagaacctattgaatatctggatttattagacactgttcagttaatagattattatgagggttattgggcggtaaaatataataacacttatggttatctttcagaattgttcttggaacatactcctatagttgaaaaatttagagattctttattagtagaaaaacaatttgaaaaagcagttgaattagagattaaacaattgaatgataaagctaaagcattaaccgactggtataatgatagtataaaacgtattgaggaagaaaaaagagtagttgaggataagattttttataggaaattagataatcttttgatattatcattagatattcagtgggaattactgactaaatatgaaaggtttgttgtttatattgaagatgagagccaggaagggtaa

SEQ ID NO: 17724 - protein, 199 aa, Unknown
  Obtained from environmental sample
  misc_feature (1)..(199): Xaa is any amino acid
MKCDYKSSMKKILFIAITFFMFLSLYSQQSFYDIENIKKLSSNPDKLYGVTVMDAKIRSAPTPAEEPIEYLDLLDTVQLIDYYEGYWAVKYNNTYGYLSELFLEHTPIVEKFRDSLLVEKQFEKAVELEIKQLNDKAKALTDWYNDSIKRIEEEKRVVEDKIFYRKLDNLLILSLDIQWELLTKYERFVVYIEDESQEG

SEQ ID NO: 17725 - DNA, 684 bp, Unknown
  Obtained from environmental sample
  misc_feature (1)..(684): n is a, c, g, or t
atggatattctttcaagaaaaattgtagaaaatagagcagttcttatcagccttaatgcttctcttgaagataaagagagaacagatatttataaagatcaactatttgagatgatctcaaaagatttagaagatttgaaaagagatggggttgattatataaattttcatttagcagatggaagaagtattttaagagttaccagaccagacatttcaggagaaaactttaatagtaaaagtattaaagctgtccatcttaataaaaaagtagagagtcactatgagatagatcgtttttttgaaggtattagatatatttaccctctgtttttagaggataaatttttgggttcagtagaactctctatcgacatggagtcattgattgcatcaatgtataaggggcttgacgctgcatatagtatgatagtgaaagctgatgcaataaagcttgtcatggatgatttatatcttaaaaatcactatcatgagacttgtcttggcagtgactactatatgcatacaaatattcataactcaaaagtgattaataaaagtattgcaaaatcgatctatcctgaattaaaatccaatcttccaaaagatagagcatttgctattaacagagtaacatctctattagagagtgagatatatctgtttcttcctacagttngataa

SEQ ID NO: 17726 - protein, 227 aa, Unknown
  Obtained from environmental sample
  misc_feature (1)..(227): Xaa is any amino acid
MDILSRKIVENRAVLISLNASLEDKERTDIYKDQLFEMISKDLEDLKRDGVDYINFHLADGRSILRVTRPDISGENFNSKSIKAVHLNKKVESHYEIDRFFEGIRYIYPLFLEDKFLGSVELSIDMESLIASMYKGLDAAYSMIVKADAIKLVMDDLYLKNHYHETCLGSDYYMHTNIHNSKVINKSIAKSIYPELKSNLPKDRAFAINRVTSLLESEIYLFLPTVX

SEQ ID NO: 17727 - DNA, 630 bp, Unknown
  Obtained from environmental sample
  misc_feature (1)..(630): n is a, c, g, or t
atgaatctgctactccagtatgagaaaacgatagagagtgctgcttcatttacaagaacggatttaaaaggtgttattacatatttaaatgagactcatgagaaaattacaggatataaaaaagaggagttgataggacacagacatactccatttttaagagattacagtgttcctcgtggattttacagagagttatgggagaccataaaatctaaaaaaagctttaagggtgtaattacaaatatagcaaaagatggtaaaactatctatcttgatacgctagttgttcctattttagattcagatgaaaatatagttgaatatatgagcatacagtatgacatatcagatatggtgaatatgcataaagagatagaagatactcaaagagaagtaatctataaaatgggtgaaataggtgaatctcgttcaaaagagacaggtaatcatgtaaaacgtgttgcagagtactctaaacttttagctataaagtatggcttaaatgctaaagaagctgaacttttatatgacgcttcaccaatgcatgatataggtaaagtaggaatacccgatagtgttttgaaaaaacnctgggaagnctggatgagggtgagtggaaaattatga

SEQ ID NO: 17728 - protein, 209 aa, Unknown
  Obtained from environmental sample
  DOMAIN (5)...(68): PAS domain
  misc_feature (1)..(209): Xaa is any amino acid
MNLLLQYEKTIESAASFTRTDLKGVITYLNETHEKITGYKKEELIGHRHTPFLRDYSVPRGFYRELWETIKSKKSFKGVITNIAKDGKTIYLDTLVVPILDSDENIVEYMSIQYDISDMVNMHKEIEDTQREVIYKMGEIGESRSKETGNHVKRVAEYSKLLAIKYGLNAKEAELLYDASPMHDIGKVGIPDSVLKKXWEXWMRVSGKL

SEQ ID NO: 17729 - DNA, 729 bp, Unknown
  Obtained from environmental sample
  misc_feature (1)..(729): n is a, c, g, or t
ttgtatactatattacaatctgatattcacttatcatattcgagttttaatggcaaatatgatgatatagttaacaaaaaaaatattcttgcatcaatttcaaatgaagaaaaaaatgatcataaaataatttttctagatagtagtaaagatataaatttaggatatagattttctttaggaggtatatctgaaaaagtagaaaacttgaaacaaattatattaaataatgaaaagtatattttagcaaattcaaaaaagaatatttatttatggaatattaatcaaccaaatttaaatcctgtcaaaataaataaagatgattatttaatattggattatgaagtttttgaaaaagataaaactttacacattattgcaataacagaatgtaataatatattggtttggaaagttattgaacatatagttttaaatatttctatattatcactagaagacaatgcgtatgttgttgtaaacctaaaggggaaaaataaattaataaataattgtaggtattcaaaatcaatttacaactataatatagaaaccaatacaattgataaaaaatatacaatacctaaggaataccataaaatagtaagtttagctattcatcctaccaaaaggcaaataactttttcttttagtattcccgatacttctgatccatttgaaatagatatagagtttttgaattttgaaatattgcagtttttgatttag

SEQ ID NO: 17730 - protein, 242 aa, Unknown
  Obtained from environmental sample
  misc_feature (1)..(242): Xaa is any amino acid
MYTILQSDIHLSYSSFNGKYDDIVNKKNILASISNEEKNDHKIIFLDSSKDINLGYRFSLGGISEKVENLKQIILNNEKYILANSKKNIYLWNINQPNLNPVKINKDDYLILDYEVFEKDKTLHIIAITECNNILVWKVIEHIVLNISILSLEDNAYVVVNLKGKNKLINNCRYSKSIYNYNIETNTIDKKYTIPKEYHKIVSLAIHPTKRQITFSFSIPDTSDPFEIDIEFLNFEILQFLI

SEQ ID NO: 17731 - DNA, 717 bp, Unknown
  Obtained from environmental sample
  misc_feature (1)..(717): n is a, c, g, or t
atggtttggaaagttattgaacatatagttttaaatatttctatattatcactagaagacaatgcgtatgttgttgtaaacctaaaggggaaaaataaattaataaataattgtaggtattcaaaatcaatttacaactataatatagaaaccaatacaattgataaaaaatatacaatacctaaggaataccataaaatagtaagtttagctattcatcctaccaaaaggcaaataactttttcttttagtattcccgatacttctgatccatttgaattagaatatagagtttttgaatttgaaaatattgcagtttttgatttagaaaaagaaaaagagatttttagagaacatgaaaaaggtcactttttacataaaattgaatatattgatgaaaaagaaaatacttatttaatcgtgtatgatcaagatggatgtggtcataatttacaacctttagttaaaaaatggaaagaaaactcaaataaatatgttttagattatgtatatgattcatatcccattgaaaaaaatcatttacttaataatttaaaattaattggaaatcaaatattttttaatatttatgatgtagatgctgaatataatgatattaacgaaataataaaaatctcaaataataaagaaaaaagtttttataaactgaatgaaaactatgttgtaaatgatttagtagaacttaatttggaataa

SEQ ID NO: 17732 - protein, 238 aa, Unknown
  Obtained from environmental sample
  misc_feature (1)..(238): Xaa is any amino acid
MVWKVIEHIVLNISILSLEDNAYVVVNLKGKNKLINNCRYSKSIYNYNIETNTIDKKYTIPKEYHKIVSLAIHPTKRQITFSFSIPDTSDPFELEYRVFEFENIAVFDLEKEKEIFREHEKGHFLHKIEYIDEKENTYLIVYDQDGCGHNLQPLVKKWKENSNKYVLDYVYDSYPIEKNHLLNNLKLIGNQIFFNIYDVDAEYNDINEIIKISNNKEKSFYKLNENYVVNDLVELNLE

SEQ ID NO: 17733 - DNA, 750 bp, Unknown
  Obtained from environmental sample
  misc_feature (1)..(750): n is a, c, g, or t
gtggtggatgcgatgatccgtaatatgctactgtatggaacattgatctttatcttcatcacctttgtggggataatccttgtgaagatcttcttgcgtccgatgcgtgaagcgatcaaactgctggataatttcatcaaagacacgacgcatgaactcaatacgccggtatccgtcatcgtcgcgaatatagaaggggtcgatgttcaaaagcttgaggaaaaagaggcgaaaaagatacgacggatcgacatcgcagcacgtacgatctcaaatatctacaatgatctgacttatctcatcttgaataacgatattgcggtcaaagacgagcagatcaatctgtcgacattcttgtgcgagcgtgtagactacttcaaggtcgggatcgagcagaaaaagatcacctttagccgtgaggttagtgatgaggtgatgatttatatggataggaacaagctggggcggctaatcgacaatatcatctccaatgccatcaaatacaatggtgttggcggaaatatccatattgtgctcaaagagaaaagtctgaaagtgacggacacgggaataggtatacctgccgacaagatcgaacgtatttttgagcgttatcaaagagccaatgacagtgtcggcggttttgggatcggattgaacatcgtcgcgatgatcgctaaagagtacgatattgaggtaaaagtggactcggtgatcaataaaggcaccacaatcgaacttaatttttaa

SEQ ID NO: 17734 - protein, 249 aa, Unknown
  Obtained from environmental sample
  DOMAIN (41)...(105): His Kinase A (phosphoacceptor) domain
  misc_feature (1)..(249): Xaa is any amino acid
MVDAMIRNMLLYGTLIFIFITFVGIILVKIFLRPMREAIKLLDNFIKDTTHELNTPVSVIVANIEGVDVQKLEEKEAKKIRRIDIAARTISNIYNDLTYLILNNDIAVKDEQINLSTFLCERVDYFKVGIEQKKITFSREVSDEVMIYMDRNKLGRLIDNIISNAIKYNGVGGNIHIVLKEKSLKVTDTGIGIPADKIERIFERYQRANDSVGGFGIGLNIVAMIAKEYDIEVKVDSVINKGTTIELNF

SEQ ID NO: 17735 - DNA, 876 bp, Unknown
  Obtained from environmental sample
  misc_feature (1)..(876): n is a, c, g, or t
atggatttagcttatgatgagatagtattagtaactccatcagatcatcttatcaaagatgaaacagaatatgaaaaagttttaagtaaagcaaaagagtttacaaaggatgataagttagtaacgtttggaataagacctacatttcctgaaactggatttgggtatattcaggcagtgcctgaaaatgatgaatgtttgattttaaatgttgaattatttaaagaaaaaccaaattttgaaacggctactcaatatatagaagaaaattcaaaattaagcattcaaaatttaccattaaaatactactggaactctggaatgtttatgtttaaagcaggtgtttttctagaagaacttcaaaaatactctcctgaaatatttgatacttctaaacaagctttagaaaatgcctcaaaagagggaatgattagaataaaatatgaagatatgataaatatccctgaagatagtatagactatgcagtgatggaaaaatcttcaaaagttaaagtgataccatcagatataaattggtcagatgtcggaagttttgattctctttatgatgagttaccaaaagatgaaaatggtaatactcaaaataaaaatcatattagtataaatagtaaaaataatttcatctatggaagtgaaagaaaaatagcaacaatagatatagaagatatgattatagtcgatacaggagatgcacttttagtttctaaaaaaggaagctctcaaaaagtaaaaaaggttgtagaaacccctaaaaatagagattcagaattacataatattcatcttacaggtcatagaccttggggtacatatactgtattagaagatagtataggatataaaattagcggatag

SEQ ID NO: 17736 - protein, 291 aa, Unknown
  Obtained from environmental sample
  DOMAIN (209)...(290): Mannose-6-phosphate isomerase
  misc_feature (1)..(291): Xaa is any amino acid
MDLAYDEIVLVTPSDHLIKDETEYEKVLSKAKEFTKDDKLVTFGIRPTFPETGFGYIQAVPENDECLILNVELFKEKPNFETATQYIEENSKLSIQNLPLKYYWNSGMFMFKAGVFLEELQKYSPEIFDTSKQALENASKEGMIRIKYEDMINIPEDSIDYAVMEKSSKVKVIPSDINWSDVGSFDSLYDELPKDENGNTQNKNHISINSKNNFIYGSERKIATIDIEDMIIVDTGDALLVSKKGSSQKVKKVVETPKNRDSELHNIHLTGHRPWGTYTVLEDSIGYKISG

SEQ ID NO: 17737 - DNA, 885 bp, Unknown
  Obtained from environmental sample
  misc_feature (1)..(885): n is a, c, g, or t
atggccagagggcttgctttggtaggattaaacggaaaaataggttttatagacaaaactaatcagctcattattccttttaaatatgaggaagctgaagattttgcaaacggattagcagttgttgggataaacgataaatatgggataattaatcgcttgggagaggaaatagtcccattaatgtatgacgaaattggaacaaccaaaaacaaatttattgctgttggattaaatgagaaatacggatttataaatacaagcggcaatcttgtaattggtttagaatacgagtctgttggttactttaataatggaattgcttttgtttttaaagacaataaatatggtattatagataccaacttgtattatgttgttaaacctgtttacgattggatagataacttagaagatgaatttattcgtattaaatcaaatcagttttacggtgttattaatagtaaaggagatagtattttagctcccatttatacccatattactgagcccgaaaatggtttggctatagtggtaaaagataatttttacggctatgtaaataccaaaggtacgatgattattgaacctactattccatatcaagaaggtgtgttaaattggggtttatttaatgataaaggctatgccagacaaatgacagaaggaaaaataggcttaatagacaccacgggaaaaaaagttgttcctgctttatttgaagatattggtgttatctctaaagaattaattgctataaaaagacacgngcaatggggttattgtgactttaataccaaacttaaaattccatacaactttattattgctggagaaattattgatgaaatgccattgttaactttgaaaataaatttggtatga

SEQ ID NO: 17738 - protein, 294 aa, Unknown
  Obtained from environmental sample
  DOMAIN (81)...(97): KWG Leptospira
  misc_feature (1)..(294): Xaa is any amino acid
MARGLALVGLNGKIGFIDKTNQLIIPFKYEEAEDFANGLAVVGINDKYGIINRLGEEIVPLMYDEIGTTKNKFIAVGLNEKYGFINTSGNLVIGLEYESVGYFNNGIAFVFKDNKYGIIDTNLYYVVKPVYDWIDNLEDEFIRIKSNQFYGVINSKGDSILAPIYTHITEPENGLAIVVKDNFYGYVNTKGTMIIEPTIPYQEGVLNWGLFNDKGYARQMTEGKIGLIDTTGKKVVPALFEDIGVISKELIAIKRHXQWGYCDFNTKLKIPYNFIIAGEIIDEMPLLTLKINLV

SEQ ID NO: 17739 - DNA, 570 bp, Unknown
  Obtained from environmental sample
  misc_feature (1)..(570): n is a, c, g, or t
atgtttagtagcgataattggcaagaaatatttcaaacaattaagaaaaacaagctccgtacgttcttgtcgggatttactattacccttggtttgctcatttttatcacactacttggtttaggcaacggactaaaaaattcattcaatcaattctttatggatgatgctaccaataccatgtttgtatttccggggagaaccagcatgccttacaaaggttataatgtaaatagaactattcagtttaaaaacgatgatttagccgatatccaaaagaattttcctttttatttagaatacattacgccccgaatatttagaaacggaactgtaagttttaacaacgaatctaactcctattcatacgttggtgtgagtcctgctcatcagatttccgaaaaaaccattatgatgaaaggtcgttatttaaacgatttagatgttaaagaaaaaacaaaatatgctgtaattggtagattagtagaaaaagatttatttaaagatgaaagtgctttgggtgaacatattatcatcaacaatactgcctacaaagtatctcggccataa

SEQ ID NO: 17740 - protein, 189 aa, Unknown
  Obtained from environmental sample
  misc_feature (1)..(189): Xaa is any amino acid
MFSSDNWQEIFQTIKKNKLRTFLSGFTITLGLLIFITLLGLGNGLKNSFNQFFMDDATNTMFVFPGRTSMPYKGYNVNRTIQFKNDDLADIQKNFPFYLEYITPRIFRNGTVSFNNESNSYSYVGVSPAHQISEKTIMMKGRYLNDLDVKEKTKYAVIGRLVEKDLFKDESALGEHIIINNTAYKVSRP

SEQ ID NO: 17741 - DNA, 546 bp, Unknown
  Obtained from environmental sample
  misc_feature (1)..(546): n is a, c, g, or t
ttgtttttaattacatttttagtgtatccttgttttattatgttgacagcaattatttttaatatttacagttttgtttctagtaattttttgaatttagtttctaatctacaaggaaatttaatttattcatatatttttataataattttttgtgggattatttattctaaatttagtttaaatttgttttttggaaagtggagtgataaaggattactattacatctaaaatggactaattttaataaatatattcttgaacattctttaatgaaagaatataaaccatcttcagttgcaatttgggattattatttaattttcgcactgagttttggatctgcaaaaaaatgttccgaaattttatttacaaatattcatggtaatgaatttgaacaggatttaataagtatagcactagatatttcttcagaaaaggcaaactttttaacggattttaataagaaatttgttttagagaatgcctttatttcattaaaaactacaattgaccattttttaaataataaaaggaaaaagtaa

SEQ ID NO: 17742 - protein, 181 aa, Unknown
  Obtained from environmental sample
  misc_feature (1)..(181): Xaa is any amino acid
MFLITFLVYPCFIMLTAIIFNIYSFVSSNFLNLVSNLQGNLIYSYIFIIIFCGIIYSKFSLNLFFGKWSDKGLLLHLKWTNFNKYILEHSLMKEYKPSSVAIWDYYLIFALSFGSAKKCSEILFTNIHGNEFEQDLISIALDISSEKANFLTDFNKKFVLENAFISLKTTIDHFLNNKRKK

SEQ ID NO: 17743 - DNA, 624 bp, Unknown
  Obtained from environmental sample
  misc_feature (1)..(624): n is a, c, g, or t
atgattaaattaataatttttgatttgtggtatacacttatatataaaaaacagagtacaaatacaagagaattaatgtatagtatgtgtcctcaaaaaataagtttgtctgaattttcaaaaatatctactacagtaattcaaactaaaaaatggaatagtaaattagaagcttatgaagaattagctaggcaatcacaattagataaacctaaagaaattgctaaaagatggtttgaattaagaaaatctaaagattctaaattcttaacttatgattatgtaatacctttattaaaaaagttatctaagaattataaattaggattaatttctaattgtacatattattctgctgaaattatgaaaaaagaaacttctatttttgattatatagattatgaaattttgtcatttcaagtaggtttattaaaacctgatttaaatatttttctaaaaatgcttgaaaaagcaaacgttaaaccagaagaagcagtaatgattggagataatataaataatgacattattccttgtaaaatattaggtcttaatgcaattcatttcactggtgattctaataaacttaaaacagatttaattaatttagatctaaaaatataa

SEQ ID NO: 17744 - protein, 207 aa, Unknown
  Obtained from environmental sample
  DOMAIN (2)...(192): haloacid dehalogenase-like hydrolase
  misc_feature (1)..(207): Xaa is any amino acid
MIKLIIFDLWYTLIYKKQSTNTRELMYSMCPQKISLSEFSKISTTVIQTKKWNSKLEAYEELARQSQLDKPKEIAKRWFELRKSKDSKFLTYDYVIPLLKKLSKNYKLGLISNCTYYSAEIMKKETSIFDYIDYEILSFQVGLLKPDLNIFLKMLEKANVKPEEAVMIGDNINNDIIPCKILGLNAIHFTGDSNKLKTDLINLDLKI

SEQ ID NO: 17745 - DNA, 612 bp, Unknown
  Obtained from environmental sample
  misc_feature (1)..(612): n is a, c, g, or t
ttgaaagaagttttctttgtaacagctacaaatacagatgtgggtaaaagttatgcatctgaaatctttcttgaaaagtttgcaaaagaaaataaaaaagttggctattttaaacctattgaaacaggtgtagatacactcccacaagatggtttgaaattgttacaaatagtacaaaacctcaatccccatttcactccagaccttaacgaagttgtaccttatcaatttaaactaccagctgccccatttgttgctaaaggtgatacaaagattgatatccaaaacttgctacaaaaagcaaaaaatcttttaaattattgtgatgttttaattgttgagggtgctggtggattaatggtaccaattgagaaaaactattttatgattgatttgattaaagagtttcacaaacaattaaatgcaaaaacgatacttatatctcctagtaacttggggagtattaacgatactatgctttctcaaactctattaaagaattataatataaattatgaatggtatattaacctttataaagataaagagagttttaaaactgtcactttgcctttttataaagagtatttcaatcaaataaattatttgtaa

SEQ ID NO: 17746 - protein, 203 aa, Unknown
  Obtained from environmental sample
  misc_feature (1)..(203): Xaa is any amino acid
MKEVFFVTATNTDVGKSYASEIFLEKFAKENKKVGYFKPIETGVDTLPQDGLKLLQIVQNLNPHFTPDLNEVVPYQFKLPAAPFVAKGDTKIDIQNLLQKAKNLLNYCDVLIVEGAGGLMVPIEKNYFMIDLIKEFHKQLNAKTILISPSNLGSINDTMLSQTLLKNYNINYEWYINLYKDKESFKTVTLPFYKEYFNQINYL

SEQ ID NO: 17747 - DNA, 699 bp, Unknown
  Obtained from environmental sample
  misc_feature (1)..(699): n is a, c, g, or t
gtgctggagagaattttaagtgagtcaggtctgcgagagggtcatgaatataaagttcaaggtagttttaaagatggtgagagtaaaacactaagacctgatgttgtagttcatcttcctgaaaataaagatatcatcatagattcaaaagtttctcttgtcgcttatgagtcatttattaaaagtgatgatcctctagcgaaagatagagctttaaaaaatcatatatcttccataaatgcacatatcaaaggactctctcaaaagagatatgagaacttaataggtgttaatagtttggattttgttcttcttttcatgccgatcgagggtgcttttttggttgcactagagagagataatgatttttttaaaactgcttatgatcaaaatattatggtagtctctccatcaacacttttagtaactctgagaacaattgaacatatctggagacgtgagagacaagaagagtcagcaaaagagatagcagcacaagcagaggcactttatgataaatttgtagggtttgtagaagatatggaaaaaataggcgagcagatagatagaactcatgatgtatataataaagcgatgaataaacttacaactggtagaggtaatcttattagacgagcagaaaatatacgcgaattaggactgaagccgaaaaagattttatctataaaagataattag

SEQ ID NO: 17748 - protein, 232 aa, Unknown
  Obtained from environmental sample
  DOMAIN (1)...(230): RmuC family
  misc_feature (1)..(232): Xaa is any amino acid
MLERILSESGLREGHEYKVQGSFKDGESKTLRPDVVVHLPENKDIIIDSKVSLVAYESFIKSDDPLAKDRALKNHISSINAHIKGLSQKRYENLIGVNSLDFVLLFMPIEGAFLVALERDNDFFKTAYDQNIMVVSPSTLLVTLRTIEHIWRRERQEESAKEIAAQAEALYDKFVGFVEDMEKIGEQIDRTHDVYNKAMNKLTTGRGNLIRRAENIRELGLKPKKILSIKDN

SEQ ID NO: 17749 - DNA, 642 bp, Unknown
  Obtained from environmental sample
  misc_feature (1)..(642): n is a, c, g, or t
atgacagatcggctgagacatgctacgatgggcacttttgggctttatggcgaaagtgcagaggatagagtagcagaattttttaaaaatatgtttaatacaatgttcgtattagtacgttcagaaacaatgaattttatacaaccttcaaattttgaagatatgcatttaagtcattttagtacagaatataattggtttatgactgctgtattagcaggtaaaataaaacattttcctaaacctcaattaattcgtcaatttcatggaaaaaacttgagtcaaaggaatgataatcacccacataaaggaataatgaaagaattattatctcctacttggaacaaagatgtaaattattttaatgaaaatatgattcaactagttaaaaaacttacaaaactagaagatcaaaaaaaatctcaagaaatagctatgcaaatattgtcaaattatcttttgttacgaattaatgatgtaaaagaattaaaagctgataatttaattttattaaaattttttaataaaattaaattgaagtgtaaagacttaaagaatataacttattatataaaatatacaaataagtataaattattttctgatgtagttaaaacaatgataaaatataaagtgaactaa

SEQ ID NO: 17750 - protein, 213 aa, Unknown
  Obtained from environmental sample
  misc_feature (1)..(213): Xaa is any amino acid
MTDRLRHATMGTFGLYGESAEDRVAEFFKNMFNTMFVLVRSETMNFIQPSNFEDMHLSHFSTEYNWFMTAVLAGKIKHFPKPQLIRQFHGKNLSQRNDNHPHKGIMKELLSPTWNKDVNYFNENMIQLVKKLTKLEDQKKSQEIAMQILSNYLLLRINDVKELKADNLILLKFFNKIKLKCKDLKNITYYIKYTNKYKLFSDVVKTMIKYKVN

SEQ ID NO: 17751 - DNA, 759 bp, Unknown
  Obtained from environmental sample
  misc_feature (1)..(759): n is a, c, g, or t
atgaaatacctgttgatattgattttattggtatttacaggttgtaataatgtacaagacaagcttagaaacagtgttcaaacagaaaatgcaaaacatataagaaataattacaaagctttagttgaactacttttagagtataaagtaaaattagataaaagaaacccaaaagcttatagttcacagcttaacaacttattgagaaagaatatcgatgagaatatcgatgagataaatctctatgtagataatagtatcccattgaaacattatcaagattatctcaaccatgcttttgataaaaaaacagatgtgagttatagaagtgattatcttgcaattggtatttataaaatgttttatgaagcatatgatatggattctaaatataagatgacagctttaagttatgatgttgataaactacaaaaagcgtataaaaacttacaaattattcagtggagaattaagtttaataaagataatagtgataagtatctttttttaacatggcaaaataattggcaaattgaactagaaaaaaaattaaatactcagactatagatactattaaattagctgatttatactatataaaatcaaagcaagaatcagtgttagacccatcaaataatagttttgaagttatcacatctaaaatgttattatatctagaaaatagtcttatattattaaatgttgaacctgaagaattagggatagaaactattatgagtattttatttttaatataa

SEQ ID NO: 17752 - protein, 252 aa, Unknown
  Obtained from environmental sample
  SIGNAL (1)...(18)
  misc_feature (1)..(252): Xaa is any amino acid
MKYLLILILLVFTGCNNVQDKLRNSVQTENAKHIRNNYKALVELLLEYKVKLDKRNPKAYSSQLNNLLRKNIDENIDEINLYVDNSIPLKHYQDYLNHAFDKKTDVSYRSDYLAIGIYKMFYEAYDMDSKYKMTALSYDVDKLQKAYKNLQIIQWRIKFNKDNSDKYLFLTWQNNWQIELEKKLNTQTIDTIKLADLYYIKSKQESVLDPSNNSFEVITSKMLLYLENSLILLNVEPEELGIETIMSILFLI

SEQ ID NO: 17753 - DNA, 624 bp, Unknown
  Obtained from environmental sample
  misc_feature (1)..(624): n is a, c, g, or t
ttgaaatttgaaagagcaaaagcaaaagtttttttagttggtgaagatggagacctctatcttaatggtaagtttgaaaaagtacttcatgcgagaaatagagtatttgaagtagatgcagatactaatatggaatttagaattagaaatggatataaagaggttgttttttataaggatatttatgcagatagttttaacgagttatcatatgaacttataacaatacctcttgatataagactttatacacaaaccatagacaacgagatgtgggaagatacaaaaaatgctacaaatacaccaattgagtgggaaaaagcaaaaaaatattgtaaaaatttacgaataggggagtttgaagattggcaactaccaactatagcgcagctggataatcttcacaaaaatcataaagatgagatatataatggttatggtggagttttttattggtcaaatgatacagagtctgggcaaaataatatttggcagtacgcaaaagggctaaatatagaagatggagaaataatcaaatcagttcaagagtttaaagatggacgggttcgatgtgtacgaattatcaataaagatttaccatacctcaatttgaaatggacataa

SEQ ID NO: 17754 - protein, 207 aa, Unknown
  Obtained from environmental sample
  misc_feature (1)..(207): Xaa is any amino acid
MKFERAKAKVFLVGEDGDLYLNGKFEKVLHARNRVFEVDADTNMEFRIRNGYKEVVFYKDIYADSFNELSYELITIPLDIRLYTQTIDNEMWEDTKNATNTPIEWEKAKKYCKNLRIGEFEDWQLPTIAQLDNLHKNHKDEIYNGYGGVFYWSNDTESGQNNIWQYAKGLNIEDGEIIKSVQEFKDGRVRCVRIINKDLPYLNLKWT

SEQ ID NO: 17755 - DNA, 507 bp, Unknown
  Obtained from environmental sample
  misc_feature (1)..(507): n is a, c, g, or t
atgagttatgaattaaagttgaaaatagaagatataataaaattaaaaagcacagaaagttgtagttggagtgattatataaatttagattttcttgctttttatactgataattataaaataaatgacatagagagttgtcttgtgaaagataaaattaaaatcgaagaaaagatacatgatactatttcagattgtaggcaaagaagtttatgtgttatttattttgaagataaaccatttgtattatatcaagacaatggtaagggtgaaaattattccaatacgcatactatagataaacatacatttgctaattgcttaaattatattaacacattactagcagagcaaactatagaaaacgatgaaagttatgatacaattattgacataaaatcttataatatgatagacttatacttagaagataacacaattaaaacaaaaagaagtgacgaactaatagatttaaataaaagattaaaatttgaaagtgagaattaa

SEQ ID NO: 17756 - protein, 168 aa, Unknown
  Obtained from environmental sample
  misc_feature (1)..(168): Xaa is any amino acid
MSYELKLKIEDIIKLKSTESCSWSDYINLDFLAFYTDNYKINDIESCLVKDKIKIEEKIHDTISDCRQRSLCVIYFEDKPFVLYQDNGKGENYSNTHTIDKHTFANCLNYINTLLAEQTIENDESYDTIIDIKSYNMIDLYLEDNTIKTKRSDELIDLNKRLKFESEN

SEQ ID NO: 17757 - DNA, 639 bp, Unknown
  Obtained from environmental sample
  misc_feature (1)..(639): n is a, c, g, or t
atgatacattatttaattgttgatgatgaacccattgcgcatcgtattatagaaaaatattgcaatgatttaccttatttggaaaaaaaaggtaattgctacaatgcatttgaagcaatgcaatttttaaatgagaatgaagtcaatttattgtttttggatataaatatgccgagattatctggttttgattttttaaaaacaatcccaaatccaccaaaaattattgtaacaactgcctacaaagagtttgcattagaaggatatgagcttaatatttccgattatttattaaagccttttagctttgaacgttttgccaaagcagtcaataaaactgtaatgagtcaagcgattattgaagaaaacactactaaaacagtaattgaagatgcaaaaacaaagtctaaaagtttctttttaaaaggcgacaaaaaacaccatcaaatacatttagaatctattttatttatagaagcttacggacattttactaaagtatatttagaaaataaaatgattttaagtaacgaaaaaatttcttcttttgaagagtttttaccaaaaaacgaatttattcgcacgcacaaatcatttattattgcccaaacaaaaaatcatcaaattgaaaggaaatag

SEQ ID NO: 17758 - protein, 212 aa, Unknown
  Obtained from environmental sample
  DOMAIN (2)...(118): Response regulator receiver domain
  misc_feature (1)..(212): Xaa is any amino acid
MIHYLIVDDEPIAHRIIEKYCNDLPYLEKKGNCYNAFEAMQFLNENEVNLLFLDINMPRLSGFDFLKTIPNPPKIIVTTAYKEFALEGYELNISDYLLKPFSFERFAKAVNKTVMSQAIIEENTTKTVIEDAKTKSKSFFLKGDKKHHQIHLESILFIEAYGHFTKVYLENKMILSNEKISSFEEFLPKNEFIRTHKSFIIAQTKNHQIERK

SEQ ID NO: 17759 - DNA, 606 bp, Unknown
  Obtained from environmental sample
  misc_feature (1)..(606): n is a, c, g, or t
atgaaaaaactttcaaaaactggttctttagctgaatacacaaagctaaatgaacaaattgaaaaattagcggaaaaaaaaggtagagatgaaaaactacttgaagagttagaaagtatagaaaatgaaattaaagatttagaaaataaactttcaaaaatcaagcaaaatttagataataatttagaagattttgataaaaaactaaccatatttaataattcatttagcaattattcaaaagtattatatgacaaagaatattttttatcatatgataaagatgaagagccaataaggctttatacgaaaaatgttggtggtaatcagggaagtggtaaaaagcaagcaataatctctgcatttgatttagcatatattgattttattagtgaattaaaattaagttttcctcattttgttgctcatgataaagttgaactaatcgatattgataaattaaaaagtttatttgatatatcaaataaaataaatggacaatatattgtgccaataattcaagataaaattgagagtatattacctgaatttaataaaaacgttattttagttttatctgaaagtgataagttttttaagatttga

SEQ ID NO: 17760 - protein, 201 aa, Unknown
  Obtained from environmental sample
  misc_feature (1)..(201): Xaa is any amino acid
MKKLSKTGSLAEYTKLNEQIEKLAEKKGRDEKLLEELESIENEIKDLENKLSKIKQNLDNNLEDFDKKLTIFNNSFSNYSKVLYDKEYFLSYDKDEEPIRLYTKNVGGNQGSGKKQAIISAFDLAYIDFISELKLSFPHFVAHDKVELIDIDKLKSLFDISNKINGQYIVPIIQDKIESILPEFNKNVILVLSESDKFFKI

SEQ ID NO: 17761 - DNA, 726 bp, Unknown
  Obtained from environmental sample
  misc_feature (1)..(726): n is a, c, g, or t
gtgcggccactgggcaggaataacatagatttagaagctgcaaaaactaaaaatatcgttgtaaaaaatgtggcaggttactcaacagactcagtaatacagcacaccttctccatgctcttctatctgtcgggtcactctcgttattatgatgagtatgtaaagagtgatgagtggagcaagagtgctatttttacaaatgtaaccatgccttttggtgagattaagggtaaaaagtacggtattatcggtcttggtgagataggtcgcggtgttgcaaaaatcgcttctacttttggcagtgaaatttgttactactctacaagtggaaaaaatagcaactctgaatttcaaagagtagagcttgatgagatgcttagttcatgtgacattatctccattcatgcaccacttaatgagcagacaaaaaacttgcttgattatgagaaactttcaaaactaaaagatggtgcaattttactaaatcttggtcgtggtggtattgttaatgaagatgatctttcacgcattttagatgagaaaaatatttttgtaggacttgatgttttagaaaaagagcctatgaaaaaagatcatccacttctaaagattaaaaacttgaatagactatatatcacccctcacattgcttgggcatctattgaagctagagatactttaatcgaaaagatcattataaatattgacgagtttttacaagcttaa

SEQ ID NO: 17762 - protein, 241 aa, Unknown
  Obtained from environmental sample
  DOMAIN (32)...(215): D-isomer specific 2-hydroxyacid dehydrogenase, NAD binding domain
  misc_feature (1)..(241): Xaa is any amino acid
MRPLGRNNIDLEAAKTKNIVVKNVAGYSTDSVIQHTFSMLFYLSGHSRYYDEYVKSDEWSKSAIFTNVTMPFGEIKGKKYGIIGLGEIGRGVAKIASTFGSEICYYSTSGKNSNSEFQRVELDEMLSSCDIISIHAPLNEQTKNLLDYEKLSKLKDGAILLNLGRGGIVNEDDLSRILDEKNIFVGLDVLEKEPMKKDHPLLKIKNLNRLYITPHIAWASIEARDTLIEKIIINIDEFLQA

SEQ ID NO: 17763 - DNA, 519 bp, Unknown
  Obtained from environmental sample
  misc_feature (1)..(519): n is a, c, g, or t
ttgatcttattacagataaaagtatggaagaaatttgtgaggttgtatatgattttggtgcgtgtaagtggacgcatggagattgttagtgaagatcccttagtaattgttgattttgctcatacaccagatggaatggcacagatactaaatgcattaaaagagaaagagatattagtagtttttggtgcgggtggtaatcgagataaaagtaaacgtcctctcatgggaaaagttgcagcttcattagcaaaacatctctatattacaagtgataatccaagacatgaagatcctgaattgataatagaggatattctaagcggtatagaagatagatcatcagttagtgtaaatgtaaacagaaaagaggcaataaaaaaagctcttaaagatcaaaaaaagaatgaaactgttttgatactaggtaagggtgatgaaacttatcagatcatttatgataagagattcccttttgatgacagagaagttgcaaaagagcttctgcttttaaaatag

SEQ ID NO: 17764 - protein, 172 aa, Unknown
  Obtained from environmental sample
  DOMAIN (22)...(105): Mur ligase family, glutamate ligase domain
  misc_feature (1)..(172): Xaa is any amino acid
MILLQIKVWKKFVRLYMILVRVSGRMEIVSEDPLVIVDFAHTPDGMAQILNALKEKEILVVFGAGGNRDKSKRPLMGKVAASLAKHLYITSDNPRHEDPELIIEDILSGIEDRSSVSVNVNRKEAIKKALKDQKKNETVLILGKGDETYQIIYDKRFPFDDREVAKELLLLK

SEQ ID NO: 17765 - DNA, 381 bp, Unknown; identical to SEQ ID NO: 11419
  Obtained from environmental sample
  misc_feature (1)..(381): n is a, c, g, or t

SEQ ID NO: 17766 - protein, 126 aa, Unknown; identical to SEQ ID NO: 11420
  Obtained from environmental sample
  misc_feature (1)..(126): Xaa is any amino acid

SEQ ID NO: 17767 - DNA, 540 bp, Unknown
  Obtained from environmental sample
  misc_feature (1)..(540): n is a, c, g, or t
atgattagattaatagcagtacaacttctcttagtaacttttttgctaagtgaagatttagatataaaaaaacttcaaaatgagtttattaaaaatgtgattgaacttaatgtttataaaaaaagatattctcaatttcttgacaaaaagtgtcaaacagattatatctgtttgcaagaacagatacaaagactcaaaacttgggaaagtgttcaaaatgataatatactaaaaaaacttcttaagaaaaaacttttaaaaacactttatgataaagagtattgggaaaaagttttaaccaaaataacacaaacaaatataaatcttaaagagagtcagttcgtcagtattattgacctaaaaaaccaatacttcatagttgcactttgggataataaaacaaaacaatataactatataggtagagatttaatctcaagtgggaatatcanaagagaagcggaagtaaaatatggtgataatcattatttaaaaacacctgcgggtgtttttgaaacacagttagggttggcgttctga

SEQ ID NO: 17768 - protein, 179 aa, Unknown
  Obtained from environmental sample
  misc_feature (1)..(179): Xaa is any amino acid
MIRLIAVQLLLVTFLLSEDLDIKKLQNEFIKNVIELNVYKKRYSQFLDKKCQTDYICLQEQIQRLKTWESVQNDNILKKLLKKKLLKTLYDKEYWEKVLTKITQTNINLKESQFVSIIDLKNQYFIVALWDNKTKQYNYIGRDLISSGNIXREAEVKYGDNHYLKTPAGVFETQLGLAF

SEQ ID NO: 17769 - DNA, 759 bp, Unknown
  Obtained from environmental sample
  misc_feature (1)..(759): n is a, c, g, or t
gtggccgagtatatatcaagtaatggactccctggaatgttgagaatgcagacacacggaggtagagccagagcaataattgaaggagctaacaagatagatataacattcatcgcagctccatatgccaatatttatggtgacgcggttggatatttaggtaaaaataaatgtggtagcttggggtataccatacccgattcaaaatatgctaaattaaaagtattggttactgataatttagttgatgatgaaatactaaatccagaaatctcagggttaaacatagactatatattaaaagtaaattctattggtgagaaaaaaggaattgtttcaggtacaacacaaattacaaccaatccaattggagtaaaaatagctaaaaacacatcaagactgctttttgagctaggacttataaaacctgggttctctttccaaagtggagcaggtggtgttagtttgcgagctactaaagatttgaaagacataatgattaaagaaaacattaaagctagtttctttagtggtggaatcactaaataccatgttgaaatgttagaagagggactcgttgagaaattgtatgatgttcaatgttttgatttatatgcagttgattcaatactaagaaatgagaatcacattccaattagtgcttcaacttatgctaatcctaataaccctaatcaagttattaaagatttagatatggtaattttaggtgcaacagaaattgatataactataatgtaa

SEQ ID NO: 17770 - protein, 252 aa, Unknown
  Obtained from environmental sample
  DOMAIN (1)...(252): Citrate lyase, alpha subunit (CitF)
  misc_feature (1)..(252): Xaa is any amino acid
MAEYISSNGLPGMLRMQTHGGRARAIIEGANKIDITFIAAPYANIYGDAVGYLGKNKCGSLGYTIPDSKYAKLKVLVTDNLVDDEILNPEISGLNIDYILKVNSIGEKKGIVSGTTQITTNPIGVKIAKNTSRLLFELGLIKPGFSFQSGAGGVSLRATKDLKDIMIKENIKASFFSGGITKYHVEMLEEGLVEKLYDVQCFDLYAVDSILRNENHIPISASTYANPNNPNQVIKDLDMVILGATEIDITIM

SEQ ID NO: 17771 - DNA, 783 bp, Unknown
  Obtained from environmental sample
  misc_feature (1)..(783): n is a, c, g, or t
atggatgataagcaaaaagaagaaattaaattaaaattacaagaatttggattaaataattggtaccataatattgaagtgattaaaggtagcggaatctttactcaagaagaaaaaacttgtgtgaattttggaagaaaatttgcacttaaaggaataccagaaagctattgggttggaaaaagagtattagatcttgggagttttagtggagcactaagtttcgctcttgaagatcttggcgcagaagttgttgcagttgatgtacaagatccagacttaaatggttttggattaattcataatattagaaactcaagtgtagagttcaaacgaataagtatatatgaccttgaccctgaggagttaggtttatttgatgtagttgcatttactgggttattttatcatctaaaacatcctctccttgcctttgaaagaataaatagtgtttgtaaagaagatgcatatttaattacaataggaacttcatcagacttatggtttcataatgatgaaacaaacagctgtgatgatggagtgagttttttatcaacagtagtatccaatggtaagagtttaaataaatatcctatttgtggattttctgctaatcactattatactgatacatctaattggtttatcccaaatcttacatgcttaaaaagttggcataaagcatcaggttttgatgttattcacgaagaacttaaagaaagcacaaaagtattgacttatcctgaaggagataaaatagttccccgatcaattatgaaataa

SEQ ID NO: 17772 - protein, 260 aa, Unknown
  Obtained from environmental sample
  misc_feature (1)..(260): Xaa is any amino acid
MDDKQKEEIKLKLQEFGLNNWYHNIEVIKGSGIFTQEEKTCVNFGRKFALKGIPESYWVGKRVLDLGSFSGALSFALEDLGAEVVAVDVQDPDLNGFGLIHNIRNSSVEFKRISIYDLDPEELGLFDVVAFTGLFYHLKHPLLAFERINSVCKEDAYLITIGTSSDLWFHNDETNSCDDGVSFLSTVVSNGKSLNKYPICGFSANHYYTDTSNWFIPNLTCLKSWHKASGFDVIHEELKESTKVLTYPEGDKIVPRSIMK

SEQ ID NO: 17773 - DNA, 618 bp, Unknown
  Obtained from environmental sample
  misc_feature (1)..(618): n is a, c, g, or t
atgttacaacatggtgtagatgtgtgggagaatggagagacttattcttataaacctgctttatattcaggtgattgttttaggcatacaattgaaactggagaattaggattatttgtgggaagctcaggattgatatttcagcgtaaaacacttgaaaaaataatgcctgtaccattagattttagaattagtgctgatgcatttttaactagaacaagttttacaacaggtttcgtttattctattcctgaagctttaggatattatcgtaagcataataatgctgtattagataataaaagtcatgatcaccatacttttcagaaaaatatacttttccctcaccttaataacttttataaaaaaagaaatattgactatagatataaaacaagagatgaaattccagtagggcttttaacctatgaacagcatttgttaaattatttattaataaaaaagattcatgatatatgtactacgtatgaaaaagttgcaatatttggaataggaggacatacaaaatggctttctcaaaaattaaaaaccataaaaatgatggtattgttgctgtataagatacaaccttccactgatgtaaatattttgatttga

SEQ ID NO: 17774 - protein, 205 aa, Unknown
  Obtained from environmental sample
  misc_feature (1)..(205): Xaa is any amino acid
MLQHGVDVWENGETYSYKPALYSGDCFRHTIETGELGLFVGSSGLIFQRKTLEKIMPVPLDFRISADAFLTRTSFTTGFVYSIPEALGYYRKHNNAVLDNKSHDHHTFQKNILFPHLNNFYKKRNIDYRYKTRDEIPVGLLTYEQHLLNYLLIKKIHDICTTYEKVAIFGIGGHTKWLSQKLKTIKMMVLLLYKIQPSTDVNILI

SEQ ID NO: 17775 - DNA, 525 bp, Unknown
  Obtained from environmental sample
  misc_feature (1)..(525): n is a, c, g, or t
atgaaaaataagaataaacagtcttcaccccagtcagaattagaactcactcggtggagcaccaggacctatataaaagcattttgctttttactttccgtcacaataattattattaccattgtcagttttcattattttaaagccagcaaccattctatggacctactaaccatggaagagagaacttggctgaaagcccatgacggcaagatccgactggcccctactcctcactgggcgcccatggaattcattgatgaaaaaggtcgctaccagggactggttgccgattacatccgactcattgagcagaaccttgattttacatttcaacttgtcaaggtgggctcctggagcgaagccgttgaaaaagcaaaaaaaagagaactggatgtatatgcatcggccatgaaaacccctatccgcatggaatacatggattttacaacaccctattttaatctgccctataccatcatatctcgcaaatcggtgaaggatacgctcacccggaacagatga

SEQ ID NO: 17776 - protein, 174 aa, Unknown
  Obtained from environmental sample
  misc_feature (1)..(174): Xaa is any amino acid
MKNKNKQSSPQSELELTRWSTRTYIKAFCFLLSVTIIIITIVSFHYFKASNHSMDLLTMEERTWLKAHDGKIRLAPTPHWAPMEFIDEKGRYQGLVADYIRLIEQNLDFTFQLVKVGSWSEAVEKAKKRELDVYASAMKTPIRMEYMDFTTPYFNLPYTIISRKSVKDTLTRNR

SEQ ID NO: 17777 - DNA, 678 bp, Unknown
  Obtained from environmental sample
  misc_feature (1)..(678): n is a, c, g, or t
atggagagatttaagcagcaacaaaaagctctgcaacctatcaaaataagagataaaatcattgatcccagtgatttcatctttattgctggtccctgcactatagagaattatgatgaccttctattaatagtaaatcgactaaaagagatgggaatcaaattttttagaggtggcgcatataaaatgcgaacctcaccttacgattttggaggtttaggagagatcggtcttaaatatctcaagaaagtcagcgataaaactggtttgatctctgtttccgaagttatctcaagtgaagatgtagggatcgtgtctaagtatgttgatattcttcaagttggtacacgaaacatgcataattatcctctgctaaaaaaactaggcaaaatcaataatcccatcattttaaaacgtggaatgagtagtacaattgaggagtggctctttgctgcggaatatattctagaagcgggaaatcaacaggttattctttgcgaacggggaattagaactttcgaaacctttaccagaaacacacttgacatctctgcgataacatcagtaaaacagttatctaatcttcccgttattgttgatccatctcacagttctggaaaaagagagatgattaaatctctcagttgggctgctgctgctgctggtgccgatggttga

SEQ ID NO: 17778 - protein, 225 aa, Unknown
  Obtained from environmental sample
  DOMAIN (18)...(225): DAHP synthetase I family
  misc_feature (1)..(225): Xaa is any amino acid
MERFKQQQKALQPIKIRDKIIDPSDFIFIAGPCTIENYDDLLLIVNRLKEMGIKFFRGGAYKMRTSPYDFGGLGEIGLKYLKKVSDKTGLISVSEVISSEDVGIVSKYVDILQVGTRNMHNYPLLKKLGKINNPIILKRGMSSTIEEWLFAAEYILEAGNQQVILCERGIRTFETFTRNTLDISAITSVKQLSNLPVIVDPSHSSGKREMIKSLSWAAAAAGADG

SEQ ID NO: 17779 - DNA, 1011 bp, Unknown
  Obtained from environmental sample
  misc_feature (1)..(1011): n is a, c, g, or t
gtgtttnnnnnnnggattatggctcagcgcattcaatcagatatactcaaaaaaccgacatttgcaccataccatttacatattgataaccagtcattaactagtaataaatataatctgaactatcttatatataatctttcctttgacaaagcattaaaagattttttgagtgttacaactttcacacatttgacactattaacaaacagcatattctcttcaaccttccccgaagtactagagagtttaaaagtaaatgctgcaaaaaaaggtatacaactcaataccgttatcggcacatcaaaagagaatgatattctctctataatagcaccagatactaaagccgttatgcttacaccacttccagcactaagcgaacaagacaaagaacagattttccaagatttaatcaaaaaacatattcctacttacgctcttggaaatgacctgagagttgaaaaaggggtactgatttcatctttctcaatggaaaatcagtcccgaagaattaggcagttagcattgaacattcaagctgttatacgaggtgaagatgcagagacattacctataaagtttgacgaaaaatatcaattaaacattaatatcgccacagcaaatgccattggtctctatccacctataaatatattgagacaggctaaactttttagtgaagaaaattataagaaagatgatctactaacactttcagatgtagcgaaacaggctataaaaaacaacctgcgtatcattgctggtaagttaaccgtaacgtctgaagatgaaaatatcaaagagatacgatcgatcctatttccacagataacaggcaatctctcatatatgcagcaaaacagtgataatatttatgttaaaaatggcttttacgctgaaaaaaagtcttctggtgttatcaagctgcatcaaactatttttctcagaaaaaacgatggctgcagtggagatacaaaaagatatgaaaaatgctgcacaggcaccaca

SEQ ID NO: 17780 - protein, 337 aa, Unknown
  Obtained from environmental sample
  misc_feature (1)..(337): Xaa is any amino acid
MFXXXIMAQRIQSDILKKPTFAPYHLHIDNQSLTSNKYNLNYLIYNLSFDKALKDFLSVTTFTHLTLLTNSIFSSTFPEVLESLKVNAAKKGIQLNTVIGTSKENDILSIIAPDTKAVMLTPLPALSEQDKEQIFQDLIKKHIPTYALGNDLRVEKGVLISSFSMENQSRRIRQLALNIQAVIRGEDAETLPIKFDEKYQLNINIATANAIGLYPPINILRQAKLFSEENYKKDDLLTLSDVAKQAIKNNLRIIAGKLTVTSEDENIKEIRSILFPQITGNLSYMQQNSDNIYVKNGFYAEKKSSGVIKLHQTIFLRKNDGCSGDTKRYEKCCTGTT

SEQ ID NO: 17781 - DNA, 597 bp, Unknown
  Obtained from environmental sample
  misc_feature (1)..(597): n is a, c, g, or t
gtggagctattgtcttctatatcaacacaaaactcatacagcagcgattatatacttcactatgaaaaacaagagagcaataacttgctctttttagtcggtggtctagctaaatcatataaaatagataaacactccaatgaaatctttttgtactacatctacaaaaattctcttttatcagaaatctcagatatctccagcggtactttactctctttctccaacatagctattgtagaagattctcaaatattgagtattgattatcaacaatttaaagaacacttcttaaataagcatctattatgtatcgaattaattcaggaaatctgttcaaggtcgcaaaaattagaatctttaataaatcgcgaatttatatttgattcagttcaaaaagtagcacagatgctggatgcagacatagatatgtttaacaagctcaaacggcacgacatttcacttatacttcatatacaacctgcaactctatcgcgtgtattaaacagactaaagcgaaataagattattgatatactacaaggtaaagtcactgtgttagatacaatagcactcaaggagataagaaatgactaa

SEQ ID NO: 17782 - protein, 198 aa, Unknown
  Obtained from environmental sample
  misc_feature (1)..(198): Xaa is any amino acid
MELLSSISTQNSYSSDYILHYEKQESNNLLFLVGGLAKSYKIDKHSNEIFLYYIYKNSLLSEISDISSGTLLSFSNIAIVEDSQILSIDYQQFKEHFLNKHLLCIELIQEICSRSQKLESLINREFIFDSVQKVAQMLDADIDMFNKLKRHDISLILHIQPATLSRVLNRLKRNKIIDILQGKVTVLDTIALKEIRND

SEQ ID NO: 17783 - DNA, 345 bp, Unknown
  Obtained from environmental sample
  misc_feature (1)..(345): n is a, c, g, or t
atgactaagataaaagtagttggtctactggttttaatattatcaattgctctggctattttatctagctatatatctattgaaaacaaaataaataacaatgtccttgacattataaacactcagaaaggttttactcaagagatttcaaagaacatcttttacatatataaaaacaaaaatgcttctaccnnaacactagataattctattaaaaaattttcacacaacttaagacaaagaaaaagtataaattctatagaaatcaatgagattnaagagaagagtcaagaaatagtaatattatggaaacaattttatctatctgtacaactcttcagaaga

SEQ ID NO: 17784 - protein, 115 aa, Unknown
  Obtained from environmental sample
  SIGNAL (1)...(19)
  misc_feature (1)..(115): Xaa is any amino acid
MTKIKVVGLLVLILSIALAILSSYISIENKINNNVLDIINTQKGFTQEISKNIFYIYKNKNASTXTLDNSIKKFSHNLRQRKSINSIEINEIXEKSQEIVILWKQFYLSVQLFRR

SEQ ID NO: 17785 - DNA, 786 bp, Unknown
  Obtained from environmental sample
  misc_feature (1)..(786): n is a, c, g, or t
ttggatacttcagaaaaaaatcgaaagttattattttttctaagtttgtatcatgatcattatgggaataattttaatggatatgaaatatcattgatgaaaattctatttgcttctactcctgatatggaagttcaggatgaggatttatttttattctttaaaagtgtgattaatagtctgaatgtttttgtatcatatatagatcttgaagcggctaattttactttgatcaaattagtaaatatggagattaaacatattcaaaaagcatacaaaactacaaataacttatctatttataaaaaattacatattgaatttgaagatcggttgatttcaggaaaaatgttaaaaaaggtaaaaataaatggcaagatagttgaaaatgagcatatcttccatctccttgatttaggaattaatcttaagattgaagaacgtaaccagttagatggtatggagttaagaataaagagtacgcgaacttatggtagagtcataaaagaagacggcataagtattattgaattattagttatgccaaatgaattaaacaaaacttacgaagaaattgaatccagaaaacaattaataactagtatacttgaagataatcctaataataattatagaaaattattcccactttctgatataatgaaggatgcaaagattttttttaatggcttcgatgacaaaattaaattatgtagcatgttgaaagaacattatagaaatgagaatattgaaggaaagaataataaactggttatcccttattaa

SEQ ID NO: 17786 - protein, 261 aa, Unknown
  Obtained from environmental sample
  misc_feature (1)..(261): Xaa is any amino acid
MDTSEKNRKLLFFLSLYHDHYGNNFNGYEISLMKILFASTPDMEVQDEDLFLFFKSVINSLNVFVSYIDLEAANFTLIKLVNMEIKHIQKAYKTTNNLSIYKKLHIEFEDRLISGKMLKKVKINGKIVENEHIFHLLDLGINLKIEERNQLDGMELRIKSTRTYGRVIKEDGISIIELLVMPNELNKTYEEIESRKQLITSILEDNPNNNYRKLFPLSDIMKDAKIFFNGFDDKIKLCSMLKEHYRNENIEGKNNKLVIPY

SEQ ID NO: 17787 - DNA, 321 bp, Unknown
  Obtained from environmental sample
  misc_feature (1)..(321): n is a, c, g, or t
atgaaaatgaattttagatacaataattttatgaatatactagaaaccatcaaacaaagaaaatcagtacgagcatttttaaaaaaagatgttgaattagaaaaaataagaactatttttgatactgctaaacacgcaccatctggggtcaatatgcaaccttggcaagtggcagttgtaagtggtgatactaaaaaaactattgaaattcaaatgatagaagcttttaaaaacaatgaacctgagagaatggaatacaactattatcctctaaagtgggaagaaccatacaaaactagaagaaaagagactgtcttttga

SEQ ID NO: 17788 - protein, 106 aa, Unknown
  Obtained from environmental sample
  DOMAIN (17)...(106): Nitroreductase family
  misc_feature (1)..(106): Xaa is any amino acid
MKMNFRYNNFMNILETIKQRKSVRAFLKKDVELEKIRTIFDTAKHAPSGVNMQPWQVAVVSGDTKKTIEIQMIEAFKNNEPERMEYNYYPLKWEEPYKTRRKETVF

SEQ ID NO: 17789 - DNA, 423 bp, Unknown; identical to SEQ ID NO: 8191
  Obtained from environmental sample
  misc_feature (1)..(423): n is a, c, g, or t

SEQ ID NO: 17790 - protein, 140 aa, Unknown; identical to SEQ ID NO: 8192
  Obtained from environmental sample
  DOMAIN (2)...(127): Chorismate synthase
  misc_feature (1)..(140): Xaa is any amino acid

SEQ ID NO: 17791 - DNA, 369 bp, Unknown
  Obtained from environmental sample
  misc_feature (1)..(369): n is a, c, g, or t
atgaacagttttggagagagatttaaatttacaacatttggtgagtctcatggagttgccctaggatgtattgtagatggtgttccagctggtattaaaatagatgaggcctttattcanagtgagatggatagaagaaaaccaggtaaaacaaaatatgaaacacaaagaaaagagagtgatacaatacaaattttaagtggagtatttgagggtgttagtacaggtacgcctattgctatggttttatttaacgaaaatcaaaaaagtaaagattattctaatgtaaaagatctttttcgacctgggcatgctgactttacttattttcataagtatggaataagagactatagagggtggtggtag

SEQ ID NO: 17792 - protein, 122 aa, Unknown
  Obtained from environmental sample
  DOMAIN (8)...(122): Chorismate synthase
  misc_feature (1)..(122): Xaa is any amino acid
MNSFGERFKFTTFGESHGVALGCIVDGVPAGIKIDEAFIXSEMDRRKPGKTKYETQRKESDTIQILSGVFEGVSTGTPIAMVLFNENQKSKDYSNVKDLFRPGHADFTYFHKYGIRDYRGWW

SEQ ID NO: 17793 - DNA, 336 bp, Unknown
  Obtained from environmental sample
  misc_feature (1)..(336): n is a, c, g, or t
ttgatagacaaacaagtctttggagaggaaatacaatattttgttcctcgaaaaaataaggatgaaaagtttgaggaactattggagatgcaagatacgcttgttgaaatatttaaatcagatgctgacagatctacaatccgtcttcagaagaataaaattaaatctcatttgaaatcaatgtctaatcaaatactacagattcgcttaaagccgagccaaactaaaccattgttggggaatgaccaatcatatttctctcttttcaaaattgacttaggctgttattcttttagtagtggaatcgaattaaatggaacggttgttatcatttga

SEQ ID NO: 17794 - protein, 111 aa, Unknown
  Obtained from environmental sample
  misc_feature (1)..(111): Xaa is any amino acid
MIDKQVFGEEIQYFVPRKNKDEKFEELLEMQDTLVEIFKSDADRSTIRLQKNKIKSHLKSMSNQILQIRLKPSQTKPLLGNDQSYFSLFKIDLGCYSFSSGIELNGTVVII

SEQ ID NO: 17795 - DNA, 927 bp, Unknown
  Obtained from environmental sample
  misc_feature (1)..(927): n is a, c, g, or t
gtggtagatgaagtaccactttatgagttcagcggtgagggtgacattttagttttacacattagaaaaaaaggtctctctacatgggatatgttagagattttagctaagtttttaggtattaaatctcgtgagtttggttatgcaggacttaaagataaaaatgcacagacaaaacagtacatctctattcataaaaactatgaagagaagttagagagttttgagcatgataagataaaaatactctcaaaaacttaccataacaacaagataaaactggggcatttaaaaggaaatagattttttattagaattaaaaaagtgactcctgtagcagctactaaaatagctaatgcgcttcaaaatattaaatcttttggtatgccgaacttttttggctttcaacgttttggaatgaatggagataactacaaaaaaggtgaagatatcctaaaaaatggtaaaaaagagaaaaatgtaaaactgaaaaaaatgtatataaatgcatatcagagtcatctttttaacctttggttatcacgcagactagaactatctactatgcttacatcttttggtgtagatgagttggagacacttctgaatatgccccctcatgatataaaagagcttcaaactcaaaagcatccttttaaactatttagcggtgatgtaatgatgcactatccgtatggaagactttttcactttgaaaatgcgactgaagatgtagagcgttttgaaacaagaaatatttcacctactggacttctttgtggacaaaaaagtacaaaggctacttcacaagctcacctcatcgaaaaagagtttgatgatgatataaatgttgatggagctcgccgttacgcttggatcttcccagaagatgtagagggtgagtacaaagagcatgaagcaggttga

SEQ ID NO: 17796 - protein, 308 aa, Unknown
  Obtained from environmental sample
  DOMAIN (1)...(308): tRNA pseudouridine synthase D (TruD)
  misc_feature (1)..(308): Xaa is any amino acid
MVDEVPLYEFSGEGDILVLHIRKKGLSTWDMLEILAKFLGIKSREFGYAGLKDKNAQTKQYISIHKNYEEKLESFEHDKIKILSKTYHNNKIKLGHLKGNRFFIRIKKVTPVAATKIANALQNIKSFGMPNFFGFQRFGMNGDNYKKGEDILKNGKKEKNVKLKKMYINAYQSHLFNLWLSRRLELSTMLTSFGVDELETLLNMPPHDIKELQTQKHPFKLFSGDVMMHYPYGRLFHFENATEDVERFETRNISPTGLLCGQKSTKATSQAHLIEKEFDDDINVDGARRYAWIFPEDVEGEYKEHEAG

SEQ ID NO: 17797 - DNA, 861 bp, Unknown
  Obtained from environmental sample
  misc_feature (1)..(861): n is a, c, g, or t
atgatcagatggctgaggtctatcttaaccaatcatcattgtggttttagtcaaatacagtctcattcttcactcgaaaacgactatttaaaaaatggtttttgggctatgaattttgatgaagaattgccaaataaaggattgtatgtagagttcattgtaagtattcatgatgttacaaaagaggttttagacatggttaatgatgatatgactgagaaagataaacagtctatgatctcaaaaaccagtaatggcattatgaaaaattggccaagagaatcttggcaagacgtaaagattaaatcattttataagggcaatcagtatttcttgtttgttacagagcgttttgaagatattcgtttggttggcgcacctccaacaagtattggtaaatttggaagcgacacagataattgggtatttccaagacacacgggtgatttttcaatatttagaatttatgccgatgcaaataatcatccagcaacctacagtaaagacaataaaccctaccaaccaaaacactttttaccaatttcgttagatggcgttgaagaaggggattttacaatggttttcggatttccaggcacaactaatgagtatttacctgctgttgctatcgagcacattacaaaaaatttcaatccaaccaatatagctattcgcgaagctgctttaaaagtgattgatgctgaaatgaaaaaaaatgacgctgtccgaattaaatacgcttcanaacaagcacgaattgccaacgcttggaaaaaatggattggcgaagattttagtattaaaaaaagtaatgctgtggccaaaagacgcgattttgagccacgtttacaaacgctttaa

SEQ ID NO: 17798 - protein, 286 aa, Unknown
  Obtained from environmental sample
  misc_feature (1)..(286): Xaa is any amino acid
MIRWLRSILTNHHCGFSQIQSHSSLENDYLKNGFWAMNFDEELPNKGLYVEFIVSIHDVTKEVLDMVNDDMTEKDKQSMISKTSNGIMKNWPRESWQDVKIKSFYKGNQYFLFVTERFEDIRLVGAPPTSIGKFGSDTDNWVFPRHTGDFSIFRIYADANNHPATYSKDNKPYQPKHFLPISLDGVEEGDFTMVFGFPGTTNEYLPAVAIEHITKNFNPTNIAIREAALKVIDAEMKKNDAVRIKYASXQARIANAWKKWIGEDFSIKKSNAVAKRRDFEPRLQTL

SEQ ID NO: 17799 - DNA, 771 bp, Unknown
  Obtained from environmental sample
  misc_feature (1)..(771): n is a, c, g, or t
atggcagaagaaagcgttgtggtagaaaaagagctgactataaaatcacctatagtagtgcatacaagaaatgtcgcaaaagagttaataagagtctccaaaaaatataaatttcctgttgatatgttagattttaatgtgcttgatgttaaaacttttactagaacatcagaagaggctcaaaaagacttagactggacggaactctttgatgatgacataaattactacaatgaagaagatgcaattcttacaaaagatgttcagttaaaacaagagtatgatattgaaatttttgaaaaaactgaaagagaacctatagatgatttagagacatcgataggtgcaaacaattatgtgacaacagtatacttgagtataaaaaaaggctcccatatacactattatgatggcttgaaagatgatctttaccttcttatactaaagaaaaaacttcgtgcaaatattttgattttactgtttgaggctcctcttaaagagacagttgaaaaattcactgcaaaagtacgtgttgcaggtgagatggtactgcaagataagcagatgcttcttattgcgagaggaattgacccagttgcaacggtggatgataagttagtaactaatagacagcttgaaacagtctctgtagattctgtaaaaaagatggattattcaaagcgcgggtttatgatgagtgctgttaaagatcaagtgctgtttgagtatacaaaacccaaaatgggtatagcaagccgaaattgccgaagt

SEQ ID NO: 17800 - protein, 257 aa, Unknown
  Obtained from environmental sample
  misc_feature (1)..(257): Xaa is any amino acid
MAEESVVVEKELTIKSPIVVHTRNVAKELIRVSKKYKFPVDMLDFNVLDVKTFTRTSEEAQKDLDWTELFDDDINYYNEEDAILTKDVQLKQEYDIEIFEKTEREPIDDLETSIGANNYVTTVYLSIKKGSHIHYYDGLKDDLYLLILKKKLRANILILLFEAPLKETVEKFTAKVRVAGEMVLQDKQMLLIARGIDPVATVDDKLVTNRQLETVSVDSVKKMDYSKRGFMMSAVKDQVLFEYTKPKMGIASRNCRS

SEQ ID NO: 17801 - DNA, 864 bp, Unknown
  Obtained from environmental sample
  misc_feature (1)..(864): n is a, c, g, or t
ttggttgcaaaagagaggggctatgttgtatttaaagagggtaaatatgatatagaaaataatatagatattgatgagatcagttttaaaactactggttcaattgacacaaatattgatgcagatgttactattaatgtaaaaaaagatgatgtctttgaagatgctattggaaatggcatggagattgttgtcaaaaaaattatcgtaaacggaagtactggaccaaatacctctattagatcaaaaattgctactgtttatggtcaaactcataaaacatcttttattgaggctgatgatcttaagcttaacgttcataaaggtatagctaaggcaaaaaatgcagttattacaagattagagcatggaactattaccgctgatatagctcatgtagaacaagcgttaggcggaaccattatcgctaaaactatcacaattgatcatttaggctcacatgtgactatgattgcttctgataaaatagaagtaaaaaagatgcaaggaagtgaaaacagttttattattgatccggtactaaaagatgaatcaaaacagactctaggtaaagatgaagttcttataagaaaagcaaatagaaaaattgagttgattgaagaagagttagtaaaatatagaactaggttgcttgagggaattgatctgtttaagagtgttaaatctaaattaaatcagctaagaaaagctaaaaaagagatccctgtagctctgaaaaaaaagtataaacagttcagtaatgttgaagagcatatcaaaaatttagaagaagaacttagtgaacagaaatattcaattgagcatttaacggttaagcatgaagcatttcaagagaatatttaa

SEQ ID NO: 17802 - protein, 287 aa, Unknown
  Obtained from environmental sample
  misc_feature (1)..(287): Xaa is any amino acid
MVAKERGYVVFKEGKYDIENNIDIDEISFKTTGSIDTNIDADVTINVKKDDVFEDAIGNGMEIVVKKIIVNGSTGPNTSIRSKIATVYGQTHKTSFIEADDLKLNVHKGIAKAKNAVITRLEHGTITADIAHVEQALGGTIIAKTITIDHLGSHVTMIASDKIEVKKMQGSENSFIIDPVLKDESKQTLGKDEVLIRKANRKIELIEEELVKYRTRLLEGIDLFKSVKSKLNQLRKAKKEIPVALKKKYKQFSNVEEHIKNLEEELSEQKYSIEHLTVKHEAFQENI

SEQ ID NO: 17803 - DNA, 750 bp, Unknown
  Obtained from environmental sample
  misc_feature (1)..(750): n is a, c, g, or t
atgggaattgttaataccgacgattatcagattgtatattctgatactcctgggatactaaaaccaagctacaaattgcaagaaaaaatgatgcgatttgtaggaacggcatttgaagatgccgatattatattatatataacggatgttattgaaacttttgacaaaaatgaacaatacatagaaaaattatcaaaagttaatgttcctattttacttttagtaaataaaattgacttaacagatcaagagaaacttgagaaacttgttgacacatggaaacaaaggcttcctcatgtggaaattattccaatatgtgctataaagaaatttaacttaagtcatgtatttaatcgaattgtagacctattacctgaaggagaaccatttttcccaaaagatgctcttacagacaagacggaaagattctttgtttcggaaattattcgcgagaaaattttactccattatagaaacgaaattccatattctgttgaaatagaaattgaagaatttaaagatgaagaaaaaatattgcggataagatctattattcatgttgtacgaccatcgcaaaagggaataataataggacataaaggcgaatctctaaaaagagtgggtacagaggcacgattagatattgaagaattctttggaaagaaggtttttattgaaatttatgttaaagtaagtaaagactggcgagataaagacagatcattaagaggttttggatataatgcataa

SEQ ID NO: 17804 - protein, 249 aa, Unknown
  Obtained from environmental sample
  DOMAIN (183)...(247): KH domain
  misc_feature (1)..(249): Xaa is any amino acid
MGIVNTDDYQIVYSDTPGILKPSYKLQEKMMRFVGTAFEDADIILYITDVIETFDKNEQYIEKLSKVNVPILLLVNKIDLTDQEKLEKLVDTWKQRLPHVEIIPICAIKKFNLSHVFNRIVDLLPEGEPFFPKDALTDKTERFFVSEIIREKILLHYRNEIPYSVEIEIEEFKDEEKILRIRSIIHVVRPSQKGIIIGHKGESLKRVGTEARLDIEEFFGKKVFIEIYVKVSKDWRDKDRSLRGFGYNA

SEQ ID NO: 17805 - DNA, 834 bp, Unknown
  Obtained from environmental sample
  misc_feature (1)..(834): n is a, c, g, or t
atgttttggactaaggaaatttatagaattcatgaaatttcggaaagtaaaatgaagttagactcaaatgaacgtattaatctaagcctaaaatgttatactccagaggataggtctgtaattagtgaagcttntgagaaatgcataaaaaatggaaaatcttacgatcttgaatttccttttataacttttaagggaaaaaacaaatggatacgtactgtagcaaaagcaataaaagaaaatggtaaagttattcgactgattggtaatgtaatggatattacagaccgtaaaaaagccgaagaaaaaattaaaaaccaaaacgaagaattgagtgagagtttagaacgtatccagaatattaatagtgaactcgaagaatcaaaagaaaaagcggaaataagtgaagtaaaatatagaagtgtagttgaaaatatgattgatggattttatagatctgatataaacggaaatacaatattaattagtccatcggttacaaaaatattaggctttaccaaaaacgaaatattaggacattcggtagcttctttttatgtacatcccgaagaaagagatatgtttctcgaaacaatacaaaaaacagggaaagttgaacaatatcctgctgaatttaaaagaaaagggaaaagcaatatttttattgaaacaaatgctcaaattatttatgataagaaaggtcagtataatggtgtggaaggggcttttcgtgatgttactgagcgaaaagctgtagtaagagaattggaaattgccaaagaaagagccgaagaaagcaactcgagccgatctgatcaatggtttttnnnttaa

SEQ ID NO: 17806 - protein, 277 aa, Unknown
  Obtained from environmental sample
  DOMAIN (137)...(200): PAS domain
  misc_feature (1)..(277): Xaa is any amino acid
MFWTKEIYRIHEISESKMKLDSNERINLSLKCYTPEDRSVISEAXEKCIKNGKSYDLEFPFITFKGKNKWIRTVAKAIKENGKVIRLIGNVMDITDRKKAEEKIKNQNEELSESLERIQNINSELEESKEKAEISEVKYRSVVENMIDGFYRSDINGNTILISPSVTKILGFTKNEILGHSVASFYVHPEERDMFLETIQKTGKVEQYPAEFKRKGKSNIFIETNAQIIYDKKGQYNGVEGAFRDVTERKAVVRELEIAKERAEESNSSRSDQWFXX

SEQ ID NO: 17807 - DNA, 651 bp, Unknown
  Obtained from environmental sample
  misc_feature (1)..(651): n is a, c, g, or t
atggatcttttcagtgtagaaaataaatttgatttaagaactaagtttggctttgctaccagtgataaaataatgctctttgtaggacgtcttggaaaagaaaaaaacataaattttttaatggatgtgtataaagagacacgtaagaaagttaacaatttaaaatttgtcattgttggcagcggtgaagaaagaaaaccgcttgaaaagtatgccaaacaattaggagtaaattctggtgttgccttcacaggtgcaattccacgtgaggaagttattgatgtgtataagcaagcagacgtttttgcctttgcttcttataccgaaacacaaggattagttgttcttgaatccatggccgcaggaactccagttgtggctcttggtaaaatgggagtctatgatttgttaaagaatcccgaagctggtggaattatgataaatgatttagatgaaagaaaatttgtaaattcaatttataatgtgttgaataacaaggatttttattccgatttatctggtcgcggaaaaatatttgtaaaggaaagcttttcttctcatacttcaatcagaaaagctttgaacttgtatgaaatagttatcgcagagaaaagaattgcttcgtcaaataatattgaataccaaagttga

SEQ ID NO: 17808 - protein, 216 aa, Unknown
  Obtained from environmental sample
  DOMAIN (9)...(179): Glycosyl transferases group 1
  misc_feature (1)..(216): Xaa is any amino acid
MDLFSVENKFDLRTKFGFATSDKIMLFVGRLGKEKNINFLMDVYKETRKKVNNLKFVIVGSGEERKPLEKYAKQLGVNSGVAFTGAIPREEVIDVYKQADVFAFASYTETQGLVVLESMAAGTPVVALGKMGVYDLLKNPEAGGIMINDLDERKFVNSIYNVLNNKDFYSDLSGRGKIFVKESFSSHTSIRKALNLYEIVIAEKRIASSNNIEYQS

SEQ ID NO: 17809 - DNA, 399 bp, Unknown
  Obtained from environmental sample
  misc_feature (1)..(399): n is a, c, g, or t
atggattatggctggaacttgtacgcttcttgtgattattataatccagaagatgattcaatatcacctgaaatggaatcactcgtgaaagaagaaattaagaaatccaagaatgaaaaggacatcaatctgaagcatagtgcaatggaaaagtttgataaaaaccatgagttcgtagttttgaaaaaacacgtttttgaactgcaaagcattagcccaaaaagatcattctcaaatacaagagaaagcttaacaagactgataatattaatgatggaatttacgtttttactgatcgcaatgatgaactgcttattcctcataaagtatttgcaaaatttgacaaagccaaaaataataaataatacagtttggggtgccaccgggttggcctgttga

SEQ ID NO: 17810 - protein, 132 aa, Unknown
  Obtained from environmental sample
  misc_feature (1)..(132): Xaa is any amino acid
MDYGWNLYASCDYYNPEDDSISPEMESLVKEEIKKSKNEKDINLKHSAMEKFDKNHEFVVLKKHVFELQSISPKRSFSNTRESLTRLIILMMEFTFLLIAMMNCLFLIKYLQNLTKPKIINNTVWGATGLAC

SEQ ID NO: 17811 - DNA, 408 bp, Unknown
  Obtained from environmental sample
  misc_feature (1)..(408): n is a, c, g, or t
atgagcgtagcacctaaaaatacgttaggggaaaataaaatagatttagatctaatcccttggggattaattgcaaagcatcttccgcaagcatttgaagaaggggtgattaaatattataaagaatcctggaaattaggctttacaacaacttccatgttctccgctacaatgcgacatcttattgcttacagggacggtgaaaattatgatccttctgcacaagagttaggaattattaagcaccatttagcaggtgcactattttcaattataatgatgttggatacattcgataaccatcctgagcttgacaaccgttccaagaattacaaacctgaagattggtctactgaaaaaatgaaaaaacagatagaagattttaaaaaagcacttacaactaaataa

SEQ ID NO: 17812 - protein, 135 aa, Unknown
  Obtained from environmental sample
  misc_feature (1)..(135): Xaa is any amino acid
MSVAPKNTLGENKIDLDLIPWGLIAKHLPQAFEEGVIKYYKESWKLGFTTTSMFSATMRHLIAYRDGENYDPSAQELGIIKHHLAGALFSIIMMLDTFDNHPELDNRSKNYKPEDWSTEKMKKQIEDFKKALTTK

SEQ ID NO: 17813 - DNA, 636 bp, Unknown
  Obtained from environmental sample
  misc_feature (1)..(636): n is a, c, g, or t
atgggggtaaatgttttcccctcttattgtagagtgtgggttacaaaagctttaaatgatgataaactaattgaagatcttattcataatagaaactttaaagatagaaaatttaaagagctaaaagctaaaaaactgatacattcacatgaggtcaaagtagcaccatttaagtattttgataatttactttgggtacttaaaagtttgagaaaagagcataaaaatattttagactttaaatttttagaatctaaaaagatttcaaaatattttgaaatatacagcaagttttatatagggcatatgagtagtgatacttttgtaaggttgttgaaatatttaaatattactactatatcagaagatattgcattagataagattcaagatgatcaaatcatagttacaattgaacagacaaaagatggatatagcttaatatattatttaaaaataattaatgaaaaacttaaaaaactagaagtaaatggagaggaattagtagtatcaaataaagatccaaaaggttttactgcttctgaaacaaagtatatgaaatttatttttaagaaattatatcaattaacaattgatgatattcaaaatctgttaacacaaaatgattttaattaa

SEQ ID NO: 17814 - protein, 211 aa, Unknown
  Obtained from environmental sample
  misc_feature (1)..(211): Xaa is any amino acid
MGVNVFPSYCRVWVTKALNDDKLIEDLIHNRNFKDRKFKELKAKKLIHSHEVKVAPFKYFDNLLWVLKSLRKEHKNILDFKFLESKKISKYFEIYSKFYIGHMSSDTFVRLLKYLNITTISEDIALDKIQDDQIIVTIEQTKDGYSLIYYLKIINEKLKKLEVNGEELVVSNKDPKGFTASETKYMKFIFKKLYQLTIDDIQNLLTQNDFN

SEQ ID NO: 17815 - DNA, 498 bp, Unknown
  Obtained from environmental sample
  misc_feature (1)..(498): n is a, c, g, or t
gtgactcctttggggcatcatgtaacaaaatggctactaccgataataacttttggtgttgctatgtttataatattttttttaattactataaatagtggtgatagaattaatattgatgctcctattgtaaaagaggatctctctgcagatatagtaaaaaaagagaaaagtgtttggattgagcgtttcgctcaaaatgagagagaaggctacttttatccggtaaacgagatctacatagagttagatctagaaaaaaaaatagaatattctaaaatatatagactctctgcatctttgaaagatccatatcaactcttttgtttaaaacaggaattaaagcaacataaactactatattatttaaataaagatagaaatggtgctgaactattgatcttttcaaaagatcaaaaaagattacaatcacttttaaattcacttaaaaattatcaaattgtggcgagagtagagccatataaagaggacatataa

SEQ ID NO: 17816 - protein, 165 aa, Unknown
  Obtained from environmental sample
  misc_feature (1)..(165): Xaa is any amino acid
MTPLGHHVTKWLLPIITFGVAMFIIFFLITINSGDRINIDAPIVKEDLSADIVKKEKSVWIERFAQNEREGYFYPVNEIYIELDLEKKIEYSKIYRLSASLKDPYQLFCLKQELKQHKLLYYLNKDRNGAELLIFSKDQKRLQSLLNSLKNYQIVARVEPYKEDI

SEQ ID NO: 17817 - DNA, 558 bp, Unknown
  Obtained from environmental sample
  misc_feature (1)..(558): n is a, c, g, or t
ttgactcttcatttagcagctgggctagatgactgcatcatctttgacctcgatgcgcaaaacagttctttccacatctccaatgcaagagagatcccttttgatgtaattcgcattaatagccaaaaagagttattcaaagctcttgatgagtatgaagatagtaaaaatatattaatagatgtaggcggttatgataatgacctgaacagattggcaatcgcaaatagtgatattgtaattgcacctgtaaaagacaacagttttgaaattcttgctcttcaaaaattcatgaagatcatagatactgttaagcaaaaaagtgatgttgaagtgtatgctctcattaacaatgttcatccacagagtaaagactttgagagattaatagaatttatcaatggtcaaaaaaacataacattgctaaaaacaatcataagacaacgtgcagaatatcaaaacactttagaagagggtaagactgtattagacaaaacacatttttctaaagctagtatagacatattaaagctattagaagaactaaaaaatatataa

SEQ ID NO: 17818 - protein, 185 aa, Unknown
  Obtained from environmental sample
  misc_feature (1)..(185): Xaa is any amino acid
MTLHLAAGLDDCIIFDLDAQNSSFHISNAREIPFDVIRINSQKELFKALDEYEDSKNILIDVGGYDNDLNRLAIANSDIVIAPVKDNSFEILALQKFMKIIDTVKQKSDVEVYALINNVHPQSKDFERLIEFINGQKNITLLKTIIRQRAEYQNTLEEGKTVLDKTHFSKASIDILKLLEELKNI

SEQ ID NO: 17819 - DNA, 759 bp, Unknown
  Obtained from environmental sample
  misc_feature (1)..(759): n is a, c, g, or t
ttgatggctcaggctgtggataaatttaatgaaggcattgatatgcctgatattgaagcagttatttttcttcgttcgacagattctgaaactatttttttgcaacagcttggtcgtggtttacgacttaagtttggaaaaggtgagcttttggttttggattttgttgctaatttagataggattctttatttaaatcattttatgcaagaagtaaagaaatatgctccgaagcattatgatcaggatttgatccaactgaatggtgaaggtttttcttttaacttttcggaagaaattattggaaatattttgaatcttttggaagaaattcagaggaagggttatatttctgatattcctgaagcattagaggcttatcatgaagataatgatgtttctgcagatcaaataacagttgcttcagagaaaaaaatattttggaaatgtcaacgttgtggaaaaggtgttctttcaagagtgcatagtacaagaattagaaagcaaggaaatggaatttataaatatgttcctgtgagctgtgatgtttgtaaagaaaaatctataacgtatatttctgatattttagaagctttggaagcttatattggcgatgatgctaatgagataacttctggttctatgaaatcagtttattggaaatgtaaaatttgtagagaaggcgttttatctgatgtatatagaagaataaaaaaacagacagatggtgtttatacatatatcccccgttacttgtga

SEQ ID NO: 17820 - protein, 252 aa, Unknown
  Obtained from environmental sample
  misc_feature (1)..(252): Xaa is any amino acid
MMAQAVDKFNEGIDMPDIEAVIFLRSTDSETIFLQQLGRGLRLKFGKGELLVLDFVANLDRILYLNHFMQEVKKYAPKHYDQDLIQLNGEGFSFNFSEEIIGNILNLLEEIQRKGYISDIPEALEAYHEDNDVSADQITVASEKKIFWKCQRCGKGVLSRVHSTRIRKQGNGIYKYVPVSCDVCKEKSITYISDILEALEAYIGDDANEITSGSMKSVYWKCKICREGVLSDVYRRIKKQTDGVYTYIPRYL

SEQ ID NO: 17821 - DNA, 705 bp, Unknown
  Obtained from environmental sample
  misc_feature (1)..(705): n is a, c, g, or t
atggataaatctgcacagattatttcaacaattgaaaaaaaagggaaactaaaacaactcgtatttgacaacacattaaatacattcaattcgttgaaaggtattttgaatgatttagcaaaagaatataacgaaaaactaaaaactcaggattccagaattagaatagaatatagaaatgcgggtgtttatcagtgcgaattaaaagttgctggcgatttgcttgttttcaatgtacacacaaatgtttttgagtttgatagagatcataaaatttggaccttgccacaaacaagacaagatcgagattctacttattcaggaataataagtatatataattttctttcagattcattcaaatataatcgagtagaagatattggatatatgattggacgcgtttttattaacaaaaacaatcatttttttgtagaaggaaaacaacaagtaggttatttgtcanatgaatttggcaaaaaaactattgatgcagaagctctaagaggaattgtagaatcagcaataatttattctcaaaaatttgatttgcttgctccaccttatgattctgtgaaagatattaatgtaaatccaatattagaatctcgaaaacaaggaattcaaacaagaaaaaagactcggattcctcatttaattcagatgatattactgggcggaacttcttgtactcnaggaggttaa

SEQ ID NO: 17822 - protein, 234 aa, Unknown
  Obtained from environmental sample
  misc_feature (1)..(234): Xaa is any amino acid
MDKSAQIISTIEKKGKLKQLVFDNTLNTFNSLKGILNDLAKEYNEKLKTQDSRIRIEYRNAGVYQCELKVAGDLLVFNVHTNVFEFDRDHKIWTLPQTRQDRDSTYSGIISIYNFLSDSFKYNRVEDIGYMIGRVFINKNNHFFVEGKQQVGYLSXEFGKKTIDAEALRGIVESAIIYSQKFDLLAPPYDSVKDINVNPILESRKQGIQTRKKTRIPHLIQMILLGGTSCTXGG

SEQ ID NO: 17823 - DNA, 789 bp, Unknown
  Obtained from environmental sample
  misc_feature (1)..(789): n is a, c, g, or t
ttgcagcaagtaaatatttcattttttgcaatagacgaagcacattgtatctctgaatggggacacgattttagaccagaatacagacgaattagaccaataatcaacgaaataaaacgtactccgattatagcacttacagcgactgcaactcctaaagtgcaacacgatattctgaaaaatcttgatattgcagaagcagaagtttttaaaacgtcattttttagggcaaatctttattacgaagtaaaacctaaaattgaaccagaaaagcaaataataaaattcataaaaaataacaaaggtaaatctggtattatatattgtcttagcagaaaaaaagtagaacaacttgctgaaacacttcaagttaacaatattaatgctttgccgtatcatgccggtttagattctgcaacaagaactcttcatcaagataaatttttgaacgaaaatgttgatgtaattgtagcaactattgcttttggaatgggaattgacaaaccagatattagatacgtattgcattatgatattcctaaaagtttagaaggatattatcaagaaacaggacgtgcaggaagagacggaggagaaggtatttgtgttgcatattatagttataaagacattcaaaaattagaaaaattcttgcaaggaaaaccaatttcagaacaagaaattggcaaacatttaattttagaaactgtagcttacgccgaatcggcagtttgtcgtccaaaaatgttattgaattaccttggggaaactcttgatcaaaatgtgtga

SEQ ID NO: 17824 - protein, 262 aa, Unknown
  Obtained from environmental sample
  DOMAIN (121)...(197): Helicase conserved C-terminal domain
  misc_feature (1)..(262): Xaa is any amino acid
MQQVNISFFAIDEAHCISEWGHDFRPEYRRIRPIINEIKRTPIIALTATATPKVQHDILKNLDIAEAEVFKTSFFRANLYYEVKPKIEPEKQIIKFIKNNKGKSGIIYCLSRKKVEQLAETLQVNNINALPYHAGLDSATRTLHQDKFLNENVDVIVATIAFGMGIDKPDIRYVLHYDIPKSLEGYYQETGRAGRDGGEGICVAYYSYKDIQKLEKFLQGKPISEQEIGKHLILETVAYAESAVCRPKMLLNYLGETLDQNV

SEQ ID NO: 17825 - DNA, 534 bp, Unknown
  Obtained from environmental sample
  misc_feature (1)..(534): n is a, c, g, or t
atggaaaacgttttggttctccattattatgataattccataatatctatgttggtggattattngagaaatgatgacaaacttaagcatttagttttcttaaccctcactccggaagaagattttataagttttaaaaataattttgaattgataatagcagcaggaggtaaggtaagtaatgcagcaggtaatattttatttattttcagattaggaaagtgggatttacctaaaggcaaagtagaagttggtgaaacacttgaagaatctgcaataagagaggtagaggaggagtgtggaattagtaaattaactattagaaaccacttaaaagatacttatcatctttatgaattaaataataaaatggttataaaacaatcggtttggtatgaaatgaaaactgatgatacaagtaaattaattcctcaaacagaagaaaatattaccgatgcccgttggatgacaaatgaagaaattcaaaaagaagttatgaaaaatacttatccatctatcaaagaaattatttaa

SEQ ID NO: 17826 - protein, 177 aa, Unknown
  Obtained from environmental sample
  DOMAIN (51)...(176): NUDIX domain
  misc_feature (1)..(177): Xaa is any amino acid
MENVLVLHYYDNSIISMLVDYXRNDDKLKHLVFLTLTPEEDFISFKNNFELIIAAGGKVSNAAGNILFIFRLGKWDLPKGKVEVGETLEESAIREVEEECGISKLTIRNHLKDTYHLYELNNKMVIKQSVWYEMKTDDTSKLIPQTEENITDARWMTNEEIQKEVMKNTYPSIKEII

SEQ ID NO: 17827 - DNA, 417 bp, Unknown
  Obtained from environmental sample
  misc_feature (1)..(417): n is a, c, g, or t
ttgttattatctcttcttgtattcaaaaagaaaagaacccatccagggtatgtattgccgtattacggctcccaatggtgggttttaaacaaagtcctttcaaaagaggtcgttaagttcattgaagataatcctgagtttttgtcctaccactctcactctcttcttcctgacgagcttttttttcaatcaatagtaggcactattttagagaaaaaaaatagtgatacacaggagataaaagtaattaaagataacttgcattttattatttgggacgaagaaacaagccatccaaaaacattaaaattgagtgattataaaaaaatcgcttcaacaaacaaactctttgcacgtaaatttgattacattgacagtaaaaaactagtaaaaaaaataaatgagcagtcagaatag

SEQ ID NO: 17828 - protein, 138 aa, Unknown
  Obtained from environmental sample
  misc_feature (1)..(138): Xaa is any amino acid
MLLSLLVFKKKRTHPGYVLPYYGSQWWVLNKVLSKEVVKFIEDNPEFLSYHSHSLLPDELFFQSIVGTILEKKNSDTQEIKVIKDNLHFIIWDEETSHPKTLKLSDYKKIASTNKLFARKFDYIDSKKLVKKINEQSE

SEQ ID NO: 17829 - DNA, 846 bp, Unknown
  Obtained from environmental sample
  misc_feature (1)..(846): n is a, c, g, or t
atgtatcagatcggcncgagcacccataatgttaaggttgttgacttttacaatgatttaaaaccgaaaaacaaattaggcgttttattgagaaatcctatctttctttttcgtgtactttttaaatcaaagttgaagttgaaatacatcattgatttcatcaagcattacaggatgcatttagatattttagctagtggtatttttgaaggtgaaaaattagttgaattctctgaggagctcaacctaaaagaagaagatgtggtttacgattattggtttataaacagcattattagtattgattattggcgcagtaaaaaaaagtggaaaaatacactaatatgtcgtgctcatcggtacgatctatatacagaggattggccaatgttaggagtgcctttcactttttaccgtttaaatgttgttgacaagttgatttttatttctaaacatgggctaaattatttaaacgaactcaccaataatgtgttcaatgaaaagtttcagttgtcttatttaggagtaaactcaccagaaaaaaagaatcctagagaacagaaagaactttatcgaattgtgtcttgtgcaagagttgttgactttaaaaatgtgcatttaattcctaaagttttatctcagttaaacactcctattgaatgggttcattttggagatggtccaatgatgagtgaattagagaaaaatattattgatcttccaaaaaacattaacgtgattttgaaaggcatcaaagtaacaaggaggttctttcattctacgaaaatcaaactgttgacgcgtttatttctcttagtaattcagaagggctacctgtttctatga

SEQ ID NO: 17830 - protein, 281 aa, Unknown
  Obtained from environmental sample
  misc_feature (1)..(281): Xaa is any amino acid
MYQIGXSTHNVKVVDFYNDLKPKNKLGVLLRNPIFLFRVLFKSKLKLKYIIDFIKHYRMHLDILASGIFEGEKLVEFSEELNLKEEDVVYDYWFINSIISIDYWRSKKKWKNTLICRAHRYDLYTEDWPMLGVPFTFYRLNVVDKLIFISKHGLNYLNELTNNVFNEKFQLSYLGVNSPEKKNPREQKELYRIVSCARVVDFKNVHLIPKVLSQLNTPIEWVHFGDGPMMSELEKNIIDLPKNINVILKGIKVTRRFFHSTKIKLLTRLFLLVIQKGYLFL

SEQ ID NO: 17831 - DNA, 525 bp, Unknown
  Obtained from environmental sample
  misc_feature (1)..(525): n is a, c, g, or t
ttgctacttttgatagtaaatattaatggaaaactaaattataatattatgaattcatatttaacttttcagttgggtgctgagagttttgcattaaatgttaagaatgtgattaacattttagaaatgtataaaattacaaaagtacccaaaatgcccaaatatgtaaagggggcaattaatttgcgtggcgaagttttaactgttattgatactcgcttaaaatttggaatggaagaaacaaaaataacaaaaaatacttgcatacttgttttggatgtaaatatatcttcaaacaaagttaaaataggtgttcttgttgatatggttaacgaagtaattgaattagatgaaaatacaataaaaccaccagctacaattggcgaaaaatacaataatgaatttattattggtatgattttaaacaatgataaatttacaatgcttttagatataaataaagtattctcaacagaggaaataattagtattgagaatattaaagaacctgctattgaagtttaa

SEQ ID NO: 17832 - protein, 174 aa, Unknown
  Obtained from environmental sample
  DOMAIN (19)...(160): CheW-like domain
  misc_feature (1)..(174): Xaa is any amino acid
MLLLIVNINGKLNYNIMNSYLTFQLGAESFALNVKNVINILEMYKITKVPKMPKYVKGAINLRGEVLTVIDTRLKFGMEETKITKNTCILVLDVNISSNKVKIGVLVDMVNEVIELDENTIKPPATIGEKYNNEFIIGMILNNDKFTMLLDINKVFSTEEIISIENIKEPAIEV

SEQ ID NO: 17833 - DNA, 354 bp, Unknown
  Obtained from environmental sample
  misc_feature (1)..(354): n is a, c, g, or t
gtggtaatgataataaaactgctggtggaaacaatgtttgataatgaacaaaaaataaatgttactggtaatgaaaataaaacagcagctaaagatttgtttgattattctatatcatatgttgttgaagcaacaaaacataattcagcaattgaaaatatcttattaggtatttctaaatttacagcagatataaaatatgaaaagccagatactattgattacacaatagaagataaaattaatcataataagcttaaaaatataaagctttttttgatgactacatggataattataatattgtttaaaaacaaaattaatatatttgaagagcaagatattactttttga

SEQ ID NO: 17834 - protein, 117 aa, Unknown
  Obtained from environmental sample
  misc_feature (1)..(117): Xaa is any amino acid
MVMIIKLLVETMFDNEQKINVTGNENKTAAKDLFDYSISYVVEATKHNSAIENILLGISKFTADIKYEKPDTIDYTIEDKINHNKLKNIKLFLMTTWIIIILFKNKINIFEEQDITF

SEQ ID NO: 17835 - DNA, 387 bp, Unknown
  Obtained from environmental sample
  misc_feature (1)..(387): n is a, c, g, or t
gtgattacttcccttaaatctgttcaaggaataggttttgatcttataataattactatcaggggaggtatatctaaaggaatttataacaaaaatgacgtatatctcgtacacgcccacatgttaacgctattcaaaaaagaaggaattactattttagatatttattattgtccacaccattctgatctagagaagtgtatatgtagaaaaccagattcattaatgttagaaaaagccatagctcgtttcaatattgataaatctctttcatttatgataggtgatagtcagagagatattgaagcggcaactaaagcaggaataaaatcttttaaaatagaatcaaatacaaacttaaatcaactagaaaactacttgttttga

SEQ ID NO: 17836 - protein, 128 aa, Unknown
  Obtained from environmental sample
  misc_feature (1)..(128): Xaa is any amino acid
MITSLKSVQGIGFDLIIITIRGGISKGIYNKNDVYLVHAHMLTLFKKEGITILDIYYCPHHSDLEKCICRKPDSLMLEKAIARFNIDKSLSFMIGDSQRDIEAATKAGIKSFKIESNTNLNQLENYLF

SEQ ID NO: 17837 - DNA, 693 bp, Unknown
  Obtained from environmental sample
  misc_feature (1)..(693): n is a, c, g, or t
atggaaaaaacaaaaatgctctttaactcatacgaatttatctttgcatttttacccctaacattttttatatacttttatctcaatagtaaaagacaaacagaggcttctaaaggatttttagtatttgcaagtttgtttttctatagttggtggaatatagtatacctgccaataatattaagtagtatgctctttaattatataatagggaatatacttaatggaaataaagaattaaaaaatagtaaaaaacagataaataaaaaaacaatattatctataggtattatagcaaatgtatcattactaggatactttaaatacgcagacttttttatccaaaatgtaaactttctaacagatggtaatataccaacactagaacttgcccttcctctagcaatatctttctttaccttccaacaaatagcatacctagtagatagctatcgaaaagagacacaagaatatgactttctaaactatgcactgtttgtaactttttttcctcaactaatagcaggaccaatagtacatcataaagagatgatgccccagtttgcttctagatggaataaagtaaaaaactataaaaatatagccttaggattgtttatattctcaataggactttttaaaaaaggtagttatagcagatacctttgctatatgggcaacaaaagggtttga

SEQ ID NO: 17838 - protein, 230 aa, Unknown
  Obtained from environmental sample
  misc_feature (1)..(230): Xaa is any amino acid
MEKTKMLFNSYEFIFAFLPLTFFIYFYLNSKRQTEASKGFLVFASLFFYSWWNIVYLPIILSSMLFNYIIGNILNGNKELKNSKKQINKKTILSIGIIANVSLLGYFKYADFFIQNVNFLTDGNIPTLELALPLAISFFTFQQIAYLVDSYRKETQEYDFLNYALFVTFFPQLIAGPIVHHKEMMPQFASRWNKVKNYKNIALGLFIFSIGLFKKGSYSRYLCYMGNKRV

SEQ ID NO: 17839 - DNA, 786 bp, Unknown
  Obtained from environmental sample
  misc_feature (1)..(786): n is a, c, g, or t
gtgcaaaaacttcagctcaactttttaagtttaacatttctcaaaaagattgtttaccgagcaaaaaataggtttactttgtcagttaaaagcatcataaactctttagatttttttaaaactctaaatactaaagaggtggagctattgtcttctatatcaacacaaaactcatacagcagcgattatatacttcactatgaaaaacaagagagcaataacttgctctttttagtcggtggtctagctaaatcatataaaatagataaacactccaatgaaatctttttgtactacatctacaaaaattctcttttatcagaaatctcagatatctccagcggtactttactctctttctccaacatagctattgtagaagattctcaaatattgagtattgattatcaacaatttaaagaacacttcttaaataagcatctattatgtatcgaattaattcaggaaatctgttcaaggtcgcaaaaattagaatctttaataaatcgcgaatttatatttgattcagttcaaaaagtagcacagatgctggatgcagacatagatatgtttaacaagctcaaacggcacgacatttcacttatacttcatatacaacctgcaactctatcgcgtgtattaaacagactaaagcgaaataagattattgatatactacaaggtaaagtcactgtgttagatacaatagcactcaaggagataagaaatgacctagataaaagtaggtggtctactggtttttatattatcaattgctctggctaa

SEQ ID NO: 17840 - protein, 261 aa, Unknown
  Obtained from environmental sample
  misc_feature (1)..(261): Xaa is any amino acid
MQKLQLNFLSLTFLKKIVYRAKNRFTLSVKSIINSLDFFKTLNTKEVELLSSISTQNSYSSDYILHYEKQESNNLLFLVGGLAKSYKIDKHSNEIFLYYIYKNSLLSEISDISSGTLLSFSNIAIVEDSQILSIDYQQFKEHFLNKHLLCIELIQEICSRSQKLESLINREFIFDSVQKVAQMLDADIDMFNKLKRHDISLILHIQPATLSRVLNRLKRNKIIDILQGKVTVLDTIALKEIRNDLDKSRWSTGFYIINCSG

SEQ ID NO: 17841 - DNA, 951 bp, Unknown
  Obtained from environmental sample
  misc_feature (1)..(951): n is a, c, g, or t
caggacccatggcaaggttatggttttggtgaggagagtaaaaaagttttaggaccaggtaaccttggaggaagggaatccaatgggggagatactcatcacccggctctttcagaaaaagatggtgtatatgatggaaaatggcttgctattcaagacaaagctaatccaagagttgcaatcattgacttagaagattttgaaactaaacaaatcgttgttaacccagttttcaaatctgatcatggtggatctttctttacaccaaactctgagtatattatagaatcttcacaatatgctgctcctttggataataattatcatccaatcgaagagtacaaagagacttatcgtggtggtgctacgatgtggaaatttgatcctaaaattggtagaattaatgagaaagaatcatttactatcgaattcccaccatatatgcaagatttaactgatgctggtaaaggtgttagtgatggttgggcttttacaaactcatttaactctgaaatgtatacaggtggtatcgaagtaggtatgcctccattcgaagctggttgtagtagaaatgacactgacttcttacatgtatataactggagaaaattagctaaacttgctaagaataaaaagaatgtaaaaatcattaacggtcatagagttattcctatggatgttgctgttaaaaacaatgcacttttcttaattccagaagcaaaatcaccacacggtgttgatgttaacccatctggtgaatatatcgtagtttgtggtaaattagatacacatgcatctgtttattcatgggcaaaaatcaagaaacttattgatagtaaaaagtatatcggtaaagatccatacgggattcctatcttagatatgaaagcttctttacatggtcaagttgaactaggtcttgggcctttacataatcagttttctaagtaa

SEQ ID NO: 17842 - protein, 316 aa, Unknown
  Obtained from environmental sample
  misc_feature (1)..(316): Xaa is any amino acid
MDPWQGYGFGEESKKVLGPGNLGGRESNGGDTHHPALSEKDGVYDGKWLAIQDKANPRVAIIDLEDFETKQIVVNPVFKSDHGGSFFTPNSEYIIESSQYAAPLDNNYHPIEEYKETYRGGATMWKFDPKIGRINEKESFTIEFPPYMQDLTDAGKGVSDGWAFTNSFNSEMYTGGIEVGMPPFEAGCSRNDTDFLHVYNWRKLAKLAKNKKNVKIINGHRVIPMDVAVKNNALFLIPEAKSPHGVDVNPSGEYIVVCGKLDTHASVYSWAKIKKLIDSKKYIGKDPYGIPILDMKASLHGQVELGLGPLHNQFSK

SEQ ID NO: 17843 - DNA, 483 bp, Unknown
  Obtained from environmental sample
  misc_feature (1)..(483): n is a, c, g, or t
atgaaagatattgttaatactattttagatgaaacaaaattagcctataaagaaagcatactaactgagaataaaataatcgaagataaactactctcaattatggcaaatacaaaattattattaaatgaactagagactgtaaagttaaaaaagaagaaaaaatataagcttaatgaaaatacagaagccttagaggttgaaaaagtaaaaagaaaagtacctctatggctaanaaagcaaaatcagtacaattacaaaattttaaatacttttatgagcttatcaaacaacaataaccacacaataagtacaagattgttagagatgcattgcaatattgatccaaaagtatttttatctaaactatatctattaaaaacaatatcagaaaaaaatcatggaaaagtttttaatgaaaaagatggtcagataagtctttgggagcctatcgaggagattgtagtaaaatattttaaataa

SEQ ID NO: 17844 - protein, 160 aa, Unknown
  Obtained from environmental sample
  misc_feature (1)..(160): Xaa is any amino acid
MKDIVNTILDETKLAYKESILTENKIIEDKLLSIMANTKLLLNELETVKLKKKKKYKLNENTEALEVEKVKRKVPLWLXKQNQYNYKILNTFMSLSNNNNHTISTRLLEMHCNIDPKVFLSKLYLLKTISEKNHGKVFNEKDGQISLWEPIEEIVVKYFK

SEQ ID NO: 17845 - DNA, 576 bp, Unknown
  Obtained from environmental sample
  misc_feature (1)..(576): n is a, c, g, or t
ttgtctgaaataaaatacatttattccaaacgacaagcaggaaatcgtgatgatttaataaataacataaaaaagcgaattataaatgaatttggcaagcgatatgtgagtaatgaaattaatcaacttgcttgtgaactgtttgaacttacagaagatgcgggggataaaataaaatgttacagcttgatgaacacagctggaaaaacaaaatataaaaatcagaaagaaaaggcggtaaaggaaaataatcagaaaaaagaacaaaagcacgctgaaaaaagaaatgtagaaattgaaaaaaaatatgaattaataaaaaataacaaaaaacttgataaacgtataanattaataagagaatttgggaaatataaagacgaanataaaaatgtaaaacgaanatatgatgaagtagtgggggagtataaacgagaaattgaactgatgatagaaaatcaggacgataactacgacaaaatatttcaattgattgataaatttgatgataatatttatttcccacaagtantaaagaaaactgtttttaaagcagtagaaacaatggcgatataa

SEQ ID NO: 17846 - protein, 191 aa, Unknown
  Obtained from environmental sample
  misc_feature (1)..(191): Xaa is any amino acid
MSEIKYIYSKRQAGNRDDLINNIKKRIINEFGKRYVSNEINQLACELFELTEDAGDKIKCYSLMNTAGKTKYKNQKEKAVKENNQKKEQKHAEKRNVEIEKKYELIKNNKKLDKRIXLIREFGKYKDEXKNVKRXYDEVVGEYKREIELMIENQDDNYDKIFQLIDKFDDNIYFPQVXKKTVFKAVETMAI

SEQ ID NO: 17847 - DNA, 726 bp, Unknown
  Obtained from environmental sample
  misc_feature (1)..(726): n is a, c, g, or t
atggtattagaaaaagtacttgaaagctctggtttacgactcaatgaagagtatataagagaaactacacttaaaaatgacgatggagaaaaatacagacccgatgtgatagtaaatctccctgctaatagacaagtaatcatcgatgcaaagacttctttgacaaattatgaacaatatacatcgacacaagatgtaatagagaaaaagggccatttgaatttacacataaaatcaataaatacccacatagattccctttcaaataaaaattatgaagagttaaagggggttaatactttagacttcatatttatgtttatccctattgagagtgcattaatgctagctatggaaagtgataaaggtctatttgataaagcctttaaaaagaagattgtactagtttccccaactacacttttagtagctttaaaagcagttgagaatagttggagatatgagaaacaagcacaaagtacaacagaggttatacgacttgcagagaagctttataataaggtaagaacttttgtagaagattttgaaaaagtaggaaaaaatctgagtcaagctcaaaaatcatatgatgatgcctacaaaaaactctcatctggaaaagataatatcgtaagacaaatagaggttttcaaagaaaaatcaaatataagcccttcaaaacagataagtcaagatattgttgatagtgctatggntgaacaatag

SEQ ID NO: 17848 - protein, 241 aa, Unknown
  Obtained from environmental sample
  DOMAIN (1)...(232): RmuC family
  misc_feature (1)..(241): Xaa is any amino acid
MVLEKVLESSGLRLNEEYIRETTLKNDDGEKYRPDVIVNLPANRQVIIDAKTSLTNYEQYTSTQDVIEKKGHLNLHIKSINTHIDSLSNKNYEELKGVNTLDFIFMFIPIESALMLAMESDKGLFDKAFKKKIVLVSPTTLLVALKAVENSWRYEKQAQSTTEVIRLAEKLYNKVRTFVEDFEKVGKNLSQAQKSYDDAYKKLSSGKDNIVRQIEVFKEKSNISPSKQISQDIVDSAMXEQ

SEQ ID NO: 17849 - DNA, 519 bp, Unknown
  Obtained from environmental sample
  misc_feature (1)..(519): n is a, c, g, or t
atgtttntaacacttacaagagctcaacttatctttaaacttgtaaactatgtgtctgatttatatatcaaacatcataaacaaatctttgatggttcttttaacagcgctttattagaatatgacaaagcccacgagtgttcacaagctgtagaggtactcaaaaatatctcgtatagatatatttatacacacaagcaggtacaagctttagagataaaaggatattctatcatacaagggttatttgatatttatgagccgcttttaaaacttaatactgaagaatttgaatcactattagctgataaaagagtagattgtgctatttgtcaaaatttactctacagattatcaaaaaaacatcttgtagcctataaaaaaagtgtaagtggtatcagtgatactgagaactataaacttttagagtggtattatagagcaagacttttatgtgactatattagtggtatgacagatgattatgctttatttgaacatcaatctctgtctgcgtaa

SEQ ID NO: 17850 - protein, 172 aa, Unknown
  Obtained from environmental sample
  misc_feature (1)..(172): Xaa is any amino acid
MFXTLTRAQLIFKLVNYVSDLYIKHHKQIFDGSFNSALLEYDKAHECSQAVEVLKNISYRYIYTHKQVQALEIKGYSIIQGLFDIYEPLLKLNTEEFESLLADKRVDCAICQNLLYRLSKKHLVAYKKSVSGISDTENYKLLEWYYRARLLCDYISGMTDDYALFEHQSLSA

SEQ ID NO: 17851 - DNA, 366 bp, Unknown; identical to SEQ ID NO: 13597
  Obtained from environmental sample
  misc_feature (1)..(366): n is a, c, g, or t

SEQ ID NO: 17852 - protein, 121 aa, Unknown; identical to SEQ ID NO: 13598
  Obtained from environmental sample
  misc_feature (1)..(121): Xaa is any amino acid

SEQ ID NO: 17853 - DNA, 384 bp, Unknown
  Obtained from environmental sample
  misc_feature (1)..(384): n is a, c, g, or t
ttgtttattgaagatatcgattatattttgccactcttgtataagatgcgtgagataggattgagtatttcgatggatgattttggtacgggttattcgtcgttaaacatgctgcgtacactgcctattgatgaactaaagattgataaaagttttgttgatactcttttagatgatacggccgcccaaaaaatgattcaaaatatcattactataggtaagaatctcgagttacatgttttggctgaaggtgtggagactaacgcccaagaaaagcttttgaagtcctttggctgtgaccgttttcaaggctatttgtacgccaagcctttggcgtatgagactctcaaagattttttaaaatcccagccattgaacctttaa

SEQ ID NO: 17854 - protein, 127 aa, Unknown
  Obtained from environmental sample
  DOMAIN (1)...(110): EAL domain
  misc_feature (1)..(127): Xaa is any amino acid
MFIEDIDYILPLLYKMREIGLSISMDDFGTGYSSLNMLRTLPIDELKIDKSFVDTLLDDTAAQKMIQNIITIGKNLELHVLAEGVETNAQEKLLKSFGCDRFQGYLYAKPLAYETLKDFLKSQPLNL

SEQ ID NO: 17855 - DNA, 816 bp, Unknown
  Obtained from environmental sample
  misc_feature (1)..(816): n is a, c, g, or t
atgtcagctcttgatttggtattccaaacacttgatgttgatcagatactattaccggaattctactggggttcttattttcaggtgatgaccattcgtaatatcgaacctggctcttacagcaattttgagaatttactgaatcgactagatgaaattaaaaactcagctgttattatttgcgatccaaacaatccgattggcaataaaattgaagacgctgagttattaaaaacaattaaagttcttaacgaaaacgggacaagcgttattatcgattgtccctatcgtcgtattttctgtgatcaggaagaccagttctatcaagatctgcttgaatttgagaatattattattgtagaaagttttagtaaatcgataggtttaagtgggcaacgcctaggatttattcatactgcagatacagatttcaatacagaattgggcattcgactgatgtatgcaaccaatggtattaatgctttttcacaaatcttggttgctaaactattagattcagaacaaggtgaaattgtaaggaaaaactttaaaaagacaacagttgaaggaattcgaaagaacattaaattccttgaaaagaagaaactgcttgcgactaaattctacacagatagcaaagccatcggtatttttgttattgtgaataaatcagaagaagagctacttgaaaaaagaattggttcagtttctttaagctactttaccaaaactaaaaaagaagaagctacacagtattcacgtctatgcgtttcagtatctcctgaaaaattcgagacttatttcgataaattctag

SEQ ID NO: 17856 - protein, 271 aa, Unknown
  Obtained from environmental sample
  misc_feature (1)..(271): Xaa is any amino acid
MSALDLVFQTLDVDQILLPEFYWGSYFQVMTIRNIEPGSYSNFENLLNRLDEIKNSAVIICDPNNPIGNKIEDAELLKTIKVLNENGTSVIIDCPYRRIFCDQEDQFYQDLLEFENIIIVESFSKSIGLSGQRLGFIHTADTDFNTELGIRLMYATNGINAFSQILVAKLLDSEQGEIVRKNFKKTTVEGIRKNIKFLEKKKLLATKFYTDSKAIGIFVIVNKSEEELLEKRIGSVSLSYFTKTKKEEATQYSRLCVSVSPEKFETYFDKF

SEQ ID NO: 17857 - DNA, 786 bp, Unknown
  Obtained from environmental sample
  misc_feature (1)..(786): n is a, c, g, or t
ttggatcgatgggatataaaagaatcattggacagagaactgcttgtaaatacctatgggcaatctcaaaccttattgtttcttaaacgagctaatcgttatttccctatcatcgtacctatcttaaaagaggaaggtgtcccagatgattttaaatatttagctttaattgaaagtggcttgataacaacaattgtttcaccagcaggtgctgtcgggttttggcaatttatgccacctactgcccgcgactataagcttgaaatcaacaaagaagttgatgaacgttacaatattgaaaaatcgacccgagcagcctgtaagtatttgaaagattcctataaaaaatttggaagctgggccttggtcgcagcctcatataatgcaggcagaacacacattcattctcaaatgaaacttcaaaatgcaggatcgtattatgaccttttgttgggtgatgaaacagctcgttatctgttcagaattattgcgaccaaacttataatggagaatcctcaagattttgggtttagattccgtgactccgatttatatcccaacattccaactcggaagattaaaattaaaggtggagtgaagaattttgctgattttgcccaacagaatggggtgaattataaaatactaaaactctttaatccttggttaagaaagccatatctaacaaataagtataaaaaagagtacgaaattacacttcctgccaaaggatatattaattttgcgttttctgaatacaaaaaacctcaggtagagaaaaaatag

SEQ ID NO: 17858 - protein, 261 aa, Unknown
  Obtained from environmental sample
  DOMAIN (35)...(150): Transglycosylase SLT domain
  misc_feature (1)..(261): Xaa is any amino acid
MDRWDIKESLDRELLVNTYGQSQTLLFLKRANRYFPIIVPILKEEGVPDDFKYLALIESGLITTIVSPAGAVGFWQFMPPTARDYKLEINKEVDERYNIEKSTRAACKYLKDSYKKFGSWALVAASYNAGRTHIHSQMKLQNAGSYYDLLLGDETARYLFRIIATKLIMENPQDFGFRFRDSDLYPNIPTRKIKIKGGVKNFADFAQQNGVNYKILKLFNPWLRKPYLTNKYKKEYEITLPAKGYINFAFSEYKKPQVEKK

SEQ ID NO: 17859 - DNA, 714 bp, Unknown
  Obtained from environmental sample
  misc_feature (1)..(714): n is a, c, g, or t
ttgggatacttttacagctgggattatttgtatcactgtttagtaaaatatttgagtttaaaaaacctaacagtagtaataacgctacatattcaacaagttttgaatatacacaaacaaataacaaacaaaataataaaaggagagacgatgaaattatcgatgttgaaattattgatgataacaatactattaagtactagtggagttgcgaatagtaatttagagaaaaaacttataaaatttgaaaaacaaagagttgctaagtcactacaaagagttggaggaaaccttcaaaatgttgatttagtattaaaaaaagatctaaatcaagatggttgggtagggtatacttttaatttagaatttgaagtacaaaataaaaagctttctcaaaaagatacactttttagtgatggtaaaaatgttactatggacttaatcaacttagaaaataaaagatcatttaaaactgttatgtatccaactttaggaaaaaaatttttcagtaaaaaacattttatagagggtaatatagatgcaaaacattcacttgtaatatttagtgatcctttatgtccaatctgtgtagatgagattccatatgtattaaaaaatattattgacaatccaaaaaatatagctgtatactattatcatcttccactagatatgcatccaacagcaaaagtactctcaaaagcctctatatag

SEQ ID NO: 17860 - protein, 237 aa, Unknown
  Obtained from environmental sample
  misc_feature (1)..(237): Xaa is any amino acid
MGYFYSWDYLYHCLVKYLSLKNLTVVITLHIQQVLNIHKQITNKIIKGETMKLSMLKLLMITILLSTSGVANSNLEKKLIKFEKQRVAKSLQRVGGNLQNVDLVLKKDLNQDGWVGYTFNLEFEVQNKKLSQKDTLFSDGKNVTMDLINLENKRSFKTVMYPTLGKKFFSKKHFIEGNIDAKHSLVIFSDPLCPICVDEIPYVLKNIIDNPKNIAVYYYHLPLDMHPTAKVLSKASI

SEQ ID NO: 17861 - DNA, 768 bp, Unknown
  Obtained from environmental sample
  misc_feature (1)..(768): n is a, c, g, or t
atggcatggcgagcaaaaaaatcattaaaaacaacccttataaaaagtccaaatggcattgtgctaattacccttgaatcattagaagcaatgtttgtgaacgctccttacaatgtatctactctattcggaaatcttaaatatattgtgattgacgagatacattcgtttttaggagtggatagaggtttgcaactaatgtcattattgtcgcggattcaacaagtcaataaaacaagaatcacaaccatcggattgtctgctacaatcggagatgataattatattgaagctaaaagattgacaggagatatatcagagacaaaggttttactagataggacaaagaaagaaactgaagcaaagttcaaatattttaaaaatagtacagccgaattatctttagatttactcaaagatttgtacaaggaaacgtgttcaaacaaagttcttattttcccaaacagcagagggcgaacagaggaagttgcggtaaaacttcggaaaatatcgaataaagtaaacggacacaaaaattattattcacaccattcatcagttgacaaagagattagggaaagcatagaacattttgcgaaaagcaatgaacgttttaacttttgtatttcttgtacatcgacattggaacttggaatcgatatcggtacagtcgataaaattgttcagattgattcaacacattccgtttcttctctcgttcaaaggataggacgaagtggtcgcagagacggagaaaaaagcatgtaa

SEQ ID NO: 17862 - protein, 255 aa, Unknown
  Obtained from environmental sample
  DOMAIN (172)...(250): Helicase conserved C-terminal domain
  misc_feature (1)..(255): Xaa is any amino acid
MAWRAKKSLKTTLIKSPNGIVLITLESLEAMFVNAPYNVSTLFGNLKYIVIDEIHSFLGVDRGLQLMSLLSRIQQVNKTRITTIGLSATIGDDNYIEAKRLTGDISETKVLLDRTKKETEAKFKYFKNSTAELSLDLLKDLYKETCSNKVLIFPNSRGRTEEVAVKLRKISNKVNGHKNYYSHHSSVDKEIRESIEHFAKSNERFNFCISCTSTLELGIDIGTVDKIVQIDSTHSVSSLVQRIGRSGRRDGEKSM

SEQ ID NO: 17863 - DNA, 312 bp, Unknown
  Obtained from environmental sample
  misc_feature (1)..(312): n is a, c, g, or t
atgtctcccaaaaatgttacacaaaaagaaattgctgatttaatactcaaactgaataatgaggttgctctggatgcaggagaaaaagaattgcttgcctatatttacaatcaacaaataaaagtttatttcatttgttccccagataaagcatgcgtaatagcaactgaaaaattaggttttattaatcaagttataagcttagaagatttaactagtgtagcaggcataaaggagcctggtttaagatatcaatatacaagacaatggctaagtaatttaaaaacagatatatttctggggaatatatga

SEQ ID NO: 17864 - protein, 103 aa, Unknown
  Obtained from environmental sample
  misc_feature (1)..(103): Xaa is any amino acid
MSPKNVTQKEIADLILKLNNEVALDAGEKELLAYIYNQQIKVYFICSPDKACVIATEKLGFINQVISLEDLTSVAGIKEPGLRYQYTRQWLSNLKTDIFLGNI

SEQ ID NO: 17865 - DNA, 963 bp, Unknown
  Obtained from environmental sample
  misc_feature (1)..(963): n is a, c, g, or t
gtgagagtgcggttcattgctgaactgcgcgaaaaaggaaccctttccgacggttcacctgttccagaagatatcgaactgcacagaccgtatgtggatgacattcacatgaaatgccctaagtgcagtggcaaaatgatcagaactccggaagtgatcgactgctggtttgatagcggcagcatgccgtttgcccagtggcactatcctttcgaaaataaagatatcttcgacgaagagctcttccctgctgatttcatcagtgaaggtatcgaccagactcgtggctggttctacagtctgttggctatctctacaattcttaaaggaaaatctccttataagaatgtattggtgaacgatcttattttggataagagcggccagaaaatgagtaagaccaaaggcaacagtgttgatccaatgaaactgatggaacaatacggtgccgatgccaaccgctggtatctgcttgcagtgagcccaccctgggttcctaccaagtttgatgaaaacggggttgcagaagtaatcaataaattcttcggtaccctgaaaaatgtttactcattctacgttacctatgccaacatcgataatttcgatgctactgcttatgagttcaacgctgttaaagaagttgaaatcgataaatggattatgtctaaactgaatagcctggtaaaactggttaacgaaagtaatgataattacgatcttaccagaagcgttcgtgctatccagagtttcgtgattgatgatcttagtaactggtatgtgcgtcgttgccgtcgtcgtttctgggaaatgaatctttctatggataagaaggaagcttaccttaccttgcatcacgcttttaacacagntagcaagcttatcgccacttatgctccntacctggctgaagagattatacaaatcttacagtggagagagtgtacatttggcaaattatcctaa

SEQ ID NO: 17866 - protein, 320 aa, Unknown
  Obtained from environmental sample
  misc_feature (1)..(320): Xaa is any amino acid
MRVRFIAELREKGTLSDGSPVPEDIELHRPYVDDIHMKCPKCSGKMIRTPEVIDCWFDSGSMPFAQWHYPFENKDIFDEELFPADFISEGIDQTRGWFYSLLAISTILKGKSPYKNVLVNDLILDKSGQKMSKTKGNSVDPMKLMEQYGADANRWYLLAVSPPWVPTKFDENGVAEVINKFFGTLKNVYSFYVTYANIDNFDATAYEFNAVKEVEIDKWIMSKLNSLVKLVNESNDNYDLTRSVRAIQSFVIDDLSNWYVRRCRRRFWEMNLSMDKKEAYLTLHHAFNTXSKLIATYAPYLAEEIIQILQWRECTFGKLS

SEQ ID NO: 17867 - DNA, 504 bp, Unknown
  Obtained from environmental sample
  misc_feature (1)..(504): n is a, c, g, or t
gtgatgggaccaaaatacggcaagcacatgaaacagattgctgctaatttggctcagatggacggatcgaaggttgtgcaaactcttcattccggagaggattattttttagaagttcaaggttcaaccttcaaacttaccgaagaagatcttaccatcaccattaaagataaagagggattcgtctttgaatccaataaagaactgtttgttgctttagatactcacatgacagatgaacttatttctgaaggtctggcaagggaactggttaataaaattcagtttactcgccgtgagaaagattttgagatcatggatcgcatcaaagtattctatcaagctgatgaagaaattcaggctgtaatcgctaaacatggcgagtacattaaaagcgaaactcttaccaacgatatcttcgctgtaaaagttgttgaaaaagatatggttgagtgggatatcaacggacgtgtagttcagttgacagtggagaaagataactag

SEQ ID NO: 17868 - protein, 167 aa, Unknown
  Obtained from environmental sample
  misc_feature (1)..(167): Xaa is any amino acid
MMGPKYGKHMKQIAANLAQMDGSKVVQTLHSGEDYFLEVQGSTFKLTEEDLTITIKDKEGFVFESNKELFVALDTHMTDELISEGLARELVNKIQFTRREKDFEIMDRIKVFYQADEEIQAVIAKHGEYIKSETLTNDIFAVKVVEKDMVEWDINGRVVQLTVEKDN

SEQ ID NO: 17869 - DNA, 537 bp, Unknown
  Obtained from environmental sample
  misc_feature (1)..(537): n is a, c, g, or t
atgcatatattattttcgcttctttatgcaccttttgtttttttatcgttacggtattttgatttaaaagttgtctcaagtataatatttactattgcacttatttggtttttaatagcaattaaaaaaagttttaaagagtctatcttccctttattttatatcatagttgcaattttagcttttagttttgacaattttttactactaaaaagtttacctcttcttatctctattcttgtgagtttatattttttctatagttactttacaaaaaactcttttatacttttagtattggatagattaaaaaaagagatagctacaaatgagaaagaatatatccaaaaatcaacacttttttggtgtataatctctataataaatatcttaattcatatttttgttttacaatctgataatataaactattggatatactatagctctattggctggtattttgtttttggtgttgcatttattttgcaaatgatacacaaaaagatatatttaaaaaaggatacttatgtttaa

SEQ ID NO: 17870 - protein, 178 aa, Unknown
  Obtained from environmental sample
  misc_feature (1)..(178): Xaa is any amino acid
MHILFSLLYAPFVFLSLRYFDLKVVSSIIFTIALIWFLIAIKKSFKESIFPLFYIIVAILAFSFDNFLLLKSLPLLISILVSLYFFYSYFTKNSFILLVLDRLKKEIATNEKEYIQKSTLFWCIISIINILIHIFVLQSDNINYWIYYSSIGWYFVFGVAFILQMIHKKIYLKKDTYV

SEQ ID NO: 17871 - DNA, 894 bp, Unknown
  Obtained from environmental sample
  misc_feature (1)..(894): n is a, c, g, or t
gtgtctctttcaaaagagtgcgttagttacatcaacgagatgattaaccctctcattggggatgacatgatcgttaaagagctctttagaaaaaacgttacgctttatgtggatgacaaaatcactagtaaaaacggcgttatcacttacaagataaatagctgtaaattcaaacaagtaacgagaatcaaagacttcagcgaagatggactcgtttttgacataccaaacgtttcttttagtcacatcgcaggtcattatgttgcgaagcagagacttcacgaggttataaacttctttaaagagccaaaactccttagaagttttgacatagagccaccaaaaggaatgcttctttatggacctcctggaaccggtaaaaccatgcttgcaaaagcttttgctagagaagcggaactccctttcatctctataacgggacttgagctcctgcaacctgaaaagacaaaaaaagtttttgcaaaagcaaaagagtactctcccgccattgttttcatagacgagatagatactattggtaaacgcggaggcggtggcacgcgcgagattgcgatcaacacgcttctagccgagatggatggtttctccggtaatggcgaaaacgtttttgttatcgccgctacaaactacaaagaaaacattgacgcggctatcattagaccaggaagaattgagattcatatagagataaacaaccttgataaagacgctagactctactttttagagggaattatcaacaagaaaccttcaagtgggaattttgatatgaacaagttgttgatgtatacagctggatttacaggcgcgcaacttgaacttttaagcaaagaggcgtcattttactgcttgcgtcacactctgcccgcctga

SEQ ID NO: 17872 - protein, 297 aa, Unknown
  Obtained from environmental sample
  DOMAIN (116)...(292): ATPase family associated with various cellular activities (AAA)
  misc_feature (1)..(297): Xaa is any amino acid
MSLSKECVSYINEMINPLIGDDMIVKELFRKNVTLYVDDKITSKNGVITYKINSCKFKQVTRIKDFSEDGLVFDIPNVSFSHIAGHYVAKQRLHEVINFFKEPKLLRSFDIEPPKGMLLYGPPGTGKTMLAKAFAREAELPFISITGLELLQPEKTKKVFAKAKEYSPAIVFIDEIDTIGKRGGGGTREIAINTLLAEMDGFSGNGENVFVIAATNYKENIDAAIIRPGRIEIHIEINNLDKDARLYFLEGIINKKPSSGNFDMNKLLMYTAGFTGAQLELLSKEASFYCLRHTLPA

SEQ ID NO: 17873 - DNA, 903 bp, Unknown
  Obtained from environmental sample
  misc_feature (1)..(903): n is a, c, g, or t
gtgctcaagattcagaatggagcaatctcttttgatcgccttgaggtgaaatttaatattgatgacacaggaaagccattaggagtatactttaaagagcaaaaagaatcaaataaattaattgaggaatttatgcttttggcaaataagcgagttgcagagtttattggtaaagttgcaaaaggaataaaagcaaaaacctttgtttatagaattcatgataaaccagatcccgaaaagttggagcgtttctcaaagttcattcaacgatttgggtatgggataaatacttcgagccagaagaatattacaagttcaattaatgatttgcttgatcaggttcaaggtaaaaaagaacaaaatgtaattgaaactttagccgttcgttcaatggcaaaagccgtgtactctactaaaaatgtaggtcattatggtttgtctttttctcattattcgcattttacttcgccaattaggcgttatcccgatatgatggttcatcgtttattaaccgcatatatggatggagagaaaagcgcgaatcaaaataaatacgaagatatgtgtaagcattcttctgaaagagaacgcaaagcggcagaagcagaacgtgcttcaataaagtataaacaggttgagttcatgaaagatcatattggagaagatttcgatggtgttatttctggagtaaccgagtgggggttttatgttgagcttaacgacagcaaatgcgaaggtctagttcatattcgtgagcttgacgatgattactactttttcgatgaggataattattccattattggacgacgaaataagaaacgtatcaattgggagatctgtcagaattacattgtaagagctgatctagagaaaaaaccactagattacccgctagcttaa

SEQ ID NO: 17874 - protein, 300 aa, Unknown
  Obtained from environmental sample
  misc_feature (1)..(300): Xaa is any amino acid
MLKIQNGAISFDRLEVKFNIDDTGKPLGVYFKEQKESNKLIEEFMLLANKRVAEFIGKVAKGIKAKTFVYRIHDKPDPEKLERFSKFIQRFGYGINTSSQKNITSSINDLLDQVQGKKEQNVIETLAVRSMAKAVYSTKNVGHYGLSFSHYSHFTSPIRRYPDMMVHRLLTAYMDGEKSANQNKYEDMCKHSSERERKAAEAERASIKYKQVEFMKDHIGEDFDGVISGVTEWGFYVELNDSKCEGLVHIRELDDDYYFFDEDNYSIIGRRNKKRINWEICQNYIVRADLEKKPLDYPLA

SEQ ID NO: 17875 - DNA, 393 bp, Unknown
  Obtained from environmental sample
  misc_feature (1)..(393): n is a, c, g, or t
atgaaaaataaaaaatccccaacaatattaattgtagatgacaatgaaattaatatagatatattattaggtgccttaaataaatatgatattattgctgcacttagtggacaagaagcattagatattgttaaaaaagagaaagtagacttaatactactagatatcatgatgccctctttagatggatatgaagtttgtagaatattaaaaaatagtgataagtactcaaatatcccaattatatttcttacagctaaaaatgaaacggatgatattaaaaaaggttttgagtacggggcgattgattatattgttaaacctttcaatccctcagagttagacatacgactcaatactcatttagaactccttagttacaaaaataattag

SEQ ID NO: 17876 - protein, 130 aa, Unknown
  Obtained from environmental sample
  DOMAIN (7)...(126): Response regulator receiver domain
  misc_feature (1)..(130): Xaa is any amino acid
MKNKKSPTILIVDDNEINIDILLGALNKYDIIAALSGQEALDIVKKEKVDLILLDIMMPSLDGYEVCRILKNSDKYSNIPIIFLTAKNETDDIKKGFEYGAIDYIVKPFNPSELDIRLNTHLELLSYKNN

SEQ ID NO: 17877 - DNA, 477 bp, Unknown
  Obtained from environmental sample
  misc_feature (1)..(477): n is a, c, g, or t
atggaaaatatttttgagccatttattcaagcagatgacacaattacaagagaatatggtggtactggacttggtctatctatatcaaaacaacttgtagagttaatgggtggaatacttagaattgaaagtaaggtaaaagagggtacacaaatatattttgatattgagttaagagaaataaaacaagaggattacattaacgagaaagggttagaaaaaacaaagaaaaaaatagagtttaatttgtataataagagagagacaatagtttttgaaaaagagaaagagttacttgaacaattagaagaggcagtattgagaaaaagaccaaatgtggtatatcctattattgatgaattagataaatataatttacaaatactaagtagtgtagattttaagaatataaaaacatatattaagagatatatgtttcatgaagcaagcgagatactaaataaatatgaaaaataa

SEQ ID NO: 17878 - protein, 158 aa, Unknown
  Obtained from environmental sample
  misc_feature (1)..(158): Xaa is any amino acid
MENIFEPFIQADDTITREYGGTGLGLSISKQLVELMGGILRIESKVKEGTQIYFDIELREIKQEDYINEKGLEKTKKKIEFNLYNKRETIVFEKEKELLEQLEEAVLRKRPNVVYPIIDELDKYNLQILSSVDFKNIKTYIKRYMFHEASEILNKYEK

SEQ ID NO: 17879 - DNA, 489 bp, Unknown
  Obtained from environmental sample
  misc_feature (1)..(489): n is a, c, g, or t
atgatagataaagctacatatccatttctagcacttagtttatataatcttgtgccatcttgttatacctgtaatacaaaagtcaaaggtaaaaatgagataaaaaaattatcaccaagtgatgaaaagtttgattttaatgataaagtaaaattcaaaacttttttaaataatattgatttacaaatagagaaaaataatgactttgaacttttactaaaggaagatttttcagttaaatttgatgaatatataaaagtactagagttagataaaagatataaatatcataaagataaagttattgaaatgataaataaaagaagagactatcccgatagtagaataaaagaactatctttaataactaaaaagaccgaagaagatgtaaaacaagatttatttgggatatatttaaatgaagacctacataaaaaaccatttagtaaactcataaaagatataagtgaagaattgggactaacataa

SEQ ID NO: 17880 - protein, 162 aa, Unknown
  Obtained from environmental sample
  misc_feature (1)..(162): Xaa is any amino acid
MIDKATYPFLALSLYNLVPSCYTCNTKVKGKNEIKKLSPSDEKFDFNDKVKFKTFLNNIDLQIEKNNDFELLLKEDFSVKFDEYIKVLELDKRYKYHKDKVIEMINKRRDYPDSRIKELSLITKKTEEDVKQDLFGIYLNEDLHKKPFSKLIKDISEELGLT

SEQ ID NO: 17881 - DNA, 360 bp, Unknown
  Obtained from environmental sample
  misc_feature (1)..(360): n is a, c, g, or t
atgccagatccagtttcgttaacttgggataattcaaatggagagtaccacatgattgtaattgaatgtattgaggagtctccaacattaattagcgaatcaacagatgcgccaacaagagtatttagaaatatgccaacgcaaggagacgaacaggaattagatccaagaagttttatgtactacgggcaacatcaaataattttatttagattaaattcggaatatgcagcactttacgagcaacttgatgcaacttctttggacattgttgctcctccttcaaatatcgaaaatggtttaggtatttttacaggaataaattcagatactttaataataaatgtagaatcattgtaa

SEQ ID NO: 17882 - protein, 119 aa, Unknown
  Obtained from environmental sample
  misc_feature (1)..(119): Xaa is any amino acid
MPDPVSLTWDNSNGEYHMIVIECIEESPTLISESTDAPTRVFRNMPTQGDEQELDPRSFMYYGQHQIILFRLNSEYAALYEQLDATSLDIVAPPSNIENGLGIFTGINSDTLIINVESL

SEQ ID NO: 17883 - DNA, 519 bp, Unknown
  Obtained from environmental sample
  misc_feature (1)..(519): n is a, c, g, or t
atgatcagatcggcncgagggagttggtattggaattgcttttgtaacggtggaaactctggtggaacagatattatcgcgcttataataactaaatataaaaatatttcaccgggaaaaattattctttacattgatgtaatgattattgcctcatcgtattttatttccagaaaaatagaaacagttgtttatggttacgttgtaatgggcgtttttgcttacactctcgatttgattttaaatggagcaaaacaatcttatcaattaacagtaatgtctaaaaaaagcaatgaaatagctgatgaaataacattaaatgttggtcgcggtgtaactctgatgaaaggaacaggttggtattcaaaaagtgaaattgatattttgtttgtaataattagaaaacatgacaaacaaaaagttttacgaattcttgcagaaattgataatgatgcatttatttccgaagcaaaagtttctgcagtttttggaattgggtttgatagaataaaattgtag

SEQ ID NO: 17884 - protein, 172 aa, Unknown
  Obtained from environmental sample
  misc_feature (1)..(172): Xaa is any amino acid
MIRSARGSWYWNCFCNGGNSGGTDIIALIITKYKNISPGKIILYIDVMIIASSYFISRKIETVVYGYVVMGVFAYTLDLILNGAKQSYQLTVMSKKSNEIADEITLNVGRGVTLMKGTGWYSKSEIDILFVIIRKHDKQKVLRILAEIDNDAFISEAKVSAVFGIGFDRIKL

SEQ ID NO: 17885 - DNA, 540 bp, Unknown
  Obtained from environmental sample
  misc_feature (1)..(540): n is a, c, g, or t
ttgaaaaccaaaaaagagttaaaaaaagagattatcatacaagctgcattggagctgttttcaaaaaaaggtttttatacaacaactattcctgatattgcacaatctttaaaaatgagtgtaggaaatatgtataactacttcaaatcaaaagatattttagcaaaagagattatcaaacatatttcacattatttaggagaacagttaaaaagtatcaatgaaaaagagatctctacagaggaaaaaacaaaacaaatcgttacagtatattttcaaactgccaatctcaaacctgaaatgatagattattttttaagagtttttttatcaaatagagaggtttttaaagagggttgtgaggggatgatttgtgtaaatgattttgttacagagattatgatctattttgaagatggtgttaaaaatggggaactaagagaccaagacttttttagtgcttttggtttatttatgggntatttaggtggtatgggttttctccaaagggaaatattttacccaccatctgatagttaa

SEQ ID NO: 17886 - protein, 179 aa, Unknown
  Obtained from environmental sample
  DOMAIN (12)...(58): Bacterial regulatory proteins, tetR family
  misc_feature (1)..(179): Xaa is any amino acid
MKTKKELKKEIIIQAALELFSKKGFYTTTIPDIAQSLKMSVGNMYNYFKSKDILAKEIIKHISHYLGEQLKSINEKEISTEEKTKQIVTVYFQTANLKPEMIDYFLRVFLSNREVFKEGCEGMICVNDFVTEIMIYFEDGVKNGELRDQDFFSAFGLFMGYLGGMGFLQREIFYPPSDS

SEQ ID NO: 17887 - DNA, 852 bp, Unknown
  Obtained from environmental sample
  misc_feature (1)..(852): n is a, c, g, or t
ttgtttgtgaatacagatggttctattttttataccctccgcaaagaatcggatacgaatatcaatataaataacaacagcgtgtctttgggtatattggaagaagcaatcaaaaatagaccggatcatgaagtgtttattgattactatgaatataccccttcttctgagccagctgcattttttattgagcctattaagaaacaaggtgttttaaagggatggatagtccttcaatgtacaattaacaattttaattctatcttttctgccacagatgatcttggtcagacaggcgaaacttttttggtgaataagaacggggtaatgttgaccgaatctttttttaaaggccagtcaacaattttaaaaacacaccttgctgatcgaaatattaaggtaaaatttgctgaacgtaaaggtcatcgggtggtcactgactatcgcggggcaacggcgctgagttcttttgaagtttttgagtatctgggaaccagctggctggttgttgcaaaaatagataaggatgagataaccacagatcactataagcaacatcataaatattatgaaaaaatgcttttaaaacatctcagaaacctccagcccatgccgacatccaatacgaaagatcatcatcctcctgcaggtgcattgagagtggacatggatgaatttttaaaagcaacaaaccatgagagtcttgagacctggggcgtgtcaacctgtaccgcactgctggcaatggtaccggagaaatttgcgtatctggcacatatcagtcccaaagataaaatttataatggggacagatacaaatctggggtctcaaatcccaaaaaagatcaatag

SEQ ID NO: 17888 - protein, 283 aa, Unknown
  Obtained from environmental sample
  misc_feature (1)..(283): Xaa is any amino acid
MFVNTDGSIFYTLRKESDTNININNNSVSLGILEEAIKNRPDHEVFIDYYEYTPSSEPAAFFIEPIKKQGVLKGWIVLQCTINNFNSIFSATDDLGQTGETFLVNKNGVMLTESFFKGQSTILKTHLADRNIKVKFAERKGHRVVTDYRGATALSSFEVFEYLGTSWLVVAKIDKDEITTDHYKQHHKYYEKMLLKHLRNLQPMPTSNTKDHHPPAGALRVDMDEFLKATNHESLETWGVSTCTALLAMVPEKFAYLAHISPKDKIYNGDRYKSGVSNPKKDQ

SEQ ID NO: 17889 - DNA, 660 bp, Unknown
  Obtained from environmental sample
  misc_feature (1)..(660): n is a, c, g, or t
ttggaaattctatttttgtcaaaaaaaaaggcagtgaatttccttgcacatgcccctcttcagggaaacaatgataaaatccttttgggaatttttattgctgatgcagtgaagggaaaacagtgggaaaaatacgagacagaaattcaggtaggcatacgacttcaccgacaaatagatacttataccgataaacatcccattgtaaaaagaagtgtaaacagaattagggatgattatggaagatattcgggagtggtgatggacatttattacgatcactttctcgccaaaaactggaatctttaccatccggcaactctcgacagtttttcacaacatgtttataaaattcttaccaaacgatttttaatactccccgaccgaacaaaaaggatgttgccttttttaatcgcacaaaactggctgaaatcttatgcaaaattcccaggtttggaacgtgtatttcaggggatggacaggcgtaccagattactttctggtatgagtgatgctgttattagcctggaaaagaattatgaagaattaaaaaaagactttacaatattttatcccgaactacaaagtttttcgaaagatgtgcttggagagattcttgcaaacaatatcgaaaatcattcgcttaaaagtaaagtgtaa

SEQ ID NO: 17890 - protein, 219 aa, Unknown
  Obtained from environmental sample
  DOMAIN (30)...(202): Protein of unknown function, DUF479
  misc_feature (1)..(219): Xaa is any amino acid
MEILFLSKKKAVNFLAHAPLQGNNDKILLGIFIADAVKGKQWEKYETEIQVGIRLHRQIDTYTDKHPIVKRSVNRIRDDYGRYSGVVMDIYYDHFLAKNWNLYHPATLDSFSQHVYKILTKRFLILPDRTKRMLPFLIAQNWLKSYAKFPGLERVFQGMDRRTRLLSGMSDAVISLEKNYEELKKDFTIFYPELQSFSKDVLGEILANNIENHSLKSKV

SEQ ID NO: 17891 - DNA, 765 bp, Unknown
  Obtained from environmental sample
  misc_feature (1)..(765): n is a, c, g, or t
gtgagttttttagaactttttaagcgtccatgttttatcggagcacatcgaggttctcgctcaacacatccagaaaacactctatccgctcttaaaaatagcattggtcattgtgacttcattgaagttgatgtgcagttaagtcgtgatggaatcacagtaattatgcacgatgaaaccttagagcgaacaaccaatgtcaaagaaaaagaagcctataaaacacgtattccttacaaacttactgattttacatatgccgagttgacaagtcttgattatggaagttggttctatattgataaaaaaaagcctgagccattactgacacttaaaaaagtattggagtttgtaaaagaaaacaaactttttattaatatagagataaaagacttacatcatcattttagcgacaagcaagttctatcaactgttctcaaagagatcaataattctggagcgaaagagttgattttgctctcttcctttagacatgagtacatgattctctccaataagatgcaagctgatatacctacagcagcattagtttataataagcatccagcatctctgctacaatatttaaaatcattaaacgtagatgcatatcactttaacgataaacttgccgataaacaaacaattagaaaattaagagatgcaggggtttttgtaaatatatacactgttaacgatttaaaaagacgtcaacagctttttaatatgggcgtaaatggagtatttaccgattatttagagtag

SEQ ID NO: 17892 - protein, 254 aa, Unknown
  Obtained from environmental sample
  DOMAIN (16)...(254): Glycerophosphoryl diester phosphodiesterase family
  misc_feature (1)..(254): Xaa is any amino acid
MSFLELFKRPCFIGAHRGSRSTHPENTLSALKNSIGHCDFIEVDVQLSRDGITVIMHDETLERTTNVKEKEAYKTRIPYKLTDFTYAELTSLDYGSWFYIDKKKPEPLLTLKKVLEFVKENKLFINIEIKDLHHHFSDKQVLSTVLKEINNSGAKELILLSSFRHEYMILSNKMQADIPTAALVYNKHPASLLQYLKSLNVDAYHFNDKLADKQTIRKLRDAGVFVNIYTVNDLKRRQQLFNMGVNGVFTDYLE

SEQ ID NO: 17893 - DNA, 609 bp, Unknown
  Obtained from environmental sample
  misc_feature (1)..(609): n is a, c, g, or t
gtgagttttctcacacaaaaacctttagagcccatggaggtaaaatggccaaacaagctagataattatattaaatattttaataaacttaaaatgagagcaattggacgtaatcttagaatcaaacataaaaaagcacaaatagttgcttctatggttagtggaatgcaagtaaataaagctttggaattactcaaatatcttccaaaaaaagctgctcaaatgatctataaagttttaaaaagcgcaataagtaatgccgaacataatttaaagaaagatgctgataacttgattattaaacatataatcgtaaataaaggaactgaactaaagagaattagacctatctcaagaggaagagctcatagaataactaaggnggtatcacatataagaattattttagatgaatttattaatgataaaaaggtagaagagaagaagagtaaaaaaactggaaaggttgaaaagattgagaaaaaagaagaaaaagctccaaaaaaaagtactgataaacaaaaggctccaaaaaagtggatacaaaaaaaacttcctaaaaatcctacagtaaatattatgggaaaaaaagttcctccataccgtttc

SEQ ID NO: 17894 - protein, 203 aa, Unknown
  Obtained from environmental sample
  DOMAIN (34)...(138): Ribosomal protein L22p/L17e
  misc_feature (1)..(203): Xaa is any amino acid
MSFLTQKPLEPMEVKWPNKLDNYIKYFNKLKMRAIGRNLRIKHKKAQIVASMVSGMQVNKALELLKYLPKKAAQMIYKVLKSAISNAEHNLKKDADNLIIKHIIVNKGTELKRIRPISRGRAHRITKXVSHIRIILDEFINDKKVEEKKSKKTGKVEKIEKKEEKAPKKSTDKQKAPKKWIQKKLPKNPTVNIMGKKVPPYRF

SEQ ID NO: 17895 - DNA, 378 bp, Unknown
  Obtained from environmental sample
  misc_feature (1)..(378): n is a, c, g, or t
atgaataataagtgtattgtttgtaatagtttggagtttgatactatattagattatagattaaatagagtagttacttcagataataaaactatgaataaaaactttttattgttaaaatgtagacaatgtttacatattcaaaagaaaatagataaagattttttaaatacgatagacaaaatatatgcaaactataaagcatattatttaaatgatgggaatgaagaagagaanagagatgatgctactacaagtcgttcaaaaataatattaaataatatcaaaagtattattccaaaagatggaaatattttagatatagggaaccggaaaggggtgtattttttaaaaaaagtttttctaaaggaaaaataa

SEQ ID NO: 17896 - protein, 125 aa, Unknown
  Obtained from environmental sample
  misc_feature (1)..(125): Xaa is any amino acid
MNNKCIVCNSLEFDTILDYRLNRVVTSDNKTMNKNFLLLKCRQCLHIQKKIDKDFLNTIDKIYANYKAYYLNDGNEEEXRDDATTSRSKIILNNIKSIIPKDGNILDIGNRKGVYFLKKVFLKEK

SEQ ID NO: 17897 - DNA, 543 bp, Unknown
  Obtained from environmental sample
  misc_feature (1)..(543): n is a, c, g, or t
gtgccaataaatggaaaaccacttttaggatattggctagaaaatttatctaaagcaggaataaaagaatttttgataaacacctcttatcttcatcagcaagttgaagattttgtaagtcaaagtatatataaagatatggtcaccttagtctatgaagaggagttgttaaatacaggtggtaccctactggaaaatgaagagttttttaataacgaatcttttatcttagttcatgcagacaatctctccttttgtgattttggggcctttattaagtctcatcatgacagaatgaaaaagagtgaactaactatgatgctttttaaaagtgacaatcctagtagttgcggtatcgtagagttggattcctttaatatggtagtgaagttttatgaaaaagtaaaaaatcctccatcagatttagcaaatggtgctgtgtatatttgtgaatcatcaataatatcattttgcaaaagactcaataaaaaaaagattgatttctcaaatgaagttttaccatattttatgggcaaagattaa

SEQ ID NO: 17898 - protein, 180 aa, Unknown
  Obtained from environmental sample
  DOMAIN (1)...(180): Nucleotidyl transferase
  misc_feature (1)..(180): Xaa is any amino acid
MPINGKPLLGYWLENLSKAGIKEFLINTSYLHQQVEDFVSQSIYKDMVTLVYEEELLNTGGTLLENEEFFNNESFILVHADNLSFCDFGAFIKSHHDRMKKSELTMMLFKSDNPSSCGIVELDSFNMVVKFYEKVKNPPSDLANGAVYICESSIISFCKRLNKKKIDFSNEVLPYFMGKD

SEQ ID NO: 17899 - DNA, 444 bp, Unknown
  Obtained from environmental sample
  misc_feature (1)..(444): n is a, c, g, or t
ttggtgatgataaatggagatgcttttcaaaatattttaacgaaaattaatgatcactttaaatctgatttttgtttcaatatctcagctaagttaaacgacaatatgacactacnagaatcagaaattaaaacagggacagatattttaatgtacttgaataaatctcaccctcatctactaagttctttcactgatgatagttctaaatcatctgatattgttgaaatagattttgatgatattgatttcaaattagcaaaaaaaatatataaatgggatattaagtataggatattgatagataaaaggcatacgaagcttgcgtttatgatatctgctgaatcaaaccttactaagaatgagaaactttttataagaaattgcctttatacgttgtctagatatggcgttactttagaagatattgaatattctctatag

SEQ ID NO: 17900 - protein, 147 aa, Unknown
  Obtained from environmental sample
  misc_feature (1)..(147): Xaa is any amino acid
MVMINGDAFQNILTKINDHFKSDFCFNISAKLNDNMTLXESEIKTGTDILMYLNKSHPHLLSSFTDDSSKSSDIVEIDFDDIDFKLAKKIYKWDIKYRILIDKRHTKLAFMISAESNLTKNEKLFIRNCLYTLSRYGVTLEDIEYSL

SEQ ID NO: 17901 - DNA, 792 bp, Unknown
  Obtained from environmental sample
  misc_feature (1)..(792): n is a, c, g, or t
atggttatagtttgtagtatgtggcttaccggtttcgatgttccctgtctccataccatgtacttagataaaccgatgcagggtcatacacttatgcaggcaatagcaagggtcaatagagtatttaacgataaacctggtggcttgatagttgattaccttggcatagcatctgatctaaagaaagctctatctttctattccgagagtggcggtaagggtgatcctgctgaaactcaggagaaagctgttaagatgatgcttgagagattagaagtggtatctcaaatgttccacggttttgcttatgaagatttttttgatgcagatgtatcacaaaaactcaagataatactggaggccgaggaatatatcctgggattggaagatggtaagaagagatacgtaagagaagtggttgctctatcacaggcatttgctatagcgattcctcatgaacaagctatggatgtaaaagatgagataagttttttccagactgtcaaagccaggttggtaaagtttgatagtaaagagggtggaacatttaatgaagatcttcaaacaacaatcaaacaaataattgataaagctttagtctcagatgcggtcgtagatatcttcagtgagataggtatcaaaaatcctaacatatcaataatgtctgaagagttcctcttagaagtccgtaatatgaagcataagaatattgcccttgaggttttaaaaaattactcaatgatgagatacgctcacgtggtaggcttaaatatgtgcagggtaaaactctaa

SEQ ID NO: 17902 - protein, 263 aa, Unknown
  Obtained from environmental sample
  misc_feature (1)..(263): Xaa is any amino acid
MVIVCSMWLTGFDVPCLHTMYLDKPMQGHTLMQAIARVNRVFNDKPGGLIVDYLGIASDLKKALSFYSESGGKGDPAETQEKAVKMMLERLEVVSQMFHGFAYEDFFDADVSQKLKIILEAEEYILGLEDGKKRYVREVVALSQAFAIAIPHEQAMDVKDEISFFQTVKARLVKFDSKEGGTFNEDLQTTIKQIIDKALVSDAVVDIFSEIGIKNPNISIMSEEFLLEVRNMKHKNIALEVLKNYSMMRYAHVVGLNMCRVKL

SEQ ID NO: 17903 - DNA, 855 bp, Unknown
  Obtained from environmental sample
  misc_feature (1)..(855): n is a, c, g, or t
ttgatggctggaactatccacctatgggagcattattatgtttccttggtattaaaaacacaatgcctcttatgcatggagcacaaggatgtgnctagtttttcaaaagtattttttactagacattttagtgatccaattgctgtacaaacaacggcagtaaatgatataactgctgttcttgatggtggagattatagtgttagtgaagctgtaaaaaatatcacaaaaaaagtaaaacctgacctcgttggactttttacaacaggtatgactgaaacaaaaggtgatgatataaaaggggcaacttttttacttaaagatgttcaaaaaatggtatatgttcatactcctgattttgaaggtggattagaaagtggttatgctaaatcaattgaagctattattgaacaactagtagctcctacaacttcgattgataataaaaaagcagttatcatccctaatgtaaaccttactccaattgaagtagaaaagataaaagaacaagtagacttatttggttatgaaacactagcattacctgatattagtcaatctcttgatggtcatcttggacttaaacaaggtgcaatgagtagtggtggaataagtattgaagagatagaaaaactcgctagttcacaagttgttataacaattggaaactctgtagaaaaagctggaaatttacttaatggtaaaaatgaaaatatgatacatcttcactttgatacgataagtggtttactaaaagctgataaattttataaaggtttaatggatattaaaaaatatctaaaccaaatccatcagtggtacgatggagaaaaagattaccagatgctcttctag

SEQ ID NO: 17904 - protein, 284 aa, Unknown
  Obtained from environmental sample
  DOMAIN (16)...(284): Nitrogenase component 1 type Oxidoreductase
  misc_feature (1)..(284): Xaa is any amino acid
MMAGTIHLWEHYYVSLVLKTQCLLCMEHKDVXSFSKVFFTRHFSDPIAVQTTAVNDITAVLDGGDYSVSEAVKNITKKVKPDLVGLFTTGMTETKGDDIKGATFLLKDVQKMVYVHTPDFEGGLESGYAKSIEAIIEQLVAPTTSIDNKKAVIIPNVNLTPIEVEKIKEQVDLFGYETLALPDISQSLDGHLGLKQGAMSSGGISIEEIEKLASSQVVITIGNSVEKAGNLLNGKNENMIHLHFDTISGLLKADKFYKGLMDIKKYLNQIHQWYDGEKDYQMLF

SEQ ID NO: 17905 - DNA, 774 bp, Unknown
  Obtained from environmental sample
  misc_feature (1)..(774): n is a, c, g, or t
atggcattaaacattgtttttgtaatgctaggttctttatttgtagcacttacattagttccagtattaacgtatttactacttaagccatcaaagtccaaagagaattcattgatgagaggtgtaaaaaaagcttacactccattgctgatgttggctcttggacattcaaaattttttttaatagctgtatctgtaatctttgttggtttagcttatattttaagtcagcaaggtcgtgagtttatgcctgagttaaatgaagagtctattatgtatagggttatatctatacctggaactggtttagcacaatccacgcaaacagcgagtgaaatagaaaaacatatattaaaaaactacccaaatgaagtaacatctgttctttcaatgataggaagaagtgaaaagggagaaacggctcaagcaaactatatggaagttcttttaacccttaaggatgatataaaaaaccttgaagatttaacccaaaagatgaataaagatttaaaacatacttttgaatatgttcagtttattcctactcaacctatcgctatgagaattgaggaattgcttgaaggtgtaaaagcagaattggcagttaaaatatatggcgatgaccaaaaagtgttagactctatcgctaaatctattcaatctaaactcaaaggtgttgatggtttagaagagatggaagttgaagttcaacttggtcaagcacaaattaaaattgagcccaaattatttagcacttgctcgttatggaattaa

SEQ ID NO: 17906 - protein, 257 aa, Unknown
  Obtained from environmental sample
  misc_feature (1)..(257): Xaa is any amino acid
MALNIVFVMLGSLFVALTLVPVLTYLLLKPSKSKENSLMRGVKKAYTPLLMLALGHSKFFLIAVSVIFVGLAYILSQQGREFMPELNEESIMYRVISIPGTGLAQSTQTASEIEKHILKNYPNEVTSVLSMIGRSEKGETAQANYMEVLLTLKDDIKNLEDLTQKMNKDLKHTFEYVQFIPTQPIAMRIEELLEGVKAELAVKIYGDDQKVLDSIAKSIQSKLKGVDGLEEMEVEVQLGQAQIKIEPKLFSTCSLWN

SEQ ID NO: 17907 - DNA, 387 bp, Unknown
  Obtained from environmental sample
  misc_feature (1)..(387): n is a, c, g, or t
atgaatttagatattatacgacaagaaagagaaaaatggcttcattggaaaaatataattcctatgagagaagctctagaaaatattaagaaaattgatacaactaatataaatattgacataaatagtgattgggttactgctaaaaaagctataccagatgatgagatagaaaatataaataaaaatcttaaaaaacttataccttggagaaaaggtccttttaacctttgtggaatagaagtaaatagtgaatggcaaagtaatctaaaatataatttacttgaaaaacattttgatttaaaggataaaatagtagccgatgttggctgtaacaatggatattatatgtttagaatgctttcacaaaaccctaaaaaactgtag

SEQ ID NO: 17908 - protein, 128 aa, Unknown
  Obtained from environmental sample
  misc_feature (1)..(128): Xaa is any amino acid
MNLDIIRQEREKWLHWKNIIPMREALENIKKIDTTNINIDINSDWVTAKKAIPDDEIENINKNLKKLIPWRKGPFNLCGIEVNSEWQSNLKYNLLEKHFDLKDKIVADVGCNNGYYMFRMLSQNPKKL

SEQ ID NO: 17909 - DNA, 360 bp, Unknown
  Obtained from environmental sample
  misc_feature (1)..(360): n is a, c, g, or t
ttgaaaaaaataagattttcttatataattattgcttctattctttcattcttattgctctcttttatctactacaacaaaacacatgagatggctgttgataatgcaaaggttaaaataaatgaactacttttaaattatcaagcgatgcgtgaatatgttggtaaagtgcaaaaagaggagatatatcatcttcaagaaaatggaataataaataaagaatattttagtccagctttattatcttcaacatttagtgctaaaaatgtaaataacttttataatgaatttaaagaaaaaattaatcaaagtccagtaactataagatttgctagtgataatcctagaaacatttgctaa

SEQ ID NO: 17910 - protein, 119 aa, Unknown
  Obtained from environmental sample
  misc_feature (1)..(119): Xaa is any amino acid
MKKIRFSYIIIASILSFLLLSFIYYNKTHEMAVDNAKVKINELLLNYQAMREYVGKVQKEEIYHLQENGIINKEYFSPALLSSTFSAKNVNNFYNEFKEKINQSPVTIRFASDNPRNIC

SEQ ID NO: 17911 - DNA, 369 bp, Unknown
  Obtained from environmental sample
  misc_feature (1)..(369): n is a, c, g, or t
atgaaaaataaaattacacaagagtttattgataatgatagaagatcatttattgataaagttgtaaaaggtacaatcactggttcattaatggttatgataccaatgagttctaaactttttagtgaagttttaggtgaggagaaaaaggcacaaagtgaaataaatccaatgaacttaaatgcaaattattgttttattgtggatgttacagcttgtattggttgtggtaactgttgtgttgctgatagaaaagagaataatgttccccaaggtcaatatagaacttgggttgaaagatatgttatagatatggtaaataaagtatatgttgattctccagatggcggagaaaagaggctacactaa

SEQ ID NO: 17912 - protein, 122 aa, Unknown
  Obtained from environmental sample
  misc_feature (1)..(122): Xaa is any amino acid
MKNKITQEFIDNDRRSFIDKVVKGTITGSLMVMIPMSSKLFSEVLGEEKKAQSEINPMNLNANYCFIVDVTACIGCGNCCVADRKENNVPQGQYRTWVERYVIDMVNKVYVDSPDGGEKRLH

SEQ ID NO: 17913 - DNA, 738 bp, Unknown
  Obtained from environmental sample
  misc_feature (1)..(738): n is a, c, g, or t
ttgatatatattgttttagtctatggcaggggtagaagtggctcaatgttatcgccatctacagtggctaataattattttacactcacaattaaaagacttgatatttttgcaactaatgaaggtgtgccacttatagatgtattagaaaataagagttttatgcaaaaatatatcaaagaacacttaacatcacttggcagtgtcgtgggtataacaggtttttttaaaatacttgatagaatcaaccaaaagcgaagtggtattaactatgcaaaggatgatgaactgcataagcatttgtcaaggatgataaaaaattttaaaaatgctcatcaacaaacagagatacttcctacatcaatattgagtaatactttaaaagaaagatggatacagattgatgaaataatacaaaaagagaaaaatttagcaaagcttatacgaaaatattttaaacatgaagaactttttaatcgaaagaactggaaaaaaagtgtagctagttgtggcttagtaaatctttttaaaaagtacaatgtaaatgggagtatgaatatacctcgattctttaaacagattcaagggacatgcaagcatctgataatagcatattcaggtatgagaaatacagaggcagagactctcatgactaactgtttagaagtgctacatgattcggcatcaggtagtataactaggctaattggttctacaacaaaattacatggctattga

SEQ ID NO: 17914 - protein, 245 aa, Unknown
  Obtained from environmental sample
  misc_feature (1)..(245): Xaa is any amino acid
MIYIVLVYGRGRSGSMLSPSTVANNYFTLTIKRLDIFATNEGVPLIDVLENKSFMQKYIKEHLTSLGSVVGITGFFKILDRINQKRSGINYAKDDELHKHLSRMIKNFKNAHQQTEILPTSILSNTLKERWIQIDEIIQKEKNLAKLIRKYFKHEELFNRKNWKKSVASCGLVNLFKKYNVNGSMNIPRFFKQIQGTCKHLIIAYSGMRNTEAETLMTNCLEVLHDSASGSITRLIGSTTKLHGY

SEQ ID NO: 17915 - DNA, 330 bp, Unknown
  Obtained from environmental sample
  misc_feature (1)..(330): n is a, c, g, or t
atggtaaaaatattcctgtctattatactttttgtcaatatagtattcgcagatatctatcaaacaaactgtagctcatgtcatcaaaaaattgatgtaacattagaaaaactcttttttagataccttttaaaatatagtagtgaaaaaaatgtcaaaaaatctcttatagaatatttacaaaacccaactgtagatacaactgtgatgccagaagcttttataaaaagatatggtatcaagaaaaaaacgacactcaaagatgaagagctacgaaaagctatagatatctattgggaaaaatacaaagtatttgggaaactcaaataa

SEQ ID NO: 17916 - protein, 109 aa, Unknown
  Obtained from environmental sample
  SIGNAL (1)...(17)
  misc_feature (1)..(109): Xaa is any amino acid
MVKIFLSIILFVNIVFADIYQTNCSSCHQKIDVTLEKLFFRYLLKYSSEKNVKKSLIEYLQNPTVDTTVMPEAFIKRYGIKKKTTLKDEELRKAIDIYWEKYKVFGKLK

SEQ ID NO: 17917 - DNA, 729 bp, Unknown
  Obtained from environmental sample
  misc_feature (1)..(729): n is a, c, g, or t
atgtttccaaattttaataaaaaaaatgagaaagaaactcaatcaaatgtagataaaaatttaaagatgatgagtatttcggctattgtattaatagtattatttttatatacacttacaaaagcagataatgtgatacatgggtcaagttattatgtaggggttggctttttatttatacttttaattttaacatttgcattacaaaaatataaagataaaattcgtaaaaaattagggacaagtagattttcgagtgaattggaaaaagcacaagaggaaacacctacaaatgaaaagagcaaagtaaaacaaaaagaggaagtgacatcacaaattacacctataagttctaatatcacttttaaagatgtagcagggattgagagtattaaagaggagcttgaagaggtagttgactttttgaatcatccaaaaaaatatcaaaaacataatatctctttaccaaaaggtgttttacttgtaggacctccaggtgttgggaaaaccctcattgccaaagcggttgctggtgaagctgatgttccatttttttaccatagtgcagctagttttgttcatatctatngtggtatgggagcaaaaagagttcgagaactttttattgcagcaaaagcaaaagcaccttctaatatatttatagatgagattgatgctgttgggaaaagtaaaggatgggaagtaatgatgaaagaaaagctactttaa

SEQ ID NO: 17918 - protein, 242 aa, Unknown
  Obtained from environmental sample
  DOMAIN (158)...(242): ATPase family associated with various cellular activities (AAA)
  misc_feature (1)..(242): Xaa is any amino acid
MFPNFNKKNEKETQSNVDKNLKMMSISAIVLIVLFLYTLTKADNVIHGSSYYVGVGFLFILLILTFALQKYKDKIRKKLGTSRFSSELEKAQEETPTNEKSKVKQKEEVTSQITPISSNITFKDVAGIESIKEELEEVVDFLNHPKKYQKHNISLPKGVLLVGPPGVGKTLIAKAVAGEADVPFFYHSAASFVHIYXGMGAKRVRELFIAAKAKAPSNIFIDEIDAVGKSKGWEVMMKEKLL

SEQ ID NO: 17919 - DNA, 768 bp, Unknown
  Obtained from environmental sample
  misc_feature (1)..(768): n is a, c, g, or t
atggatgttagtccaaataatattgatgatagtaaaattttttcaaaaagacttttcagaatgaaaaatagatatagtgatataaatgaagttcatgttgatggagcatatcctagtgataaaaatgatgaaattttatcatttttaggaatttctttaattccaacagcagttagaggtagaaaagcaactattacaatagaaataaatctaacaaaagttggagattataaagtaaaatgtccaacacaagaggtaatcgcgacccaaggtaaaaaaagatttaaggcattatttaattatgatacatgtaataattgtcctttcaataagatatgtaagttacataatactaaaaaggggaaagctctttatttttcaaaaaaccaggcgaaagcaaatgtaagaaataggataattaatactctaccaaaagaacaaagaacattaagagcaaatgttgaggcaacagtaaagagttttagaaaaaatttaaatgataaaggaaaacttaaaaccaaaggaaaatttaaaacccttttatatgcatttagtatggctatttcaattaatttcaaaagaattattaagtataaatttgatggacatagtaatgcttcgcttaaaaatcaaaaattaaaagaaaaactagctgtttttaagctatttttatactattggaggcatttctttttactttttattgaaaatattcgagtaataaggcttataaaaaaacagaatattgctttgataatttataaataa

SEQ ID NO: 17920 - protein, 255 aa, Unknown
  Obtained from environmental sample
  misc_feature (1)..(255): Xaa is any amino acid
MDVSPNNIDDSKIFSKRLFRMKNRYSDINEVHVDGAYPSDKNDEILSFLGISLIPTAVRGRKATITIEINLTKVGDYKVKCPTQEVIATQGKKRFKALFNYDTCNNCPFNKICKLHNTKKGKALYFSKNQAKANVRNRIINTLPKEQRTLRANVEATVKSFRKNLNDKGKLKTKGKFKTLLYAFSMAISINFKRIIKYKFDGHSNASLKNQKLKEKLAVFKLFLYYWRHFFLLFIENIRVIRLIKKQNIALIIYK

SEQ ID NO: 17921 - DNA, 963 bp, Unknown
  Obtained from environmental sample
  misc_feature (1)..(963): n is a, c, g, or t
atgtatttagtgaggaggcattttatattttatcttgataagttggaaaagatttaccagcaccaattacagaatatatatcctcgcaaaatgaaacaagaaccgaaaacagttgtagnaactataaaagaaaaagtggtagaaactgtacnagatgaggaaactggtgagtctaaagaggtactaaaaatggtacctaaaaaagtttcaacagaggtagagtatgtatatactaaattactagaagtaataggtgcagatgaatcacttttagaaaaactagagtcaatgttagacaaaaaagatacttatagcttgattattggtgaagattgtatcacacatccaaatagtcaaaatattgcaaaattggctgcaatggtagaaaaatatactgactttaaagtattagttgttccaactcaaacaaatactctgggtgttagtttattatgtgatttagatgtgatagcaacagggaaaactgttgggtacaatatgaaagctgatttccaattaagtgctttgggtgatggagatattgatatgcctgtaatatcacaacaagagggaacatttgtaaatatgaataaaacagtagttcctacaaatgctgcgatatcttatgaaggatatactttaaataatatagcaaatgaaatacttgataataaagtaaaagatactatagattacacagcaatgatttttaataaaattgcatttgattgtttagaaaattattatagcaatgatagaattgaacatagaggttatattttagaaacacaagaagttacaactttagatgaaagtgtaaaaaataagtttaaaacaataaattgtgaagaaaatgagtatattgtttacaatgctaatccaataaatcaatttaatgagtttacagcagtatcaaatcaactaaaagatgatatagttgctttatatttatcagaaagttaa

SEQ ID NO: 17922 - protein, 320 aa, Unknown
  Obtained from environmental sample
  misc_feature (1)..(320): Xaa is any amino acid
MYLVRRHFIFYLDKLEKIYQHQLQNIYPRKMKQEPKTVVXTIKEKVVETVXDEETGESKEVLKMVPKKVSTEVEYVYTKLLEVIGADESLLEKLESMLDKKDTYSLIIGEDCITHPNSQNIAKLAAMVEKYTDFKVLVVPTQTNTLGVSLLCDLDVIATGKTVGYNMKADFQLSALGDGDIDMPVISQQEGTFVNMNKTVVPTNAAISYEGYTLNNIANEILDNKVKDTIDYTAMIFNKIAFDCLENYYSNDRIEHRGYILETQEVTTLDESVKNKFKTINCEENEYIVYNANPINQFNEFTAVSNQLKDDIVALYLSES

SEQ ID NO: 17923 - DNA, 780 bp, Unknown
  Obtained from environmental sample
  misc_feature (1)..(780): n is a, c, g, or t
atgaaggcttttcgggaaggtaacccaaaagtagcccgaatggttccccgttttgcaacccgatgggttgagaaaatcatttgtcaggatcagatgaacactataattaataaatatattgattatgttggagttgattttcaacccaaagttatcgacgaattcaatctgaaaatcgacgtacaaggattagggaatcttcctgaatcgtcacgcggtttttttgcttcaaatcatccttatggtattctcgatggcttaataatcacttatttcgtaggtcaaaaatatggtgatttaaaagcaattggaaatgatgcctttttattaatcccaagcctaaaaccccttattgcggcggttaatgtttacggacgaagttcaaaggagtatgttgccgagttagataaagtgtataaatcggatgttgcaattacacactttccggcaggggaagtttctcgagtttataatggaaaaatacaagatgctccttggcaaaaaagctttattacaaaggcagttcatagtaagcgcgatgttattcctttttattttcatggacaaaattccgctttgttttataatatattccgtttccggaactgtcttggtattaaaacaaatctagaattagtgcttttgcctcgagaattgtttaagaaaaaggaaggcgaaatttgtcttgtaataggaaaacctattccttggcaaacttttgataagcgaatgtcgcactacgattgggctcaaaagtgcgcgagtatgtctattctctga

SEQ ID NO: 17924 - protein, 259 aa, Unknown
  Obtained from environmental sample
  misc_feature (1)..(259): Xaa is any amino acid
MKAFREGNPKVARMVPRFATRWVEKIICQDQMNTIINKYIDYVGVDFQPKVIDEFNLKIDVQGLGNLPESSRGFFASNHPYGILDGLIITYFVGQKYGDLKAIGNDAFLLIPSLKPLIAAVNVYGRSSKEYVAELDKVYKSDVAITHFPAGEVSRVYNGKIQDAPWQKSFITKAVHSKRDVIPFYFHGQNSALFYNIFRFRNCLGIKTNLELVLLPRELFKKKEGEICLVIGKPIPWQTFDKRMSHYDWAQKCASMSIL

SEQ ID NO: 17925 - DNA, 456 bp, Unknown
  Obtained from environmental sample
  misc_feature (1)..(456): n is a, c, g, or t
atgaaatttaccatatcgaaaagtatcattgaaaatataatatcttcaatgcaaccatttctaaataaaaaagattctagttctattacatctcatatatatctagaaatattaaatgcaaatttaattataaaatctacagattatgagatgggttgtgaagcaattgtatctgatataaaaaatatcatagatggaaaagctacaattaatggtggaaattttttaaatattataagaagattaaaagatgaagatattgattttgaagtatcagggaataatttaaatattaaacaaaaaagatctaattttaaacttcctatgtatgatgcaaatgaatatccatcttttccaaagttagaaaatttacattcattagaaataaatacaattaatttaataaatagtattaaaaaaataacaccttcaatagaaacaatacctnagccataa

SEQ ID NO: 17926 - protein, 151 aa, Unknown
  Obtained from environmental sample
  DOMAIN (1)...(119): DNA polymerase III beta subunit, N-terminal domain
  misc_feature (1)..(151): Xaa is any amino acid
MKFTISKSIIENIISSMQPFLNKKDSSSITSHIYLEILNANLIIKSTDYEMGCEAIVSDIKNIIDGKATINGGNFLNIIRRLKDEDIDFEVSGNNLNIKQKRSNFKLPMYDANEYPSFPKLENLHSLEINTINLINSIKKITPSIETIPXP

SEQ ID NO: 17927 - DNA, 477 bp, Unknown
  Obtained from environmental sample
  misc_feature (1)..(477): n is a, c, g, or t
ttgactacaaaagagatattatcacaactacaagaagaagtatcaaaaaatgattttgaaagatacttgaagcagcttacatataaaaaatcaagctctagtgatgagatagctgtttttgaagtaaataataaatttattgcaaattatataaaaacaaaattttcatctataattcaagatgtctttgaaaaaaacaaaaatactaaaccttcgattgaaataaaaattgcaggtgagagacgaagaactacaaaagagattttaaacaaaaaaattactaatgatactagtgaaagtacaattttaaatcaatcttatacatttgaatcttttgtagttggaaaatcaaataagatggcttacaccgcatctaaagcagttgctgataaaccaggtgtgcaatacaatccattatttttatatgggtggaactggtcttggaaaaactcatctacttccagctattggaaatga

SEQ ID NO: 17928 - protein, 158 aa, Unknown
  Obtained from environmental sample
  misc_feature (1)..(158): Xaa is any amino acid
MTTKEILSQLQEEVSKNDFERYLKQLTYKKSSSSDEIAVFEVNNKFIANYIKTKFSSIIQDVFEKNKNTKPSIEIKIAGERRRTTKEILNKKITNDTSESTILNQSYTFESFVVGKSNKMAYTASKAVADKPGVQYNPLFLYGWNWSWKNSSTSSYWK

SEQ ID NO: 17929 - DNA, 816 bp, Unknown
  Obtained from environmental sample
  misc_feature (1)..(816): n is a, c, g, or t
ttgattcattcaatattaattacttcagtagcaacttatggatgggattctgcttttggtataaaggtttttatatcagaaataatgggtgtatatcgtgatattaaaactcagctaacgttggaggtgagtatggaagaaagaataaaagaatatcgcaaagggctttataaaaaagcgttgacggttttctttactgatttattaatggtgttgatatgtgtctctataaaggcttctttaacagcaactattgattatgtgatttatactacattaattgctttaagtcctgttctcattgaggatattactaataaagcattaagtgataaagataagttaaatattcaatattttatggtgtttgttttagcatttgctactataggagctttatcagttggatattttagtacagattggacagtttttataacaagtttaattgttgcaggtgtttttttagctattacattttttttagcacatttttcttatgttccttctttaagatccaaagaagaagtaatgcaagatttaatgaaaagaaaatggaaagtttatgaaaaaatggaagatgatgaaatcattgaagatatgattaataccataaaacattattttaaaaaagatttatggggtgccgatttaaatctcggaaatcctatgtttttggatgataaaggtattccccaaactactaagggtgcttcctttgctcgtggtaataacacacctatagataatatggtcccttactttaaaaagattatagcatctaaagataatgtcgctgtagaaaagaagaggtaa

SEQ ID NO: 17930 - protein, 271 aa, Unknown
  Obtained from environmental sample
  misc_feature (1)..(271): Xaa is any amino acid
MIHSILITSVATYGWDSAFGIKVFISEIMGVYRDIKTQLTLEVSMEERIKEYRKGLYKKALTVFFTDLLMVLICVSIKASLTATIDYVIYTTLIALSPVLIEDITNKALSDKDKLNIQYFMVFVLAFATIGALSVGYFSTDWTVFITSLIVAGVFLAITFFLAHFSYVPSLRSKEEVMQDLMKRKWKVYEKMEDDEIIEDMINTIKHYFKKDLWGADLNLGNPMFLDDKGIPQTTKGASFARGNNTPIDNMVPYFKKIIASKDNVAVEKKR

SEQ ID NO: 17931 - DNA, 729 bp, Unknown
  Obtained from environmental sample
  misc_feature (1)..(729): n is a, c, g, or t
atgaacggcagaaaatgtgttgtagtagattttgatatcggacagagaaatctggacatgattttaggtttggagaatcgtgttgtatatgatgttgttcaagtcatggatgaggaaatttcactaaagcaagctctaattaaaagtaaaatggatgacaaccttcacttcttagcagcttcacaaacaaaagataagactgttttagactctcttaaaatcaaaaaattggtagctactcttaaagagcagtttgagtatgttattttagatgctcctgcaggtattgagagtggttatgagcatacaatcgaatttgctgacagtgccataatcgtagttaatcctgaggtttcatccattcgtgatgctgatcgtgctatcggcatattagactcaaaatcacaaaaagtaaaagatggcggtgaagtagataaatatctgattattaaccgtataaatcctgatatggttcaaagcggtgagatgttaaacagtagtgatattttagaaattttaggaattaaacttcttggtaaaatacctgaagacaaaggtgtaatagatgcgtcaaatcaaggtaaaccgattatcttgaatttaaaatctgatgcaggacaagcatataaacgtatatctgcacgtctttgcggagagagtgttgagcttaaagatgtagagagtaaagagggcggaatcttgaaaaaactaacgggaatcttcaagtaa

SEQ ID NO: 17932 - protein, 242 aa, Unknown
  Obtained from environmental sample
  DOMAIN (48)...(189): CobQ/CobB/MinD/ParA nucleotide binding domain
  misc_feature (1)..(242): Xaa is any amino acid
MNGRKCVVVDFDIGQRNLDMILGLENRVVYDVVQVMDEEISLKQALIKSKMDDNLHFLAASQTKDKTVLDSLKIKKLVATLKEQFEYVILDAPAGIESGYEHTIEFADSAIIVVNPEVSSIRDADRAIGILDSKSQKVKDGGEVDKYLIINRINPDMVQSGEMLNSSDILEILGIKLLGKIPEDKGVIDASNQGKPIILNLKSDAGQAYKRISARLCGESVELKDVESKEGGILKKLTGIFK

SEQ ID NO: 17933 - DNA, 492 bp, Unknown
  Obtained from environmental sample
  misc_feature (1)..(492): n is a, c, g, or t
ttgtttcataaacaaaaatatttttcagtgaaaaagtatcttatatattcgatgatcacatttcttgcagctgtcatcgtaatagtcgtaattaaatttgttccttttaataaaccgactgctggcgaattcgaaatttcaagtgttgaaataggaactgtaatgtcaactctccctgctgaaggtacggtggagccagaaagcgaagtgattattttaagtcctgcgtcgagtataattaaacgtatcgttaaggatgtgggaagtactgtaaatgccggtgaagcaataatcattatggatcctactcctattcaggagcaaattgaaaagctagaggatcagttggaagtgaagaagaattcactgagaaagaaccaactgaatgcaagaagtatccgtgtcgatcttgattataatgtagaagttcgaaaactgagaattgcttctataaagtcagaacttgccgatcaggaacattactttgagtag

SEQ ID NO: 17934 - protein, 163 aa, Unknown
  Obtained from environmental sample
  misc_feature (1)..(163): Xaa is any amino acid
MFHKQKYFSVKKYLIYSMITFLAAVIVIVVIKFVPFNKPTAGEFEISSVEIGTVMSTLPAEGTVEPESEVIILSPASSIIKRIVKDVGSTVNAGEAIIIMDPTPIQEQIEKLEDQLEVKKNSLRKNQLNARSIRVDLDYNVEVRKLRIASIKSELADQEHYFE

SEQ ID NO: 17935 - DNA, 891 bp, Unknown
  Obtained from environmental sample
  misc_feature (1)..(891): n is a, c, g, or t
atgctgcaacaaacacaagttaatagagtggaaagcgagtattatccaaagtttttagaaaagtttccaactctaaaaaaactttcaaatgcacctttggatgaagttttgtcttcctggagtggacttgggtattattcaagggctagaaatctccataaaacagctcaaatttgccaaaacaaactaccagatagtatgggagaacttcaaaagcttcctgggattggaaaatataccgcaagtgcaatttgtagttttggatatcatcaagaggtatctgtagtagatacaaatattgctcgtgtattaaaacgatattttgctactttagatgtttcagatatagaagtttgggaaagtgcgaataaatttttgaatacaaaagaaccaacaaaacacaaccttgcccttatggatttaggttcaatagtttgtactcctacaaatcctttatgtgagaattgtcctttatctataagttgtttagggaaagaaaatccagaactgtacacacaaaaaaagaaaaaagcgtatgagtcattagaattattttacggcatctatggaaaagaagataagatagcccttgttaaaacaacaggaaaaatgtataaaggaatgttagagttacctactgttgatcctatagaggaaaattttattggacagtttaaacatagttatacaaaataccgattaagtgtaaagctttataaaatagataatttaagtgatggaagtatttggattgatttagataaaattgattccacaactatctcatcattgaacaaaaagggcgttgaaaaattttttattgtaaagagaattgaaaaggaaacaactcctttgaaaaaggcctggttaaatttcggacctaaatggaaa

SEQ ID NO: 17936 - protein, 297 aa, Unknown
  Obtained from environmental sample
  DOMAIN (58)...(87): Helix-hairpin-helix motif
  misc_feature (1)..(297): Xaa is any amino acid
MLQQTQVNRVESEYYPKFLEKFPTLKKLSNAPLDEVLSSWSGLGYYSRARNLHKTAQICQNKLPDSMGELQKLPGIGKYTASAICSFGYHQEVSVVDTNIARVLKRYFATLDVSDIEVWESANKFLNTKEPTKHNLALMDLGSIVCTPTNPLCENCPLSISCLGKENPELYTQKKKKAYESLELFYGIYGKEDKIALVKTTGKMYKGMLELPTVDPIEENFIGQFKHSYTKYRLSVKLYKIDNLSDGSIWIDLDKIDSTTISSLNKKGVEKFFIVKRIEKETTPLKKAWLNFGPKWK

SEQ ID NO: 17937 - DNA, 624 bp, Unknown
  Obtained from environmental sample
  misc_feature (1)..(624): n is a, c, g, or t
atgcactttttaggattagattacatcatatcatcaatagtttggttaactataatatttgctttagttntcacatttagaaaacatatagctaaattattttatcctaaaacatcacttgatctttttataagtaaactaaaacactatcttcaagaaacttatccaaaaataaaatttgatttaacaattattgaaactagtaaaattgaaaaaaatcctgatttaagaaaatatattattattggtaatattcttgatcaatacaaaaacctcacccttgatccaaataaatttcctcaatcaacaccaacatctcttagatgggatggttatgtatttaactgtgaacccaacaaagataaactgccccctgattgggcaaaaaggaaaaatgctttaataataagagaccataaaagatgtttacgatgtagtaaagttgtaactttaaatacaattgagattcacctaattcgtcctattcaagatggtggaaaatattatctagaaaatctcttatctgtttgtaaagattgtgaaaaagttttaagcaatgatcctaaaaagatggcaaacttaaatatcaaagatgatcttgatagtattgttgaaaaaacttaa

SEQ ID NO: 17938 - protein, 207 aa, Unknown
  Obtained from environmental sample
  misc_feature (1)..(207): Xaa is any amino acid
MHFLGLDYIISSIVWLTIIFALVXTFRKHIAKLFYPKTSLDLFISKLKHYLQETYPKIKFDLTIIETSKIEKNPDLRKYIIIGNILDQYKNLTLDPNKFPQSTPTSLRWDGYVFNCEPNKDKLPPDWAKRKNALIIRDHKRCLRCSKVVTLNTIEIHLIRPIQDGGKYYLENLLSVCKDCEKVLSNDPKKMANLNIKDDLDSIVEKT

SEQ ID NO: 17939 - DNA, 462 bp, Unknown
  Obtained from environmental sample
  misc_feature (1)..(462): n is a, c, g, or t
atgacaggtgctagacttacgagtgtacttactatatcaaaagcagatataaatcttaaccaaaatactattttaataaaaaatcacaagagcaatagaacttatactggatttatacatccaaagtataaaggactattagaagagcgtatgaagacacttagcccaatagattatatagtaagtggaaattcaaaagaactacatagaacaagtgtaagtaaagccttacaacccttattaaatgacttatttaatcaaggaccaaatacagatgatagaaaaagaagagtagttgtacatacacttagacatacattcgctagtttacttgcaattgatggagttcctatttatactattaaaaaattaatggatcatagtgagattgaacaaacaatgagatacgcaaagcttcaacctgatgcaggtagtgaagcggttgctaaattgaaaatttaa

SEQ ID NO: 17940 - protein, 153 aa, Unknown
  Obtained from environmental sample
  DOMAIN (1)...(146): Phage integrase family
  misc_feature (1)..(153): Xaa is any amino acid
MTGARLTSVLTISKADINLNQNTILIKNHKSNRTYTGFIHPKYKGLLEERMKTLSPIDYIVSGNSKELHRTSVSKALQPLLNDLFNQGPNTDDRKRRVVVHTLRHTFASLLAIDGVPIYTIKKLMDHSEIEQTMRYAKLQPDAGSEAVAKLKI

SEQ ID NO: 17941 - DNA, 858 bp, Unknown
  Obtained from environmental sample
  misc_feature (1)..(858): n is a, c, g, or t
gtggcctttaaccctgggtattccacagctagtaacctacaggatatttcaggaaattataaatttccctcaaaggacattgaagagaaagtgtggcaaccaaaaaactacgaaaaaaactttaagggtttagtatcgtttagatatgcactngtccatcaaagaaacttagcacaatttaatcttgttactgatattggtattgatatacttcataaagaacttttacgatatgggtttaaagatatcccttttgacctttctattacccttggaagttttggtatatctccaattgatttaagtgagcagtatacaatgttttcaaataatggtatcgtagtaactccgtatcttatctcaagtataactaatagatacaatcaaaaaatagtatttgaaccagaagaagcgtatttaacctcacctgaacaagcttatcttatgactacaatactacatgatgttgttaaaaaagggacagggagaaatgccaatgttgctaatatagatattgttggtaaaactggtacaacaaataacaatatagatgcttggttttgtggatactcaccaacactacaaacagtagtatggtatggaaatgatgataataaaccaatggggaaaagagaaacaggtggacgaacagcagcccctgcttttaaatacttttatgaaaattggctaaaactgcatcctgagatgccaagaaattttgtaaagccagaaaatgtttttatacaaaaatataatggtgaagatgaatattttacagaaacttcaaagatgccaaaagagcaaacagatatagagatacaaacagattatctaaaaaataaaaatgttattttttag

SEQ ID NO: 17942 - protein, 285 aa, Unknown
  Obtained from environmental sample
  DOMAIN (1)...(227): Penicillin binding protein transpeptidase domain
  misc_feature (1)..(285): Xaa is any amino acid
MAFNPGYSTASNLQDISGNYKFPSKDIEEKVWQPKNYEKNFKGLVSFRYALVHQRNLAQFNLVTDIGIDILHKELLRYGFKDIPFDLSITLGSFGISPIDLSEQYTMFSNNGIVVTPYLISSITNRYNQKIVFEPEEAYLTSPEQAYLMTTILHDVVKKGTGRNANVANIDIVGKTGTTNNNIDAWFCGYSPTLQTVVWYGNDDNKPMGKRETGGRTAAPAFKYFYENWLKLHPEMPRNFVKPENVFIQKYNGEDEYFTETSKMPKEQTDIEIQTDYLKNKNVIF

SEQ ID NO: 17943 - DNA, 801 bp, Unknown
  Obtained from environmental sample
  misc_feature (1)..(801): n is a, c, g, or t
gtgattttcattaaatttaaatatatagatctaaaatacaaaccaaaaagttctgacttagtctgtgaatattacatggaacctgggacaaaaataagttttgaagctgcagcaaacgcttgtgctttggaatcatcaataggtacttggactgaaatttctacattaagtcctagacttgctaaaaaattaaaaccttcggtttattacttaaataaaaaaactaatataataaaaattgcatatcatgatggattattcgaagcaggaaatatgcccgggatattatctagtatagctggaaatgtttttggaatgaaaatggtttcaaacttaaaattattagatatacattttccaaaatctatagttaaagaatatagaggcccacaatttgggattgcaggaataagaaaaattactggagttaaaactagaccgtttgttggaacaatagtaaaaccaaaagtaggattaaatgaaaaagaacacgcaaaagttgcatatgacggatggcttggcggtttagatattgtaaaagatgacgaaaatttagtttctttaaaatttaataatttctataaacgaatggatgaaacattcaaattaagagatatggctgaaaaattaaccggagaaaaaaaaatatatttggctaatataactgcgcctttatctgaaatgaaaaaaagagctgactatgtaaaaaagaaaggtggagaatatgtcatggtcgatattcttactgcaggctttgcagctttacaggatataagagacccactccaaaatttaggatag

SEQ ID NO: 17944 - protein, 266 aa, Unknown
  Obtained from environmental sample
  DOMAIN (5)...(125): Ribulose bisphosphate carboxylase large chain, N-terminal domain
  misc_feature (1)..(266): Xaa is any amino acid
MIFIKFKYIDLKYKPKSSDLVCEYYMEPGTKISFEAAANACALESSIGTWTEISTLSPRLAKKLKPSVYYLNKKTNIIKIAYHDGLFEAGNMPGILSSIAGNVFGMKMVSNLKLLDIHFPKSIVKEYRGPQFGIAGIRKITGVKTRPFVGTIVKPKVGLNEKEHAKVAYDGWLGGLDIVKDDENLVSLKFNNFYKRMDETFKLRDMAEKLTGEKKIYLANITAPLSEMKKRADYVKKKGGEYVMVDILTAGFAALQDIRDPLQNLG

SEQ ID NO: 17945 - DNA, 327 bp, Unknown
  Obtained from environmental sample
  misc_feature (1)..(327): n is a, c, g, or t
atgaaaaaaattgttattataggtttgttgattacatcgtcaatattcttacattactataatcatcacattataattaatacttccagaagttgcgcaaaattagaaaattctagaaaagttaaagaacaggttaagaacgcccttttaacccataacagtaatttaagctctcgcagtagaatcaagaaactagccaccgagaaactgaacatgttagattgcaccccaaacgaagtgattaatatcgtcagaaacaagaaagacaatactttctgcctagttgactacttcgttccttccgttgaagcaatgactaccaactag

SEQ ID NO: 17946 - protein, 108 aa, Unknown
  Obtained from environmental sample
  misc_feature (1)..(108): Xaa is any amino acid
MKKIVIIGLLITSSIFLHYYNHHIIINTSRSCAKLENSRKVKEQVKNALLTHNSNLSSRSRIKKLATEKLNMLDCTPNEVINIVRNKKDNTFCLVDYFVPSVEAMTTN

SEQ ID NO: 17947 - DNA, 387 bp, Unknown
  Obtained from environmental sample
  misc_feature (1)..(387): n is a, c, g, or t
atgtcaaaaaaatatgcctcaatagatattggtcttaaaagaatagggtgtgccgtatctttaatgtcaaatattgtaaatccacaagaggcaatattacgaaaaaatagagagcaagcaagccatgatgttgataaatttttaaaagattggcgaattgatatactagtagttggatatccagaatctagtgaagatatgaaacctagagttgaacattttgtaaagcttttaaagtttagtggagagatagtatttcaaaatgaaaatttaagttcacaagaagcaaaagaattaacaaaaggtgaaataaaacataaaagagatggacgaatcgactccatagctgcaaaaattatacttgaaagatatttggcttcaaaatga

SEQ ID NO: 17948 - protein, 128 aa, Unknown
  Obtained from environmental sample
  DOMAIN (3)...(127): Uncharacterised protein family (UPF0081)
  misc_feature (1)..(128): Xaa is any amino acid
MSKKYASIDIGLKRIGCAVSLMSNIVNPQEAILRKNREQASHDVDKFLKDWRIDILVVGYPESSEDMKPRVEHFVKLLKFSGEIVFQNENLSSQEAKELTKGEIKHKRDGRIDSIAAKIILERYLASK

SEQ ID NO: 17949 - DNA, 351 bp, Unknown
  Obtained from environmental sample
  misc_feature (1)..(351): n is a, c, g, or t
ttgtctttatttaaagcagctttaatccctaaatataaagataagagaaatatagcaaccatactaataacattaatagtaagtgttattgggattcgattgagtatttcatcctttacattcataccactactaaaagagataccaaaatctaacattgttatgtttacaatccaagagaaaaactgtacatataaaggcttatccagtccatatatctctttaagatgtactatagactcttctgtaatattaggatttaaatctcctgatgcaaagaaactattaggtgctaagtttatagncataaatgagataagagagataataaaaagcctcactataatgtaa

SEQ ID NO: 17950 - protein, 116 aa, Unknown
  Obtained from environmental sample
  misc_feature (1)..(116): Xaa is any amino acid
MSLFKAALIPKYKDKRNIATILITLIVSVIGIRLSISSFTFIPLLKEIPKSNIVMFTIQEKNCTYKGLSSPYISLRCTIDSSVILGFKSPDAKKLLGAKFIXINEIREIIKSLTIM

SEQ ID NO: 17951 - DNA, 309 bp, Unknown
  Obtained from environmental sample
  misc_feature (1)..(309): n is a, c, g, or t
atgaaaaaagcactcaaaatcacaggaataaccttattagttttattggttttaattatttcgttgccttttatgtttaaaggtaaaataatagatatagttaaagaacaagccaatgctaacctgaatgcaaaagtagattttggagagtttgatttgggcttaattagtacctttcctaattttaatttttctatcgataatgttactgttgatggagtagataaatttgaaggaacgcagttggcaaatattaaaaatctatccttaaaagtagatttaatgagtgtaattagtggcgataaataa

SEQ ID NO: 17952 - protein, 102 aa, Unknown
  Obtained from environmental sample
  misc_feature (1)..(102): Xaa is any amino acid
MKKALKITGITLLVLLVLIISLPFMFKGKIIDIVKEQANANLNAKVDFGEFDLGLISTFPNFNFSIDNVTVDGVDKFEGTQLANIKNLSLKVDLMSVISGDK

SEQ ID NO: 17953 - DNA, 429 bp, Unknown
  Obtained from environmental sample
  misc_feature (1)..(429): n is a, c, g, or t
atggggatagattgtaaaagaaaaggtggtcatagtttttttgattcacgagagataaaagtgatactagatcttatggttttaatggtgaaacaaaatgatatgatggcatttatccatatagttgagtatggaaaaaatataggaaaagcaatagccaaagatatatttgaagcacttttacgaatagggcatggaaatatttttcatggacttttaaatcctgataacactattattaaaccctataaaagtaataaaacaaccaatgtacaacttggactttttgatgattttatagagatgggaagtactgcaaaatttaaagatttaggctgggaaacaaagtttttaaataactcaattttgaaacatccaaaactcactttagagggtgggatattttatatgtctagcataatccnataa

SEQ ID NO: 17954 - protein, 142 aa, Unknown
  Obtained from environmental sample
  misc_feature (1)..(142): Xaa is any amino acid
MGIDCKRKGGHSFFDSREIKVILDLMVLMVKQNDMMAFIHIVEYGKNIGKAIAKDIFEALLRIGHGNIFHGLLNPDNTIIKPYKSNKTTNVQLGLFDDFIEMGSTAKFKDLGWETKFLNNSILKHPKLTLEGGIFYMSSIIX

SEQ ID NO: 17955 - DNA, 918 bp, Unknown
  Obtained from environmental sample
  misc_feature (1)..(918): n is a, c, g, or t
atggctggactctatattgttgcatcctatagcctctataaagtggaaggagatacgatttctcaaacctatcctgatggaagctctaaaagtaacgctattcatacagttggcgtcattgaggaaatacacaaattcacccaacgttttaaagtggatactaaagaagactttaagtttataaataatggcatatttggttacaccgcatatgatgcagtaaaacattttgaagatatagagatttcaaaaaaggagaactctattactattcccgaaatatattacgctgtttatcaaaatatcattgccatagatcatcaaaaaaatgaagcttatatttttgcgcattgtttccatagcgagaataatatagacgaagtattacaattaattcaaaccagacaatatgcttcgtacaattttaaacctaaaggagagattgaatctaaccttacggatgacgactataaagcccatgtagagctcgctaaaaaacattgtggcagaggagatgtttttcaattggtattgtctaaacggttttctcaagaatttagtggagacgagtttaatgtttacagagctttaagaagtattaacccatccccttacctcttttatttcgattacggtaattttaaaattttcggtagttcgcctgaagctcagttagttgttagtgataataaagcagaaattcatccaattgccgggacttttaaacgaagtgggaacgatttaaaagatgccgaattagcagaggaattaattaaagataaaaaagaaaatagcgaacatgttatgctggtagatttagccagaaatgacctcagcagacatggtagtaacgttaaaggtgaaaattacagagaggntcagttcttctctcatgtgaatcatctgggaagtaaagta

SEQ ID NO: 17956 - protein, 306 aa, Unknown
  Obtained from environmental sample
  DOMAIN (5)...(114): Anthranilate synthase component I, N terminal region
  misc_feature (1)..(306): Xaa is any amino acid
MAGLYIVASYSLYKVEGDTISQTYPDGSSKSNAIHTVGVIEEIHKFTQRFKVDTKEDFKFINNGIFGYTAYDAVKHFEDIEISKKENSITIPEIYYAVYQNIIAIDHQKNEAYIFAHCFHSENNIDEVLQLIQTRQYASYNFKPKGEIESNLTDDDYKAHVELAKKHCGRGDVFQLVLSKRFSQEFSGDEFNVYRALRSINPSPYLFYFDYGNFKIFGSSPEAQLVVSDNKAEIHPIAGTFKRSGNDLKDAELAEELIKDKKENSEHVMLVDLARNDLSRHGSNVKGENYREXQFFSHVNHLGSKV

SEQ ID NO: 17957 - DNA, 837 bp, Unknown
  Obtained from environmental sample
  misc_feature (1)..(837): n is a, c, g, or t
gtggatttacaggagacttttaagcaggtgatttcggttggggattcgaaaactttgaatttatcgatggagattttgccaaagggaccaagagtgcttactttcagaaatcagatctactacgaaaaatttcccttggcacctttgttacgaagaattctagagattggtgagatggcaattggagtacctgtagagatagaatatgccgtctgtcttaagaagagtgaatccaatcctaacccctctttttcattgctccagatcaggccgctatcggtgaataaagagaagatagatataaagttaaatgaaattaacagtgaggatattctactatatacccaaagaggaatcggtaatggaaaaatttctcacatcaaagatatagtttatattgatcctgacgaatttgataacaccaaaacaatggaaatggttttagaaatagaaaaaatgaatgagaaattgaaatcttctaaccgtaaatatttgttaataggaccaggaaggtggggatcaagtgacagatttttaggagttcccgttcgttgggcacagatcaattgcgctaagattatagtggagacaagtttagaaaaattcagtgttgaagcctcacaaggaagtcatttcttccataatattattgctatggaagtgggatatttgacagttaatcataatagtgaatccgggaaactggattgggaatggttaaaaaaacagaaaatagaagagaaactgaagtatacattccacattaagttagagcaagaattaagtgtgaaaattgatggcaggtcaggaaattcagtgatatataagaacggataa

SEQ ID NO: 17958 - protein, 278 aa, Unknown
  Obtained from environmental sample
  misc_feature (1)..(278): Xaa is any amino acid
MDLQETFKQVISVGDSKTLNLSMEILPKGPRVLTFRNQIYYEKFPLAPLLRRILEIGEMAIGVPVEIEYAVCLKKSESNPNPSFSLLQIRPLSVNKEKIDIKLNEINSEDILLYTQRGIGNGKISHIKDIVYIDPDEFDNTKTMEMVLEIEKMNEKLKSSNRKYLLIGPGRWGSSDRFLGVPVRWAQINCAKIIVETSLEKFSVEASQGSHFFHNIIAMEVGYLTVNHNSESGKLDWEWLKKQKIEEKLKYTFHIKLEQELSVKIDGRSGNSVIYKNG

SEQ ID NO: 17959 - DNA, 918 bp, Unknown
  Obtained from environmental sample
  misc_feature (1)..(918): n is a, c, g, or t
gtggttatcggaactggaatttttagcgaattcaaggcgagtttttctgatttttttggctcaaaatctgctgcatttcagtcaaaattagctaaaataaaatcaactgctttacaagagttaaaagagaaagcaataaaactaaatggtgatgctatcataagtattgatttggattatataaattttacacaaaatataatcgggttaatagtaaacggaactgttgtctcattagtaaaaaatatcaatgattataatataattgaaactaaagatgagttaaatgaagtagatattaactgtcctatttacataaagtctaaaattataagaaaacaaatagtaaaagaaaaaatcgaaaatttattcgtttcatttaggcttctaaatccaaaaaatttaagtataaatgcagttaaatttaaagtaaaattatttaatttttttaacgaaacaatagatttctcaaaccaatcaaaaattattacaaatctaaaacagcaagaagaacaaataatacaattaaatattgaagaatgtcaatacgatcttatttctcatatcgaagtattaatagaaaaaatttcactacttaatcaaaatgattggatttcaaaaggtcattttgcaaaatctaatatctctagtaatgatatttatgtatatcanaattattttggtattgatactatttgttatccaacaaaaaatgagatagaatggacttgtgtatgtggcaatgttaataacttagagagcgatgaatgttccaattgttatagaaaaaaacatgaagtgttaatatcaaaagagcaaattttggaagaaaagtcagactttattactaataaagaaatcccattagtaaataaaaagatttgggaacagaaagagaaaatgcacgccatgttttaa

SEQ ID NO: 17960 - protein, 305 aa, Unknown
  Obtained from environmental sample
  DOMAIN (1)...(80): Domain of unknown function DUF74
  misc_feature (1)..(305): Xaa is any amino acid
MVIGTGIFSEFKASFSDFFGSKSAAFQSKLAKIKSTALQELKEKAIKLNGDAIISIDLDYINFTQNIIGLIVNGTVVSLVKNINDYNIIETKDELNEVDINCPIYIKSKIIRKQIVKEKIENLFVSFRLLNPKNLSINAVKFKVKLFNFFNETIDFSNQSKIITNLKQQEEQIIQLNIEECQYDLISHIEVLIEKISLLNQNDWISKGHFAKSNISSNDIYVYXNYFGIDTICYPTKNEIEWTCVCGNVNNLESDECSNCYRKKHEVLISKEQILEEKSDFITNKEIPLVNKKIWEQKEKMHAMF

SEQ ID NO: 17961 - DNA, 507 bp, Unknown
  Obtained from environmental sample
  misc_feature (1)..(507): n is a, c, g, or t
atgcaagatttattttgcgatataactgcaaaagccagaacgcatgaagcgttaattaaaaagctcaaagaatctggaactctaaatttttttcttttaaacatcgacaacttttcaaatatcaacaatgcttatggatatgaagttgggactgccgtcttatatgaatttgtaaagtacctagaaattgctaagcctgagacttcattgatgtatagttgctattcagacaagtttgtcttaatagacgagagagaactcgatgatactgagttactctctatcgcagaagcgatcctttcattcttctctcaagtggagtttgtagtccaagatattgaaatgagaatttcactcagtattggaatctctaaagacagcggtctgataaatatatctaaggctgaaacagctatagaagagctgagaaaagcaaaacgaaatcactgtcttatctttaatgaaaactctgagtttgtcaaaatcaaaaactcgagccgattctga

SEQ ID NO: 17962 - protein, 168 aa, Unknown
  Obtained from environmental sample
  DOMAIN (14)...(149): GGDEF domain
  misc_feature (1)..(168): Xaa is any amino acid
MQDLFCDITAKARTHEALIKKLKESGTLNFFLLNIDNFSNINNAYGYEVGTAVLYEFVKYLEIAKPETSLMYSCYSDKFVLIDERELDDTELLSIAEAILSFFSQVEFVVQDIEMRISLSIGISKDSGLINISKAETAIEELRKAKRNHCLIFNENSEFVKIKNSSRF

SEQ ID NO: 17963 - DNA, 756 bp, Unknown
  Obtained from environmental sample
  misc_feature (1)..(756): n is a, c, g, or t
gtgcaaaaccatattgagatggatcattcgggatcgcttccttatttaatggaaaaatgtcccaaagcaaaagtgtttgcttcaccaaaaggtatagaaggtttgcaaaaacattttaggaaagaatgggattataatattgtgaaatctggtgatacactgaatctgggtaagcgaaatcttaattttgtacaaacacccatggtgcattggccggataatatggtaagctactgtccagaggaaaagctattgttttctaacgatgcatttggacagcatatagcttcttctgagcgatttgatgatgagtatcctcttagtaccatgcttcatgaagctgccaaatattatgcaaatatcgttcttccatacagtagccaggtacagaaagcccttgaagttgttggaacattagatgtggatacgatctgtccgagtcacggtttgatcatgcgaaaatacattcctgaaattttggaaaaatataagaaatggtcagcaaacgtgattgataacaaagctttgatcatctacgatacaatgtggagatcgacagaaaaaattgcacacactattcaggaagcgtttgaggtgaaagattaccaaactcggatgttcaacctgcaaaacacgcatgtatctgatattatgacggaaatcctgactgcgaaatatatctgtgtaggttcgccaactttgaataataatattcttccaactgttgctgccttccttacttatctaaaaagatag

SEQ ID NO: 17964 - protein, 251 aa, Unknown
  Obtained from environmental sample
  misc_feature (1)..(251): Xaa is any amino acid
MQNHIEMDHSGSLPYLMEKCPKAKVFASPKGIEGLQKHFRKEWDYNIVKSGDTLNLGKRNLNFVQTPMVHWPDNMVSYCPEEKLLFSNDAFGQHIASSERFDDEYPLSTMLHEAAKYYANIVLPYSSQVQKALEVVGTLDVDTICPSHGLIMRKYIPEILEKYKKWSANVIDNKALIIYDTMWRSTEKIAHTIQEAFEVKDYQTRMFNLQNTHVSDIMTEILTAKYICVGSPTLNNNILPTVAAFLTYLKR

SEQ ID NO: 17965 - DNA, 855 bp, Unknown
  Obtained from environmental sample
  misc_feature (1)..(855): n is a, c, g, or t
atgaccaccgaacaaatgactgcaatagcacaacctgcaaacagcctcctcgtttacaacacaaccgacagtgtttttaattattacgacgaaaattctgacagttggaatatccttggaggtataaaaactgaaattccttggctttcagaaggaggatttacttttcttggaaatatagatgacaatgtaggaattggaattgtcaaagctcaaactaaattgcatatttttgcagtaacagaagattttatcactgaactaccccctcctacaattcgcattgaaaacacagacaaagacaatgaaaattattacgcttgggatattcaaaataaaaaagaaaatctatattttaattttggaacagacatagagcctgttacaaaaaccgaaacaaaatttatttttactgacgaaaaacattttggtattggaactgataaaccaatggcaaatttacacataaataattacaacattaaagcccccagtagtagttcaaatattattcttgaatcatataaaaaagaacctatatatttcgaaattgcaaatagcaatgggcaaataaatttcaattatacaacagaagggaaaaaactttcattaataaaatacaaacctaacaaaaggaaattaagttttctgaacgggaactgcactattgacaacaaaggaactgtaactgcaacaaaatttgttggcgaatttgaaggtattaatgaattttggtacaaagactctgattatcctcataatctcacctacgacggtgatattgttattggagacagcgattttaaaaacacaaaagatggagcttctgaattatcaaaatcgcacaaaccatga

SEQ ID NO: 17966 - protein, 284 aa, Unknown
  Obtained from environmental sample
  misc_feature (1)..(284): Xaa is any amino acid
MTTEQMTAIAQPANSLLVYNTTDSVFNYYDENSDSWNILGGIKTEIPWLSEGGFTFLGNIDDNVGIGIVKAQTKLHIFAVTEDFITELPPPTIRIENTDKDNENYYAWDIQNKKENLYFNFGTDIEPVTKTETKFIFTDEKHFGIGTDKPMANLHINNYNIKAPSSSSNIILESYKKEPIYFEIANSNGQINFNYTTEGKKLSLIKYKPNKRKLSFLNGNCTIDNKGTVTATKFVGEFEGINEFWYKDSDYPHNLTYDGDIVIGDSDFKNTKDGASELSKSHKP

SEQ ID NO: 17967 - DNA, 705 bp, Unknown
  Obtained from environmental sample
  misc_feature (1)..(705): n is a, c, g, or t
atggaagaagctggagaagttggtaaagtaaacatctcgggagctacttatgaatacattaaagaattctttaattgtgaataccgtggtaaaattaaagccaaaaacaaaggtttaattgacatgtattttgttactggaattagagcagaactatctgttgatggcgaaggaataataccaaacgatttattccaaaaatatgtggacttacatatttacagtagtattaactaccgtaaggcagaaaaatacattttaaaaagattacaaaaggagttgcccgacaacttgcattatcacgatattaaccacactaaagatgtttgtgctgcagtagaacgcttagccctgatggaaggtgttgaaggtgatgatatctttttattaaaaactgctgctttgtatcacgatgctggatttataaaacaatactctaaaaatgaagatataggagcagcattagctgtagaggtattacctaggtttggttattccttggaacaaatagaaaccattaaaaaattgatttctgttacaaaaatacctcatcagccttcaaatcatatagaacaaattatttgtgatgccgatttagactatttaggtggagaccaatttcacgagactgctgacaaacttaagctagaactaatggaaagaggcatggtaaactccgacaaagaatgggataactccaaataa

SEQ ID NO: 17968 - protein, 234 aa, Unknown
  Obtained from environmental sample
  DOMAIN (102)...(203): HD domain
  misc_feature (1)..(234): Xaa is any amino acid
MEEAGEVGKVNISGATYEYIKEFFNCEYRGKIKAKNKGLIDMYFVTGIRAELSVDGEGIIPNDLFQKYVDLHIYSSINYRKAEKYILKRLQKELPDNLHYHDINHTKDVCAAVERLALMEGVEGDDIFLLKTAALYHDAGFIKQYSKNEDIGAALAVEVLPRFGYSLEQIETIKKLISVTKIPHQPSNHIEQIICDADLDYLGGDQFHETADKLKLELMERGMVNSDKEWDNSK

SEQ ID NO: 17969 - DNA, 906 bp, Unknown
  Obtained from environmental sample
  misc_feature (1)..(906): n is a, c, g, or t
atgactcagaagctctcccttgatgagttaactggacttcatttacgacaaacatttgaaaccgatatgaaaaaaatgtttatttcaaaagagacaggatatgtatttatagtaaaaattgatgatttaagttcttatgcaaaaaatcatacaaataaagaggtagataaatttttaatctattttacaaatatattaaagaacctatctcctaaagtaacagcatatagattttatggttctgagtttgctatgatagcaaaaaacatagaagaaaatgagataaaacaggtaattcatagactaaaaattgctttagaatcatttgctataacatttaacattactgatgtagcacatattgggggaactccttttaaccctataggtacaactcctggtataattgcaagtgccaacgaagcttatgaaaaagccaaattaattggtgcaaatgaagcttttataagagatgacaatgatttagcaagagatatgaatgaatggagagatttagtttttgatatcatagataatcaaaaatttaatattagttatattggacaagcttattgtttagatatgaaagagcaaaatcttgtggtaatggaggaagcatttactcaagcaaaagataaaaataatgaacttataccaataggaacatttatctcaatagctgagaaatatgacaaaatattagactttgataaagctgttgtaaaaaaagtgatacaacatataaaagatacaagtattacacatagtatctctattaacttatcattagattctgtttttgatatcaagtttaaaaactggctaaaaggtattgttttagaaaataaagagattgcctctcagttggttttagtgttacagcgtatggtgctgctaaagatgtag

SEQ ID NO: 17970 - protein, 301 aa, Unknown
  Obtained from environmental sample
  DOMAIN (1)...(153): GGDEF domain
  misc_feature (1)..(301): Xaa is any amino acid
MTQKLSLDELTGLHLRQTFETDMKKMFISKETGYVFIVKIDDLSSYAKNHTNKEVDKFLIYFTNILKNLSPKVTAYRFYGSEFAMIAKNIEENEIKQVIHRLKIALESFAITFNITDVAHIGGTPFNPIGTTPGIIASANEAYEKAKLIGANEAFIRDDNDLARDMNEWRDLVFDIIDNQKFNISYIGQAYCLDMKEQNLVVMEEAFTQAKDKNNELIPIGTFISIAEKYDKILDFDKAVVKKVIQHIKDTSITHSISINLSLDSVFDIKFKNWLKGIVLENKEIASQLVLVLQRMVLLKM

SEQ ID NO: 17971 - DNA, 492 bp, Unknown
  Obtained from environmental sample
  misc_feature (1)..(492): n is a, c, g, or t
gtgaagttgcaggaaacggaatttnatctgtttgatctcgcccactcgacgcggaccatgctggcggccaaggccattgagaaatccatcgagtttgtgatctccaaggatacggatgtattgatcaacggcgatgagcgaaagctaaagcaggttntgataaacctgattaacaatgccattaaatttacgccggaaaatggcaagattggtttgaaggtttcgacgaacgccggcaattatataagcatcttcatcgaagataacggatatggtatcagcgaggacgaaattgaagatgtcatgcgcccgtttggccgggcctatcattccgtgacaaaatccatcgaagggacggggctgggattgcccttgtcaaaatccattattgaacttcatggtggcgagttaaagatagccggtaataacaataaagccggcacaacagttgaaatcaggcttcccaaaacaaggctccgtcagtgcgcttga

SEQ ID NO: 17972 - protein, 163 aa, Unknown
  Obtained from environmental sample
  DOMAIN (44)...(157): Histidine kinase-, DNA gyrase B-, and HSP90-like ATPase
  misc_feature (1)..(163): Xaa is any amino acid
MKLQETEFXLFDLAHSTRTMLAAKAIEKSIEFVISKDTDVLINGDERKLKQVXINLINNAIKFTPENGKIGLKVSTNAGNYISIFIEDNGYGISEDEIEDVMRPFGRAYHSVTKSIEGTGLGLPLSKSIIELHGGELKIAGNNNKAGTTVEIRLPKTRLRQCA

SEQ ID NO: 17973 - DNA, 819 bp, Unknown
  Obtained from environmental sample
  misc_feature (1)..(819): n is a, c, g, or t
atgacangtggaaaggatatcgtattagcgtctattcttggagctgaggaatttgatttcggtaagttgttactgattgcggaaggctgtgtaatggcaagaatatgtgagaaaaatacttgtccaacagggattgctactcatgatccaaagttcaaagcaaagtataaagggaacaaagatcatattattgatacccttacctatcttgcagaagatgttcgaagagagctagctaaaattggtgtagaatctttgccgaatattatggggaatacagcgttgcttacaattaatgagatacatcagccactaataaataaattggggctcgatcttggtttctttacaggtgcacctgaatatcataaagaagaggatttggaatcactttcagatccagtgagtgcattaaactcaaacattgttcatgacctaaaagacaaaatcgagaaaaatgagccaatagaagaagaatatgaaatcataaatacggatcgttctgctttagctactctatttggacttttagcggagaaagaaagcaaagaccgattagcatccatcaaaaataaaaagacaagtgttaaaccttatactcaaaaaattgatttaacatttagaggaagcgcaggccaaagttttggggtttttcaaaccaaaggagttaacatcagacttattggtgaagcaaatgattctgtatgtaaatctatgtcaggtggaaaaacagtgattgtacctccgaaagaggcaacatacaaacctgaagatatgctattattggaactgtgcattgtatggagctacaaatggtaa

SEQ ID NO: 17974 - protein, 272 aa, Unknown
  Obtained from environmental sample
  misc_feature (1)..(272): Xaa is any amino acid
MTXGKDIVLASILGAEEFDFGKLLLIAEGCVMARICEKNTCPTGIATHDPKFKAKYKGNKDHIIDTLTYLAEDVRRELAKIGVESLPNIMGNTALLTINEIHQPLINKLGLDLGFFTGAPEYHKEEDLESLSDPVSALNSNIVHDLKDKIEKNEPIEEEYEIINTDRSALATLFGLLAEKESKDRLASIKNKKTSVKPYTQKIDLTFRGSAGQSFGVFQTKGVNIRLIGEANDSVCKSMSGGKTVIVPPKEATYKPEDMLLLELCIVWSYKW

SEQ ID NO: 17975 - DNA, 654 bp, Unknown
  Obtained from environmental sample
  misc_feature (1)..(654): n is a, c, g, or t
atgcaaaatgttccgtctgtacaagtagaagttgatggcaaaatgagtattcgaggcaatggaaatgtgcgtatcttaatcgatggtcgcattagtggcttaactgatacagcatcactgttgagaacgattccagcggcttctatagataaggttgaagtaattacaaatccatcatcaaaatatagtgccgaaggttctggtggaatcattaatattgtcctaaaaaaaggaaagaaaaacagattgagtagtagttttgaactcttttctggtgtccgagttaattctggattgaatgtaaacatcaacaaagcaaatgaaaagtattcgtggtatcttaattctggtttgggatattctgaaccaaaagctacaagttcaatagcattaacaaattttaaaacttctccttcggaaagctttacaaattcaaaaaaaatactcaaacaattttatgctttgaataatcttggtggtgcatatcaattcaattcgaaacattccatttcagcggattttacttatcgattggctaacttaacaccgttaatgctatcggttataaagattataatgaccactcattgtctgctacttcagagccgtttgattctgaacaatttaaaagaagttcttccaaattaccagtga

SEQ ID NO: 17976 - protein, 217 aa, Unknown
  Obtained from environmental sample
  misc_feature (1)..(217): Xaa is any amino acid
MQNVPSVQVEVDGKMSIRGNGNVRILIDGRISGLTDTASLLRTIPAASIDKVEVITNPSSKYSAEGSGGIINIVLKKGKKNRLSSSFELFSGVRVNSGLNVNINKANEKYSWYLNSGLGYSEPKATSSIALTNFKTSPSESFTNSKKILKQFYALNNLGGAYQFNSKHSISADFTYRLANLTPLMLSVIKIIMTTHCLLLQSRLILNNLKEVLPNYQ

SEQ ID NO: 17977 - DNA, 390 bp, Unknown
  Obtained from environmental sample
  misc_feature (1)..(390): n is a, c, g, or t
atgaaccctaaattaattattggaattatagcaatcatcgggttcacttcattgttgatgtacaattttggagaaagtataagtacctataccaatttcgaaaaagctatcgaaatgaaaacggctcatgttgcaggagaatgggataaatcacaggattatggattttctatggagacaaagatattctctttttatatgaaagatgaagatggaatctcaaagaaagtagtttactctaaaccaaagcccaataattttgaacaagcggatcgattagtggtgatcggagaaatgcgtggtgatactttttatgctaatgatatgctgatgaaatgtccttctaagtataatgatgcgcccgaatttgaaaaagcatcacagagctaa

SEQ ID NO: 17978 - protein, 129 aa, Unknown
  Obtained from environmental sample
  misc_feature (1)..(129): Xaa is any amino acid
MNPKLIIGIIAIIGFTSLLMYNFGESISTYTNFEKAIEMKTAHVAGEWDKSQDYGFSMETKIFSFYMKDEDGISKKVVYSKPKPNNFEQADRLVVIGEMRGDTFYANDMLMKCPSKYNDAPEFEKASQS

SEQ ID NO: 17979 - DNA, 615 bp, Unknown
  Obtained from environmental sample
  misc_feature (1)..(615): n is a, c, g, or t
ttgttcatctgttctatgttccttgttccaagttctatgttcgatattcccctgcttctttgttattttaaacacaaaaattttttaatgtctgatactttaaaaactattaccctcactccatcctggaagaactacttctggtcctatttttttggactcttattagttccttttcttattggtattatcattatttcgtacgcacataaaaccagaaagaaaactcattatcagataacagatatttctattgcacgaattgaagaaactgataaacgagaactagacctagttaatatcttagaaacatcattttctcaaactaccactcaaaagctttttgggattggaaatatcaagcttcaagcaaatgtaagtgaactcatacttgaaggaattagtcaacccgcttctattttagctaatatcgatatcgcaattgcatatcagaaagaacgattgaaagcttctaaaaaagtacctacccgagaaccaacccacgatcctagaactattgataaactagattatctaactggtttatggcaacaaggattaatcaatgatgaagattatgattctgagcgaaagaattctcttaatttcttttaa

SEQ ID NO: 17980 - protein, 204 aa, Unknown
  Obtained from environmental sample
  misc_feature (1)..(204): Xaa is any amino acid
MFICSMFLVPSSMFDIPLLLCYFKHKNFLMSDTLKTITLTPSWKNYFWSYFFGLLLVPFLIGIIIISYAHKTRKKTHYQITDISIARIEETDKRELDLVNILETSFSQTTTQKLFGIGNIKLQANVSELILEGISQPASILANIDIAIAYQKERLKASKKVPTREPTHDPRTIDKLDYLTGLWQQGLINDEDYDSERKNSLNFF

SEQ ID NO: 17981 - DNA, 672 bp, Unknown
  Obtained from environmental sample
  misc_feature (1)..(672): n is a, c, g, or t
atgaaaaaagttttaaaagcaataggattaattttggcgctgctaattatagttggtgccattttttatgtagcaaataatgaaagtttacctaccggaattaaaagtgaaaaagcagaagctttggctacaaaaatgatgaaagctttaaactacgaagcgtataaaaacacagaagttttagaatggaggtttagagggaaacatttttacaaatggtataaatctgaaaatattgttgaagtttcttgggataaaaacaaggtgattttacacacaaaacaaccagaaaaatctgtagtatttgtttcagatatcaacaccgaaaatcagcaattaattcaacaagcaaccaattattttaataatgatagtttttggttggtggctccgtttaaagtttttgatactggcgtagaaagaagcattgtaaaacacaaggaaaaagatgctttgttaattacatacacttctggcggatcacggctggagattctattatggatcttaatgaagacagtttccgaaagttcacaatgtggccattatatccgatggggaatgaacttctggggcgatgggaacacagcgcggattcattccccaaaccacaatggttgttggctcaccacatgggatgaagatcaatcaaacgtgcttgggctaatctaa

SEQ ID NO: 17982 - protein, 223 aa, Unknown
  Obtained from environmental sample
  misc_feature (1)..(223): Xaa is any amino acid
MKKVLKAIGLILALLIIVGAIFYVANNESLPTGIKSEKAEALATKMMKALNYEAYKNTEVLEWRFRGKHFYKWYKSENIVEVSWDKNKVILHTKQPEKSVVFVSDINTENQQLIQQATNYFNNDSFWLVAPFKVFDTGVERSIVKHKEKDALLITYTSGGSRLEILLWILMKTVSESSQCGHYIRWGMNFWGDGNTARIHSPNHNGCWLTTWDEDQSNVLGLI

SEQ ID NO: 17983 - DNA, 861 bp, Unknown
  Obtained from environmental sample
  misc_feature (1)..(861): n is a, c, g, or t
atggtactggaggggacgaatttctggaacgctggcggcattaatgtttccgtttccacctctggcgttgaagtgggagcggattctgtgcaggcccttatcgccggcgcgattgaatttggcactgacgagctttaccagggtaccttcaaggcggaaagccgccacccgttcaagctctatgataataaacaggccaaaaacgatgctcgctttactgaaaaggtcgtgtatgtcctttactttgacggatctgtcagcggcctcgcagttggcgccagtgtcgagttcaagggcatcaaggtcggtagcgtccgcgatatcagccttgaaatcgatgaggcaaagcagaagtactacatcccggtacttatcgagatcgaaccgcaaagaatcaagctgacggatgatggcaagaaaatcctctcagctctggagaggcgcgagttgcgccagaaaatcatcaaggacttgatcgcgcggggcctgaaggcgaagctgaaaaatgcaaatttcctgacaggccagcttattgtcgatctcgacctggtaccggaccgggaagcagtctatgtcgcctccaacaggcgctatcctgaaattccgacagtcccggcggatctggatgaaattaccagctcgttgacacagttgatgtcaaagctcggcaagctgccgattgagcgcctcggnaatagcctgaacaatacggtggaggtgttggaccagctgttcaattcgcgtgaattacagcaaccattgaagatatcgcaggtggcagctccgtccggtggtagcggaaaatcgacccaaaaccttcgaaatcggaaacatcgagggtccgggagcattacaaattga

SEQ ID NO: 17984 - protein, 286 aa, Unknown
  Obtained from environmental sample
  misc_feature (1)..(286): Xaa is any amino acid
MVLEGTNFWNAGGINVSVSTSGVEVGADSVQALIAGAIEFGTDELYQGTFKAESRHPFKLYDNKQAKNDARFTEKVVYVLYFDGSVSGLAVGASVEFKGIKVGSVRDISLEIDEAKQKYYIPVLIEIEPQRIKLTDDGKKILSALERRELRQKIIKDLIARGLKAKLKNANFLTGQLIVDLDLVPDREAVYVASNRRYPEIPTVPADLDEITSSLTQLMSKLGKLPIERLGNSLNNTVEVLDQLFNSRELQQPLKISQVAAPSGGSGKSTQNLRNRKHRGSGSITN

SEQ ID NO: 17985 - DNA, 831 bp, Unknown
  Obtained from environmental sample
  misc_feature (1)..(831): n is a, c, g, or t
ttggtcgagagacaaagctttaagtgcagatgctttgatttaaaaggcattcatcatcgggttgtaagttatttaccaatcaaccatatttttgagcgttttgcttcgtattattaccatttaatggggtttgaagttcattttgcagaatccatagaaaaattaggagataatttaaaagagattcaaccgcattttatgcccgttgttcctagattaatcgaaaaagtttttgataaaattgtcgccaaaggaaatgagttatcaggaattaaaagaatcttgtttttttgggctttagctttggcagaaaaatacaaaccgtaccttcaaaattcttcattttataactttaaattaaaaatagcgcgtacactaatttttagcaaatggaaagaagctttaggtggaaaattattatttatggtttccgggagtgctccattgcaagaacgtttaataaccatttttactgctgctggaattccgatttttgaaggttacggaatgacagaaacttcgcctggagtttctataaacgatttaagaaacggtggatttaaagttggcaccgttggtaaaatcttaaaagatattgaagttaagattgctcatgacggagaaattttagtcaaaggctctaacatcatgttaggatattacaaaaacgaagaattgacacatgcaaccattattgatggttatttacatactggagatataggaacgcttgacaaagatggttttttacaaattacagatcgtaaaaaagaaatgtctaaaacttctggaggtcactatattgctccggttgtttacaaagtgttttaa

SEQ ID NO: 17986 - protein, 276 aa, Unknown
  Obtained from environmental sample
  misc_feature (1)..(276): Xaa is any amino acid
MVERQSFKCRCFDLKGIHHRVVSYLPINHIFERFASYYYHLMGFEVHFAESIEKLGDNLKEIQPHFMPVVPRLIEKVFDKIVAKGNELSGIKRILFFWALALAEKYKPYLQNSSFYNFKLKIARTLIFSKWKEALGGKLLFMVSGSAPLQERLITIFTAAGIPIFEGYGMTETSPGVSINDLRNGGFKVGTVGKILKDIEVKIAHDGEILVKGSNIMLGYYKNEELTHATIIDGYLHTGDIGTLDKDGFLQITDRKKEMSKTSGGHYIAPVVYKVF

SEQ ID NO: 17987 - DNA, 861 bp, Unknown
  Obtained from environmental sample
  misc_feature (1)..(861): n is a, c, g, or t
ttggcactactttcaaacagttacttaagccatccaacaataccacgattattcgatttccaatataatcaattagagaagtaccagctagataaagcatttacttcttttaaagataataattggtattcgataaccactaaagaatatgtagaccaagcaaatcaaattagtcgtgntttattgcgattgggaataaaaaaagatgataaaattgctgtcatatcaactacaaacagaacagaatggaatataatggatattggaattttacaattaggtgcgcaaaatgtgcctatttatccaaccatttgtaaagaagattatgaatatgtattgaatcattctggagcaacatattgttttgtttcagataccgctgttttagaaaaattaaatcacgttaaagaaaacacgcaattaaaaggcgtttatacgtttgatgacattaaaggcgaacatcattggagtgaaattttagaacttggaaaagacgaaagcaatcaacctgaagttgaagcatgcaaaaactcagtgaattcagatgatttagcaacgttaatttacacttctggaacaactggtaaaccaaaaggtgtgatgttatctcacggaaatattgtttctaatgttttagcaagtgaaaaaagagttccgttagttggtggtaaaagtcaagcattgagctttttacccgtttgtcatatttttgaaagaatgattttatatctatatcaatattgtggtgtagaaatttattttgcagaatctattgaaaaaatgagcgataatttaaaagaaattaaacctcatgtaatgactgctgttcataagattgtacggaaaaangtataccgataa

SEQ ID NO: 17988 - protein, 286 aa, Unknown
  Obtained from environmental sample
  misc_feature (1)..(286): Xaa is any amino acid
MALLSNSYLSHPTIPRLFDFQYNQLEKYQLDKAFTSFKDNNWYSITTKEYVDQANQISRXLLRLGIKKDDKIAVISTTNRTEWNIMDIGILQLGAQNVPIYPTICKEDYEYVLNHSGATYCFVSDTAVLEKLNHVKENTQLKGVYTFDDIKGEHHWSEILELGKDESNQPEVEACKNSVNSDDLATLIYTSGTTGKPKGVMLSHGNIVSNVLASEKRVPLVGGKSQALSFLPVCHIFERMILYLYQYCGVEIYFAESIEKMSDNLKEIKPHVMTAVHKIVRKXVYR

SEQ ID NO: 17989 - DNA, 510 bp, Unknown
  Obtained from environmental sample
  misc_feature (1)..(510): n is a, c, g, or t
ttgatgtttccattccttttacagaaaaaatacatgaaaaaaaataaaaaacagaaactatcggaaggggaaatttttatttctgactacttaagaagtgaaaaaattaaatttgaatctcaagttagaattaatgatttaaaaaacgacattaaaaaatatagagatgcagatttttatttaccaaaattgaaagtttatattgaatttaatggaatgtggaatgtatcaaaagaagatagagaaaggtatagattaaagaaaaaagtttatttcattaataatattccctgcatttatttgtatccggaaaacttaggaattattgattactgtttttccaaaaggttggttgaggttttaaaaaaaaataatctaaaaaaagagctattcaaatatagatttaatagacttaaagaagatagaggagatttatttttttggctaattatatcaaacctaatattagttcgaagtaactataatttttccgacgataatcttacctaa

SEQ ID NO: 17990 - protein, 169 aa, Unknown
  Obtained from environmental sample
  misc_feature (1)..(169): Xaa is any amino acid
MMFPFLLQKKYMKKNKKQKLSEGEIFISDYLRSEKIKFESQVRINDLKNDIKKYRDADFYLPKLKVYIEFNGMWNVSKEDRERYRLKKKVYFINNIPCIYLYPENLGIIDYCFSKRLVEVLKKNNLKKELFKYRFNRLKEDRGDLFFWLIISNLILVRSNYNFSDDNLT

SEQ ID NO: 17991 - DNA, 759 bp, Unknown
  Obtained from environmental sample
  misc_feature (1)..(759): n is a, c, g, or t
gtggtcaggatagggggatttaaccaatggtttgaaaacagaggagttaagattcgtcttaatatggatattgagtcaattttatgggcagcagtagtctctatggcatacagaatgagagaccgtcaacaatttttagcttggccagtttctaccatttattttagtggacaaggcatagtgataatattggtattggtgtttttctctactcaactcaaacactatgaagctcctaaaataaaggaaattagtcaacaagagtggttatctgctcaagttattgaaagaaataactggcttaatgtccctaaacaagcctttcaagtacgtttccatggtgacattaaagtcatgtcatcttcactaaaatcattgggttggaacgaaatcaaacccaatgcatggaaggatgtttggaatgccctaagagctgatgaaaaagatgaaaaagtaccttttattcccacaaccaataatggcaagattgaaactgtaatttacactaaaagaattgacgataatttatttgcattgcatttatgggaacgcccgttaaaaataacatcatctgaccaacacttatatgcaggttatgtttctcaaaatcacataggtaaaaattgggggctcacattttggaaaaatagttataacaatgatgccatattgacttttataaaagccattgagaaaagcaatcaactgtattacagtaaaagtgataatcagttttttatccaagtcagggaaaattaa

SEQ ID NO: 17992 - protein, 252 aa, Unknown
  Obtained from environmental sample
  misc_feature (1)..(252): Xaa is any amino acid
MVRIGGFNQWFENRGVKIRLNMDIESILWAAVVSMAYRMRDRQQFLAWPVSTIYFSGQGIVIILVLVFFSTQLKHYEAPKIKEISQQEWLSAQVIERNNWLNVPKQAFQVRFHGDIKVMSSSLKSLGWNEIKPNAWKDVWNALRADEKDEKVPFIPTTNNGKIETVIYTKRIDDNLFALHLWERPLKITSSDQHLYAGYVSQNHIGKNWGLTFWKNSYNNDAILTFIKAIEKSNQLYYSKSDNQFFIQVREN

SEQ ID NO: 17993 - DNA, 555 bp, Unknown
  Obtained from environmental sample
  misc_feature (1)..(555): n is a, c, g, or t
ttgcgcttttcacaagactttgtacctgttgataaatccatacatgatttgaaaggttttgattgtggtaaaaaatcaatgaatgaatttttatcacggttcgcttacaaacattcgaaattaggactaagtcgcacatatgttataactactgctgataattccattaaaaacaaaaggcaagttgcttgttattttacattagcgcattctacggtttctaaaactggagttcctattgacaaaagtttacctcaatacccatttccaatcatattactggcaagattagccgtagactctcaatttcaaaaaaataaaattggcacaaaatctttaatctatgcattaagaagggcacgtgatttaaacagtgctggcttaaatgtttttggattggtccttgatgtgctcgatgaaggtgctttgggtttttataagagcttttccttttttaatcccttcacagatgacccaatgagattgtttgtgggcatggaaactttgaaatcgatttttatcccaaaaatcaaagtgtcaaaaccagaacaatag

SEQ ID NO: 17994 - protein, 184 aa, Unknown
  Obtained from environmental sample
  misc_feature (1)..(184): Xaa is any amino acid
MRFSQDFVPVDKSIHDLKGFDCGKKSMNEFLSRFAYKHSKLGLSRTYVITTADNSIKNKRQVACYFTLAHSTVSKTGVPIDKSLPQYPFPIILLARLAVDSQFQKNKIGTKSLIYALRRARDLNSAGLNVFGLVLDVLDEGALGFYKSFSFFNPFTDDPMRLFVGMETLKSIFIPKIKVSKPEQ

SEQ ID NO: 17995 - DNA, 369 bp, Unknown
  Obtained from environmental sample
  misc_feature (1)..(369): n is a, c, g, or t
atggccaatagaagttatttgtactcctgtaatataattcctggggagcaaaaagaagaaaagaaattgataggaattgccgaatggaataatgacatacccattgtatttaagttactactttctggagatccgcaaatttgtaaatcatcgatatggaatttaaaagaaaaaattgcaatagctagctgctacgatcaaggattcaggaatctcaatcgattcctagatcaaatagacagagaagacgctaaagaacttgtaaatgaatctatagctttcttaagggctaaggaaaacaaagggagatattttgtattggaatgtggagaaatattcgatatgaatgagctcgagccgattctgtga

SEQ ID NO: 17996 - protein, 122 aa, Unknown
  Obtained from environmental sample
  misc_feature (1)..(122): Xaa is any amino acid
MANRSYLYSCNIIPGEQKEEKKLIGIAEWNNDIPIVFKLLLSGDPQICKSSIWNLKEKIAIASCYDQGFRNLNRFLDQIDREDAKELVNESIAFLRAKENKGRYFVLECGEIFDMNELEPIL

SEQ ID NO: 17997 - DNA, 717 bp, Unknown
  Obtained from environmental sample
  misc_feature (1)..(717): n is a, c, g, or t
atgaaagggaatctcggttcagattcaaaagaggaaagtgtcagggaaaaacttttccagaaatataagaagagtctgagcaaaaaagaaaaatcagctcagcagcagatccggatcctttttaaacacaatatcttcaactaccagttacctccgcactccctgcttcttgaagacctgtttgacgagaagaactgggagctcctcggcatgagcaaaaaacaggtcatagtagccggcgggcttggaggcgctaccatcggcgccggtctcgatatcgccgcccttggccattcattaggcctgttcaccgccattggtggagttgtcggagcagtgggagcactagtcggaggtgaaaatttatccaaccaggtacaggtgctcggtatcccgctggggggtgagatggtgcaggtcggaccggctaaaacaattgatctcctgttcattctacttaacagagctctgctatactaccaacacactataaactgggcccatggcagaagagattatccagagccgaaaaacgggttagtccctactgcaacaaatcaaaacttcacccagcactggccctcgggaaatatcaaaatctgccatgattttttcaaaaatatcaagacagacaacggagagagcgaatcagaagcaaaagaaaaattcagcgcactgttgctccaaagtctcaaagagatctccgaggacgattga

SEQ ID NO: 17998 - protein, 238 aa, Unknown
  Obtained from environmental sample
  misc_feature (1)..(238): Xaa is any amino acid
MKGNLGSDSKEESVREKLFQKYKKSLSKKEKSAQQQIRILFKHNIFNYQLPPHSLLLEDLFDEKNWELLGMSKKQVIVAGGLGGATIGAGLDIAALGHSLGLFTAIGGVVGAVGALVGGENLSNQVQVLGIPLGGEMVQVGPAKTIDLLFILLNRALLYYQHTINWAHGRRDYPEPKNGLVPTATNQNFTQHWPSGNIKICHDFFKNIKTDNGESESEAKEKFSALLLQSLKEISEDD

SEQ ID NO: 17999 - DNA, 621 bp, Unknown
  Obtained from environmental sample
  misc_feature (1)..(621): n is a, c, g, or t
atgaaaagttcgctaaaaggtgcatatggagacgatgtaaaaaacaacgaagactatggtcgaatcgttaacgttgcacatacaaagagaattaaaggcttagttgatgacgccatcaaaaatgatggcgaagtagtgtttgncggagatattgatgtaaaagatcgatttatcgcgcctacgcttatcgttggtaaaccgggcagcaaaaaattccttagcagccgtattatgaacgaggaaatatttggcccggtgctgccaattattgcgtatagcgacatcgaagagagcatctcccatatcaacgcactccccaaaccactagcgatttatgtatacagtgaagatcgtaaagtaatagatgagttgctgacgcggacgtcttccgggggctcttgtattaataccaatatggtgcagttcttacatggtaacttaccatttggcggggtaaataatagcgggattggtagtgctcacggtgaatacggctttaaagctttttcgcatgaacgtgcagtacttgaggataaatttacgtctaaccaccttttataccctccctatacgaacagcgtcaaaacccttactcgcctgattacgaaatttggcgcttaa

SEQ ID NO: 18000 - protein, 206 aa, Unknown
  Obtained from environmental sample
  misc_feature (1)..(206): Xaa is any amino acid
MKSSLKGAYGDDVKNNEDYGRIVNVAHTKRIKGLVDDAIKNDGEVVFXGDIDVKDRFIAPTLIVGKPGSKKFLSSRIMNEEIFGPVLPIIAYSDIEESISHINALPKPLAIYVYSEDRKVIDELLTRTSSGGSCINTNMVQFLHGNLPFGGVNNSGIGSAHGEYGFKAFSHERAVLEDKFTSNHLLYPPYTNSVKTLTRLITKFGA

SEQ ID NO: 18001 - DNA, 789 bp, Unknown
  Obtained from environmental sample
  misc_feature (1)..(789): n is a, c, g, or t
atgctggtgactgtcaaaacaaatccagaagaattgagccagtacccggacacggaatcactagaggaactcttcgcggagttagcccgagcaagcctgcgaggacatcactatgtggtgattgatcgcgatacagctgattgggccaaaaccaacctaacactcgataccagaaccagtgcacaactcgaatatctaaaaagcaaatacacacaagatggacagttgtgtctgacagccttctgcaagctatccgtggtgcttggcgagatgcaacctacgaactcatcaacgaacccgcactggcatgaaataggacaccaaaaactactaagaggtgactacctaaaccccagcctcctcctactggagcatgcaaccaatgacggtgccctagtaaagcagttagttgccattgggaaacacgtaacgaaaattagtcatcacaactgtgaagttcaacatggcggaggctcaagtgcttacgctgagtacgagcggctcatcagtcaaaaaaaagtaataacatgcttcgtcgatagcgacaaattcacaccatcatgcggtttgtcagcaacgaacaaaaaactgtcaaaagcttacaccgataaaaacattatcggtattttatcgttcagtaaaggaaaggaaatagagaattacatacctttggacctaataagatcacacaacataagaccagaatacaaacagttcgatgaacttgaaaaaattcaagagactgggcaagtaatatttgatctccggagccgattcttgatccactag

SEQ ID NO: 18002 - protein, 262 aa, Unknown
  Obtained from environmental sample
  misc_feature (1)..(262): Xaa is any amino acid
MLVTVKTNPEELSQYPDTESLEELFAELARASLRGHHYVVIDRDTADWAKTNLTLDTRTSAQLEYLKSKYTQDGQLCLTAFCKLSVVLGEMQPTNSSTNPHWHEIGHQKLLRGDYLNPSLLLLEHATNDGALVKQLVAIGKHVTKISHHNCEVQHGGGSSAYAEYERLISQKKVITCFVDSDKFTPSCGLSATNKKLSKAYTDKNIIGILSFSKGKEIENYIPLDLIRSHNIRPEYKQFDELEKIQETGQVIFDLRSRFLIH

SEQ ID NO: 18003 - DNA, 774 bp, Unknown
  Obtained from environmental sample
  misc_feature (1)..(774): n is a, c, g, or t
gtggaatttgtcagtaatggaagccgcctcgtaactggatatgacccatctttttttatggataaacgccttaaaggattcagggagttgattcatcctgatgatatagacagggttgccactgaaatgtttaattcaatcactaaaaaaagagaaccctctcagactgaatatcgcattatcaattcccttggtgtaataaaatgggtctttgataaggcagaaggagtgttatttgatgatgacaagcttgtcgccattgaaggatttattaccgattttacagtttttaaacagatggaacaaaaactcaggcatgaaaaccgctatcttcgctcaaccattaaggatcgatacaagtttgacaatatcattggaaactgccaggcaatgcaggatgtctacgaattgatattaaaggctgccggaaccaatgacagcgtgtttatatatggcgaatcaggaaccggaaaagagttggtcgcacatgccattcataatgcttcggatcgaagtgatcataagtttgttgctgtcaattgcagcgccattcctgaaaatctcatagagaatgagtttttcggatcaaaaaagggtgcttttacaggttcgagtattgacaaaaaaggctatcttgatatggcagatggcggaactctgtttctcgatgaaattggtgaggtcagtttagcactccaggtaaaacttttaagagcaattgaaggaggagggtactcacctataggaagtaccaagttaagaagactgatttaa

SEQ ID NO: 18004 - protein, 257 aa, Unknown
  Obtained from environmental sample
  DOMAIN (124)...(257): Sigma-54 interaction domain
  misc_feature (1)..(257): Xaa is any amino acid
MEFVSNGSRLVTGYDPSFFMDKRLKGFRELIHPDDIDRVATEMFNSITKKREPSQTEYRIINSLGVIKWVFDKAEGVLFDDDKLVAIEGFITDFTVFKQMEQKLRHENRYLRSTIKDRYKFDNIIGNCQAMQDVYELILKAAGTNDSVFIYGESGTGKELVAHAIHNASDRSDHKFVAVNCSAIPENLIENEFFGSKKGAFTGSSIDKKGYLDMADGGTLFLDEIGEVSLALQVKLLRAIEGGGYSPIGSTKLRRLI

SEQ ID NO: 18005 - DNA, 669 bp, Unknown
  Obtained from environmental sample
  misc_feature (1)..(669): n is a, c, g, or t
ttgaaaagagaaattgtgattacagcagatggttcttcaaccatccatttaccagattgggatgaaaattaccactcaactcatggcgcaattcaagaagcaaaacacgtatttatctctaaaggatttgatgcagtttctgtatcagaagtttcgattttagaaataggtcttggaacaggtttaaattgttttatcacttttttagaagcgatagagaataagaaatcgataaattatgttggagtagaagcatttcctgtaacaaagaaagaagtttctaaattgaattatgttgcagaattaaaagcagaacatcaacaattggtttttgatgaaattcacaattgtcattgggaagaaaaacatcagattcattctagtttttggctgacaaaaagaaaacaattttttaaagatattgttgatgaaaatcagtttgaactcatctattttgatgcttttggtgcagagtatcagccagaattatggaccgttactatttttgaaaaaatgtttaaagcattaaaagtaaacggtattctagtaacatattccgctaaaggaagtgttcgaagagccctgcaagaagttggttttacagttgaacgacttgatggtccgccaggaaaaagagaaatgttaagaggaataaaaaagaagcaataa

SEQ ID NO: 18006 - protein, 222 aa, Unknown
  Obtained from environmental sample
  DOMAIN (5)...(220): Protein of unknown function (DUF752)
  misc_feature (1)..(222): Xaa is any amino acid
MKREIVITADGSSTIHLPDWDENYHSTHGAIQEAKHVFISKGFDAVSVSEVSILEIGLGTGLNCFITFLEAIENKKSINYVGVEAFPVTKKEVSKLNYVAELKAEHQQLVFDEIHNCHWEEKHQIHSSFWLTKRKQFFKDIVDENQFELIYFDAFGAEYQPELWTVTIFEKMFKALKVNGILVTYSAKGSVRRALQEVGFTVERLDGPPGKREMLRGIKKKQ

SEQ ID NO: 18007 - DNA, 363 bp, Unknown
  Obtained from environmental sample
  misc_feature (1)..(363): n is a, c, g, or t
atgaaaaaaactactttagtacttggagcatcagtaaacacagagcgttactcgaacaaagcaattcgaaagctaagagcaaataatattgaagtttttgcccttggcgcaaaaaaaggaactgttttagatgttaaaataggggtagagaaattactatttaaggatgttgataccgtaactttatatttaaatccaacaatacaaaaagagtattataaatatgtaattggcttacaaccaagacgcgtaatttttaatcctggaacagaaaatgctgaatttttagagttgctgaaagaacataatattgaaacagaagttgcttgtacgttggtgctgttaagtatccatcaatattaa

SEQ ID NO: 18008 - protein, 120 aa, Unknown
  Obtained from environmental sample
  misc_feature (1)..(120): Xaa is any amino acid
MKKTTLVLGASVNTERYSNKAIRKLRANNIEVFALGAKKGTVLDVKIGVEKLLFKDVDTVTLYLNPTIQKEYYKYVIGLQPRRVIFNPGTENAEFLELLKEHNIETEVACTLVLLSIHQY

SEQ ID NO: 18009 - DNA, 723 bp, Unknown
  Obtained from environmental sample
  misc_feature (1)..(723): n is a, c, g, or t
ttgtcggataaaatccgcaagtttctggnctatttggctactggcattgtgttttctgctatagttatttgggtggcttatagttacttcgactcgccaaaagaaaagcaattgaaacgtgagatagctttcatgaaactgcaatatgaaacgttgagcgaaaggctagaccaaaccaacgatgtgctggctcacttacaagaaaaagacgatgatatttatcgggtaatatttgaggcggaacctattccttcttccaagcgtgatgctggatttggtggggttaaccgatacaagaaattggagaattacgatgcctcggaagtggtgattgagagtactaaaaagctggacaagattgccaagcaattggtggttcaaagcaaatcatttgatgaggtgatacaactggcactgagtaaagagaaaatgttggcctgcatccctgccatccagccgatatccaatgagaaacttacgaggatcgcctctggttatggatacaggatacaccctatttataagataaagcacttgcacactggtttggactttagcgcacccaagggtactgatatctacgctactggtgatggggtggttgagaaagtggagaatctcaacaatggttatggtcaccatgtggttattaatcatggctatggttataaaaccttgtatggtcacatgagcggatttaatgtaagagaaggccaaaagtaa

SEQ ID NO: 18010 - protein, 240 aa, Unknown
  Obtained from environmental sample
  DOMAIN (178)...(239): Peptidase family M23
  misc_feature (1)..(240): Xaa is any amino acid
MSDKIRKFLXYLATGIVFSAIVIWVAYSYFDSPKEKQLKREIAFMKLQYETLSERLDQTNDVLAHLQEKDDDIYRVIFEAEPIPSSKRDAGFGGVNRYKKLENYDASEVVIESTKKLDKIAKQLVVQSKSFDEVIQLALSKEKMLACIPAIQPISNEKLTRIASGYGYRIHPIYKIKHLHTGLDFSAPKGTDIYATGDGVVEKVENLNNGYGHHVVINHGYGYKTLYGHMSGFNVREGQK

SEQ ID NO: 18011 - DNA, 468 bp, Unknown
  Obtained from environmental sample
  misc_feature (1)..(468): n is a, c, g, or t
atgatggaatacaaaacaagaatcactgccgaagatggtaaacaagatttagtaatcacaagggaattcgatttacccgttgaattgctatataaagcatatacagaacctgagcttgtagagcaatggatgggcaccaaagtgataaaactcgaaaatattaatcacggtagctatcaattcgaaacttcatataacggcagtgttgttttttccgcaaatggtactattcatcaagttatacccaatcagaaaatagtaaggacttttgaaatggaaaacatgactattggcgtacagctagaatttttaaaatttgaaaagcttactaatgacaatagtaaactaaccatacatataatttataggtcagaaaagcaccgagcagaacaggtcaaattaccttttgtcaatgggttaagtatggctcatgatagattgcaagaaattttaaacacttcaaaataa

SEQ ID NO: 18012 - protein, 155 aa, Unknown
  Obtained from environmental sample
  misc_feature (1)..(155): Xaa is any amino acid
MMEYKTRITAEDGKQDLVITREFDLPVELLYKAYTEPELVEQWMGTKVIKLENINHGSYQFETSYNGSVVFSANGTIHQVIPNQKIVRTFEMENMTIGVQLEFLKFEKLTNDNSKLTIHIIYRSEKHRAEQVKLPFVNGLSMAHDRLQEILNTSK

SEQ ID NO: 18013 - DNA, 450 bp, Unknown
  Obtained from environmental sample
  misc_feature (1)..(450): n is a, c, g, or t
ttgtttcgtatccttatctacattatcaaaatcaaaatacatttcatgaaaaaattattcgtattaacaatactattttcatttttcatatcacttactatcaatcctatttctggtatttcttggaattctaccggccatagagtaattgcagctattgcatgggaccacttaactcctgttgctaaggaaaatatcatgtcaatattgaaaaaagcacctgaagattctgacctgatagaaatgtatgataaagacagtgatcatgccgataaatattactttatgaatgctgcatattggccggatgttgtgcgtgacagagatgaaaaagtacgcaacgagaaatatcataaaggaacttggcattatgttggaacctattggaaacaaantaaagaaggtcctgttaacgccgaaggaatgttcagctgctgggccgattcttga

SEQ ID NO: 18014 - protein, 149 aa, Unknown
  Obtained from environmental sample
  misc_feature (1)..(149): Xaa is any amino acid
MFRILIYIIKIKIHFMKKLFVLTILFSFFISLTINPISGISWNSTGHRVIAAIAWDHLTPVAKENIMSILKKAPEDSDLIEMYDKDSDHADKYYFMNAAYWPDVVRDRDEKVRNEKYHKGTWHYVGTYWKQXKEGPVNAEGMFSCWADS

SEQ ID NO: 18015 - DNA, 711 bp, Unknown
  Obtained from environmental sample
  misc_feature (1)..(711): n is a, c, g, or t
ttgcactaccaaaagatccaggatctttttgtactgagttcagatcgaaaagacttttcacttttagactggataaaagagctcctgacctcaaaagaagagcaaaaagtcgtgatgcgaaacaaagatcaaaagcagatcatcttgaagataagaggcgagcttttagaacactctaatgaatatctcatcatcacccaggacatcacaatggaagagcagcacacaaaagagatcgaagagctctataacatcgatcacttgacaaagcttcccaacagactcaaacttatcaaagacctacagatatacgacgagttggctttggctatattggatattgactcttttaaagtgatcaatgatttttatgggcatgtaataggcgactttcttatccaacaggtagcacaaaggatcaagaactacatcacgcatgagaacctgctcttataccgtctgccctcagacagttttgcccttgtcaatacacaagatattgaaaaagagtattttgagatcattattatctcattgatccagatcgtctcaaaggcaccctttgtctacctcggtgaagatgaagagatagagatctttgccaacataaccggaggcattgtctttgaaaaagagtcggccatggcccatgccgatctcgccctgcgcgaggccaaaagtttacatagagctctcgagccgattctgtga

SEQ ID NO: 18016 - protein, 236 aa, Unknown
  Obtained from environmental sample
  DOMAIN (79)...(232): GGDEF domain
  misc_feature (1)..(236): Xaa is any amino acid
MHYQKIQDLFVLSSDRKDFSLLDWIKELLTSKEEQKVVMRNKDQKQIILKIRGELLEHSNEYLIITQDITMEEQHTKEIEELYNIDHLTKLPNRLKLIKDLQIYDELALAILDIDSFKVINDFYGHVIGDFLIQQVAQRIKNYITHENLLLYRLPSDSFALVNTQDIEKEYFEIIIISLIQIVSKAPFVYLGEDEEIEIFANITGGIVFEKESAMAHADLALREAKSLHRALEPIL

SEQ ID NO: 18017 - DNA, 675 bp, Unknown
  Obtained from environmental sample
  misc_feature (1)..(675): n is a, c, g, or t
ttgtacgcaattttagatattgaaactaccggaggaaaatttaacgaagaaggaattactgaaattgcaatctataaatttgacggacatactgttgtagatcaacttattacattggtaaatccagaaaaagacattcagccttttgtggtgcaacttaccggaattaacaataaaatgctgaaaaatgctccaaaatttcacgaagtagcaaaacgaatcttagaaattacagaagattgtattattgttgctcacaactcgagttttgattatcgtattttaaaaacagaatacaaacgtttaggatatcaatttaaaagagacacattgtgtacggttgaattaagtagaaaaataattccagacaaaccttcgtacagtttaggtaaattatgtaaatcactcggaataccaatgaatgatagacatagagcttctggtgatgcactcgcgaccattcaactttttaaattattgttacatacagatgttgacaaaacaatactaaaaagtaccattaaacattttgattctaagaaggttgccgaaaaactaactggtntagtagaagtaattccacaattatgggcgtttattattcgcctaaagatgatggcgaaattattttatggcgccagaagtaccttaaaaagatcttacaatcagtcgtaa

SEQ ID NO: 18018 - protein, 224 aa, Unknown
  Obtained from environmental sample
  DOMAIN (2)...(157): Exonuclease
  misc_feature (1)..(224): Xaa is any amino acid
MYAILDIETTGGKFNEEGITEIAIYKFDGHTVVDQLITLVNPEKDIQPFVVQLTGINNKMLKNAPKFHEVAKRILEITEDCIIVAHNSSFDYRILKTEYKRLGYQFKRDTLCTVELSRKIIPDKPSYSLGKLCKSLGIPMNDRHRASGDALATIQLFKLLLHTDVDKTILKSTIKHFDSKKVAEKLTGXVEVIPQLWAFIIRLKMMAKLFYGARSTLKRSYNQS

SEQ ID NO: 18019 - DNA, 456 bp, Unknown
  Obtained from environmental sample
  misc_feature (1)..(456): n is a, c, g, or t
atgaaaaaaattactttccttttaattctatttgtaactacattttctttttcacaaaaatctaagtccgctaaaatggggcaagctactttagaggagttacaaatgactgtttatgacaaagattctactgctgtagctgttgtattgtatgaacaaggaaacacttacataaattctgaaagagattacaatttaagtacagcctattattatagaattaaaatacttaaaaaagaaggttttaaaaatgggattgtacaaattcctttttataaaaaagaatctatagataatatcaaagcggttacatacaatattgtttccaattccattcaaaaaaaatacctattagaaaaagacatatttaaaaacaaagaaactgaaaattggactactttatcatttacgttaccgaatattaaattgttcggtaatagatattnaaatacctga

SEQ ID NO: 18020 - protein, 151 aa, Unknown
  Obtained from environmental sample
  SIGNAL (1)...(18)
  misc_feature (1)..(151): Xaa is any amino acid
MKKITFLLILFVTTFSFSQKSKSAKMGQATLEELQMTVYDKDSTAVAVVLYEQGNTYINSERDYNLSTAYYYRIKILKKEGFKNGIVQIPFYKKESIDNIKAVTYNIVSNSIQKKYLLEKDIFKNKETENWTTLSFTLPNIKLFGNRYXNT

SEQ ID NO: 18021 - DNA, 330 bp, Unknown
  Obtained from environmental sample
  misc_feature (1)..(330): n is a, c, g, or t
atgttgcttaccagcttaaaatattttttagaattagatgtaaacaaacccaaatacaatttaaagagtaaaaaaagaatgctatcagaaagctttaatagcgacaatatgttgttgactgataaaggaagaactatggatgagcgttctataattgtaattgaaaataacgaggttttaggatattgttttaccaatttggcttttcaagaaagtcaaatgagcattttaaaagaaatgcttactcctattttaaataaagagttggctaaaaccatcataaaaaattatttaaaaaataaatccgttttaaaaattataagattctag

SEQ ID NO: 18022 - protein, 109 aa, Unknown
  Obtained from environmental sample
  misc_feature (1)..(109): Xaa is any amino acid
MLLTSLKYFLELDVNKPKYNLKSKKRMLSESFNSDNMLLTDKGRTMDERSIIVIENNEVLGYCFTNLAFQESQMSILKEMLTPILNKELAKTIIKNYLKNKSVLKIIRF

SEQ ID NO: 18023 - DNA, 651 bp, Unknown
  Obtained from environmental sample
  misc_feature (1)..(651): n is a, c, g, or t
atgcctatgcgtgatttagatattcgtggagctggaaatatcttaggcggtgacaagagtggttttatcaatgatatcggctttgaattgtattccaaaatactcaacgacgctgttcgtgagctaaaagaatccgaattcagtgatatgtttgaaggtattgaagctgaaatcgatcttccagaaaccattgttgaatttgatgaatcggctcttcttccaactgattatgtgagtgataatgtggagagattaaacctatatcgtaaactttctcaagccaaaacagaacaagacgttgaagattggaaagaagaaatagaagacagatttggcccagctccaaaagcggctaaatatctaattgaagctagcaagattaagctactagcttcaaagtgcctttttacaaaagtcactatccgttccgaaagaatgtgggctgtgtgccctaaagctgattccaagttggctgaacctttttatgaaaacggcaagtttcaatcaatacttaaaggtttagaagtacttagacctgataaatttcagcttattcaaaagaatgagtctgtaagattagctatccaagatattcccaacgtttatggagccacagaatttttaaaggaattagttcaaaagaccgagtaa

SEQ ID NO: 18024 - protein, 216 aa, Unknown
  Obtained from environmental sample
  DOMAIN (66)...(176): TRCF domain
  misc_feature (1)..(216): Xaa is any amino acid
MPMRDLDIRGAGNILGGDKSGFINDIGFELYSKILNDAVRELKESEFSDMFEGIEAEIDLPETIVEFDESALLPTDYVSDNVERLNLYRKLSQAKTEQDVEDWKEEIEDRFGPAPKAAKYLIEASKIKLLASKCLFTKVTIRSERMWAVCPKADSKLAEPFYENGKFQSILKGLEVLRPDKFQLIQKNESVRLAIQDIPNVYGATEFLKELVQKTE

SEQ ID NO: 18025 - DNA, 597 bp, Unknown
  Obtained from environmental sample
  misc_feature (1)..(597): n is a, c, g, or t
gtgttgccttctcaaagagctggcgtttttgttaaacaagcattaaaagaaactattgatatcggttttttgccaacaatttttaatatagaacaatttattgaagaagtttctgggttgcataaagtggattctattcagttattatttcatttttatgctgtttataaaaaagtagaagctgaacctgaagaatttgaaagttttatttcttgggcttttactgtggtacaagattttaacgaagtagatcagcatttaatcaaccctaaagagatttttccgtatttaagagatattcaacgattaaaaaattggtcagtaaaaaaaccttttgaagaaaccaaaatggtgaaaaatcatttttctttcttagaaaaattagaagtttactacacagaattttataaatttttactggaaaataaaattggttatcaagggttaatttacagagaagccagtaaaaacattgaaacttatattgaaaagaacaagcataagaagtatgtttttatgggttttaatgcgctaaacaaatctgaagtaatttgtttcaagaactgtgtctgcagtcaaccgctgtccgattcttga

SEQ ID NO: 18026 - protein, 198 aa, Unknown
  Obtained from environmental sample
  misc_feature (1)..(198): Xaa is any amino acid
MLPSQRAGVFVKQALKETIDIGFLPTIFNIEQFIEEVSGLHKVDSIQLLFHFYAVYKKVEAEPEEFESFISWAFTVVQDFNEVDQHLINPKEIFPYLRDIQRLKNWSVKKPFEETKMVKNHFSFLEKLEVYYTEFYKFLLENKIGYQGLIYREASKNIETYIEKNKHKKYVFMGFNALNKSEVICFKNCVCSQPLSDS

SEQ ID NO: 18027 - DNA, 558 bp, Unknown
  Obtained from environmental sample
  misc_feature (1)..(558): n is a, c, g, or t
atgataaaaaaactctcaatttttctcgcgttttgcgttgtgcaaattacttatagtcaagaaactatagatgaaaaagtaacaaaaagaatttacactacaaaaaaaattaaaacggcaccaattatcgatggcaatattactgatgaaatttggaatgctgtttcttggaatgctaattttacacaattatcacctatagaagggaatcaaccaactcaaaaaacaaaatttaaaattatttatgatgataagaatttgtacctagctgttcgatgttacgattctgaaccaaataaaattgtaaagcgcttgtctcgtagagatggaaatgacggagattggattgaaattaatttagatagttatcatgatttaagaactgcttttgcatttacagtgactgcggcaggagtaaaaggagaagaatttgcttctttaaatggtaaaagttgggataaaagctggaacccaatatggtttgtaaaactaagattgacgaagaaggttggacagcagaatttaaattccgctttctcaaattcgatttacagataa

SEQ ID NO: 18028 - protein, 185 aa, Unknown
  Obtained from environmental sample
  misc_feature (1)..(185): Xaa is any amino acid
MIKKLSIFLAFCVVQITYSQETIDEKVTKRIYTTKKIKTAPIIDGNITDEIWNAVSWNANFTQLSPIEGNQPTQKTKFKIIYDDKNLYLAVRCYDSEPNKIVKRLSRRDGNDGDWIEINLDSYHDLRTAFAFTVTAAGVKGEEFASLNGKSWDKSWNPIWFVKLRLTKKVGQQNLNSAFSNSIYR

SEQ ID NO: 18029 - DNA, 822 bp, Unknown
  Obtained from environmental sample
  misc_feature (1)..(822): n is a, c, g, or t
gtgctagaagaacgtactgaaggattgaataaaattagaattaaacgttgggacaataccaaagattattatttgccatttgatgaagaaacgtacactgcagatgtgtttgcaaatccagattttgataccaatacaattcgctattcatacaattcaatgacaacgccaagttctgtcattgattttaatatggatgaccaatcaaaagaaatcaaaaaagaacaagaagttttaggaggaaaatttgataaaaataagtacacgagtaaacgtgtttgggtaacagcaagagacggaaaaaaaatagcgatttctttagtgtacagaaaagatactgagattaatgaaaacacacctgtattgcaatatgcgtacggttcttatgggtatacaattccagatggatttagcaccacaagattgagtttgttagatagaggatttgtgtacgctttagcgcatattagaggaagcgaatatttaggaagaaattggtacgaagacggaaaattattgagcaagaaaaacacgtttaacgattttatagattgttctaaattcttgataaaaaacaagtacacttccgcagatcatttatatgcaatgggcggatctgctggcggattgttaatgggagcaattgtaaatatgaatccagaattgtacaacggaattattgcacaagttccttttgttgatgtaatttctaccatgttagatgaaagtattcccgtaacaaccggagaatttgatgagtggcggaaatcgaagaacaaagatattcgaactactttaaagttatcgcgtacgatcaagtaa

SEQ ID NO: 18030 - protein, 273 aa, Unknown
  Obtained from environmental sample
  DOMAIN (135)...(273): Prolyl oligopeptidase family
  misc_feature (1)..(273): Xaa is any amino acid
MLEERTEGLNKIRIKRWDNTKDYYLPFDEETYTADVFANPDFDTNTIRYSYNSMTTPSSVIDFNMDDQSKEIKKEQEVLGGKFDKNKYTSKRVWVTARDGKKIAISLVYRKDTEINENTPVLQYAYGSYGYTIPDGFSTTRLSLLDRGFVYALAHIRGSEYLGRNWYEDGKLLSKKNTFNDFIDCSKFLIKNKYTSADHLYAMGGSAGGLLMGAIVNMNPELYNGIIAQVPFVDVISTMLDESIPVTTGEFDEWRKSKNKDIRTTLKLSRTIK

SEQ ID NO: 18031 - DNA, 390 bp, Unknown
  Obtained from environmental sample
  misc_feature (1)..(390): n is a, c, g, or t
atgggcattttttcaaaacatatttcgccacataaacttcacccagaaattttacactggcaagaaggtgacgaaattaaggcacgtaatattactttaaataacccgctttcaattgtggtggcttttgaggatggaaacctgaatataatctataattttatagctattactcccgatggatttatcattatttcagaaaaagaaacggaacagctacataaagtgccttttaaaaaatttattaaaacagctaaaaacctgagtttaattaaccgaacaattcaacaagatttagtacacaaccaagattatatggaactgattgaatcgttccaaactgcatacaaagaactcgaagaatctgacaaccctaaattaattgactaa

SEQ ID NO: 18032 - protein, 129 aa, Unknown
  Obtained from environmental sample
  misc_feature (1)..(129): Xaa is any amino acid
MGIFSKHISPHKLHPEILHWQEGDEIKARNITLNNPLSIVVAFEDGNLNIIYNFIAITPDGFIIISEKETEQLHKVPFKKFIKTAKNLSLINRTIQQDLVHNQDYMELIESFQTAYKELEESDNPKLID

SEQ ID NO: 18033 - DNA, 720 bp, Unknown
  Obtained from environmental sample
  misc_feature (1)..(720): n is a, c, g, or t
ttgtgtttaacggtaacgggttgccacgggaacaccgctccttgtgtttccttgagctttgaggaggatttttttatcnacggggtttttccgaaaaagcttgttgggccgccaacagttttcgccgcggaaattccatatcggattagtggagtcttccgacagtttggaacatcgattaaaaattgggnaaaaagtggcagcggnacagaggtgtatctcgttccgcaaaaaatttccaaagtgtggatatcgattacacatgccggaatagcaaacctcgatgatgatatatgtggtgtaaatactttagcacgtgaaatacataaatgtgaaataagtacaggaaaccattttagcaattcgtttaattctaaaaaattcaaagaaaacaaaagcgatgtcccacaaagtgtaaacgatccaaaactgtttaagagattaggagaaatattcagttctaaaagtacaaatgtagatctgtttttagttaacgaagaatatggggttgtagtaaccgcaactaaatcagataacaaaaaagtgtataactgcactttttttagtgtagaggatcttagtatttcaggagaaattgaattaaatgaaatgccgatttacatagggaatgataaagcagtttttgtgaataggaaaaaaactgactatgaaaatgaatctatagaattggttttcaagagcatcataataaatgactaa

SEQ ID NO: 18034 - protein, 239 aa, Unknown
  Obtained from environmental sample
  misc_feature (1)..(239): Xaa is any amino acid
MCLTVTGCHGNTAPCVSLSFEEDFFIXGVFPKKLVGPPTVFAAEIPYRISGVFRQFGTSIKNWXKSGSGTEVYLVPQKISKVWISITHAGIANLDDDICGVNTLAREIHKCEISTGNHFSNSFNSKKFKENKSDVPQSVNDPKLFKRLGEIFSSKSTNVDLFLVNEEYGVVVTATKSDNKKVYNCTFFSVEDLSISGEIELNEMPIYIGNDKAVFVNRKKTDYENESIELVFKSIIIND

SEQ ID NO: 18035 - DNA, 384 bp, Unknown
  Obtained from environmental sample
  misc_feature (1)..(384): n is a, c, g, or t
atgagtaattatgaaaaatacaatacagccgcccggttaatctgtatcggaaatagcgattgcaatgttgcaaaagaaatgggcgtcacgccacagactatctgcaactggaggaaaaaggacgaatttaaggagatcctgaatacgcataaggaggaactcaacagagataactggcttaagctaagagcactatcccataaagccatgaataaacttgaagaactagtggacatagacgattcaaaggtaaacatacaagcaatcaggctgatccttcatgctcaaggatactttcataccgccacgcaccgttacgccattcaagaaatggacctagaaaacgtatcaatatcgagcaagctcccgaagttacaattctag

SEQ ID NO: 18036 - protein, 127 aa, Unknown
  Obtained from environmental sample
  misc_feature (1)..(127): Xaa is any amino acid
MSNYEKYNTAARLICIGNSDCNVAKEMGVTPQTICNWRKKDEFKEILNTHKEELNRDNWLKLRALSHKAMNKLEELVDIDDSKVNIQAIRLILHAQGYFHTATHRYAIQEMDLENVSISSKLPKLQF

SEQ ID NO: 18037 - DNA, 468 bp, Unknown
  Obtained from environmental sample
  misc_feature (1)..(468): n is a, c, g, or t
atgaaaatcaaaattcttgccattggaaaaacagatgataaaaatttacaccaattaattgaggtgtatcaaaaacgtttacaacattatatcaaatttgaattagatatcatcccagacattaaaaatgttaagaatttaagtgaaattcagcaaaaagaaaaagaaggcgaattgattttaagcaagttgcaaaacaccgatcaattggttttgttagatgacaaaggaaaacagtttacttctatagaattttctcagtatttacaaaagaaaatgaatgcaggaattaaacaattagtgttggtaattggcggtccttatggtttttctgatgcagtttataaaaaatcaccacggaaattatcggttcctaaaatgacattttctcatcaaatgattcggttatttattgtagaacagatttataaaggtttaactatttcgaaaaatgagcttatcatctga

SEQ ID NO: 18038 - protein, 155 aa, Unknown
  Obtained from environmental sample
  DOMAIN (1)...(152): Uncharacterized ACR, COG1576
  misc_feature (1)..(155): Xaa is any amino acid
MKIKILAIGKTDDKNLHQLIEVYQKRLQHYIKFELDIIPDIKNVKNLSEIQQKEKEGELILSKLQNTDQLVLLDDKGKQFTSIEFSQYLQKKMNAGIKQLVLVIGGPYGFSDAVYKKSPRKLSVPKMTFSHQMIRLFIVEQIYKGLTISKNELII

SEQ ID NO: 18039 - DNA, 429 bp, Unknown
  Obtained from environmental sample
  misc_feature (1)..(429): n is a, c, g, or t
atgcaaaaagtaattttaacactcgtatgtatcatcacaagttttttctttcaggcattttcacaagaaaaagtaacacacacaattaccgtaacaatttctggaatggaatctgataaaggcgacgtttttgtagccttatacaattctgaaaaagattttttaaacaaaaattttaaaggaactattgtaaatgtatcagataaaaaagcaacagcggtttttaaaaatattgaaaacggaatctatgccatttctgtttttcatgatgaaaataacaacaaaaaactagacactagaatttttggaattccaaaagaaccgatcggaatgtctaatggagcaacagggtttatgggacctccaaaatataaagacgcaaaatttagcgtaactaaagacattaaaatccctataaaagtagaataa

SEQ ID NO: 18040 - protein, 142 aa, Unknown
  Obtained from environmental sample
  SIGNAL (1)...(19)
  misc_feature (1)..(142): Xaa is any amino acid
MQKVILTLVCIITSFFFQAFSQEKVTHTITVTISGMESDKGDVFVALYNSEKDFLNKNFKGTIVNVSDKKATAVFKNIENGIYAISVFHDENNNKKLDTRIFGIPKEPIGMSNGATGFMGPPKYKDAKFSVTKDIKIPIKVE

SEQ ID NO: 18041 - DNA, 669 bp, Unknown
  Obtained from environmental sample
  misc_feature (1)..(669): n is a, c, g, or t
ttggttgagttcaatggttctgcctatgcacagtcaactagtagtgcagatagttacatagataaactgatacgggataatataaacggtaatttcaagcagtttgatagctggatggccaaaaacaaaaacagtatcgctacagagcctactgttaacgtcaaagtcaactttgcaagaacaacagagaaagcagatcagattgtatacagtaaaaacagaaagctgtacataactgattttgaaggtaagcccgaagaggatattattggtgccgcagcaacattaagtggcataagcatgaattatcagtcatcaactttgcgcaataaaactgatgttacggtaacggtttccatttactttgacaaaagccgctcatggatgaaagataatggtaaaaacgtcactacgttaatgcacgagcagcgacattttgatattaccgcaataaaggcgtgtcaattgaaagaacagttagaaactacagagttcactcctcagaattacaagagtcagctgaaagacttgctgaataaagcgcagacagaaggggcagagatgcaaaatacctatgatgatgaaacagagcatggtacaatagtagaccaacaggaagcatggaatacgaaaatagatgaactgttgagcaaacaaaaatgctactaa

SEQ ID NO: 18042 - protein, 222 aa, Unknown
  Obtained from environmental sample
  misc_feature (1)..(222): Xaa is any amino acid
MVEFNGSAYAQSTSSADSYIDKLIRDNINGNFKQFDSWMAKNKNSIATEPTVNVKVNFARTTEKADQIVYSKNRKLYITDFEGKPEEDIIGAAATLSGISMNYQSSTLRNKTDVTVTVSIYFDKSRSWMKDNGKNVTTLMHEQRHFDITAIKACQLKEQLETTEFTPQNYKSQLKDLLNKAQTEGAEMQNTYDDETEHGTIVDQQEAWNTKIDELLSKQKCY

SEQ ID NO: 18043 - DNA, 465 bp, Unknown
  Obtained from environmental sample
  misc_feature (1)..(465): n is a, c, g, or t
atgagttctcaatacttttttgaattcacaaaaggggttgagattgattacaatcctttaaccaaaattttattagttgaatacacattgcctaatattgaggacatccctaacattaaagaaactaaatatttaacttcaaaaaaagagtataaagatatcttaatctcaaaacgtgatttaagtaatctctttgataatgctatttataatatcacacttcgctctatctatgaaatattagttagtaattctattaatattgaggctattaattttaatggttggattaaaacaaataataaagcaacaggtttaataaacaaaacttgtattatttcaatacaagttaaacgtgatgaatttttagagataaatcttcaaaatgttgatgcaaaaacttgtcttaagcactttaaaggacttggaagtagtaaattatatggaatgactcccattcagcnn

SEQ ID NO: 18044 - protein, 155 aa, Unknown
  Obtained from environmental sample
  misc_feature (1)..(155): Xaa is any amino acid
MSSQYFFEFTKGVEIDYNPLTKILLVEYTLPNIEDIPNIKETKYLTSKKEYKDILISKRDLSNLFDNAIYNITLRSIYEILVSNSINIEAINFNGWIKTNNKATGLINKTCIISIQVKRDEFLEINLQNVDAKTCLKHFKGLGSSKLYGMTPIQX

SEQ ID NO: 18045 - DNA, 642 bp, Unknown
  Obtained from environmental sample
  misc_feature (1)..(642): n is a, c, g, or t
atgacatatcaaaacacatatataattttttgcaatcatctatttaatacaaaaagtaataattttatttttggaatcaatgctgatttagcaaatattttaatacctacattcatcacactactagtatttattttagggttattctttcaattctattttcagaaatctaaaagaaaatctgaattgaaaagtttaaagacaatgttatcagtgtggattgaaaaaagtgatataacaataagaagacaaattattgaataccgtaaattcatattcaatttagaatccttaaaaaacatttcaaatgtatcattagttttagattcatttcagctagataaattagataacattgaacttgaaagactgtctaatctaattatattaaatcatgtaggcgatgaaaaaaacaaaacctataccctctttaatataacggcacaaataaaaaaaatattaaatattgaaaaacaaattgttgaaaaatataattctttaagttacaatacggaagaatgccgaaaaaaatggaatgaaaattactcagaattaaattactatatttcggtattaccaattaaaaaagaaaaaaccactaataagattgaaaaaaattttatgaagagattgaaagtttaa

SEQ ID NO: 18046 - protein, 213 aa, Unknown
  Obtained from environmental sample
  misc_feature (1)..(213): Xaa is any amino acid
MTYQNTYIIFCNHLFNTKSNNFIFGINADLANILIPTFITLLVFILGLFFQFYFQKSKRKSELKSLKTMLSVWIEKSDITIRRQIIEYRKFIFNLESLKNISNVSLVLDSFQLDKLDNIELERLSNLIILNHVGDEKNKTYTLFNITAQIKKILNIEKQIVEKYNSLSYNTEECRKKWNENYSELNYYISVLPIKKEKTTNKIEKNFMKRLKV

SEQ ID NO: 18047 - DNA, 648 bp, Unknown
  Obtained from environmental sample
  misc_feature (1)..(648): n is a, c, g, or t
atgatggatcagcatctcctttttctggcgaataccatcacacataccgaattattgccagccttaaatgtggttggaactgaccgtttgttccaattcatgctttgtttgaaagagcacgatgctgataaaggcttagagctcatcaacaccttattgcaagaaggttacgatatccaagagtttttgattgggttaaccgagcacttacgaaatttatatattgctcatcattctgaaaaattatatttggtagaagcttcagaagagacaaaatctaaatataagagcaccgctacagacttttctagagatgacttgatgcgtatgctacacattgtaagtgaagctcaaatcaaactaaaagatgccagccaacctcgtatacagttcgagattaccttgcttaagctcatccacatggagcgttccgagaatatctctaaacttttagctgcgctcgaagacttaaaaaaaaactctagcaacctcgtaaataccactcctactaactctaaagcagctttaaagcccactgaggataaaaaagaatcttccgtaaaaattatccaaccagtttctacggacctaccagaacaaacacccgtaaacgatattaaggntgaagaaaccgtgctgttcagttga

SEQ ID NO: 18048 - protein, 215 aa, Unknown
  Obtained from environmental sample
  misc_feature (1)..(215): Xaa is any amino acid
MMDQHLLFLANTITHTELLPALNVVGTDRLFQFMLCLKEHDADKGLELINTLLQEGYDIQEFLIGLTEHLRNLYIAHHSEKLYLVEASEETKSKYKSTATDFSRDDLMRMLHIVSEAQIKLKDASQPRIQFEITLLKLIHMERSENISKLLAALEDLKKNSSNLVNTTPTNSKAALKPTEDKKESSVKIIQPVSTDLPEQTPVNDIKXEETVLFS

SEQ ID NO: 18049 - DNA, 420 bp, Unknown
  Obtained from environmental sample
  misc_feature (1)..(420): n is a, c, g, or t
atggtatgcagcggcaaaaccgatcatgcagaagcgatcaaaattatctacgaccccaagctcgtgagctacgaaaaactgctcgaacttttcttcaccattgctcatgatccgacccaactcaatcgccagggcaacgacattggcaagcaatatcgctccgccatttttgttcacgatgatgcagaaaaaacagtcgtccaaaaatatatcgacaagctcaccgcaagcaaaaaattcgataagcctatcgtgaccacgattgaacccttaaccgagttttatgatgcagaaacatatcatcaagactatgcacgcttaaacccctcgaatccctacatccaaggcgttgcagtccccaagctcaaaaagctgcaatccaagtacaacgatctgctaaaaaagatggcaggaaaataa

SEQ ID NO: 18050 - protein, 139 aa, Unknown
  Obtained from environmental sample
  DOMAIN (1)...(118): Peptide methionine sulfoxide reductase
  misc_feature (1)..(139): Xaa is any amino acid
MVCSGKTDHAEAIKIIYDPKLVSYEKLLELFFTIAHDPTQLNRQGNDIGKQYRSAIFVHDDAEKTVVQKYIDKLTASKKFDKPIVTTIEPLTEFYDAETYHQDYARLNPSNPYIQGVAVPKLKKLQSKYNDLLKKMAGK

SEQ ID NO: 18051 - DNA, 696 bp, Unknown
  Obtained from environmental sample
  misc_feature (1)..(696): n is a, c, g, or t
atgtgtatttgccaatggacttacgaagtttgccagacacgaaagattttgttttttaatctttcgccaaagccaaaaagaaagggattggccaaaattatccatttctttttcccaagaatattaacactctgtgaaaaaactaaaagaacatatacggcaaaaaaatactactcgaaaaaacgtaacattgtcaaggaagtcacgaagaaggccattgaaaaagggatttctgaagatgagatcaatctttggaaaaaacgcttgcccgaggagttagtcaatgccgcaaatagatatgaatttaacggtgctattctgtcaaatggcctacttaatcctgattactggataaaatctttagaggttagtacctctgaatcaaatcaaagatggacaaacatgaagtctgtattagatgtcgggtatgatttatgtgtaagcaatagcattgattttatagtagtctatatcccttcaccgatacaatataacccacgacatcacagtcctgagaatgtcttagtactagctggagtccaaatcaaaaatgagtggttgacaaaccaatcccagttccaggaaaaactcaacagatggtgcaaacaaaaaagcattccttgtatcgatcttactgagcctttcagaaaagcaccaaataaagataggctaaattacaagctggattcccactag

SEQ ID NO: 18052 - protein, 231 aa, Unknown
  Obtained from environmental sample
  misc_feature (1)..(231): Xaa is any amino acid
MCICQWTYEVCQTRKILFFNLSPKPKRKGLAKIIHFFFPRILTLCEKTKRTYTAKKYYSKKRNIVKEVTKKAIEKGISEDEINLWKKRLPEELVNAANRYEFNGAILSNGLLNPDYWIKSLEVSTSESNQRWTNMKSVLDVGYDLCVSNSIDFIVVYIPSPIQYNPRHHSPENVLVLAGVQIKNEWLTNQSQFQEKLNRWCKQKSIPCIDLTEPFRKAPNKDRLNYKLDSH

SEQ ID NO: 18053 - DNA, 303 bp, Unknown
  Obtained from environmental sample
  misc_feature (1)..(303): n is a, c, g, or t
gtgtgttatggaagtaaaaccaattgggtttttcatatgncggatgaaaaaggaccggatgaaaaaattatttgtgtgcctgtttctgatccaatttggaatgagttaagcgatttgtctgatatgaacccacatcaagtaaaagaaatcacacatttttttcaggtttataaagatttagaaaagaaaaaagttgatgtcggcggttggggaaatgcttcagaagcttatgatattgttgataaatgcatcgacagatatgaaaagagcgaacataaaaaaaatggaaactttactatttaa

SEQ ID NO: 18054 - protein, 100 aa, Unknown
  Obtained from environmental sample
  DOMAIN (4)...(89): Inorganic pyrophosphatase
  misc_feature (1)..(100): Xaa is any amino acid
MCYGSKTNWVFHMXDEKGPDEKIICVPVSDPIWNELSDLSDMNPHQVKEITHFFQVYKDLEKKKVDVGGWGNASEAYDIVDKCIDRYEKSEHKKNGNFTI

SEQ ID NO: 18055 - DNA, 573 bp, Unknown
  Obtained from environmental sample
  misc_feature (1)..(573): n is a, c, g, or t
atgggaagtaattttaacaaacctgaactgcttgcgaaggtggaccaggaagaaaggaaaatcatcaagttggagttgaagcgcattgaaggcgaaaacatcgtgccgtaccaagcttggtatgaggtggtttacatgccaccgtcaacgatttccttcgagtttgttagtgaaacttcgcaaaaatccggaatgaaaaaagctacccaggaagatattgaagtcaattcttccctggttcccaaagtcagcagtattcgtgactgggttggtgcagaccctagaatttctggcttacccttccagcttacttttcccgcaaaagcgggagtaaaggaaaatgaaaggcaacgtgaatacttcacggagggaagcgaaggcgaaaaacagaaggagataattagcaaacgtctggatcaactttataacgattattcggccgaatacagcagagtnaaccaagcggnaaacaaaacgatcagagaaaataaagctaaacagaggatgatccaccatccaggaaaaaagacgagggcatggaggcatagccaaaaagaagacgaattaaactaa

SEQ ID NO: 18056 - protein, 190 aa, Unknown
  Obtained from environmental sample
  misc_feature (1)..(190): Xaa is any amino acid
MGSNFNKPELLAKVDQEERKIIKLELKRIEGENIVPYQAWYEVVYMPPSTISFEFVSETSQKSGMKKATQEDIEVNSSLVPKVSSIRDWVGADPRISGLPFQLTFPAKAGVKENERQREYFTEGSEGEKQKEIISKRLDQLYNDYSAEYSRVNQAXNKTIRENKAKQRMIHHPGKKTRAWRHSQKEDELN

SEQ ID NO: 18057 - DNA, 429 bp, Unknown
  Obtained from environmental sample
  misc_feature (1)..(429): n is a, c, g, or t
atgaggtttttatttgtcttatttacgtttttgattttttcatgttcaaaaaacagcgaattacaatctattataaaacaagacgggaaatatggaattatagatttgaatggaaattttatagtagaggcatattgggatgacatttggtcaataagtgaagggtattaccccgtcaaaaaagattctttatggggatttatgaataaaaaaggaaaagttattatatatcctcaatacaaagaagttggattcttttatgaaggtacagtagaagcctcaaattttgaagataaatggggcattattaatactgaaaaagacaccttagtaccttttatttatgattatatttttggcggttttactaacggtttatcagatgttagtttagatgagaaatgtggatctctacatcacaaaattngn

SEQ ID NO: 18058 - protein, 143 aa, Unknown
  Obtained from environmental sample
  SIGNAL (1)...(19)
  DOMAIN (64)...(80): KWG Leptospira
  misc_feature (1)..(143): Xaa is any amino acid
MRFLFVLFTFLIFSCSKNSELQSIIKQDGKYGIIDLNGNFIVEAYWDDIWSISEGYYPVKKDSLWGFMNKKGKVIIYPQYKEVGFFYEGTVEASNFEDKWGIINTEKDTLVPFIYDYIFGGFTNGLSDVSLDEKCGSLHHKIX

SEQ ID NO: 18059 - DNA, 684 bp, Unknown
  Obtained from environmental sample
  misc_feature (1)..(684): n is a, c, g, or t
gtgagaaagcttacgaaggttgaacaaaataaattaaagttacttacaaaaaaccaaatttcagttgccttaattgagccaactgaaactggcctaaagaaatctattatggatgctacaggttcagtacgtagttttttaaaaagtgaaaacatccacgattacgaattacaaaaacaaggtccagataataagcaattaatcccgacggttattcatactggctttaaaactataaattcaaaagcatcattatatcgccccataacaaaaaacggggatccaagaatttggttctatagtttgacccagattgccgccccgaatgatatcattgcaataacttattttaacgatgcttttcaaattttgaatctgacaaaattagatgtggaagcattgattaattcttcagttctaaatccatttcaggatttaatcaaggcaattaatactattgaaaatgaagttgcattcgaacttttggcattgttacgaaaaatagcgagtgctggtcctattccttcgatggtagacgccgacacttccgttggacgaactcttgaaaccgcgctcggtatagacatcaattcctctaagaaaccagactacaaaggaattgagctaaagtcattcagaagtaacagaacaaatagaaagatcttttactcagttgccagctga

SEQ ID NO: 18060 - protein, 227 aa, Unknown
  Obtained from environmental sample
  misc_feature (1)..(227): Xaa is any amino acid
MRKLTKVEQNKLKLLTKNQISVALIEPTETGLKKSIMDATGSVRSFLKSENIHDYELQKQGPDNKQLIPTVIHTGFKTINSKASLYRPITKNGDPRIWFYSLTQIAAPNDIIAITYFNDAFQILNLTKLDVEALINSSVLNPFQDLIKAINTIENEVAFELLALLRKIASAGPIPSMVDADTSVGRTLETALGIDINSSKKPDYKGIELKSFRSNRTNRKIFYSVAS

SEQ ID NO: 18061 - DNA, 696 bp, Unknown
  Obtained from environmental sample
  misc_feature (1)..(696): n is a, c, g, or t
gtgattaagattttacagcctaaatattttgtaatggaaaatgtaaaagggatacttactaaagaaggtgggaaagtaaaagagttaattctcaaagaaatcaactcgattatagacattaatgaaattccacttctcaactcatttatcaaaaagttacgaactgaatctaattcatttctctttgattgtattgtaagaagagtcgagcttgaaaaactactcgaaaaggacaaagactcaggaagagaagatttcatcagatttgttgaaaataggtttaaaaaaatcaccccgagaattaccgattacaaaacaagtaaaactgacaaaaatataattactatccgccatggttttaatcttttagctcgtacaaagcagtgggataaattaaagcgagacataattagagagaaagatttttgtaatatagatagtgacaactttgttgatacattctccaattttttaaccgaaataggtcctgaaagtataatttcaaaaattgaaaatgcatttggatcattacaagtacccgctaattacaagcaagaatgtattgacattattactgctttacagatttacaccacatcctttgatgaaactgtagaggttttaaaatcacattggcaacaaaggtcaaaaaaaagacttaattacatcttagaaagcttcgactttatacaatga

SEQ ID NO: 18062 - protein, 231 aa, Unknown
  Obtained from environmental sample
  misc_feature (1)..(231): Xaa is any amino acid
MIKILQPKYFVMENVKGILTKEGGKVKELILKEINSIIDINEIPLLNSFIKKLRTESNSFLFDCIVRRVELEKLLEKDKDSGREDFIRFVENRFKKITPRITDYKTSKTDKNIITIRHGFNLLARTKQWDKLKRDIIREKDFCNIDSDNFVDTFSNFLTEIGPESIISKIENAFGSLQVPANYKQECIDIITALQIYTTSFDETVEVLKSHWQQRSKKRLNYILESFDFIQ

SEQ ID NO: 18063 - DNA, 699 bp, Unknown
  Obtained from environmental sample
  misc_feature (1)..(699): n is a, c, g, or t
ttgatgacgattgattcttttaataaatattcaggctctgttcaggataataatttttataagccaacagaaaaacttcagggtgaaaaactaccctttcaatacgttcaggaaacccgcccaattttaattctggatgagtcccaaaattatacttcagagttatcaaagcaggccttaagaaccttacatccactattcgctctaaaatattctgcaaccccaaaggaactagctcctacctatgagaagaaaatagagcttatgaaccgtttctaccatctttccccggtagatgctttcaaaatgaatctggtaaaaaagattgaggtacttggagttacacaggaacacaacgtgaatgacgaccaaatatcatttcgctttgttgaagggaaagttggttatggccctgccgttgaggcaaatctacaggttgtaaagaatggtgttgcaggtagagatactgttacactgcggggtggagaaaatttatttgagaaaactggtaatgaaaactaccagggaatggtggtggagaatattgataaaagaaataacctggtcattattagtggagaagagtttaatgttgttgaaggaggagacgtaactctttcaaaagaagagattttcagagtacagattgaagaaacgatcaaagctcatatgattaagcaaaagcaggttattcattag

SEQ ID NO: 18064 - protein, 232 aa, Unknown
  Obtained from environmental sample
  misc_feature (1)..(232): Xaa is any amino acid
MMTIDSFNKYSGSVQDNNFYKPTEKLQGEKLPFQYVQETRPILILDESQNYTSELSKQALRTLHPLFALKYSATPKELAPTYEKKIELMNRFYHLSPVDAFKMNLVKKIEVLGVTQEHNVNDDQISFRFVEGKVGYGPAVEANLQVVKNGVAGRDTVTLRGGENLFEKTGNENYQGMVVENIDKRNNLVIISGEEFNVVEGGDVTLSKEEIFRVQIEETIKAHMIKQKQVIH

SEQ ID NO: 18065 - DNA, 552 bp, Unknown
  Obtained from environmental sample
  misc_feature (1)..(552): n is a, c, g, or t
ttgataatacaaagaggattaaaacaaagcatattaattattttttccagtcttgttttattggcagttttaatttttccagcaaaaaatgttattgggaaacgattttcagaaattaaaacagaaattaacaaaccaattgttggagattattacaattctacaaatactcgaatggctattttaaaatgttcgtttattttattaaaagaggtacctctttttggttatggagatcgtttacaagaaaaattaaatgcttgttataaagaaaataacgacagcaatttttacctaaaacacacttttaacacacataattactatataaatttaataacgtacggcggatggatttttctcttagtctttatgtcatatctgttttatatgtataaaaaaatcaaatattcggcattaggattgtttttattcattcagtttttgataattaatatcacagaaaattatttctctagacattatggaattgttttattcgcttatttaacggctatgtttatctttatacacgaaaaagaaaaaacatga

SEQ ID NO: 18066 - protein, 183 aa, Unknown
  Obtained from environmental sample
  misc_feature (1)..(183): Xaa is any amino acid
MIIQRGLKQSILIIFSSLVLLAVLIFPAKNVIGKRFSEIKTEINKPIVGDYYNSTNTRMAILKCSFILLKEVPLFGYGDRLQEKLNACYKENNDSNFYLKHTFNTHNYYINLITYGGWIFLLVFMSYLFYMYKKIKYSALGLFLFIQFLIINITENYFSRHYGIVLFAYLTAMFIFIHEKEKT

SEQ ID NO: 18067 - DNA, 474 bp, Unknown
  Obtained from environmental sample
  misc_feature (1)..(474): n is a, c, g, or t
ttgataatttcatcaaaaacttttttaccaattcctttgattatcaataatccaacattggaaacagcttttggaggtattggaatgtatttttttaaatttgataaagaagataaaaaatcatcgccttcggttgctagtttgctgggtttgtattcaaccaacaaaagttatgtgcttattgcttcttcacgattgttttggaatgaaggtaaaaacagagctacttttattgccggaccgataagaatcaatcatgattttgtttatgaaaatgatgagggtgaggatttacatctagtttattctgagctacgcagcattatttctgcagaatacagcagaaagatttttaatgatttctatcttggtattttatatttaggaaccaaaaccaagtacaaattcgaccagggaagtgaagaagaaactaatttttccgaaagaatttttaaagaaaaccgatatccttga

SEQ ID NO: 18068 - protein, 157 aa, Unknown
  Obtained from environmental sample
  misc_feature (1)..(157): Xaa is any amino acid
MIISSKTFLPIPLIINNPTLETAFGGIGMYFFKFDKEDKKSSPSVASLLGLYSTNKSYVLIASSRLFWNEGKNRATFIAGPIRINHDFVYENDEGEDLHLVYSELRSIISAEYSRKIFNDFYLGILYLGTKTKYKFDQGSEEETNFSERIFKENRYP

SEQ ID NO: 18069 - DNA, 645 bp, Unknown
  Obtained from environmental sample
  misc_feature (1)..(645): n is a, c, g, or t
atggataaggttgagcttcagaagttaagagaagaatattcccttagtagtttagacgaaagtgatgtatcacaaaacccaatagatcagtttaagcaatggattgaggaagctttaaaagcaggcgttccagaaccaaatgcaatgaatttggctacagttgataaaaaaggaagaccacattcgcgcatagttctattaaaaggatttgatgaaaatgggttcgtgttttttacaaattatgctagtgataagggcaaggaaattgaagagaatccgcatgtttcactttgtttcttttggatagaattagagcgacaaatcagaattgatggtgttgccaaaaagatatcaaaagtagaaagtgaggcttattttaagtcacgtcctcatatgagtcagattggagcattagcttctaatcaaagtgaaattgttgaaaacagattgtttttagagcaaaaatttgaaaagctagaagctaagtttacggaaggtgaagttcctatgccagaatcatggggcggttatgtgattgatccctcagctttagaattttggcagggaagaagaagccgtttacatgacagagttaagtatgaatggaaagcagataactggattataaatagactatcaccttaa

SEQ ID NO: 18070 - protein, 214 aa, Unknown
  Obtained from environmental sample
  DOMAIN (35)...(121): Pyridoxamine 5'-phosphate oxidase
  misc_feature (1)..(214): Xaa is any amino acid
MDKVELQKLREEYSLSSLDESDVSQNPIDQFKQWIEEALKAGVPEPNAMNLATVDKKGRPHSRIVLLKGFDENGFVFFTNYASDKGKEIEENPHVSLCFFWIELERQIRIDGVAKKISKVESEAYFKSRPHMSQIGALASNQSEIVENRLFLEQKFEKLEAKFTEGEVPMPESWGGYVIDPSALEFWQGRRSRLHDRVKYEWKADNWIINRLSP

SEQ ID NO: 18071 - DNA, 579 bp, Unknown
  Obtained from environmental sample
  misc_feature (1)..(579): n is a, c, g, or t
ttgtttcaatttaatgaagggnttgatgaatacgacggggtagaaataggatatctatattctttgattgacaacgataaattaaagctgagattgtttgaagacccagctaaagttagccttgataaggcaccaaatattgttgttgaagataccttcttgagctcggcagaaaaggtcttggaaacgattaccaattaccgataccgaaacttatgggtaaaaggagttgattcttttgattttaatgaaaacgaagtaactcgattaggttcagaacatgtatgtaatatcagtggcaaacaatttaactttgtaactgtaaccaagagagggaatccaaatgagattgtatacggagaattgacaaaaaaccctcctcctgttgatgagctgtacaacttttatatcattacaccgatcaatgaagaatcttgtaaagtaagagtagaaattttttggaaagctaaatctttgattaagaaattacttatagcagtagtagttaagagagtactaaaaaggaatacgatggactcttttaagaacttgaaagaactagttgagaaacaagcttag

SEQ ID NO: 18072 - protein, 192 aa, Unknown
  Obtained from environmental sample
  misc_feature (1)..(192): Xaa is any amino acid
MFQFNEGXDEYDGVEIGYLYSLIDNDKLKLRLFEDPAKVSLDKAPNIVVEDTFLSSAEKVLETITNYRYRNLWVKGVDSFDFNENEVTRLGSEHVCNISGKQFNFVTVTKRGNPNEIVYGELTKNPPPVDELYNFYIITPINEESCKVRVEIFWKAKSLIKKLLIAVVVKRVLKRNTMDSFKNLKELVEKQA

SEQ ID NO: 18073 - DNA, 432 bp, Unknown
  Obtained from environmental sample
  misc_feature (1)..(432): n is a, c, g, or t
ttgggttcgttattgaaatatcaaaccgtatctttagctgaaaatacaaaacttaattgttcaaatgctatgttgcatgtaattggtataaaaaactgtgataccatccgtaaaacccaaaaatggttagttgaaaatgagatcgactatgaattcattgacctgaagaaagaacctcttactcttgatgaaattagtgaactttcatttaaagttgggctggatgttttagttaataggagaggaacgacttaccgaaacctaggtttaaaggataaagagctaactaatgaagagatggtcgcagtgttagagcaaaatcaatcaatgataaaacgcccagtccttattttggatgaagcagtactcgttggatttgatgaagaagcattcaaaaattttatcggtattgaagaatctacagaagaataa

SEQ ID NO: 18074 - protein, 143 aa, Unknown
  Obtained from environmental sample
  DOMAIN (28)...(136): ArsC family
  misc_feature (1)..(143): Xaa is any amino acid
MGSLLKYQTVSLAENTKLNCSNAMLHVIGIKNCDTIRKTQKWLVENEIDYEFIDLKKEPLTLDEISELSFKVGLDVLVNRRGTTYRNLGLKDKELTNEEMVAVLEQNQSMIKRPVLILDEAVLVGFDEEAFKNFIGIEESTEE

SEQ ID NO: 18075 - DNA, 366 bp, Unknown
  Obtained from environmental sample
  misc_feature (1)..(366): n is a, c, g, or t
atgcatatgaaaaaaaatatattctttttaattggctgtttttgtcttgcagggttccctgtgctagcgcaaagcacacttgagtcagaacaactaacatctacccaaaatctaagatttgaattcactgccaattatattaatcaatttgatttcggttattctaaagccaaggttaagaaaagtgcttttcttacaacagccggatacttgctccaaggatttaaattttcttcccctatagatcaatttaatgctacggctccatttgacatacgaggatatcagcccaaagacttttcttcgtttgtatcttatataaatgacacgagtttacttcaacacaaaattactcctatcaaatga

SEQ ID NO: 18076 - protein, 121 aa, Unknown
  Obtained from environmental sample
  misc_feature (1)..(121): Xaa is any amino acid
MHMKKNIFFLIGCFCLAGFPVLAQSTLESEQLTSTQNLRFEFTANYINQFDFGYSKAKVKKSAFLTTAGYLLQGFKFSSPIDQFNATAPFDIRGYQPKDFSSFVSYINDTSLLQHKITPIK

SEQ ID NO: 18077 - DNA, 375 bp, Unknown
  Obtained from environmental sample
  misc_feature (1)..(375): n is a, c, g, or t
atgtcaaatccaaagtttattaatgagctcaaccaaaaagtaaatatttttgctgaaattgatggcagtcctaaacaaggggttggtccaggaggaaagtcagaagtaacagcagcggatagatcatctgatttagacgagttagagtttgtggattatgatattaagaaagaagttaaaatcattatagaagtcgataaactccctaataattcaaaaggtgaaggtattaaatatgcttttggagaaaggatgggaagagctcctcaccatatcgaggttcaaagaaaaggaaatgattttactctgatcgttcattatatggaaagtggtgctttggtagatgttgatccagcaatcaaacatccaaattaa

SEQ ID NO: 18078 - protein, 124 aa, Unknown
  Obtained from environmental sample
  misc_feature (1)..(124): Xaa is any amino acid
MSNPKFINELNQKVNIFAEIDGSPKQGVGPGGKSEVTAADRSSDLDELEFVDYDIKKEVKIIIEVDKLPNNSKGEGIKYAFGERMGRAPHHIEVQRKGNDFTLIVHYMESGALVDVDPAIKHPN

SEQ ID NO: 18079 - DNA, 585 bp, Unknown
  Obtained from environmental sample
  misc_feature (1)..(585): n is a, c, g, or t
atgcatgtgccaaaatttgatcaatatccactaattaagattgcgttggatgaaatggagcctgatagagctaagttatctaatccagaatacatgaattctttagttaattgcgctgagcaattacagactgaggaattgatttcttcggcagaacgtgttcttgagatagcggataatagatctttaagcattcgtaaacttgctaatgtagaattaccaaaattgaaaagaattctcttagctccaatctattttcttgtttggttaaatagcatcattccatatcaacctgcaagacatataataaaaactaaaatcgaggataaggcttttgatgtttctattaaatttgtgcttgggttatttatatttccactcttctatttaatcatcacacttatacttcttctttttgatgtaccctcgatttgggcttggggatattttactgttagcctgttcacttccattatgttcaaaaaagccaatgaagttgttagaagtttgaaagagcataaaaaaatccagcaatttaaaaaatcacatcccaacgaataccaggaagtaaaagaaaaaccttaa

SEQ ID NO: 18080 - protein, 194 aa, Unknown
  Obtained from environmental sample
  misc_feature (1)..(194): Xaa is any amino acid
MHVPKFDQYPLIKIALDEMEPDRAKLSNPEYMNSLVNCAEQLQTEELISSAERVLEIADNRSLSIRKLANVELPKLKRILLAPIYFLVWLNSIIPYQPARHIIKTKIEDKAFDVSIKFVLGLFIFPLFYLIITLILLLFDVPSIWAWGYFTVSLFTSIMFKKANEVVRSLKEHKKIQQFKKSHPNEYQEVKEKP

SEQ ID NO: 18081 - DNA, 444 bp, Unknown
  Obtained from environmental sample
  misc_feature (1)..(444): n is a, c, g, or t
ttggtgacctgtgctttgtggaattcccaatacatcgattattgtttgaaattaagcatggaatggattgaaaggcctaagtttattaatggaacagtgaataagctaccctttcccgatcttcccgataatctaaaaaaagagttaaaagaaatcgcaatcagacaattttatcgagtgaagacagtgagccaaggtgatgaaaagagcataaatttttcatcatttgatttcttcgatcgacctgggatttctatcgccgaggagtatatcgttaaaaggaatgagattcaagatattaagaaggactatctgcaagatttggaccaattgaatgaacttgtatattctcagttcaatgtctcaacaaaagagcgaaaagatattaatgaaatcacatcaaaggcaggaaaatcaacagaaggaagattttcgattcaataa

SEQ ID NO: 18082 - protein, 147 aa, Unknown
  Obtained from environmental sample
  misc_feature (1)..(147): Xaa is any amino acid
MVTCALWNSQYIDYCLKLSMEWIERPKFINGTVNKLPFPDLPDNLKKELKEIAIRQFYRVKTVSQGDEKSINFSSFDFFDRPGISIAEEYIVKRNEIQDIKKDYLQDLDQLNELVYSQFNVSTKERKDINEITSKAGKSTEGRFSIQ

SEQ ID NO: 18083 - DNA, 450 bp, Unknown
  Obtained from environmental sample
  misc_feature (1)..(450): n is a, c, g, or t
atgaatcgtatacgcgatgaatcaaaaagactaaaaaaacactcttacttagaaatacaatatgaaaacatactaaaaaatgcagaagaaacattgagacaaatagaagattttacagacttacctattatctctactaataatagtgattatggaattaatataaacaaaagaagtccagtgaaggatttaatcggtgaacttccatttctatctagaaacaagctgagagaattaaatcaaggatttggtgaatgctattttcataattatatgtcctatcaagaactattagaagattataacaaaatatcaaaatatcaagagctaagctcaagtgagattaaagaaatttgtgttaatatcttggcctcaaatataaaaggaattgataatgaaatattcattaatacaacttcaattctaaaatcagtttacaaatcaagctaa

SEQ ID NO: 18084 - protein, 149 aa, Unknown
  Obtained from environmental sample
  misc_feature (1)..(149): Xaa is any amino acid
MNRIRDESKRLKKHSYLEIQYENILKNAEETLRQIEDFTDLPIISTNNSDYGININKRSPVKDLIGELPFLSRNKLRELNQGFGECYFHNYMSYQELLEDYNKISKYQELSSSEIKEICVNILASNIKGIDNEIFINTTSILKSVYKSS

SEQ ID NO: 18085 - DNA, 642 bp, Unknown
  Obtained from environmental sample
  misc_feature (1)..(642): n is a, c, g, or t
gtgttgttgctctattccggcattatattgttcctgggattcgatcatttgaaaaaacaggcgaagcatgttcagggccacacaactcatatttcattgtttgtcacttttcttttgggcatgatggtttccattcacctctacagagagggactagccgtagccgtaattgtgacaacacttcttgccttaaaagacaaattcaaatcaacccttaaaaaaattacggaacaggaattgtatgcgaccatcaaattctttattctttccctattgatattgcccttcttacccgatcaaaagttcggcccaaacggcatattgaacctgtatgagatcggctgggttgtggttattgtatcggtcttgaacttcattgggtatttctttaccaaatttgttggctcaaagaaagggataattgttaccgcaattttgggcggtttaatatcaagtactgcggttgcgtggtcattttcgtcccgaagcaaagaaaaaccgggaactgaccagcacctatactgcgggaatactaatagcctctgcaattatgtttccaaggctgccgattgtatcctatatcttcaatccagctgttctccaaacattgtggttcccattttaattagatgtatatcgtag

SEQ ID NO: 18086 - protein, 213 aa, Unknown
  Obtained from environmental sample
  misc_feature (1)..(213): Xaa is any amino acid
MLLLYSGIILFLGFDHLKKQAKHVQGHTTHISLFVTFLLGMMVSIHLYREGLAVAVIVTTLLALKDKFKSTLKKITEQELYATIKFFILSLLILPFLPDQKFGPNGILNLYEIGWVVVIVSVLNFIGYFFTKFVGSKKGIIVTAILGGLISSTAVAWSFSSRSKEKPGTDQHLYCGNTNSLCNYVSKAADCILYLQSSCSPNIVVPILIRCIS

SEQ ID NO: 18087 - DNA, 402 bp, Unknown
  Obtained from environmental sample
  misc_feature (1)..(402): n is a, c, g, or t
ttgacagtagttactgtagagataaatcgggatacaattttagaggttctaaatgtcacatcaatcggtcttgtaatcagtgggggaaccgtttacggaaatttggaaaatggaagactttcaaccgagaaaggatttttagtgattcaaactattggattgtccaaaaaggaaatgaggaagtacgatttacaagaaatagataatattgaagctgttcccaaagagtatatgtggaataaaatatatgggcgagagaacccatcatatgttagatatagaatgagtactagatatagagaaaaagatgttttctttgctgatggattggatcataaatcggctttttatgtactaagtaaaatgaaagagaatccaattttagcagagaaattgaaatag

SEQ ID NO: 18088 - protein, 133 aa, Unknown
  Obtained from environmental sample
  misc_feature (1)..(133): Xaa is any amino acid
MTVVTVEINRDTILEVLNVTSIGLVISGGTVYGNLENGRLSTEKGFLVIQTIGLSKKEMRKYDLQEIDNIEAVPKEYMWNKIYGRENPSYVRYRMSTRYREKDVFFADGLDHKSAFYVLSKMKENPILAEKLK

SEQ ID NO: 18089 - DNA, 387 bp, Unknown
  Obtained from environmental sample
  misc_feature (1)..(387): n is a, c, g, or t
gtgtggcgagaaagactagaaatcaatatcccaaaaattacagcaacagatgcagcacaacgattactgaatgtagttcctgattacgatttggttctatatgagtattatcttaccgataaagccgggcataataaaagtcccgaagatgctgaaagagtgcttaaaccactagacgaatttttgcttcacatcatcaaacacaaaagaagtgaagatgtcttagtaataacaagcgatcatggaaatctggaagatctttcggttaaaactcacaccagaagagatgtacccctatttgtaatgggagaaggaattgagcactttaataaagtggaaagtttggttggggttaaggaagggataatgaaaagtgtaaataagtga

SEQ ID NO: 18090 - protein, 128 aa, Unknown
  Obtained from environmental sample
  DOMAIN (7)...(118): Metalloenzyme superfamily
  misc_feature (1)..(128): Xaa is any amino acid
MWRERLEINIPKITATDAAQRLLNVVPDYDLVLYEYYLTDKAGHNKSPEDAERVLKPLDEFLLHIIKHKRSEDVLVITSDHGNLEDLSVKTHTRRDVPLFVMGEGIEHFNKVESLVGVKEGIMKSVNK

SEQ ID NO: 18091 - DNA, 372 bp, Unknown
  Obtained from environmental sample
  misc_feature (1)..(372): n is a, c, g, or t
atgagtttaccaaaacgtgttttatattatttattaggattttctatcggtgcaattgtagtgtactttatttggtctggaaaaggggtttcttttgattacggaatggacgcaagaacgctaaaacaaatacgaattagagaaaaagtatacactccagaagcacaagctgttttaactaagaataacttagattctgttgcagtaaacactattcttaaaaatggtgatgttaattttagcgaaagtaaaccaaggataaaaccatgtccagaatatttaattagtggaaatggacgttttaaaaatattcaactgtatattcaacgttgtgattctattgcgacaattcaaaaagtgattattaagtaa

SEQ ID NO: 18092 - protein, 123 aa, Unknown
  Obtained from environmental sample
  misc_feature (1)..(123): Xaa is any amino acid
MSLPKRVLYYLLGFSIGAIVVYFIWSGKGVSFDYGMDARTLKQIRIREKVYTPEAQAVLTKNNLDSVAVNTILKNGDVNFSESKPRIKPCPEYLISGNGRFKNIQLYIQRCDSIATIQKVIIK

SEQ ID NO: 18093 - DNA, 687 bp, Unknown
  Obtained from environmental sample
  misc_feature (1)..(687): n is a, c, g, or t
gtgtttaccgtagatttgatatatggtaatcctggacaaagcgttgctatgctggaaaaggatttagacacacttctcggctttaatcccccacatatttccgcctattcgttgacaattgagccaagaacacggcttggtaaacaactagaattgggaagactaatccctgcagaagacgatgaagttgaaatccatttcgatttgcttgaacagaaattggctgaaaaagggattgatcgatatgaagtaagtaactttgctcaaaaagggaaagaagctattcataacaccaactattggagccataaaaattatttggggcttgggcctggtgcacattctttttggtggaatgaagaaaaaacaggtgctttcagatgggagaacaaacccaatctagaaaattacttaatccgaaaaaattctacggagataaataaagaatacttaaatttaggtagccttgctgaagaacgaattatgctaggcttacgaactatgaaaggtattgatttaaatgcatttgataagaagtataattttacattcaacaatgttcagaaagagtatcttaaaaaaatgcactcagacggtaaattgattctagatactaagttgaaccttacatcaaaagggctaaaaatagcagatgctattgtactcgacttaattagtcttgcctaa

SEQ ID NO: 18094 - protein, 228 aa, Unknown
  Obtained from environmental sample
  DOMAIN (98)...(215): HemN C-terminal region
  misc_feature (1)..(228): Xaa is any amino acid
MFTVDLIYGNPGQSVAMLEKDLDTLLGFNPPHISAYSLTIEPRTRLGKQLELGRLIPAEDDEVEIHFDLLEQKLAEKGIDRYEVSNFAQKGKEAIHNTNYWSHKNYLGLGPGAHSFWWNEEKTGAFRWENKPNLENYLIRKNSTEINKEYLNLGSLAEERIMLGLRTMKGIDLNAFDKKYNFTFNNVQKEYLKKMHSDGKLILDTKLNLTSKGLKIADAIVLDLISLA

SEQ ID NO: 18095 - DNA, 630 bp, Unknown
  Obtained from environmental sample
  misc_feature (1)..(630): n is a, c, g, or t
ttgctgaatgtgctgctgcactattcggtatttgatgtgagcgatacgctgctcgtgatgcgcccctatcagatagcggccaccgaacgcattttgtggaagataaaaagctcgtttgaggcgaagaactggagcaaccccgaaagcggtggctttatctggcataccactggctccggcaagaccttaaccagctttaaagcagctcgcctagccaccgagctggagtttatcgacaaggtgttctttgtggtcgaccggaaagacctcgactaccagaccatgaaggaataccagcgcttctcgccggatagtgtcaatggttcagatagcaccgctggcctcaagcgtaatatcgaaaaagacgacaacaaaatcatcgtcaccaccattcaaaagctcaacaacctgatgaagagcgaaggtgatctggctatttacaataagcaggtggtgtttatctttgacgaatgccaccgcagccagtttggtgaggcgcagaaaaacctgaataagaagttcaaacgtttctaccagtttggctttaccggcacgcctatcttcccgcaaaacgcattgggtgcagaaaccaccgccagcgtgttggccgcgagttgcattcttacgtga

SEQ ID NO: 18096 - protein, 209 aa, Unknown
  Obtained from environmental sample
  DOMAIN (20)...(192): DEAD/DEAH box helicase
  misc_feature (1)..(209): Xaa is any amino acid
MLNVLLHYSVFDVSDTLLVMRPYQIAATERILWKIKSSFEAKNWSNPESGGFIWHTTGSGKTLTSFKAARLATELEFIDKVFFVVDRKDLDYQTMKEYQRFSPDSVNGSDSTAGLKRNIEKDDNKIIVTTIQKLNNLMKSEGDLAIYNKQVVFIFDECHRSQFGEAQKNLNKKFKRFYQFGFTGTPIFPQNALGAETTASVLAASCILT

SEQ ID NO: 18097 - DNA, 621 bp, Unknown
  Obtained from environmental sample
  misc_feature (1)..(621): n is a, c, g, or t
atgaaggataaaatattacataaagcggctgaaatgtttttaaacctagggtttaagagtgttacgatgggtgatattgcacatgaattgggtgtttctaaaaaaacaatttatactcattttagcaataaaacagcgttgataaaagaagtgactgaatctgtttttgaaattatttgttcaggaattaatatcatttgtagtaaagaagataatccgatagatgaattgtatgaaataaaacggttttctatggagtatttaaagaacgaaaaaacatctccacaacatcaattgcaaaagtattatccaaagatttatgcaacattaaaaagcaaacaatttgatataatgcaagattgtgtggttaaaaacttaaaacgaggagtcgcattaggtttttaccgagatacgattgatgttgattttatttcaagaatttattttcatggaataattggtctaaaagacattgagctgtttccgttaacgcaattttctatgaataatataatgggcttctatttagaatatcatttaagaggaatttgtacagaaaaaggaattcataaattaaacgaagttataacaaacaatcaaccagaaaaaaatgcaaaataa

SEQ ID NO: 18098 - protein, 206 aa, Unknown
  Obtained from environmental sample
  DOMAIN (5)...(51): Bacterial regulatory proteins, tetR family
  misc_feature (1)..(206): Xaa is any amino acid
MKDKILHKAAEMFLNLGFKSVTMGDIAHELGVSKKTIYTHFSNKTALIKEVTESVFEIICSGINIICSKEDNPIDELYEIKRFSMEYLKNEKTSPQHQLQKYYPKIYATLKSKQFDIMQDCVVKNLKRGVALGFYRDTIDVDFISRIYFHGIIGLKDIELFPLTQFSMNNIMGFYLEYHLRGICTEKGIHKLNEVITNNQPEKNAK

SEQ ID NO: 18099 - DNA, 717 bp, Unknown
  Obtained from environmental sample
  misc_feature (1)..(717): n is a, c, g, or t
ttgcgaagaggaaaagaaactgtgcatgaaanatggaatatcaattctggcatattatctggcgacgcgatgttgattttagcatatcaatattttgaaaattatccagcagaaatttttcaaaaattagcaaaactatttagtaaaacggctattgaagtttgtgacggacaacaattagatgtagattttgaaactagaaataatgtttctatcgaagaatacatcaaaatgatttctttaaaaacatcggttttaattggtgccgctttaaaaatgggtgcaatcgtttgtgaatctaacgaaaaagatgccgatattttatatgattttggattgaacctaggaattgcttttcaattacaagatgattatttagatacttacggaaatcctgaaacttttggaaaacaagttggcggagatattattgaaaataaaaagacctatttgtatttaaaagcattagaattagcttcaaaagaagattcagaactgttaaacaagttttatcaatctaagttagaggatagtaatgagaaaataaagttagtaagaaaagtctttgacaaataccagattccaacttatatgaaagcccaaataactaattatagccaaaaagcttttgctgttttagaggatataactatttctgaaggtgcaaaaaaaggattgttagaatttggaaaagcgttaatgacacgtaacgtataa

SEQ ID NO: 18100 - protein, 238 aa, Unknown
  Obtained from environmental sample
  DOMAIN (1)...(193): Polyprenyl synthetase
  misc_feature (1)..(238): Xaa is any amino acid
MRRGKETVHEXWNINSGILSGDAMLILAYQYFENYPAEIFQKLAKLFSKTAIEVCDGQQLDVDFETRNNVSIEEYIKMISLKTSVLIGAALKMGAIVCESNEKDADILYDFGLNLGIAFQLQDDYLDTYGNPETFGKQVGGDIIENKKTYLYLKALELASKEDSELLNKFYQSKLEDSNEKIKLVRKVFDKYQIPTYMKAQITNYSQKAFAVLEDITISEGAKKGLLEFGKALMTRNV

SEQ ID NO: 18101 - DNA, 675 bp, Unknown
  Obtained from environmental sample
  misc_feature (1)..(675): n is a, c, g, or t
ttgttgattccggtaaccatgcccaaggaactcagaagttcttttaaacttatccattccataatttaccccaaaggttccgtaaagatcttggcgctaagaaatgaaaatgagaccgagcaaagaaacatggaaattttccttaaaaatgcggtcaagaaatttaaagaaagtgatttgtccgtttcctattcggtcatagataataccgatttcaacaccaccgtaaatgtaagtatgcaatccttaaatgcagcattctttaagcccaatattattttcgtgagtatagaccctgctatgtccaatttatcatattacaacaaactgattgcagataccaagaagaataattttggaatggttatttatatcccctttgccacggcaagtctggccattgaaaaaagtattaatttatggatgaccgatatccctgctgattggaaagagacttttagcgttagaaacaataacctgtcctccctgacatcacttttaatttgccgaaattggaaaggcaatatagatgtgcatattcttaacaatgatcccaaattggtatttgatgaaaaggacatagaagatttaaaaaccatggtccgattcccaaagcacactaccattaaaacacatcagggcaaactgctggaaaatgttgtaagggagaaaaat

SEQ ID NO: 18102 - protein, 225 aa, Unknown
  Obtained from environmental sample
  misc_feature (1)..(225): Xaa is any amino acid
MLIPVTMPKELRSSFKLIHSIIYPKGSVKILALRNENETEQRNMEIFLKNAVKKFKESDLSVSYSVIDNTDFNTTVNVSMQSLNAAFFKPNIIFVSIDPAMSNLSYYNKLIADTKKNNFGMVIYIPFATASLAIEKSINLWMTDIPADWKETFSVRNNNLSSLTSLLICRNWKGNIDVHILNNDPKLVFDEKDIEDLKTMVRFPKHTTIKTHQGKLLENVVREKN

SEQ ID NO: 18103 - DNA, 483 bp, Unknown
  Obtained from environmental sample
  misc_feature (1)..(483): n is a, c, g, or t
atgttttctgattttgcaaaatccaaatcaacggaactagtaaaggttaatcttaaaactgttattgactcatcagtggatttgtttaatagtaacacaaatgtttcaattactgttaaatatgaagaaagtgaaaaagagctaattacttatggttttgaaaaagaattgcatcgagttattaataacattctaaaaaatgcaatacaatcggtagataaaaataaagttgccataattaatattgatattaaacaacattccaaatttattactgtatcaatagctgacaatggaaaaggtatttcggaagaaatgaagtcacaaatatttcatccatattttaccaccaaaactagtggtaccggattaggactagcaattgtgaaaaatataatgaacgaaataggaggcaaggttagtttcgaatcggtgaaccatggtggtacaaggtttattctaaagtttccggttgcgaaatag

SEQ ID NO: 18104 - protein, 160 aa, Unknown
  Obtained from environmental sample
  DOMAIN (52)...(159): Histidine kinase-, DNA gyrase B-, and HSP90-like ATPase
  misc_feature (1)..(160): Xaa is any amino acid
MFSDFAKSKSTELVKVNLKTVIDSSVDLFNSNTNVSITVKYEESEKELITYGFEKELHRVINNILKNAIQSVDKNKVAIINIDIKQHSKFITVSIADNGKGISEEMKSQIFHPYFTTKTSGTGLGLAIVKNIMNEIGGKVSFESVNHGGTRFILKFPVAK

SEQ ID NO: 18105 - DNA, 723 bp, Unknown
  Obtained from environmental sample
  misc_feature (1)..(723): n is a, c, g, or t
atggttggagttgccaaagcaatgaaaaagagaggcatggatcttcctttaattattggtggagcaactacttcaaaaatacatacagcggtaaaaattgatccgaattatgaatcgccggtagttcatattctggatgcttctcgggcagttacggtctgtactgatttgttgaaagacactaaagctacgtttgcatccgctgttaagacggaatactccaaaatgagagacagtcattcaaatcggcatcaaaagaagaaatacctgagttttgaagacgctaagaagaatacaacttctatcgattggttaacaacgaatattacaaaacctgagaaaataggagtacaggtttttgatgaagtgagtttatcgacattacgagagttcattgattggtctccgttttttagaacctggatgttaacaggcaaatatcctgcgatacttgaggacgaaatcgtaggagaacaggcgatcgaattgttcaaagatgccaatgatctgttggacgaaatcatttccaataatgatttaaaacctaaaggagtgattggtttatttcctgccgtacgtgatggggaagacgtgatcgtttttgaagatgacgaaagaacggttgaaaagacccgatttcattttatccgacaacaagcagagaagagagcaagtcagncaaattctagtntagtagattacatcgntccnaaaagaagctaa

SEQ ID NO: 18106 - protein, 240 aa, Unknown
  Obtained from environmental sample
  DOMAIN (93)...(240): Vitamin B12 dependent methionine synthase, activation domain
  misc_feature (1)..(240): Xaa is any amino acid
MVGVAKAMKKRGMDLPLIIGGATTSKIHTAVKIDPNYESPVVHILDASRAVTVCTDLLKDTKATFASAVKTEYSKMRDSHSNRHQKKKYLSFEDAKKNTTSIDWLTTNITKPEKIGVQVFDEVSLSTLREFIDWSPFFRTWMLTGKYPAILEDEIVGEQAIELFKDANDLLDEIISNNDLKPKGVIGLFPAVRDGEDVIVFEDDERTVEKTRFHFIRQQAEKRASQXNSSXVDYIXPKRS

SEQ ID NO: 18107 - DNA, 495 bp, Unknown
  Obtained from environmental sample
  misc_feature (1)..(495): n is a, c, g, or t
atgaaaggagttaaaattattttaggaattgtaaccgctttggtaatcgtgtttttttcaacaggattaattatcaaagaaacaacatatcaagtaaaagtagaaattgaaaaaccattagatgcggttttttctgtgtttaataatcaagaattaatgaaagaatggttgacggatgttaagtcgataacaccaataagtgttaaaccaggaattgttggcagcgaatataaaatgcttgtagaaaatcaaggaaaagaaatggacatgaatgaaaaagtaatggcttttattccaaataaaaaagtaactttattttttgatgcggacgacatgttaaaaacagatgaatataatttcagtttttctgaagcgaaaaccagcaattataacagatgtaatttgcaaaagttattcgtattcgatgagttgttggtttccttatttacaaggaacgtttaccgatttgatcacaaatttttagaagattctatn

SEQ ID NO: 18108 - protein, 165 aa, Unknown
  Obtained from environmental sample
  misc_feature (1)..(165): Xaa is any amino acid
MKGVKIILGIVTALVIVFFSTGLIIKETTYQVKVEIEKPLDAVFSVFNNQELMKEWLTDVKSITPISVKPGIVGSEYKMLVENQGKEMDMNEKVMAFIPNKKVTLFFDADDMLKTDEYNFSFSEAKTSNYNRCNLQKLFVFDELLVSLFTRNVYRFDHKFLEDSX

SEQ ID NO: 18109 - DNA, 612 bp, Unknown
  Obtained from environmental sample
  misc_feature (1)..(612): n is a, c, g, or t
gtggatcaagaatcggctcagtatatgaaaaggattagattggaaagtggttataaatgtaaatatgaagaaataccagaagaagtactttcatataatggaaggaaaattataacaggagaaggatttaactgggggtatggaggttcaggacctcaatatttggcagaagaaatagcaagacatcatactaataacaattatactgaggaagagtggagaagatttttgaatgaagaaattaataaaaaagaatataaaaacaaagatttatttataagtgattacactgtatctaggtattttggaaattcacataatttaagtagatttcaaattatagaacaatatgtgaatgaatatgctaaatatagaaaagagatattagataatccattagattttgcttatttagttaaaagttatttaactgaaaagttgtatgaacctacagagtatttaatatttaattatctaaaggagtactttaaaaatgactattctccttcaattcatcagaacaagaataattctaatgaaagacaagaacttctaaatgcaataaagattttgtgtagacattttgatattaaaagtaatgaactttgctaa

SEQ ID NO: 18110 - protein, 203 aa, Unknown
  Obtained from environmental sample
  misc_feature (1)..(203): Xaa is any amino acid
MDQESAQYMKRIRLESGYKCKYEEIPEEVLSYNGRKIITGEGFNWGYGGSGPQYLAEEIARHHTNNNYTEEEWRRFLNEEINKKEYKNKDLFISDYTVSRYFGNSHNLSRFQIIEQYVNEYAKYRKEILDNPLDFAYLVKSYLTEKLYEPTEYLIFNYLKEYFKNDYSPSIHQNKNNSNERQELLNAIKILCRHFDIKSNELC

SEQ ID NO: 18111 - DNA, 837 bp, Unknown
  Obtained from environmental sample
  misc_feature (1)..(837): n is a, c, g, or t
ttgaggaaaagaacgaagaagtcggcgatccggaagtntgctgagaagaaaactttcgaagaaattgagcaggatgcacgagccaaggtcatgaagatgtatgacgactgggccggccgcatggaaaaactggacatcaacgatcgccgcactgttttcatcaatacgattaccaatacctacgatccccataccggatactaccccccgaaagacaaagaaaactttgacattcagatgtctggtaagttggaaggcattggcgctacccttcaggaaaaagacggctatataatggtagtccgcattgttccgggaagcgcgtcctaccggcagggtgaactggaagaaaatgacctgatcctcaaagtaggacagggcaaagaagagcccgttgacattgttgacatgggcattgacgatgcggtcaagcttatccgtggccccaaaggaacggaagttcggctgacggtgaaaaaagtaaacggggccaagattgtgattccgattgtccgtgacctggtcattctggaagaaacttttgccaaatcggccatcatcaaaaatgaaatggcaccggaaggcatcggctacatcaaattgcccaaattctatgcggatttcaacgaccgcaatggccgtacctgtgccaaagatgtcaagacggaaatcaccaaactcaaagccgaaaatgtaggcggtctgattctggacctgcgcaacaatggcggtggttcgctgatggacgtagtcgacatggctggtctgtngggcgaatccggcccattgtacagggtcaaggtcgctacggacgtcctcaggtccttgacgaacggn

SEQ ID NO: 18112 - protein, 279 aa, Unknown
  Obtained from environmental sample
  DOMAIN (77)...(159): PDZ domain (Also known as DHR or GLGF)
  misc_feature (1)..(279): Xaa is any amino acid
MRKRTKKSAIRKXAEKKTFEEIEQDARAKVMKMYDDWAGRMEKLDINDRRTVFINTITNTYDPHTGYYPPKDKENFDIQMSGKLEGIGATLQEKDGYIMVVRIVPGSASYRQGELEENDLILKVGQGKEEPVDIVDMGIDDAVKLIRGPKGTEVRLTVKKVNGAKIVIPIVRDLVILEETFAKSAIIKNEMAPEGIGYIKLPKFYADFNDRNGRTCAKDVKTEITKLKAENVGGLILDLRNNGGGSLMDVVDMAGLXGESGPLYRVKVATDVLRSLTNG

SEQ ID NO: 18113 - DNA, 798 bp, Unknown
  Obtained from environmental sample
  misc_feature (1)..(798): n is a, c, g, or t
gtggttgtcgacactagtggatcaagaatcggtccaggaataaaacagatcactactgtatgcacgcagctattcaccgatattccggtcgattcccgcaacaaaaaggccattgactattaccggggacaaacccgcaagttttggctgaatttcggccattaccaacagggaatgatcgccctggccctgcaccgcgagaaggataccgaagtcccgcaggacatcgtgaagtcattgcgcgaacacgccttgcaaagcgatgaaatgggcatgtactggaagcgcaccaatcgctggtgcctctactggtacgaagcgcccatcgaaacgcaggcactgctcattgaagtctttgacgaagtgggcaatgacaaggcagcggttgaggaaatgaagatctggttgctcaagcaaaagcaaacccaggactggaaaaccaccaaggcgacggtagaagcatgttatgcgttgttgctgcagggcaccgatctgctggcagaaagtgaattggccgaaatcaccatcggagggaagcgctacgatccgattgcggacccctctaccaaggtggaagctggaaccggttacttcaaaacttcctggggcaaaggcgaaatcactcccaaaatgggtgtggtcgaagtcaaaaacaacaacaatgtggtggcttggggagcagtttactggcagtatttcgagcaattggacaaaattacctttgccgaaaccaacctgaagctgcagaaaagctgtttttggaagagaatcacctaccggacccaaatcaagaagtga

SEQ ID NO: 18114 - protein, 265 aa, Unknown
  Obtained from environmental sample
  misc_feature (1)..(265): Xaa is any amino acid
MVVDTSGSRIGPGIKQITTVCTQLFTDIPVDSRNKKAIDYYRGQTRKFWLNFGHYQQGMIALALHREKDTEVPQDIVKSLREHALQSDEMGMYWKRTNRWCLYWYEAPIETQALLIEVFDEVGNDKAAVEEMKIWLLKQKQTQDWKTTKATVEACYALLLQGTDLLAESELAEITIGGKRYDPIADPSTKVEAGTGYFKTSWGKGEITPKMGVVEVKNNNNVVAWGAVYWQYFEQLDKITFAETNLKLQKSCFWKRITYRTQIKK

SEQ ID NO: 18115 - DNA, 528 bp, Unknown
  Obtained from environmental sample
  misc_feature (1)..(528): n is a, c, g, or t
gtgaaaataaaaaaacgatatagcataccgttaggactacttgtaatactaggagcgtttgctaagacacaatatgcaaaagatattagcaacacaattaaagtgatacaggaagacaagtttacagctgaaatgagagaaggagctgaaaaactaggaaaagaagagacccctattgctgttaaagcatatgcaaatcaacaaaaaaaattatgtcctattaaaaattcgcaagatgatatcatcatagatgttatttctgagaacaataaaattatatgggttagaaagactaattatgaaaaattattacaattgaaaaatatcaataatgataaaattaaattaaatagagcattaacaaatggaatgattaatgaaatatgctcacaaaaggcaatgaactatcttgttataaataaagatgtgtctgtagaatataaatattttgattttaatatggaactaacaaataatattttagtaaagaaaaacgattgtgtgttcagctttcgagccgattcttga

SEQ ID NO: 18116 - protein, 175 aa, Unknown
  Obtained from environmental sample
  misc_feature (1)..(175): Xaa is any amino acid
MKIKKRYSIPLGLLVILGAFAKTQYAKDISNTIKVIQEDKFTAEMREGAEKLGKEETPIAVKAYANQQKKLCPIKNSQDDIIIDVISENNKIIWVRKTNYEKLLQLKNINNDKIKLNRALTNGMINEICSQKAMNYLVINKDVSVEYKYFDFNMELTNNILVKKNDCVFSFRADS

SEQ ID NO: 18117 - DNA, 432 bp, Unknown
  Obtained from environmental sample
  misc_feature (1)..(432): n is a, c, g, or t
ttgctgaacacaatggtaaaagctggattaatacatactgatagtaagcaactatcagtagatgccacagttgatattcatggttctgtttattgtcatttaaaggggggcacaacttttgagaaatctgtttttatcaattctcttcaggaaattgtaggtccaattgataaccccaggtatgtaatagtaaggaagagcaggtttatgcttttgcttaagcaaagagattatcattcagtaccagatgtaatcggaaaaacgaagaaacttgcaatggatttcaaaaaccaatgggatgaccatgtgggttcaagcgatttaatttatactagaactatagagggcaggaaattgcttttaaagtcgagaatagaatcgctgtcgtcgcagtttgttgatgaaattgagagggtgaataagtggagatag

SEQ ID NO: 18118 - protein, 143 aa, Unknown
  Obtained from environmental sample
  misc_feature (1)..(143): Xaa is any amino acid
MLNTMVKAGLIHTDSKQLSVDATVDIHGSVYCHLKGGTTFEKSVFINSLQEIVGPIDNPRYVIVRKSRFMLLLKQRDYHSVPDVIGKTKKLAMDFKNQWDDHVGSSDLIYTRTIEGRKLLLKSRIESLSSQFVDEIERVNKWR

SEQ ID NO: 18119 - DNA, 504 bp, Unknown
  Obtained from environmental sample
  misc_feature (1)..(504): n is a, c, g, or t
atgaaaattactgtagcaggaactggatacgtaggcctttcattatcagtattattgtctcagcatcatgaagtcgtagctcttgatattattgaagataaggtggatctcattaatagtgggaaatcacctattacagattcagagatagaagcttttttaaaaaataaaaagctgaatcttagggctactttaaataaggaagaggcatataaaaccgctgagtatgtaattattgctactccaaccaattacgatccggaaactaatcattttgatactacatcagtagagtcggtcattaaggatgtaattgcggttaatctcaacgcaataatgataataaagtcaactgtgccagttgggtatgtccagaagataaaaaatgagtttgattgtgataacattatcttttcaccggagttcttaagggagggtaaagcattatatgataatctatatccatctcgaattgtagtaggggaaaaatctgaacgtgctcgn

SEQ ID NO: 18120 - protein, 168 aa, Unknown
  Obtained from environmental sample
  DOMAIN (1)...(168): UDP-glucose/GDP-mannose dehydrogenase family, NAD binding domain
  misc_feature (1)..(168): Xaa is any amino acid
MKITVAGTGYVGLSLSVLLSQHHEVVALDIIEDKVDLINSGKSPITDSEIEAFLKNKKLNLRATLNKEEAYKTAEYVIIATPTNYDPETNHFDTTSVESVIKDVIAVNLNAIMIIKSTVPVGYVQKIKNEFDCDNIIFSPEFLREGKALYDNLYPSRIVVGEKSERAR

SEQ ID NO: 18121 - DNA, 402 bp, Unknown
  Obtained from environmental sample
  misc_feature (1)..(402): n is a, c, g, or t
atgactaaaaatgagcatggctcatggagtggaagtaagggtccttttcttgataaagaattagtagaatttagtacaaaactacccgttcacttgaaaatgaatggactaactacaaagtatttactgaaaaaagttgcagaaagatacttgcccaaagaaattatttataggtcaaaatcaggttttggagctcctgtaagagattggattattgatgacttaaacgagaaaattaatactgatctaaacgaaaaatttataaacgaaggtggtatattttcttataaggaaataaagaaactgatcgatgaaaataaaaagggaaaaattgatgtttcctactcaatatggtcgttactagcaattagttcatggataaaacaatttaccaataaatag

SEQ ID NO: 18122 - protein, 133 aa, Unknown
  Obtained from environmental sample
  misc_feature (1)..(133): Xaa is any amino acid
MTKNEHGSWSGSKGPFLDKELVEFSTKLPVHLKMNGLTTKYLLKKVAERYLPKEIIYRSKSGFGAPVRDWIIDDLNEKINTDLNEKFINEGGIFSYKEIKKLIDENKKGKIDVSYSIWSLLAISSWIKQFTNK

SEQ ID NO: 18123 - DNA, 777 bp, Unknown
  Obtained from environmental sample
  misc_feature (1)..(777): n is a, c, g, or t
ttgggtaatgaaatctatgttgcccgggggaaaaataaactcgcagaaaagattgtatcaggagacctgcaaattacccaacgggtaaaagatgccattaatgaatgtttgaactgtaaaacatgttcagcaaactgtccggctggtgtcagcccagaacatgtggttctcagacttcgctggtatattaccacccaggaaggtctaggctttttcaaggcacttatcttccgtcagttgatctggagaaaatggcccattacccttgctgcaaaaatagttggtattacccagagagcccttttcggcattggcccccggaatcccgttcgacatctctttccactttttggcttctcaaaacgacgttttttcccgacaatggccctgcgcagtggacagagcctctatcctgaggtggttccagccaaaaaagatcctgtaaagaagcgaatcgggtactttaccggatgtgcaggtaatctcatctaccccaatgttgttaaatcggtggtggatattctcaccggctttggatatgaggttgtcattcctaaaaagcagaagtgtaacggcactccggtactggccaatggtgattatgaaggtgccaaaaagcttatggagcacaattttaatcttttccgacaatacaatctggatgctattgtggtcgcctgctcatcatgcggcatggcactgaaaaaggagatcaaactctttattgaagaccgcagtgagcttgatgatttaccggcaaggtgtctgatattatga

SEQ ID NO: 18124 - protein, 258 aa, Unknown
  Obtained from environmental sample
  DOMAIN (175)...(235): Cysteine-rich domain
  misc_feature (1)..(258): Xaa is any amino acid
MGNEIYVARGKNKLAEKIVSGDLQITQRVKDAINECLNCKTCSANCPAGVSPEHVVLRLRWYITTQEGLGFFKALIFRQLIWRKWPITLAAKIVGITQRALFGIGPRNPVRHLFPLFGFSKRRFFPTMALRSGQSLYPEVVPAKKDPVKKRIGYFTGCAGNLIYPNVVKSVVDILTGFGYEVVIPKKQKCNGTPVLANGDYEGAKKLMEHNFNLFRQYNLDAIVVACSSCGMALKKEIKLFIEDRSELDDLPARCLIL

SEQ ID NO: 18125 - DNA, 459 bp, Unknown
  Obtained from environmental sample
  misc_feature (1)..(459): n is a, c, g, or t
gtgatcgagctgaccctcagtggatttgaagaaaacgagggcaagaccggaaagaagttggttgtgtccggggagaacaagtgcatggtgaccggagacaagatttatttcaacccaatgtttgaacttgggatggatgaaaaccccttccaacgtgaaaaaagactgtttcccatcgactttggttgcccgcttaagtatgtgtatcgctattccattgtgattccggaagggtatgaagttttggaaattccggaaaatgtaaacgtaattctctccggaaaagcagctcaatttcgtcatatattgcatttggaggggaatctcctgcaggtaatgagcagcctttccgtttcacaggtttggttcgggccggatgattaccagggcttgaaggactttttcgacatggtggtggtcaagcacacggagcaggtcgttctaaccaagaagatatga

SEQ ID NO: 18126 - protein, 152 aa, Unknown
  Obtained from environmental sample
  misc_feature (1)..(152): Xaa is any amino acid
MIELTLSGFEENEGKTGKKLVVSGENKCMVTGDKIYFNPMFELGMDENPFQREKRLFPIDFGCPLKYVYRYSIVIPEGYEVLEIPENVNVILSGKAAQFRHILHLEGNLLQVMSSLSVSQVWFGPDDYQGLKDFFDMVVVKHTEQVVLTKKI

SEQ ID NO: 18127 - DNA, 702 bp, Unknown
  Obtained from environmental sample
  misc_feature (1)..(702): n is a, c, g, or t
ttgaaaatggtcaattccttcagtcaggaaccaacctataaaaatcctgggtacagggactatagagaatatgactacaatcctgacggcgacctcataatttggcgaacgctggctaaacatgcgatttctaaccccaaagaaaacctctcggttctggaattgcaatcatgtaatatttctgaaattagaaaagtaacgaagttgcctccaaggtatcgcaagacgcattttgatttaggcagcattgataatatctatgaatggagccacgttttaatgggcattggcagaggcttttccagatttatagaaacgactgaattggtggaagaattgccagagggtatgatcgaaattgcggcgaaaggtaattatggagaagggatgaccgggacatggaaaatgtcgatcgatcgatcaaacggctatattgtacgaaaggcagagtttttccccgatgggaaatcgcaaccatatcttctcgtagaaaccgaaggaacaatgcagggagaaggattttcggtggcagcaaaggggagattatccttttcatttccctccgattataaatttgtcattgaagtgactcctcgatcaggtttattgtcttttgaccaggcattttatgatcaaaccgcagccaatgtaaaaatggactacccaaaaatgaaactgatggatctgcgaaaaggcaaatag

SEQ ID NO: 18128 - protein, 233 aa, Unknown
  Obtained from environmental sample
  misc_feature (1)..(233): Xaa is any amino acid
MKMVNSFSQEPTYKNPGYRDYREYDYNPDGDLIIWRTLAKHAISNPKENLSVLELQSCNISEIRKVTKLPPRYRKTHFDLGSIDNIYEWSHVLMGIGRGFSRFIETTELVEELPEGMIEIAAKGNYGEGMTGTWKMSIDRSNGYIVRKAEFFPDGKSQPYLLVETEGTMQGEGFSVAAKGRLSFSFPSDYKFVIEVTPRSGLLSFDQAFYDQTAANVKMDYPKMKLMDLRKGK

SEQ ID NO: 18129 - DNA, 474 bp, Unknown
  Obtained from environmental sample
  misc_feature (1)..(474): n is a, c, g, or t
atgcagtcacttgggaataatgctaaatatatacaaatcgaaggaaatggcccaaatgcattagattttcacatagcattttacattggtgaaatctctacaaaagacaataattgctattttcacataatttcaaaagatacagggtttgacccattagtcaaacatttgaaaacaaagaaaatttttgttcagagagaaaaagatatttctgagataccacttctaaagatatcaaatacagaaactttgccagaaagagttaattcgattgttgagtttctaaaatctagaggtaactcaaaaccaagaacaataaaaactctctctaattccattaaatcacttttcatgcagaaactagttgataaagagcttactgaaattattgacgaactaattaaaagaaaagtagttatagtcaaaggtacaaaagccagctatgatttatcaaataaattattaaaaaattaa

SEQ ID NO: 18130 - protein, 157 aa, Unknown
  Obtained from environmental sample
  misc_feature (1)..(157): Xaa is any amino acid
MQSLGNNAKYIQIEGNGPNALDFHIAFYIGEISTKDNNCYFHIISKDTGFDPLVKHLKTKKIFVQREKDISEIPLLKISNTETLPERVNSIVEFLKSRGNSKPRTIKTLSNSIKSLFMQKLVDKELTEIIDELIKRKVVIVKGTKASYDLSNKLLKN

SEQ ID NO: 18131 - DNA, 327 bp, Unknown
  Obtained from environmental sample
  misc_feature (1)..(327): n is a, c, g, or t
atgaaaaaaactcaaataatactattactcattttattatcaatggctagccatgctctggattatgacaacagcaaagtcatttacactaaaattgatagcattgattatgctttaaaaaaaataaaattatttaatcaaagttattcctaccaacttaaatttggagatgttctatatttaagtttgtttgatcaaaaaaaaatcgaatcaatagatttaaataaaaaatattacatagaaataaaatacaaaaacagtaattattttgatctaaaaaaagacggtgttgtcgtattcattggaaaaataaagcctcctatataa

SEQ ID NO: 18132 - protein, 108 aa, Unknown
  Obtained from environmental sample
  SIGNAL (1)...(19)
  misc_feature (1)..(108): Xaa is any amino acid
MKKTQIILLLILLSMASHALDYDNSKVIYTKIDSIDYALKKIKLFNQSYSYQLKFGDVLYLSLFDQKKIESIDLNKKYYIEIKYKNSNYFDLKKDGVVVFIGKIKPPI

SEQ ID NO: 18133 - DNA, 687 bp, Unknown
  Obtained from environmental sample
  misc_feature (1)..(687): n is a, c, g, or t
atgttaaaaggtgttattgattctccagacattccgttaaacgtttctcgttctggcttacaagcagacggagcggtgaagaaaatctctgggtacatcaccaaaaaagtggctgataaattaaactcgctatacaaaaacaatcgtgaagattttgagcaaaaatggaacgatatcaaagtaattattgaatacggaatgttatctgacgataagttttttgataaagcacaaagctttgcattgtatccaacggtagataataccttctttaatttagaagaattaaaagagaaaacaaaagacgcacaaacggataaagatggaaatcaaatcattttgtacgctgcaaataaagaagcacaacacagttacattcaagatgcaaaagcaaaaggatatgaagtgttgattttagattctccaattgttggacatttaattcaaaagattgaaggaagcaacgaaaaattaaaattcactagagtagattctgatcacattgacaatttaataaagaaagacgacacggttatttctaaattatctgacgaagaaaaagagaaattaaagccaattattgaagctgctgtaccaaaagaaacctatacagttcagttagaagcgatggattcttctgcgtctccgtttttgattactagcttccagagtttatgcgtagaatga

SEQ ID NO: 18134 - protein, 228 aa, Unknown
  Obtained from environmental sample
  misc_feature (1)..(228): Xaa is any amino acid
MLKGVIDSPDIPLNVSRSGLQADGAVKKISGYITKKVADKLNSLYKNNREDFEQKWNDIKVIIEYGMLSDDKFFDKAQSFALYPTVDNTFFNLEELKEKTKDAQTDKDGNQIILYAANKEAQHSYIQDAKAKGYEVLILDSPIVGHLIQKIEGSNEKLKFTRVDSDHIDNLIKKDDTVISKLSDEEKEKLKPIIEAAVPKETYTVQLEAMDSSASPFLITSFQSLCVE

SEQ ID NO: 18135 - DNA, 303 bp, Unknown
  Obtained from environmental sample
  misc_feature (1)..(303): n is a, c, g, or t
atgagtgtactgaaaaaaccgcttgtttctgaaaaaatggccgttctcaatgaacgtcctagcaacaagtacaatcaatatgcattcaaggtcgatatggatgctaccaagcctcagatcaagcgtgaggtagaagcgatgtatgatgtgtcggtgaagggcgttcgtacccttattgtgcagggcaagtcccgcaaccgccaatcacgtacaggctatatcacgggcaagtccccgaattataaaaaagcgattgtttccctggtagcaggtgatgagatcgatttctacaagaatatttaa

SEQ ID NO: 18136 - protein, 100 aa, Unknown
  Obtained from environmental sample
  DOMAIN (1)...(100): Ribosomal protein L23
  misc_feature (1)..(100): Xaa is any amino acid
MSVLKKPLVSEKMAVLNERPSNKYNQYAFKVDMDATKPQIKREVEAMYDVSVKGVRTLIVQGKSRNRQSRTGYITGKSPNYKKAIVSLVAGDEIDFYKNI

SEQ ID NO: 18137 - DNA, 333 bp, Unknown
  Obtained from environmental sample
  misc_feature (1)..(333): n is a, c, g, or t
ttgaccgaatttaatactaaaagttcagttatagagcagcaaaaaatcgagaacgaaaaaaaatatgagcctcaagaaaaatcagaagaacaaaaagaagaacctgtcgttgaaacctccaacgatgctgataaagcaaagcctataatagatataaatacggctactttagaagaacttcagaaattagatggaataggcgttgcttatgcccaacgaattttggattatcgccaagagaacggagaatttaaatcgatagacgaattattaaaaattaagggaatcggtaaaaagcgattagagacaatggctccatttatcaaactttag

SEQ ID NO: 18138 - protein, 110 aa, Unknown
  Obtained from environmental sample
  misc_feature (1)..(110): Xaa is any amino acid
MTEFNTKSSVIEQQKIENEKKYEPQEKSEEQKEEPVVETSNDADKAKPIIDINTATLEELQKLDGIGVAYAQRILDYRQENGEFKSIDELLKIKGIGKKRLETMAPFIKL

SEQ ID NO: 18139 - DNA, 402 bp, Unknown
  Obtained from environmental sample
  misc_feature (1)..(402): n is a, c, g, or t
gtgcttcaagatagggagttttcattttatgattttaatggaaatcaattttcatatcgtgggtcaaagatagaagtaatgtatattccaattacagatgttgaagaaacagtgttgaatatttcagattataaattatctcaaaactatccaaatccgtttaatccaagtacaacaattaaatattcaatttcatccaatgtaaaaagtggaatagcaaatgtgagtttaaagatatatgatgtacttggtagagaagttgcaacactagtaaacaaagaacagagtgcaggtaactatgaagttcaattcaatgcaagcagtttaacatcaggaatatatttttacaaattacagagtggtaaattttctaaaagtaagaagatggtattggtgaaataa

SEQ ID NO: 18140 - protein, 133 aa, Unknown
  Obtained from environmental sample
  misc_feature (1)..(133): Xaa is any amino acid
MLQDREFSFYDFNGNQFSYRGSKIEVMYIPITDVEETVLNISDYKLSQNYPNPFNPSTTIKYSISSNVKSGIANVSLKIYDVLGREVATLVNKEQSAGNYEVQFNASSLTSGIYFYKLQSGKFSKSKKMVLVK

SEQ ID NO: 18141 - DNA, 798 bp, Unknown
  Obtained from environmental sample
  misc_feature (1)..(798): n is a, c, g, or t
ttggatcggnccgagcagacaaatgctgcgaaaagatcggatgacgtcgcgacggtggtacaatcattaaaccagatggcaggcactttaaaagcggataataaccagctaaaaagactgaatgaaaagcagaatcaattttttgctgatataactcatgaagttcgaaaccctttacatacgatatctggttcactggaaatgatagaactcgaagacctatcagcagagaataaactaaaatatcatcagcaagctaaacggcagatagagcgaataacaagactatttgaagatattaaaacacttcaacgctacgattatgatgcgagttttattcatagacaggaatttgatttgaaatctctgatcgataatgtggtagaagtgcacggtccgttagcacaagaaaaaaagattaaaattaaaacagaattaaagctgatttcaaaagtgtatgctgatcctgataaaatcgaacaagtagtggaaaatttagtttcgaatgctgtaaaatatacaaatgctggggttatcaatattatagcagaggagaacgataacatagtgactgtaacggtacaagatacaggcataggaatcagtgaagaacatcttgaccgattgtttgacaggttttacagaacggataaagctcgttccagagataagggtggtacaggcttgggactcgcagttgtaaaaggaatactaaaagctcatgattctgaggttgtagtaacgagtgaggtcggcaaaggaagtacgtttagttttacccttaatactcttcagtaa

SEQ ID NO: 18142 - protein, 265 aa, Unknown
  Obtained from environmental sample
  DOMAIN (43)...(109): His Kinase A (phosphoacceptor) domain
  misc_feature (1)..(265): Xaa is any amino acid
MDRXEQTNAAKRSDDVATVVQSLNQMAGTLKADNNQLKRLNEKQNQFFADITHEVRNPLHTISGSLEMIELEDLSAENKLKYHQQAKRQIERITRLFEDIKTLQRYDYDASFIHRQEFDLKSLIDNVVEVHGPLAQEKKIKIKTELKLISKVYADPDKIEQVVENLVSNAVKYTNAGVINIIAEENDNIVTVTVQDTGIGISEEHLDRLFDRFYRTDKARSRDKGGTGLGLAVVKGILKAHDSEVVVTSEVGKGSTFSFTLNTLQ

SEQ ID NO: 18143 - DNA, 753 bp, Unknown
  Obtained from environmental sample
  misc_feature (1)..(753): n is a, c, g, or t
ttgagctttgatcggtcgagtgactacgctgcatgcgtgctggggagtctcaaaagttatgtggactatgcctttgccaatatccgccagataaccatgctgcccgaagcaaggctttacgaggattatttcaaggataagcccatccatttcaggaacctggagtacatgagtttcttccacaacttttatgagaaaaaagtggaaatgctggctatatctaatgacgggcataagctggtgaatgccataaacgggggtacaagcctcagttttattgatgagatactcacccagcatgacttattgcaagacatcaacattcgtcgcttggcattgataaaagcctgccaaaacttttaccgtgatgatgagtttaagaagcctaaagttgctgctctcttagacaagataatagaagaaaatctgcatcctgagataagccttgcagcccaaaacatgaaaagtggtttggtgaaactcacccccggcaagcccgcccctgacattgaattacgcaccagcgccaacgtgcccatgaaactgagcgacctaaaaggcaagtatatttacttggaatttactgatgccacctgccaagcctgcaatatggaaaccatgctggtgcagcaactaaagaaagagtttggcaaaaaagtaaccttcgtaactgttcttatcaatgatgacttacgaagtgtctcgcaagtttatacaagccaatggctacgactggactttcctcctatcagg

SEQ ID NO: 18144 - protein, 251 aa, Unknown
  Obtained from environmental sample
  misc_feature (1)..(251): Xaa is any amino acid
MSFDRSSDYAACVLGSLKSYVDYAFANIRQITMLPEARLYEDYFKDKPIHFRNLEYMSFFHNFYEKKVEMLAISNDGHKLVNAINGGTSLSFIDEILTQHDLLQDINIRRLALIKACQNFYRDDEFKKPKVAALLDKIIEENLHPEISLAAQNMKSGLVKLTPGKPAPDIELRTSANVPMKLSDLKGKYIYLEFTDATCQACNMETMLVQQLKKEFGKKVTFVTVLINDDLRSVSQVYTSQWLRLDFPPIR

SEQ ID NO: 18145 - DNA, 600 bp, Unknown
  Obtained from environmental sample
  misc_feature (1)..(600): n is a, c, g, or t
atggttgttactacggcagataagcaaacctattcgaatcatttaaaagttgctaaaggaacacacacttattctgttccgtttgatattaaaaatccaaagttgtggtggacacataatttaggaaaaccgcatttgtatgattttgattttaaattgattgaaaacaatacgataaaagataaaaaatcatttaaaaaaggaattagaacgataaagttggttacagaaaaagattctattggcgaatcattttattttgaattgaacggaaaaccggtctacatgaaaggtgccaattacattccgcaaaacagttttcagaataaagtaactgatgaaaactacaataaactactttctgatgtggtagcttctaatatgaatatgttgcgagtttggggcggcggaatttacgagaatgatattttttacgatttgtgcgatgaaaaaggaatcttagtttggcaagattttatgttttctacagcaatgtatcctggcgatattgagtttttaggcaaatgtagaacaagaagcagaagatcaagtaaaaagattgcgaaatcatgcttcaattgctttatggtgtggaaataa

SEQ ID NO: 18146 - protein, 199 aa, Unknown
  Obtained from environmental sample
  misc_feature (1)..(199): Xaa is any amino acid
MVVTTADKQTYSNHLKVAKGTHTYSVPFDIKNPKLWWTHNLGKPHLYDFDFKLIENNTIKDKKSFKKGIRTIKLVTEKDSIGESFYFELNGKPVYMKGANYIPQNSFQNKVTDENYNKLLSDVVASNMNMLRVWGGGIYENDIFYDLCDEKGILVWQDFMFSTAMYPGDIEFLGKCRTRSRRSSKKIAKSCFNCFMVWK

SEQ ID NO: 18147 - DNA, 444 bp, Unknown
  Obtained from environmental sample
  misc_feature (1)..(444): n is a, c, g, or t
gtgggcgatattattaaaaaaatcaatcgtgttaacatttctaaactttcagatttaaaagggcagttaaacgcaaaaagacctggagattttgttgatgtaattgttgatcgaaatggagatttgattactaaaaaagtgaaattaagtaaaccgttgccaatgtatatttctaaagcttttaattgggaattgaaaaatttaaccaaaaaagagttgaaaaaatacggaatttcacacggtgttagaatctatagaacaaatgatgataattctgaaaatagtttaaaaaattacatccttcttaaagtaaatgatacagcattaaaagatgccgaaaaagcggttgcaattttagatgaaataggaaaagatatgagatataaaatttttatagatatgatgaatgttaaaggggaaaaagaacgaatcaggtttcgataa

SEQ ID NO: 18148 - protein, 147 aa, Unknown
  Obtained from environmental sample
  misc_feature (1)..(147): Xaa is any amino acid
MGDIIKKINRVNISKLSDLKGQLNAKRPGDFVDVIVDRNGDLITKKVKLSKPLPMYISKAFNWELKNLTKKELKKYGISHGVRIYRTNDDNSENSLKNYILLKVNDTALKDAEKAVAILDEIGKDMRYKIFIDMMNVKGEKERIRFR

SEQ ID NO: 18149 - DNA, 417 bp, Unknown
  Obtained from environmental sample
  misc_feature (1)..(417): n is a, c, g, or t
atgaacatgttgaaaaaaagcggattggacaccataattccgaccttgaaacaacctgttttaggaatctgtttaggcatgcaattgatgtgtattgcaacagaagaaggaaacaccaaaggattgggaatttttaacacgacagtaaaacgtttttcatcaaaagtaaaagttccgcaaatgggttggaataccatttctgatttgaaatcggatgtatttacaggaattaaagaaaacgaatttatgtatttggtgcatagtttttacgcagaaaattgcaaagaaactattgcaactacgaattacgacatcgcatatgctgctgctttgcaaaaagataacttttatggagtgcaatttcatcccgagaaaagcggtgtaataggagaacaaattttgaagaatttcatagaa

SEQ ID NO: 18150 - protein, 139 aa, Unknown
  Obtained from environmental sample
  DOMAIN (2)...(138): Glutamine amidotransferase class-I
  misc_feature (1)..(139): Xaa is any amino acid
MNMLKKSGLDTIIPTLKQPVLGICLGMQLMCIATEEGNTKGLGIFNTTVKRFSSKVKVPQMGWNTISDLKSDVFTGIKENEFMYLVHSFYAENCKETIATTNYDIAYAAALQKDNFYGVQFHPEKSGVIGEQILKNFIE

SEQ ID NO: 18151 - DNA, 459 bp, Unknown
  Obtained from environmental sample
  misc_feature (1)..(459): n is a, c, g, or t
gtgacccgcgaattggtgcgtcagaatgtcattttcaattttgccagctattaccgggccaaacatgaaagcattgccatccccaatgaattcaaaatcaccgacgcgatttatacagaattcacggattactgcaagaacgaaggctttacttttgacaccaaaacagagaagcaatttgcccgcctcaaggaattgatggtggaggagcattatgcggatgcactggatggagaattgaaggtgattgagagcaaaatatcggccgagaagcaaacagatctgatcgaattccgtggcgaaatctcggatctgctcaagcgcgaattggtttcccgctattattaccgcagtggcgaggttcaggccagctttagcaacgatcctgaaatcctcaaagcaaaagaaatcctgctttccccggagaaatatagagagatgctgacggtgcagaagtag

SEQ ID NO: 18152 - protein, 152 aa, Unknown
  Obtained from environmental sample
  misc_feature (1)..(152): Xaa is any amino acid
MTRELVRQNVIFNFASYYRAKHESIAIPNEFKITDAIYTEFTDYCKNEGFTFDTKTEKQFARLKELMVEEHYADALDGELKVIESKISAEKQTDLIEFRGEISDLLKRELVSRYYYRSGEVQASFSNDPEILKAKEILLSPEKYREMLTVQK

SEQ ID NO: 18153 - DNA, 417 bp, Unknown
  Obtained from environmental sample
  misc_feature (1)..(417): n is a, c, g, or t
atgcttgaaatcaagaaaataagggaaaatcataaacacttcgtggaagggctgaaaaagcgcggaatcgaaggtgtggaaactaccattgatcggatactggagcttgaccggcagcgcagggaacaacagcaccgcatgcaggagttgcaggccgaaggaaatgtcgcagcaaaatctatcggtcaactgatcgcctccggaaaaaaagaagaggccgaaaaagccaaaaaattcagcggtgaatccaaagctgccatcaaggaactggaagaaattgtgcgcggatttgatgccgaacaaacccagcttttggtagccctgcccaatgtccctcacgacagtgttccggtaggaagtagcgaaacagacaatttggaagtttcccggcatggcgtgttcaatgaagtccccgaa

SEQ ID NO: 18154 - protein, 139 aa, Unknown
  Obtained from environmental sample
  DOMAIN (1)...(112): Seryl-tRNA synthetase N-terminal domain
  misc_feature (1)..(139): Xaa is any amino acid
MLEIKKIRENHKHFVEGLKKRGIEGVETTIDRILELDRQRREQQHRMQELQAEGNVAAKSIGQLIASGKKEEAEKAKKFSGESKAAIKELEEIVRGFDAEQTQLLVALPNVPHDSVPVGSSETDNLEVSRHGVFNEVPE

SEQ ID NO: 18155 - DNA, 480 bp, Unknown
  Obtained from environmental sample
  misc_feature (1)..(480): n is a, c, g, or t
ttgaatttaaaaaatgatacagatagtttcattaaacttgtagatgcaactataaaaagaaataatatcaccattattttggatttagaagaaaatatccatattcaaggatatccaaatgagcttattcaatgttttatgaatatttttaataatgcaaaagatgctttagtagaaaacaatgatgaagatgatagatttattttcatctcacaaattataaatgagaataatgtgattatagaatttaaagacaatgcaggtgggattcctgaggatattattgataaagtatttgaaccatattttacaactaaacacaaatcacaaggtactggtcttggacttcatatgagttataatctagtaacaaatggtatgaaaggaactcttgaagttaaaaacgatgaatatgattttaatggaaaacattacaaaggtgcatgttttggtattgtgatacctttaaatatttcttaa

SEQ ID NO: 18156 - protein, 159 aa, Unknown
  Obtained from environmental sample
  DOMAIN (37)...(157): Histidine kinase-, DNA gyrase B-, and HSP90-like ATPase
  misc_feature (1)..(159): Xaa is any amino acid
MNLKNDTDSFIKLVDATIKRNNITIILDLEENIHIQGYPNELIQCFMNIFNNAKDALVENNDEDDRFIFISQIINENNVIIEFKDNAGGIPEDIIDKVFEPYFTTKHKSQGTGLGLHMSYNLVTNGMKGTLEVKNDEYDFNGKHYKGACFGIVIPLNIS

SEQ ID NO: 18157 - DNA, 504 bp, Unknown
  Obtained from environmental sample
  misc_feature (1)..(504): n is a, c, g, or t
atggttaataatagtaataagacaatattagtaacaggatgtgctggctttattggaagtaattttgtaccgtattttttagaaaaatataataattataatattgtaaatattgatttacttacatatgcaggtaatttagaaaatctaaaagagtgtgataataataaaagatataaatttataaaaggtgatatttgtaatagagaacttatagagtttatttttgatgaatatgatatacaaggtgttattcactttgcagcggaatcacatgtagataactctattaaaaacccaggagtatttgtgcaaacaaatgtaaatggtacttttactcttcttgatgtagcatataaatattggatggacaaaccatttaaatttaaagaaaaatatcaaaattgtagatttcatcatatatctacagatgaagtgtatggactcttaatgaaccgacctatttacagaaactacaccttatgctccaaattcaccttatag

SEQ ID NO: 18158 - protein, 167 aa, Unknown
  Obtained from environmental sample
  DOMAIN (9)...(166): NAD dependent epimerase/dehydratase family
  misc_feature (1)..(167): Xaa is any amino acid
MVNNSNKTILVTGCAGFIGSNFVPYFLEKYNNYNIVNIDLLTYAGNLENLKECDNNKRYKFIKGDICNRELIEFIFDEYDIQGVIHFAAESHVDNSIKNPGVFVQTNVNGTFTLLDVAYKYWMDKPFKFKEKYQNCRFHHISTDEVYGLLMNRPIYRNYTLCSKFTL

SEQ ID NO: 18159 - DNA, 702 bp, Unknown
  Obtained from environmental sample
  misc_feature (1)..(702): n is a, c, g, or t
atgtacgaagatcaatggataccttttgttggacctaaaagtaaaaaagtaggtgccagtatagtcaattgtaaactgtttaacctagactttgaggattgtgattgtgaaagcgctggaagagaatacggagattggtttgacattatcaaaaaacattgccccatgttcgtacaagtaatggagtaccaacattggccagaagaggcacagcgttggatgtgtattttaattgggagaatgttatatgacataaaggacttagatgattggcaagttataccgtatttacttggtcaagccggtagcggtaaatcgttaggaccttacattccagtactcaagtgtacagttggtgggtgtaaaacggtattcgcaaaagatgttaaagttggtgacaaattgatgggggatgattctaatccccgaacagtattggcaattgataaggggaaagataaaatgtatcatgtcagacaggtcaatggagatgattacgtggcaaatggggcacatattttgagtcttaagatgacatatgtaaatcagaaatccaaatcagttggaggtaaaaaatgtatttatcgtaacgtaaatggtaaaaaatataaagttggggatattgttgatatatctattgaagattatttaaaattaggaaacagtgtcaaaaaatcacttaaaggttataaagttgcataa

SEQ ID NO: 18160 - protein, 233 aa, Unknown
  Obtained from environmental sample
  misc_feature (1)..(233): Xaa is any amino acid
MYEDQWIPFVGPKSKKVGASIVNCKLFNLDFEDCDCESAGREYGDWFDIIKKHCPMFVQVMEYQHWPEEAQRWMCILIGRMLYDIKDLDDWQVIPYLLGQAGSGKSLGPYIPVLKCTVGGCKTVFAKDVKVGDKLMGDDSNPRTVLAIDKGKDKMYHVRQVNGDDYVANGAHILSLKMTYVNQKSKSVGGKKCIYRNVNGKKYKVGDIVDISIEDYLKLGNSVKKSLKGYKVA

SEQ ID NO: 18161 - DNA, 783 bp, Unknown
  Obtained from environmental sample
  misc_feature (1)..(783): n is a, c, g, or t
gtggatcaagattcggctcgagaaatctacaactacttgtccatccggcatgacatcacagaccgaaaaaatggagaagaacgattagcaaagcagttcgaggagctaaaaactaagaatattgaaatcgaacagtttgcttatatagcatcccatgatctacaagaaccattaagaaccgtaatcaattacacagaaacactcacagaagagtatgaagggaaacttgattctactgctgataagtatttaagctttattcaagatgcttcaaaaagaatgagtgaccttataaaaggtctgctcgattactctcgtttggggaaacttactggaagaaccaaagttaactgcgcgactctcattcaagaaatcaaggctgatcttgaggccaccatcaatgagaccaacacaaccattacagttggagatttaccaattgttaatggcttcgaaattgaattacgtcttttattccaaaatctaattaccaatgccattaagtttaaaagagctgacgttgagcctgaaataactatttcggcaaaaaagactgatttattctgggaattttcagtaaaagataatggtatagggattgacgatattcatcacgaaaagatattcatcatttttcagcgattgcataaccgaaaagattacgctggaacagggatagggctatctcattgccaaaaaatagttaacctccatggaggaagtatttgggtagattccaaaattaataaaggaagcatctttaattttacaattccaatttag

SEQ ID NO: 18162 - protein, 260 aa, Unknown
  Obtained from environmental sample
  DOMAIN (42)...(110): His Kinase A (phosphoacceptor) domain
  misc_feature (1)..(260): Xaa is any amino acid
MDQDSAREIYNYLSIRHDITDRKNGEERLAKQFEELKTKNIEIEQFAYIASHDLQEPLRTVINYTETLTEEYEGKLDSTADKYLSFIQDASKRMSDLIKGLLDYSRLGKLTGRTKVNCATLIQEIKADLEATINETNTTITVGDLPIVNGFEIELRLLFQNLITNAIKFKRADVEPEITISAKKTDLFWEFSVKDNGIGIDDIHHEKIFIIFQRLHNRKDYAGTGIGLSHCQKIVNLHGGSIWVDSKINKGSIFNFTIPI

SEQ ID NO: 18163 - DNA, 699 bp, Unknown
  Obtained from environmental sample
  misc_feature (1)..(699): n is a, c, g, or t
atgtttgaaaaatttattaatttttacccaacaaaaaaattaatagaaattaacgaaatagacataagagactatatttcaaaactatctagagaaaataaatcaaaatcatttctcaatcaaatgataaatagcattaaattttactacgaaatagtacaaggaatgcccaacagattttacgaaattgaaagaccaataaaagagaccaaactaccaaaagtaattagtttagaagaggtaaaagcaataattagcaatacaaacaacataaaacacaaatgcatagtaagcttaatgtattcggcaggcttgcgaagaggagaattactaaaccttaaacttacagacatcgacagtaaacgaatggtaataacagtgaaacaagcaaaaggaaacaaagaaagactaacaatacttagtaaaacaattttagaagatttacgaaaatactttatcgaatggaaaccaaaagaatacctatttgaagggaaaaactacactaaatatagttcttccagtattttaaaaatagtaaaaaatgcagctataaaagctaaaataataaaaacagtaactcctcacatgttacgacacagttttgcaccccagttgcttgaaaacggaacagacttaagatatattcaagtattattaggtcacggaagtccaaaacaagtgaaatatacacacatgtag

SEQ ID NO: 18164 - protein, 232 aa, Unknown
  Obtained from environmental sample
  DOMAIN (67)...(231): Phage integrase family
  misc_feature (1)..(232): Xaa is any amino acid
MFEKFINFYPTKKLIEINEIDIRDYISKLSRENKSKSFLNQMINSIKFYYEIVQGMPNRFYEIERPIKETKLPKVISLEEVKAIISNTNNIKHKCIVSLMYSAGLRRGELLNLKLTDIDSKRMVITVKQAKGNKERLTILSKTILEDLRKYFIEWKPKEYLFEGKNYTKYSSSSILKIVKNAAIKAKIIKTVTPHMLRHSFAPQLLENGTDLRYIQVLLGHGSPKQVKYTHM

SEQ ID NO: 18165 - DNA, 588 bp, Unknown
  Obtained from environmental sample
  misc_feature (1)..(588): n is a, c, g, or t
ttgtatatgaacagattggataaagatttacatgtagtttatgagaaacgtaaagattatgaagacagtgttactcttttaaacaacagacttgctgcctttttagatcaaaagcaagaagaagcgcaacatatgtttccacattactttgaacgttacaaaacggatggtgtagagtacaacatgtatattggtggttctttgaccgacaaaaaagcatttgacaatttgtatttatacaatttgcgtttatggcaattacaaaccatgtttgagctagaaaatattgcttttaaagcgcgtgaagaaatgaatcacgatttaagagttgcttctttaattttagtgcacagcaatccgttatctattaaatttagaatggatgaaaaacaatttgatgtggatggtgcttacaacatcagatatgaaattatcaaaaaaagaattgataaagcgcatataaaaaacactactgagcggctaactgttcctggcaaaatagccattgtttattctcaagacagcgatgcgagagagtatttaaaatacatccgttttttacaatcaaaaaaatattttggtgcattn

SEQ ID NO: 18166 - protein, 196 aa, Unknown
  Obtained from environmental sample
  misc_feature (1)..(196): Xaa is any amino acid
MYMNRLDKDLHVVYEKRKDYEDSVTLLNNRLAAFLDQKQEEAQHMFPHYFERYKTDGVEYNMYIGGSLTDKKAFDNLYLYNLRLWQLQTMFELENIAFKAREEMNHDLRVASLILVHSNPLSIKFRMDEKQFDVDGAYNIRYEIIKKRIDKAHIKNTTERLTVPGKIAIVYSQDSDAREYLKYIRFLQSKKYFGAX

SEQ ID NO: 18167 - DNA, 570 bp, Unknown
  Obtained from environmental sample
  misc_feature (1)..(570): n is a, c, g, or t
atggtctatataaacggtattgacataacagagataaatccagagtcactttataagagagagtcagttgtatcacaggaaccatttcttttttcaaagtcaatttcagaaaatatatcgctgggattgaaagataaggatattattgaggtgaaaaagaatgcaggctatgctgcattagatgatgagatcaatggttttaaagatggatatgaacaaatgattggagaacggggaatttctctttccggtggtcagaaacagagaactgcaatcgcaagagccctgattaaaccagcagatgtcctgtttttagatgatccgttatccagtgtagactcaaaaacagaagagatcatactggctaatcttaataaactggtaaatgaaaaaaagtcctttaaaacaacatttataatttctcaccggatatcaaccttgaaacaggcagacgtcatccttgtttttaaagatggagagatcgttgaatccggtgttcataaggatcttgtgaaacaggcaggcttgtatttcaaactgtctgaaatgcagaaaatggaggagttttaa

SEQ ID NO: 18168 - protein, 189 aa, Unknown
  Obtained from environmental sample
  DOMAIN (2)...(159): ABC transporter
  misc_feature (1)..(189): Xaa is any amino acid
MVYINGIDITEINPESLYKRESVVSQEPFLFSKSISENISLGLKDKDIIEVKKNAGYAALDDEINGFKDGYEQMIGERGISLSGGQKQRTAIARALIKPADVLFLDDPLSSVDSKTEEIILANLNKLVNEKKSFKTTFIISHRISTLKQADVILVFKDGEIVESGVHKDLVKQAGLYFKLSEMQKMEEF

SEQ ID NO: 18169 - DNA, 426 bp, Unknown
  Obtained from environmental sample
  misc_feature (1)..(426): n is a, c, g, or t
atggtttatagtatcagattatcccttagaggcaaaaataattggaagtcccgtgaagtaaataattataaggctttttggtgtgtagaaaaaatacaaaatactaaacttgaatttgaattgaaagaaggatataaaccaaaagttgcactaatgggtttggcatttaaaaaaaacattgatgatctaagggaatcaccagcaaaatatattgcacaaaagataatgcaatcagaaaacaatggtaatatcatgcttgttgagcctaatatcgaagaacattcattatttaaacttacagactataagaaggcttatcaaagtgcagatattatagtctttcttgtatcacataatgagtttatgggtttaaagtatgataatagtaaagtgatattagatttttgtggagttttcaaaaaataa

SEQ ID NO: 18170 - protein, 141 aa, Unknown
  Obtained from environmental sample
  DOMAIN (50)...(141): UDP-glucose/GDP-mannose dehydrogenase family, UDP binding domain
  misc_feature (1)..(141): Xaa is any amino acid
MVYSIRLSLRGKNNWKSREVNNYKAFWCVEKIQNTKLEFELKEGYKPKVALMGLAFKKNIDDLRESPAKYIAQKIMQSENNGNIMLVEPNIEEHSLFKLTDYKKAYQSADIIVFLVSHNEFMGLKYDNSKVILDFCGVFKK

SEQ ID NO: 18171 - DNA, 312 bp, Unknown
  Obtained from environmental sample
  misc_feature (1)..(312): n is a, c, g, or t
gtgaaaaaagcaacaacatatctattttttgtactattaatagcctctttgggatttctatatagtttttctttggttaaaaattcgaataagaaaattaaaaaagtaacgatagagtttgctgagggaaacaatgattttttaactcaagaaatggttaataaattgttaatacaaaatagtaaagagcttaaaaaccaaccaaaatctgttatagatttacaagaattagagcatgctgtacttttaaatccatatatagaaagtgcaacggttttttacacaatagacggcgagttaaaacaatcgtaa

SEQ ID NO: 18172 - protein, 103 aa, Unknown
  Obtained from environmental sample
  misc_feature (1)..(103): Xaa is any amino acid
MKKATTYLFFVLLIASLGFLYSFSLVKNSNKKIKKVTIEFAEGNNDFLTQEMVNKLLIQNSKELKNQPKSVIDLQELEHAVLLNPYIESATVFYTIDGELKQS

SEQ ID NO: 18173 - DNA, 627 bp, Unknown
  Obtained from environmental sample
  misc_feature (1)..(627): n is a, c, g, or t
ttgatacaagaacagaattcgtatccaggaattactaataaaatattaagtaaaaaagcaaaatcaatttgtgtggcttatgatcatttagagcgattttttcctgttgataaaattgtaaaaacaggaaatcctgtaagacaagatctattgacaattcatcataaaacagaagaggcaaaagcattttttaagttagatgcaactaaaaaaacaatattgattttaggcggaagtttaggagcaagaaggatcaatcaattaattgaagcgcaattagatttttttaaaaatgaagaagtgcaacttatttggcaatgtggtgcattctatattgatgaatatcaaaaatacaataaaaacaaaaacgtacaagttcatcaatttttaaacagaatggatttagcatatgcagcagcagatgttattatttctagagctggagcgagttcggtttcagaattatgtattgttggcaaaccaacaatttttataccgtcgccaaatgttgcggaagatcctccaaaccaaaaaacgcaaaatccattgccgataagcttgggccaaattttattacacgaaagtgagttagaaacgtttcccattgtgtttgaaacctttgattga

SEQ ID NO: 18174 - protein, 208 aa, Unknown
  Obtained from environmental sample
  DOMAIN (72)...(207): Glycosyltransferase family 28 C-terminal domain
  misc_feature (1)..(208): Xaa is any amino acid
MIQEQNSYPGITNKILSKKAKSICVAYDHLERFFPVDKIVKTGNPVRQDLLTIHHKTEEAKAFFKLDATKKTILILGGSLGARRINQLIEAQLDFFKNEEVQLIWQCGAFYIDEYQKYNKNKNVQVHQFLNRMDLAYAAADVIISRAGASSVSELCIVGKPTIFIPSPNVAEDPPNQKTQNPLPISLGQILLHESELETFPIVFETFD

SEQ ID NO: 18175 - DNA, 333 bp, Unknown
  Obtained from environmental sample
  misc_feature (1)..(333): n is a, c, g, or t
ttggaattagccacagtacatgtgtatggtaacccaatgatcaatcaagagccaaagctacttgaagctatggtaactcgcttaactcattaccacgagaataaaattgaatctaattggtctttaaatgaagttagtaagaaagacttcacaaacgatctcaaagcaattgttggaatagaaattgaaataaccagaatggaaggaaaattcaaattcaatcagaacaaaagcagagaagaccaagccaaagtggtagaaaatttagatgatttaggcattgatgaggttagtcagattatgaaaaataatctgacttctaaagaagtataa

SEQ ID NO: 18176 - protein, 110 aa, Unknown
  Obtained from environmental sample
  misc_feature (1)..(110): Xaa is any amino acid
MELATVHVYGNPMINQEPKLLEAMVTRLTHYHENKIESNWSLNEVSKKDFTNDLKAIVGIEIEITRMEGKFKFNQNKSREDQAKVVENLDDLGIDEVSQIMKNNLTSKEV

SEQ ID NO: 18177 - DNA, 354 bp, Unknown
  Obtained from environmental sample
  misc_feature (1)..(354): n is a, c, g, or t
gtggagcgcatctccccccattacaagctttttcactcttccaacttctatccattgcacctctggcggcaaggtttcctggctatctgggccaaaatcaagattgacaattttttgaaaatcgaacaaatcagacccgctgtcgccagtcaacgaccaaaagaaacgaatacgatcttcattggaaaaactatcaaatcgaatttctgttgtcggtgctgtggttggaacatgattggtttccttgaatttgctgataagcctcttggatacgttgtcagcaattcttttaagtctctgctgcggtatgtacgattcgtaattctacttgattacccgattgaacttttctaa

SEQ ID NO: 18178 - protein, 117 aa, Unknown
  Obtained from environmental sample
  misc_feature (1)..(117): Xaa is any amino acid
MERISPHYKLFHSSNFYPLHLWRQGFLAIWAKIKIDNFLKIEQIRPAVASQRPKETNTIFIGKTIKSNFCCRCCGWNMIGFLEFADKPLGYVVSNSFKSLLRYVRFVILLDYPIELF

SEQ ID NO: 18179 - DNA, 306 bp, Unknown
  Obtained from environmental sample
  misc_feature (1)..(306): n is a, c, g, or t
gtgcaatattttctttttaggataaattatatgaagattttagttcttaactgcggaagctcatctattaaataccagctcattaatactgaattgcaagaatgcctttgcaaaggaataatcgaacgaattggtgccgttgcatctattataaggcaagagtggaaaggtgagaaggtagttaagaagtcgatggtgttagaaaatcatactaccgctttaaaaacaataatggatttgctaattgaagcagataacgattacctcatagtttgtctggaattgaagttgttggacaccgtgtag

SEQ ID NO: 18180 - protein, 101 aa, Unknown
  Obtained from environmental sample
  misc_feature (1)..(101): Xaa is any amino acid
MQYFLFRINYMKILVLNCGSSSIKYQLINTELQECLCKGIIERIGAVASIIRQEWKGEKVVKKSMVLENHTTALKTIMDLLIEADNDYLIVCLELKLLDTV

SEQ ID NO: 18181 - DNA, 378 bp, Unknown
  Obtained from environmental sample
  misc_feature (1)..(378): n is a, c, g, or t
atgaaaacaaattataaaaaatttatagccgaaggattactaattgtttttagtgttttattcgccctgtttattaacaagttgtttgatgattatcaaactaatagcaaaaaaaacatcgctatagaaagcatcaaaaaagagcttgctcaaaatcaaaaaatcttaatgagatggaaagaaaaacatattaaagtaagaactcggatttcatcaattttagacggtaaaaatgacagcctaaaaacagagctccagcagggtcagttttttaatttaggtatactaactgataatgaatctttgatagatgctattctaaccaatacggcttgggaatcccgtaaaactacgggtattattcggaatttgatttga

SEQ ID NO: 18182 - protein, 125 aa, Unknown
  Obtained from environmental sample
  misc_feature (1)..(125): Xaa is any amino acid
MKTNYKKFIAEGLLIVFSVLFALFINKLFDDYQTNSKKNIAIESIKKELAQNQKILMRWKEKHIKVRTRISSILDGKNDSLKTELQQGQFFNLGILTDNESLIDAILTNTAWESRKTTGIIRNLI

SEQ ID NO: 18183 - DNA, 432 bp, Unknown
  Obtained from environmental sample
  misc_feature (1)..(432): n is a, c, g, or t
atgaaagattatttaaatgatttaagaaaatactatttgttgtatttaattttattgattggtttgatatttgtttcaacaattagtcatgtatttctagtcaaatttattaggctaccttggtatgattttgatgtgctactcatttttgtattgccatttttattgacaatattttcagtttataaaattttgaaacaaaaatttgatgaaattgaaccgactaatatacaaacaaagcttaatattaaatcattttttacctttctattagttctaccaataatcgcaagccaatactatattgatgccaggttaaatagaatgattgatattaatagtgtctcaaatatcaaagattatccgactgataaatattttaaaatccacgaatacaatattgataaaacatttttgaagttgatttattaa

SEQ ID NO: 18184 - protein, 143 aa, Unknown
  Obtained from environmental sample
  misc_feature (1)..(143): Xaa is any amino acid
MKDYLNDLRKYYLLYLILLIGLIFVSTISHVFLVKFIRLPWYDFDVLLIFVLPFLLTIFSVYKILKQKFDEIEPTNIQTKLNIKSFFTFLLVLPIIASQYYIDARLNRMIDINSVSNIKDYPTDKYFKIHEYNIDKTFLKLIY

SEQ ID NO: 18185 - DNA, 600 bp, Unknown
  Obtained from environmental sample
  misc_feature (1)..(600): n is a, c, g, or t
ttgacaaaacctatgttcatttttgcagcactgggagggtctaaaatagagacttttttaaaaagtgtgtttttttataattttttttatcccctatattactgcgtattttgtaattgcaaaaaacttggcatgaaatatgctacagattatatggtaaatatggggaggaaaatattggaacaaaataattatttatttacaatcaatattgataaattaattaatgaaattgacattataaatcttaagtttttgtcagttttgtggcttgcaaatcaatgtaatttgaaagcttataaattatcaagaatttataaaaatgatagtggaaaatcattgaaaaattatatttttcaagtaaaaatgaatagagctattgaattacttaatataaaaaataatctaactattaatgaggtctcaaaaatcattggatataagaattctgagtatttttcaaagatttttaacgagtattataataaaacaccttttgaagtaaaaaattcttcaaaaataaatagccgaattatgcaaaagtttcgggggttacaatgtagggattatgatttattaacaattaaaaaattgagttaa

SEQ ID NO: 18186 - protein, 199 aa, Unknown
  Obtained from environmental sample
  DOMAIN (125)...(170): Bacterial regulatory helix-turn-helix proteins, AraC family
  misc_feature (1)..(199): Xaa is any amino acid
MTKPMFIFAALGGSKIETFLKSVFFYNFFYPLYYCVFCNCKKLGMKYATDYMVNMGRKILEQNNYLFTINIDKLINEIDIINLKFLSVLWLANQCNLKAYKLSRIYKNDSGKSLKNYIFQVKMNRAIELLNIKNNLTINEVSKIIGYKNSEYFSKIFNEYYNKTPFEVKNSSKINSRIMQKFRGLQCRDYDLLTIKKLS

SEQ ID NO: 18187 - DNA, 441 bp, Unknown
  Obtained from environmental sample
  misc_feature (1)..(441): n is a, c, g, or t
atgagagagtttttgaaaaaaatagaggcaaagagtattattatgtttataagaataaaggaaatcttctatcaatatgcaatgggtaatcctataagattgaatgattcaaaggggttggctacaaatagctcaaagaaatggaaatatgaaaaacaagattttggaaaaaacattgaactacatttgtatccttctgcagatggtattacaggtaatgtaaaagtagaagttgtatcatacccgtattgtaaagagggcgaagtatatagttttgaaaaattcatacagtttagtataaactcaaaaaaatctatatggtcgtatataatagagaggagtaaattagttaaagtcatccaagaaatcaaatcatccaaaacaacatggaatataacaaaatgccaatcaatcaaaaagtcgattttgccctacttatga

SEQ ID NO: 18188 - protein, 146 aa, Unknown
  Obtained from environmental sample
  misc_feature (1)..(146): Xaa is any amino acid
MREFLKKIEAKSIIMFIRIKEIFYQYAMGNPIRLNDSKGLATNSSKKWKYEKQDFGKNIELHLYPSADGITGNVKVEVVSYPYCKEGEVYSFEKFIQFSINSKKSIWSYIIERSKLVKVIQEIKSSKTTWNITKCQSIKKSILPYL

SEQ ID NO: 18189 - DNA, 354 bp, Unknown
  Obtained from environmental sample
  misc_feature (1)..(354): n is a, c, g, or t
ttgatgaggcattttaaaacaaaaagaggctttttaaagcctctttttttagtttattttgtttttttaattgcaatgtacaatccatacaaaaaactaattataattttaaaaccccaaaaacgctgccatttcccttcagaaaaatttacttcatttacttttgcaaaatcgccagcaaaaatagctctccaactcgtcataaataacgaaatgagtgtaacaaatagtaaaaacggaagcgcaatttttaaaacgtttgtccaaaaccctggagattttagtttttctaatatggtcattattgtagttttttattattgtgatgtctatcgtgatctcgtgttgttttaa

SEQ ID NO: 18190 - protein, 117 aa, Unknown
  Obtained from environmental sample
  misc_feature (1)..(117): Xaa is any amino acid
MMRHFKTKRGFLKPLFLVYFVFLIAMYNPYKKLIIILKPQKRCHFPSEKFTSFTFAKSPAKIALQLVINNEMSVTNSKNGSAIFKTFVQNPGDFSFSNMVIIVVFYYCDVYRDLVLF

SEQ ID NO: 18191 - DNA, 471 bp, Unknown
  Obtained from environmental sample
  misc_feature (1)..(471): n is a, c, g, or t
atgagagcgactattcgaaatttattcgttgaacgtggggtgcattccgactatttctggcgactttatttaaacggacaatattctgtgaaatgttgccctaattacttaaaagaagagcattttaagtctataaatagccaacttcataaattgagtttttcaaccgctactgtgacctcttttctgaactcaactgataaaaaatattctcattttatattgcttgaccatcaggactggttgattggaagcggaactaaggaacttgaagaggaatggatagcaattattaaagctgccaaacctaaggcaaaggtattattccgatcagttcataaaaaccttcattttctaccgaattttgtatcagaacggatttctgtcattccaatagaccaaaattatttattgcaaaatgatcgtgtaggaacctacccctccacttttgttttagaagttgatgtttaa

SEQ ID NO: 18192 - protein, 156 aa, Unknown
  Obtained from environmental sample
  misc_feature (1)..(156): Xaa is any amino acid
MRATIRNLFVERGVHSDYFWRLYLNGQYSVKCCPNYLKEEHFKSINSQLHKLSFSTATVTSFLNSTDKKYSHFILLDHQDWLIGSGTKELEEEWIAIIKAAKPKAKVLFRSVHKNLHFLPNFVSERISVIPIDQNYLLQNDRVGTYPSTFVLEVDV

SEQ ID NO: 18193 - DNA, 537 bp, Unknown
  Obtained from environmental sample
  misc_feature (1)..(537): n is a, c, g, or t
atgaaatctctttcaagaaattgcgaaattacactcaaaattcaaaagatatttttggaatctaacagcgttatatattacaaaacacccatcggaactgcaaaaattattggagatgaaaacggaattcaatctatttctgttttagatgatattatagaaacatctaaaaatattccattatttttaaaagattgtattgctcaactagaagaatattttgcaggaacaagaaccgagttcaagttgaaattaaatccgcaaggaaccaaatttcagcaaaaagtttggaaagagcttttaaatattccttttaataaaaccagaacgtatctagaacaaaccaaagcaattggcgatgtaaaagccattagagcagtcgcatcagcaaacggtaaaaatccaatttggattgtaattccgtgtcaccgggtgcttggttctgacggatctttaactggttatgcgggcggaatctggcgtaaaaaatggttgttagatcacgaaaatccagtaaagcaacagtcgttgttttaa

SEQ ID NO: 18194 - protein, 178 aa, Unknown
  Obtained from environmental sample
  DOMAIN (89)...(177): 6-O-methylguanine DNA methyltransferase, DNA binding domain
  misc_feature (1)..(178): Xaa is any amino acid
MKSLSRNCEITLKIQKIFLESNSVIYYKTPIGTAKIIGDENGIQSISVLDDIIETSKNIPLFLKDCIAQLEEYFAGTRTEFKLKLNPQGTKFQQKVWKELLNIPFNKTRTYLEQTKAIGDVKAIRAVASANGKNPIWIVIPCHRVLGSDGSLTGYAGGIWRKKWLLDHENPVKQQSLF

SEQ ID NO: 18195 - DNA, 417 bp, Unknown
  Obtained from environmental sample
  misc_feature (1)..(417): n is a, c, g, or t
ttgatgaaaaatctgattcaggaattcaaaaaatttgtttctcgcggtaacgttatagaattggcagtaggtttaattcttgcaacttatttcggcgctattgttaagtcatttgttaatgatataatcatgcctccagttggatactttattgctggggtagattttagtgaactcacaatcactgtttcggaaaaaatcctcgcggacggtactttagaagtaattaccattaactacggtacttttataaataccattatcactttttttatagtcgcatttgcaatatttgctatcgtaaaagcctacaataattttatgaaaaaagaagaagagaaacctgctcctaaacctgtagagccttccaaagagcaagtattacttaccgaaatcagagatttactcaaaaaataa

SEQ ID NO: 18196 - protein, 138 aa, Unknown
  Obtained from environmental sample
  DOMAIN (5)...(138): Large-conductance mechanosensitive channel, MscL
  misc_feature (1)..(138): Xaa is any amino acid
MMKNLIQEFKKFVSRGNVIELAVGLILATYFGAIVKSFVNDIIMPPVGYFIAGVDFSELTITVSEKILADGTLEVITINYGTFINTIITFFIVAFAIFAIVKAYNNFMKKEEEKPAPKPVEPSKEQVLLTEIRDLLKK

SEQ ID NO: 18197 - DNA, 672 bp, Unknown
  Obtained from environmental sample
  misc_feature (1)..(672): n is a, c, g, or t
atgctgttgaacaagctgaacttatttaaaaattcaaacatcactcaaaacgagtttttagaaaaatattggcatcaaaaacctttattattgaaaaatgctattgcgaaagatgaattagataaactgcctaataaaactaagttaattcaattgagctgtcatgaagagattcaatcaagaattgtctttaaacaatctgaagatgattattccgttgagtttggaccattcttagaaaacgattttgaagaaatcaatcaagacacatggaatttattggtttcagatgtcgacaaatggcaaccacaaagccgaaaaatattagaatattttgggtttattcgcaattggatttttgatgacatcatgttgagctgtggctcaattaacggaacggttggtccgcatactgatctatatgatgtgtttcttgttcaagttgaaggtcaaaggcaatgggcatttagtcaagataaaataatcaatcctaaatttaaaccggatttagaacttaaattaatgtcaaattttaaagcggatgaaattcacactttaaacccaggagatgtttatatattccacctcaagtcggacattatggcattgccaaaacagaggattgcgtcacttgctctgtcggcacaagaacccttcgcatctgaattatga

SEQ ID NO: 18198 - protein, 223 aa, Unknown
  Obtained from environmental sample
  misc_feature (1)..(223): Xaa is any amino acid
MLLNKLNLFKNSNITQNEFLEKYWHQKPLLLKNAIAKDELDKLPNKTKLIQLSCHEEIQSRIVFKQSEDDYSVEFGPFLENDFEEINQDTWNLLVSDVDKWQPQSRKILEYFGFIRNWIFDDIMLSCGSINGTVGPHTDLYDVFLVQVEGQRQWAFSQDKIINPKFKPDLELKLMSNFKADEIHTLNPGDVYIFHLKSDIMALPKQRIASLALSAQEPFASEL

SEQ ID NO: 18199 - DNA, 456 bp, Unknown
  Obtained from environmental sample
  misc_feature (1)..(456): n is a, c, g, or t
atgaatgccgataatagcaaggtagtctttgaagccacacatggaatagttgatgagattcttgacaaaactattgaaaaactcttctgcgtatatgttcgaagtgacaataatacgattgaagcatgtgagtttttgctaaagttgtgtgaacaccagtattggtatgagttttatctcgaatttggtttttgtaagtggattcgatatgaaaagtacccagacgatttttttttagaagatttagaaagtgatatgaaagtcgacctttcagatcggaacggagtcactggtctgaaaattgagaaagcctcggttcaacaaatctccaaaggtgtgagtcttgagttacatctttcagataagactcatttcaaactagaaaatgaatattttgaaaaggaagatgatattggtgagcaaactaaattaaatatttacaacagtgatgcataa

SEQ ID NO: 18200 - protein, 151 aa, Unknown
  Obtained from environmental sample
  misc_feature (1)..(151): Xaa is any amino acid
MNADNSKVVFEATHGIVDEILDKTIEKLFCVYVRSDNNTIEACEFLLKLCEHQYWYEFYLEFGFCKWIRYEKYPDDFFLEDLESDMKVDLSDRNGVTGLKIEKASVQQISKGVSLELHLSDKTHFKLENEYFEKEDDIGEQTKLNIYNSDA

SEQ ID NO: 18201 - DNA, 624 bp, Unknown
  Obtained from environmental sample
  misc_feature (1)..(624): n is a, c, g, or t
ttgtttatcaccacaattcttactgtactttgtggagtatttttaagaattgtcttgcaaataatgttatctttaaaattcaacagagcaaactactttatattgaaccacttttctaaaatatttctaatattcataatcattaccatgagtagttgtaccaactatgtactctttaaaagtgttcctgtaaaaaacgttccttttatagaaaattttgacagtcaagaggcttttaatacaaattggaaagacaactcttttggtcaccctacatcgtatcacttagaaaaaaacagtttaaaaattaccacacgaccaaacagcaaggatagaataaaagtaaaaaccaaacgtaaaaattttggacttggcacttatgaatggaacatttacgttccgaaatttgatttaaacgaccaatgtagcattggtgcttttatttatcattcaggaagaacatcttacgaaatagattctgacataggatcaggaaacaaagaagaccgcaaagaggttgcttgcaagcctaatgaagcacttgtccattgcacatcacaacacaccccaaattcttcacgaacttttaaagtaattcccgagcatgggctacttttaaactaa

SEQ ID NO: 18202 - protein, 207 aa, Unknown
  Obtained from environmental sample
  misc_feature (1)..(207): Xaa is any amino acid
MFITTILTVLCGVFLRIVLQIMLSLKFNRANYFILNHFSKIFLIFIIITMSSCTNYVLFKSVPVKNVPFIENFDSQEAFNTNWKDNSFGHPTSYHLEKNSLKITTRPNSKDRIKVKTKRKNFGLGTYEWNIYVPKFDLNDQCSIGAFIYHSGRTSYEIDSDIGSGNKEDRKEVACKPNEALVHCTSQHTPNSSRTFKVIPEHGLLLN

SEQ ID NO: 18203 - DNA, 660 bp, Unknown
  Obtained from environmental sample
  misc_feature (1)..(660): n is a, c, g, or t
atggcagagttttgntggggacaatcgccaaatacagaagtcagaaaacacaactatttttatccagcttgtcaaggaaagtgcaaaccaattttagcgcacatgttatcgggaattgaaatggacacaaatccgatgttgcaaaaccctgcaatcggcaaagaactcgaactcatttttcaagatgaagatgtaattgtaattcacaaacctgctgagtttttatcagttccgggaattcacattcaagattctgtttatacgagaatcaaacaacaatatccacaaataactggccctataattgtgcatcgattagacatgtctacttctggattagttgtgttggcaaaaaataaaaaagcgcacaaagaattgcaacgtcaatttatcaataaaactgtttctaaaaaatacgtggctttattggatggaaatcttgaagaaaactctgggacaattaatttacctttgcgtgtagatttggatgatagaccaagacaattggtttgttttgaacacggaaaaaaggcagaaactaagtgggaagttatcgaacgaaaagacaacaaaacaagagttcatttgtatccaattacaggaagaacgcatcaattgagggttcacacttcgcattctttggggttaatattccaataa

SEQ ID NO: 18204 - protein, 219 aa, Unknown
  Obtained from environmental sample
  DOMAIN (64)...(212): RNA pseudouridylate synthase
  misc_feature (1)..(219): Xaa is any amino acid
MAEFXWGQSPNTEVRKHNYFYPACQGKCKPILAHMLSGIEMDTNPMLQNPAIGKELELIFQDEDVIVIHKPAEFLSVPGIHIQDSVYTRIKQQYPQITGPIIVHRLDMSTSGLVVLAKNKKAHKELQRQFINKTVSKKYVALLDGNLEENSGTINLPLRVDLDDRPRQLVCFEHGKKAETKWEVIERKDNKTRVHLYPITGRTHQLRVHTSHSLGLIFQ

SEQ ID NO: 18205 - DNA, 558 bp, Unknown
  Obtained from environmental sample
  misc_feature (1)..(558): n is a, c, g, or t
atgggtagcaatggcttaacttctgctcgacatgatgttttcggaaaagagttagcggataaatttccagaaagttttgacccagcagtaccaagtgatttagtttattctggttctaaaagtttaatggaagatgtaggcgctcctgttaatgcagggaaattagttttatctccaacacgaacttatgctccagtcattaaacaaattttagataaacatagaagtgagattcacggaatggttcattgttctggcggagcacaaacaaaagttttgcattttgtaaaaaatgtacatgtgataaaagataacttatttgaaattccaccactttttaaattgattcaagatgaatcaggaacagattggaaggaaatgtataaagtattcaacatgggacaccgcatggaattgtatgtgcctcaagagattgcagaatcaataattgagatttctaagtcatttaatattgatgctcagattataggacgagtagaatcaaatgacggaaataaattaaccattaattcaccttatggtgagtttatctactaa

SEQ ID NO: 18206 - protein, 185 aa, Unknown
  Obtained from environmental sample
  DOMAIN (29)...(177): AIR synthase related protein, C-terminal domain
  misc_feature (1)..(185): Xaa is any amino acid
MGSNGLTSARHDVFGKELADKFPESFDPAVPSDLVYSGSKSLMEDVGAPVNAGKLVLSPTRTYAPVIKQILDKHRSEIHGMVHCSGGAQTKVLHFVKNVHVIKDNLFEIPPLFKLIQDESGTDWKEMYKVFNMGHRMELYVPQEIAESIIEISKSFNIDAQIIGRVESNDGNKLTINSPYGEFIY

SEQ ID NO: 18207 - DNA, 738 bp, Unknown
  Obtained from environmental sample
  misc_feature (1)..(738): n is a, c, g, or t
ttgttactagctgcagagataaagaagagaacaggaattcctacagttatggatttacgagatgagtggcttgaaagtcatcttatcaaatatccaacgggatggcataaacagaaaatgaggaagatcgaggaagacactctttcccagaccgatattctgacggttatcaatgatccttacaaagaatctatagggagtcgttatccagctctagatataagagttattaatcaagggtatgaccccgaacactttgaaacggaagaaggagctatacgaccttccgataaaatgattcttttttatagcggcttattttatggcgatagaaagcccgatttattcttagaatcaatctttgagttactagaagagaatccaaactatagaaacaaattagaacttcactttcagggagggttagattctcaaactcaaatgctcattgaaaaatataagcttcaagaagttgtgcaagattatggatatgtgaaccataaggtagcggttaagaatattatgaaagcagatgttctttggctaatggtagggcatatgaatcattcggataaagttacagtaggtaaaatgttcgaatattttggcccaaagaaacctatacttgctcttgtacccgatggtggaacaagaacgctattagaagaatatggagcttactatattgcgaaaccagaatcaagaaatgagattaacctggaattgacaaaatgttaa

SEQ ID NO: 18208 - protein, 245 aa, Unknown
  Obtained from environmental sample
  misc_feature (1)..(245): Xaa is any amino acid
MLLAAEIKKRTGIPTVMDLRDEWLESHLIKYPTGWHKQKMRKIEEDTLSQTDILTVINDPYKESIGSRYPALDIRVINQGYDPEHFETEEGAIRPSDKMILFYSGLFYGDRKPDLFLESIFELLEENPNYRNKLELHFQGGLDSQTQMLIEKYKLQEVVQDYGYVNHKVAVKNIMKADVLWLMVGHMNHSDKVTVGKMFEYFGPKKPILALVPDGGTRTLLEEYGAYYIAKPESRNEINLELTKC

SEQ ID NO: 18209 - DNA, 762 bp, Unknown
  Obtained from environmental sample
  misc_feature (1)..(762): n is a, c, g, or t
ttggcgaagatggacatcacagaattggcaaattggtttgacaaactcgataaaaaaatctctaaaaggcaattaacaattgctgaagaaattttaaaagaaattagaactcgaattcagtttttactagatgttggtttagattatttaaacttagacagaacttcaaaatcgctgtctggcggagaagcgcaacgtatcagattggcaacacaaattggttctcaactagttggcgtgttgtatattttagacgaaccgagcattggtttacatcaaagagacaatcaaaaattaattgattctttaataaaattacgagatatgggcaattcggtgctggttgtagaacatgataaagacatgattgaagccgcagatttggtgtttgatattggccctggagctggaagacatggcggagaaattgtaagcgaaggaacgtttgaagaattaaaaaaacacgatacgttaactgcggattatatcacaggtaaaaaagtaattgctgttcctaaaaaaagaagaaaaggaaacggaaaaaaaattcaattaaaaggagcgacaggaaataatttaaaaaatgtttcagtagattttcctttaggaaaaatgatttgcgttactggagtttctggaagcggaaaatcaaccttgataaatgaaacattgtatccaattttaaaggcacatatttatcgtggcgttaaaaaaccaatgccgtacaaaagcatcaaaggcttagaacattttgataaaagt

SEQ ID NO: 18210 - protein, 254 aa, Unknown
  Obtained from environmental sample
  DOMAIN (4)...(135): ABC transporter
  misc_feature (1)..(254): Xaa is any amino acid
MAKMDITELANWFDKLDKKISKRQLTIAEEILKEIRTRIQFLLDVGLDYLNLDRTSKSLSGGEAQRIRLATQIGSQLVGVLYILDEPSIGLHQRDNQKLIDSLIKLRDMGNSVLVVEHDKDMIEAADLVFDIGPGAGRHGGEIVSEGTFEELKKHDTLTADYITGKKVIAVPKKRRKGNGKKIQLKGATGNNLKNVSVDFPLGKMICVTGVSGSGKSTLINETLYPILKAHIYRGVKKPMPYKSIKGLEHFDKS

SEQ ID NO: 18211 - DNA, 654 bp, Unknown
  Obtained from environmental sample
  misc_feature (1)..(654): n is a, c, g, or t
ttggcaactcgttatctccaatcccaaaagcacaaatcacaaggtatgaaacgaattactagtctgctgatcctgtttgtaatggggggcgctgctctcatggcacaggaaaaatacaatgactttattccggttggtccagcaccaattgatttcaaagtttacggcggccaactcttctcagagctgtccattgacgaagccaacaacgaagaggtcctcaacctcctccccaatgaattgactcacaaatccatcgtcaccatcgacaaaaagggagaaatctccttttctgcaatcgaattgtctcagaaggatttcacctatatcgtaaagacagactacatcaagtacaccactttgccggtccgtaaggatgcggaatcgggagaaaacattggtgttgcccgggtcggagtaggcatccgcgtcgaagccaccatgcgtaccaaaaagaaaaacatcaccgtaagtgacctgtatgcgcttggtacttctgccaacgaaaaaggcctgagcggtcacatcacggtgtccatcatgggcattgaatcggaagaagcaacctccatcttccacgtctacgccgaaatcagcccaacttcaattgctgaaactttgcaaaccatcgttcncgtgaagtcgaccatttag

SEQ ID NO: 18212 - protein, 217 aa, Unknown
  Obtained from environmental sample
  misc_feature (1)..(217): Xaa is any amino acid
MATRYLQSQKHKSQGMKRITSLLILFVMGGAALMAQEKYNDFIPVGPAPIDFKVYGGQLFSELSIDEANNEEVLNLLPNELTHKSIVTIDKKGEISFSAIELSQKDFTYIVKTDYIKYTTLPVRKDAESGENIGVARVGVGIRVEATMRTKKKNITVSDLYALGTSANEKGLSGHITVSIMGIESEEATSIFHVYAEISPTSIAETLQTIVXVKSTI

SEQ ID NO: 18213 - DNA, 330 bp, Unknown
  Obtained from environmental sample
  misc_feature (1)..(330): n is a, c, g, or t
ttggctttcggtgaaattccaacaagctcagaagaatctaatgatagacttagacttgattcagttccagaaaaaatcgtagccagatataaaggtgaagtcggttatattttgaagcattcaattacttatggtttgaatcacaaccttactttgaatgagttaaaaaggcttatgaaatatattactaacaaaagagcgttccatatttttttagaagaaaaaggattaagtaagagggacatactaattgatgcattatatttatttcgaaaccagatatatgtttatggagacataaatcaaaagttagtttcgtgtcacaaatag

SEQ ID NO: 18214 - protein, 109 aa, Unknown
  Obtained from environmental sample
  misc_feature (1)..(109): Xaa is any amino acid
MAFGEIPTSSEESNDRLRLDSVPEKIVARYKGEVGYILKHSITYGLNHNLTLNELKRLMKYITNKRAFHIFLEEKGLSKRDILIDALYLFRNQIYVYGDINQKLVSCHK

SEQ ID NO: 18215 - DNA, 726 bp, Unknown
  Obtained from environmental sample
  misc_feature (1)..(726): n is a, c, g, or t
atggagaaagacttagatgaattggttgctaaaaaaagctggaaagaagagaatgaagtatatataaaagatagtagttcaagagatttaaatgcatttaaaagtattgtaaagatacttaacattaaaaaagatgagtttaatgatttagaagttgatactgactttattaatgaacttgcagaacgtcaactgagaacaattgaagaaactcttagaaaaagtcttgatttaattaataaggaaggaatagagtctaaagaagtcggaacacttttaaccaatattaaaaataaaaactccgaattatcgaatcttatagacaatatacaaagcgtcaataaatcagttgacttaaattttttaacaactaaatctaaagaactccagactactacaaaagaattcgaagaaacttatgaaaagctcaaaaaagctgaagatgaattaaaaagatcagaaaacgagaaaaaaagagttgaagaagaattaagattagagaaagagaagaatacttacttattggcatcagaaaagggacttagtcaagatgccaaaggtctctatcatagtataaaaattacatctaagacaattaaatctgtttcagaagacctaatagagaaactttcatcagaaagtttttcaacaaaatatatattgaataaaattcgtgtgattaaatacaattcggagaaggcgttaaaaattacacaccttataacn

SEQ ID NO: 18216 - protein, 242 aa, Unknown
  Obtained from environmental sample
  misc_feature (1)..(242): Xaa is any amino acid
MEKDLDELVAKKSWKEENEVYIKDSSSRDLNAFKSIVKILNIKKDEFNDLEVDTDFINELAERQLRTIEETLRKSLDLINKEGIESKEVGTLLTNIKNKNSELSNLIDNIQSVNKSVDLNFLTTKSKELQTTTKEFEETYEKLKKAEDELKRSENEKKRVEEELRLEKEKNTYLLASEKGLSQDAKGLYHSIKITSKTIKSVSEDLIEKLSSESFSTKYILNKIRVIKYNSEKALKITHLIT

SEQ ID NO: 18217 - DNA, 852 bp, Unknown
  Obtained from environmental sample
  misc_feature (1)..(852): n is a, c, g, or t
atgtgtgatagaacaggaaagatgtttgagggaaaaatgaaagaaattgaattcttatcgaaaaatgatgtactaaaggagtttgaaaaaattgaaatttcaaattgttcaaatatgcataaaatctcaaattccgaacagttaaaaatcttacaaataaaaatcacagaattaatcaacgaaaggaatgaattattaaacgctgattttgcaaataatatacaaaacagactggaaagagtatttacttcctctacagaaattagtgatttacattctctatttttaagtttcattacaaattatgaaggagtttttgaaactacacctattgtcttttatccacaaaatttaagctttaataaaaaatttatatcaaataaatcaaaagttataaacttaacacttgataaatttccatctttaaaatatcaaactgaatggaatcaaattatagaaatcaaatctgatgaagacctgaaacataaataccttaaactaaataattggataaatgaagttgctttggaaagttattctataaatgaaattaaagaaaagttagaatttatgttagcagattatgaaaaacaactaaaatatcactcaaaacaaatagaatataataaacttgaattactacttaattcgagtataggaataattgaaaaccttcttaaattaaatttaactgaaataggaaaaaacactattaatgcaaaaaaggaaaaattgaatttagaaattaataagcaatttttatctggtaatgagattgcatatataactgaagtcggaacaaaaaaatcactacaaaaaactacctacaacaacgtgtatattaatggctag

SEQ ID NO: 18218 - protein, 283 aa, Unknown
  Obtained from environmental sample
  misc_feature (1)..(283): Xaa is any amino acid
MCDRTGKMFEGKMKEIEFLSKNDVLKEFEKIEISNCSNMHKISNSEQLKILQIKITELINERNELLNADFANNIQNRLERVFTSSTEISDLHSLFLSFITNYEGVFETTPIVFYPQNLSFNKKFISNKSKVINLTLDKFPSLKYQTEWNQIIEIKSDEDLKHKYLKLNNWINEVALESYSINEIKEKLEFMLADYEKQLKYHSKQIEYNKLELLLNSSIGIIENLLKLNLTEIGKNTINAKKEKLNLEINKQFLSGNEIAYITEVGTKKSLQKTTYNNVYING

SEQ ID NO: 18219 - DNA, 738 bp, Unknown
  Obtained from environmental sample
  misc_feature (1)..(738): n is a, c, g, or t
atgagtaaaaactttttaaatctaacgtcaatttttgtgctttttttattcattcttatagtttcattacctgtggaggctaaaaagataaaaaagagacgttcttcaaaaattaaagttttactggttgatgggcagagtaaatttcattcaggttggaaagaatggactccggttttactcaagcaattagatgattccgggctgtttcaagttgatattgctacctccccaatgaaaggtgaaagcctggataaattcaatccgaaatttaaaaaatacgaagtggtggtctcaatatacgatggagatacctggtcgatgcgtacccaacggaatttggaaaagtatgtagaaggaggaggaggattagtgattgtacatgctgctgacaatgcttttgcagactggaaagcctacaacatcatgattggacttggaggctggggagagcgcactgaaacggctggaccttatgtttatattgatgataaaggtgaaacaatcagggacacttctcctggaaaaggaggccaccatggcccaaagcacgaatatgccgttgaaacacaagctcctgatcatccaattatgaaagacatacctgccaaatggctccatgctgaggatgaattgtatgacatgttacggggacctgccacaaatatggaaatattagcaactgcatattcctctgaaaaatatgatggaaccctcagaaatgaacctatcttatga

SEQ ID NO: 18220 - protein, 245 aa, Unknown
  Obtained from environmental sample
  misc_feature (1)..(245): Xaa is any amino acid
MSKNFLNLTSIFVLFLFILIVSLPVEAKKIKKRRSSKIKVLLVDGQSKFHSGWKEWTPVLLKQLDDSGLFQVDIATSPMKGESLDKFNPKFKKYEVVVSIYDGDTWSMRTQRNLEKYVEGGGGLVIVHAADNAFADWKAYNIMIGLGGWGERTETAGPYVYIDDKGETIRDTSPGKGGHHGPKHEYAVETQAPDHPIMKDIPAKWLHAEDELYDMLRGPATNMEILATAYSSEKYDGTLRNEPIL

SEQ ID NO: 18221 - DNA, 507 bp, Unknown
  Obtained from environmental sample
  misc_feature (1)..(507): n is a, c, g, or t
atggaaaacaaaaaaagacttataaagctgggtttaatacaaacaagttgcgttaaagattcatctgaaaatatttcacaaagtgtagaactcataaaaaaagcagctgaagaaggtgcgagtattatatgtcttcaagaactttttactactctttatttttgcaatacacacgatgagaataattttgatttagctgaatccattgatggtagtttagtacaacaactaagcaaattggcaaaggaattaaatattgtattgattgctcctttctttgaaaaaagagctcagggattatatcataactcattagttgttattgatgctgatggcgctgttctaggaaattatcgcaagatgcatattcctgatgatcccggttttcatgagaagtattactttgcccctggcgataaagaatcaggatttcaggtttttaatacaaaatttggaaaaattggaacattgatatgctgggatcaatgtcctcgagccgattcttag

SEQ ID NO: 18222 - protein, 168 aa, Unknown
  Obtained from environmental sample
  DOMAIN (9)...(166): Carbon-nitrogen hydrolase
  misc_feature (1)..(168): Xaa is any amino acid
MENKKRLIKLGLIQTSCVKDSSENISQSVELIKKAAEEGASIICLQELFTTLYFCNTHDENNFDLAESIDGSLVQQLSKLAKELNIVLIAPFFEKRAQGLYHNSLVVIDADGAVLGNYRKMHIPDDPGFHEKYYFAPGDKESGFQVFNTKFGKIGTLICWDQCPRADS

SEQ ID NO: 18223 - DNA, 348 bp, Unknown
  Obtained from environmental sample
  misc_feature (1)..(348): n is a, c, g, or t
ttgagtttctgctggttgaaattgcaaggttattcgtattttcaggaaaaagcttgcaaaatgataggaaaaagagacaagtctccacagctaaatattttccaggtaccactggttcagtttatcgatcgcattaaaatagactgcatccgctgcaagggatttataaagctaaccaatgggcaggccatttttgtgcaaggggttttttctgatgtgatctttcagaaaatacctaccttcaagggatcaggagaactagtcttgatcggaacctttaaaagaaaagaaaaccttcaaatcatctacgatgaatactgtaaaagcagcggcaacaatcaactttag

SEQ ID NO: 18224 - protein, 115 aa, Unknown
  Obtained from environmental sample
  misc_feature (1)..(115): Xaa is any amino acid
MSFCWLKLQGYSYFQEKACKMIGKRDKSPQLNIFQVPLVQFIDRIKIDCIRCKGFIKLTNGQAIFVQGVFSDVIFQKIPTFKGSGELVLIGTFKRKENLQIIYDEYCKSSGNNQL

SEQ ID NO: 18225 - DNA, 603 bp, Unknown
  Obtained from environmental sample
  misc_feature (1)..(603): n is a, c, g, or t
atgaatggagatcatcagcaagagtatattgaaaaaaaaagtagcggtggacttggacgtgtgtatttcattccaacaaaagattttgaaacaatacctgagtataaatttaataatgatatacaatttaaacataaagatattgtagaaaagtacaatatacagccacaaacattttatccattaatagaaactaataaaaacaacaatataaagaacatgaaatttaggattaagaacgaagcgcatagcaaagcaattcaagaacgactatttgagctagggtatagatggtcagaaccaggtatccaatacactgaatataaatttttatacacgtgcgtttatggtaattctctacaattagaatacagttctcgtgtaagtaggttcaataatcatagtggaacagaaacaacccttgacgagctatacgaaaagaaagagtttaaaacaaccttagcttataatcatactggttttgatgtagattattatgatgttacagaaatcaaacgtaattttctaaacataggatgtaacaagatagacatcaggtcattaaagaaattgataaaagaatacgaggagtttaaatcttag

SEQ ID NO: 18226 - protein, 200 aa, Unknown
  Obtained from environmental sample
  misc_feature (1)..(200): Xaa is any amino acid
MNGDHQQEYIEKKSSGGLGRVYFIPTKDFETIPEYKFNNDIQFKHKDIVEKYNIQPQTFYPLIETNKNNNIKNMKFRIKNEAHSKAIQERLFELGYRWSEPGIQYTEYKFLYTCVYGNSLQLEYSSRVSRFNNHSGTETTLDELYEKKEFKTTLAYNHTGFDVDYYDVTEIKRNFLNIGCNKIDIRSLKKLIKEYEEFKS

SEQ ID NO: 18227 - DNA, 387 bp, Unknown
  Obtained from environmental sample
  misc_feature (1)..(387): n is a, c, g, or t
ttgtggctgtatattgtacttttctacaatatctttatgtttaaattgtatatcattattaaatttatactcaggtattgtttcaaaatcttttgttggaatgaaatacacacgtccaagtccaccgctactttttttttcaatatactcttgctgatgatctccattcatatctttttttcttcaaatataagtataataatccaaactacaaagcgtttgaaacgattaattgattatttcgttttattagtgatgattataaaatataaaatctctaattcattatctgaaattaagctaaaagattatcagaagttttatcaggtgacggaagataacgaagacgttgattttcttaccatgaagttgaatgaggtgtcnnnt

SEQ ID NO: 18228 - protein, 129 aa, Unknown
  Obtained from environmental sample
  misc_feature (1)..(129): Xaa is any amino acid
MWLYIVLFYNIFMFKLYIIIKFILRYCFKIFCWNEIHTSKSTATFFFNILLLMISIHIFFSSNISIIIQTTKRLKRLIDYFVLLVMIIKYKISNSLSEIKLKDYQKFYQVTEDNEDVDFLTMKLNEVSX

SEQ ID NO: 18229 - DNA, 543 bp, Unknown
  Obtained from environmental sample
  misc_feature (1)..(543): n is a, c, g, or t
atgagagtatttaaattatttagcgtcctagcttttgtcctactactttgtgtttcttgcgacaaagaggcgcctcgtcaaattgtatttttttctaaagatcaattaaaaaaagatttaccagttcagattaatgatacagaagggaacactgtctctgtaaattctaatacgattattaatttaaaatcatctaaagtatttaatgataatattgactatcttaaagaagttgatgtagagcaaatgagctttaaaataaaaaactttaaaataaaccctgccacaagagtttttaatattgaagtgtttgttgatgaaattaaaataacagaaaatgacattagtattgattttttaagtcttttaaataatagcttagagtttaaaataaggaataatgaaatactttctgcaatatcttctaagttattacaaagaaaacaggttgttctttcttattatagcaatgcaattactgataagttatttaattttgatcttgagttttctttaacaactaaaggtacttttgtagattaa

SEQ ID NO: 18230 - protein, 180 aa, Unknown
  Obtained from environmental sample
  misc_feature (1)..(180): Xaa is any amino acid
MRVFKLFSVLAFVLLLCVSCDKEAPRQIVFFSKDQLKKDLPVQINDTEGNTVSVNSNTIINLKSSKVFNDNIDYLKEVDVEQMSFKIKNFKINPATRVFNIEVFVDEIKITENDISIDFLSLLNNSLEFKIRNNEILSAISSKLLQRKQVVLSYYSNAITDKLFNFDLEFSLTTKGTFVD

SEQ ID NO: 18231 - DNA, 303 bp, Unknown
  Obtained from environmental sample
  misc_feature (1)..(303): n is a, c, g, or t
atgatgttaggactaagaaccactatttataaagtttcagaattgcaaaaagcaaaaaaatggtattcgaaagcattcgatacaaaagcttattttgatgaacttttttatgtgggattttcgattcaagggtatgaattgggcttgcttccagaagaaaaaagtggtgagaaaacagataatgtcttgagttattggggcgttgaaaacattgacgaatcctatcanaacttgatcaaattaggagcaacagaacctgagaaaccaataatgtcggtggtgattaatggttgctacggttag

SEQ ID NO: 18232 - protein, 100 aa, Unknown
  Obtained from environmental sample
  misc_feature (1)..(100): Xaa is any amino acid
MMLGLRTTIYKVSELQKAKKWYSKAFDTKAYFDELFYVGFSIQGYELGLLPEEKSGEKTDNVLSYWGVENIDESYXNLIKLGATEPEKPIMSVVINGCYG

SEQ ID NO: 18233 - DNA, 423 bp, Unknown
  Obtained from environmental sample
  misc_feature (1)..(423): n is a, c, g, or t
atgcagcctcaaaagaccactcgagatcccaatttaaccgacagctatcttttttttgaaaatttagttcacagtgtcctgattgtcaccgctttgtctttgttcggtagtctgcatgcgcagtcgttgaatgaaggagcaaggctggtggatgcccgtatcgacttgaaagagactgcggtgaagggatcttttgtggtcatcgaatatgaaatcccttattccggcatggttgagatccggctcttcgacaagatgggcaacaagatctggcaaaatcagtaccctgatcagtacggagagaacagaatcgtactaaaagcttccaaatttcatcccggagaaacctacacttacgccttaaattacaagaaagacgaagtgaaggagaaaattatcgttccacccatcggatacgattga

SEQ ID NO: 18234 - protein, 140 aa, Unknown
  Obtained from environmental sample
  misc_feature (1)..(140): Xaa is any amino acid
MQPQKTTRDPNLTDSYLFFENLVHSVLIVTALSLFGSLHAQSLNEGARLVDARIDLKETAVKGSFVVIEYEIPYSGMVEIRLFDKMGNKIWQNQYPDQYGENRIVLKASKFHPGETYTYALNYKKDEVKEKIIVPPIGYD

SEQ ID NO: 18235 - DNA, 501 bp, Unknown
  Obtained from environmental sample
  misc_feature (1)..(501): n is a, c, g, or t
gtggatcaagaatcggctcgagtacatgcagaagaaaatgcaatgttacaaataacaaaactaggtggacaaggtgttaaagatggattcttatttactacagcaagcccttgtgaattatgttcaaaaaaagcttatcaattaggaataagaacgattttctatattgacccatatcctggaatttcacaagatcaaatattaaaaggtggctcaattagtacaaggcctataatgattcccttctctggtgcaattggaaatgcttacaataaactctatgaaacttttatgtcctataaagatgaagtttctatgacacttgaaataaaatcaaaaaacaaatttggaattcaattcaaaggaatattaaaaaaactcaaaagtaaagatgaaaatatttctaattatttaaaagaaaataaaaacattacagatgaagacgttatcaaactattatcagaagcaatagaaaaaagaaatgaaaaatcagaatcttaa

SEQ ID NO: 18236 - protein, 166 aa, Unknown
  Obtained from environmental sample
  misc_feature (1)..(166): Xaa is any amino acid
MDQESARVHAEENAMLQITKLGGQGVKDGFLFTTASPCELCSKKAYQLGIRTIFYIDPYPGISQDQILKGGSISTRPIMIPFSGAIGNAYNKLYETFMSYKDEVSMTLEIKSKNKFGIQFKGILKKLKSKDENISNYLKENKNITDEDVIKLLSEAIEKRNEKSES

SEQ ID NO: 18237 - DNA, 612 bp, Unknown
  Obtained from environmental sample
  misc_feature (1)..(612): n is a, c, g, or t
atgaaaaaagtactgattttttattgcgttctttttagccttcaaggattttctcaaactaattggcaagcatttaaaaaattatcttgtgcagaaaaaacgtgggtaatttttcatccatttaaagcaaaaaaagcatttaaaatttctaaagaagcacaaagagtttcagattcaattgcaaaaacacctttattagatggtgataaaaggagcggacaagtagatgcttttcggcatgcctattggatggcgcgtttgcatcaagaaattggaaaaaatgctgcgttaaaattgggaaaagcacacgaaaaaagcaattatcagcaatacaaaaaagggcaattagaatacggtgaagttcctgataaaatttcttcagaaatggatttattcaacaacactgttggtgttacatataccaaaaaaggaattccgtatccaaaaaatggcttgatttatagaattgtaaatggcattttagcaggaaactataaggtcatcaaaaaagacaaaaaaagaaattatgtaacttgtgatgatcaaattatttctcaaaaagatctcaaaggaaaatggaaaaatgagaagtgtttgataaactctaactag

SEQ ID NO: 18238 - protein, 203 aa, Unknown
  Obtained from environmental sample
  SIGNAL (1)...(18)
  misc_feature (1)..(203): Xaa is any amino acid
MKKVLIFYCVLFSLQGFSQTNWQAFKKLSCAEKTWVIFHPFKAKKAFKISKEAQRVSDSIAKTPLLDGDKRSGQVDAFRHAYWMARLHQEIGKNAALKLGKAHEKSNYQQYKKGQLEYGEVPDKISSEMDLFNNTVGVTYTKKGIPYPKNGLIYRIVNGILAGNYKVIKKDKKRNYVTCDDQIISQKDLKGKWKNEKCLINSN

SEQ ID NO: 18239 - DNA, 531 bp, Unknown
  Obtained from environmental sample
  misc_feature (1)..(531): n is a, c, g, or t
gtgaatgaaaatggcggatttatcacagaattttggcatgatgaagatccgttaagagaacattttttacagcgaaatagaattgtagcaggaatttctcaagcaacaattatcatagaatccgcagaaaaaggcggctctttggttactgctgatattgccaattcgtacgatagagatgtgtttgctgttccaggaagaacaacagacttgtatagtaaaggttgtaaccgcttgattaaagacaacaaagcggcgctgttaacatccgcagaagatgttgcaaaaatgttgaattgggatcttgattcaaaacagaaaaaaacaaaaaccattcaaaaacaattgtttgtggagttgaatacgaacgaacaaaaagtgtacgattatttgcttaaaaacggcaaacaactcttagatattattgccatagaatgcaatattcctatttacaaattagcgcctttattattacaattagaaatgaaaggcgttgtacaacctttgccaggaaaattgtttgaagtgtag

SEQ ID NO: 18240 - protein, 176 aa, Unknown
  Obtained from environmental sample
  DOMAIN (1)...(88): SMF family
  misc_feature (1)..(176): Xaa is any amino acid
MNENGGFITEFWHDEDPLREHFLQRNRIVAGISQATIIIESAEKGGSLVTADIANSYDRDVFAVPGRTTDLYSKGCNRLIKDNKAALLTSAEDVAKMLNWDLDSKQKKTKTIQKQLFVELNTNEQKVYDYLLKNGKQLLDIIAIECNIPIYKLAPLLLQLEMKGVVQPLPGKLFEV

SEQ ID NO: 18241 - DNA, 489 bp, Unknown
  Obtained from environmental sample
  misc_feature (1)..(489): n is a, c, g, or t
ttggaaataatgtttaaaaccaatctctatccactaaaattcactcccattttaaaagataaaatttggggtggaacgaagctctctacggttcttgataaacctactggtgatagcaaaatttgcggagaatcctgggaaatatctggtgttccaaataatatttctacagttagcgaaggcattttaaaaggaaaactgcttactgagttgatagatgagtataaaggcgatctaattggtgaacacatttatcaaaaatttggaaataaattccctctgctcattaaatttattgatgcaaatgaagacttatcaattcaagttcaccccaacgatgtactagctcagaaaaggcataattcttttgggaaaactgaaatgtggtatgtggttgacgcagaagaaggagctactttaatttcaggattcaatcgtaaaatagacaaagatcaatacgtaaaagtctttgaagaaggtcgaatntag

SEQ ID NO: 18242 - protein, 162 aa, Unknown
  Obtained from environmental sample
  misc_feature (1)..(162): Xaa is any amino acid
MEIMFKTNLYPLKFTPILKDKIWGGTKLSTVLDKPTGDSKICGESWEISGVPNNISTVSEGILKGKLLTELIDEYKGDLIGEHIYQKFGNKFPLLIKFIDANEDLSIQVHPNDVLAQKRHNSFGKTEMWYVVDAEEGATLISGFNRKIDKDQYVKVFEEGRX

SEQ ID NO: 18243 - DNA, 879 bp, Unknown
  Obtained from environmental sample
  misc_feature (1)..(879): n is a, c, g, or t
atggaccgcgatacgttcaagcatatcacgctggcctcgcgccgcatcgaaagctgcgagaaagtcgccaggatgtgcaagacgccaatcgagatcgcgcaggtcgatgccgacaatgtcgccgaggtcgtcgcgctcatcaaaaaggtgaagcctgacctcctgatcaacatggccctgccttaccaggacctgccgatcatggatgcctgcgtcgagaccggcaccaattacatggacaccgccaattacgagccgcgcgacgtggccaagttcgaatatcactggcagtgggcctatcaggacaagttcgtggacaagggcatcaccgccattctcggctgtggcttcgatcccggcgtgtcgaacatctggtgcgcctatgcccagcaggaactgtttgacgagatcgactatatcgacattgtcgactgcaatgccggcgaccatggcaagacgttcgcgacgaacttcaatccggaaatcaatatccgtgaggtgacgcaggacgggaagtactggaaagacggcgagtggatcgagattccggcgctctcgatcaagtgtgacatcgactatcccgaagtcggcccgcgcgcttcctacctcatctatcacgaggaagaggaaagcctggtcaagaacatcaagggcctgaaacagatccgcttctggatgacgttcggccctgaatacatcaagcacctggaagtcttcaaatccatcggcctgatcgggctcaagcccatcaagcacaagggcatggacatcgtacccatggaattcctgaaggacctgctgcccgttccatcgtccctcgccgaaggctacacgggaagaccagattcgggtgatcatcggtgcaagaagatggcannt

SEQ ID NO: 18244 - protein, 293 aa, Unknown
  Obtained from environmental sample
  DOMAIN (1)...(292): Saccharopine dehydrogenase
  misc_feature (1)..(293): Xaa is any amino acid
MDRDTFKHITLASRRIESCEKVARMCKTPIEIAQVDADNVAEVVALIKKVKPDLLINMALPYQDLPIMDACVETGTNYMDTANYEPRDVAKFEYHWQWAYQDKFVDKGITAILGCGFDPGVSNIWCAYAQQELFDEIDYIDIVDCNAGDHGKTFATNFNPEINIREVTQDGKYWKDGEWIEIPALSIKCDIDYPEVGPRASYLIYHEEEESLVKNIKGLKQIRFWMTFGPEYIKHLEVFKSIGLIGLKPIKHKGMDIVPMEFLKDLLPVPSSLAEGYTGRPDSGDHRCKKMAX

SEQ ID NO: 18245 - DNA, 549 bp, Unknown
  Obtained from environmental sample
  misc_feature (1)..(549): n is a, c, g, or t
atggagaagaaagtaattgatgaaatgttattgacccaaaaaatgaagttgtcaaaattgaaacttctttggcactactcactagtcatacttttatttcttcctactttgtttgttgtatggaattttcttgagtattatgttctaggaataaaagagggtatgaagcctgatttagggggggcagtaggtattatttgcataatgtttactctaatctttttttatattcaaaggaagcgtcttgaatttaaagaattcaaggttaatggattaactcagcgagcttttatgtccgcctataagcaaacagcaaaagagttgaattggagtgctgaggttatgaaagacaacattattattgcacatcggtatgcaagctgggagttcagtgtaggtgaactgataacgataatcatggatggagacagaattctaatcaatagtatttgtgatcctgatagagcaatttcagccatttcatatggttggaacaagaggaatataaaaacttttatcaaaaatattaatagagctacaatggagtaa

SEQ ID NO: 18246 - protein, 182 aa, Unknown
  Obtained from environmental sample
  misc_feature (1)..(182): Xaa is any amino acid
MEKKVIDEMLLTQKMKLSKLKLLWHYSLVILLFLPTLFVVWNFLEYYVLGIKEGMKPDLGGAVGIICIMFTLIFFYIQRKRLEFKEFKVNGLTQRAFMSAYKQTAKELNWSAEVMKDNIIIAHRYASWEFSVGELITIIMDGDRILINSICDPDRAISAISYGWNKRNIKTFIKNINRATME

SEQ ID NO: 18247 - DNA, 381 bp, Unknown
  Obtained from environmental sample
  misc_feature (1)..(381): n is a, c, g, or t
atgaaaaatctattaaaaaaaatgataaaattagttgataataatagttttaggctcgttttggttttgatacttttaacgagtattcacgtttcggctcaacaaaaatcgcctactttttcgtacacggtttcttttccagaagacagcaactccaaaatcgctatcatgctagagttaacttacgctccttggctggaatccaaaatctccgtttccaaatctttaacaaattgcccaaaggattgggattgcccttggcaattcaattcaattccaaaaatttccaattcggcgatttattgcgtcaaaacaaatttggtgtaccaaaattatttctcttggctaactcgatcaatgcaccaaaatgcactttcttta

SEQ ID NO: 18248 - protein, 127 aa, Unknown
  Obtained from environmental sample
  misc_feature (1)..(127): Xaa is any amino acid
MKNLLKKMIKLVDNNSFRLVLVLILLTSIHVSAQQKSPTFSYTVSFPEDSNSKIAIMLELTYAPWLESKISVSKSLTNCPKDWDCPWQFNSIPKISNSAIYCVKTNLVYQNYFSWLTRSMHQNALSL

SEQ ID NO: 18249 - DNA, 735 bp, Unknown
  Obtained from environmental sample
  misc_feature (1)..(735): n is a, c, g, or t
ttgaaaacaaaaacgttattaactgtattaacaatactctttagtttgcaaagttttgcacaattattttctggacgtatcataaatgcaagtaaagagcctttagaaaatgtatatgtatataatacaacatcaaacagtcatacacatacaaaagtaaacggaggttttatcctcgagaattctaccgttggcgatgttattgaaataggacttttaggatataaaaagcagcaattttccttgaaagaatctgaacttaaaaacaaagtaacgctaattttagaagacaaagtatttttgttagatgaattgattttaactaaaaaaatagatcccattcaaactgttgtaaaaatagatttggcaaaaaaccctgtaaactcttcgcaagaaattttacaaaaagtaccaggtttatttattggtcaacatgctggtggaggtaaagcagaacaaatatttttacgtggttttgatatagatcatggaacagatttaagtttgtctgtagacggaatgcccgtaaatatggtttcgcatgcacacggacaagggtatagcgatttgcattttttgattccagaaaccattcaaaaaataaattttggtcaaggaccttattatgcaaatcatggacattttaatactgcaggatatgtagattttaaaaccaaaaaccgcaattaccaaaaaggtcaattaatattggtattggcccagttaaaactttaa

SEQ ID NO: 18250 - protein, 244 aa, Unknown
  Obtained from environmental sample
  SIGNAL (1)...(18)
  misc_feature (1)..(244): Xaa is any amino acid
MKTKTLLTVLTILFSLQSFAQLFSGRIINASKEPLENVYVYNTTSNSHTHTKVNGGFILENSTVGDVIEIGLLGYKKQQFSLKESELKNKVTLILEDKVFLLDELILTKKIDPIQTVVKIDLAKNPVNSSQEILQKVPGLFIGQHAGGGKAEQIFLRGFDIDHGTDLSLSVDGMPVNMVSHAHGQGYSDLHFLIPETIQKINFGQGPYYANHGHFNTAGYVDFKTKNRNYQKGQLILVLAQLKL

SEQ ID NO: 18251 - DNA, 357 bp, Unknown
  Obtained from environmental sample
  misc_feature (1)..(357): n is a, c, g, or t
atggcaatgtggtgtttaaataattgccttacgctcaatcaattaaacacagatgatctatgcatagcattttattctgatttattaattaaccctaaaaaagaatttaaaaacattttaaagtttattggtcttaataattacgagaaggatattgataatatagattttagaaaagcaagttcgactgattttaaacaaagtttcaataaatcagttcaaaaacagctatataaaaactttgaaaatcttgacattgaaacaaaagatagaattcaagaaatatttgattactttgattttaaattatattcggctcattcaccattcccaaataaacaattcctaacagcataa

SEQ ID NO: 18252 - protein, 118 aa, Unknown
  Obtained from environmental sample
  misc_feature (1)..(118): Xaa is any amino acid
MAMWCLNNCLTLNQLNTDDLCIAFYSDLLINPKKEFKNILKFIGLNNYEKDIDNIDFRKASSTDFKQSFNKSVQKQLYKNFENLDIETKDRIQEIFDYFDFKLYSAHSPFPNKQFLTA

SEQ ID NO: 18253 - DNA, 738 bp, Unknown
  Obtained from environmental sample
  misc_feature (1)..(738): n is a, c, g, or t
atgcacgatacgttagaaaacattcgtctcactttaaagcgttaccgtaaactaaatgttgagaaaattattctggaagagtggaaaaatcgatatatggttacctactctgatgacttaattggtgttattaatgaacatcaaaaattcagctttgcaaataatcagctcactcagtttctagagtctctaaaaataaatcctaccgaatctacaattacagaagtttttaaacacccgaatttaaagcttagtaaatcgaatcaatccttccactatccagatccgtttactgtaaaggtagagcaagcagagttagtgcatatgcacacaaatggtaatacgtattattatgactgccaacacctttccattcttgatgaaagtaaaactcagaaaggtgcatatcttattattcacgacaaaaccgaagaccgtttattagacatcaagcgaaatgacatgattaatgttattgtgcatgagctaaagaacccaataactggggttgtaggcttaactaagcttattatagataatcaatcgatgaataaagaggaagttactgtacttcttaaagaagtatttgcctcaggcgaacgcatgaatgagttggtaaatcggttcttagaagttcaaaaacttgaagctggccatactagtttagacttctcttctgtggatgttctaacagtagttactgacgtcaaaatggtttctaactcttctctttactaa

SEQ ID NO: 18254 - protein, 245 aa, Unknown
  Obtained from environmental sample
  DOMAIN (151)...(218): His Kinase A (phosphoacceptor) domain
  misc_feature (1)..(245): Xaa is any amino acid
MHDTLENIRLTLKRYRKLNVEKIILEEWKNRYMVTYSDDLIGVINEHQKFSFANNQLTQFLESLKINPTESTITEVFKHPNLKLSKSNQSFHYPDPFTVKVEQAELVHMHTNGNTYYYDCQHLSILDESKTQKGAYLIIHDKTEDRLLDIKRNDMINVIVHELKNPITGVVGLTKLIIDNQSMNKEEVTVLLKEVFASGERMNELVNRFLEVQKLEAGHTSLDFSSVDVLTVVTDVKMVSNSSLY

SEQ ID NO: 18255 - DNA, 873 bp, Unknown
  Obtained from environmental sample
  misc_feature (1)..(873): n is a, c, g, or t
atggcagataatggattacccgtactccatctgatatatctcaacgttaaaacctttctgagacgtcactcattattgaaaagcaagcaaggacgaataaagacccttatttctcaaggtgctactgtattcgcaaaaaaagagatggccgttgttaactctaaaatcaccaattacttttcggctgttaatgatggcgatttagaaaaaattctttctattggtacagaacttaaacctgctacagattcactagaagttagtttagatagaaacagattagtaaacgttcaggctcaattatcaaaaaaagaaggcattgttgataaacgtagcgggctactttcatcatggttggaagccattgaaggtgatctattccaagaatcagacgctattaaaactcatattgaaagttttgctactctttcgtttacagatggtagtaatattcttattgatgcatctaccaccgctgtaatcagaaagtctagaattgataaacttaatgaaagctcagatactgaaataactcttgttgaaggtggcttactctccaaactctctactgttgggcgagataaaagcaactatatcttaaatgcaggggcatcaactaccgagttaaaaactcaaaacttttacgctgaaaataatgtcggcgataatataaagcttaccaattacgatggaaaagctaatgttactgcaaatgatataactattaccatcaataagaatgagggaactatcattacaggtaataatgcacctctacctccaattgacttcttgcagcaccagtgttgcaatctgagaaaagagacaccatcatttatacagacaatttatctacctcagccgattacttga

SEQ ID NO: 18256 - protein, 290 aa, Unknown
  Obtained from environmental sample
  misc_feature (1)..(290): Xaa is any amino acid
MADNGLPVLHLIYLNVKTFLRRHSLLKSKQGRIKTLISQGATVFAKKEMAVVNSKITNYFSAVNDGDLEKILSIGTELKPATDSLEVSLDRNRLVNVQAQLSKKEGIVDKRSGLLSSWLEAIEGDLFQESDAIKTHIESFATLSFTDGSNILIDASTTAVIRKSRIDKLNESSDTEITLVEGGLLSKLSTVGRDKSNYILNAGASTTELKTQNFYAENNVGDNIKLTNYDGKANVTANDITITINKNEGTIITGNNAPLPPIDFLQHQCCNLRKETPSFIQTIYLPQPIT

SEQ ID NO: 18257 - DNA, 558 bp, Unknown
  Obtained from environmental sample
  misc_feature (1)..(558): n is a, c, g, or t
atgctgttgaacaagctgaacttatttaaaaattcaaacatcactccaaacgagtttttagaaaaatattggcatcaaaaacctttattattgaaaaatgctattgcgaaagatgaattagataaactgcctaataaaactaagttaattcaattgagctgtcatgaagagattcaatcaagaattgtctttaaacaatctgaagatgattattccgttgagtttggaccatttttagaaaacgattttgaagaaatcaatcaagacacatggaatttattggtttcagatgtcgacaaatggcaaccacaaagccgaaaaatattagaatattttgggtttattcgcaattggatttttgatgacatcatgttgagctgtggctcaattaacggaacggttggtccgcatactgatctatatgatgtgtttcttgttcaagttgaaggtcaaaggcaatgggcatttagtcaagataaaataatcaatcctaaatttaaaccggatttagaacttaaattaatgtcaaattttaaagcggatgaattcacactttaa

SEQ ID NO: 18258 - protein, 185 aa, Unknown
  Obtained from environmental sample
  misc_feature (1)..(185): Xaa is any amino acid
MLLNKLNLFKNSNITPNEFLEKYWHQKPLLLKNAIAKDELDKLPNKTKLIQLSCHEEIQSRIVFKQSEDDYSVEFGPFLENDFEEINQDTWNLLVSDVDKWQPQSRKILEYFGFIRNWIFDDIMLSCGSINGTVGPHTDLYDVFLVQVEGQRQWAFSQDKIINPKFKPDLELKLMSNFKADEFTL

SEQ ID NO: 18259 - DNA, 318 bp, Unknown
  Obtained from environmental sample
  misc_feature (1)..(318): n is a, c, g, or t
atggttgccgctaaagaatcatatatcgatgctgtgctctctcattataaacttgaaaatatattctctgaccagcaacgatatccccaaatttctttagatgagttaagtaaaagatcaccccaagtagtcttactaagtagcgaaccttatccatttaagggaaagcatataaaagagattcaagaggcttgccctaattctcatatccaattaataaacggagagtggtttagctggtatggttcgggaatgctaaacgcatttacagagctgaataaatggcgaaagacaatttctattcattcagctccgtaa

SEQ ID NO: 18260 - protein, 105 aa, Unknown
  Obtained from environmental sample
  misc_feature (1)..(105): Xaa is any amino acid
MVAAKESYIDAVLSHYKLENIFSDQQRYPQISLDELSKRSPQVVLLSSEPYPFKGKHIKEIQEACPNSHIQLINGEWFSWYGSGMLNAFTELNKWRKTISIHSAP

SEQ ID NO: 18261 - DNA, 480 bp, Unknown
  Obtained from environmental sample
  misc_feature (1)..(480): n is a, c, g, or t
aaaaggaatcaactttcaaatgaaatcaatcaatttaagacgaaaatcagcacaaatgaaagtgataaaaaatttttagaacttgaaattgaaaaagtaaataccaatttaaaagaatctaaagaacttatatcgattttaagagaccgacatattattgcggttcctcttgctgggcaagccatatcactaaatgcgtatgctaaaatatactgggataaaagcactaaaaccatttatttagatgcccaaggattaccagaacctcctgaaggaaaagtatatcaattatggtcattaactttagagcctttaacatctaaaagtttaggcacactcaatgattttgattcggtaaccaacaaaatatttactcttaaaaatgctaatgcttctcaagcttttggtattactcttgaaccagaaggtggcagtataacgcctacattagatcaattatacacccttggaatcgtttaa

SEQ ID NO: 18262 - protein, 159 aa, Unknown
  Obtained from environmental sample
  misc_feature (1)..(159): Xaa is any amino acid
MRNQLSNEINQFKTKISTNESDKKFLELEIEKVNTNLKESKELISILRDRHIIAVPLAGQAISLNAYAKIYWDKSTKTIYLDAQGLPEPPEGKVYQLWSLTLEPLTSKSLGTLNDFDSVTNKIFTLKNANASQAFGITLEPEGGSITPTLDQLYTLGIV

SEQ ID NO: 18263 - DNA, 690 bp, Unknown
  Obtained from environmental sample
  misc_feature (1)..(690): n is a, c, g, or t
gtgatcaatgcaacgggagtntttgcagatgccgtgcgaaaaaaagatctttcaggtgtaaacaacagaatgacgggtagtagaggtactcatattgtattggataagagtttcttaaagggagaaactgcaattatgattcctcataccaaagacggacgtgttttatttgctgttccttggcacgataaattgttgattggaacgacagatattgaagttcaagaatacaatcttgatcctgtttcaacagaagaagaaattaattttttattgaatcacacggctaaataccttgttaaaaatccaactaaaaaagatattaaaagtgttttctcaggtttacgacctttggtgaaaaatgattcttctgaaagttcttctgaaatatctagagaacatcaaatagaaattagcgaaaatggattggttagtattttaggcggaaaatggacaacgtatcgaaaaatggcaaaagatgttgtaaacaaagcttctacgtacgccggtttaccaagagtaaaatcagaaacgcataaattgcaattgaacggttatcatgtaaattctgcagtttttgaagcgttgagtatttatggatctgatgctttaaaaataaataaaataagtggtgataatcctgatttaaaagagaaattacatcaagaatatccaattataaaagcacct

SEQ ID NO: 18264 - protein, 230 aa, Unknown
  Obtained from environmental sample
  misc_feature (1)..(230): Xaa is any amino acid
MINATGVFADAVRKKDLSGVNNRMTGSRGTHIVLDKSFLKGETAIMIPHTKDGRVLFAVPWHDKLLIGTTDIEVQEYNLDPVSTEEEINFLLNHTAKYLVKNPTKKDIKSVFSGLRPLVKNDSSESSSEISREHQIEISENGLVSILGGKWTTYRKMAKDVVNKASTYAGLPRVKSETHKLQLNGYHVNSAVFEALSIYGSDALKINKISGDNPDLKEKLHQEYPIIKAP

SEQ ID NO: 18265 - DNA, 300 bp, Unknown
  Obtained from environmental sample
  misc_feature (1)..(300): n is a, c, g, or t
gtgaaaattgaggcccaacgagaaggaaacggcgtgcgctattcgattgttgacaacggacgcggtatcccggaagatcaactggctaaagtgtttgatatgtttgtgaaatcgaacattgacttcaacagcagcggattgggactttacctggcgaaaaagactgccttgaaattgggcggcaagatttctcttgaaagcaaagaaggcacaggaaccacagcccacatctacctggcnctgaccacggagcagctgacactgactcctcggattccctcctttcctaagcggttctga

SEQ ID NO: 18266 - protein, 99 aa, Unknown
  Obtained from environmental sample
  DOMAIN (1)...(82): Histidine kinase-, DNA gyrase B-, and HSP90-like ATPase
  misc_feature (1)..(99): Xaa is any amino acid
MKIEAQREGNGVRYSIVDNGRGIPEDQLAKVFDMFVKSNIDFNSSGLGLYLAKKTALKLGGKISLESKEGTGTTAHIYLALTTEQLTLTPRIPSFPKRF

SEQ ID NO: 18267 - DNA, 711 bp, Unknown
  Obtained from environmental sample
  misc_feature (1)..(711): n is a, c, g, or t
atgaagattatagcaagtaactttaagactaatcacacacgaagtagtaccaaatcttttatagatactatcaatcaatttctagaatctaatcaaataaaaaatgaagtatttgtatttcctaccgcaacatcttttgataactttaatacagtaaataacctaaaaataggtgctcaaaatgcatactacactaaaaatggttcatttacaggtgagattgggacagaacaacttgatgaatttgatataaaaacaattttaattggacatagtgaaagaagacatatcttaaaagagtcacaaaaagatttaacactaaaatataactattataaatctttaggatatacaattatatattgtgttggggagcctttagaggtaagagaaaaaggtcttactgaaactttaggatatatctgggaacagtttgaaggtatagatttaagttatgacaaactaattgttgcttatgaaccagtttgggctataggaacaggtgttgtagcaactgcccaagagatagcgcaagtacataaaaaaatcaaaaagaaaatttcacatccccttttatatggaggaagtgttaaacctgagaatttagaagagatattaaaaatagacaatgttgatggtactttgattgggacaacatcttgggatgtagaacaatttaaacagatgattgaaattacaagtaaaaattaa

SEQ ID NO: 18268 - protein, 236 aa, Unknown
  Obtained from environmental sample
  DOMAIN (1)...(234): Triosephosphate isomerase
  misc_feature (1)..(236): Xaa is any amino acid
MKIIASNFKTNHTRSSTKSFIDTINQFLESNQIKNEVFVFPTATSFDNFNTVNNLKIGAQNAYYTKNGSFTGEIGTEQLDEFDIKTILIGHSERRHILKESQKDLTLKYNYYKSLGYTIIYCVGEPLEVREKGLTETLGYIWEQFEGIDLSYDKLIVAYEPVWAIGTGVVATAQEIAQVHKKIKKKISHPLLYGGSVKPENLEEILKIDNVDGTLIGTTSWDVEQFKQMIEITSKN

SEQ ID NO: 18269 - DNA, 429 bp, Unknown
  Obtained from environmental sample
  misc_feature (1)..(429): n is a, c, g, or t
atgatcaagaatcggctcgagaaactttcattagaagtgattatcacacctataacatctactgatgaaatgataggaaatatggttgagacagctatatttgcacaatggatgcatagggattggtttacaccatattacgctagatggagcaatggcgaagtggacatggttggacttggtgataatacattgaagcctatttgggcccttgaaatcaaatggtctgaccgatattttgaaaaaccaaaagaattaaaaagtttaattaaattttgccaagaaaataatattaagacgccaattgttacatcaataagtaaagaaggggaagtagaatatgcagatgtccattttcaatttttaccttcatcagcctatgcttacacggttggaaaaaatacgcttgattttaaaataaataaataa

SEQ ID NO: 18270 - protein, 142 aa, Unknown
  Obtained from environmental sample
  misc_feature (1)..(142): Xaa is any amino acid
MIKNRLEKLSLEVIITPITSTDEMIGNMVETAIFAQWMHRDWFTPYYARWSNGEVDMVGLGDNTLKPIWALEIKWSDRYFEKPKELKSLIKFCQENNIKTPIVTSISKEGEVEYADVHFQFLPSSAYAYTVGKNTLDFKINK

SEQ ID NO: 18271 - DNA, 936 bp, Unknown
  Obtained from environmental sample
  misc_feature (1)..(936): n is a, c, g, or t
gtggtgattgatcgcgatacagctgattgggccaaaaccaacctaacactcgataccagaaccagtgcacaactcgaatatctaaaaagcaaatacacacaagatggacagttgtgtctgacagccttctgcaagctatccgtggtgcttggcgagatgcaacctacgaactcatcaacgaacccgcactggcatgaaataggacaccaaaaactactaagaggtgactacctaaaccccagcctcctcctactggagcatgcaaccaatgacggtgccctagtaaagcagttagttgccattgggaaacacgtaacgaaaattagtcatcacaactgtgaagttcaacatggcggaggctcaagtgcttacgctgagtacgagcggctcatcagtcaaaaaaaagtaataacatgcttcgtcgatagcgacaaattcacaccatcatgcggtttgtcagcaacgaacaaaaaactgtcaaaagcttacaccgataaaaacattatcggtattttatcgttcagtaaaggacaggaaatagagaattacatacctttggacctaataagatcacacaacataagaccagaatacaaacagttcgatgaacttgaaaaaattcaagagactgggcaagtagatatttggctatactttgacttgaaactaggaataagcaaggacaagcttaagacctacaaaataagctcagaaaagaaagattggtttgcgaaaagttctctttccacaaatgctaatgtagcaggatttgcggaaaatatcttggacagcttcttgaaatgccatgaggcttcaaagaactcaacaaaagatgcaggtcccagattggttggaacagttggatctgatttggccactttattggtactcatccacgagaaacccaaggcccaaagcaagttagtccccacgntt

SEQ ID NO: 18272 - protein, 312 aa, Unknown
  Obtained from environmental sample
  misc_feature (1)..(312): Xaa is any amino acid
MVIDRDTADWAKTNLTLDTRTSAQLEYLKSKYTQDGQLCLTAFCKLSVVLGEMQPTNSSTNPHWHEIGHQKLLRGDYLNPSLLLLEHATNDGALVKQLVAIGKHVTKISHHNCEVQHGGGSSAYAEYERLISQKKVITCFVDSDKFTPSCGLSATNKKLSKAYTDKNIIGILSFSKGQEIENYIPLDLIRSHNIRPEYKQFDELEKIQETGQVDIWLYFDLKLGISKDKLKTYKISSEKKDWFAKSSLSTNANVAGFAENILDSFLKCHEASKNSTKDAGPRLVGTVGSDLATLLVLIHEKPKAQSKLVPTX

SEQ ID NO: 18273 - DNA, 360 bp, Unknown
  Obtained from environmental sample
  misc_feature (1)..(360): n is a, c, g, or t
atgatgaatatgaaatcaatttttgtgtgttttttatttacaattattattggaataacaaatgtaaatggacaaacaaccacgagtaatgaggtgaaatctcttattaaaaagaagatagaatacaacaagaaaaatggctatgggtttagaattcagttagaaagcggacttgcaactgcaattaaaacgacgcaacgtaaatttagaatagagcgtccaacaattaaaacctatattttatttgaatctccagaatggaaagtacaagttggagattacaaaactagattggaagctgataaaattttcaatgaaattaaaaagaagtttccatcggcaattatagtccctaggtaa

SEQ ID NO: 18274 - protein, 119 aa, Unknown
  Obtained from environmental sample
  misc_feature (1)..(119): Xaa is any amino acid
MMNMKSIFVCFLFTIIIGITNVNGQTTTSNEVKSLIKKKIEYNKKNGYGFRIQLESGLATAIKTTQRKFRIERPTIKTYILFESPEWKVQVGDYKTRLEADKIFNEIKKKFPSAIIVPR

SEQ ID NO: 18275 - DNA, 660 bp, Unknown
  Obtained from environmental sample
  misc_feature (1)..(660): n is a, c, g, or t
gtgggtctgtatgccaagatcacctgccgtgtgaagcagatcgacgaaaccggcaacgaggtgttccaacgcttcgaaaccacgccgggccgctgccgtcttggtagcttgctgccgctgaatgcgaaggcaccgttcgaactggtcaaccgtctgctgcgtaagaaagacgtgcagaacacgatcgacaccgtctaccgctattgcggtcagaaagagtcggttatcttctgtgaccagatcatgggcatgggcttccgcgaggcgttcaaggcgggcatttcgttcggcaaggacgacatggttatccccgacaacaagtgggacatcgttgaaggcgttcgcgatcaggtcaaagatttcgaacagcaatatatggacggcctgatcacccaaggtgagaaatacaacaaggtcgttgatgcttggtcgaaatgtaacgatcaggtcacggacgcgatgatgaacaccatctccgcgcccaaatacgatgagaatggcgcagaaatggaaccgaactcggtttacatgatggcgcactcgggcgcgcgtggctcggtcacccagatgaaacagctgggcgggatgcgcggccttatggccaagccgactggcgagatcatcgaaacgccgatcatctcgaactttaaagaaggctga

SEQ ID NO: 18276 - protein, 219 aa, Unknown
  Obtained from environmental sample
  DOMAIN (126)...(217): RNA polymerase Rpb1, domain 4
  misc_feature (1)..(219): Xaa is any amino acid
MGLYAKITCRVKQIDETGNEVFQRFETTPGRCRLGSLLPLNAKAPFELVNRLLRKKDVQNTIDTVYRYCGQKESVIFCDQIMGMGFREAFKAGISFGKDDMVIPDNKWDIVEGVRDQVKDFEQQYMDGLITQGEKYNKVVDAWSKCNDQVTDAMMNTISAPKYDENGAEMEPNSVYMMAHSGARGSVTQMKQLGGMRGLMAKPTGEIIETPIISNFKEG

SEQ ID NO: 18277 - DNA, 705 bp, Unknown
  Obtained from environmental sample
  misc_feature (1)..(705): n is a, c, g, or t
ttgaacctggtccttgattccttgaaaagaaggaagattgatacatttatagccttcgaaaaacaatgctgcccttacccagaagttacatttgaaataaagaagaagaagtatttaggaatgcttcccaggtcatgggtatgcccgacctacattttttggaagaaagatggcaactactacgtcaagaaagttgatcgattcggtatctatccaaccattcagcgggaaaggttcaagcactttcaactgttcgatttctacaaaaaaaacgtttcagcattgaaccaggaggaaatcttaaacatttacactgacaccatcaaaatcgtctcacccgatccttccgattccaccgcaggtgtccgttaccaaacgaagtcaaagggctatctctatgattctaggtattggggtaactttattccgctggcctgttcttttactttgacttataaagcacgtgatgtggattattatgccgcgtataagtattcaatttttcaaccggcagcgaacaattccgaattggacagcgcttatgtaaactatttggctggattcaatggtcctattgcaaacaacgaaagcaattactattacaaccagtccacaaaaatttacacctgggtaatgttgatagaacgcgagatcgccgaattggaatccagaggtctgtggaggttagatgatgggcacaaataa

SEQ ID NO: 18278 - protein, 234 aa, Unknown
  Obtained from environmental sample
  misc_feature (1)..(234): Xaa is any amino acid
MNLVLDSLKRRKIDTFIAFEKQCCPYPEVTFEIKKKKYLGMLPRSWVCPTYIFWKKDGNYYVKKVDRFGIYPTIQRERFKHFQLFDFYKKNVSALNQEEILNIYTDTIKIVSPDPSDSTAGVRYQTKSKGYLYDSRYWGNFIPLACSFTLTYKARDVDYYAAYKYSIFQPAANNSELDSAYVNYLAGFNGPIANNESNYYYNQSTKIYTWVMLIEREIAELESRGLWRLDDGHK

SEQ ID NO: 18279 - DNA, 744 bp, Unknown
  Obtained from environmental sample
  misc_feature (1)..(744): n is a, c, g, or t
gtggatcaagaatcggtcgagaactggagtgaagttgtagaacatgtacaccaagcacgacatgtgtcccaaatggcccaagcggatgtcgatattgtaaagaatcaaagagagatagttggcgaactcaaaataggcgctagcacaacaatatcactacacattttgcccaaagtgttgtcagcttttcataaaaagcatcctcgtattcaactcatgttgataaataggaacactgagcatgttcttgaggcgctcctaaaaaaagaaatcgatatcgctgttgtagaatcgaaatacgagatgaacggcgttcagtatagcatattcatggaggatgaaattatcccggtttgttcacctcgaagtgcctttgcccaatctgtgatttcacttgaagagctcaaaaaaatcccattagctatgagagaacgaggttcgggaacactctctgttttgttgaaagagtttgagggaaataatatcaaactcggtgatttacagataacagcccgattgggaggaacggatccgctaaaaaaatatctgattgaaagtgatgaaattggattcctttcaaaagttgctgttcaagaagagctagaaaaagacctcttaaaaagagtggatatacaaggacttactttcccaaggcatttctattttgttacacgaaaaggagaagaactcccaagttttgtccaagcattcaaaaaacaagctaaagaaacgtataacgtgtag

SEQ ID NO: 18280 - protein, 247 aa, Unknown
  Obtained from environmental sample
  DOMAIN (36)...(246): LysR substrate binding domain
  misc_feature (1)..(247): Xaa is any amino acid
MDQESVENWSEVVEHVHQARHVSQMAQADVDIVKNQREIVGELKIGASTTISLHILPKVLSAFHKKHPRIQLMLINRNTEHVLEALLKKEIDIAVVESKYEMNGVQYSIFMEDEIIPVCSPRSAFAQSVISLEELKKIPLAMRERGSGTLSVLLKEFEGNNIKLGDLQITARLGGTDPLKKYLIESDEIGFLSKVAVQEELEKDLLKRVDIQGLTFPRHFYFVTRKGEELPSFVQAFKKQAKETYNV

SEQ ID NO: 18281 - DNA, 363 bp, Unknown
  Obtained from environmental sample
  misc_feature (1)..(363): n is a, c, g, or t
gtgatagattcaatggcggtaaaatacacaggttctgtaaattctgtccattactgttctgtattgccttatggattaaatgatgctgctgtacaaaaaaaattattagaagaaaccagtatcaatcaaaagccgtattataaagtgcaaattagttttgctgaagatggaggcggagaggactttgatgatgtctttatctactggattgataaaaaaacctttaaagttgattatttagcctattcgtttcatgaaaatgatggcggaatgcggtttagagaagccaccaatgagcgttttgtaaacggaattcgattgttgattatacaactacaaccaaaaatgcttcaactaaattag

SEQ ID NO: 18282 - protein, 120 aa, Unknown
  Obtained from environmental sample
  misc_feature (1)..(120): Xaa is any amino acid
MIDSMAVKYTGSVNSVHYCSVLPYGLNDAAVQKKLLEETSINQKPYYKVQISFAEDGGGEDFDDVFIYWIDKKTFKVDYLAYSFHENDGGMRFREATNERFVNGIRLLIIQLQPKMLQLN

SEQ ID NO: 18283 - DNA, 771 bp, Unknown
  Obtained from environmental sample
  misc_feature (1)..(771): n is a, c, g, or t
atggatggagtgtcagctaaaggtcacgctggtataggtggttttgatattttctatacccgcaaggatgaagcaggcaaatggataaagcctgttaatattggttatccaatcaactctgataaagatgaagtgagcttttttgtgagtgctaatgccaaaacagctttctttagtagcaacgaattggatattggtattggtggttgggacttgtattcatttgatttgtacaaagaagcccggcctgaggcaatgactatcctaaaaggtaacacaaccactgatgatgaacaacttagccgcaaagccaagattgaactaaaaaacgtgaacaccaaagaggtaactgaggtgcctgttgatactattacagggcaatttgtagccgttgttgagtccaatcaagattacataatgactgtgaaaggcgaaggaactgcttttaattcaacctatatttctaaagatgaaccagatgataagcccatcaaggtggaaatggaagtgaaaaagatgaagacgggcggcacttacaaaatcaacaatatcaattatgaaaccaactcttatcagctagaccaagtttctaaagtgatgttgggtgaatttgccgattttatgaaaggcagtaaaaccatgaaagtgagcatccatggncatactgatattgtgggtagcgaccaggataatcttattctatcagagaatagggcgaagtcagggtatgagtttcttatcaagtcagggcttgataagagtacggtttaa

SEQ ID NO: 18284 - protein, 256 aa, Unknown
  Obtained from environmental sample
  DOMAIN (185)...(256): OmpA family
  misc_feature (1)..(256): Xaa is any amino acid
MDGVSAKGHAGIGGFDIFYTRKDEAGKWIKPVNIGYPINSDKDEVSFFVSANAKTAFFSSNELDIGIGGWDLYSFDLYKEARPEAMTILKGNTTTDDEQLSRKAKIELKNVNTKEVTEVPVDTITGQFVAVVESNQDYIMTVKGEGTAFNSTYISKDEPDDKPIKVEMEVKKMKTGGTYKINNINYETNSYQLDQVSKVMLGEFADFMKGSKTMKVSIHGHTDIVGSDQDNLILSENRAKSGYEFLIKSGLDKSTV

SEQ ID NO: 18285 - DNA, 399 bp, Unknown
  Obtained from environmental sample
  misc_feature (1)..(399): n is a, c, g, or t
atggacaagaaagaacaaatcatcgccattgccacccaactgttttccgaaagagggttcgaaaatacgccgatctcgatgatttgtgagcaggccaatgtttccaaaggtttgatatttcaccatttcaagtccaaaaatcatttgctcagggagatattttccagaactaaccagctgatcaaggacatcaatccagccccacaagaagatcggtccccacaacaaaagctggccgatttggtggaagcctttggttcgcaattggaacaggacaaaatgtttgcccaattgaatctcaatatgaatctgcaggccaaacacgtgaaatcctcacgatctggtcatggaaaggtctgctttatcctggactcaagtctggccttttcaaggaattaa

SEQ ID NO: 18286 - protein, 132 aa, Unknown
  Obtained from environmental sample
  DOMAIN (7)...(53): Bacterial regulatory proteins, tetR family
  misc_feature (1)..(132): Xaa is any amino acid
MDKKEQIIAIATQLFSERGFENTPISMICEQANVSKGLIFHHFKSKNHLLREIFSRTNQLIKDINPAPQEDRSPQQKLADLVEAFGSQLEQDKMFAQLNLNMNLQAKHVKSSRSGHGKVCFILDSSLAFSRN

SEQ ID NO: 18287 - DNA, 609 bp, Unknown
  Obtained from environmental sample
  misc_feature (1)..(609): n is a, c, g, or t
gtgaacggaaacggaattagagataacgatgaaactttgttacaaaacgtggttgtaaaaatcaataaaaaagaagttttaacagatatcaatggagaagcaaccatcttaaatttactaaaagatgagtacgattttgatgctttttctttagaaaaattaaacggctggtttccaaatattaatagtactgtaattattcagaatgatgatgtggtttatgtgccttttgtgagaggagtaaaagtgtacggagatgttgttttagacagacaaaaaattgccgttgcagacgaagcaccgttagatttatcaagaataaaaattaccgcaactgttggagaaaaagtatatggagcattgacaaacaataaaggacgttttgagttttacttgccatttggagaatatgtaattaccctggatgaaagtatcttaaacaaccgattaaaaattactagaaaccatattccattaaaattaaaaagcacacaagacggcgttcatatctccttttatctcatagaaaaacgtcgaacacgtaattttcaccgatttcaccaaaaggcaaaatactgtcatctttattcttacctttgcaagtcctaa

SEQ ID NO: 18288 - protein, 202 aa, Unknown
  Obtained from environmental sample
  misc_feature (1)..(202): Xaa is any amino acid
MNGNGIRDNDETLLQNVVVKINKKEVLTDINGEATILNLLKDEYDFDAFSLEKLNGWFPNINSTVIIQNDDVVYVPFVRGVKVYGDVVLDRQKIAVADEAPLDLSRIKITATVGEKVYGALTNNKGRFEFYLPFGEYVITLDESILNNRLKITRNHIPLKLKSTQDGVHISFYLIEKRRTRNFHRFHQKAKYCHLYSYLCKS

SEQ ID NO: 18289 - DNA, 360 bp, Unknown
  Obtained from environmental sample
  misc_feature (1)..(360): n is a, c, g, or t
ttgttttttaatattggcgtacttgaacagggcaatgaaaattatgatgaagcagaaaactattatttaaaagcaattgagattaatcctgaatatgttgatgcttattataatttaggaattgtgtacagtaaacaagcaaccttacttaaaaatgacatcaataatttcatagatcaacctgaaaaatatgacgaaatcttcctagatattatagaagttttcagaaagtcaatttcaaactataaccgtgcagtaaagttacaggaatacgattatgatacattatttgagataggattcacctgtactgcacaagcaaatgaaatcgggaagcaggccaataaaaaattagaataa

SEQ ID NO: 18290 - protein, 119 aa, Unknown
  Obtained from environmental sample
  DOMAIN (1)...(32): TPR Domain
  misc_feature (1)..(119): Xaa is any amino acid
MFFNIGVLEQGNENYDEAENYYLKAIEINPEYVDAYYNLGIVYSKQATLLKNDINNFIDQPEKYDEIFLDIIEVFRKSISNYNRAVKLQEYDYDTLFEIGFTCTAQANEIGKQANKKLE

SEQ ID NO: 18291 - DNA, 315 bp, Unknown
  Obtained from environmental sample
  misc_feature (1)..(315): n is a, c, g, or t
gtgtatgaatgcattacctacaactattactttgatgcagataagatcgccaaagtctacaagaacagatggcagatcgagacaaagttaaaacgactaaagcaaaactttcccctcaaatatttcctaggggacaaccaaaatgccattgagatacagatttgggtcagtttgataatccaactcatcacacttgtcattcagcgaaaagcagagaaaaaatgggcatactacaatatgatatccgtgatacggtatcatttaatgacctatattgacctgttcaagttcctgaaaaatccaaaggcaaagtag

SEQ ID NO: 18292 - protein, 104 aa, Unknown
  Obtained from environmental sample
  misc_feature (1)..(104): Xaa is any amino acid
MYECITYNYYFDADKIAKVYKNRWQIETKLKRLKQNFPLKYFLGDNQNAIEIQIWVSLIIQLITLVIQRKAEKKWAYYNMISVIRYHLMTYIDLFKFLKNPKAK

SEQ ID NO: 18293 - DNA, 642 bp, Unknown
  Obtained from environmental sample
  misc_feature (1)..(642): n is a, c, g, or t
gtggatccaagacatcggtcgagtggacgtcgaagaagatatatagacgcctttgaattgatgatctcaattttaggagacttaggcagcacaaaggagtctattgcttatttagacaaattaaaaaccatcaatgatgcttcactttataataacccattattaaaggcgaataaacttacagaaaaagaacttgccgaagagaaaaaattaactactcgcatccaaactctcagaaacgaatatttaagtgccaatacaaatttaaaatcttctctaaaaactgaaatagacaagctctcggctcaaaaacagcttctaacaaacaaagtaactaatactcaaaataatgagtatctgcctatttggaagatccaacaacaaatggctaatgatgaactaattctccattatacagaactgaatgataaattttatgtcagctctatcactaagtcttccatcgatttatctactttagatattactccagctactgattctcttcttaataatacggcaaacgatttagcttccaggcaacaacctctttcagtcgcattactccgaaggtttataaacttcttagaattgactgagatcccggtgcattataactcacggttacagtacataccttga

SEQ ID NO: 18294 - protein, 213 aa, Unknown
  Obtained from environmental sample
  misc_feature (1)..(213): Xaa is any amino acid
MDPRHRSSGRRRRYIDAFELMISILGDLGSTKESIAYLDKLKTINDASLYNNPLLKANKLTEKELAEEKKLTTRIQTLRNEYLSANTNLKSSLKTEIDKLSAQKQLLTNKVTNTQNNEYLPIWKIQQQMANDELILHYTELNDKFYVSSITKSSIDLSTLDITPATDSLLNNTANDLASRQQPLSVALLRRFINFLELTEIPVHYNSRLQYIP

SEQ ID NO: 18295 - DNA, 330 bp, Unknown
  Obtained from environmental sample
  misc_feature (1)..(330): n is a, c, g, or t
atgccacattttgtactggactgttccaacacagtcataaaaacaaagtcacctgaatccataatgcagttggtttataatgccgccaaatccacaagactttttgatccaatggatatcaaagtaaggatcaacccttttcaatattatcatgtgaataattccaaagatgactttatccacattttcgcaaatatcatggaggggcgaaacacagatcaaaaagcagatttatccaaaaagttaatttctgaactcaaagttatgttccccgaggttccaataatctctatcaatatcagagattttgaaaaaagcgagctactgtaa

SEQ ID NO: 18296 - protein, 109 aa, Unknown
  Obtained from environmental sample
  misc_feature (1)..(109): Xaa is any amino acid
MPHFVLDCSNTVIKTKSPESIMQLVYNAAKSTRLFDPMDIKVRINPFQYYHVNNSKDDFIHIFANIMEGRNTDQKADLSKKLISELKVMFPEVPIISINIRDFEKSELL

SEQ ID NO: 18297 - DNA, 675 bp, Unknown
  Obtained from environmental sample
  misc_feature (1)..(675): n is a, c, g, or t
atgaagcagagaaagttaaaacggcttttttctgatggggaaacgaaatttgatttcgacaacaagatttttggccacaagactgtaaaggacgagttgaagcgaattcaacatagaaaatgttgcttttgcgaatccaaggtgagccatattgcgcacggagacgtggagcatttccgaccgaaaaccgcttatttcatcgacgacgatcccactttggtttatccgggatactattggctggcctacgattactcgaatctgttttttgcctgccagatttgcaatcaaaccttcaagaagaattatttccctgtggaagatgagggcaatcggtgcatttcccatgcgcacgatctggaaaatgaatcaccgttgctggttcatcctgagtatgacgaccctgcggaacacatcggctttcggaatgaggttgcctattctgtcccgggaagtaccaagggcgaaaaaacgattgaaagaacaggcttgaaccgcgatcttttgcttgaagaaaggagaacctacctggaaagtaagcgtttgatcgcaacaattgctcaacttccgatccttgaggccactgaagcaagaatccacctcgccctctctcgccaaaaggacaaaatgttttccgccatgattcgctccaatttccccgaaattcaccaataa

SEQ ID NO: 18298 - protein, 224 aa, Unknown
  Obtained from environmental sample
  misc_feature (1)..(224): Xaa is any amino acid
MKQRKLKRLFSDGETKFDFDNKIFGHKTVKDELKRIQHRKCCFCESKVSHIAHGDVEHFRPKTAYFIDDDPTLVYPGYYWLAYDYSNLFFACQICNQTFKKNYFPVEDEGNRCISHAHDLENESPLLVHPEYDDPAEHIGFRNEVAYSVPGSTKGEKTIERTGLNRDLLLEERRTYLESKRLIATIAQLPILEATEARIHLALSRQKDKMFSAMIRSNFPEIHQ

SEQ ID NO: 18299 - DNA, 522 bp, Unknown
  Obtained from environmental sample
  misc_feature (1)..(522): n is a, c, g, or t
ttgggaagtctttttaatccaacaggagagtatttagctgcctctggaagcgataatgcgatacgcatttataatataaaatcaggaaaactgataaaaacgatattaggacattcaatggtcccattatcaatggattttagcccaaacggaaaattattagctagtgctggagacgataaaacgataaaaatatgggatacaagtaattggaaattattacactctctaaaaggagaaaatgaagcaattcattctgtgatttttattgataataatagcgttttagctggcggaactgataaaaaaatgttgggagaattgttagaataccatttaaattttaaaggatttgtaaaacccattgtagcaactctatgggatattaaaaatgaaacaatattgcaaacactttcagagcataccgacgacattggtttaggaatggacattagttctgacagaaaactagtggcaactccgagtaaagatagaaccgttaaaatttggagtgtgaattga

SEQ ID NO: 18300 - protein, 173 aa, Unknown
  Obtained from environmental sample
  DOMAIN (30)...(67): WD domain, G-beta repeat
  misc_feature (1)..(173): Xaa is any amino acid
MGSLFNPTGEYLAASGSDNAIRIYNIKSGKLIKTILGHSMVPLSMDFSPNGKLLASAGDDKTIKIWDTSNWKLLHSLKGENEAIHSVIFIDNNSVLAGGTDKKMLGELLEYHLNFKGFVKPIVATLWDIKNETILQTLSEHTDDIGLGMDISSDRKLVATPSKDRTVKIWSVN

SEQ ID NO: 18301 - DNA, 426 bp, Unknown
  Obtained from environmental sample
  misc_feature (1)..(426): n is a, c, g, or t
atgaaaaaatctcaaaaaagagaactcttaaaagcattagaaaaaaaagatattctttgtgcttataaaatacttcttcaagctcacaaaaaaggtttaggacttgtatcttcttcacaaagatttgctctaagccatgaagaagctttagagtttgctagaaatatggaaggatgttttatagatgaaaagtcgctaattatctacccattgcaaacaaaagagactattaaagatattattaaaaacatctatacaaaaaacaagtatgctttactttcaaatagttctatagggttaagactagtttgggcaagtgaaacttttattgagctagctttagaagaactttgtaatgaaaatatacttacaaaagatggtaatttatataaaaatagtgatattcaaagaagatataccagataa

SEQ ID NO: 18302 - protein, 141 aa, Unknown
  Obtained from environmental sample
  misc_feature (1)..(141): Xaa is any amino acid
MKKSQKRELLKALEKKDILCAYKILLQAHKKGLGLVSSSQRFALSHEEALEFARNMEGCFIDEKSLIIYPLQTKETIKDIIKNIYTKNKYALLSNSSIGLRLVWASETFIELALEELCNENILTKDGNLYKNSDIQRRYTR

SEQ ID NO: 18303 - DNA, 645 bp, Unknown
  Obtained from environmental sample
  misc_feature (1)..(645): n is a, c, g, or t
atggtgtataaatttggtgcaagagtagcaaaagcattttgtagggacttgcnccgggttattaagatttggttaaatatgcgttggttttttcgtgagattgctgggaaatcatcggttttcgtaattgcccactcctcgcccgaattcaaaacaatggaaatcggaataggacggggagtcttcttttgtggcaaacaattgtatcatgagaatgcaaactctatgaccctgaaaatcgaaatgtttcctgcattcatgagcgaatgcctgttcgaattgaaatgtggaaagaatccctatcgattgctgattgtcaaatccgccctgcctgaagtggaggatcgcggagccgccttcaacctggaaatcacgaatcagaaagccatccatcagctcaaggaaatgctgttccaatttgtggagcgtcctacgccgaaaaagaccgtggtcattgctgacggcatttcatttaaaatcagctattcttctccagcacggacatttcaaaccactctttcttcgattcaggagagttcgattgaattggaatttgtccaccatctcttccagatctgcatggcgcaggttccggataagaatttcaaattgtatcttgaggaagtgaaaagggaatacctctga

SEQ ID NO: 18304 - protein, 214 aa, Unknown
  Obtained from environmental sample
  misc_feature (1)..(214): Xaa is any amino acid
MVYKFGARVAKAFCRDLXRVIKIWLNMRWFFREIAGKSSVFVIAHSSPEFKTMEIGIGRGVFFCGKQLYHENANSMTLKIEMFPAFMSECLFELKCGKNPYRLLIVKSALPEVEDRGAAFNLEITNQKAIHQLKEMLFQFVERPTPKKTVVIADGISFKISYSSPARTFQTTLSSIQESSIELEFVHHLFQICMAQVPDKNFKLYLEEVKREYL

SEQ ID NO: 18305 - DNA, 648 bp, Unknown
  Obtained from environmental sample
  misc_feature (1)..(648): n is a, c, g, or t
atgaatctttgggaaactgatttaagaaccaaagaaactaagatgaccgttagcttaaacggtagccgaggaagtttgatgtgggataaaaaagaagagaacctgtatctactaagtggcggacgaatttcaaaagttgatttaggtaaaggaagtgcaaaaggaattagcatttctggagagatggaatatgatgcggttaaagaacgagaatacatgtttgagcatgtttacatccgtactaaaaatattttctatgaacctacttttcatggtaaagattgggaaaaacttcatgccgattacaagaagtatcttccatcaattggtaattcatacgaatttgcagaaatgctttcagagatgttgggagagctaaatgtatctcactctggtgcacgttataacggaaacatcagcaatggcgatgcgaccgcttctcttggaattttcattgattatgctcacaaaggggatggtatcaaaattaccgaagtaatgaaaggtggcccgttggataaagctaaattcgatattaagcccggcatgattatcgagaaaattgatggcgaaactctaacgcctgatagagatatcgccagtttcttgaatagaaaagcagactcttttgtacttcttatatcgtaa

SEQ ID NO: 18306 - protein, 215 aa, Unknown
  Obtained from environmental sample
  misc_feature (1)..(215): Xaa is any amino acid
MNLWETDLRTKETKMTVSLNGSRGSLMWDKKEENLYLLSGGRISKVDLGKGSAKGISISGEMEYDAVKEREYMFEHVYIRTKNIFYEPTFHGKDWEKLHADYKKYLPSIGNSYEFAEMLSEMLGELNVSHSGARYNGNISNGDATASLGIFIDYAHKGDGIKITEVMKGGPLDKAKFDIKPGMIIEKIDGETLTPDRDIASFLNRKADSFVLLIS

SEQ ID NO: 18307 - DNA, 615 bp, Unknown
  Obtained from environmental sample
  misc_feature (1)..(615): n is a, c, g, or t
ttgtatgcctggattcagcttatgaaagatgagtacaacacggatgaactcgcctcctcaataaccacagagatagagaatgatgtgaagcgtcttgctggcgtagcggagcgntttggaaagattggatccgcacccgagcttcaccccatggatatccgccctattcttgaagatgttatggtgtatatggagcgtcgtctgccaagtttagggaaagcggtagtagtaaagaaagagctaactgcggagggaatggtgaatttaaatcctgaacttttccaatgggccattgagaatttggtaaagaatgcaatggatgcacttcccaaaaatcagactcactcttttatctctgtgtcttccaaaattcatgaaggcgagattgtaatagatattgaagactcaggaactggtattgatattaaacacgtgaaaagtgtttttaagccagggtttagcacaaaaaaaagagggtggggcttaggcttgagtcttacaaaacgtattattgaagactatcatgatgggcatgtgtatgttcttagatctgaactagatgaaggaactacaatacgagttacgctacatttgattgacgagacagtgaaatag

SEQ ID NO: 18308 - protein, 204 aa, Unknown
  Obtained from environmental sample
  DOMAIN (89)...(199): Histidine kinase-, DNA gyrase B-, and HSP90-like ATPase
  misc_feature (1)..(204): Xaa is any amino acid
MYAWIQLMKDEYNTDELASSITTEIENDVKRLAGVAERFGKIGSAPELHPMDIRPILEDVMVYMERRLPSLGKAVVVKKELTAEGMVNLNPELFQWAIENLVKNAMDALPKNQTHSFISVSSKIHEGEIVIDIEDSGTGIDIKHVKSVFKPGFSTKKRGWGLGLSLTKRIIEDYHDGHVYVLRSELDEGTTIRVTLHLIDETVK

SEQ ID NO: 18309 - DNA, 528 bp, Unknown
  Obtained from environmental sample
  misc_feature (1)..(528): n is a, c, g, or t
ttgattgagcatcatgttactcctgaaatttgggagcgcatagttcgagaatgtagaacttattttgatgatttaggccagacaaatcatttcggtaatacttttgaatggtttggaaaaactaaaaacaagaccgctgtccatatttctatttcttcagggaaagatataagccggctaaaaattcatgtagactactcttcaatttcatccaaaattaaaataattgcttcattagcaggatttatttcctttgcaattatctcatctttactgaacttagactctatatctaactttgtaccactcgctttaaatcttactggagctggacttggatatctatctagttcatctattttaaaacgtttccttaaaaagaaatctaatttttatgtcacatttattgataatacttcgaaactaatatcttcaaaattcgaaaagaaaatctctataaatgaagatgtctccattgaagatgaggatactatattgaataaaggacataacagggcacgagtttga

SEQ ID NO: 18310 - protein, 175 aa, Unknown
  Obtained from environmental sample
  misc_feature (1)..(175): Xaa is any amino acid
MIEHHVTPEIWERIVRECRTYFDDLGQTNHFGNTFEWFGKTKNKTAVHISISSGKDISRLKIHVDYSSISSKIKIIASLAGFISFAIISSLLNLDSISNFVPLALNLTGAGLGYLSSSSILKRFLKKKSNFYVTFIDNTSKLISSKFEKKISINEDVSIEDEDTILNKGHNRARV

SEQ ID NO: 18311 - DNA, 867 bp, Unknown
  Obtained from environmental sample
  misc_feature (1)..(867): n is a, c, g, or t
atgatgatcaaaagggtctttaaaattgagctaaattttggtgttggctccaatattttaaataatccggcaattgcatctttatgcgtgccaatactaagggagggcagttctacaaagtctgccactgaaatcagtaatatacttgattattatggcgcctttctggatttaaaatcaggcttagagaatacaatcattagcctatacggtcgatccaagtttattaatgagctgataccacttcttgctgatattatcaaaaatccgatctttgacgagaccgcattatcaaagcataagcttaaaatgtttcagaagctttcaatagaccagcaaaaaacaagctattggtcaccaagactacttcgacaaaatatttttggttctgaccaccccaatagccagtttatctcggaagagaagattgataaaataacaagagatgatcttgtaggatttcataaggatcatcttttaaaaagcctgcaaaatattatcatagccggctcctttgattccaatgttgttgttactcaactacaggagcattttaaggtaataaataacgctggtaaacatgaagataaaataccattaagttctgaaaatactaaagtagttaccaagaagttgcccaataacagtcaagcaagtattgcgcttggcattggagttattggcatgaaaaaccctgattatccggaatacgcctttctcacaaaagtattaggtggttattccgggtccaggtttaatgaaaacgtcaccgaaacaacagggttgacctacgcgatcatggctataacattcctttatggtcaggtcttactaccaatttcagcagatgtgagtctaatcagttga

SEQ ID NO: 18312 - protein, 288 aa, Unknown
  Obtained from environmental sample
  DOMAIN (145)...(286): Peptidase M16 inactive domain
  misc_feature (1)..(288): Xaa is any amino acid
MMIKRVFKIELNFGVGSNILNNPAIASLCVPILREGSSTKSATEISNILDYYGAFLDLKSGLENTIISLYGRSKFINELIPLLADIIKNPIFDETALSKHKLKMFQKLSIDQQKTSYWSPRLLRQNIFGSDHPNSQFISEEKIDKITRDDLVGFHKDHLLKSLQNIIIAGSFDSNVVVTQLQEHFKVINNAGKHEDKIPLSSENTKVVTKKLPNNSQASIALGIGVIGMKNPDYPEYAFLTKVLGGYSGSRFNENVTETTGLTYAIMAITFLYGQVLLPISADVSLIS

SEQ ID NO: 18313 - DNA, 792 bp, Unknown
  Obtained from environmental sample
  misc_feature (1)..(792): n is a, c, g, or t
ttggctaggatgaacatgcttttgcacggcatgaaagatacggagtgtgaaatattccacggtgataccttgaagaaccaatgggatattttgaacgagatgaacccggccaagaaaatagaatttgatgccattgtagcaaatcccccctttagtttgcgttgggaacctaatgacacgttagcagacgacttccgttttaagagttatggacttgctccaaaatcggcagctgattttgcattcctgttacatggttttcattttcttggaaaagaaggaacaatggctattattttgccccatggggtcttgtttcgaggtggagcagaagaacgtatccgcaccaaacttttgaaagataataatattgatacggttattggcttgccctctaatttgttctattctactggtattccagtttgcattctagtactgaagaaatgcaagaaagaagatgatgtgctatttatcaatgccagcgatgaggaaaactatgagaagggaaaacgccaaaatcaccttcgtgataaagacattgacagaatcattgaaacgtatatgaatcgcccaagtcaggcaattgaacgatatgcccgaagagtaccgatggacgaaattgaaaagaatggttacaacctaaacatctcaaggtatgttagcactgagaaaaaagaggtgaaaatagacctagaagatgttaacgaacgtttaacctcaataaatgaccgtatcaaaaccaaaacggatgagcataataagtactcgagccgaattcaaagctgctaa

SEQ ID NO: 18314 - protein, 263 aa, Unknown
  Obtained from environmental sample
  DOMAIN (53)...(214): N-6 DNA Methylase
  misc_feature (1)..(263): Xaa is any amino acid
MARMNMLLHGMKDTECEIFHGDTLKNQWDILNEMNPAKKIEFDAIVANPPFSLRWEPNDTLADDFRFKSYGLAPKSAADFAFLLHGFHFLGKEGTMAIILPHGVLFRGGAEERIRTKLLKDNNIDTVIGLPSNLFYSTGIPVCILVLKKCKKEDDVLFINASDEENYEKGKRQNHLRDKDIDRIIETYMNRPSQAIERYARRVPMDEIEKNGYNLNISRYVSTEKKEVKIDLEDVNERLTSINDRIKTKTDEHNKYSSRIQSC

SEQ ID NO: 18315 - DNA, 732 bp, Unknown
  Obtained from environmental sample
  misc_feature (1)..(732): n is a, c, g, or t
gtgaatttagttaaactgaaatactgggctggcaatagttgttattctgtggaagttctcgaaaagcataaaatagatttagaccttctttattattacataaagcataatcaaaaaaggtttacagataatcaacaagcggcaaacatcccctcaatttcaaaaggtgatgttgaaaaatttcaaatatgctttcctgaaaattctcaggaacaaaaaaaaatcgcatcctgtctttcttctttagatgagttgatagctgcccatagtgataagctggaagcacttgaagaccataaaaaagggctattacaacagttattcccaaatgagggcaaaacagtgcctgagttgcgttttcctgagtttgaaagtgagggggagtggtatcctacgaccgtcgaagataactgtttagttaaggggagaattggatatcgtggttacaccacacaagatttagttaaaaaaggagaaggggcattagttcttggtggaaagcacattcaaaatcaattacttgacttgtctgaccctacttttatcagttgggagaagtattatgaatccccagaaataatggtagaaataaatcacataattttttcgcaaagaggcagtttaggtgattgcgcaataatcgataaggaaattgcacaagctactataaacccgagtatggtactcttaaaggatataacatgcaatccaagattttatactatgctctaa

SEQ ID NO: 18316 - protein, 243 aa, Unknown
  Obtained from environmental sample
  misc_feature (1)..(243): Xaa is any amino acid
MNLVKLKYWAGNSCYSVEVLEKHKIDLDLLYYYIKHNQKRFTDNQQAANIPSISKGDVEKFQICFPENSQEQKKIASCLSSLDELIAAHSDKLEALEDHKKGLLQQLFPNEGKTVPELRFPEFESEGEWYPTTVEDNCLVKGRIGYRGYTTQDLVKKGEGALVLGGKHIQNQLLDLSDPTFISWEKYYESPEIMVEINHIIFSQRGSLGDCAIIDKEIAQATINPSMVLLKDITCNPRFYTML

SEQ ID NO: 18317 - DNA, 300 bp, Unknown
  Obtained from environmental sample
  misc_feature (1)..(300): n is a, c, g, or t
ttggacgcaggacacaaagaatggctggataaaattcgctcatgggaaagtgagttgggcgaaatggaatctgaaaatggcaaaatagtggctcgtacagaaagcaaggatgctcaaaagaaagtagagcatttccaaaatcagattttgattcagaaacagcaacttgatcagatgaagcacaacatcaagatttatggcggggaccttgaaaaggggcagaccgagttgagcgaatacaatgagtattacaataatttccgcaacgaattcaaaacgtttacggcacagtataactga

SEQ ID NO: 18318 - protein, 99 aa, Unknown
  Obtained from environmental sample
  misc_feature (1)..(99): Xaa is any amino acid
MDAGHKEWLDKIRSWESELGEMESENGKIVARTESKDAQKKVEHFQNQILIQKQQLDQMKHNIKIYGGDLEKGQTELSEYNEYYNNFRNEFKTFTAQYN

SEQ ID NO: 18319 - DNA, 330 bp, Unknown
  Obtained from environmental sample
  misc_feature (1)..(330): n is a, c, g, or t
ttggcgaatattgtaattctcaatcaggtattcgtcttcgtcgttaatcaggatatcgaatgggagatagggaagtgcaaaatcaggaacaatcaacatttcacgacagggataaccttcgctaataaactcttccactccttccgggaagagaagtcggtaaaattcattggccagtgcttcaaaatcaatcggactttcaagttcctgatgcccatccattctaaccgaggtgcgaaaaaggtctatgacctggatgagaaaaggaagggtttggggagggctatggaccttggaagagacaagtacatcggaaatacaagtcaataa

SEQ ID NO: 18320 - protein, 109 aa, Unknown
  Obtained from environmental sample
  misc_feature (1)..(109): Xaa is any amino acid
MANIVILNQVFVFVVNQDIEWEIGKCKIRNNQHFTTGITFANKLFHSFREEKSVKFIGQCFKINRTFKFLMPIHSNRGAKKVYDLDEKRKGLGRAMDLGRDKYIGNTSQ

SEQ ID NO: 18321 - DNA, 489 bp, Unknown
  Obtained from environmental sample
  misc_feature (1)..(489): n is a, c, g, or t
ttgtcaacggacgagttggaagaaaaccaaattcggaaaaaggggtcagatgcttacgagctagagatacaaggtctaaaagataagtatttaaggttatttgcagaatttgacaactataaaaagcgaacagctcgagagcggttagacctgattaaaaccgcctcagaggatctgatgctcagattactgccagttttggacgattttgatcgggcgaaaaagaatgccgagagtaatgatagcgctgaaaactttagtgaaggcgtatcactcgtatatcagaagctttaccagatacttgagtctaaagggctgaaagccatggattccgatgtattagacttcgaccctgagttgcatgaagggatcacaagaattccagtgcaggatccagcacagaaaggaaaaattatcgatttcattgagaaaggttattatctcaatgacaaaataattcggcatgccaaggtggtgatcggcgaatga

SEQ ID NO: 18322 - protein, 162 aa, Unknown
  Obtained from environmental sample
  DOMAIN (2)...(162): GrpE
  misc_feature (1)..(162): Xaa is any amino acid
MSTDELEENQIRKKGSDAYELEIQGLKDKYLRLFAEFDNYKKRTARERLDLIKTASEDLMLRLLPVLDDFDRAKKNAESNDSAENFSEGVSLVYQKLYQILESKGLKAMDSDVLDFDPELHEGITRIPVQDPAQKGKIIDFIEKGYYLNDKIIRHAKVVIGE

SEQ ID NO: 18323 - DNA, 543 bp, Unknown
  Obtained from environmental sample
  misc_feature (1)..(543): n is a, c, g, or t
atgattttgttagagttgaaaaccctggttaatcctgatattccatttaaggaaaggttagatattcttgcaaattttgggttagaatcaaataaacagtttgaaaatgactaccaagaattaataaattattttaaagaatacgatcctttgtatttatgctccttttgtgcatattattttttatctagtgaagaaggaatagacgaagaagcaataaatggatttttagaattccctcctttctatgtagaagttttacaagctttttcactaatgaatgagagagaattatccgcaaaacctttgcatgaaaaagtagaaccctttaaagctttaattcaagaccttaataaaaatcaatcttatgggaattttaaacacattaaaaaaattgaagatgaggaaggaatgaatgagtttattttaagaactgatatgatgattaatacgttagctgttagaaattgggcttatgtaagtcaaatgaaaaccattaatcaagaattagcatctctcatttctcaagatttgaaaaagtaa

SEQ ID NO: 18324 - protein, 180 aa, Unknown
  Obtained from environmental sample
  misc_feature (1)..(180): Xaa is any amino acid
MILLELKTLVNPDIPFKERLDILANFGLESNKQFENDYQELINYFKEYDPLYLCSFCAYYFLSSEEGIDEEAINGFLEFPPFYVEVLQAFSLMNERELSAKPLHEKVEPFKALIQDLNKNQSYGNFKHIKKIEDEEGMNEFILRTDMMINTLAVRNWAYVSQMKTINQELASLISQDLKK

SEQ ID NO: 18325 - DNA, 546 bp, Unknown
  Obtained from environmental sample
  misc_feature (1)..(546): n is a, c, g, or t
ttgactcggctcgagtatgactaccgcggatttggagaaagcagcgaatttgagatcgacaacaacatgtacctctacccgcactttcaggacgatatcaaggccatgatcgatttttgccgtcagcaattcgtgcagactttccacgtatatggatggggaatcggcgcaggtttgtctttgggcgtcggttggaaccgcattgaaatcaaagcgattattgcagatacgcccttcctttctatggaagacctggaaaaccgctttgagacctgggacaatccaatggaagttcctttcgctggttatgacaaaaagtttgagccgatctactcgcttgaccttgagccggccatcctcaaaaacaccaataaatccgtcttgctgatcattggcagcaatgacattctcttcaaagaaaccggacatggaaaaactgggggaaaagccgaagaaacttatttgcccaaaatatctacgtggtccaaaaccctgaacggaaagaccacttccggattgaccaagccggttacttcaaagcaatga

SEQ ID NO: 18326 - protein, 181 aa, Unknown
  Obtained from environmental sample
  misc_feature (1)..(181): Xaa is any amino acid
MTRLEYDYRGFGESSEFEIDNNMYLYPHFQDDIKAMIDFCRQQFVQTFHVYGWGIGAGLSLGVGWNRIEIKAIIADTPFLSMEDLENRFETWDNPMEVPFAGYDKKFEPIYSLDLEPAILKNTNKSVLLIIGSNDILFKETGHGKTGGKAEETYLPKISTWSKTLNGKTTSGLTKPVTSKQ

SEQ ID NO: 18327 - DNA, 426 bp, Unknown
  Obtained from environmental sample
  misc_feature (1)..(426): n is a, c, g, or t
atggatatacatgtaggggcgctgataaaacagcgagccaaagatctaaggatcggccccactgaattgggtgcgaaaatcaatacatccaagcaaaacgtatatggaatttacaagcgtaaatcaattgatacgcgattgttgatgaagttatgcaatgctttgagttatgatttttttcgcctttacagtgaaagcctgagacttaacgatggctcagccccagaagatgattatgcaaaatgtatttctgaaaagaccctgctcgaaagggaaaaggacgttttgaaaaatgaatatgcttatctgaaaaagatcaattctttgttggagaagcgcttcagtaaagaaaacttgatgaacctgttctatagtaatcatttagattcactattttctctctcgatcgatataaatcacccttaa

SEQ ID NO: 18328 - protein, 141 aa, Unknown
  Obtained from environmental sample
  misc_feature (1)..(141): Xaa is any amino acid
MDIHVGALIKQRAKDLRIGPTELGAKINTSKQNVYGIYKRKSIDTRLLMKLCNALSYDFFRLYSESLRLNDGSAPEDDYAKCISEKTLLEREKDVLKNEYAYLKKINSLLEKRFSKENLMNLFYSNHLDSLFSLSIDINHP

SEQ ID NO: 18329 - DNA, 468 bp, Unknown
  Obtained from environmental sample
  misc_feature (1)..(468): n is a, c, g, or t
atgtcaaagcttgcagtcctttttcttttcttatttttggcatgtaacaatgcaacagtaaccaaacctggttcatcagatgttaatactcttacctcgcccccagaattaaagattagttttaacaagcaaactgttcaaagtactgattcagtaacgataaattattctctaaaaaatatatctgatagcagcattacgctttgttttgacttacactcaaatttacacactctaaaagattcacaaggaatttatcaagaagctcatccttttcaatctcatgccggatgtctcgaaagtgaaatagtaaaaattcctagtcaatcaagtttaacttgggtttcaaaaaagaaatttcagaaccttccagcaggtgattatttatatacagcaagaataaaatcttttgcttacagggaaggatatatatattctaacccaattaaattaattgtttcaaagtaa

SEQ ID NO: 18330 - protein, 155 aa, Unknown
  Obtained from environmental sample
  SIGNAL (1)...(17)
  misc_feature (1)..(155): Xaa is any amino acid
MSKLAVLFLFLFLACNNATVTKPGSSDVNTLTSPPELKISFNKQTVQSTDSVTINYSLKNISDSSITLCFDLHSNLHTLKDSQGIYQEAHPFQSHAGCLESEIVKIPSQSSLTWVSKKKFQNLPAGDYLYTARIKSFAYREGYIYSNPIKLIVSK

SEQ ID NO: 18331 - DNA, 594 bp, Unknown
  Obtained from environmental sample
  misc_feature (1)..(594): n is a, c, g, or t
ttgttttggaaagcggctcacttttattttagtttcaaccttccattgtggagccttattctgatcattctgatgcttcttatatttacatacgtttatctacaggagttaaaagcgaaaagactaggtattgaattaacatctgaaagtatttcagataaggtatttaaagttctttctatacgcattgatcaaaagatcgaagagatagaatcagagctaactttcaaacccaatacgaactggtttcaagagcagtgcaaatcatccattcatgatctaggaaaaaggtatacatcggaactaaatgttaagcttccaatctcagaaatttttgatggaattagtcggaataaggcatttaagaaaagaattacaagacttttggatcaatttcttataaaggggaagaagattttaaaggactatccagaaataaaagaagacattaagagcttagaaattcacttcgacaatttatatctattatttatcaatacagattttcttggaacgaatcgtcttccagtaaaaaaaattgaaagtttgctggatagcatccaaggctcagttaaagtaatgtatgaatactaa

SEQ ID NO: 18332 - protein, 197 aa, Unknown
  Obtained from environmental sample
  misc_feature (1)..(197): Xaa is any amino acid
MFWKAAHFYFSFNLPLWSLILIILMLLIFTYVYLQELKAKRLGIELTSESISDKVFKVLSIRIDQKIEEIESELTFKPNTNWFQEQCKSSIHDLGKRYTSELNVKLPISEIFDGISRNKAFKKRITRLLDQFLIKGKKILKDYPEIKEDIKSLEIHFDNLYLLFINTDFLGTNRLPVKKIESLLDSIQGSVKVMYEY

SEQ ID NO: 18333 - DNA, 534 bp, Unknown
  Obtained from environmental sample
  misc_feature (1)..(534): n is a, c, g, or t
gtgcagacaatcctggtcatcagccagatagaatcgggtgaactggcaatgcacacggaagattttggcatccacgagctcatcatagatgtgctggattcgttggagtataaattcaccaaaaaaggccgcgacatcgattacaaagtggtcaccaacggtttggagaaagtcaaggtcaaggcggacaagcaacgcatcgaacaagtgctgcgcaacctgattgacaatgcggtcaaatatggcgatgccaatggcgtggtgaccatcgtgatcaagtctgccggagagcataaactattgattcaggtagacgacgacgggccgggaattgagcaagaacacctgccgcgcttgtttgagcggttctaccgggtggacaaaagccgctcgcggggcaaaggcggtaccggccttggattggcgatttgcaagcacttgatagaagcccatggcgaaaaactgtgggtggacagcgaatttggaaacggttcaacttttcagtttactttaacgagggcaggagagaattga

SEQ ID NO: 18334 - protein, 177 aa, Unknown
  Obtained from environmental sample
  DOMAIN (62)...(174): Histidine kinase-, DNA gyrase B-, and HSP90-like ATPase
  misc_feature (1)..(177): Xaa is any amino acid
MQTILVISQIESGELAMHTEDFGIHELIIDVLDSLEYKFTKKGRDIDYKVVTNGLEKVKVKADKQRIEQVLRNLIDNAVKYGDANGVVTIVIKSAGEHKLLIQVDDDGPGIEQEHLPRLFERFYRVDKSRSRGKGGTGLGLAICKHLIEAHGEKLWVDSEFGNGSTFQFTLTRAGEN

SEQ ID NO: 18335 - DNA, 345 bp, Unknown
  Obtained from environmental sample
  misc_feature (1)..(345): n is a, c, g, or t
atggtggttcaaactgaaaacaatggtttgattcaaatgaataacaatttggggttagagtcacctaaagttttattacaaaactatctttcggaagtttttataaaggttgaagataaaccattgttaaccttaaatagccaaatattggttttagaaaaaaaacaagatcaagctttattatctatcaagttttctttaactgactcaaataatcttgttgtttttgataaaacctataaaagtcaactaagcataaatgacaactctattcctgcttttgtaaattccatggctactttaatagaagaaatgattaaacaactaagtctagatattcaatga

SEQ ID NO: 18336 - protein, 114 aa, Unknown
  Obtained from environmental sample
  misc_feature (1)..(114): Xaa is any amino acid
MVVQTENNGLIQMNNNLGLESPKVLLQNYLSEVFIKVEDKPLLTLNSQILVLEKKQDQALLSIKFSLTDSNNLVVFDKTYKSQLSINDNSIPAFVNSMATLIEEMIKQLSLDIQ

SEQ ID NO: 18337 - DNA, 927 bp, Unknown
  Obtained from environmental sample
  misc_feature (1)..(927): n is a, c, g, or t
gtgatcaagaatcggctgagcataagtaatgatgtaaaatcatcgggctanatattgctcgctgcgctcactggaaatattgatgtaaaaggtggaaataaaaagccgggcggtgttcaggaaaaagacattactttgcacgacgagcttatggcgacccttccagacccaatggggaaggaacgcttcccaatcttcattgataagtatcatgaaggccagagcatgattttgtctgattatattgaaagcggtaaaattaaagcgattttttccatcggggccaatgtcatgatgtatcctgattatggacgcttgcgtaagcagatggaaaaattagaattttttagtgtttgtgatttttatgatactccgacacgcgcatttgccgacgtatcacttcctgcggctacgcatcttgagcgcgaaagcctgatcattggcggtgataaggtgcggtatcgtccaaatgttgttcaaccacgtgggaatgcgaaagcggatgccgatatcatgtttgcgcttgctgaaaaattaggtttaaaagataacttctggggtggcgacattaaagcctcctttgaagaacgcttgaatctgtccggttataaacttgatgacctgccaagcaaaggggaagccgccccttataacaacggttcatttgttgaaaaaaaatatgagcaggatgggtttcaaacctcaagcggaaaggttgaatttaaaagcaaccttcttgaagagcatgggtacgacggacttcctacttataaagaaccatattggtcacctgtgagtacgccgaaaacgcggcagagtaccattattttgccatggtggagcataagaatacacatctcaggacgcagccaaatgctcggcatgacctacctgttgcattatctgagggcaaaccatgacggatga

SEQ ID NO: 18338 - protein, 308 aa, Unknown
  Obtained from environmental sample
  misc_feature (1)..(308): Xaa is any amino acid
MIKNRLSISNDVKSSGXILLAALTGNIDVKGGNKKPGGVQEKDITLHDELMATLPDPMGKERFPIFIDKYHEGQSMILSDYIESGKIKAIFSIGANVMMYPDYGRLRKQMEKLEFFSVCDFYDTPTRAFADVSLPAATHLERESLIIGGDKVRYRPNVVQPRGNAKADADIMFALAEKLGLKDNFWGGDIKASFEERLNLSGYKLDDLPSKGEAAPYNNGSFVEKKYEQDGFQTSSGKVEFKSNLLEEHGYDGLPTYKEPYWSPVSTPKTRQSTIILPWWSIRIHISGRSQMLGMTYLLHYLRANHDG

SEQ ID NO: 18339 - DNA, 693 bp, Unknown
  Obtained from environmental sample
  misc_feature (1)..(693): n is a, c, g, or t
ttgataactggatctaaaacaatcatcgataaaaatggaaatgtagaccagaaaccaattaatgaaatctatcttcgacaagaagaatatgaaggaactatgtatgtatttatacaagccccgggagttgattttgagtttaaagatggccgactaagacataatatgaactgggatagaaatggttgggatgatgacaagagaatacatttcgagtttgatattgtagttaagatgcctaaaaacttaagagtaaaagcatcaacaataaatggtggaactctttccgtagtgaatatgcaaaatggtgttgaagcaggtaatgtgaatggaaatgtatatctcaaagaagttgctggacagacaactgcacgtacggtaaatggagatgtggaggtttactttgctaagagtccaaaagaggattcacattttaatacggttaatggtagcatggaaatttattcaccagacgacttaggagcaattgtaacctttgaaagtttacatggtgatctctatacagattttgaacaagtatctcgattaaaaaaccaattgaacaaggaaaaaacaggagacggctttcgatatcgtgtgggtaaaacaaccccaatccaaattggcaaaggtggtccaaaaatggaattcgaaacggtgaacggaagtgcttatatccgaaaaagaaaataa

SEQ ID NO: 18340 - protein, 230 aa, Unknown
  Obtained from environmental sample
  misc_feature (1)..(230): Xaa is any amino acid
MITGSKTIIDKNGNVDQKPINEIYLRQEEYEGTMYVFIQAPGVDFEFKDGRLRHNMNWDRNGWDDDKRIHFEFDIVVKMPKNLRVKASTINGGTLSVVNMQNGVEAGNVNGNVYLKEVAGQTTARTVNGDVEVYFAKSPKEDSHFNTVNGSMEIYSPDDLGAIVTFESLHGDLYTDFEQVSRLKNQLNKEKTGDGFRYRVGKTTPIQIGKGGPKMEFETVNGSAYIRKRK

SEQ ID NO: 18341 - DNA, 471 bp, Unknown
  Obtained from environmental sample
  misc_feature (1)..(471): n is a, c, g, or t
atgaagctcacaaaagataaaatcaaaaacgcagtcatgtgcgctcaacaagtgttgaagcaaaaagatgtctacggaaatgatccccaaaagttggcaatttccgtggattccgtaacagattatattgcagggcattgcaatatcgcaattgaaattcgggaagtagttttcgaggccacacatctaaaaggtcgaaaagagacttataagattgatggcaattcgagtgtgattattgagatacgttcgaatctttcagatttttggaaaagattcgtggcgataaaagagctaatgcatattatcgtagataaagacgatgatgacttaacgccttatggtgatgttatactcgaaaaactcgtacttgaagggcatattggcgtgctctcgggcgatggggactctccgcccgcacaatcagagctagttgccgagattgctgctattgaggttattacccaataa

SEQ ID NO: 18342 - protein, 156 aa, Unknown
  Obtained from environmental sample
  misc_feature (1)..(156): Xaa is any amino acid
MKLTKDKIKNAVMCAQQVLKQKDVYGNDPQKLAISVDSVTDYIAGHCNIAIEIREVVFEATHLKGRKETYKIDGNSSVIIEIRSNLSDFWKRFVAIKELMHIIVDKDDDDLTPYGDVILEKLVLEGHIGVLSGDGDSPPAQSELVAEIAAIEVITQ

SEQ ID NO: 18343 - DNA, 834 bp, Unknown
  Obtained from environmental sample
  misc_feature (1)..(834): n is a, c, g, or t
atggagcaaggcgtcattagggctcttggttatgttgaaaaagtatcgttgtcattagcttcgttaggaattgatctcagcgctgacgaggaactgacaaaatatactggcttgctcgacaaaaaaagtgcgaagaaacttgcagggaaatggcgaaaacgttggggaataaccaatgaacaacagttagaatgggcgaatgcaaataccgtctattctgatctgcgcagttatattgagaggcttggtgtttttgtcctgcactactcaatggatacagaaaaggtagctggtctttacactaagattgacggtggcccccatgccatcgtgataaataggtcaagtggtagcaaagcacgcaggctcttcactcttgcacatgaattttgccacgttcttttaagagcaagtggtatttccaacccatcaatccggaagaataggattgaagtattttgcaaccagtttgcggcataccttctcgcgccgaaagaattgataaggcaagggcttgataagtataattacacgccatcaatcgacaatagtaccataagactgcttgctcaaaacttggggattagccagcaatgttgtctccttagacttatcgatatgaagattttgcccaaagaagactactcccgatgggtaggacgtttcgtaggcaaaattccagaagaagacaaaaagactaaatcgggtggaggaggtggagacccagacccaataagggacaagagacttattatgttttacgtttcttgcgaagctatcaaaagctcgcaaggaggcttattgacgcaatgctcgaccgattcttgtcactaa

SEQ ID NO: 18344 - protein, 277 aa, Unknown
  Obtained from environmental sample
  DOMAIN (79)...(205): Domain of unknown function (DUF955)
  misc_feature (1)..(277): Xaa is any amino acid
MEQGVIRALGYVEKVSLSLASLGIDLSADEELTKYTGLLDKKSAKKLAGKWRKRWGITNEQQLEWANANTVYSDLRSYIERLGVFVLHYSMDTEKVAGLYTKIDGGPHAIVINRSSGSKARRLFTLAHEFCHVLLRASGISNPSIRKNRIEVFCNQFAAYLLAPKELIRQGLDKYNYTPSIDNSTIRLLAQNLGISQQCCLLRLIDMKILPKEDYSRWVGRFVGKIPEEDKKTKSGGGGGDPDPIRDKRLIMFYVSCEAIKSSQGGLLTQCSTDSCH

SEQ ID NO: 18345 - DNA, 585 bp, Unknown
  Obtained from environmental sample
  misc_feature (1)..(585): n is a, c, g, or t
atgaatatttttccattaagtccttataacttaatcttccctgatccatcccaagcagaagatgaagggattgtggcttatggtggagatttaagtgttaatagaattatgtatggatattcaaagggaattttcccttggtttaatgaagatgatcctattttatggtggtctccaaatcctcgatttgttttagatatcaatgatttacatatctcaaaaaatttaaaaaaaacaataagaaaaaaaatctttgaagtaaaatttgatataaactttgaacaagtaatcaaagagtgtgcaaaagcaaaaagaccagatcaagagggtacttggataactactgatatgcttgaagcatattgtgatttacataaagctggatttgcccatagttttgaatcttatgaagatggcaagttagttggtggtggctatggtgtggttattggtgatatcttttgtggagagtcaatgtttgctcttaaaagtgatgccagtaaagtagcttttgtagcactagtccagagactaaaaaatactggatctagtttaattgatagtcagatttatacagactattag

SEQ ID NO: 18346 - protein, 194 aa, Unknown
  Obtained from environmental sample
  DOMAIN (32)...(194): Leucyl/phenylalanyl-tRNA protein transferase
  misc_feature (1)..(194): Xaa is any amino acid
MNIFPLSPYNLIFPDPSQAEDEGIVAYGGDLSVNRIMYGYSKGIFPWFNEDDPILWWSPNPRFVLDINDLHISKNLKKTIRKKIFEVKFDINFEQVIKECAKAKRPDQEGTWITTDMLEAYCDLHKAGFAHSFESYEDGKLVGGGYGVVIGDIFCGESMFALKSDASKVAFVALVQRLKNTGSSLIDSQIYTDY

SEQ ID NO: 18347 - DNA, 543 bp, Unknown
  Obtained from environmental sample
  misc_feature (1)..(543): n is a, c, g, or t
atgaaaaaaaaagttttaatattacatggttggggtggaagccatgaaccccattggcaatggtggttaagtaatgaactaccaaaagatgaatatgagatttcatttccatcttttccaaatgaagagttaccaaactttaacgagtggttaaattttttgaaaaatgaatttgataaatttcaacctgatattgtagtgtgtcattcactagctaatattctatggtttcattttgttgaaaaatttcctataaaagagctagaaaaattgatgcttgtggcacccgtaagaaaagattgtaaaataaaagagctacaaacatttttcccttatcctattccaaaagatttaaaagctaaagagataataatggttgcaagtgataacgatatttatttaaatgtccaagaggcaatagagttacaaagtcaactcaatgtggggctaaaaatacttgaaaatgctggtcatataaatgctgatagtggctttggagaacttccttgtgcagtagattggataaaaagagaacttgaatag

SEQ ID NO: 18348 - protein, 180 aa, Unknown
  Obtained from environmental sample
  DOMAIN (5)...(179): Protein of unknown function (DUF1234)
  misc_feature (1)..(180): Xaa is any amino acid
MKKKVLILHGWGGSHEPHWQWWLSNELPKDEYEISFPSFPNEELPNFNEWLNFLKNEFDKFQPDIVVCHSLANILWFHFVEKFPIKELEKLMLVAPVRKDCKIKELQTFFPYPIPKDLKAKEIIMVASDNDIYLNVQEAIELQSQLNVGLKILENAGHINADSGFGELPCAVDWIKRELE

SEQ ID NO: 18349 - DNA, 663 bp, Unknown
  Obtained from environmental sample
  misc_feature (1)..(663): n is a, c, g, or t
ttggcttcaggaagaactgatttacccaataaaagcataaaaaaagctgaatttatttgggagaagtacaataacaaaacaggctttcctataaaagatttaaataccaattctatgtgttatacaaccgttggtttgccaaaaaataataaaaataccaaaggaattatttggggagcttgtggagatgataaaatagtaagatttaatcctaatgcaattaatagagacaagcgtttacctaaactatttattcaaaaagttaaaattaatgaagaaaatattagttggaattcacttaaaaatcacaacgatagtttaattacgcttaatgaagaggctttaatttatggaaatagattggatgatgaagagaaatcaacattatttaaaaacttagaaggaattacattttctgaggtaagaaactggtatcaaataccagaggatttagttctgcccaaccatttaaacaacatttcatttgagtttttagctgtagaaacagaaagaaattttttggtaaaatatcaatacgctttgatagaatatgcttctgctatcgatttggaaaaagtagaatggtctccattatcatccaacacattggctaactacaataatttatgggagggaatataccttttagttaaccatatctga

SEQ ID NO: 18350 - protein, 220 aa, Unknown
  Obtained from environmental sample
  misc_feature (1)..(220): Xaa is any amino acid
MASGRTDLPNKSIKKAEFIWEKYNNKTGFPIKDLNTNSMCYTTVGLPKNNKNTKGIIWGACGDDKIVRFNPNAINRDKRLPKLFIQKVKINEENISWNSLKNHNDSLITLNEEALIYGNRLDDEEKSTLFKNLEGITFSEVRNWYQIPEDLVLPNHLNNISFEFLAVETERNFLVKYQYALIEYASAIDLEKVEWSPLSSNTLANYNNLWEGIYLLVNHI

SEQ ID NO: 18351 - DNA, 360 bp, Unknown
  Obtained from environmental sample
  misc_feature (1)..(360): n is a, c, g, or t
atgaattgggaattgatttataaaacttcaggttcaaagacggtccaaataatgagtggtagaaatgacaatttaggaaagattttaaattggaagataagctcaacaaaaagtaatgttcatacaataaacgttgaccgcattgaagataaagtggaagtgtcttttttaagcaacgactctatagaagacatcaaaattagcattgagaaaacaccgaaaaataacttgcttgaattttcgaacttatactctcaattctcagtagcattagataacgagacctcaagaggttatttagaggaaagaaataacaaaatttgttgggatgaaaaccttagcaatgctatttgtagttaa

SEQ ID NO: 18352 - protein, 119 aa, Unknown
  Obtained from environmental sample
  misc_feature (1)..(119): Xaa is any amino acid
MNWELIYKTSGSKTVQIMSGRNDNLGKILNWKISSTKSNVHTINVDRIEDKVEVSFLSNDSIEDIKISIEKTPKNNLLEFSNLYSQFSVALDNETSRGYLEERNNKICWDENLSNAICS

SEQ ID NO: 18353 - DNA, 615 bp, Unknown
  Obtained from environmental sample
  misc_feature (1)..(615): n is a, c, g, or t
atgagaacagtcttaataacaggtgctacgggattaatcggacaggaaattgttaaagtttgtcatgaaaacaattggtctgttcgctacttaacaacgtctaagcacaaactttctaatcaagataattataaaggtttttattggaacccaagttctaaagaaattgatatctcttgttttgaaaatgttgatacaattataaatttagttggagcaacgatttcaaaacgatggactccagattacaaaaaagagattattagtagtagaacagaaactgttaagttgttgtttgataccattaaagctcatagctttcctattgaacagatggtttccgcgagtgcaataggtatctatccaagttctcaaactaactattatgaagaagattttgaaaagacttctgattcctttttaggacatgtagttgaaaaatgggaagctgctgtcgaccagttttcatctttagggattaaggtctcaaaaataagaatcggtttggtactttcaagaaaaggaggagcgcttccggaaattataaaatctatgcgttttggtgcaggagcagnttttggagatggtcaccattggcatcttggatacctattn

SEQ ID NO: 18354 - protein, 205 aa, Unknown
  Obtained from environmental sample
  misc_feature (1)..(205): Xaa is any amino acid
MRTVLITGATGLIGQEIVKVCHENNWSVRYLTTSKHKLSNQDNYKGFYWNPSSKEIDISCFENVDTIINLVGATISKRWTPDYKKEIISSRTETVKLLFDTIKAHSFPIEQMVSASAIGIYPSSQTNYYEEDFEKTSDSFLGHVVEKWEAAVDQFSSLGIKVSKIRIGLVLSRKGGALPEIIKSMRFGAGAXFGDGHHWHLGYLX

SEQ ID NO: 18355 - DNA, 600 bp, Unknown
  Obtained from environmental sample
  misc_feature (1)..(600): n is a, c, g, or t
ttgatgcgttataaaggtggattgaaagattttatctataaagattatttatacaatgatggcaatctatttaagataaatagttcgtttgatttaaaaaagatcaatgacgaaattttgcttaaaacggtgcaagattcgtttgcggcttttaaaaagttaaataattatgtaacaagccaaaataaaatttatcccttggcattagttaataattttaaacccattaaggttaaatttacggaagcacaacaacttcaaattaaggaattagtaggtgacaaaataatggatgaagtttttatgatagcaagacaaaaagcatttaataacgatagagaaacagccagattattgtgcaattatatcttaaataatttcccaaatcactctgatgctagaattttaaaaggacgtactttatcttgggacggaaagtataaggaagccgaagaaacgttgttagatgccgtaaatagagatcctttttattttgattcttatgcagcactgttagatttgtattggtggtctgatcaagaagaaaaaggagtggagctcgcaaaaaaagcgagggtaataagattgaaaaccctataa

SEQ ID NO: 18356 - protein, 199 aa, Unknown
  Obtained from environmental sample
  misc_feature (1)..(199): Xaa is any amino acid
MMRYKGGLKDFIYKDYLYNDGNLFKINSSFDLKKINDEILLKTVQDSFAAFKKLNNYVTSQNKIYPLALVNNFKPIKVKFTEAQQLQIKELVGDKIMDEVFMIARQKAFNNDRETARLLCNYILNNFPNHSDARILKGRTLSWDGKYKEAEETLLDAVNRDPFYFDSYAALLDLYWWSDQEEKGVELAKKARVIRLKTL

SEQ ID NO: 18357 - DNA, 420 bp, Unknown
  Obtained from environmental sample
  misc_feature (1)..(420): n is a, c, g, or t
atggacttcgacgacctgttgatgaagccgattgagctgtttgaacgccacccggaggtcctgcacaagtggcagcacaagttcaaatacatcatggtggacgagtaccaggataccaaccacgcccagtacatgatcaccaaaatgctggctgcggttcaccaaaacatctgcgttgtgggagacgatgcccagagtatctattcgtttcgcggcgccaatatccagaacatcctcaatttccagaaggactatcccgatacccggcaattcaaactggagcaaaattaccgttccaccaaaaacatcgttgaggcagccaacagcatcattgcccgcaacaaaaaccagatccaaaaaacggtttttaccgagaaagatgccggcgaactgatcaccatcatcgaagccaataccgng

SEQ ID NO: 18358 - protein, 140 aa, Unknown
  Obtained from environmental sample
  misc_feature (1)..(140): Xaa is any amino acid
MDFDDLLMKPIELFERHPEVLHKWQHKFKYIMVDEYQDTNHAQYMITKMLAAVHQNICVVGDDAQSIYSFRGANIQNILNFQKDYPDTRQFKLEQNYRSTKNIVEAANSIIARNKNQIQKTVFTEKDAGELITIIEANTX

SEQ ID NO: 18359 - DNA, 645 bp, Unknown
  Obtained from environmental sample
  misc_feature (1)..(645): n is a, c, g, or t
ttggcagatgtagatacaaattcgcaatggattggagtagaattaaataaaattggcgtttcggtctatcaaatttcatcgattcaagatgacgagcaacatattttaaacgcgttaaaagaagcacaagaacgagcggatattgtaattattactggaggattaggttcaactaaagacgacatcacaaagaaaacaatcgctacatattttaatgatactgaactgatagaatatccagaagttgtagcgcatatcaaagcattgtttcaaaaaataaatcatccttttaaagaagttcaaagatatcaagcgcaattaccatcaaaagctacctatttaaaaaatcaatacggcacagcaccaggaatgtggttttacgaaaacaataccgtttttgtttcgttgcccggcgttccgtatgaaatgaaaggattgatgaccaatgaagttttgccaagaattcaacaacaatttaaactgccttttattagtcataaaacaattatgacctacggacaaggagaaagtgtgattgcagaacgaattgcagaagtagaagacaacctgncaaaacatataaaattagcgtatttaccatctttcggaaaagtaaagattgcgattgtctggaaacggaactga

SEQ ID NO: 18360 - protein, 214 aa, Unknown
  Obtained from environmental sample
  DOMAIN (3)...(100): Probable molybdopterin binding domain
  misc_feature (1)..(214): Xaa is any amino acid
MADVDTNSQWIGVELNKIGVSVYQISSIQDDEQHILNALKEAQERADIVIITGGLGSTKDDITKKTIATYFNDTELIEYPEVVAHIKALFQKINHPFKEVQRYQAQLPSKATYLKNQYGTAPGMWFYENNTVFVSLPGVPYEMKGLMTNEVLPRIQQQFKLPFISHKTIMTYGQGESVIAERIAEVEDNLXKHIKLAYLPSFGKVKIAIVWKRN

SEQ ID NO: 18361 - DNA, 375 bp, Unknown
  Obtained from environmental sample
  misc_feature (1)..(375): n is a, c, g, or t
ttgggaggagaaaaccgttactcaattatagccggaggcaacttgcgaaccgtgttgcatccgcccgaaccatccatgaaagaacaaaagaagattcctacctccaaagtccagcgtgcttcacgatttgtccgcactggcgcaaaagttggccgcaactatgtctcccattacaccaaaaagatcttcaacaaggacattgaacgttccgagttggaccagaaaaatgcggaagacatttatggagaattgagccagttgaaaggcggcgctttgaaggtcgcgcagatgctgagcatggacaaaggcatgtttccgcgggagttacccggcaatttgccagtcgcaatctcgaccgagtctgtgatccactga

SEQ ID NO: 18362 - protein, 124 aa, Unknown
  Obtained from environmental sample
  misc_feature (1)..(124): Xaa is any amino acid
MGGENRYSIIAGGNLRTVLHPPEPSMKEQKKIPTSKVQRASRFVRTGAKVGRNYVSHYTKKIFNKDIERSELDQKNAEDIYGELSQLKGGALKVAQMLSMDKGMFPRELPGNLPVAISTESVIH

SEQ ID NO: 18363 - DNA, 318 bp, Unknown
  Obtained from environmental sample
  misc_feature (1)..(318): n is a, c, g, or t
ttggggtgtaaggcatgtgtctcgattattatcagtaactcccacaaaatttatagttcgattcccttcaaggggggtcacagggtgctatctcgaacatacaaaaagccttataaaaaaggctttttgacggtattttgtgctcctttagcacattttactggtgaaccgtgtcgagacgaacctcgaaccaatagtaaaaaagatgaagaaggaacaccatgtataagttatgacatcaattctgaaaaacgaaaaatctcaaacaaaatcaattccgacaaattagcaaaaagcttgatccaggccatctattga

SEQ ID NO: 18364 - protein, 105 aa, Unknown
  Obtained from environmental sample
  misc_feature (1)..(105): Xaa is any amino acid
MGCKACVSIIISNSHKIYSSIPFKGGHRVLSRTYKKPYKKGFLTVFCAPLAHFTGEPCRDEPRTNSKKDEEGTPCISYDINSEKRKISNKINSDKLAKSLIQAIY

SEQ ID NO: 18365 - DNA, 555 bp, Unknown
  Obtained from environmental sample
  misc_feature (1)..(555): n is a, c, g, or t
atgtttttcgttacttttgagtttgaaagaataagttggaagattgagtttttgcatatctattgccacgaatatcacaaatttttgtggaagaaaaaagagaacgaatacaatttatttaatcagtcaattcgtggcaaaattataagtaagaaaatggacgaaataaactctattgtaagcgatattaaaaacggaaacgtaaaacccatttattttttaatgggagaagaagcctattacattgatagaatttccgatttaatagaagctacggtgttagatgaagctgaaaaaggttttaatcaagtggtaatgtacggtagagatgtttctatagaagaaatagcatcttctgcgaaacgttatccgatgatggcagaaaagcaagttattattgttaaagaagcacaagatttaagcagatcgatagaaaagttggtttcttatgtagaaaatattcaaccaactaccgttttggtcatcaattataagtacaaaaaattagacaagcgtaaaaagctatacaaagcaattgaaaaagctggagttatn

SEQ ID NO: 18366 - protein, 185 aa, Unknown
  Obtained from environmental sample
  misc_feature (1)..(185): Xaa is any amino acid
MFFVTFEFERISWKIEFLHIYCHEYHKFLWKKKENEYNLFNQSIRGKIISKKMDEINSIVSDIKNGNVKPIYFLMGEEAYYIDRISDLIEATVLDEAEKGFNQVVMYGRDVSIEEIASSAKRYPMMAEKQVIIVKEAQDLSRSIEKLVSYVENIQPTTVLVINYKYKKLDKRKKLYKAIEKAGVX

SEQ ID NO: 18367 - DNA, 774 bp, Unknown
  Obtained from environmental sample
  misc_feature (1)..(774): n is a, c, g, or t
ttgggtaaaggtagtaaaagggggatggtaaataaaacagatcaattgattttccaatgtaagcagaatttattgttccctgatgatgagcttaaagaaatcgtaaccaatgatgaatcagatagttttaaaaagatctataataactatctcatcctctgcaaagaacagaatgtggtggattttgaagatctgattttcatgacggtcaaaatgttgaccgatgatgaaaaggtactgtcaagtgtccagaaaaggtatcattatatttttattgatgaataccaggatttgaactttggtcagtatgagcttacaaagctgatttcacaacataatcatattgttgtgattggtgatccggatcaatccatatatggattcaggggatcagacaataaatatttcaaacggtttgcccaggatcgcccgggatgtgaaaagattatactgaataagaattacaggtcaacacagaccattctcgatgcctcgtttcagatgatcagcaagtctttggagaatgaagacaaattcaaggttttttcagatgtgggaagcgccaaaaagctgataatcagggagaccgctacagaatatgcagaagccgtggctattggcaaaatgattgacaaacttgtgggtggaacatcctttttttcaatggatgccggcaaaaacagatttggacgagcaaaaagagtattcttttgcagattttgctattctttgccgaacatcaagacagtgcgaaatctttatcagcatgtttga

SEQ ID NO: 18368 - protein, 257 aa, Unknown
  Obtained from environmental sample
  DOMAIN (1)...(257): UvrD/REP helicase
  misc_feature (1)..(257): Xaa is any amino acid
MGKGSKRGMVNKTDQLIFQCKQNLLFPDDELKEIVTNDESDSFKKIYNNYLILCKEQNVVDFEDLIFMTVKMLTDDEKVLSSVQKRYHYIFIDEYQDLNFGQYELTKLISQHNHIVVIGDPDQSIYGFRGSDNKYFKRFAQDRPGCEKIILNKNYRSTQTILDASFQMISKSLENEDKFKVFSDVGSAKKLIIRETATEYAEAVAIGKMIDKLVGGTSFFSMDAGKNRFGRAKRVFFCRFCYSLPNIKTVRNLYQHV

SEQ ID NO: 18369 - DNA, 339 bp, Unknown
  Obtained from environmental sample
  misc_feature (1)..(339): n is a, c, g, or t
atgataagcattatagtaccagtatttaatgaacaagctagtttagggcggtttatctcttatataaaaaggaatatttcgaaaactaaagcagagttaatatttattgatggcgggagttccgataacacaattcagatatgcaacgagatgggggcgaaagtttttaagtcgcccaaaaaaggaagagcatctcaaatgaatttcggagcttcaaaagcttctggaaatatactttattttttacatgtagactctcttccgcccttaggtttcgtggtagatatttataaaaatattgagaaaggttattcggcaggtgctatagattgtctttga

SEQ ID NO: 18370 - protein, 112 aa, Unknown
  Obtained from environmental sample
  misc_feature (1)..(112): Xaa is any amino acid
MISIIVPVFNEQASLGRFISYIKRNISKTKAELIFIDGGSSDNTIQICNEMGAKVFKSPKKGRASQMNFGASKASGNILYFLHVDSLPPLGFVVDIYKNIEKGYSAGAIDCL

SEQ ID NO: 18371 - DNA, 321 bp, Unknown
  Obtained from environmental sample
  misc_feature (1)..(321): n is a, c, g, or t
ttgaagaaggaattgaataaagtagtacttataggtagcgattgcccaactttaactagttcgattctggaagaagcgtttcaaaaactagatgaaagcgatgtggtatttggtccttcaaaagatggaggatactacttaataggaatgagttcctattatcctgaagtacttgataacatagcttggagcacagaaaaagtcatggatcaaacggaagaaaaagctaaccaaaataatattaagctatcaaaactagtgacattaaatgatatagacaatgagtcagattggaacgaatacttaggaagtattaaatga

SEQ ID NO: 18372 - protein, 106 aa, Unknown
  Obtained from environmental sample
  misc_feature (1)..(106): Xaa is any amino acid
MKKELNKVVLIGSDCPTLTSSILEEAFQKLDESDVVFGPSKDGGYYLIGMSSYYPEVLDNIAWSTEKVMDQTEEKANQNNIKLSKLVTLNDIDNESDWNEYLGSIK

SEQ ID NO: 18373 - DNA, 585 bp, Unknown
  Obtained from environmental sample
  misc_feature (1)..(585): n is a, c, g, or t
atgacaaatatatattggcctgtttataaaaacttagaaaaggaactattgaatttaacgtattcaatacatatagacgatactcaattaagcgtatattcctcaaaaattttagaccttattattaggtgtgcaatagaaatagaatcaatttctaaagaattatatctaaaagagggaggaacaaaacagggtaatataaaatatgatgaaactgccattaaattattgaacaaaaaatggtcgctagacaaaaagcttgtcataataagttctactaattgcttccaaaccaatagaatactaattccttttgaaaaaaacgaaccaagagaaaatggcaaactaacattcaaatggaatcttggttatcaggctattaagcacaaccgaagagataatcttccatttgggaatttagagaacctttttagtattttatccgccttatttttactaaatatttactttaagaaagaccagttcaaattaggagaagactcaaaaggaaagatttttcacataatctcgattctgaaatattttcgattaaagttcatcctaacgtctcgagccgattcttga

SEQ ID NO: 18374 - protein, 194 aa, Unknown
  Obtained from environmental sample
  misc_feature (1)..(194): Xaa is any amino acid
MTNIYWPVYKNLEKELLNLTYSIHIDDTQLSVYSSKILDLIIRCAIEIESISKELYLKEGGTKQGNIKYDETAIKLLNKKWSLDKKLVIISSTNCFQTNRILIPFEKNEPRENGKLTFKWNLGYQAIKHNRRDNLPFGNLENLFSILSALFLLNIYFKKDQFKLGEDSKGKIFHIISILKYFRLKFILTSRADS

SEQ ID NO: 18375 - DNA, 654 bp, Unknown
  Obtained from environmental sample
  misc_feature (1)..(654): n is a, c, g, or t
gtgcgttttttgttttatttaacaaaaaagtcctgttttttctgcatctttgtttctatgaaaatttatcccatagaaaccggtaattttaagcttgatggcggcgcaatgttcggcgtggttccaaaagctatttggcaaagaacaaatccggcagattcaaataatttaatttcgatgagcatgcgctgtatgcttattgaagatggagaaaaattaacgttggttgatacaggactgggcgcaaaacaaacagaaaagttttttggatattattacttgtatggagatttttctttggacgcttcattagcaaaattaggttttcatagagatgatattaccgacgtttttttaacacatttgcattttgatcattgcggtggcgttattcaatggaataaaaacaaaacgggatatatgcctgcttttaaaaacgcaaaagtttggtctaataaagatcattggaaatgggcaacaattccaaatccaagagaaaaagcctcttttttaacagaaaatattcaaccaattaaagaaaacggacagttaaattttataaaaaacggcattaaagatgttggatttgatgttttatttatggacggtcatacagacnaaacaaagctctcgagccgattcttgatccantag

SEQ ID NO: 18376 - protein, 217 aa, Unknown
  Obtained from environmental sample
  DOMAIN (61)...(204): Metallo-beta-lactamase superfamily
  misc_feature (1)..(217): Xaa is any amino acid
MRFLFYLTKKSCFFCIFVSMKIYPIETGNFKLDGGAMFGVVPKAIWQRTNPADSNNLISMSMRCMLIEDGEKLTLVDTGLGAKQTEKFFGYYYLYGDFSLDASLAKLGFHRDDITDVFLTHLHFDHCGGVIQWNKNKTGYMPAFKNAKVWSNKDHWKWATIPNPREKASFLTENIQPIKENGQLNFIKNGIKDVGFDVLFMDGHTDXTKLSSRFLIX

SEQ ID NO: 18377 - DNA, 630 bp, Unknown
  Obtained from environmental sample
  misc_feature (1)..(630): n is a, c, g, or t
atgaaaaaagcacgaattattattttatcattttttataggaatggtagcggcaaatgctcaaaagaaagggtattggcaacaacatgtaaattacaccatgaatgtagatgttgatgtaaataattttcaatataacggaactcaaaaattagtgtacacgaataattctggtgacgcattaacaaaagtatactatcacttattttacaacgcttttcagccagatagtgagatgaatgcaaggttgcaaaatatagctgacccagacggcagaatgaccactaaaagcggcacaaaagaaaaaccggtgtatgaaagtagaatttctaaattaaagccaaacgaaatagggtatttaaaagtacttactctaaaacaaaatggcaagaatgttcattttgaaacagccggaactattttagaagtgacattaaacacaccaattaaaccgggttctaaagtaacttttgatatgacttttaaaggacaattaccagttcatatccgtagagcaggaagaaataatcctgatggagtagcgatgtctatggcgcaatggtatcctaaaatggcagaatacgattttgaagttggcacgcagatccatatattgctagagatttcatga

SEQ ID NO: 18378 - protein, 209 aa, Unknown
  Obtained from environmental sample
  SIGNAL (1)...(18)
  misc_feature (1)..(209): Xaa is any amino acid
MKKARIIILSFFIGMVAANAQKKGYWQQHVNYTMNVDVDVNNFQYNGTQKLVYTNNSGDALTKVYYHLFYNAFQPDSEMNARLQNIADPDGRMTTKSGTKEKPVYESRISKLKPNEIGYLKVLTLKQNGKNVHFETAGTILEVTLNTPIKPGSKVTFDMTFKGQLPVHIRRAGRNNPDGVAMSMAQWYPKMAEYDFEVGTQIHILLEIS

SEQ ID NO: 18379 - DNA, 351 bp, Unknown
  Obtained from environmental sample
  misc_feature (1)..(351): n is a, c, g, or t
gtgtttttcccaccttcaaatggaaaatccagcctcaacaccgccaatatcctggtcatccgaaattccgatgaggacaagattgattcgcgggataaaatagccatcatggctgatggaaaagagattctgctcaaaaacctaaccatcgaaacgctgctggagagctacctgcccgaaaataaatttctacaaattttccgcagtactttgatcaatgtggaccactcattcaccaaacaaaatcacaatacgctgcttttcgacttgcccaaccagacttcccccttggaattgaccatcggacgcagctatacttccctattcaaaaaacgcttccctaacgcctga

SEQ ID NO: 18380 - protein, 116 aa, Unknown
  Obtained from environmental sample
  misc_feature (1)..(116): Xaa is any amino acid
MFFPPSNGKSSLNTANILVIRNSDEDKIDSRDKIAIMADGKEILLKNLTIETLLESYLPENKFLQIFRSTLINVDHSFTKQNHNTLLFDLPNQTSPLELTIGRSYTSLFKKRFPNA

SEQ ID NO: 18381 - DNA, 411 bp, Unknown
  Obtained from environmental sample
  misc_feature (1)..(411): n is a, c, g, or t
gtgaaagagtttagaccgttttatctattatacattgtgtctaattttttaccgtgtattattttgaaaaatatatctgtagattttactgagaatatgatgtattctgtaaacacattttttaaaatcaccactttgttggcgttaatttatatagtttttatcatttttaaaataatgcgttctaaagaacaaactacgtatcggtttattttaaaaacacaatatctaggaatttcatttttaattatcgctcagattgttaccgattattttgataaattgggtaaaattaatggtcttttagtcggactttcttgtgctggtttggcaataacatacacttgtcatcatttttataaaaaacattttacagaagtttctaagaatcataaaatgttagcgaaatga

SEQ ID NO: 18382 - protein, 136 aa, Unknown
  Obtained from environmental sample
  misc_feature (1)..(136): Xaa is any amino acid
MKEFRPFYLLYIVSNFLPCIILKNISVDFTENMMYSVNTFFKITTLLALIYIVFIIFKIMRSKEQTTYRFILKTQYLGISFLIIAQIVTDYFDKLGKINGLLVGLSCAGLAITYTCHHFYKKHFTEVSKNHKMLAK

SEQ ID NO: 18383 - DNA, 339 bp, Unknown
  Obtained from environmental sample
  misc_feature (1)..(339): n is a, c, g, or t
gtggtactcgatgccttggacaaaggctcctatgtgaaaattattccaagcgaacgcaaaataataggatataccaccaagaatagcggcggggtaccagaaaattttaaaaactactttgtgatggtctttgataaggatttcgaatccaccaagacttttagcggggagcaacttttggaaggtatggagattgaaaccgaccacgccggtgccattgtcagctttaaaacaaggagaggcgaggtcgttatcgccaaagtagcctcctcttttattggctatgaccaggccgaattgaatntaaaggagcttgtaccgataatttataccatatga

SEQ ID NO: 18384 - protein, 112 aa, Unknown
  Obtained from environmental sample
  misc_feature (1)..(112): Xaa is any amino acid
MVLDALDKGSYVKIIPSERKIIGYTTKNSGGVPENFKNYFVMVFDKDFESTKTFSGEQLLEGMEIETDHAGAIVSFKTRRGEVVIAKVASSFIGYDQAELNXKELVPIIYTI

SEQ ID NO: 18385 - DNA, 798 bp, Unknown
  Obtained from environmental sample
  misc_feature (1)..(798): n is a, c, g, or t
ttgtgtcttacaggccaagtataccgtctcaaggaaaacccgacggagaaacggcgagcctttagcagcaatgtgtttcagaaaattggagcagaggatccttttgtagtaaaattgcaactctcgaatggggaagaggttatcaacttagctgttacttggaattctgaaattaaaggaaaaggacttcaaagtcacaagtttgaagaaaccacataccctcgttacgtccttgaatcttttaatgaacccattaatcagggaacaataatttctcaaacgcaaattgagaacttgcttggagtttcaggtttagagctaaaaaagaattttttatggttattctatgttcagcaaggcgaagttattgcatttctgaaacaagttgaaaatgaacgcgccaaaattctcaatgaactattccgtacaacagagcaggacgacttgctaaatcaatatcaagagcttggaatccaagttcaaaaaaacattgatgctgctgaaaaaatgttggaattggaaaaaatcgaatttgcagcaacccaacagaccattattgatttcgataaaaccgaggtgaaatatgaatccatttttaccaaccagaaaagtatagttgactgggatcaagagtttaagcaaaagatcaatggtgaaaaaaggggggaattgcttcgcgaaattttcatgtttcgagatgtagtaactaagccacaagaattccagaaattccttttcattctggcaatgaaaaagtttgcggtaaatgataccctaattcgaaaggtactatggnnc

SEQ ID NO: 18386 - protein, 266 aa, Unknown
  Obtained from environmental sample
  misc_feature (1)..(266): Xaa is any amino acid
MCLTGQVYRLKENPTEKRRAFSSNVFQKIGAEDPFVVKLQLSNGEEVINLAVTWNSEIKGKGLQSHKFEETTYPRYVLESFNEPINQGTIISQTQIENLLGVSGLELKKNFLWLFYVQQGEVIAFLKQVENERAKILNELFRTTEQDDLLNQYQELGIQVQKNIDAAEKMLELEKIEFAATQQTIIDFDKTEVKYESIFTNQKSIVDWDQEFKQKINGEKRGELLREIFMFRDVVTKPQEFQKFLFILAMKKFAVNDTLIRKVLWX

SEQ ID NO: 18387 - DNA, 357 bp, Unknown
  Obtained from environmental sample
  misc_feature (1)..(357): n is a, c, g, or t
atggttcttctcgaacactacnggatcaaggatcgngntcganagtatgtaaacagaaaaacaataattgaacaagaaactaaacagcgagtactaaaaaaacgcataaaagaaataaaaagaaaaataccatactctatttttatttttattttttttgcaatagggcttgtttttttactagaaggaaaactagataaatttttaggaaatagttataatttaattcttattattagcgctttttttattttaataacagctatttacatcattataactactcttaaaattaaagacattaataaagagattcaatatttaggagaaaaaatgtataaaaaaatgaagctataa

SEQ ID NO: 18388 - protein, 118 aa, Unknown
  Obtained from environmental sample
  misc_feature (1)..(118): Xaa is any amino acid
MVLLEHYXIKDRXRXYVNRKTIIEQETKQRVLKKRIKEIKRKIPYSIFIFIFFAIGLVFLLEGKLDKFLGNSYNLILIISAFFILITAIYIIITTLKIKDINKEIQYLGEKMYKKMKL

SEQ ID NO: 18389 - DNA, 528 bp, Unknown
  Obtained from environmental sample
  misc_feature (1)..(528): n is a, c, g, or t
atgacaaaaattacagcaattattccaacttttaacgaagaatctaatatccaaagagcgttagattcggttagttttgcggatgaaattattgtcattgattcttttagtactgataaaacggttgcaattgtaaaagagtccaacgctattttagttcaaagaacttttgatgatttttcgagtcaaaagaattttgcgcttgaaaaagcgagtaacgattggatttttttattagatgcagacgaaacaattccagaaaatttaaaagaagaaattttacaaacggtagtttctactactaattttgatgctttttatatctacagaagctttttctttaaaaaggaaaaactacattttagtggctggagaagagataaggtcattcgattatttcataaagatacgtgcagatatgttggaaaagttcatgaagaaatatcaacaaatggtaccggtggttttttaaaagggaaaatcactcattattcgtataaaagtttcatccatataaaaacaatttaa

SEQ ID NO: 18390 - protein, 175 aa, Unknown
  Obtained from environmental sample
  DOMAIN (5)...(162): Glycosyl transferase
  misc_feature (1)..(175): Xaa is any amino acid
MTKITAIIPTFNEESNIQRALDSVSFADEIIVIDSFSTDKTVAIVKESNAILVQRTFDDFSSQKNFALEKASNDWIFLLDADETIPENLKEEILQTVVSTTNFDAFYIYRSFFFKKEKLHFSGWRRDKVIRLFHKDTCRYVGKVHEEISTNGTGGFLKGKITHYSYKSFIHIKTI

SEQ ID NO: 18391 - DNA, 816 bp, Unknown
  Obtained from environmental sample
  misc_feature (1)..(816): n is a, c, g, or t
atgaaaaattcgatggaaactttgaaagtaaatcgtgtagaaaaagatatctctatcgttattgtaaattataaaagttggaaacatttaaaaaattgtttggatgcattaacgcattttaagcaaaagaaattcacttttgaagttgttgtaattgacaataactcaaatgatggaaaattaaaagagttttcagaaaaatacacacaatttcggtttatagaaaattcaggaaacaatggttttgcaaatggatgtaatttaggcgccatcaactctgctggaaaaaacatgttgtttttaaatccggataccattgcaaatgaggacgcaatcgataagatgtcaacctgtttaagcaacaacgaaaactacggaattgtatcttgtaatcagttaaataataatggttcttttgaagatgttgataggatttttcctggaccatttacgttatttggaattacaagagcaatttataggcttcttgcaaaagaaacaaaacaagatgaagaaaatatttttcctgattgggtttctggttcagttgtgtgtatttctagaaaatggtttcaaaaaataaatggctggaacgaagattattggatgtattttgaagatgtagatttgtgtaaaaaagtgagagacgctaacggagaagttgttttactaaaaaatgtgaatattattcacaatcatggtggagcatcaagaattaatataaatacatcaaaaattaccaagtcagaagtgttaatttctaaacatgtgtatattcggatcataactcagctggaccgattcttgatccactag

SEQ ID NO: 18392 - protein, 271 aa, Unknown
  Obtained from environmental sample
  DOMAIN (18)...(195): Glycosyl transferase
  misc_feature (1)..(271): Xaa is any amino acid
MKNSMETLKVNRVEKDISIVIVNYKSWKHLKNCLDALTHFKQKKFTFEVVVIDNNSNDGKLKEFSEKYTQFRFIENSGNNGFANGCNLGAINSAGKNMLFLNPDTIANEDAIDKMSTCLSNNENYGIVSCNQLNNNGSFEDVDRIFPGPFTLFGITRAIYRLLAKETKQDEENIFPDWVSGSVVCISRKWFQKINGWNEDYWMYFEDVDLCKKVRDANGEVVLLKNVNIIHNHGGASRININTSKITKSEVLISKHVYIRIITQLDRFLIH

SEQ ID NO: 18393 - DNA, 474 bp, Unknown
  Obtained from environmental sample
  misc_feature (1)..(474): n is a, c, g, or t
gtggatggaaataaactggcctacatatggaaagcaaggaggagttctttggaatttgccatttccaaatttttgagatatggtagcaaacgatttagcttggacgatttggcccatgaaatcggtatttccaagaaaaccatctatcagcactttaccaataaggaggccttggtctatgaaagccttgggtttttattggacaagataaaagtcgaagtaagtcagagtgtggaacaagttagatccaatcctcttttgggaatcattatgatagataaaatagggttggaatatttgaagttgtttagtcccacttttttggacggaattaaaaaatactaccccatggttaatgagcagtaccacaactttaaaaatcgggaaataaacaacctagtgctttcactactgaaaaccgcccaaaaaaatggccagatcagggatcaatccaaaaagttgtgtgtgaattag

SEQ ID NO: 18394 - protein, 157 aa, Unknown
  Obtained from environmental sample
  DOMAIN (17)...(62): Bacterial regulatory proteins, tetR family
  misc_feature (1)..(157): Xaa is any amino acid
MDGNKLAYIWKARRSSLEFAISKFLRYGSKRFSLDDLAHEIGISKKTIYQHFTNKEALVYESLGFLLDKIKVEVSQSVEQVRSNPLLGIIMIDKIGLEYLKLFSPTFLDGIKKYYPMVNEQYHNFKNREINNLVLSLLKTAQKNGQIRDQSKKLCVN

SEQ ID NO: 18395 - DNA, 339 bp, Unknown
  Obtained from environmental sample
  misc_feature (1)..(339): n is a, c, g, or t
atggtaacagtttatggtttaaatgaagaagtaggaaatattacctattatgattcttcaggtaacgatgcttttgtaaaaccttacagcgaagaaactgctaaaaaaattgataaagaaatttctaaaatgatagaagctcaatacattagagctattgaattgttaaaaaacaataaagaaaaattaactattttagctgagttattattagaaaaagaagtcatctttaaagatgatttaatgaaaatatttggaaaaagaccttttgaagaagaagaaataataagaaaagaaattgttatagacgcagaagaaacagataaaaaagaagaataa

SEQ ID NO: 18396 - protein, 112 aa, Unknown
  Obtained from environmental sample
  DOMAIN (1)...(84): Peptidase family M41
  misc_feature (1)..(112): Xaa is any amino acid
MVTVYGLNEEVGNITYYDSSGNDAFVKPYSEETAKKIDKEISKMIEAQYIRAIELLKNNKEKLTILAELLLEKEVIFKDDLMKIFGKRPFEEEEIIRKEIVIDAEETDKKEE

SEQ ID NO: 18397 - DNA, 549 bp, Unknown
  Obtained from environmental sample
  misc_feature (1)..(549): n is a, c, g, or t
atgagtttttttaaaaaggtatttaaattatcatcagaaacatctgaagataaactggcgaaacaacaagaagtcaatttatctttggatgattcttttgtacactatttcttagaaaaaggcggtaaatttttatactgtacaaagaaagaggaagttgaatttcacttacaaaatatcatcaaagaaaatggctggaatgaattagtttgcttagataaaaaactaagtgaactaataaaaaaaacagacattattagcaaatctgatattaattattctgctcccttttttacaacttgcgaacatttaatttcagacaacggagatattcttttttcttcaaatcaaatacgaagcaaaagacttgcctcccttttcagaacactttatcgtctacgcaactaccactcaattagcttaaaaccccgcgaaacgtcaccacgacttacatccattttaaggccatattcccccaatattgtgccctctaaattatcttgcccacaccgcgtgtcattctcaattccgccacctcattcacanann

SEQ ID NO: 18398 - protein, 183 aa, Unknown
  Obtained from environmental sample
  misc_feature (1)..(183): Xaa is any amino acid
MSFFKKVFKLSSETSEDKLAKQQEVNLSLDDSFVHYFLEKGGKFLYCTKKEEVEFHLQNIIKENGWNELVCLDKKLSELIKKTDIISKSDINYSAPFFTTCEHLISDNGDILFSSNQIRSKRLASLFRTLYRLRNYHSISLKPRETSPRLTSILRPYSPNIVPSKLSCPHRVSFSIPPPHSXX

SEQ ID NO: 18399 - DNA, 543 bp, Unknown
  Obtained from environmental sample
  misc_feature (1)..(543): n is a, c, g, or t
atgaatacaagtatagtaggaagacatgttaccttaacagatgaattaaaattacatattgaaagtacaatagatacatttaaaaaatacaatttagatatgatctctgtaaatgcaattgtttctcaagaacaaaaacatggtaaaaatgtaataacatttgaatatgtactaaatatagcaaatattgatacagttgttgttaaacaaaaagataaagatttacatagtgcaattgatatagctacagatagagtttgtaaaatattaagaagacacgctgataaaataaaagcacatgatgcaacaaaattaacaaatatagagattgcagagcaagaagataatattgcaaaagagcttgaaaaatttgatactgagatagtaccaatgaaactagcatcatataagcctgtagagatagaggaagctttaacagatttaaaaggtagtgatgcactctttaaagtgttctacgatatggatgataactttagagtattatataaaatgaaagatggaaagagcttcggtttatattaa

SEQ ID NO: 18400 - protein, 180 aa, Unknown
  Obtained from environmental sample
  DOMAIN (2)...(100): Sigma 54 modulation protein / S30EA ribosomal protein
  misc_feature (1)..(180): Xaa is any amino acid
MNTSIVGRHVTLTDELKLHIESTIDTFKKYNLDMISVNAIVSQEQKHGKNVITFEYVLNIANIDTVVVKQKDKDLHSAIDIATDRVCKILRRHADKIKAHDATKLTNIEIAEQEDNIAKELEKFDTEIVPMKLASYKPVEIEEALTDLKGSDALFKVFYDMDDNFRVLYKMKDGKSFGLY

SEQ ID NO: 18401 - DNA, 786 bp, Unknown
  Obtained from environmental sample
  misc_feature (1)..(786): n is a, c, g, or t
ttggaggctttgaattcggctcgagactggcgccttgcagattatgacagagcagttgtgatgggaaagcgctcttttggaaaaggtttggtgcagcgttttagagctttgagttatggaacgcaattaaaagtaaccatttctaaatattatacaccaagcggacggtgtattcaagaattagattatgcaaatagagatttaaaaacaggaaaagttccgaagttttcggatgctggagttaatgagtttagaactcaaaacggaagagtagtttttgatggtggcggaattaatccagatattattaccgaaaacgaaatggtaacagaagaaacgaaaatactattaaattctagagccttatttaattttgcaatccattttaaaaataaaaacaacaggattacttctgcaaaagagtttaggtttacgaatactgattttaaacaatttcaatcgtttttaaaaacggatacaacgtttcaaacaaaagaagaaacatcctttaaagaagcttataaaacgttgaatacttctcaaaaccagaaaataaaaacagcatattcgcgaataataagcacgttaaaatcagaaaaaataaaagagttaacaagtaataaagaacttataaagaacgaattaaaagatattattttagatcaatattactatcaagaaggtgtttatcaaaataaaatagcatctgataaaactgttttagaagcggttaaattattcaaaaacgcaacaaagtacaatcagatactatcaggcaaaaagtaa

SEQ ID NO: 18402 - protein, 261 aa, Unknown
  Obtained from environmental sample
  misc_feature (1)..(261): Xaa is any amino acid
MEALNSARDWRLADYDRAVVMGKRSFGKGLVQRFRALSYGTQLKVTISKYYTPSGRCIQELDYANRDLKTGKVPKFSDAGVNEFRTQNGRVVFDGGGINPDIITENEMVTEETKILLNSRALFNFAIHFKNKNNRITSAKEFRFTNTDFKQFQSFLKTDTTFQTKEETSFKEAYKTLNTSQNQKIKTAYSRIISTLKSEKIKELTSNKELIKNELKDIILDQYYYQEGVYQNKIASDKTVLEAVKLFKNATKYNQILSGKK

SEQ ID NO: 18403 - DNA, 480 bp, Unknown
  Obtained from environmental sample
  misc_feature (1)..(480): n is a, c, g, or t
atgaaaaaaacaattctagttttaatttgcctttttagtatatcggcactttttgcgcaaagtccatctcaagcagcaacgtatgctgtttctggtaaagtaattgacaaagacaccaaacaacctttagaatatgctactgttgttctaaaaaacttaaaaagcaacaaattaagtggtggaattactgatggaaaaggtgaattttacattaaaattgctggcggtacgtatgatataagtgttgagtttatttcttttaaaacaattcgttttaataatagaactattgataaaaacatcaatcttggaaccgtaattttatctgaagatggccaagtgcttgatgaagtaaacatcattccagaaaaatctaccgtagatattcgtntagatcacaaactatttaacgtaggtaaagacttgacgctacaggcagaaatgttgccaagtttcagaccaggttccgctgaaatgtga

SEQ ID NO: 18404 - protein, 159 aa, Unknown
  Obtained from environmental sample
  SIGNAL (1)...(19)
  misc_feature (1)..(159): Xaa is any amino acid
MKKTILVLICLFSISALFAQSPSQAATYAVSGKVIDKDTKQPLEYATVVLKNLKSNKLSGGITDGKGEFYIKIAGGTYDISVEFISFKTIRFNNRTIDKNINLGTVILSEDGQVLDEVNIIPEKSTVDIRXDHKLFNVGKDLTLQAEMLPSFRPGSAEM

SEQ ID NO: 18405 - DNA, 636 bp, Unknown
  Obtained from environmental sample
  misc_feature (1)..(636): n is a, c, g, or t
ttgatgacaaaacagtggatggaagaagagatattacggacagtcagaaaaaatcaatttgaaaaactatgtcgtgtacggtttcagatttatggaggtaagggtggcttatttgatgggcagaacccatggactgagtttattatagactgccaacgtgttgagccaagtatgatgcaattgaatgaaaaaggattgtcattgatatatgcaaagggtattgcaaaaagccctgacagtattgccaaccttaagactaccaatgcaatgatatactgcgtggctgccagacaggcttcagctaagaaagttgataatgctataatactaaatacacaaggcaaccctatagaaactacacttgccaacctttattgtatcaaaggcgatattatttacacccctcctttatcagaaggtcctgtagctggtgtaatgcgtagatatgtacttaaagaattacctaaaaacggttttactgtcaaagaagaacctttctctatcgatttcttaaaaactgcagatgctgtatttgtaacgaatgcaatcagacgcttcaaatgggtggctagtatagaagacactcagtattcttttgacaaaattcttaatgtttacgagaaaatcagctattaa

SEQ ID NO: 18406 - protein, 211 aa, Unknown
  Obtained from environmental sample
  DOMAIN (1)...(210): Aminotransferase class IV
  misc_feature (1)..(211): Xaa is any amino acid
MMTKQWMEEEILRTVRKNQFEKLCRVRFQIYGGKGGLFDGQNPWTEFIIDCQRVEPSMMQLNEKGLSLIYAKGIAKSPDSIANLKTTNAMIYCVAARQASAKKVDNAIILNTQGNPIETTLANLYCIKGDIIYTPPLSEGPVAGVMRRYVLKELPKNGFTVKEEPFSIDFLKTADAVFVTNAIRRFKWVASIEDTQYSFDKILNVYEKISY

SEQ ID NO: 18407 - DNA, 636 bp, Unknown
  Obtained from environmental sample
  misc_feature (1)..(636): n is a, c, g, or t
ttgnattgccgcaggccatgggccttaaggcnatgctgttgtggacatcgacgtaactttaaggaaaccccactatcctgttatcattttatgacgattttaaagcctggccttttggatacagaaaggtattttgatcttttggcgaaatatcttcctgggaatacctttgagtctttgcagcgcaagctttatgtagtggctaccgacttgcaaaaaggggatgaaaaaatattttctgaaggggaattgattaaacccttgttggcttctgcggcattaccgcctgtctttagtccggtggctattaatggacgcttatatgccgatggaggtataatgaacaatttcccctatgatgaagttgccgtttcatcagattttgttattgggagtaatgtttccgggatcaaggaaattcccaaagaaggaataaaatcgtccttgcagttggccaataggactacctctttaatgatttatgccattaataggaacaaagttaataaatgtgacctattattcgaaccaaaagccttggagctcattgggatattggacaaaaaaggaattgaaaaagcctacaccattggttacgagcacgccataagggtaatggagcagaaatttaggtag

SEQ ID NO: 18408 - protein, 211 aa, Unknown
  Obtained from environmental sample
  DOMAIN (7)...(123): Patatin-like phospholipase
  misc_feature (1)..(211): Xaa is any amino acid
MXCRRPWALRXCCCGHRRNFKETPLSCYHFMTILKPGLLDTERYFDLLAKYLPGNTFESLQRKLYVVATDLQKGDEKIFSEGELIKPLLASAALPPVFSPVAINGRLYADGGIMNNFPYDEVAVSSDFVIGSNVSGIKEIPKEGIKSSLQLANRTTSLMIYAINRNKVNKCDLLFEPKALELIGILDKKGIEKAYTIGYEHAIRVMEQKFR

SEQ ID NO: 18409 - DNA, 600 bp, Unknown
  Obtained from environmental sample
  misc_feature (1)..(600): n is a, c, g, or t
atggatcacagaatcggctccatggtcattaaatcactnattaaaaaggaaataaagggcaatgaattgcgcagggcctattctattagttcctctcctaagtgtgagggtataaccatcggtgtcaagaaagtggacaaggggggattttcagatttcgcacataacaaacttaaggtaggggatgtattggaagtaatgccgccggaaggccgatttatttttaaaccctctccgaatccaaaaaacatagtggcctttgctgcaggtagtggtattactcctatcatgagtattgccaaaaccgtattggaatccaattccaaaaataattttgtgttggtatatgggaataaatcctataaggaaaccatgttctataccgatttggtgaagcttcaattagaatataccaataggtttcatatatattttattttgagccagacccaggaggacgaatccatttttgggcgtatagaggcctcaacaataaactatgttctcaaaaacaaacataaaaacttggaattcagtgattactacctgtgtgggccagaggcaaatgatacagttggtaaccgaaaacctaaaagataa

SEQ ID NO: 18410 - protein, 199 aa, Unknown
  Obtained from environmental sample
  DOMAIN (81)...(195): Oxidoreductase NAD-binding domain
  misc_feature (1)..(199): Xaa is any amino acid
MDHRIGSMVIKSLIKKEIKGNELRRAYSISSSPKCEGITIGVKKVDKGGFSDFAHNKLKVGDVLEVMPPEGRFIFKPSPNPKNIVAFAAGSGITPIMSIAKTVLESNSKNNFVLVYGNKSYKETMFYTDLVKLQLEYTNRFHIYFILSQTQEDESIFGRIEASTINYVLKNKHKNLEFSDYYLCGPEANDTVGNRKPKR

SEQ ID NO: 18411 - DNA, 726 bp, Unknown
  Obtained from environmental sample
  misc_feature (1)..(726): n is a, c, g, or t
ttgactcggtcagtatgtctgagaggaatatcatattcaggtgtaaatacctgtatgacatatttagtcttgatattttcatttatgctgccattaaagagttttgctcaagatattggcataaaatattacgcaattgactctgtcgataaagagcttgtgttttttgatgattttgaaaagcagaaagataattggctctcttcaaatggagagcctgttgagttcagcaaaagagtatttatagagtctggtgtttttaattttaagggatacaaaaagggttataaagcatgggcttgcaaagtgccatttgattattctcgaaattttgaaattgaattcagagcaaaggttgaaagtaagaattcgagcatacataatggcataatattctggtcgagagagcatacggaaaatttagtggcaaactatttatatttcgggtctacaggatatgtagaatttcaaacggctgatgaggttaacagcaaaaatactaaaagtggttataccacttcggcaataagtgtaattggatttcaacttggaggatataatacttatacaattcgtcattataatggagtgtattatatttttgtaaataataatttcttagtgcttaaaccttacgtaagtacaaatggttctttcatcggaataggaggaaataaaggctcattgctaacatatgactatataaaaatgtactatttacgatag

SEQ ID NO: 18412 - protein, 241 aa, Unknown
  Obtained from environmental sample
  misc_feature (1)..(241): Xaa is any amino acid
MTRSVCLRGISYSGVNTCMTYLVLIFSFMLPLKSFAQDIGIKYYAIDSVDKELVFFDDFEKQKDNWLSSNGEPVEFSKRVFIESGVFNFKGYKKGYKAWACKVPFDYSRNFEIEFRAKVESKNSSIHNGIIFWSREHTENLVANYLYFGSTGYVEFQTADEVNSKNTKSGYTTSAISVIGFQLGGYNTYTIRHYNGVYYIFVNNNFLVLKPYVSTNGSFIGIGGNKGSLLTYDYIKMYYLR

SEQ ID NO: 18413 - DNA, 411 bp, Unknown
  Obtained from environmental sample
  misc_feature (1)..(411): n is a, c, g, or t
atgactttaataaaaacaaaagcaattgtattcagttcgttaaaatacggagataccagtttaattgttcgttgttttactttagaagacggattaagatcttatttattaaaaggtgttttaagtgctaaaaaaggaaaagtaaaacccgcctattttcagccgttaacacaattaaatattgaggcaaatcacaacaagaaaggaagcttaaatagcattcgggaagttcatattatcaatccgtataagaatatttataccaatatttttaagcaaacaatagtgttgttttggtccgaaattttaagcagcaccatacaggaagaagaagctaacgaagccttattttcttttttagaaacctctttacttcggttagataccaatgataaaacatcaaattttcca

SEQ ID NO: 18414 - protein, 137 aa, Unknown
  Obtained from environmental sample
  misc_feature (1)..(137): Xaa is any amino acid
MTLIKTKAIVFSSLKYGDTSLIVRCFTLEDGLRSYLLKGVLSAKKGKVKPAYFQPLTQLNIEANHNKKGSLNSIREVHIINPYKNIYTNIFKQTIVLFWSEILSSTIQEEEANEALFSFLETSLLRLDTNDKTSNFP

SEQ ID NO: 18415 - DNA, 369 bp, Unknown
  Obtained from environmental sample
  misc_feature (1)..(369): n is a, c, g, or t
ttgactgctatcttgtcaattttcactagatcggttgatgtagattttatactacaaaagcagattcactttttaaaacgaaagccaaaatatccttttttcttttctaagaatgaaccagattcaatttggataaagaaaattaagaatacagacgaacaagaattgtttgcagaaacacaaaaaatatatgctaatattgattttcttaaaaatgatttaacgcaattatttaaacatattaaatattacaatccagcttttaaagcaccaaaagtgattacgcttttaagcaatatcgattatcaaaataaagtattgtatacaggagattatttgttgatttctttagaatgtttatttgggtaa

SEQ ID NO: 18416 - protein, 122 aa, Unknown
  Obtained from environmental sample
  misc_feature (1)..(122): Xaa is any amino acid
MTAILSIFTRSVDVDFILQKQIHFLKRKPKYPFFFSKNEPDSIWIKKIKNTDEQELFAETQKIYANIDFLKNDLTQLFKHIKYYNPAFKAPKVITLLSNIDYQNKVLYTGDYLLISLECLFG

SEQ ID NO: 18417 - DNA, 393 bp, Unknown
  Obtained from environmental sample
  misc_feature (1)..(393): n is a, c, g, or t
ttgggtaaaagccataaattctattcagattacccaagttatatcaaacaaaactttgagaaaaatcacattgtaattgatgttgctaaagcaattatcccgaaacaaaacaatgcaaaagatagaacgtttgtcagtaaaatgataacagaaggaaagaaattgtatctcttagatatctatttaccaaatgtaacagggtatcaaacaatagggtattcagaagaaaaaaacaattgggcaattgacaatgaagaacaggtttggaactattctattgaccataagtacctgtttagcaccgatacaaaattgaacaaacggctcttagaattggcgccgtctcaacatttattacatccagaagatgcgcctgtctccaggaagaattga

SEQ ID NO: 18418 - protein, 130 aa, Unknown
  Obtained from environmental sample
  misc_feature (1)..(130): Xaa is any amino acid
MGKSHKFYSDYPSYIKQNFEKNHIVIDVAKAIIPKQNNAKDRTFVSKMITEGKKLYLLDIYLPNVTGYQTIGYSEEKNNWAIDNEEQVWNYSIDHKYLFSTDTKLNKRLLELAPSQHLLHPEDAPVSRKN

SEQ ID NO: 18419 - DNA, 354 bp, Unknown
  Obtained from environmental sample
  misc_feature (1)..(354): n is a, c, g, or t
ttgctatggatttcggaaccactatttgtagcctgtatgaaaaatgaagcccctccgctcgcagttcacatgttccctcaaatagataactatataatttctcgtcaaattggtgaagggggatatggttccgtgtatgaagccatccaggccagcactggtcaaaaggttgcgatcaagatgctgaagtttgtggacaaccttgatgagcaaaaagaaaataccaattggtcgtttgagcggaaaagagactttgtgcgatttgaacatctcatgttgttaactactaaacaagggtattctgagatgagttcctttgccggtttaattgatgaagggaaacattcgaaannt

SEQ ID NO: 18420 - protein, 118 aa, Unknown
  Obtained from environmental sample
  misc_feature (1)..(118): Xaa is any amino acid
MLWISEPLFVACMKNEAPPLAVHMFPQIDNYIISRQIGEGGYGSVYEAIQASTGQKVAIKMLKFVDNLDEQKENTNWSFERKRDFVRFEHLMLLTTKQGYSEMSSFAGLIDEGKHSKX

SEQ ID NO: 18421 - DNA, 453 bp, Unknown
  Obtained from environmental sample
  misc_feature (1)..(453): n is a, c, g, or t
gtgtgtttaaccgttgttgctcttggaaatgacacccatacagtaacggcaattaaagaaactattgataaatcaaattttggacaattaaaaattggagataaagttaatttggaaagagcaatgaaactaggctccagattagatggccacattgttcagggacatgttgatcaaatagctagatgtatcgacgtgaaagaaactgaaggaagctggttctacacttttgaatatgatgaaaaatacaacaatatcaccattgaaaaaggttctgtcacaataaacggagttagcttaacggttgtagattcaaaaaagaatagctttggtgtggcaattattccttatacttatgaacataccaatttccacagctttaaaataaatgatactgtgaacttagaatttgatgtaattggaaaatatgttgccagacttcagcaactttaa

SEQ ID NO: 18422 - protein, 150 aa, Unknown
  Obtained from environmental sample
  DOMAIN (54)...(138): Lumazine binding domain
  misc_feature (1)..(150): Xaa is any amino acid
MCLTVVALGNDTHTVTAIKETIDKSNFGQLKIGDKVNLERAMKLGSRLDGHIVQGHVDQIARCIDVKETEGSWFYTFEYDEKYNNITIEKGSVTINGVSLTVVDSKKNSFGVAIIPYTYEHTNFHSFKINDTVNLEFDVIGKYVARLQQL

SEQ ID NO: 18423 - DNA, 363 bp, Unknown
  Obtained from environmental sample
  misc_feature (1)..(363): n is a, c, g, or t
ttgactttcccaaaagccatccaaaaccaggtttacgatccctgttcacttcgaataagcaattttgaagtcgagccggaaagcaaggaataccaggcttgccgatttgagctgaatggatcgagaatcatttgccgaaaagcccgcattacccccaaaaagaccggacagtttgtgacattttggaaacgggaaggggccgggccgattcaaccttttacccatgacgaccaatttgattttttcgtggtaaacgtgtcaaccgaaagcgatttgggacaattcatcttccccaaatccattctgatggcaaaaggaatcatttccaccgacanaaaaggaggcactcgagccgattcttga

SEQ ID NO: 18424 - protein, 120 aa, Unknown
  Obtained from environmental sample
  misc_feature (1)..(120): Xaa is any amino acid
MTFPKAIQNQVYDPCSLRISNFEVEPESKEYQACRFELNGSRIICRKARITPKKTGQFVTFWKREGAGPIQPFTHDDQFDFFVVNVSTESDLGQFIFPKSILMAKGIISTDXKGGTRADS

SEQ ID NO: 18425 - DNA, 492 bp, Unknown
  Obtained from environmental sample
  misc_feature (1)..(492): n is a, c, g, or t
ttgggccagatgtccctcgcgcaatcaaccagcccaatgaaacggccgttcaaagacatccagggcaaatggttcatcaaccggtccaatttccccatgtgcctgaagggaaacaaaacgcatccagaattcaactacagcattcaggatcggaagggcaaaaccgtgctgctggacgaagtgtattttgagaaaaggggcaaacgaaagagcattacgggatttgacacctcattgaatgagaaaaactcaaaatttgtctggcggggaaatgggattttgggaattctgaaaagcaaatgggagattgtgcattttgatctgcaggaagaatggatggtcatctacttcgaaaanacactcttcactcctgagggatacgatgtggtctcgcggaagaaaaacctgtccccggaaatccgaaagcatatcgaaaaaatcctgaaaagcttaaatccaaagccggaactcaccgaaatctcccagaattga

SEQ ID NO: 18426 - protein, 163 aa, Unknown
  Obtained from environmental sample
  misc_feature (1)..(163): Xaa is any amino acid
MGQMSLAQSTSPMKRPFKDIQGKWFINRSNFPMCLKGNKTHPEFNYSIQDRKGKTVLLDEVYFEKRGKRKSITGFDTSLNEKNSKFVWRGNGILGILKSKWEIVHFDLQEEWMVIYFEXTLFTPEGYDVVSRKKNLSPEIRKHIEKILKSLNPKPELTEISQN

SEQ ID NO: 18427 - DNA, 849 bp, Unknown
  Obtained from environmental sample
  misc_feature (1)..(849): n is a, c, g, or t
atgaatccatctgtgaaattttggttcaacaatatgaaatcacaaaaattaataaatcctagcgaacgttcgttaattgttctttttcgcaaaacgaatagatttgcaaaaaagcttatatttgattttatgcaagaagattacattaaaattatttttggcttgaagctaaagcagataaggactgagaagaatttatcattattcggattgtctaaattatcaggtttgtcaaagtcgtatttgaatgaaattgaaaatgggaaaaaatatcccaaaccggataaaatttctattctttccgaaaaattagatgttccttatgaccaaatggtctcattgaaactagataaaaatttagcccccattggcgatttgctgcaatcaaaaatattgaaagagattcctctggatctatttggaattaaagaaagcaccctgattgatatagtggccaatgcacctgcaaaagtgaatgccttcataagtacgatcatcgaaattgctcaaaactatagttttagtcgagaaagctttttcttggcatccgtaaggtcatttcaacaagccaacaacaactattttgacgatttagaacagcaagtattaaaatttgtggaggcttatcaaatcgatttgaatcaacccatttcttccactgaattggaggaaattttagtagaagagtacggctataatatacaagccaatgagttagataagtatgaagcactgggaaacctgcgaacagttgttattccaaaaaccaagacgcttttattggctaatgagatagatgaagctcaacgcacttttatctatgcgaaagaaattgcctatattttctga

SEQ ID NO: 18428 - protein, 282 aa, Unknown
  Obtained from environmental sample
  DOMAIN (57)...(111): Helix-turn-helix
  misc_feature (1)..(282): Xaa is any amino acid
MNPSVKFWFNNMKSQKLINPSERSLIVLFRKTNRFAKKLIFDFMQEDYIKIIFGLKLKQIRTEKNLSLFGLSKLSGLSKSYLNEIENGKKYPKPDKISILSEKLDVPYDQMVSLKLDKNLAPIGDLLQSKILKEIPLDLFGIKESTLIDIVANAPAKVNAFISTIIEIAQNYSFSRESFFLASVRSFQQANNNYFDDLEQQVLKFVEAYQIDLNQPISSTELEEILVEEYGYNIQANELDKYEALGNLRTVVIPKTKTLLLANEIDEAQRTFIYAKEIAYIF

SEQ ID NO: 18429 - DNA, 426 bp, Unknown
  Obtained from environmental sample
  misc_feature (1)..(426): n is a, c, g, or t
ttgattatcgactctggatcaagttatttgatgctacaaaataaattatatgattacatcatagattcactcaacaaaatcaatccaaagtttgtagagtttatagataaatttaatcaggcacaaaaagcaggcaagccgttcatttcaaccgagttaaatttatcagagtggcctgatttattttttacttttgaaggagttaatgatgaaccagttacattgtgttgcaaaccagatcattattggcagataaatgcgggcatgccaaatcgtgtattttttaccatcttacaacaaatcagtggttggccggatcaaacagtttttggtttaccactgattagtagttacttatgcatatttgatcgttctactggaccagatggaatcataaaattctctaaaaaagtaaaacaatcatga

SEQ ID NO: 18430 - protein, 141 aa, Unknown
  Obtained from environmental sample
  misc_feature (1)..(141): Xaa is any amino acid
MIIDSGSSYLMLQNKLYDYIIDSLNKINPKFVEFIDKFNQAQKAGKPFISTELNLSEWPDLFFTFEGVNDEPVTLCCKPDHYWQINAGMPNRVFFTILQQISGWPDQTVFGLPLISSYLCIFDRSTGPDGIIKFSKKVKQS

SEQ ID NO: 18431 - DNA, 486 bp, Unknown
  Obtained from environmental sample
  misc_feature (1)..(486): n is a, c, g, or t
atggcttaccaaacggtaaaacacgatagctttgcaaagactcatgaaataacgtttctcaatcaaaaaaataaattattatcactggaaaataaattagctttagaatcaaaaaccaatcaaaggttaatcaatgctttgttggccactttattattattctttttgtttttaatttatagaattagaaaacagcaaaaacaatataaaaaattatccgaattggatcacatgacattaatctataatcgcaaaggcgcccgagattatatggattatttattgccttattcagaaaacaaaaatgaggtcatttcttatggcatttttgatttagataaatttacaaaaattaacgataaatacggtcatgtaattggtgattgggtgattaaaaaggtggtttcagtctgcaagaatttgaataatgaacaagtgacttttgctcgactaggtggagaagaattttcaatgactattcgcnnn

SEQ ID NO: 18432 - protein, 162 aa, Unknown
  Obtained from environmental sample
  misc_feature (1)..(162): Xaa is any amino acid
MAYQTVKHDSFAKTHEITFLNQKNKLLSLENKLALESKTNQRLINALLATLLLFFLFLIYRIRKQQKQYKKLSELDHMTLIYNRKGARDYMDYLLPYSENKNEVISYGIFDLDKFTKINDKYGHVIGDWVIKKVVSVCKNLNNEQVTFARLGGEEFSMTIRX

SEQ ID NO: 18433 - DNA, 336 bp, Unknown
  Obtained from environmental sample
  misc_feature (1)..(336): n is a, c, g, or t
ttggccgagctcataagtcgttacanncagggtttatatgaatatgatttatggattagatcaaaagaaaatggaatagtctttcttaaagcatttgaaataactcaagaaatagaactttcagtaccaagactaaaagaaaggtcaagtatgagaattagcaatacaaatgacagtataaagaaattcagtactgaagatgattttacaatttacgaaggagattggggaaaaccatatggagcacgatttgagatttggtttaaaccagacaatggagaaaaagaaaagaaattattggaaaaaaattatataatcgaaggatggatgagataa

SEQ ID NO: 18434 - protein, 111 aa, Unknown
  Obtained from environmental sample
  misc_feature (1)..(111): Xaa is any amino acid
MAELISRYXQGLYEYDLWIRSKENGIVFLKAFEITQEIELSVPRLKERSSMRISNTNDSIKKFSTEDDFTIYEGDWGKPYGARFEIWFKPDNGEKEKKLLEKNYIIEGWMR

SEQ ID NO: 18435 - DNA, 309 bp, Unknown
  Obtained from environmental sample
  misc_feature (1)..(309): n is a, c, g, or t
atgaaaataggatttatactaatattatcaatagccatctgcacttcttgcaaggtgaaacaaaagactattgaaaagaatgaatccgaaacgattgacataagaaagcaatcccaagaacattatgatagttactatactctatatcaaattgcgaataacaaattcataggacaagattcattagtaacaactcattatttgaacggtgaaatccaaagtataggaaaatttgacagaactagagaatggaaatgtaacggccttaaaattgaagtattaaaaataattacgaacatggaaatctaa

SEQ ID NO: 18436 - protein, 102 aa, Unknown
  Obtained from environmental sample
  SIGNAL (1)...(19)
  misc_feature (1)..(102): Xaa is any amino acid
MKIGFILILSIAICTSCKVKQKTIEKNESETIDIRKQSQEHYDSYYTLYQIANNKFIGQDSLVTTHYLNGEIQSIGKFDRTREWKCNGLKIEVLKIITNMEI

SEQ ID NO: 18437 - DNA, 360 bp, Unknown
  Obtained from environmental sample
  misc_feature (1)..(360): n is a, c, g, or t
atgacattggacgatatactcaatgttgtgctggaggtttatgtagtcaatttttacaactacaaattaggcgagtggaaatattatttcgaaaacggaaaccaaaaagcaaatgttctctatgaagtaaaaaaattccaaatagaaacaagttgtaaagacggagaccaagttacctttggtcaaattatcaaggaagaatcgaaattttggaatgaaataggtcaaattattaaaccttcaactaaattggtttacgaattggaaactgtggtttttaatcaggaggattatcatagtgaatctttatcaatccaaaaaggaaaagtgaaactggaattaatagcagataaaaaatga

SEQ ID NO: 18438 - protein, 119 aa, Unknown
  Obtained from environmental sample
  misc_feature (1)..(119): Xaa is any amino acid
MTLDDILNVVLEVYVVNFYNYKLGEWKYYFENGNQKANVLYEVKKFQIETSCKDGDQVTFGQIIKEESKFWNEIGQIIKPSTKLVYELETVVFNQEDYHSESLSIQKGKVKLELIADKK

SEQ ID NO: 18439 - DNA, 681 bp, Unknown
  Obtained from environmental sample
  misc_feature (1)..(681): n is a, c, g, or t
atgtcaaatggggcttttggtttatactcattaattaatagaccaaaactatttaatgcctatatcatttctagcccaacgttagctaatgattttggagcagtaatatctgattcgaaagctaaattaaataagttagataataaactaagattcctctacttatctacaggaaatcatcaatatgaacaaggtaacttatcttcttttaataaacttgaaaaaatattaaaaaactcttcaacaaagaaccttgattggcaaattcatcgtaataataaaaacaactatatgtctcaaccaattgtttctaccataaatggtatagaagcattgtttaatgacatacatactaatcttaaggctgattctgatatctcaaaacgtggagctcaagcaattatcaattattatgatccaatttctcagaagaagtatgggtttaaagtttctgcagaagcttcttttaaaagcactagccaaatcttcgatgaaaagcagcccaaaaaaggattaagcattattcaaaacacattagattatatcctgaatctggttatgcttttcattctcttgccaaagcttatgcagatctgggggaatttaacaaagttggcaaatatcaaattcaagcagttaaaaattctaatcaatgattatgtggtctcggaatatctnnan

SEQ ID NO: 18440 - protein, 227 aa, Unknown
  Obtained from environmental sample
  misc_feature (1)..(227): Xaa is any amino acid
MSNGAFGLYSLINRPKLFNAYIISSPTLANDFGAVISDSKAKLNKLDNKLRFLYLSTGNHQYEQGNLSSFNKLEKILKNSSTKNLDWQIHRNNKNNYMSQPIVSTINGIEALFNDIHTNLKADSDISKRGAQAIINYYDPISQKKYGFKVSAEASFKSTSQIFDEKQPKKGLSIIQNTLDYILNLVMLFILLPKLMQIWGNLTKLANIKFKQLKILINDYVVSEYLX

SEQ ID NO: 18441 - DNA, 483 bp, Unknown
  Obtained from environmental sample
  misc_feature (1)..(483): n is a, c, g, or t
atgctgaatgtgcagcggtttcctatcccggattttggaaggatttggagaaggtttcaaattatgagtgatcctaaagcagatgaagttcacatttatttgatgttttatgatttcgaaattcatcctgatgagatttctaaaatattgaatttaaatcctactaaaactggattaaaaggcgaaaaatatattttgagttatgatcggaaaagaagttataaatctaattggtgggaatttagaaaggattatgaaatgggagaaaagtgggtgcaagaatctatcgatgaatttattttagaaattattgagccgaggaagaaagagattagtgaggtaatgagtaaaggagatggggaattttcagtagtaccttatttttattctaaagctaatcctggattcttctttgagaagagtactatagaagttctttcagaagcaaatctggcaattaatttagatatttactgtctttaa

SEQ ID NO: 18442 - protein, 160 aa, Unknown
  Obtained from environmental sample
  misc_feature (1)..(160): Xaa is any amino acid
MLNVQRFPIPDFGRIWRRFQIMSDPKADEVHIYLMFYDFEIHPDEISKILNLNPTKTGLKGEKYILSYDRKRSYKSNWWEFRKDYEMGEKWVQESIDEFILEIIEPRKKEISEVMSKGDGEFSVVPYFYSKANPGFFFEKSTIEVLSEANLAINLDIYCL

SEQ ID NO: 18443 - DNA, 345 bp, Unknown
  Obtained from environmental sample
  misc_feature (1)..(345): n is a, c, g, or t
atgaacgagattaaaatcgccattataggcctaggctatgtaggattaccgttagcacaccttttcgcaacaaaatatcctgtaataggatttgacattaataagttaaggatacaagagttacgcaatggaatggatcataccttggagatttcctataatgcactaaaaaaggtaacaaaggaaataccagatgtaaaaataggacttttttgtacagaccaattagaacatataaaacaatgtaattactatatcgtcactgtgcctacccctgtggacacagcaaacaaaccagatttaacggcattttacagatctagtgaaacaattggcaaattataa

SEQ ID NO: 18444 - protein, 114 aa, Unknown
  Obtained from environmental sample
  DOMAIN (4)...(114): UDP-glucose/GDP-mannose dehydrogenase family, NAD binding domain
  misc_feature (1)..(114): Xaa is any amino acid
MNEIKIAIIGLGYVGLPLAHLFATKYPVIGFDINKLRIQELRNGMDHTLEISYNALKKVTKEIPDVKIGLFCTDQLEHIKQCNYYIVTVPTPVDTANKPDLTAFYRSSETIGKL

SEQ ID NO: 18445 - DNA, 813 bp, Unknown
  Obtained from environmental sample
  misc_feature (1)..(813): n is a, c, g, or t
atgaaactccttatcgttaaacctgtaaataatcaagatgtcaatcgattccgattgaaaatacgattcgtaatctcagactttgaacctattaccgcttggtcagcgcaatcagcaaaagttccttgcgttggacttagtcatcaggtagcttttttatcagataaaactcctcgtcctaaaaagaggtcgttggtagctgagggtgttattagacattttgctccatgcaatgaagcgatagggacacattatgttagatatgatgattttattcagcctcctattcttaggcctcttataaaagaattgaatccaaaaattggagggcatgttacggtctatctacctgcctttgatcacgaaacattggtgactttttttagtcagatacccgaagttagatgggagattttctctccaacttgtgatgtagcttatgaaaagtataatgtaaaggtgaatccagtaggtaatgaaacgtttttaaaaagttttgaagatgctttaggattactatgctcagcaggatttgaagggccttcagaagcgatgtatttgggaaaaaagttattggtgatacccatcaagaatcaatatgaacagatttgtaatgctgtagcattagaagagttgggtgcaaaagctatctatgatatcaagcctgattttgtgaatcaattacgagcatggattagagatggggctattgttcatcttgatgaaatatgtgatgaaaaaaagctcataccaaagattatatcggctggcactaaggagttaaaactttacaacaatctaaagtatctgtag

SEQ ID NO: 18446 - protein, 270 aa, Unknown
  Obtained from environmental sample
  misc_feature (1)..(270): Xaa is any amino acid
MKLLIVKPVNNQDVNRFRLKIRFVISDFEPITAWSAQSAKVPCVGLSHQVAFLSDKTPRPKKRSLVAEGVIRHFAPCNEAIGTHYVRYDDFIQPPILRPLIKELNPKIGGHVTVYLPAFDHETLVTFFSQIPEVRWEIFSPTCDVAYEKYNVKVNPVGNETFLKSFEDALGLLCSAGFEGPSEAMYLGKKLLVIPIKNQYEQICNAVALEELGAKAIYDIKPDFVNQLRAWIRDGAIVHLDEICDEKKLIPKIISAGTKELKLYNNLKYL

SEQ ID NO: 18447 - DNA, 510 bp, Unknown
  Obtained from environmental sample
  misc_feature (1)..(510): n is a, c, g, or t
atgaagagaacattagacacggttgtaatatcggatgtacatttaggcactattggttgtcatgcaattgaactcactcagtatctaaattctataaatccaaagcgtgttatcctgaacggtgattttgtagatatgtggaatttccggaaatattattggccggaagcccatatgcatgtcatccgtaccctcataactatgatgaccaacggggtagatatctattatctaacaggaaatcatgacgaaactctaaggaaagtttcaagtttacaactaggtccactttttattcgagacaaactagtactagaattaaatggagaaaaagtgtggttcttccatggagatatttttgacgtaactatgaaatactcaaaatggattgcaaaacttggtgggcatggatacgaacttatgatattattgaaccggtggatcaataatatttcaattaagcttgggcatggtaagctttctctttcaaaaaaatttacgatagtgtaa

SEQ ID NO: 18448 - protein, 169 aa, Unknown
  Obtained from environmental sample
  misc_feature (1)..(169): Xaa is any amino acid
MKRTLDTVVISDVHLGTIGCHAIELTQYLNSINPKRVILNGDFVDMWNFRKYYWPEAHMHVIRTLITMMTNGVDIYYLTGNHDETLRKVSSLQLGPLFIRDKLVLELNGEKVWFFHGDIFDVTMKYSKWIAKLGGHGYELMILLNRWINNISIKLGHGKLSLSKKFTIV

SEQ ID NO: 18449 - DNA, 741 bp, Unknown
  Obtained from environmental sample
  misc_feature (1)..(741): n is a, c, g, or t
gtggctgtgaacgaatcttccctatataaggtgagcaaattggtttccgcctttaccggatttggaattcctgcttacaagcctatcgtaggggataatgtttttactcaaactgcaggaatccatgcagatggggacagtaagaaaaacttgtacttcaatgatttaatgccggagagatttggtagaaaacgtaagtacgccttaggtaaaacttcgggaaaggccaacattcaaaagaacttacaggagttgggattaacgctcaatgatgatgagttaaaaaaggttacggcacgtattattgaattgggagataaaaaggaaaaggtaaccaaggaggacctcccctatattatttccgatgttttggatagcgatacctatcagcaaaaggtttttgttaaatcatatgtactcacccattcgaaaggtttaaagccctccactaccctagccctcgaaattaatggtgaacttatagaggagcacgctcagggcgacggacaatacgatgcctttatgaatgcattgagaaaagtatacaaatccaaaaaattggaattgcccactttggtggattacgcggtgcgaattccaccaggcagtaattccgatgcactctgtgaaaccattattacctggaaaaggggcgataaggaatttatttccagggggctggactcagatcaaactgtttcagccataaaggccaccgagaaaatgttgaatataatctag

SEQ ID NO: 18450 - protein, 246 aa, Unknown
  Obtained from environmental sample
  misc_feature (1)..(246): Xaa is any amino acid
MAVNESSLYKVSKLVSAFTGFGIPAYKPIVGDNVFTQTAGIHADGDSKKNLYFNDLMPERFGRKRKYALGKTSGKANIQKNLQELGLTLNDDELKKVTARIIELGDKKEKVTKEDLPYIISDVLDSDTYQQKVFVKSYVLTHSKGLKPSTTLALEINGELIEEHAQGDGQYDAFMNALRKVYKSKKLELPTLVDYAVRIPPGSNSDALCETIITWKRGDKEFISRGLDSDQTVSAIKATEKMLNII

SEQ ID NO: 18451 - DNA, 870 bp, Unknown
  Obtained from environmental sample
  misc_feature (1)..(870): n is a, c, g, or t
ttggacacccgaaagagtttaaagaaggcgacagcgccacataccatatgccaccacaggtttttccctgacctgatattagattatatttcccaaagccctgaaaccaaagagttttatggcaactaccccgataaagcaggtttcgcgaagcagatagaagaacgcagcaaaatgcccatcaataggcaactgttggcggatgttatcactgagcaattagagaacctgaaaaccagcgaaaagacccgccagaacattgaacttcttaggcaggataatactttcacggttactactggtcaccaactgaatgtgtttacagggcctttgtatttcgtgcacaagataatttccaccatcaatttggcggagcaactgaagaaggatttccctgacaagaattttgtgcctatctattggatgcacaccgaagaccatgattttgaggagataaatcacatacacctgtttggcaaaaagatagagtgggagggcgattataaaattcccgctggttatttggatagcacagaactggcaggcgtgatagcccaactaggcgaaataatgggagactcagagaatgctcgagagttgaaaagccttttccataaggcatacttggagcataccaaccttgccgatgccactcaatttttggccaatgagctttttgctgagtacggtctcgttatcttggagcccaacgataacaggctaaagcaattgttttcaccacagttgaaggaggagatttttaggcaaagtaattcgccgattgtagcgcaaacgaatgaaaagttggatgccaagggctacaaagtgcaggtgaacccaagggagactcgaccgattcttgatcactag

SEQ ID NO: 18452 - protein, 289 aa, Unknown
  Obtained from environmental sample
  misc_feature (1)..(289): Xaa is any amino acid
MDTRKSLKKATAPHTICHHRFFPDLILDYISQSPETKEFYGNYPDKAGFAKQIEERSKMPINRQLLADVITEQLENLKTSEKTRQNIELLRQDNTFTVTTGHQLNVFTGPLYFVHKIISTINLAEQLKKDFPDKNFVPIYWMHTEDHDFEEINHIHLFGKKIEWEGDYKIPAGYLDSTELAGVIAQLGEIMGDSENARELKSLFHKAYLEHTNLADATQFLANELFAEYGLVILEPNDNRLKQLFSPQLKEEIFRQSNSPIVAQTNEKLDAKGYKVQVNPRETRPILDH

SEQ ID NO: 18453 - DNA, 582 bp, Unknown
  Obtained from environmental sample
  misc_feature (1)..(582): n is a, c, g, or t
ttgatagagaattacctccaaagcactaaacagcagtttgaatattacaaattgctaggagagctcagcttcaaacagcttgatgaagatcagttgttctggaaattcaatgaagaaagtaattcgatagccattatcgttaaccacctttggggaaatatgatgtcgagatggtccgatttccttacttctgatggtgaaaaggaatttcgaaatcgtgacctcgaatttgaagctgtaatttcatccagagaagagttattacaaaaatggaacgagggctgggcttgcctttttgaagcattaaattcagtagataaaaataactgggaaacggaagtctacatccgtaaccaaggccataccgtagttgaagctattaatcgacaacttgctcactattcttatcatattgggcagattgtgtatatcgcccgttatgcgaaaaaggggaaacatgggaaagcttatctatccctaaagggaattctgcaaactacaacaaagagaagttttcgaaggaaaaacatcgcgagcattttaccgatgatattctcgggaaaagacactacccaacgttga

SEQ ID NO: 18454 - protein, 193 aa, Unknown
  Obtained from environmental sample
  DOMAIN (41)...(79): Protein of unknown function (DUF1572)
  misc_feature (1)..(193): Xaa is any amino acid
MIENYLQSTKQQFEYYKLLGELSFKQLDEDQLFWKFNEESNSIAIIVNHLWGNMMSRWSDFLTSDGEKEFRNRDLEFEAVISSREELLQKWNEGWACLFEALNSVDKNNWETEVYIRNQGHTVVEAINRQLAHYSYHIGQIVYIARYAKKGKHGKAYLSLKGILQTTTKRSFRRKNIASILPMIFSGKDTTQR

SEQ ID NO: 18455 - DNA, 570 bp, Unknown
  Obtained from environmental sample
  misc_feature (1)..(570): n is a, c, g, or t
atgaaaggacccttattttacgctaaaattttactttttggagaatacggaattataaaagactcaaaaggtcttgcaattccctacaacacgtatagaggtgcattaaaatcttcaaaaaatctttctgaggaagcaataaaatccaatggtaatttacatcgattttacaactacttattagcattaaaggatgagaatttatcttttagattggctgactttaaagcagatttagagaacggattgtattttgattcttcaattccacaaggatatggagttggaagttctggtgctttagttgcttctatttacgataaatatgcaaataacaaaataaccgttttagagaatcttaccagagataaattgttaacgctaaaagaaatatttagtgtcatggaatctttttttcatggaaaaagtnctgggttaaatccgttacatagttatctgagtttgccaattttaatcaattctaaaaccaatattgagccactggaattccgtctcaaangaaggaaaaggcgcagggtttcattagattcagaattgttggaaaactga

SEQ ID NO: 18456 - protein, 189 aa, Unknown
  Obtained from environmental sample
  misc_feature (1)..(189): Xaa is any amino acid
MKGPLFYAKILLFGEYGIIKDSKGLAIPYNTYRGALKSSKNLSEEAIKSNGNLHRFYNYLLALKDENLSFRLADFKADLENGLYFDSSIPQGYGVGSSGALVASIYDKYANNKITVLENLTRDKLLTLKEIFSVMESFFHGKSXGLNPLHSYLSLPILINSKTNIEPLEFRLKXRKRRRVSLDSELLEN

SEQ ID NO: 18457 - DNA, 741 bp, Unknown
  Obtained from environmental sample
  misc_feature (1)..(741): n is a, c, g, or t
ttgatgcccattaaaaatcttgataataaaaacgacatgcacgctccaatagattctcttactacggatgaaaagattatgctacgctgcattcaaatcgcgaaaaacggacttggaacaacagctcccaacccaatggtgggcgctgtaatagttaatgaaaaccgtattattggagaaggatttaccagtgccttcggaggttctcatgctgaagtaaatgcaattaggtccgttcaagataagtcccttttaaaatcttctaccttatatgtaaccctagagccttgctcccattacggaaaaactccgccttgtgccgatttaatcataaaaatgggtcttaaaaaagtagttataggattaatagatccccatgaaaaagttgctggtaacggaataaaaaaattagaggcatctggatgcatcgtccaagttggaattctacaaaaagaatgtgccgaacaccataaacgctttcttaccttttacaccaaaaagcgaccttatattattttaaaatgggccgaaacggccgatggatttatcgctcctgagcctagccaaagagaaatagataaaaaaccattttggattacaaataccacttctaggcaattggttcataaatggcggagtgaagagcctggtatcctcgtcggaaacaatactgttttagccgataatccaaaattgaatctaagagattggaaagggcatgcaccaacacgaatagtttaa

SEQ ID NO: 18458 - protein, 246 aa, Unknown
  Obtained from environmental sample
  DOMAIN (21)...(122): Cytidine and deoxycytidylate deaminase zinc-binding region
  misc_feature (1)..(246): Xaa is any amino acid
MMPIKNLDNKNDMHAPIDSLTTDEKIMLRCIQIAKNGLGTTAPNPMVGAVIVNENRIIGEGFTSAFGGSHAEVNAIRSVQDKSLLKSSTLYVTLEPCSHYGKTPPCADLIIKMGLKKVVIGLIDPHEKVAGNGIKKLEASGCIVQVGILQKECAEHHKRFLTFYTKKRPYIILKWAETADGFIAPEPSQREIDKKPFWITNTTSRQLVHKWRSEEPGILVGNNTVLADNPKLNLRDWKGHAPTRIV

SEQ ID NO: 18459 - DNA, 552 bp, Unknown
  Obtained from environmental sample
  misc_feature (1)..(552): n is a, c, g, or t
atgcaaaaaagatgtttttgggtaaataatgacccgttatatattgaatatcatgataatgaatggggaaagcccgtgtacgatgacgcaacgttgtttgagtttttgttattggaaacttttcaagcgggtttaagttggataacaattttgaaaaaacgagaaaactttagagctgcttttgatcattttgattatcaaaaaattgcaaattacaagcaggataaatttgatgagttgatcgtaaatccaggaattattagaaataaactaaaagtaaaatctgccattacaaacgcacagttatttatggatattcagaaagaatttggttcgttttctaaatttatctggagttatgttgatggaaagccaattaaaaattcttttaaaacaagagaagaagtaccagctacaacagaactctcagatacaatttctaaagagttgaaaaaacgcggatttcaatttgttggttcaacaattatttatgcttttatgccggcaacccggaatgctcatgatcattcattagactgtcttcgtatttaa

SEQ ID NO: 18460 - protein, 183 aa, Unknown
  Obtained from environmental sample
  DOMAIN (7)...(182): Methyladenine glycosylase
  misc_feature (1)..(183): Xaa is any amino acid
MQKRCFWVNNDPLYIEYHDNEWGKPVYDDATLFEFLLLETFQAGLSWITILKKRENFRAAFDHFDYQKIANYKQDKFDELIVNPGIIRNKLKVKSAITNAQLFMDIQKEFGSFSKFIWSYVDGKPIKNSFKTREEVPATTELSDTISKELKKRGFQFVGSTIIYAFMPATRNAHDHSLDCLRI

SEQ ID NO: 18461 - DNA, 381 bp, Unknown
  Obtained from environmental sample
  misc_feature (1)..(381): n is a, c, g, or t
ttggacccactcgatgcttttcgttcatcctttatgtaccactatgaggatgataaggtcttgcaaaattggctccaccagattcaaagttccaccgaagatgagaagttcctcgaattcaattcagagatctatagcagcaatcccaatgttttgcaaaagacaaattgggccaggctttggatcaacaaagagcatcactttcctaagactggaggcttcatgcgaaaccttctaggatcaaatccttttgctcagttcatatctgcgtttcggggaaatgaaaaacttgcaccggaacaagggttcaataaaaaaatagaatccttgatcaaccacatttataaaacgattgactctcttcatagcattcagaagtaa

SEQ ID NO: 18462 - protein, 126 aa, Unknown
  Obtained from environmental sample
  misc_feature (1)..(126): Xaa is any amino acid
MDPLDAFRSSFMYHYEDDKVLQNWLHQIQSSTEDEKFLEFNSEIYSSNPNVLQKTNWARLWINKEHHFPKTGGFMRNLLGSNPFAQFISAFRGNEKLAPEQGFNKKIESLINHIYKTIDSLHSIQK

SEQ ID NO: 18463 - DNA, 381 bp, Unknown
  Obtained from environmental sample
  misc_feature (1)..(381): n is a, c, g, or t
atgggtacaaatcctgagttaaatactgataatgcatccataactttaaagtatgaaaatggctcattaggggttgttaattatttcgcaaatggaaataaaggatatgcaaaagaaaggattgagcttttttatcaagaaaagaatttgatcatcgataattttagaagattagatggttacggatttggctcgggattttcaagcaaattattaaaaacgaagcaagataaagggcacctgaaacagtttgaactattaaaagaaagttgggaaaaaggtggagaagtacttatcccatttgatgaaatagtaaatactactaaagctagttttgcagcattagagagtttaaaaaagaacgaattcataaaaatataa

SEQ ID NO: 18464 - protein, 126 aa, Unknown
  Obtained from environmental sample
  misc_feature (1)..(126): Xaa is any amino acid
MGTNPELNTDNASITLKYENGSLGVVNYFANGNKGYAKERIELFYQEKNLIIDNFRRLDGYGFGSGFSSKLLKTKQDKGHLKQFELLKESWEKGGEVLIPFDEIVNTTKASFAALESLKKNEFIKI

SEQ ID NO: 18465 - DNA, 585 bp, Unknown
  Obtained from environmental sample
  misc_feature (1)..(585): n is a, c, g, or t
gtgtcgaggtcgaggattaatatgcgctggttatttttattggtactgatattgaatggtgtttatctgttaacgcagcttggcaattcagaaatggatttatatgaagacataccgcgtctgcgtaatgttgagccaattgttttaacgcgagagatagatagtgctgaaaaagaagcgcagaaagcggtgcagaaagaagagcttgaagatttatcatctgacgtgacgcagttagaagaggtgtcagaaacgccgatggcagaagctgctcaatgctttactttggggccttttggccaaaaagatagtttgcaggagctaaagaatgaaatagcgccatatgtggtgaatgcggtcattcgagataaaaaagagcaagactatacggtgtattgggtttatattcagccagaaaaaaatcgtaaagacatttttaaagttgctaaacggttaaaaacaaaaaaaattaaggatttttatataattagagagggtgagaaaaataatggcatttcactcggtcattttaaagataagcagcgctcattaggcttgcaggctaaggtgaaaacatggctttga

SEQ ID NO: 18466 - protein, 194 aa, Unknown
  Obtained from environmental sample
  misc_feature (1)..(194): Xaa is any amino acid
MSRSRINMRWLFLLVLILNGVYLLTQLGNSEMDLYEDIPRLRNVEPIVLTREIDSAEKEAQKAVQKEELEDLSSDVTQLEEVSETPMAEAAQCFTLGPFGQKDSLQELKNEIAPYVVNAVIRDKKEQDYTVYWVYIQPEKNRKDIFKVAKRLKTKKIKDFYIIREGEKNNGISLGHFKDKQRSLGLQAKVKTWL

SEQ ID NO: 18467 - DNA, 351 bp, Unknown
  Obtained from environmental sample
  misc_feature (1)..(351): n is a, c, g, or t
atgcgactttggggtgattactgggaaaatgttgcgtgcaggtatttaaagaataacaaattaaaattaataaaaaataactttaattgtaaagcaggggaaattgatattattatgtcagatcaaaataccctggtttttatagaagtcaagtaccgaaaaaatgatgactgggtttcagcactagaatcggtaaccaaaaagaaacaaacaagaattattaaagcagcccaaatgtttttattaaagaataaaaaatttgatgactggaactgtcgctttgatgtagtgtctattgaaggtgacaaacaaaatccaaaaattgactggattaaaaatgcattttactaa

SEQ ID NO: 18468 - protein, 116 aa, Unknown
  Obtained from environmental sample
  DOMAIN (7)...(100): Uncharacterised protein family UPF0102
  misc_feature (1)..(116): Xaa is any amino acid
MRLWGDYWENVACRYLKNNKLKLIKNNFNCKAGEIDIIMSDQNTLVFIEVKYRKNDDWVSALESVTKKKQTRIIKAAQMFLLKNKKFDDWNCRFDVVSIEGDKQNPKIDWIKNAFY

SEQ ID NO: 18469 - DNA, 354 bp, Unknown
  Obtained from environmental sample
  misc_feature (1)..(354): n is a, c, g, or t
atgggctatgatattgtgagcggcggtactgacaatcatttgattttgatagatctcagaaacaaaggtgtaaatggcaaaatcgctgaagaagctttgggcaaagcagcgattactgttaataaaaacatggttccttttgatacagaaagtcctttcgtgacatctggaatacggataggttcaccggctatgacaacaagaggttttggtgacgaagagtttagagaagtagctaaattgattgacaaggttatacaaaatccaacagatgaaactattcataaaggagtaacaaacgaagtgaaagagctttgcgagaagtttcctttgtatgactttataactgcttag

SEQ ID NO: 18470 - protein, 117 aa, Unknown
  Obtained from environmental sample
  misc_feature (1)..(117): Xaa is any amino acid
MGYDIVSGGTDNHLILIDLRNKGVNGKIAEEALGKAAITVNKNMVPFDTESPFVTSGIRIGSPAMTTRGFGDEEFREVAKLIDKVIQNPTDETIHKGVTNEVKELCEKFPLYDFITA

SEQ ID NO: 18471 - DNA, 732 bp, Unknown
  Obtained from environmental sample
  misc_feature (1)..(732): n is a, c, g, or t
gtgcttaaaggcaccgatataaaaatcgaagcaagagctcacaaaatgtctaaaagtcgaggtaatgttattaatcccgacgctgttattggtgagtatggcgcagattctttacgtctatacgaaatgtttatgggacctctagagcaagtaaaaccttggagtacgaaaggagttgaaggcgttaacaggtttttaaatagagtgtggaggttactcataaatgaggagactaatactcttaaagaaacagttgatgattccgaagcaactaaagaccagctaaaagctttgcatatcgccattaaaaaagtatcggaagacattgaagaaatgaggttcaatacaggcatttcagcactgatgatttttgtaaacgaggcttattcttggaaaaatgttccaaaaataattgcatctaaatttatacaattactttctccatacgcaccgcatattgctcaagaaatatggcaaaaacttagtcaatctgaagaactagcttactcaaattggccagagtttaatgaggagtttctaaaagaagactcagtaacatatccggtgcaaataaacggaaaagtacgagctaatatcgaaataccttctgataaagcaggagataaaaattacgtattagaacttgcaaagaatgatgcaagaattgttgagtatcttaccaattccactttaattaaggaaatatttgttcctggaaggattgtaaattaa

SEQ ID NO: 18472 - protein, 243 aa, Unknown
  Obtained from environmental sample
  misc_feature (1)..(243): Xaa is any amino acid
MLKGTDIKIEARAHKMSKSRGNVINPDAVIGEYGADSLRLYEMFMGPLEQVKPWSTKGVEGVNRFLNRVWRLLINEETNTLKETVDDSEATKDQLKALHIAIKKVSEDIEEMRFNTGISALMIFVNEAYSWKNVPKIIASKFIQLLSPYAPHIAQEIWQKLSQSEELAYSNWPEFNEEFLKEDSVTYPVQINGKVRANIEIPSDKAGDKNYVLELAKNDARIVEYLTNSTLIKEIFVPGRIVN

SEQ ID NO: 18473 - DNA, 315 bp, Unknown
  Obtained from environmental sample
  misc_feature (1)..(315): n is a, c, g, or t
ttgattgtcatgttttactcacctgataacaatcgtaacgttgagaagataagaaactactctttctttgatggtgttgagggatgtatgattgtaaaacattcggtttgcagccatatagtatcgcaagaaggtaatatctacttaagtacaggttggaagaagaaaatcagcatacctgtaaagtttggacaggtatattttatcgagtatcatcaatacaaaaacatttcaaaattagttcctgtaccattctctaggggatataagatatgtaagagttaccaaaacctcaaagaaaaacaagctaattaa

SEQ ID NO: 18474 - protein, 104 aa, Unknown
  Obtained from environmental sample
  misc_feature (1)..(104): Xaa is any amino acid
MIVMFYSPDNNRNVEKIRNYSFFDGVEGCMIVKHSVCSHIVSQEGNIYLSTGWKKKISIPVKFGQVYFIEYHQYKNISKLVPVPFSRGYKICKSYQNLKEKQAN

SEQ ID NO: 18475 - DNA, 825 bp, Unknown
  Obtained from environmental sample
  misc_feature (1)..(825): n is a, c, g, or t
gtggatcacagaattcggctcgaggagcgttataaagctaaaaaactaagaaataaattatcatttttaaatgtagtaggttatgacacacttaatcctaatatttccaataggttaaaagtgaaatttggtctgatggatgttgcaatatgtaaccctccatatttcacaattaaatatgatacaaaatataataagctttttgagtcaattggctgtcaggaattttgtagtttaaaacggatatcatctgaaattgtctttcttgctcataacttgaagttattgaaaagaaatggagagcttgccataatagtttccgatagtttagtaacaggtaaagattatactacttttcgtaaggtaattcttagtaaatttttactacgacgtattattcaattacccgataatgtttttgataaaacagaagcaaggacacatattttgtttatttctaaatgcaagtcttccgttaaacaatgtgagatatttgcatcaaacaataatggtgaattaacagaaccaattgttgtttctacagataaattgtcagaaagaatggactttcaataccacaattataaactcaatgaactacttggtaataaaactcttaaagaaataggtgctattatcagtagagggaagttttcgtgccgagaattgtcagaatctaaactcttttattttcactcaactcattttaaggattatgatgaattgattcatttcccaaaaaattcgggtagaaaacacactaactattcagcaaaaactggagatatccttttatgtagagttggcaccagagtagtagggtag

SEQ ID NO: 18476 - protein, 274 aa, Unknown
  Obtained from environmental sample
  misc_feature (1)..(274): Xaa is any amino acid
MDHRIRLEERYKAKKLRNKLSFLNVVGYDTLNPNISNRLKVKFGLMDVAICNPPYFTIKYDTKYNKLFESIGCQEFCSLKRISSEIVFLAHNLKLLKRNGELAIIVSDSLVTGKDYTTFRKVILSKFLLRRIIQLPDNVFDKTEARTHILFISKCKSSVKQCEIFASNNNGELTEPIVVSTDKLSERMDFQYHNYKLNELLGNKTLKEIGAIISRGKFSCRELSESKLFYFHSTHFKDYDELIHFPKNSGRKHTNYSAKTGDILLCRVGTRVVG

SEQ ID NO: 18477 - DNA, 717 bp, Unknown
  Obtained from environmental sample
  misc_feature (1)..(717): n is a, c, g, or t
ttgttttccgaaacgattcgcaaatgcgggatacctcagcagtactgtctcaatgagattggtcataacgcgaaagtaattgttaagcaattattggcaatgttcgtggcgcaaatgatgccgctcagtttgaagaaattgattatttggcgtatccgttttctatttcagaaaacttttcaaatgcgggacacacataaaactattgcagaatctatagaaacgttggacgaaattttaaacatcgccaacaaaactaataaagaagtggtggcgtatttatcaatgggatttggaaatccgtacggagatccttggaatgttgaaattgttggagaatggacagaaaaattatctaaaatgggcgttaaaatattatcgctttcagatacgattgggagttcaactccagaagtaattgagtatttgttttctaatttaattccagcgtatccacaaatagaatttggcgcacatttacatactacaccaacaacttggaaagaaaaagttgatgcagcatacaaagcaggttgtcatcgttttgatggcgcaattatgggatttggcggttgcccaatggcaaaagacgatttaacagggaacatgccaaccgaaaaaatgttgtcttattttactgagcaaaaagttgaaactggcatcaaaccaatgagttttgaaagtgcttataatgtagcaatgaatgttttttcttag

SEQ ID NO: 18478 - protein, 238 aa, Unknown
  Obtained from environmental sample
  misc_feature (1)..(238): Xaa is any amino acid
MFSETIRKCGIPQQYCLNEIGHNAKVIVKQLLAMFVAQMMPLSLKKLIIWRIRFLFQKTFQMRDTHKTIAESIETLDEILNIANKTNKEVVAYLSMGFGNPYGDPWNVEIVGEWTEKLSKMGVKILSLSDTIGSSTPEVIEYLFSNLIPAYPQIEFGAHLHTTPTTWKEKVDAAYKAGCHRFDGAIMGFGGCPMAKDDLTGNMPTEKMLSYFTEQKVETGIKPMSFESAYNVAMNVFS

SEQ ID NO: 18479 - DNA, 717 bp, Unknown
  Obtained from environmental sample
  misc_feature (1)..(717): n is a, c, g, or t
atgtttattcaagaaggaacttacaaatacattccctatcataaattatttagaagaactgagtttttacaaataaacggaagcggaaaatttgaagcatacgcaaacagagattctttaaaatacagatctatttatggtttggaaaatattcctacaatgtacagaggaacgattagaaaagttggtttctctagagcttggaacatctttattcaattaggaatgaccgatgacacctacaccattgaagactcagaacacatgagttatcgtgattttgttaatttgtttttagcgtatagtccaacagattctgtagaattaaaattgcgctcgtatttaaaaattgatcaagatgatgtaatgtgggaaaaattaattgagctcgatatttttaatccaacaaaaataattggattgaaaaatgcaactccagctcaaattttacaaaaaatattaatggataaatggacgctgtctgaggatgataaagacatgattattatgcaccataaattcggtttcgaattaaatggtaaaaagcaacaaatagaaagtagcatggttactattggagaaaaccaaanctacactgcaatggcaaaaacggttggcttgcctgttgcaattgctgcattaaaaatactaaacggagaaattaaaacgcctggtgtcttaagacccatttctaaagaagtgtttgaacccatttnn

SEQ ID NO: 18480 - protein, 239 aa, Unknown
  Obtained from environmental sample
  misc_feature (1)..(239): Xaa is any amino acid
MFIQEGTYKYIPYHKLFRRTEFLQINGSGKFEAYANRDSLKYRSIYGLENIPTMYRGTIRKVGFSRAWNIFIQLGMTDDTYTIEDSEHMSYRDFVNLFLAYSPTDSVELKLRSYLKIDQDDVMWEKLIELDIFNPTKIIGLKNATPAQILQKILMDKWTLSEDDKDMIIMHHKFGFELNGKKQQIESSMVTIGENQXYTAMAKTVGLPVAIAALKILNGEIKTPGVLRPISKEVFEPIX

SEQ ID NO: 18481 - DNA, 636 bp, Unknown
  Obtained from environmental sample
  misc_feature (1)..(636): n is a, c, g, or t
atgagccacaggatactattggtagaggatgaaaagatattgggtcaattggtgaaagaagcccttgaaaaagagggttttgaaatcaaactgatcaccaacggcagcgatgccttgcaggcatacagggatttcaaacccaacctctgcctgctggacattatgctgccaggtaaagacggctatgaggtggccacacaaatcagagccatagacaaaataatacccatcatattcctgactgcgaaaatacaaaccgccgatttggtggcagggtttaatgccggctgtaacgactatatacgcaagcctttcagcatggacgaggtgattgtgcgcataaacagccggatgaccaaaaaatatggtgtgcaggaaagcgaagcagcagcagagattagaatcggagattttatattcataccgggcaaacaagagttgcaaaccgctacccaaacattaatgctcagccataaggacgccaccatactgaacctgctgtacacccacagaaatactattgtgagccgggaccacttgttgcagaaagtatggggtacagacaccatttacaattcccgtacgttggatgtttacatcaacaggctacgtaagcactttgcgggcagcaagtaa

SEQ ID NO: 18482 - protein, 211 aa, Unknown
  Obtained from environmental sample
  DOMAIN (150)...(209): Transcriptional regulatory protein, C terminal
  misc_feature (1)..(211): Xaa is any amino acid
MSHRILLVEDEKILGQLVKEALEKEGFEIKLITNGSDALQAYRDFKPNLCLLDIMLPGKDGYEVATQIRAIDKIIPIIFLTAKIQTADLVAGFNAGCNDYIRKPFSMDEVIVRINSRMTKKYGVQESEAAAEIRIGDFIFIPGKQELQTATQTLMLSHKDATILNLLYTHRNTIVSRDHLLQKVWGTDTIYNSRTLDVYINRLRKHFAGSK

SEQ ID NO: 18483 - DNA, 801 bp, Unknown
  Obtained from environmental sample
  misc_feature (1)..(801): n is a, c, g, or t
atgagaaagtcaagcaatgagcgaacaaaaggcaattatcgtactcacttagagatgttaatggaagtcctaggtagaactatgcctgttactcaaattttggagagtgatattagagtnttttgctttagatcagatttagcaccagctactcaggcaagttatttgagacatttgaaggtgttttttaaatggttatttgagaatgaaatattaaaaaatgatttgactagaaacattaagccacctaggattcctcagaaaatagctctaaaaactctttccagatccgaattggacatgatattcgattcgtttgataagtatagtaaggaagtgatcgaaaaaagatatgttactaagcctgagcagcaaaggttatggtttaaaccaatgataaatacaatttattattgtggtcttagagctaaggaagccgtaaaccttacctgggaggatgttagtttaattttaaaatcagatgaaagagataactttggtgttattcgaatatcaaacaccgatgagaatactagtaaatctggtaaagaacgaataataccaataagggaacctctctacccatggattttacagtggtataaagaccaaggaaaaccttccgagggctatgtgttcccaagtgcgactggttttgataaatggcataaaatggatacactagctctatctaaatcatttaaaaagtttgttaaacttgctgacaatataccgaatactataacactacacggcctaagacattcttgtgctactctcgagccgaatcttgaccactag

SEQ ID NO: 18484 - protein, 266 aa, Unknown
  Obtained from environmental sample
  DOMAIN (94)...(266): Phage integrase family
  misc_feature (1)..(266): Xaa is any amino acid
MRKSSNERTKGNYRTHLEMLMEVLGRTMPVTQILESDIRVFCFRSDLAPATQASYLRHLKVFFKWLFENEILKNDLTRNIKPPRIPQKIALKTLSRSELDMIFDSFDKYSKEVIEKRYVTKPEQQRLWFKPMINTIYYCGLRAKEAVNLTWEDVSLILKSDERDNFGVIRISNTDENTSKSGKERIIPIREPLYPWILQWYKDQGKPSEGYVFPSATGFDKWHKMDTLALSKSFKKFVKLADNIPNTITLHGLRHSCATLEPNLDH

SEQ ID NO: 18485 - DNA, 309 bp, Unknown
  Obtained from environmental sample
  misc_feature (1)..(309): n is a, c, g, or t
atgacctgtacaaatgatgataaatatctgagtatagtatctgagaacgtatctagactagtcacagaagtaaaccccgatattgtttattatattgctggagctgacatattagaatctgataaatttggtcgcttatcgataagtattgatggttcaaaaaaaagagatgatatagtatttactgaatgcaagaaatttgatattcctataatgtgtgttatgggtggtggatattctaaagacttggaagtgattctagaaactcacattaacacttttaaagtaggaaaacagtattatagctag

SEQ ID NO: 18486 - protein, 102 aa, Unknown
  Obtained from environmental sample
  misc_feature (1)..(102): Xaa is any amino acid
MTCTNDDKYLSIVSENVSRLVTEVNPDIVYYIAGADILESDKFGRLSISIDGSKKRDDIVFTECKKFDIPIMCVMGGGYSKDLEVILETHINTFKVGKQYYS

SEQ ID NO: 18487 - DNA, 342 bp, Unknown
  Obtained from environmental sample
  misc_feature (1)..(342): n is a, c, g, or t
atgcttgcaaacttaagtggcaaaacacattctgtttttacaggtatcgctttcattcaggtaaagaaaaacaatactaaaatccgcactcacgtgttttctgttgaaacagaagtgacttttggtaaattatcaagcattgaaatcgaagcttacgtagctaccaatagccccatggataaagctggtgcttatggtatccaagacgattggggatctgtatttgtagaacgcattaatggtgactataataacgtggttggattacccatttataaattttatcaagaattgaaatcatttgaacctcaagctctcaaaaacttagtattgccacattga

SEQ ID NO: 18488 - protein, 113 aa, Unknown
  Obtained from environmental sample
  DOMAIN (1)...(110): Maf-like protein
  misc_feature (1)..(113): Xaa is any amino acid
MLANLSGKTHSVFTGIAFIQVKKNNTKIRTHVFSVETEVTFGKLSSIEIEAYVATNSPMDKAGAYGIQDDWGSVFVERINGDYNNVVGLPIYKFYQELKSFEPQALKNLVLPH

SEQ ID NO: 18489 - DNA, 369 bp, Unknown
  Obtained from environmental sample
  misc_feature (1)..(369): n is a, c, g, or t
ttgaaaaagcttacttatttattcctttccataacgctcctaagttttggccagaagtcacctgcctttctaaatgaggtgaaggacattcagaaaaaatatgattccatttgggattcttcaaaggaaactatagtatttacaggtagttccagcattaggatgtggaaaaacctggaatccatgtttcccgaccaccaaataatcaattcaggttttggtggttcccaatcctccgatctgaaccggtattataaagaacttatattacaatataatcctaagaaagttttatctatgaaagtgataatgatattgcttccaaaaaaagatccaagatttatagagaaactaagcaatggaacgnna

SEQ ID NO: 18490 - protein, 123 aa, Unknown
  Obtained from environmental sample
  SIGNAL (1)...(17)
  misc_feature (1)..(123): Xaa is any amino acid
MKKLTYLFLSITLLSFGQKSPAFLNEVKDIQKKYDSIWDSSKETIVFTGSSSIRMWKNLESMFPDHQIINSGFGGSQSSDLNRYYKELILQYNPKKVLSMKVIMILLPKKDPRFIEKLSNGTX

SEQ ID NO: 18491 - DNA, 315 bp, Unknown
  Obtained from environmental sample
  misc_feature (1)..(315): n is a, c, g, or t
atgagtgacctgaaaaaactatatcaggacgttatccttgaacattccaaaaacccgcgaaattttggaataatagagccttgcacacatcacggtcatggagacaatccactttgcggagacaagatcgatatcttcctgtatctggatgatactgatcttattgaaaatattaaatttgatggaaaaggctgtgcaatatcaatagcttcggcatcattaatgaccgaaattcttaaaggaaaaacgattgccgacgcacaaaatctgttcggtcagtttgaaagttctgtgaccgaaggacatgaacgttaa

SEQ ID NO: 18492 - protein, 104 aa, Unknown
  Obtained from environmental sample
  DOMAIN (7)...(101): NifU-like N terminal domain
  misc_feature (1)..(104): Xaa is any amino acid
MSDLKKLYQDVILEHSKNPRNFGIIEPCTHHGHGDNPLCGDKIDIFLYLDDTDLIENIKFDGKGCAISIASASLMTEILKGKTIADAQNLFGQFESSVTEGHER

SEQ ID NO: 18493 - DNA, 567 bp, Unknown
  Obtained from environmental sample
  misc_feature (1)..(567): n is a, c, g, or t
atgaattctgacgaaagaagacaatgcgttcaagaaattggaatggtttttcaaggaagtgcattgttcgattctcaaacagtagaagaaaacgtaatgtttcctttaaaaatgtttaccaaagattctgataaaaaaatgttagaacgcgcaaattttgtcttaaaaagagtcgatttggtaggttcaaataaaaagtatgttgcagaactttctggaggaatgcaaaaaagagttgccattgcaagagcaattgtaatgaatcctaaatatttgttttgcgatgagccaaattctggtttagatccgcaaacagcaattattattgataatctaataaaagaaattacagaagaatatcaaattacaacggtaattaacacacatgatatgaactctgtgatggaaattggcgaaaaaattctttttctaaaaaacggaaaaaaagcatgggaaggaagtaataaagaaatctttaaaactgacaatgaagcagttgtaaactttgtatatagttctaatttatttaagaaagtacgagaagcatatttaaacgaaacaaattaa

SEQ ID NO: 18494 - protein, 188 aa, Unknown
  Obtained from environmental sample
  DOMAIN (1)...(147): ABC transporter
  misc_feature (1)..(188): Xaa is any amino acid
MNSDERRQCVQEIGMVFQGSALFDSQTVEENVMFPLKMFTKDSDKKMLERANFVLKRVDLVGSNKKYVAELSGGMQKRVAIARAIVMNPKYLFCDEPNSGLDPQTAIIIDNLIKEITEEYQITTVINTHDMNSVMEIGEKILFLKNGKKAWEGSNKEIFKTDNEAVVNFVYSSNLFKKVREAYLNETN

SEQ ID NO: 18495 - DNA, 519 bp, Unknown
  Obtained from environmental sample
  misc_feature (1)..(519): n is a, c, g, or t
atgaagaattcaattgcattcctttttttatccttattaatctttacaggttgtaaatcagaaaaaacagttccaaaaaaaccaaaattagtcatcggaattgtaattgaccaaatgcggtacgattatttaattcgattttcagataaatatggcgaagatggttttaaaagaattataaaagatggattctctttagaaaacgccaattataattacattccgacgtatacagctgtaggacacacttcaatatatacaggtacaacaccagaaaaccatggaattataggaaataactggtatgataaatatgcaaaaaaatacatttactgtgtagatgatgacaattactcttcagttggtgttacttctaacggtggaaaaaaatctccgcacagaatgcaaaccacaacgattacagatcaattacgattggcgcaaaatatgcacggaaaaacaattagtattgccattaaagacagatctgctgtgtgcctgcctcgagccgattcttga

SEQ ID NO: 18496 - protein, 172 aa, Unknown
  Obtained from environmental sample
  SIGNAL (1)...(19)
  misc_feature (1)..(172): Xaa is any amino acid
MKNSIAFLFLSLLIFTGCKSEKTVPKKPKLVIGIVIDQMRYDYLIRFSDKYGEDGFKRIIKDGFSLENANYNYIPTYTAVGHTSIYTGTTPENHGIIGNNWYDKYAKKYIYCVDDDNYSSVGVTSNGGKKSPHRMQTTTITDQLRLAQNMHGKTISIAIKDRSAVCLPRADS

SEQ ID NO: 18497 - DNA, 465 bp, Unknown
  Obtained from environmental sample
  misc_feature (1)..(465): n is a, c, g, or t
atgaattatctagaacatattggtaagtattttatgatgcttaaacaggtttttagaaaaccacaaagagctcgtgtntttagagaagcattgtctagagaaatagaagaacttggtggtaaatctcttgcgattattgcctttatctcttttttaatggggggtgtaatcggtttgcaaacagcatttaactttaaacattccttaattccgaaactctcatccgattgcagcaaagatcatcatctagatttgcccaacctttgttcattattagagggaaagagctcttatccctcagttcgccacgcggttccgaccattgcgtggagtttgggaccctttaacatttggttgcacatttgccgggttctacccttaataccgaagttgaaatgggcggccgacaaccgggtccggaaaaagggccatgccctaacaccaaagtgttcttacgccgattag

SEQ ID NO: 18498 - protein, 154 aa, Unknown
  Obtained from environmental sample
  misc_feature (1)..(154): Xaa is any amino acid
MNYLEHIGKYFMMLKQVFRKPQRARVFREALSREIEELGGKSLAIIAFISFLMGGVIGLQTAFNFKHSLIPKLSSDCSKDHHLDLPNLCSLLEGKSSYPSVRHAVPTIAWSLGPFNIWLHICRVLPLIPKLKWAADNRVRKKGHALTPKCSYAD

SEQ ID NO: 18499 - DNA, 798 bp, Unknown
  Obtained from environmental sample
  misc_feature (1)..(798): n is a, c, g, or t
ttggctcgagcggcttttgttgtcgcggagatcgacagtgaaaccgttcttaattctaccaattatacgacctttgccaattataatataaaaggcatcgcaatgatcatgggtaaaatggaaaacagaaccatggctcgcggtgttcgtcattctgatggaacatatcatccggaatattatgaaagctcgggaaatttcggcaaatttatttacgataataaagtgacctttgatcctaaaacattacgtgtcacagaacacattcaagatttaaaactccgtaaagatacagaatacattcctatagaggaaaatgaaaaatacggcatggatcctatgaccgtttttcttaatatgatcacgaaaccagacttcggtacatcatatgcacaagaagtaaaaacccgtcaatacggcggcattttcgtgtctgaacaaagctttatctgcgaccaaacaaaagagtttaaaccggaaagtaggtccgtatttgttggcgaggctttcgcctgtaaaatcgacggtaagagtatttctggtgatatcaaaagtacaaaanccaagaaaaaagaacgcaaaggtcgagagcgcgatgatcaggatagtcgcttatattttggaagagtgcctaattttgacggaactattccggtttatactgagtttcctatcggttggggtaaagtacgaatttaccttgctgaatttagtgtcgtaccaacgcaagacttgattctcaaaaccaagaatgagaaaaaaatgactgataggttcaaaaccattttaattttttaa

SEQ ID NO: 18500 - protein, 265 aa, Unknown
  Obtained from environmental sample
  misc_feature (1)..(265): Xaa is any amino acid
MARAAFVVAEIDSETVLNSTNYTTFANYNIKGIAMIMGKMENRTMARGVRHSDGTYHPEYYESSGNFGKFIYDNKVTFDPKTLRVTEHIQDLKLRKDTEYIPIEENEKYGMDPMTVFLNMITKPDFGTSYAQEVKTRQYGGIFVSEQSFICDQTKEFKPESRSVFVGEAFACKIDGKSISGDIKSTKXKKKERKGRERDDQDSRLYFGRVPNFDGTIPVYTEFPIGWGKVRIYLAEFSVVPTQDLILKTKNEKKMTDRFKTILIF

SEQ ID NO: 18501 - DNA, 663 bp, Unknown
  Obtained from environmental sample
  misc_feature (1)..(663): n is a, c, g, or t
atgaagaagttaaaattaattattagaagagaattcttagcaaaagtgagaaataaatcatttataatgatgacttttttaagtccgttattaatggttggaatcggatttttagtattttatttaagtaaaaagaacgacgaaaaagtaaaggagattgtttatgtagatgaatataaattatttgctaaagaagattttaaagattctaaaacagtacactatttagattatacagcgttaggaattgacgaagcgaaagcgaaagttgaagcaggaaattactacggcgttttataccttcctaaaaaagacagtttagaaaccttggcaaatgctatcgagttttattcaaaagattcgccaagcatgtcgatgattggagatttagaaaacaaagtagaagccaagttaagacatcttaaattagatcaattaggaatcgattcagaaaacctaaaagcatcacgaatagcaacagatattaccctgtctaatttttctggagacgaatcatccaagttaattaatgggttaccaattgcccgtggtgtaattgccggctatctattactgatgtctgtactgcattacggaacctctgtaatgcgaagtgtgatcgaagaaaaaccagtagactattgcactatcgtgtcgctgtaa

SEQ ID NO: 18502 - protein, 220 aa, Unknown
  Obtained from environmental sample
  misc_feature (1)..(220): Xaa is any amino acid
MKKLKLIIRREFLAKVRNKSFIMMTFLSPLLMVGIGFLVFYLSKKNDEKVKEIVYVDEYKLFAKEDFKDSKTVHYLDYTALGIDEAKAKVEAGNYYGVLYLPKKDSLETLANAIEFYSKDSPSMSMIGDLENKVEAKLRHLKLDQLGIDSENLKASRIATDITLSNFSGDESSKLINGLPIARGVIAGYLLLMSVLHYGTSVMRSVIEEKPVDYCTIVSL

SEQ ID NO: 18503 - DNA, 393 bp, Unknown
  Obtained from environmental sample
  misc_feature (1)..(393): n is a, c, g, or t
atgccgaaaattttaatcattgaagatgaagcagcaattagaagagtattaaaaaagattatttcagaagaaaatgatacttataatgtagaagaagcagaagatggtttgcaagggattgaaatgattatgaatacggattatgatttggttttttgtgatataaaaatgcccaagatggatggcgttgaagtattagaaaaagcaaaaaagataaagccagaaacgccaattgtaatgatttctggtcacggagatttagaaactgccgtaaatacaatgcgtttaggagcttttgattatatttctaaaccaccagatttaaatcgtttgttaacaccgttcgtatgcattagacagaaaagaattgtaagtctcgagccgattctgtga

SEQ ID NO: 18504 - protein, 130 aa, Unknown
  Obtained from environmental sample
  DOMAIN (2)...(123): Response regulator receiver domain
  misc_feature (1)..(130): Xaa is any amino acid
MPKILIIEDEAAIRRVLKKIISEENDTYNVEEAEDGLQGIEMIMNTDYDLVFCDIKMPKMDGVEVLEKAKKIKPETPIVMISGHGDLETAVNTMRLGAFDYISKPPDLNRLLTPFVCIRQKRIVSLEPIL

SEQ ID NO: 18505 - DNA, 495 bp, Unknown
  Obtained from environmental sample
  misc_feature (1)..(495): n is a, c, g, or t
atgccccgtggcgcgttgtatgcttatttgaaggagcacggttacaacaaaattgcattaggtcaccatagggatgacattagtgaaacatgtttcttaaatatgtttcatggtggccagttaaaggcgatgccagccaagttaaaaagtgataatggcaaacatattgttatccgaccgctggcgtattcgcgagaaaaggatatcgcggaattttcaacattaaagggctacccgattattccgtgtaatttatgcggtagccaagataatttgcaacgggtacaaatgaaaagtatgttgacgcaatgggataaggattttccgggccgtgttgaaactattttcaatagcctaaaaaatattaagccatctcagttattggatcataatcagtttgattttgcaggcttgtctcaagccaatgtgtctagcgagcatcaaactgttattccacagccgatagttttttctgcaacacaggtgagtaaataa

SEQ ID NO: 18506 - protein, 164 aa, Unknown
  Obtained from environmental sample
  misc_feature (1)..(164): Xaa is any amino acid
MPRGALYAYLKEHGYNKIALGHHRDDISETCFLNMFHGGQLKAMPAKLKSDNGKHIVIRPLAYSREKDIAEFSTLKGYPIIPCNLCGSQDNLQRVQMKSMLTQWDKDFPGRVETIFNSLKNIKPSQLLDHNQFDFAGLSQANVSSEHQTVIPQPIVFSATQVSK

SEQ ID NO: 18507 - DNA, 744 bp, Unknown
  Obtained from environmental sample
  misc_feature (1)..(744): n is a, c, g, or t
atgaaaaaaatatatttaatcttagcaagcactattgttttagcatcgtgtggtaataaaaaagaaaaatcggtagaagctgttatttctaaaggaaatttagaagaaattagagttaagaaaacagaagtagagctaaaacagcaattgattgtgaatcaattagattctttaaatgttgcgatttctaaactagataccattaaaaaattacctttagtaactacctttattactaaaacggtagaatttaatcactatttagaattgcaaggaaatgtaagcacaaagcaaaacattttggtgtatccagaaatgcctggaattttagaagacgttttcgtaaaagaaggaacttctgttaaaaaaggagacgttttagcgaagataaatgatggcgggttaagtcaacaattagcacaagcagaaacacaattgcaattagcaaaaacaacgtttgatagacaagagcgtttgtggaatcaaaaaattggttctgaaatgcagtatttacaggcaaaagcttcatatcagtcgcaaaccaatgtggtaaaacaattaaaagatcaattagaaaaaacagtaattgttgcgccttttgatggagtaattgatgaagttcttaaagaaaaaggaagcgttgtttctcctggaccaggatcagaaatttttagaatcatcaanctttctaatatgtatattgaagccgaagtgccagaaagttatattccttttattacnntn

SEQ ID NO: 18508 - protein, 248 aa, Unknown
  Obtained from environmental sample
  SIGNAL (1)...(20)
  misc_feature (1)..(248): Xaa is any amino acid
MKKIYLILASTIVLASCGNKKEKSVEAVISKGNLEEIRVKKTEVELKQQLIVNQLDSLNVAISKLDTIKKLPLVTTFITKTVEFNHYLELQGNVSTKQNILVYPEMPGILEDVFVKEGTSVKKGDVLAKINDGGLSQQLAQAETQLQLAKTTFDRQERLWNQKIGSEMQYLQAKASYQSQTNVVKQLKDQLEKTVIVAPFDGVIDEVLKEKGSVVSPGPGSEIFRIIXLSNMYIEAEVPESYIPFITX

SEQ ID NO: 18509 - DNA, 465 bp, Unknown
  Obtained from environmental sample
  misc_feature (1)..(465): n is a, c, g, or t
ttgattcaagaagcagattttgttggtgttcatctatttgaattgatggacagctttgatgtactcagtaaacttaagaaaggtggaacattcctactcaattcttcttactcaaaagatgatgtttggaataagctaccaaagcgtgttcaaaagcaaattattacaaaggaactttcattttatgtaattgatgcagcatcagttgctagaaacactggaatgggtgcaagaattaatactgttatgcagacatgcttctttgctatttctggtatattacctaaggatgaagcaattcagaaaattaaagatgcaattaagaaaacgtacagtagtaaaggtgaagagatagttaagaaaaactataatgctgttgatcaatcccttgctcatctctttcaagtagaatattcagatactgtaacgagtgaaataactgcaccgccggtttgtatcagataa

SEQ ID NO: 18510 - protein, 154 aa, Unknown
  Obtained from environmental sample
  DOMAIN (1)...(131): Pyruvate ferredoxin/flavodoxin oxidoreductase
  misc_feature (1)..(154): Xaa is any amino acid
MIQEADFVGVHLFELMDSFDVLSKLKKGGTFLLNSSYSKDDVWNKLPKRVQKQIITKELSFYVIDAASVARNTGMGARINTVMQTCFFAISGILPKDEAIQKIKDAIKKTYSSKGEEIVKKNYNAVDQSLAHLFQVEYSDTVTSEITAPPVCIR

SEQ ID NO: 18511 - DNA, 888 bp, Unknown
  Obtained from environmental sample
  misc_feature (1)..(888): n is a, c, g, or t
gtgcgtggtaaagcaacagataaagatggtatttacgaagttacaattaatggagtagacgcaacggttaaagaagacggaacttttactgcaaatgttcctttaaaatttggcacaaatgatttaattgtaaaagcgacagatttaaaacaagcatcatcaaccaaaacgtttacaattaaaagaaaatctccagatgttgttgatgttaaagatgatgtaattgttgtaaataataacaatataaataatggttttggcgaatattacgcattgttaattggtgtaagtgattatggtgacggagcaattacagatttgggtggattgcccacaaaagatgcgcaagacttgggaaacatcttaattaacaagtacagttttaaaaaacaaaatgttgtcattttaaacaaaagccctacagaaaatgatattatcaaagaatttagtaaactaaaaaagaaggttactaataaagataatttattaattttctatgctggtcatggagtttacgatgaagtaagtcaggttggagcttggttgccttcggatgcagatatggaatatgaactaaatttaattagcaactcgcaagtggtagatttcttaaaagcgataaaatctaaacatactttattaatttctgatgcttgttttagcggtagtatttttaaaacacgttcgttcgaaaaatcggcgaaatctattcaaaagaaattcgaattaacaagtagaaaagcaattaccagtggaactttaaaaacggttccaaacaaaagtatgtttttaacatatttacttgacagattacaaccaagtcaagtaataattatctgcgccttaattgtctatccaataaaaaactcgtatgaccaccctcaataa

SEQ ID NO: 18512 - protein, 295 aa, Unknown
  Obtained from environmental sample
  misc_feature (1)..(295): Xaa is any amino acid
MRGKATDKDGIYEVTINGVDATVKEDGTFTANVPLKFGTNDLIVKATDLKQASSTKTFTIKRKSPDVVDVKDDVIVVNNNNINNGFGEYYALLIGVSDYGDGAITDLGGLPTKDAQDLGNILINKYSFKKQNVVILNKSPTENDIIKEFSKLKKKVTNKDNLLIFYAGHGVYDEVSQVGAWLPSDADMEYELNLISNSQVVDFLKAIKSKHTLLISDACFSGSIFKTRSFEKSAKSIQKKFELTSRKAITSGTLKTVPNKSMFLTYLLDRLQPSQVIIICALIVYPIKNSYDHPQ

SEQ ID NO: 18513 - DNA, 750 bp, Unknown
  Obtained from environmental sample
  misc_feature (1)..(750): n is a, c, g, or t
atgtggtgtaattgcattcccgctgtagggataagaaatatactcaaacaaaaaaaaattgatttttcaagtcaatacaacataaaaaataaagtacacacttataaaaaacagattccagatttaaaagtaccattaatatcaaaattaattaaaaaacattattttaaaaaactatttaaagcctatttgattaaacatggaaagccagacattgttcacctacattcatatatgtctggcgaatttgccgtatttttaaaagaaaagtataacattacctatgttgtaacagagcactctagtggtttttttagaaataccttaactaaaaaagcgcatcaattggccaaaagaacatatcagtactcaagtaaaaacatggctgttagcccacaattagcaaccttgctggatgaaaaatataatagcagttttgagtgcatccccaatagtgttgatgttgaattttttggtcttaaaataaaagaaaaaaaacaatcatttgattttataaatgtggcttttttagataaaaacaaaaatcatgacttgcttattcgcgcctttacccgtgcatttaaaggacaagatacagtaaaactaactatagttggcgatggaattgaactcacaaatttgcacacattaatcaaagccttagatatggaaagtcaaatttcgttgtttggtaaagccaatagagaggaagttagattgatgttaccaaaaagtgatgcctttgtgntn

SEQ ID NO: 18514 - protein, 250 aa, Unknown
  Obtained from environmental sample
  misc_feature (1)..(250): Xaa is any amino acid
MWCNCIPAVGIRNILKQKKIDFSSQYNIKNKVHTYKKQIPDLKVPLISKLIKKHYFKKLFKAYLIKHGKPDIVHLHSYMSGEFAVFLKEKYNITYVVTEHSSGFFRNTLTKKAHQLAKRTYQYSSKNMAVSPQLATLLDEKYNSSFECIPNSVDVEFFGLKIKEKKQSFDFINVAFLDKNKNHDLLIRAFTRAFKGQDTVKLTIVGDGIELTNLHTLIKALDMESQISLFGKANREEVRLMLPKSDAFVX

SEQ ID NO: 18515 - DNA, 564 bp, Unknown
  Obtained from environmental sample
  misc_feature (1)..(564): n is a, c, g, or t
ttgaaaattttatacgtgaccggactagccggcccattaaaagatattttaactggtaaaaatgaaaatgaaatcacacatgccgctcaattttttcatccatggtataaattagtaaaactcggacatcaggtggactttatagtcgcctctaattttaatgaaaagtataatattaatgtagattggtttagtgaaaaaaatatctatgcgaatatctatgatccatttgttgaattaccttggtacaaacgaatttttagacgaataaaacggtttaccaagcttctgtatttcacaaataaagccatcagtgaaaataattatgactttgtttatggcaaagctttctatgaaggattagctggcaatattattgccaatatccgaggagtaccatgcggaatgaggtcaatgggaaccatgttatatgaagatttcaaaatacatggaagtaaaggtactgctctaagaagaccggcagaatacatgacttttaaantaaagaaaaagttttttatcatgactgatgatgaacactcgaccgaattcttgatccactag

SEQ ID NO: 18516 - protein, 187 aa, Unknown
  Obtained from environmental sample
  misc_feature (1)..(187): Xaa is any amino acid
MKILYVTGLAGPLKDILTGKNENEITHAAQFFHPWYKLVKLGHQVDFIVASNFNEKYNINVDWFSEKNIYANIYDPFVELPWYKRIFRRIKRFTKLLYFTNKAISENNYDFVYGKAFYEGLAGNIIANIRGVPCGMRSMGTMLYEDFKIHGSKGTALRRPAEYMTFKXKKKFFIMTDDEHSTEFLIH

SEQ ID NO: 18517 - DNA, 528 bp, Unknown
  Obtained from environmental sample
  misc_feature (1)..(528): n is a, c, g, or t
atgaggataatcaaacttaatgccatcgattctaccaattcttttttaaaggaaatggcacaatcttcgttgttagaaaattttacagttattgttgctaagaaacaaataaaagggagaggacaaatgggaacaagttggctttctgaagccaataaaaacttattgtgcagtgtgtatgtcaggtttgattcttttcctgcaatgcataaggttttggttaattatgcagtttcaattgcacttgtgaatgtgctaaatagctataaaatgccaagagtagcaattaaatggccgaacgacattttgtcatcaaataagaaaatatgtggtattttggtagaaaatgtcatgcaaaaaaacgaaattaaatcgtctattattggtataggattaaatgtaaatcaactaaatttcccaactaattttaatgcaacttctatgttaccagaaatagaagccgaagtagatcttgatgaatttttacatttattaattgctgaattaaaactcaaatttcttatataa

SEQ ID NO: 18518 - protein, 175 aa, Unknown
  Obtained from environmental sample
  DOMAIN (6)...(140): Biotin/lipoate A/B protein ligase family
  misc_feature (1)..(175): Xaa is any amino acid
MRIIKLNAIDSTNSFLKEMAQSSLLENFTVIVAKKQIKGRGQMGTSWLSEANKNLLCSVYVRFDSFPAMHKVLVNYAVSIALVNVLNSYKMPRVAIKWPNDILSSNKKICGILVENVMQKNEIKSSIIGIGLNVNQLNFPTNFNATSMLPEIEAEVDLDEFLHLLIAELKLKFLI

SEQ ID NO: 18519 - DNA, 501 bp, Unknown
  Obtained from environmental sample
  misc_feature (1)..(501): n is a, c, g, or t
atgctctatgtgcttccttctcttcttgtaatttttgagcgttggaattggattctgtttactaaagatgaacctcaagaagaaacaaaagcacaccgctatccatttgcgagaactatagtagtgacaggcttagttatctcggctttggtaattggatttagtgggaacttaaagttccaatacgattttgggaaactggaacccacatttcctaaatacgaagcatttaaagaactttctgggcaggtaggggattccgataaaagaaacccagcctatattattgcagaaaatgatgaagaagttgacgagctgcttctagcaattaataaaaaaattgcactcgaaaaagaaaatggagctcagacaataaaaagtgttgaggctttgcaagagcgtttcccatctaccaaagaagaagcggatgtcaaactagagtctattgctaaaattcgggagcttttgaaagatccgttcattgttggccaagaaagatga

SEQ ID NO: 18520 - protein, 166 aa, Unknown
  Obtained from environmental sample
  misc_feature (1)..(166): Xaa is any amino acid
MLYVLPSLLVIFERWNWILFTKDEPQEETKAHRYPFARTIVVTGLVISALVIGFSGNLKFQYDFGKLEPTFPKYEAFKELSGQVGDSDKRNPAYIIAENDEEVDELLLAINKKIALEKENGAQTIKSVEALQERFPSTKEEADVKLESIAKIRELLKDPFIVGQER

SEQ ID NO: 18521 - DNA, 789 bp, Unknown
  Obtained from environmental sample
  misc_feature (1)..(789): n is a, c, g, or t
atgaagaagcttttaaatttatttcgcccactccttaagttaaacataaaatatccttttttagtattgggtatttcactaattctagcaataataagtggcttttatgcagctaagctaaaagttgataccgatattgcaaacttgctccctgccgacaatccaaatgtattggctcttgaggaattaaaggacaaagttggaggtgaaactgaaatgcaggtggttatcaaatctccaagttttgaggcgaacaaagcctttgcagaagttctaattccaaaaacgctcgaactaacctacgcaaggtacaacgataagtatttcaagcgtgcagagtttagaaaagataccgagatactcaaagataacgctctttacttagctagtaataaggaaattgaagaaattacaacttggctaaaagacgaaatcactacagctaaagaagaagcaaacccttttcttttagattttggcgatgactttgatgatgaagacgagcccgaagaggataagtctgagaagtttaaagaaagttatgatgttctagtaccatcagaatatcctgtaattgcagacagcacaatcatggtgttgaaatctttccaacgggtcaaaagtgatatcgttactagagatattttcgagttacgaatccatatactgtatcatcagaatcatcctccagatttgaatgaactcggcggagttaaacgcacactgaaaattacctcctcagaagatgttggaaatccgtccgggaaaaaagtaaccgaaaaagcgtnt

SEQ ID NO: 18522 - protein, 263 aa, Unknown
  Obtained from environmental sample
  misc_feature (1)..(263): Xaa is any amino acid
MKKLLNLFRPLLKLNIKYPFLVLGISLILAIISGFYAAKLKVDTDIANLLPADNPNVLALEELKDKVGGETEMQVVIKSPSFEANKAFAEVLIPKTLELTYARYNDKYFKRAEFRKDTEILKDNALYLASNKEIEEITTWLKDEITTAKEEANPFLLDFGDDFDDEDEPEEDKSEKFKESYDVLVPSEYPVIADSTIMVLKSFQRVKSDIVTRDIFELRIHILYHQNHPPDLNELGGVKRTLKITSSEDVGNPSGKKVTEKAX

SEQ ID NO: 18523 - DNA, 603 bp, Unknown
  Obtained from environmental sample
  misc_feature (1)..(603): n is a, c, g, or t
ttgattcggtcgagagtgcagtgcttggccatcgacccggaatggcacgtgctgctatggaccaaggccacgcaaatccccaagaatcaatggaagcggtatagctggacgatcacatggaacaagccaaacagacaggagcgtggatatgtaaactttggtggaagggatgtacttatcgaccgaattcaaattgttgaaggtacggaaaaagaatatcaagctccgccggtgatgctgggattgacctatgaccgttggccgtactttgtacgtgggcgtgatcagatcaaggcgaatatcaaaatcgtccccggcatcaaacgcgatggtaagacagacattgaagtggttgctaaagatgcgtggggtaatatctcatggtttaagcagattcaggtcaagctggatgccaatacgattgtgccggtcggtctgcctgctgaaaaactcggtacatttcatgtcaatctgactgcaaagattgatggccaggtcgcaggcatcggcatgtcacgctatgccatcatcgntccatcggtgcgtgtcactttcaagcccgggcaatatggtttgtcgggtatatgtcaggaaaccgtttaa

SEQ ID NO: 18524 - protein, 200 aa, Unknown
  Obtained from environmental sample
  misc_feature (1)..(200): Xaa is any amino acid
MIRSRVQCLAIDPEWHVLLWTKATQIPKNQWKRYSWTITWNKPNRQERGYVNFGGRDVLIDRIQIVEGTEKEYQAPPVMLGLTYDRWPYFVRGRDQIKANIKIVPGIKRDGKTDIEVVAKDAWGNISWFKQIQVKLDANTIVPVGLPAEKLGTFHVNLTAKIDGQVAGIGMSRYAIIXPSVRVTFKPGQYGLSGICQETV

SEQ ID NO: 18525 - DNA, 438 bp, Unknown
  Obtained from environmental sample
  misc_feature (1)..(438): n is a, c, g, or t
ttggacgataaactacatgaggttgatataactaaagatagtgtagttgagatgagtattaaaaatcagccaattgttggaagtatcgaagtttactttaggcatgtaaaccataatcatgaattagctagagcattcgcttttactgattggattggcgaaccatatatggattgggtcaatggatatgcgctcgataagaagccacttgatggatactcatatgttaaggctgattatcctgaagatccaaagcttatagatggaaagcttacgataacttattggtataatgaaaagataaatggtagctggaatgatgttgttattccaaagactggtgaacatgatcctgttggctcatatcttacagggctgatatttgctcttttaagtgcgcttatatttgggatatatctaaaaacaaaatccaactaa

SEQ ID NO: 18526 - protein, 145 aa, Unknown
  Obtained from environmental sample
  misc_feature (1)..(145): Xaa is any amino acid
MDDKLHEVDITKDSVVEMSIKNQPIVGSIEVYFRHVNHNHELARAFAFTDWIGEPYMDWVNGYALDKKPLDGYSYVKADYPEDPKLIDGKLTITYWYNEKINGSWNDVVIPKTGEHDPVGSYLTGLIFALLSALIFGIYLKTKSN

SEQ ID NO: 18527 - DNA, 300 bp, Unknown
  Obtained from environmental sample
  misc_feature (1)..(300): n is a, c, g, or t
ttgtcagtgttcgctgcagtttatcaaaatcaaaaaaggagtattgatatgatatatgttggaattgacatcgcaagcaaaaaacatgattgctatattgcaaaagccaaaaatttagaacaaggtaaattgctaactattaaaaatgacttgaacggatttactactctcaaaaattgtatttttaatacaatgactgagcttaatgatctagacgtgagaatagggttagaatccactggacattacagccataacatcttgcactatctcgtaaaagaaagtttaataccatgctaa

SEQ ID NO: 18528 - protein, 99 aa, Unknown
  Obtained from environmental sample
  misc_feature (1)..(99): Xaa is any amino acid
MSVFAAVYQNQKRSIDMIYVGIDIASKKHDCYIAKAKNLEQGKLLTIKNDLNGFTTLKNCIFNTMTELNDLDVRIGLESTGHYSHNILHYLVKESLIPC

SEQ ID NO: 18529 - DNA, 579 bp, Unknown
  Obtained from environmental sample
  misc_feature (1)..(579): n is a, c, g, or t
atgaaaaaaaatacaatccttttgtttggtatcgttctcgttttcgcggcttacgggtgcaacagttccgaaagtgctactcttgtgggagaatgggtcatagaaagtgacaacggcgatactcctgaattgatcaacctccgtgaagacaaaaaggtcattgtgagtggtgacgagggcgatcgcgctggtacctggcaagcagatgacgagggaaatttgagctatgaacttggcagtgtttcctttgaatatcagctgatcgagaaaaagccagaatacatggatatgagcatgaaaggcttaggtcgtggtaaaatcgtgcgcttttatcgatttgaagcctataagaaatctgctgaagacattaaccttcaagctcctcggatattggacggcttagatcaggtttctgacgaggaacgatccgaaattgatctttcgaaaataaaggttgatgccgaccatgcctccttggtacataagtttgaagactgcagggaatttcgaatggaattgtccctaaagaaccgtacgttttccagcgataagtcttacnaaaaatggatcgtggattaa

SEQ ID NO: 18530 - protein, 192 aa, Unknown
  Obtained from environmental sample
  SIGNAL (1)...(19)
  misc_feature (1)..(192): Xaa is any amino acid
MKKNTILLFGIVLVFAAYGCNSSESATLVGEWVIESDNGDTPELINLREDKKVIVSGDEGDRAGTWQADDEGNLSYELGSVSFEYQLIEKKPEYMDMSMKGLGRGKIVRFYRFEAYKKSAEDINLQAPRILDGLDQVSDEERSEIDLSKIKVDADHASLVHKFEDCREFRMELSLKNRTFSSDKSYXKWIVD

SEQ ID NO: 18531 - DNA, 480 bp, Unknown
  Obtained from environmental sample
  misc_feature (1)..(480): n is a, c, g, or t
atgattaatgactgggtgacatcattaataaaccaaagaatgggttttattaactggtcagctagagatcaatcacgtggagggaattcagcaactgataagagtgcaggagaacgggatattattgtttcaaatcaatctaaagatgatttattcttaatagaagcatttagattatttggatgttcacgacagactattaaatcacatatggataagttagatggctataatgcaaaaggttgtaatgttgtcgttgttttagtttattgtaaagtgaaagaattttttacattatgtaataactataaaaactatttagaaaatcaacaatataaaggttttgataatacaaatttatccaacaatatttttgacgagattgattcaaaaaaagtgaacttaaagattttcaaagaaattcggaagaaaaataataaggagattactttgtatcatttattatctgattttgaataa

SEQ ID NO: 18532 - protein, 159 aa, Unknown
  Obtained from environmental sample
  misc_feature (1)..(159): Xaa is any amino acid
MINDWVTSLINQRMGFINWSARDQSRGGNSATDKSAGERDIIVSNQSKDDLFLIEAFRLFGCSRQTIKSHMDKLDGYNAKGCNVVVVLVYCKVKEFFTLCNNYKNYLENQQYKGFDNTNLSNNIFDEIDSKKVNLKIFKEIRKKNNKEITLYHLLSDFE

SEQ ID NO: 18533 - DNA, 558 bp, Unknown
  Obtained from environmental sample
  misc_feature (1)..(558): n is a, c, g, or t
atggctaaccaggactttaccaacatgtttgaacaagtattcaaaaatatcgacgacattttccacaaagacgcagggtgctcctccgagctagattacaccgaacaatcatcatggatgctatttttaaagtacctcgacgatcttgaatttaccaagtcccaagaagctgaaatgatgatggaaacatatgaatacatcatcgacgaaccttaccgttggagcgcatgggcagcaccaaaagatgctgatggcaagttcgaccacaacaacgccttaacgggtgatgacttaatggactttgtcgacggccaattattcccttacttaaaaggttttaagcaacgtgccgacaacgctaacaccatagaatataaaattggtgagatttttagcgaaataaaaaacaaaattcaaagcggttattcactacgtgatgcactcgaaaaagtagaccagttacgctttcgntcacaacaagaaaaacacgaacttagtcatatatacgaagctaaaataaaaacatgcgtaacgcaggccgtatggtggcgatactaa

SEQ ID NO: 18534 - protein, 185 aa, Unknown
  Obtained from environmental sample
  misc_feature (1)..(185): Xaa is any amino acid
MANQDFTNMFEQVFKNIDDIFHKDAGCSSELDYTEQSSWMLFLKYLDDLEFTKSQEAEMMMETYEYIIDEPYRWSAWAAPKDADGKFDHNNALTGDDLMDFVDGQLFPYLKGFKQRADNANTIEYKIGEIFSEIKNKIQSGYSLRDALEKVDQLRFRSQQEKHELSHIYEAKIKTCVTQAVWWRY

SEQ ID NO: 18535 - DNA, 330 bp, Unknown
  Obtained from environmental sample
  misc_feature (1)..(330): n is a, c, g, or t
atgttaattcttaggcctaatattgaaacaattttaccgtcatatttgtttgagataatgagatcagggatagttcgtaagcaaatagatgaaaaggtctctggtgctgctcagcctcaattgcctgttaatacgcttaatacatttagctttcctgtacctgtatcactagaagaacaaaaacatgttgttggtctaattagaaaagcagagctaagcataaatgagttaacgaatatctatatgaaaaaattaaacgcgatagacgaactaaaaaaatcaatattacaaaaagcctttagtggtgaattaaccacaacagctaactaa

SEQ ID NO: 18536 - protein, 109 aa, Unknown
  Obtained from environmental sample
  misc_feature (1)..(109): Xaa is any amino acid
MLILRPNIETILPSYLFEIMRSGIVRKQIDEKVSGAAQPQLPVNTLNTFSFPVPVSLEEQKHVVGLIRKAELSINELTNIYMKKLNAIDELKKSILQKAFSGELTTTAN

SEQ ID NO: 18537 - DNA, 636 bp, Unknown
  Obtained from environmental sample
  misc_feature (1)..(636): n is a, c, g, or t
ttgaaaagatctgtagaaagaggaatcccaattgtttcgagctatgggatgtctgaaacttgtgctcaaatagtaactaatccgatgactgcaccttcaggaatgtacacacctttaaaaagtgttggtaaaccttttctcccgaatcaactgcaaattagagacgaccaaggaaaaatccttgggaaaaatcaatcaggaatgatttggttaaaaggaccgcaggtatttgatgggtattatcataaagaagaaaatgaaaaagcctttgatataaataattggtttaagactggagattatggacatctaaatgggtttgatcaattatttatagaatcaagacgagaagatcttatcattagcggtggcgaaaatataaatcctaccgaagtagaagaagccattcaaaagctcaccctcattaacgaagccgttgtaattggacttcctgatgaagaatggggtcaaaaagtgattgccgtagttacacttatgaatgggaaatctccggatatccatgaaatgaaagagttattatccaaagaccttgaggactacaagattccaaaagaattaatcgtagtagagagtattcctaaaacggtaatgggtaaacgaaaagatgggaactag

SEQ ID NO: 18538 - protein, 211 aa, Unknown
  Obtained from environmental sample
  misc_feature (1)..(211): Xaa is any amino acid
MKRSVERGIPIVSSYGMSETCAQIVTNPMTAPSGMYTPLKSVGKPFLPNQLQIRDDQGKILGKNQSGMIWLKGPQVFDGYYHKEENEKAFDINNWFKTGDYGHLNGFDQLFIESRREDLIISGGENINPTEVEEAIQKLTLINEAVVIGLPDEEWGQKVIAVVTLMNGKSPDIHEMKELLSKDLEDYKIPKELIVVESIPKTVMGKRKDGN

SEQ ID NO: 18539 - DNA, 765 bp, Unknown
  Obtained from environmental sample
  misc_feature (1)..(765): n is a, c, g, or t
gtggtgacttttagagatgtcaaatggaaatcacatgctacagcgaagaagttcttgcagtttgaagcaataatctctgaggtacaaagacgcgattgggtgctcaaaaatgttgcccgcacagttcccgcttacaattcacgtaagcaaaaacataaacgcgttatgcccaccaaagatgaaatcaggcttttactaacaaccgttaataagaaacatgaacctttaatcatgactgcaatatttactggtatgagagcatcagagcttcgaggattgatatgggagtatgttgatctcgagaaggggcttattcatgtgaagcaaagagcagatcgcttcaatgagatcggtgaaccgaaaagtgattccggataccgaagtatccccttgacgcccaaccttgttaaaactttgaaggtatggaaaatgaaatgccctaccggtgagtatgaccttgtattccctaatgggaaaggtaatattgaaacgcattcgaatatatataaccgtgtatttaaaccgttaatggtcgaatgtggactgttagatagtgaaggtaaacccttatttggtattcacgctatgagacatgccgcagcatcgcttatgatagaccaaggatggttgccaaagcgtatacaaaccataatgggacatagttcaataaatatgacatttgatgtttacggtcacctatttgatgatccagaggcagatgtagaagctatggcaaagcttgaaagtgatttgttagcggcataa

SEQ ID NO: 18540 - protein, 254 aa, Unknown
  Obtained from environmental sample
  DOMAIN (57)...(240): Phage integrase family
  misc_feature (1)..(254): Xaa is any amino acid
MVTFRDVKWKSHATAKKFLQFEAIISEVQRRDWVLKNVARTVPAYNSRKQKHKRVMPTKDEIRLLLTTVNKKHEPLIMTAIFTGMRASELRGLIWEYVDLEKGLIHVKQRADRFNEIGEPKSDSGYRSIPLTPNLVKTLKVWKMKCPTGEYDLVFPNGKGNIETHSNIYNRVFKPLMVECGLLDSEGKPLFGIHAMRHAAASLMIDQGWLPKRIQTIMGHSSINMTFDVYGHLFDDPEADVEAMAKLESDLLAA

SEQ ID NO: 18541 - DNA, 528 bp, Unknown
  Obtained from environmental sample
  misc_feature (1)..(528): n is a, c, g, or t
gtgactcgaaatatacaagcactacttaaaaaaggttttcttataaagcgtaacgatgaagaatacgaccttccatccgaaaagaaaaagaatctaatggaagattacgatcatcaagatgggattccgattcgtggcttaattgctgccggttatttgcaagaagctgttgaagctgaccttggaaaaatcacattatcttctctgtttccaaacctagatcaattatttgctcttcgtgtatcagggtttagcatgaaagacgtcgatatctacgatggagatcttgttgtcttgatggacactgatgttaaaagtggagatatcggagcagtattatataatggagaaactagtctgaagaaaatattttgggataacaacgggctacgacttgaagctgcaaatgaaagctatgatgatattattgttgaacctgatgtatttgaagaagtacgaatcatcggaaaatatattggacatattaaccgaaaaggattccaaagagcggcgtcaaaagtagcttag

SEQ ID NO: 18542 - protein, 175 aa, Unknown
  Obtained from environmental sample
  DOMAIN (80)...(147): Peptidase S24-like
  misc_feature (1)..(175): Xaa is any amino acid
MTRNIQALLKKGFLIKRNDEEYDLPSEKKKNLMEDYDHQDGIPIRGLIAAGYLQEAVEADLGKITLSSLFPNLDQLFALRVSGFSMKDVDIYDGDLVVLMDTDVKSGDIGAVLYNGETSLKKIFWDNNGLRLEAANESYDDIIVEPDVFEEVRIIGKYIGHINRKGFQRAASKVA

SEQ ID NO: 18543 - DNA, 405 bp, Unknown
  Obtained from environmental sample
  misc_feature (1)..(405): n is a, c, g, or t
ttggaaaaggaaatatcaatttccctgatgaagttttatttggaaatgcattggcaaaaattgcaaggtactccaaaacctaattacaatgaaactaaagttgaagaagtagattctacaacaattagatctatcattgataacgcagatgatggatatttacaacctcaacaagtagttgaactacttactgcaggtcatattccaatggtaaaagcngcgggttgctcttcaaaagcaagaaagtttaggttggtggcaaagaatcttggattaccttgttggtatgaaaagttgttggtccaattcataaatccggatgtcggtggaatcttcttaactataattctgcagaaaaatcagtggtgctttgacagatatgccattaaagatctacgggtttaa

SEQ ID NO: 18544 - protein, 134 aa, Unknown
  Obtained from environmental sample
  misc_feature (1)..(134): Xaa is any amino acid
MEKEISISLMKFYLEMHWQKLQGTPKPNYNETKVEEVDSTTIRSIIDNADDGYLQPQQVVELLTAGHIPMVKAAGCSSKARKFRLVAKNLGLPCWYEKLLVQFINPDVGGIFLTIILQKNQWCFDRYAIKDLRV

SEQ ID NO: 18545 - DNA, 648 bp, Unknown
  Obtained from environmental sample
  misc_feature (1)..(648): n is a, c, g, or t
ttgagtaaatggctaatcatgcatttgaacaatgggaaatacggcaacgattttagcaaaacaatgatttctaaaaaaagccatgacgaactttggaaaccacacaccaatattggatttaatgtaaacccaaaacctccatataaaacacattttaatgcttacggattgggttggcgaatcagtgacaaaggaggctatctaacgattgaacacactggcggcttaccaggaatgctttcaagaacaattttaattccagagttaaatgtgggaatcgttgtattgacaaacacagctccaggaggaaatagtttttggacaattcctaatgaaattatggatgggtatttaggagttaaaaaaacagattggatttctttaatggaaaaaaatcttcaaagaaatgcaactcaaagtgatgcagcagcaaaagctgtttggaataccgtcgcgaaagcaaaatcaaatcatattaaacattctgattatattggcacttataaagacaattggtttgggaaaattaagatttatgagaaaaataataaactgtggtttgcatcggtacgctctccaaaattaacaggccaaatgtttttctacaaagcaaatacttttgctgttacatggaattatcaagacanc

SEQ ID NO: 18546 - protein, 216 aa, Unknown
  Obtained from environmental sample
  misc_feature (1)..(216): Xaa is any amino acid
MSKWLIMHLNNGKYGNDFSKTMISKKSHDELWKPHTNIGFNVNPKPPYKTHFNAYGLGWRISDKGGYLTIEHTGGLPGMLSRTILIPELNVGIVVLTNTAPGGNSFWTIPNEIMDGYLGVKKTDWISLMEKNLQRNATQSDAAAKAVWNTVAKAKSNHIKHSDYIGTYKDNWFGKIKIYEKNNKLWFASVRSPKLTGQMFFYKANTFAVTWNYQDX

SEQ ID NO: 18547 - DNA, 306 bp, Unknown
  Obtained from environmental sample
  misc_feature (1)..(306): n is a, c, g, or t
gtgattacttttaaagaaactgtccggatgttagaacacacgcagtgtagatgtagtgctgccctaaaagagtataatacttatattactatttgtgatccgtgggcaaatacaaaagaagttgaacatgaatatggattgacaaccataaaagaaattccaaatgcaaagtttgatgcaattgtattaacagttgctcataatgaatctgaaaatttagatttacaattattaaaaaaagcaccttctgtagtgtatgatgtgaagaataaattatctgataaccagaaagataaaggcctttaa

SEQ ID NO: 18548 - protein, 101 aa, Unknown
  Obtained from environmental sample
  misc_feature (1)..(101): Xaa is any amino acid
MITFKETVRMLEHTQCRCSAALKEYNTYITICDPWANTKEVEHEYGLTTIKEIPNAKFDAIVLTVAHNESENLDLQLLKKAPSVVYDVKNKLSDNQKDKGL

SEQ ID NO: 18549 - DNA, 585 bp, Unknown
  Obtained from environmental sample
  misc_feature (1)..(585): n is a, c, g, or t
gtgcgttttttgttttatttaacaaaaaagtcctgttttttctgcatctttgtttctatgaaaatttatcccatagaaaccggtaattttaagcttgatggcggcgcaatgttcggcgtggttccaaaagctatttggcaaagaacaaatccggcagattcaaataatttaatttcgatgagcatgcgctgtatgcttattgaagatggagaaaaattaacgttggttgatacaggactgggcgcaaaacaaacagaaaagttttttggatattattacttgtatggagatttttctttggacgcttcattagcaaaattaggttttcatagagatgatattaccgacgtttttttaacacatttgcattttgatcattgcggtggcgttattcaatggaataaaaacaaaacgggatatatgcctgcttttaaaaacgcaaaagtttggtctaataaagatcattggaaatgggcaacaattccaaatccaagagaaaaagcctcttttttaacagaaaatattcaaccaattaaagaaaacggacagttaaattttataaaaaacggcattaaagatgttggg

SEQ ID NO: 18550 - protein, 195 aa, Unknown
  Obtained from environmental sample
  misc_feature (1)..(195): Xaa is any amino acid
MRFLFYLTKKSCFFCIFVSMKIYPIETGNFKLDGGAMFGVVPKAIWQRTNPADSNNLISMSMRCMLIEDGEKLTLVDTGLGAKQTEKFFGYYYLYGDFSLDASLAKLGFHRDDITDVFLTHLHFDHCGGVIQWNKNKTGYMPAFKNAKVWSNKDHWKWATIPNPREKASFLTENIQPIKENGQLNFIKNGIKDVG

SEQ ID NO: 18551 - DNA, 405 bp, Unknown
  Obtained from environmental sample
  misc_feature (1)..(405): n is a, c, g, or t
ttgatcggctcgaggctctgtccgtgtagatattcgccggatcggtgcgatcaagttcgtgacgaaatcgtcggcaatgcgacccgtgtgaaagttgtgaagaacaaagtggcgccgccgttcaaacaggtggaattcgacattatgtatggcgaaggcatttccaaacggggcgagcttgttgatttgggtgtgaaagcgggaatcgttgaaaaatcagggtcctggttttcgtatggggatcaacggatcgggcaaggacgtgaaaacgccaagaatttcctgaaggaaaatccgcaagttgcctgggaaatcgaagacaagattcgtgcctcacacgggttggattttgatatggccaaaccaagcgccgatgacagctcggacgatctgctggaagaataa

SEQ ID NO: 18552 - protein, 134 aa, Unknown
  Obtained from environmental sample
  DOMAIN (1)...(115): recA bacterial DNA recombination protein
  misc_feature (1)..(134): Xaa is any amino acid
MIGSRLCPCRYSPDRCDQVRDEIVGNATRVKVVKNKVAPPFKQVEFDIMYGEGISKRGELVDLGVKAGIVEKSGSWFSYGDQRIGQGRENAKNFLKENPQVAWEIEDKIRASHGLDFDMAKPSADDSSDDLLEE

SEQ ID NO: 18553 - DNA, 816 bp, Unknown
  Obtained from environmental sample
  misc_feature (1)..(816): n is a, c, g, or t
ttgaaaacatcgaatcatatctattctaaaaaagaaatttcaaaaattctatctaaagcctcagagatccagactcaaaaagatttatatggaaataaagatggattgacggaacaagaacttttagaattagcaaaagaggttgggatagacaaagactctcttcttgaagcgcttaacaatgttgacgcaccggagtttgaatcaacgtttaagtggttaagtgctagcagtaggattcaagacatctcaataattgatggtgaaattacacctgaactttgggaggaaattattcaggaaatacgacgaattactggtgggattgcgaaatcaagtagcactggtaagtctttagaatgggaacaaaggaagcaagagtttggatataaacatatctcactcactccacaaaatggaaacgtgaaatttcaatatgtttctaattggtcgcctttaaagttcatgactttactcatgacaacctttctaatctgcggtttacaccttagttgttatgaaacgtttgggatacctaacgggaacaggaatcctttttgctccactgggagggcttatgggatattcttttgcaatgaccttttaacatttattcactgcgaaaagaaaaacttcgaatttgtccatcttttccagaaattagagcgtaatctcaagattcttttgagagcactgattgctgaacttcaacattcttttatagtgaatttatcagcacaagtttttgttaataaaggcttaangctttgtgaccacccttttatagaaccatggagttctcgggnaaatgtnnnn

SEQ ID NO: 18554 - protein, 272 aa, Unknown
  Obtained from environmental sample
  misc_feature (1)..(272): Xaa is any amino acid
MKTSNHIYSKKEISKILSKASEIQTQKDLYGNKDGLTEQELLELAKEVGIDKDSLLEALNNVDAPEFESTFKWLSASSRIQDISIIDGEITPELWEEIIQEIRRITGGIAKSSSTGKSLEWEQRKQEFGYKHISLTPQNGNVKFQYVSNWSPLKFMTLLMTTFLICGLHLSCYETFGIPNGNRNPFCSTGRAYGIFFCNDLLTFIHCEKKNFEFVHLFQKLERNLKILLRALIAELQHSFIVNLSAQVFVNKGLXLCDHPFIEPWSSRXNVX

SEQ ID NO: 18555 - DNA, 369 bp, Unknown
  Obtained from environmental sample
  misc_feature (1)..(369): n is a, c, g, or t
gtgtcatgggtgagatccacccccaagttcaagaaaattatgacattgatcaggcggtctatctcgttgatctcgatgttgccgcacttcaaacgattcaaaaagttgaaaagtcattcaaaccaatctctcgttttccagattgttaccgagatagttcgtttaggtttgatgataaatgtcacggcacagcaagtgtttgaggtgctagcaaaagttaacgtgaaaaatctggatgacgtaacactttttgacatgtacagtggtaaaggtattcctgaagggaaaaagagtttagcagtcagggtacgttatcgttcgatggataagacatttaccgatgatgaaattagtggttatgcatgctaa

SEQ ID NO: 18556 - protein, 122 aa, Unknown
  Obtained from environmental sample
  DOMAIN (60)...(120): Ferredoxin-fold anticodon binding domain
  misc_feature (1)..(122): Xaa is any amino acid
MSWVRSTPKFKKIMTLIRRSISLISMLPHFKRFKKLKSHSNQSLVFQIVTEIVRLGLMINVTAQQVFEVLAKVNVKNLDDVTLFDMYSGKGIPEGKKSLAVRVRYRSMDKTFTDDEISGYAC

SEQ ID NO: 18557 - DNA, 582 bp, Unknown
  Obtained from environmental sample
  misc_feature (1)..(582): n is a, c, g, or t
ttgttcagtatggccaaaaaggtaaagaaaagaaaggaaattaagcagaagctcttacataagtaccgtctggtaattttgaatgaaagtacctttgaagaaaaaatttcatttaagcttagccgaatgaatgtttttgtaaccggttccctgtttataataggattgataggattcaccattttattaatagcatttactccactgcgggaatatattccaggctactcttccactaaattgaaacgacaggccacagaacttacctatagaacagattctttggtcgccacattaaattataccaacaggtatttagaaaacattagaaaggtactgagaggtgatattgaaaacaatgaaattaacagggactccctatttgatcaatacaaactggatccttctaccatagatttaacgcctattaaggaagattccttattaagggcacaggtagctttagaggataagtataatttgttcgaaagaaacattaataacccagggcaggtacttttttctcccctttctggaccatatcccaagaatttaatgcggaatacaagcattttgccgtag

SEQ ID NO: 18558 - protein, 193 aa, Unknown
  Obtained from environmental sample
  misc_feature (1)..(193): Xaa is any amino acid
MFSMAKKVKKRKEIKQKLLHKYRLVILNESTFEEKISFKLSRMNVFVTGSLFIIGLIGFTILLIAFTPLREYIPGYSSTKLKRQATELTYRTDSLVATLNYTNRYLENIRKVLRGDIENNEINRDSLFDQYKLDPSTIDLTPIKEDSLLRAQVALEDKYNLFERNINNPGQVLFSPLSGPYPKNLMRNTSILP

SEQ ID NO: 18559 - DNA, 756 bp, Unknown
  Obtained from environmental sample
  misc_feature (1)..(756): n is a, c, g, or t
atgattacaatccgtatatggaacggccctattattattacaatatcatatgtgaaagatatgaagaggaagtgtctcctggatcaaatttttaaatatgcccataccttaaagggtaccggtagatattccaaatccaagagaatgatgcgtctttacgacaagcaggtcgagcaaggtaatgtgggttctaaattggattttaaggcgagcaaaaaagaagccgtcttggacaaaattctaaatatggaacttaaatttggacttaaaaacttggccataaacaccaagtattcagagttttcacctatgttctataatgatgacgaaattgtatttgcttccgccaaagactcttctatttttaataccagacggtataagtggaacaatcaaccttaccttgatttatatgtctccaaggtaaataaggaatcccaggatttaaaagcagcgattagattttcaaaaaaaataaattccaagtatcacgaagcatcagtgacctttactcccgataattcaaccatgtatttcactagaaataattatggtaaaaaattaaagagggataaaaatggagtcaaccatttgaaaatatatgtttccaagaaagttgatggggaatggatggaagctgaagaagtgccctttaacagcgatgattattctactgtcatccagcatttaagtccggatggaaaaactatatttgtctctgatagcccggaccatagactactgagccgatcttga

SEQ ID NO: 18560 - protein, 251 aa, Unknown
  Obtained from environmental sample
  misc_feature (1)..(251): Xaa is any amino acid
MITIRIWNGPIIITISYVKDMKRKCLLDQIFKYAHTLKGTGRYSKSKRMMRLYDKQVEQGNVGSKLDFKASKKEAVLDKILNMELKFGLKNLAINTKYSEFSPMFYNDDEIVFASAKDSSIFNTRRYKWNNQPYLDLYVSKVNKESQDLKAAIRFSKKINSKYHEASVTFTPDNSTMYFTRNNYGKKLKRDKNGVNHLKIYVSKKVDGEWMEAEEVPFNSDDYSTVIQHLSPDGKTIFVSDSPDHRLLSRS

SEQ ID NO: 18561 - DNA, 522 bp, Unknown
  Obtained from environmental sample
  misc_feature (1)..(522): n is a, c, g, or t
gtgattttaaactttgaaatttgtaaagaaaatttagacgaaatggtaaccgttcacgaaggaaaagtgtgccaaactattttagatttgtacaataaaaacgctattgtggttgaacctgctggtgcgttaaccacagcagttttagaccagttttctactgaaataaaaggtaaaaatgtagtttgtttaattagtggctcaaataatgacattactcgaacagaagaaataaaagagcgtgctttgcttcattctggacacaaacattatttcatcataaaatttccgcaaagagcaggtgctttactagagtttttaaatgatattttaggtccaaatgatgatattacccattttgaatataccaaaaaacacaacagaaattcaggtccagccattgttggtttagaaataagtaacccaagggatttagacggactgattctaaaaatgaaaacaaaaaatttctttggagaatatttgaatgataagccagatttgtttcaagttttgatgtag

SEQ ID NO: 18562 - protein, 173 aa, Unknown
  Obtained from environmental sample
  DOMAIN (80)...(172): C-terminal regulatory domain of Threonine dehydratase
  misc_feature (1)..(173): Xaa is any amino acid
MILNFEICKENLDEMVTVHEGKVCQTILDLYNKNAIVVEPAGALTTAVLDQFSTEIKGKNVVCLISGSNNDITRTEEIKERALLHSGHKHYFIIKFPQRAGALLEFLNDILGPNDDITHFEYTKKHNRNSGPAIVGLEISNPRDLDGLILKMKTKNFFGEYLNDKPDLFQVLM

SEQ ID NO: 18563 - DNA, 324 bp, Unknown
  Obtained from environmental sample
  misc_feature (1)..(324): n is a, c, g, or t
ttgaaaaaaaagnnngttttttttngggtntttttngnttncttaaggaanaatngattgaatgtacaagagcgaaatattttaatgttagacgaaccgacaaatcacttagatttagaatcgatccaggctttaaataactcgttaattaattttaaaggaaccgtgttgctttctacacacgatcatgaatttgcacaaacggttgcaaatagaattatagaaattactccaaaaggtgtgattgatagatatgctacttttgatgattatttatctgatccgaagattaaagacacgagaaaatgtattcataaacaataa

SEQ ID NO: 18564 - protein, 107 aa, Unknown
  Obtained from environmental sample
  misc_feature (1)..(107): Xaa is any amino acid
MKKKXVFFXVFXXXLRXNXLNVQERNILMLDEPTNHLDLESIQALNNSLINFKGTVLLSTHDHEFAQTVANRIIEITPKGVIDRYATFDDYLSDPKIKDTRKCIHKQ

SEQ ID NO: 18565 - DNA, 621 bp, Unknown
  Obtained from environmental sample
  misc_feature (1)..(621): n is a, c, g, or t
atggcgtatattcttgaaattgaagagctttcaaaatcatttgctaaaaaaagtattctagaaaatataaacattcaagttgctgaaggggattgtctgtgcttgattggtaagaatggttcaggaaaaagtactctcatcaatatgattattgatgtagtaaaacccgactctggagctatagatattttcggggggagcatttcaaatgaagtcatccaaataaaaaaacagattggagtactaccagagttcaatccaataatcgaagagttttccgttcaagattatttagagtatgtggggttaatttataagctagataaagagcttataaaaacacgaagtgcatttttaattgactacttttttgaagacccgccagatgcaaaaaagtcaatcggacagttttcgaaaggcatgaaactgaaagtggggatttgtgcggctctcattcataagccaaagttgttaattctagacgaaccattcgatggaatggatatgttttcgagccaaaatttagtcgattttttaaatgactaccgaagcaaaggtaactccgttttcgtctcttctcacgatatgctttttatggagaaaatagctacaaaagtttcc

SEQ ID NO: 18566 - protein, 207 aa, Unknown
  Obtained from environmental sample
  DOMAIN (30)...(206): ABC transporter
  misc_feature (1)..(207): Xaa is any amino acid
MAYILEIEELSKSFAKKSILENINIQVAEGDCLCLIGKNGSGKSTLINMIIDVVKPDSGAIDIFGGSISNEVIQIKKQIGVLPEFNPIIEEFSVQDYLEYVGLIYKLDKELIKTRSAFLIDYFFEDPPDAKKSIGQFSKGMKLKVGICAALIHKPKLLILDEPFDGMDMFSSQNLVDFLNDYRSKGNSVFVSSHDMLFMEKIATKVS

SEQ ID NO: 18567 - DNA, 741 bp, Unknown
  Obtained from environmental sample
  misc_feature (1)..(741): n is a, c, g, or t
atgcgtactttgtatccggaaatcgacttgaagtaccgttggtacatctcccataagatgatgaccctctcaaaaggattcaagaaatggttggaggcgaagaatgaaacaaatcttgagcgattctacaaagaccatccggagaaagtccaggtctaccaccagcggacttttgattatgtagaacaattcggcaaggactgtggcgccatccctttgcgcgaactcgattgcagtttgatcggcaaacccgaagctcacttcgccattgacgggaaaaactataccgcccagatgctttactattacatgcggtatgcatggagctgtaagcatatgtcttggaatcaagacatgaaaatcttcgtcgaactgggcagcggctcaggcaagcagattgaaatcatgaaaaaactcttccccaagatgactttcatgatatttgacattcctccccaaatctatgtggccgagcagtacctcaaagccaactttcccgacgatgtagtgggctaccgcgagacgaaggacatgaaagaactccccgaagatcgggagggaaaaatcttctgttttggcaattggcagttccccattcttgaaaaaacagaggtcgatatcttttggaactgtgccagttttcaggaaatggagccggaagtggtacgcaactattgtccgtggtggccaacgcaccaaatacgtataccttttgccctcgaccgattcttgatccagtag

SEQ ID NO: 18568 - protein, 246 aa, Unknown
  Obtained from environmental sample
  misc_feature (1)..(246): Xaa is any amino acid
MRTLYPEIDLKYRWYISHKMMTLSKGFKKWLEAKNETNLERFYKDHPEKVQVYHQRTFDYVEQFGKDCGAIPLRELDCSLIGKPEAHFAIDGKNYTAQMLYYYMRYAWSCKHMSWNQDMKIFVELGSGSGKQIEIMKKLFPKMTFMIFDIPPQIYVAEQYLKANFPDDVVGYRETKDMKELPEDREGKIFCFGNWQFPILEKTEVDIFWNCASFQEMEPEVVRNYCPWWPTHQIRIPFALDRFLIQ

SEQ ID NO: 18569 - DNA, 594 bp, Unknown
  Obtained from environmental sample
  misc_feature (1)..(594): n is a, c, g, or t
atggagtgtcaaattctttggtcaggtaatacaaacgggccttctgcaattcctggttcttatactgtaaaaatgtatataggggacaaaatgattggagagcgtaagttcgaaattataaaagacccaagacttactgaagtttcacaggctgactttgaagctcagttccaattagttcaaacagtaaaagctaagttagatactactcataaaacgattaaccgcattagagaagtaagaaaggaaatcaacgaattattggcggaagctaagaatgataaagatctccaagaaagagccaaattgatgttggaagcaatgtcagaaatcgaaaatgagttggttcaaactaaagctgaatctggacaagatgtacttaacttccagattaagcttaataataaactagcttctcttgctaatactattgaaacaggtcacggtagaccaantaaacaacagtatgaagtatatgaagatctagctgctcgtgttgacgtacaattcaaacgcttacaagctgtttgggatggagaatatgaaactatgatccaagagttcgaaagtaaaggcggaaagacttcaaattag

SEQ ID NO: 18570 - protein, 197 aa, Unknown
  Obtained from environmental sample
  misc_feature (1)..(197): Xaa is any amino acid
MECQILWSGNTNGPSAIPGSYTVKMYIGDKMIGERKFEIIKDPRLTEVSQADFEAQFQLVQTVKAKLDTTHKTINRIREVRKEINELLAEAKNDKDLQERAKLMLEAMSEIENELVQTKAESGQDVLNFQIKLNNKLASLANTIETGHGRPXKQQYEVYEDLAARVDVQFKRLQAVWDGEYETMIQEFESKGGKTSN

SEQ ID NO: 18571 - DNA, 465 bp, Unknown
  Obtained from environmental sample
  misc_feature (1)..(465): n is a, c, g, or t
ttgctggtttccaccgatgtgatggcccggggacttgacctgggacagatcacccaggtgatcaatttggacaccccgatttatcccggtgactacatgcaccgcattggccgaaccggccgggccaaggaagaagggatcagcattctgttttttacggaggaagaagaaccgaacgatatagccatcgaaaccctcatggattgtgaaatcccgctgctggaattcccggaagaagtcgaaatctccaaagaattggcgccggaagaacgtccggatagcatggatggaccttctgtcgaggtaaaattgcgtgatgaccggggtgcggccttccatgaaaagaagaaggacaatcaaaaggtgaatgccggtggtggaaagcgcaaaaagcttttgaaaaagaaatacaaaaagcccaaaacccgcggcgacaaatttgccaataagcggaagaagaagtag

SEQ ID NO: 18572 - protein, 154 aa, Unknown
  Obtained from environmental sample
  misc_feature (1)..(154): Xaa is any amino acid
MLVSTDVMARGLDLGQITQVINLDTPIYPGDYMHRIGRTGRAKEEGISILFFTEEEEPNDIAIETLMDCEIPLLEFPEEVEISKELAPEERPDSMDGPSVEVKLRDDRGAAFHEKKKDNQKVNAGGGKRKKLLKKKYKKPKTRGDKFANKRKKK

SEQ ID NO: 18573 - DNA, 783 bp, Unknown
  Obtained from environmental sample
  misc_feature (1)..(783): n is a, c, g, or t
ttgttgcccaccttcccctacaagtttttgaagcaattggccccgatgactgcgtattgtcgggaaaaggggatcgactaccaaggctcggcggaattgcagtacaaaatcgaaatgctgcggccctggagtgtcaatttcaaggaacgataccgcctggaaaatgagtttataggcagccttagcctggaagaaatcacggtgctggaatattggacgatcatttatagcggaggctaccacatttcattgtcctattccgcaggcagaatccttgacatcttttattcccggcattggaaggagatgatttccagccccttgcaccttgaaacttacctccggaaagctgaatggttcgatcacctgggcatcattgggagttgcaacaactacctggacaagttctccttcgcatcgccggaaaccttgcaagccatttcctcgcttcagacagatgattcacttattcagaagcaagtgttgcaaattcaagaactgaatcaaaatcgctcactgaaacgaaaaaccgataaaaagcagtgggatggcaacaagaactttcccccaattcccaatttggagaaaaaactgaagaaactcatcaggagctccgggaaacaagaagagctagaagaaagcctcgtagaaatattggcggcgatcccctatgagcagatcggaaatgcgatgcgcgggattgagccgttccaatttagacagagttggcataaatattcgttcatggacagggattggggctttttcaacttttccttcgnn

SEQ ID NO: 18574 - protein, 261 aa, Unknown
  Obtained from environmental sample
  misc_feature (1)..(261): Xaa is any amino acid
MLPTFPYKFLKQLAPMTAYCREKGIDYQGSAELQYKIEMLRPWSVNFKERYRLENEFIGSLSLEEITVLEYWTIIYSGGYHISLSYSAGRILDIFYSRHWKEMISSPLHLETYLRKAEWFDHLGIIGSCNNYLDKFSFASPETLQAISSLQTDDSLIQKQVLQIQELNQNRSLKRKTDKKQWDGNKNFPPIPNLEKKLKKLIRSSGKQEELEESLVEILAAIPYEQIGNAMRGIEPFQFRQSWHKYSFMDRDWGFFNFSFX

SEQ ID NO: 18575 - DNA, 423 bp, Unknown
  Obtained from environmental sample
  misc_feature (1)..(423): n is a, c, g, or t
gtgccgttaagtgatttagaaaaagttcctaaacaagctagagccatggtgacaatttatggccttaacgatgaaattggaaacatgacgtattatgattcttcaggtcaagattcttatggcttctctaaaccttatagtgaggacacggccagaaaaatagacgctgagatttctaaaataatagaagagcagtatcaaagggctattaaagttcttactgagaataaggacaaactaacaactttagctgaaagattattagagaaagaagttatctttaaggaagatttagaaaaaatatttggtaaaagaaattttgaaaaagatatcttggccttagaaaatgaaaaaaaacttagagaagaagaagcagcagcaaatacatctactgaagataaagagattacagtaaacaaataa

SEQ ID NO: 18576 - protein, 140 aa, Unknown
  Obtained from environmental sample
  DOMAIN (1)...(101): Peptidase family M41
  misc_feature (1)..(140): Xaa is any amino acid
MPLSDLEKVPKQARAMVTIYGLNDEIGNMTYYDSSGQDSYGFSKPYSEDTARKIDAEISKIIEEQYQRAIKVLTENKDKLTTLAERLLEKEVIFKEDLEKIFGKRNFEKDILALENEKKLREEEAAANTSTEDKEITVNK

SEQ ID NO: 18577 - DNA, 438 bp, Unknown
  Obtained from environmental sample
  misc_feature (1)..(438): n is a, c, g, or t
ttgttactagattttggtgaatatagattgagggcataccaacagaccaccaataatcaggtgcatttggcgttgaccaaaggaacctggcaaaaagatgaaaaggtcttgacaagaataaattctaccttgatcaacaatgacattttaggtacccttaccaacaatccggataaaaaattggaggacatgttcaatgccatcaacgaagaaggcaaaggggcaatagtctttataaatcaggaaaccgaatccttgaacctattgggacgcctgggcgaacttaaggagttgcaaaaacaaggaatatacaaggcccctaaggttgatatggatgccaaggattttggtgttggagctcaaatattgcacgatttggatattgccacaattaggttgttgagcaattctagccataccaaaaggtggggcttgtag

SEQ ID NO: 18578 - protein, 145 aa, Unknown
  Obtained from environmental sample
  DOMAIN (3)...(145): GTP cyclohydrolase II
  misc_feature (1)..(145): Xaa is any amino acid
MLLDFGEYRLRAYQQTTNNQVHLALTKGTWQKDEKVLTRINSTLINNDILGTLTNNPDKKLEDMFNAINEEGKGAIVFINQETESLNLLGRLGELKELQKQGIYKAPKVDMDAKDFGVGAQILHDLDIATIRLLSNSSHTKRWGL

SEQ ID NO: 18579 - DNA, 600 bp, Unknown
  Obtained from environmental sample
  misc_feature (1)..(600): n is a, c, g, or t
gtgagtgttgtaatcctttatccaagcggtaaagtaagcgaattgcaagaaaaacaactgacaacattaggtggaaatataaaagctttagaggtggatgggaccttcgatgattgccaaaatatggtgaagcaagcttttttagattccgatattaattctaaactacatctcagttctgcgaactcaattaatatagcccgttggttacctcaatcaatctattattttgaggcttttaagcaaagtgaaattaaaaaacggcttgtattctctgttccatcaggtaattatggaaacctcactgcaggaatattagccaagaaattagggcttcctattcatcgttttattgccgcttcaaatcaaaacgatgtaattcctcgattcttaaaaggacaagaatatcatcctaaaccaactattccaacactttcaaatgctatggatgtaagtgatccgagtaactatcctcgacttctggaactagttgataataattttaaggaactcaccaggcacttatctggatttacaatggatgataaagaaacgctaaaaaccattaagctttgtttgataactcgagccgattcttga

SEQ ID NO: 18580 - protein, 199 aa, Unknown
  Obtained from environmental sample
  misc_feature (1)..(199): Xaa is any amino acid
MSVVILYPSGKVSELQEKQLTTLGGNIKALEVDGTFDDCQNMVKQAFLDSDINSKLHLSSANSINIARWLPQSIYYFEAFKQSEIKKRLVFSVPSGNYGNLTAGILAKKLGLPIHRFIAASNQNDVIPRFLKGQEYHPKPTIPTLSNAMDVSDPSNYPRLLELVDNNFKELTRHLSGFTMDDKETLKTIKLCLITRADS

SEQ ID NO: 18581 - DNA, 783 bp, Unknown
  Obtained from environmental sample
  misc_feature (1)..(783): n is a, c, g, or t
atgataaaacaactgttgatacctatatccattatttggaaaagagatgnccaaggattacctgctattggtgttgaatttcctatgatacttacacattatggtgttcgtgttgcacgagcagtactagctaaatatgatgatggatcattaggatttgcaggaaatttaaanttgggtgataaggtaaggtttggttatggtgacccaatgaaaattttaagtgaatcagataaggttttaaaaaaaatacataataaaccttctgaagcaatctttatttattcgtgtatggcacgtagacattttatgcctagtcttattgagacagaaactttacctcttcaagatattgcaccttcatcaggtttttttacctatggagaatttttcacatcaaagagtaaagaattgctcaatcaaacaatgacaattatctcgttaagtgaaaataaccttatacctaaaaagaagaaagaagtgttaacaaaagagcctagcactcgacataattcaattaatgctttaattcatttggttaatgtaactagccatgaggctatgaaacaagaagcgttaatgcaggcacaagagacatttgaaaaactgtttgagggctcacctgatggtattttattgattgaaaaagataaatttattcagtgtaatcaaaaaatgcttgatatttttggatatacaacaaaaacagaatttttaaatgcaagacctttgcagatatttccaagaaaacaacctgatgtgcacactcctttgttaaaataa

SEQ ID NO: 18582 - protein, 260 aa, Unknown
  Obtained from environmental sample
  misc_feature (1)..(260): Xaa is any amino acid
MIKQLLIPISIIWKRDXQGLPAIGVEFPMILTHYGVRVARAVLAKYDDGSLGFAGNLXLGDKVRFGYGDPMKILSESDKVLKKIHNKPSEAIFIYSCMARRHFMPSLIETETLPLQDIAPSSGFFTYGEFFTSKSKELLNQTMTIISLSENNLIPKKKKEVLTKEPSTRHNSINALIHLVNVTSHEAMKQEALMQAQETFEKLFEGSPDGILLIEKDKFIQCNQKMLDIFGYTTKTEFLNARPLQIFPRKQPDVHTPLLK

SEQ ID NO: 18583 - DNA, 402 bp, Unknown
  Obtained from environmental sample
  misc_feature (1)..(402): n is a, c, g, or t
gtgttgtgtatagtcatgaaagaagaaacttttgaaaaatataaacttgtagttgatgagtggtttgtaaatggttttaatggaactaaggcatatcaaaagttttatcctaaagcgagtgatgaagttggagcaaatatgttttctgaaatcgtgagaatacatgaggttttcgaatataaaaaacagaaagaaaacaaagctcaaatagccctccaaacttcacatggtcgtgtcttagaagagttaaggaattgggcgtactcagacatcacagagactttaatgttaaccccaaacgaagttaaagagttaccgaaaaatattagaagactaattaccaagtttaagcattctaaaaagatttcatcaagcaaggtggaaaaagaccagaagtcgtaa

SEQ ID NO: 18584 - protein, 133 aa, Unknown
  Obtained from environmental sample
  misc_feature (1)..(133): Xaa is any amino acid
MLCIVMKEETFEKYKLVVDEWFVNGFNGTKAYQKFYPKASDEVGANMFSEIVRIHEVFEYKKQKENKAQIALQTSHGRVLEELRNWAYSDITETLMLTPNEVKELPKNIRRLITKFKHSKKISSSKVEKDQKS

SEQ ID NO: 18585 - DNA, 792 bp, Unknown
  Obtained from environmental sample
  misc_feature (1)..(792): n is a, c, g, or t
atgaaatactacaatattgctggagaacttcaaggagatttacacggttctaacttgataaaagcattgtttcaacaagacgaaaatgcaacgattagatnttgggntggagatttaatggaaaatgctggagcaacattggtaanacattataaagaattggcttttatgggttttgtagaagtgttggcaaacattcctaccatatataaaaacattgctttttgcaagaaagatattgaagcatttcagccagatgttgtcgtttttattgattattccggatttaatttacgaattgcaaaatgggcaaaacaaaaaggttttagaaccaattattatatttctccacaagtttgggcatcaagatctagcagagtagaaaagattaagagagatattgacatgatgaatgtgattcttcctttcgaaaaagagttctacgcaaaatacaattacaaggtcaattttgtgggtcatccattaattgatgccattgccgatagacaacaagttggtgaaattgcttttagaaaagaaaacaacttaggcgataaaaaaattattgcattattgccaggaagtagaaagcaagaaattataaaaatgttatctgtaatgctttctgtggttgatgattttaaagagtatcaatttgtaattgctggcgcgccaagtcaagatttttctttttataagcaatttataaaaacggataatgtgcagtttatcaataataagacctacgatttattgagcatttcgttgctgctttctcgaccgaattcttga

SEQ ID NO: 18586 - protein, 263 aa, Unknown
  Obtained from environmental sample
  DOMAIN (3)...(263): Lipid-A-disaccharide synthetase
  misc_feature (1)..(263): Xaa is any amino acid
MKYYNIAGELQGDLHGSNLIKALFQQDENATIRXWXGDLMENAGATLVXHYKELAFMGFVEVLANIPTIYKNIAFCKKDIEAFQPDVVVFIDYSGFNLRIAKWAKQKGFRTNYYISPQVWASRSSRVEKIKRDIDMMNVILPFEKEFYAKYNYKVNFVGHPLIDAIADRQQVGEIAFRKENNLGDKKIIALLPGSRKQEIIKMLSVMLSVVDDFKEYQFVIAGAPSQDFSFYKQFIKTDNVQFINNKTYDLLSISLLLSRPNS

SEQ ID NO: 18587 - DNA, 753 bp, Unknown
  Obtained from environmental sample
  misc_feature (1)..(753): n is a, c, g, or t
gtgagtttttttaagccttcttttgttctgtttttctgtttgcttggtttgcatggccaaagccaaagcatcttgaatggcaatggcgtgaagaatgccccacagaaatcagaatttattccgctttacaagtcagttgttattatcccatttgaggacaagctgtatttatcagatgctgatagggatatagcccaaggtagcgccgtgaaagaccatcatactatcaaggcacgtttccgtgatgggctgatgataagcctcacagcgggctctaaactgcgttataaggctattcccttccattttagggattcagtgatacagcccgacctagctgaagcattttcagtggtaaaatacaagtacgaagacatccccaagaaagacgataaaaaggataatggcatttttaaaacggttgtcaacaagcctagcaaggatgcccctaggggccaaataggagcttccgctgacattgatggcaagttcatgatgcctgtgatcaaaaaaacagaaaccatccattacctctcagaaaaatacgaagccgacctttttctttttatcagtcagtttgagattaagaatgacatgaacgacccctctggttttgcctatggtggtttcaacagaacctgccgcgttcactatgccttctataaccacaacagcgaactggtggatggcggtattgcttccatcggtttctcttccgatgtgaagacatctcgaccgattcttgatccatag

SEQ ID NO: 18588 - protein, 250 aa, Unknown
  Obtained from environmental sample
  SIGNAL (1)...(19)
  misc_feature (1)..(250): Xaa is any amino acid
MSFFKPSFVLFFCLLGLHGQSQSILNGNGVKNAPQKSEFIPLYKSVVIIPFEDKLYLSDADRDIAQGSAVKDHHTIKARFRDGLMISLTAGSKLRYKAIPFHFRDSVIQPDLAEAFSVVKYKYEDIPKKDDKKDNGIFKTVVNKPSKDAPRGQIGASADIDGKFMMPVIKKTETIHYLSEKYEADLFLFISQFEIKNDMNDPSGFAYGGFNRTCRVHYAFYNHNSELVDGGIASIGFSSDVKTSRPILDP

SEQ ID NO: 18589 - DNA, 420 bp, Unknown
  Obtained from environmental sample
  misc_feature (1)..(420): n is a, c, g, or t
ttgtgttttggttggattgatagcaccaaaaaaacggtggatgaaaatcggtacaaacagtttttcagcaaacggaatgcaaagagtaattggtcaaaaatcaacaaagagaaaattgaaacgctaacctctcaaggcttgatgaccaaagctggtttagaaagtgttgaagtagctaagcaaaatggatcttggactattttagatgctgttgaagcgttaattatcccaatagatttagaagaagctttcaaaaatcagaacggtgccaaaagctatttcctcagtttaagtaaatctaaacgaaagtctcttttgtattgggttatcagtgcaaaacgaactgaaacgagagagaagcgaatcaatgaagtcgttcttcattctgctcaagagcagatgccgaaacagtttaggtga

SEQ ID NO: 18590 - protein, 139 aa, Unknown
  Obtained from environmental sample
  misc_feature (1)..(139): Xaa is any amino acid
MCFGWIDSTKKTVDENRYKQFFSKRNAKSNWSKINKEKIETLTSQGLMTKAGLESVEVAKQNGSWTILDAVEALIIPIDLEEAFKNQNGAKSYFLSLSKSKRKSLLYWVISAKRTETREKRINEVVLHSAQEQMPKQFR

SEQ ID NO: 18591 - DNA, 768 bp, Unknown
  Obtained from environmental sample
  misc_feature (1)..(768): n is a, c, g, or t
atggacttcattaccattgactttgaaactgctacatctgaaagggacagcccttgtgaaattggcttgaccttcgttaaaaacagtcaaatagttgatactaaatcatggttaataaaacctaaatatcatcagtttgacgttttcaatatcttaattcatggaataacgcccctgcatgttaaggataagcccgagtttaatgaactatgggcagaaattatgccgctgatagaaaaccagttcttaatcgcacataatgcaagctttgattttagtgtgttacgcaggacacttgaagcgtatcaactcccctttccaacgcttaactactcttgtagctacatattttctaagaaagtctggcaaggtctccctgcttatgacttaaagacactttgtagggtaaataatatcaagcttgaccatcatagggctgggtcagatagcagggcgactgctgagcttgcgcttaaggcttttgatatagctggagttgctacttttgatgaattacctgagaagttaaagacttccattgggcaactttataagggtggttacagaccttctgaaacaaaaagaacatataagccgcaagatttatcaaaaatagtaggtgaccctgccaaatataaccccgacagtattttttatgggaggacagtagtcttcacggcgacgctatcttcgatggtaaaagctgctgcccaaaagacaaccgttgacttggggggtacccaggtaactccattaccagggaccnna

SEQ ID NO: 18592 - protein, 256 aa, Unknown
  Obtained from environmental sample
  DOMAIN (3)...(157): Exonuclease
  misc_feature (1)..(256): Xaa is any amino acid
MDFITIDFETATSERDSPCEIGLTFVKNSQIVDTKSWLIKPKYHQFDVFNILIHGITPLHVKDKPEFNELWAEIMPLIENQFLIAHNASFDFSVLRRTLEAYQLPFPTLNYSCSYIFSKKVWQGLPAYDLKTLCRVNNIKLDHHRAGSDSRATAELALKAFDIAGVATFDELPEKLKTSIGQLYKGGYRPSETKRTYKPQDLSKIVGDPAKYNPDSIFYGRTVVFTATLSSMVKAAAQKTTVDLGGTQVTPLPGTX

SEQ ID NO: 18593 - DNA, 657 bp, Unknown
  Obtained from environmental sample
  misc_feature (1)..(657): n is a, c, g, or t
gtgctgtttgtagcctcctttgccttggtggtaaagcacatggggaaaccatatgtgctaaccacccggggctccgacgttttagtggagctaaagaacatgcaagaaaaaagccttgcaggcagttggataagcacctttctttttgggcagttcacttctcttgtcaataaggccagtgctgttacttcaacctcctacccccaaggcgcatttgtaaagcaggcttttggggtaacttcacaaataatacgcactggggtagatgtagaaaaaataaacaccatcaacgaccaaaaatacctgcccgatgtattgagaggaaagaaatatatcttttcgccccgctgggttagaaaaaaatacaatcaacagttgcaggtggatgccattaagctgctcaaccaaaaaatcagggacgattacttttttgtattcctcaaatacaaggactggggaaaagaatacctggatgcattggttgagcagatggaagagcacaaaatcaagtacataatacttgaacaccttacccaagaggctatatggagtgcccttaaaaaaacttcattgatgataatgacccccgtaagcgatggtaccccaaatactgccttggaagccaatgtcaagcgcatgcccctttatattgagtaa

SEQ ID NO: 18594 - protein, 218 aa, Unknown
  Obtained from environmental sample
  misc_feature (1)..(218): Xaa is any amino acid
MLFVASFALVVKHMGKPYVLTTRGSDVLVELKNMQEKSLAGSWISTFLFGQFTSLVNKASAVTSTSYPQGAFVKQAFGVTSQIIRTGVDVEKINTINDQKYLPDVLRGKKYIFSPRWVRKKYNQQLQVDAIKLLNQKIRDDYFFVFLKYKDWGKEYLDALVEQMEEHKIKYIILEHLTQEAIWSALKKTSLMIMTPVSDGTPNTALEANVKRMPLYIE

SEQ ID NO: 18595 - DNA, 738 bp, Unknown
  Obtained from environmental sample
  misc_feature (1)..(738): n is a, c, g, or t
atgaaagaacttgaagaaggacacgatcttctttttttcgaaaataggtacaaacataaaaatggttcatacaaaacccttgcttggtctgcaaatactcttcaagaaaatggattgatttatggttctgctttgaatattactgaattaaaagaaaaatctgaaataatataccaacagtcaaaaatggcagcaattggtgaaatgactgcaaatatttcacaccaatggagacaaccattaagtgtcattagtactgcttcttctggattacttttaaaaaaatcaattgacgatttagatgatgagtttttaataaatactttagaacaaataacacaatcaactcaatacttatctgatacaattgaagattttagaaacttctataccccaagtagggaaaaaacagagtttaaaatagcacatgtagttaaaaaaactctaaatcttgtaaaaaaaagatatgaaagtgaaaatatagaagtcatcaaaaatatctctgacataacaatagttaattttgaaaatgagtttttacaagtacttataaaccttttaaataatgcaagagatcaacttgctaaatcaacagaaatagataaattcatttttataaatgcctataaaaaagatactaaaattatcttcgaaataatggataatggtggaggaataaaagaaaacataatagataaaatatttgaaccatattttactacaaaagataatcaatag

SEQ ID NO: 18596 - protein, 245 aa, Unknown
  Obtained from environmental sample
  DOMAIN (65)...(135): His Kinase A (phosphoacceptor) domain
  misc_feature (1)..(245): Xaa is any amino acid
MKELEEGHDLLFFENRYKHKNGSYKTLAWSANTLQENGLIYGSALNITELKEKSEIIYQQSKMAAIGEMTANISHQWRQPLSVISTASSGLLLKKSIDDLDDEFLINTLEQITQSTQYLSDTIEDFRNFYTPSREKTEFKIAHVVKKTLNLVKKRYESENIEVIKNISDITIVNFENEFLQVLINLLNNARDQLAKSTEIDKFIFINAYKKDTKIIFEIMDNGGGIKENIIDKIFEPYFTTKDNQ

SEQ ID NO: 18597 - DNA, 738 bp, Unknown
  Obtained from environmental sample
  misc_feature (1)..(738): n is a, c, g, or t
ttgggtatcattaacaacattctcgattattcaaaaattgaaactaagaacatcactttagagaatgagctcataaatcttcccgattttttagcagataccattaaaatgctctctgctcttaccattaataaaaacgtaaagcttgagcaccatttccatttagatgtagaacaaatagaaagtgatcctactcgccttcgccagattctcataaacctaattggtaatgcaattaaatttaccgcccagggaaccattagtattctagttaaacaatcccccgatgatcaaaaaggaaacatcctatttattgttcgagatacgggtattggaattccagccgacaaatttgaactcctttttaaagaattttctcaagttgatgctgatatcaatcgtaagtatggtggaacgggcttgggtttagctattaccaaaaagcttgtcgaaaatatgggaggaaatatttgggtagaaagtaaagaggggcagggaaccgaattctactttaccattcaatccacaaaaattggctatcccgataaagaagctaccctccagaatgtaaattcggcatctaaaacacgtacagatttaaaagtcctaatagtcgaggataacgtcataaatcaaaaagtagctcaaaaactactcaaacgtttaggatacaaatcaactatagcagaaaatggcttagtagctattaatatggttcagaaaattcctacgatctaa

SEQ ID NO: 18598 - protein, 245 aa, Unknown
  Obtained from environmental sample
  DOMAIN (62)...(176): Histidine kinase-, DNA gyrase B-, and HSP90-like ATPase
  misc_feature (1)..(245): Xaa is any amino acid
MGIINNILDYSKIETKNITLENELINLPDFLADTIKMLSALTINKNVKLEHHFHLDVEQIESDPTRLRQILINLIGNAIKFTAQGTISILVKQSPDDQKGNILFIVRDTGIGIPADKFELLFKEFSQVDADINRKYGGTGLGLAITKKLVENMGGNIWVESKEGQGTEFYFTIQSTKIGYPDKEATLQNVNSASKTRTDLKVLIVEDNVINQKVAQKLLKRLGYKSTIAENGLVAINMVQKIPTI

SEQ ID NO: 18599 - DNA, 744 bp, Unknown
  Obtained from environmental sample
  misc_feature (1)..(744): n is a, c, g, or t
ttggggtttaaaactatggcaaattttatggagagtgttaaaaattcaggattagaaggatttctaatttattttcaattaaagatgggtattgtgaagaacatttccctaagtgaattagcataccctgttcatttgcgaccaaacacctctgatagctctacttttaagcaaatttttataaggcgagagtatgatattcaagttggatttaaaccgaaagtgatttttgatattggagcgaacataggattagctgctatttatttttctaacagattcagtgaggcaaaaattatctccattgaaccagccagtgataattttgaaatgatgatgaaaaacatagcaccctataagaatattaatgcgttgcattctgctatatggaatgaggataaaaacttaaaagttgttgataagggattaggagcatggggttacactgttgaggaggctacactagaggattctgattattttagcgcattctctattaaaagtataatggagaaatttaatgtagacaagattgatattttaaaaatggacattgagggatctgaaaagattgttttttcacaaaattatgagtactggcttccaagaataagagtgcttgtggttgacatacttgactggataaatccaggatgttcggacatggttttaaatgccttgtctacctataattctcttgagaaaggcgggagaaaatcatattttattaaccaggattcttag

SEQ ID NO: 18600 - protein, 247 aa, Unknown
  Obtained from environmental sample
  misc_feature (1)..(247): Xaa is any amino acid
MGFKTMANFMESVKNSGLEGFLIYFQLKMGIVKNISLSELAYPVHLRPNTSDSSTFKQIFIRREYDIQVGFKPKVIFDIGANIGLAAIYFSNRFSEAKIISIEPASDNFEMMMKNIAPYKNINALHSAIWNEDKNLKVVDKGLGAWGYTVEEATLEDSDYFSAFSIKSIMEKFNVDKIDILKMDIEGSEKIVFSQNYEYWLPRIRVLVVDILDWINPGCSDMVLNALSTYNSLEKGGRKSYFINQDS

SEQ ID NO: 18601 - DNA, 807 bp, Unknown
  Obtained from environmental sample
  misc_feature (1)..(807): n is a, c, g, or t
atgaacttatgtgagaacatgtatcagggttataaaaaagcacaaagtgatgacatgcgtgaattgacaggatattcaaattggaacaccaattttgcatctgaaactatagatcanatatcaaaactcctaagatactacccgcaaacccatagtgcattgagacaactttttactttttttgaacacaagcaaattattattccaagttatcgagtcttacaggacatgtttacaactgcatattctaaagagaacaagcgactagatagcttgatgaaaaacatccccagaaaaatacaaagtaaattgtcaagtttactggtaaattctggtggagttacaaaattcaatgagatcagaaatgaccaaaaagactttaagtacactgcagttcgttcagaagtaaataaagcaaatgaactaagattactatcaaagtttacaaaagaatttattcccaagttgaaattatctaaaaatgcgattaggttctattcagaaattgcttctacatatgctgcatatcgtattaaaagattgaataaaacacaacaatggctgcatttaatctgctttatttcatttagataccagcagatattggacaacctaataatcagtttcaaatatcacactaaggctttaatggatggaagcaagaattatgttcaacaagcactaattgaacatggtaacaagactgccgntaatatacctcanattgcaaaattttcagattggtttcaaacagagagaaggatagatgaaaaacagttagtcaaaaggttatacattcttctgtag

SEQ ID NO: 18602 - protein, 268 aa, Unknown
  Obtained from environmental sample
  misc_feature (1)..(268): Xaa is any amino acid
MNLCENMYQGYKKAQSDDMRELTGYSNWNTNFASETIDXISKLLRYYPQTHSALRQLFTFFEHKQIIIPSYRVLQDMFTTAYSKENKRLDSLMKNIPRKIQSKLSSLLVNSGGVTKFNEIRNDQKDFKYTAVRSEVNKANELRLLSKFTKEFIPKLKLSKNAIRFYSEIASTYAAYRIKRLNKTQQWLHLICFISFRYQQILDNLIISFKYHTKALMDGSKNYVQQALIEHGNKTAXNIPXIAKFSDWFQTERRIDEKQLVKRLYILL

SEQ ID NO: 18603 - DNA, 717 bp, Unknown
  Obtained from environmental sample
  misc_feature (1)..(717): n is a, c, g, or t
ttgaactttgttgctcttgattcaataggattggattatgttcccagtataaaaaatgttaaagatgcagcaggtgaattatattcaattggagaaactaaagactatcaaggcattttaaaaccaaaagcttcaatagatgtagacttaataaaagatcaaaaacgaggaattttaagaatactactttcattgatcttacaggaaaacacccaaagcattatcattcgaaaactcaattcacatgctaggtattccagattaagagctgcgctttatgagtacaacaatatatttaaatctattcatgtactgaatttgattgatgacattcaactacgcaaggcaattcgaacagctaggaatagaaccgaagcttaccatcaattacaaagccaaataagaaatatttttaaaggtgttttcaaaggcaaaagaattattgacaacagaatcagtgctcatgcatcaagactaatagcaaattgcatcattgcatacaacagtatgattttggataagatatttgagaaattgatgaaagaaggggtatctcaggaagatttagatcggtttgcaagaatttcaccaatagcttgggctcatattttacttacaggcaaatataaatttaagaataaaaaaggccatatagatgtttcaaaactattaattgttctagaatcaacagtgaaggaacagttttattcaagttaa

SEQ ID NO: 18604 - protein, 238 aa, Unknown
  Obtained from environmental sample
  misc_feature (1)..(238): Xaa is any amino acid
MNFVALDSIGLDYVPSIKNVKDAAGELYSIGETKDYQGILKPKASIDVDLIKDQKRGILRILLSLILQENTQSIIIRKLNSHARYSRLRAALYEYNNIFKSIHVLNLIDDIQLRKAIRTARNRTEAYHQLQSQIRNIFKGVFKGKRIIDNRISAHASRLIANCIIAYNSMILDKIFEKLMKEGVSQEDLDRFARISPIAWAHILLTGKYKFKNKKGHIDVSKLLIVLESTVKEQFYSS

SEQ ID NO: 18605 - DNA, 381 bp, Unknown
  Obtained from environmental sample
  misc_feature (1)..(381): n is a, c, g, or t
atgactgatataagagatgattctgatttaaaaacgatggtttattcattctatgataaggtgcaaaaggatgaacgattaggatatatttttaatgattatgcttttatagattgggatacacacttaccaaagatggttgatttctggtctaatattgtttttcgaacggggcgttatagtgggcgaccttttatgaagcatatctcgttgcctattcaaagaaatgattttaatatttggtatggtttatttgtagaaaccgtagacgagcactttgttggcgagaaagcagattttgtgaagaaaatggcatggaaaattgcaaatacctttacaattaatctagaagctgctggtaagttcgagcagaaaagctaa

SEQ ID NO: 18606 - protein, 126 aa, Unknown
  Obtained from environmental sample
  misc_feature (1)..(126): Xaa is any amino acid
MTDIRDDSDLKTMVYSFYDKVQKDERLGYIFNDYAFIDWDTHLPKMVDFWSNIVFRTGRYSGRPFMKHISLPIQRNDFNIWYGLFVETVDEHFVGEKADFVKKMAWKIANTFTINLEAAGKFEQKS

SEQ ID NO: 18607 - DNA, 495 bp, Unknown
  Obtained from environmental sample
  misc_feature (1)..(495): n is a, c, g, or t
atgcatggattgcattcaattttttcgctcttgtttttatgtactctttcggcaaatagcgcaaacctccagattcatccaccaaccgaaattggggtccaattcctcatctcgggccaagtcgagacgggggaaaacagcttctatttcgacctgcggacttctggattcaatcaccctggcgggtggctagatctggttgggtactatgatcccgccgagatcgagatcgtcgaatttattttagataccgagtttcctgggggtgttacggctgagatgtttggcactgacgggggagagattcgcattcggttgtatgcgaatgggcctacaacttttcccgcgaggctggtcgggtcgggtatcctgacaattctcgttgacgttacccatcttgaaatggatgattctatcgaatccatgggtattgaacttcatgaaccccattcatccaggcgtgcctccaatttgcgaaacaaccaggcgcgctga

SEQ ID NO: 18608 - protein, 164 aa, Unknown
  Obtained from environmental sample
  SIGNAL (1)...(18)
  misc_feature (1)..(164): Xaa is any amino acid
MHGLHSIFSLLFLCTLSANSANLQIHPPTEIGVQFLISGQVETGENSFYFDLRTSGFNHPGGWLDLVGYYDPAEIEIVEFILDTEFPGGVTAEMFGTDGGEIRIRLYANGPTTFPARLVGSGILTILVDVTHLEMDDSIESMGIELHEPHSSRRASNLRNNQAR

SEQ ID NO: 18609 - DNA, 510 bp, Unknown
  Obtained from environmental sample
  misc_feature (1)..(510): n is a, c, g, or t
atgttcaagaatgacctgtttgccttcaatttcaaaaccggcaaatcggaacccatcacccgcgacggcaaatggaacgccatcatcaacggcggcaccgactgggtatatgaagaagagtttgcctttacccgggcctttttctggtctgcagacagcaagaaagtagcctattaccgctttgatgagagccacgtcaaggagttttccatgaccatgtccggcgaactttacccggaagaatacaaattcaaataccccaaagccggtgaagcaaacgctttcatcgacctgtacatctacaacattggaacgggtaaaaaagttaaagtggacatcggggcggagaaagaccagtacattccccgcatcaagtggaccaagaacccggacaaactggctgtaatgcgtatgaatcgcttgcaaaaccaggtagaagtcctgatggtcaatgcttctgacggctcttcaaaagtgatcctgaccgaaaaggaaaattacttatgttga

SEQ ID NO: 18610 - protein, 169 aa, Unknown
  Obtained from environmental sample
  misc_feature (1)..(169): Xaa is any amino acid
MFKNDLFAFNFKTGKSEPITRDGKWNAIINGGTDWVYEEEFAFTRAFFWSADSKKVAYYRFDESHVKEFSMTMSGELYPEEYKFKYPKAGEANAFIDLYIYNIGTGKKVKVDIGAEKDQYIPRIKWTKNPDKLAVMRMNRLQNQVEVLMVNASDGSSKVILTEKENYLC

SEQ ID NO: 18611 - DNA, 882 bp, Unknown
  Obtained from environmental sample
  misc_feature (1)..(882): n is a, c, g, or t
atgctaaactcaataaaaataattaaaaataggtctgatatcggagctggaactcgcggttctgatatgggaattgatgcgatagaaattgctgcaataaataagaataacaattattttgatcagtttgattttatagatgtgtcaacagcaaacgaatctatttataacaaagtaaaaaattcttttgcaaaacggattgattgtgtgttaatgcaatgtaaacgacttagcaatcacgtaaaagttactttacaagaaaaaacatttccgattgtgttgtctggagaccattcctctgctttaggtacaattagcggtgtaaaagcggcctatccaaaagaaactgttggagtagtttggattgatgcgcatgcagatattcattcaccatatacatctccatctggaaatatacacggaatgccattggcagctgctttatctgaagataatcttgattttcaaataaacgaagtatctagacaaaccgcagatttgtgggagcgaatgaaaaatattgggattcatggacctaaagttactgcagaaaatgtggtgtattttggagttagagatactgaagatccagaggaaaagcaaattaaaaaccttaaaataaaaaattatacagtttctgaaactcgttttagaggtttagaaaaatgtgtgaatgaagctctagaaaaactgtctaattgcgatgtgatttacatttcttttgatgtagattctatggattgtgatatggtttcttacggaacgggaactcccgtctctaaagggtttgatcaacaagaaatgacgcaaataatgaatcagattattgaaacaaaaaaagtagtttgtgtagaagttgttgacgtaaatcgttgttanntn

SEQ ID NO: 18612 - protein, 294 aa, Unknown
  Obtained from environmental sample
  DOMAIN (1)...(293): Arginase family
  misc_feature (1)..(294): Xaa is any amino acid
MLNSIKIIKNRSDIGAGTRGSDMGIDAIEIAAINKNNNYFDQFDFIDVSTANESIYNKVKNSFAKRIDCVLMQCKRLSNHVKVTLQEKTFPIVLSGDHSSALGTISGVKAAYPKETVGVVWIDAHADIHSPYTSPSGNIHGMPLAAALSEDNLDFQINEVSRQTADLWERMKNIGIHGPKVTAENVVYFGVRDTEDPEEKQIKNLKIKNYTVSETRFRGLEKCVNEALEKLSNCDVIYISFDVDSMDCDMVSYGTGTPVSKGFDQQEMTQIMNQIIETKKVVCVEVVDVNRCXX

SEQ ID NO: 18613 - DNA, 456 bp, Unknown
  Obtained from environmental sample
  misc_feature (1)..(456): n is a, c, g, or t
atggtatttgttgagcttaatgaaaaaactaataaagtaatccttacaatttcagatggtgaatatgaagcactggatcaattaacatgtcaatggttgatgcatagccgagatttacaaattttgggacttaattttggtgagttgaagtctttccaatccaaactaaaccagaacagtaacaatagagaaataaaattagaacttaattttcaagattggaaggtgttgtacataataatttcagcaaggttaagtcttttggaaacagattttgaaacaatcttaagcaatgagagggatagtgtctctaatttcttgtttcacttttcagaaaaaaatgaggaggcattaaaagatattttgaaatatccaaataggncaaaaaaaatgaacatgacatttaagaaggagcattttaagatactcttcaagatttttaaaagtttgtattga

SEQ ID NO: 18614 - protein, 151 aa, Unknown
  Obtained from environmental sample
  misc_feature (1)..(151): Xaa is any amino acid
MVFVELNEKTNKVILTISDGEYEALDQLTCQWLMHSRDLQILGLNFGELKSFQSKLNQNSNNREIKLELNFQDWKVLYIIISARLSLLETDFETILSNERDSVSNFLFHFSEKNEEALKDILKYPNRXKKMNMTFKKEHFKILFKIFKSLY

SEQ ID NO: 18615 - DNA, 807 bp, Unknown
  Obtained from environmental sample
  misc_feature (1)..(807): n is a, c, g, or t
gtgttgcaaaatgccaaagagatttctgaaaaaggcatcaaagaaattgtgttaactggagtaaatattggagattacggaaaaggtgaattcggaaataaaaaacacgaacatacttttttagaattggtcaaagagttggataaagtagacggaattcatcgtttgcgaatttcatctatagaaccaaatctcttaaaagacgaaacgattgattttgttgcaaaatccaacacctttgttccgcattttcatattccgttacaatctggtagcgacgaattgttaaagaaaatgaaacgtcgttatttacgtcaaacgtatacaaacagagttgaaaaaataaaagaagtgatgccaaatgcttgtattggcgttgatgttattgttggttttcctggagaaacagatcaattatttctagaaacttacaactatttaaacgaattagacatttcgtatttacacgtttttacctattctgaaagaccaaatacagaagctgtaactttggatggaattgttcctaaaaaagtacgtgcaaaacgcagtaaaatgttgcgtggtttatcggttaaaaaacgcagagcattttacgaaagtcagttaggaaacactacaaaagtattgtttgaaagcgaaaacaaagaagggtatatcaacggatttacagagaattacgtaaaagtaaaatcaccttggaatcctgcattggttaataccattcacgaaattgctttaacaactatcgatgaagatggtttggttcgatttgattttgtaaaagaaaaagcagcattaatttaa

SEQ ID NO: 18616 - protein, 268 aa, Unknown
  Obtained from environmental sample
  misc_feature (1)..(268): Xaa is any amino acid
MLQNAKEISEKGIKEIVLTGVNIGDYGKGEFGNKKHEHTFLELVKELDKVDGIHRLRISSIEPNLLKDETIDFVAKSNTFVPHFHIPLQSGSDELLKKMKRRYLRQTYTNRVEKIKEVMPNACIGVDVIVGFPGETDQLFLETYNYLNELDISYLHVFTYSERPNTEAVTLDGIVPKKVRAKRSKMLRGLSVKKRRAFYESQLGNTTKVLFESENKEGYINGFTENYVKVKSPWNPALVNTIHEIALTTIDEDGLVRFDFVKEKAALI

SEQ ID NO: 18617 - DNA, 546 bp, Unknown
  Obtained from environmental sample
  misc_feature (1)..(546): n is a, c, g, or t
atgatntctaaagaaggtgaagtttaccctaattacagttaccctaaaatttatgggtataatgtggagggtgatgaggaactcaaaaagaaactatttccaaagtttagttttctagaatcttttcactggtggtttcattacaaagttgggccaaataaagttagaagaaggctctctcctgatcacctctttaaaaatgtttccaaagagccaaaaaagctaactaattattatatactaagtgcctaccatggaagtgagattgaaactgtatctctagacccagtgatttcggctagtataactaccgatattattgaaacagagctctctttctttctatcacacctaagctttcataggttgaatgcaaaagtaaataatgtgtccccgatatttttaaaagaaaaaatattagaaaggtggaaagcgcaattggaaacaatcttcgaaaacgtggaatgtacgttagtaaaaataccgattggaatggaacactctaagtttacaaaagatatggtagatttagttttaaagaattaa

SEQ ID NO: 18618 - protein, 181 aa, Unknown
  Obtained from environmental sample
  misc_feature (1)..(181): Xaa is any amino acid
MXSKEGEVYPNYSYPKIYGYNVEGDEELKKKLFPKFSFLESFHWWFHYKVGPNKVRRRLSPDHLFKNVSKEPKKLTNYYILSAYHGSEIETVSLDPVISASITTDIIETELSFFLSHLSFHRLNAKVNNVSPIFLKEKILERWKAQLETIFENVECTLVKIPIGMEHSKFTKDMVDLVLKN

SEQ ID NO: 18619 - DNA, 321 bp, Unknown
  Obtained from environmental sample
  misc_feature (1)..(321): n is a, c, g, or t
atgcagtttaaagctcaaaatacccaggcaatagcaccttatgctgagattaaagagcttacaaaaactgatgtaaaggtagaagaaagcatcaattctccgtggagagtgttactctttgatgatgacattcacacttttgacgaagtaattgagcaaataatgaaagcgactggttgtaattacaacaaagctcaggagcttacccttcaagtacacaacgaagggaaagcggtagtttatgaaggcgactttgtcgagtgccttcaaattgatagtgttcttaaagaaattcaactcgttaccgaaataagaggttaa

SEQ ID NO: 18620 - protein, 106 aa, Unknown
  Obtained from environmental sample
  DOMAIN (28)...(101): ATP-dependent Clp protease adaptor protein ClpS
  misc_feature (1)..(106): Xaa is any amino acid
MQFKAQNTQAIAPYAEIKELTKTDVKVEESINSPWRVLLFDDDIHTFDEVIEQIMKATGCNYNKAQELTLQVHNEGKAVVYEGDFVECLQIDSVLKEIQLVTEIRG

SEQ ID NO: 18621 - DNA, 405 bp, Unknown
  Obtained from environmental sample
  misc_feature (1)..(405): n is a, c, g, or t
atgaagaaaaacacttcagataacactgggaaacgtccagatattgccatctttaatgaagaaggtgtagccgttattatcgaattcaaagctccagatgtggaaatggtgaatcatattggagatttaaatgagtacgctcaattaattgttgccaaatctaaaggtaaaatcaaaagagtatatgcttatcttattggtggaagtctcaatccgaatagactccgtggttttaagaaattctcgaataataagggctggttccagacttccgatattgatgagccagaaactggaataactattggccagcagtattctgaaatcttattctatgatcatgttgtcgatagagcagatgtaagattggcagcatttaaagatcgcttaaaacttgacctttga

SEQ ID NO: 18622 - protein, 134 aa, Unknown
  Obtained from environmental sample
  misc_feature (1)..(134): Xaa is any amino acid
MKKNTSDNTGKRPDIAIFNEEGVAVIIEFKAPDVEMVNHIGDLNEYAQLIVAKSKGKIKRVYAYLIGGSLNPNRLRGFKKFSNNKGWFQTSDIDEPETGITIGQQYSEILFYDHVVDRADVRLAAFKDRLKLDL

SEQ ID NO: 18623 - DNA, 468 bp, Unknown
  Obtained from environmental sample
  misc_feature (1)..(468): n is a, c, g, or t
gtgcgcgctggcacttatttcaatattttggagtacgtggatatcctatcatgcattcttcttaacaggcattattcatacatgacttctaattacggtatgtctccgtttaatgaccccgaagcaattcctattggattatcaattttccatactgcttttaacatagtaaatgccttactacttattggctttgtaggctttattgctaaattagtcatcaaaatggtaccctcaaaaggtgatgacgaagagttccacctagagtatattggcactggaatgatggatactgcagaactttctcttggggaagcggctaaagaaattgcaaaatttggccaaatcaccaaacgaatgaatggctttttaagagacctcatacaggttgataaatctaaaaaacaaagaaagtatctttctaaaattaaaaaatacgaagacattactgatagtataagaaactga

SEQ ID NO: 18624 - protein, 155 aa, Unknown
  Obtained from environmental sample
  misc_feature (1)..(155): Xaa is any amino acid
MRAGTYFNILEYVDILSCILLNRHYSYMTSNYGMSPFNDPEAIPIGLSIFHTAFNIVNALLLIGFVGFIAKLVIKMVPSKGDDEEFHLEYIGTGMMDTAELSLGEAAKEIAKFGQITKRMNGFLRDLIQVDKSKKQRKYLSKIKKYEDITDSIRN

SEQ ID NO: 18625 - DNA, 522 bp, Unknown
  Obtained from environmental sample
  misc_feature (1)..(522): n is a, c, g, or t
ttggtccaaatattgggtggaccaacagattggatttactttgatggcactgttgttttaaaacagattatctttgtccgcatttgttgggataaaattatggaaaagagcatgttggagcagaatatcaacgacgaaagaggtcaagggggaaatccaatttcctacaggcctgagattcgtataatagctgaggattatgaaattccgcagttaaataggaaaaggagaatatcgatactcctgcccaaaagctatgggtctagcgaaaaaagttacccagtactgtatttacatgatggtcaaaatttatttgatggcggcgggcctttcgggaactgggccattgatganaaactttcggatttggcaagcaagggaatgggagatgttattgtagtggccatagaccatgcagaggaagaaagggtattggaattttctccatttaaggaaaccaaaatgggggcaaagggggacggtaaaaaagtacctttaaagttcttggtgggaaacccctaa

SEQ ID NO: 18626 - protein, 173 aa, Unknown
  Obtained from environmental sample
  misc_feature (1)..(173): Xaa is any amino acid
MVQILGGPTDWIYFDGTVVLKQIIFVRICWDKIMEKSMLEQNINDERGQGGNPISYRPEIRIIAEDYEIPQLNRKRRISILLPKSYGSSEKSYPVLYLHDGQNLFDGGGPFGNWAIDXKLSDLASKGMGDVIVVAIDHAEEERVLEFSPFKETKMGAKGDGKKVPLKFLVGNP

SEQ ID NO: 18627 - DNA, 549 bp, Unknown
  Obtained from environmental sample
  misc_feature (1)..(549): n is a, c, g, or t
atgatcagcattgtaaagaataaagatctttttttggaaacccttatagtacctttggtacaaggggaaattttggagtcggacattgttaaattagctgaggaactacagctccctaagacactgttaacggaacaaataaaggctgaaaaaaaagaagtctccttgttttaccccgttgcccataaaagtgtaacaagggtatattgtttgggcttgggaacaaacccaacccttaaaatggtgatagacgcttttaagcgctttcttcaaatggaagccgccaaattgccttccaatttgagcattgatataagcaacggaaattttgaccctgaatttatatcattattgactgaaggcattgttagtgggttgctattggggacttacaaaaagggtttgtaccaaacatccaatttatctacggataaatgggattcagaaccattgaatttgcaattctttgttgacgaaaaatttgaagatatagtaaaaatcgcagcagacaaaggcagggccatagcagaaacccaactaaaatactaa

SEQ ID NO: 18628 - protein, 182 aa, Unknown
  Obtained from environmental sample
  misc_feature (1)..(182): Xaa is any amino acid
MISIVKNKDLFLETLIVPLVQGEILESDIVKLAEELQLPKTLLTEQIKAEKKEVSLFYPVAHKSVTRVYCLGLGTNPTLKMVIDAFKRFLQMEAAKLPSNLSIDISNGNFDPEFISLLTEGIVSGLLLGTYKKGLYQTSNLSTDKWDSEPLNLQFFVDEKFEDIVKIAADKGRAIAETQLKY

SEQ ID NO: 18629 - DNA, 696 bp, Unknown
  Obtained from environmental sample
  misc_feature (1)..(696): n is a, c, g, or t
ttgatcatcttattgcccgttttatttgcagtttttatcacgtttacgtttaagtttatcaaaagagcattgcttacatttaaacttccacatgcaaaaacattgttcttgcttgcttttttcgttcctacatttgttggtttttttacgataactccaatttattgggtaaaattaaactggatgattccttcttatattactggaattatcatcgcaggaatgtttatcagcaagaaattggtcaaagcacaaatcattacgtctatcgtatttcatgtattgattgctgcccaaattttattttatttagttcccataaaaagtgatgacacttggattggctggaaagaattagcaattgaaacaaagaaactacaggcagaatatccgaattcatttgttttttcagatgatgattataaaacatccgcagtcttgaacttttttatggatgaaaaagtgtacgcacaaaacataattggattacaggccctacaatttgattatattggagataatttatctgatttaaacgataaaaatgccttgtttatagattctgatacacgttttaaaaatgcggataaaaaagggaaaattcctgaagaactgaatggttattttgaaatatcacagaattacagccaattattatcaccttacacggactcgagccgattcttgatcccctag

SEQ ID NO: 18630 - protein, 231 aa, Unknown
  Obtained from environmental sample
  misc_feature (1)..(231): Xaa is any amino acid
MIILLPVLFAVFITFTFKFIKRALLTFKLPHAKTLFLLAFFVPTFVGFFTITPIYWVKLNWMIPSYITGIIIAGMFISKKLVKAQIITSIVFHVLIAAQILFYLVPIKSDDTWIGWKELAIETKKLQAEYPNSFVFSDDDYKTSAVLNFFMDEKVYAQNIIGLQALQFDYIGDNLSDLNDKNALFIDSDTRFKNADKKGKIPEELNGYFEISQNYSQLLSPYTDSSRFLIP

SEQ ID NO: 18631 - DNA, 435 bp, Unknown
  Obtained from environmental sample
  misc_feature (1)..(435): n is a, c, g, or t
gtgcaaaataagttaaaaaatgactatcaaagaaatcaagaagaaattattgacgagttttcgatgtttgatgattggatggaacgttatgaatacattatcgatttaggaaaatctttgcctttaattgatgctgcttacaaacttgacgaaaatttaataaaaggatgtcaatctaaagtttggttgcattctgaaattcaaaacgaaaaacttgtttttactgcagatagcgatgctattttaaccaaaggaattgttgcgttattattgcgtgttttttctaaccaaaaatcggaagctattttacaggcagacactaaatttatagatcaaattggcttgaaagaacatttaagtccaaccagagcaaacggtttagtttctatgataaagcaaataaaaatgtacgcaattgcgttacaaacaaaataa

SEQ ID NO: 18632 - protein, 144 aa, Unknown
  Obtained from environmental sample
  DOMAIN (16)...(139): Fe-S metabolism associated domain
  misc_feature (1)..(144): Xaa is any amino acid
MQNKLKNDYQRNQEEIIDEFSMFDDWMERYEYIIDLGKSLPLIDAAYKLDENLIKGCQSKVWLHSEIQNEKLVFTADSDAILTKGIVALLLRVFSNQKSEAILQADTKFIDQIGLKEHLSPTRANGLVSMIKQIKMYAIALQTK

SEQ ID NO: 18633 - DNA, 414 bp, Unknown
  Obtained from environmental sample
  misc_feature (1)..(414): n is a, c, g, or t
ttgcgttacaaacaaaataaaaaaaatcattttataaaatataaaaaaatgaacgacgtagaattagaagaaattggagataaaattgttcgagttataaaaaccatttacgacccagaaatacctgtagatatttacgaattgggtttgatttatgatgtttttgtacatgaagataatgaggttaaaatattaatgacgttaacatcacctaactgtccggttgccgaatctttaccaagagaagtagaagagaaagtggcttctttaaaagaaattatcaaagcagaagtagaaattacttttgatcccaagtggacccaagacatgatgagcgaagaagcgaagttagagcttggaatgcttaaatttaggtttccagggaaccattatcagttagcagtaatcagttga

SEQ ID NO: 18634 - protein, 137 aa, Unknown
  Obtained from environmental sample
  DOMAIN (25)...(100): Domain of unknown function DUF59
  misc_feature (1)..(137): Xaa is any amino acid
MRYKQNKKNHFIKYKKMNDVELEEIGDKIVRVIKTIYDPEIPVDIYELGLIYDVFVHEDNEVKILMTLTSPNCPVAESLPREVEEKVASLKEIIKAEVEITFDPKWTQDMMSEEAKLELGMLKFRFPGNHYQLAVIS

SEQ ID NO: 18635 - DNA, 348 bp, Unknown
  Obtained from environmental sample
  misc_feature (1)..(348): n is a, c, g, or t
gtgctggccaagctggaaatgaccgatgacgtctaccacctggtcaagaaccagcccaaggtcaccggctttctcggcagcagcggcaagccgcaggcgatcagcgaatccgaagccgcccgcattctcaacaccaaggaagaagcggccaacgctccgaaagaacggatcacggtcagctacgaaattggcgacgaggtcaaggtcaagagcggcccgttcaacagcttcaacggcattgtcgaggaactcgatttcgacaagaacaaggtcaaggtttcggtgtcgatctttggtcgcgcaaccccggtcgaactggactttggcgaagtcgacctgattagctag

SEQ ID NO: 18636 - protein, 115 aa, Unknown
  Obtained from environmental sample
  DOMAIN (61)...(98): KOW motif
  misc_feature (1)..(115): Xaa is any amino acid
MLAKLEMTDDVYHLVKNQPKVTGFLGSSGKPQAISESEAARILNTKEEAANAPKERITVSYEIGDEVKVKSGPFNSFNGIVEELDFDKNKVKVSVSIFGRATPVELDFGEVDLIS

SEQ ID NO: 18637 - DNA, 363 bp, Unknown
  Obtained from environmental sample
  misc_feature (1)..(363): n is a, c, g, or t
atgttacaaataacaaaactaggtggacaaggtgttaaagatggattcttatttactacagcaagcccttgtgaattatgttcaaaaaaagcttatcaattaggaataagaacgattttctatattgacccatatcctggaatttcacaagatcaaatattacaaggtggctcaattagtacaaggnctataatgattcccttctctggtgcaattggaaatgcttacaataaactctataaaacttttatgtcctataaagatgaagtttctatgacacttgaaataacatcgaaaaacaaatttggaattcaattcaaaggaatattaagaaactcaaaagtaacgatgacaatattctaa

SEQ ID NO: 18638 - protein, 120 aa, Unknown
  Obtained from environmental sample
  misc_feature (1)..(120): Xaa is any amino acid
MLQITKLGGQGVKDGFLFTTASPCELCSKKAYQLGIRTIFYIDPYPGISQDQILQGGSISTRXIMIPFSGAIGNAYNKLYKTFMSYKDEVSMTLEITSKNKFGIQFKGILRNSKVTMTIF

SEQ ID NO: 18639 - DNA, 375 bp, Unknown
  Obtained from environmental sample
  misc_feature (1)..(375): n is a, c, g, or t
atgccgggagtttgggatggtgactccagaaatgttttctcactaaatgaaagaaccgaaaaggaaaatgaaatcttcgagtatgtgaaaagcatcactcaatggaggaagaatgccatcgcaattcatgaaggaataggtcttcatttcattcctgaagatgatgtatacatatatttcagaattcacaaagagcaaaccgtaatggttgttatgaataataacagagaagataaagttattgatagaaatcgtttagctgaaattctgaatcaattttccaccggaataaatattttaaccaacaaaaaaattgagcttggaaaagattttagtgttgatgctaaaacgactagtatttgggaattgaagtag

SEQ ID NO: 18640 - protein, 124 aa, Unknown
  Obtained from environmental sample
  misc_feature (1)..(124): Xaa is any amino acid
MPGVWDGDSRNVFSLNERTEKENEIFEYVKSITQWRKNAIAIHEGIGLHFIPEDDVYIYFRIHKEQTVMVVMNNNREDKVIDRNRLAEILNQFSTGINILTNKKIELGKDFSVDAKTTSIWELK

SEQ ID NO: 18641 - DNA, 354 bp, Unknown
  Obtained from environmental sample
  misc_feature (1)..(354): n is a, c, g, or t
gtgactgataaccaggagcctctaaaaacgctcaggactgacgctacggcaatagtgaccaaaggtaccaaggctgggagattcgtccgcctggtacgagaatcaagctacaagatgggcagaatagtctggatcgtcgagtatgttaaaaagaagcacggcgacgagtcgaatcctaggtttaacgagggcatgctgatgtgcgtatccccaccatttgaggctgcaattgctccagatactggagacaaatgtgtattaatcggtgaccaggggtatgtagacaattggaaaatgatcgttattagtgtcgaacctaccgctgaaataatgctagaagatctggataaataa

SEQ ID NO: 18642 - protein, 117 aa, Unknown
  Obtained from environmental sample
  misc_feature (1)..(117): Xaa is any amino acid
MTDNQEPLKTLRTDATAIVTKGTKAGRFVRLVRESSYKMGRIVWIVEYVKKKHGDESNPRFNEGMLMCVSPPFEAAIAPDTGDKCVLIGDQGYVDNWKMIVISVEPTAEIMLEDLDK

SEQ ID NO: 18643 - DNA, 570 bp, Unknown
  Obtained from environmental sample
  misc_feature (1)..(570): n is a, c, g, or t
atgaaatttgaagcgggtcaacatatatgctttgggcgtgaaaatgatctggaccaacccgaatactcaatttttagtggtgttgatgatgaatatcttgaagtgcttataaaagaagtaatggatggatcggtatcaaagcatctaaaaaatctcaaaccaggagaaatgttaaatgttgaagggcctctcggtttctttggtttgaataaagaaaaaatagaatcaggtagttttttatttattgccagcggcacaggtattgcaccttttcatagtatgatcaaaacaaacccaaaccttgattataagatacttcacgggattaggacctgtgatgaagcatatggcattgaatcctatgaacctaacagatatgtaaggtgtagctcccgagaaattaattgtgactttagtggtagagttaccgattacattgtacaaaacaaattcgacaaggatattatatgttatttttgcggcaattttaagatgataaaagaagccatggaccttcttgagaagaaaggtattcaaggcagtcaacttcatgcagaagtatatttttaa

SEQ ID NO: 18644 - protein, 189 aa, Unknown
  Obtained from environmental sample
  DOMAIN (1)...(69): Oxidoreductase FAD-binding domain
  misc_feature (1)..(189): Xaa is any amino acid
MKFEAGQHICFGRENDLDQPEYSIFSGVDDEYLEVLIKEVMDGSVSKHLKNLKPGEMLNVEGPLGFFGLNKEKIESGSFLFIASGTGIAPFHSMIKTNPNLDYKILHGIRTCDEAYGIESYEPNRYVRCSSREINCDFSGRVTDYIVQNKFDKDIICYFCGNFKMIKEAMDLLEKKGIQGSQLHAEVYF

SEQ ID NO: 18645 - DNA, 315 bp, Unknown
  Obtained from environmental sample
  misc_feature (1)..(315): n is a, c, g, or t
atgaagttgactgccttgaatacctttcttctcaagaaggtccatggcttcttttatcatcttaaaattgccgcaaaaataacatataatatccttgtcgaatttgttttgtacaatgtaatcggtaactctaccactaaagtcacaattaatttctcgggagctacaccttacatatctgttaggttcataggattcaatgccatatgcttcatcacaggtcctaatcccgtgaagtatcttataatcaaggtttgggtttgttttgatcatactatgaaaaggtgcaatacctgtgccgctggcaataaataa

SEQ ID NO: 18646 - protein, 104 aa, Unknown
  Obtained from environmental sample
  misc_feature (1)..(104): Xaa is any amino acid
MKLTALNTFLLKKVHGFFYHLKIAAKITYNILVEFVLYNVIGNSTTKVTINFSGATPYISVRFIGFNAICFITGPNPVKYLIIKVWVCFDHTMKRCNTCAAGNK

SEQ ID NO: 18647 - DNA, 768 bp, Unknown
  Obtained from environmental sample
  misc_feature (1)..(768): n is a, c, g, or t
ttgaagaaaaatgaatacgttaccgaatgttccgatattgatgacgtaattgtttttaagtcgggtggaaagatggtagttaacaaagtttcacccaaagtatttgtaggaaagggagttatacatgttgacgttttcaaaaaaaatgatgatcgtaccatttataatatgatttatcaaaatggtaaacgaggcaattattatgtaaaacgatttgctgttgtgggagttacccgcgacaaagaatatgaccttacaattggagctgaggagtcgaaagtaatttactttacagcgaacccaaatggcgaagccgaggttattaaagtaaacctaagggcaaaacccaaactcaaaaaactaaattttgattttgattttagtgaattagcaatcaaaggaagaaattctagaggtaatattattagtaagcattccataaaaaatgttgtccaacgcgaagagggtgtttctactcttggtgcgcgaaatatatggtacgacgacacggttcgcagattaaactctgatgaaagaggtaagtttataggtgcttttaaaggtgatgataagatccttagcattatgaataccggtgaattgaaattaactggttatgacctaactactcactttgaagactcaatggttgaggtaaccatgtttgatcttaacaaaatacttactgtagtatatcttgatagtgatcagaagagattttacgtaaaacgattccagttaagtgactcaacaagtgttaacaaatga

SEQ ID NO: 18648 - protein, 255 aa, Unknown
  Obtained from environmental sample
  misc_feature (1)..(255): Xaa is any amino acid
MKKNEYVTECSDIDDVIVFKSGGKMVVNKVSPKVFVGKGVIHVDVFKKNDDRTIYNMIYQNGKRGNYYVKRFAVVGVTRDKEYDLTIGAEESKVIYFTANPNGEAEVIKVNLRAKPKLKKLNFDFDFSELAIKGRNSRGNIISKHSIKNVVQREEGVSTLGARNIWYDDTVRRLNSDERGKFIGAFKGDDKILSIMNTGELKLTGYDLTTHFEDSMVEVTMFDLNKILTVVYLDSDQKRFYVKRFQLSDSTSVNK

SEQ ID NO: 18649 - DNA, 507 bp, Unknown
  Obtained from environmental sample
  misc_feature (1)..(507): n is a, c, g, or t
ttgaaaccaattgatgtggaagaaaattaccttgaattaagggtgattaatcttctgaaatatagacttaatagatttgcaagggcgttatctatactgctatttcctctcttatttatggtttttatcgtaaatcgatttggaaagcctagtttctccgaattgtttgaatggccaacttatgttagatggattggcgtggcactcttcatatttgatattcctgtaattctatattttcttaagaatagaatgggaaatcatcgatttattatcctagaaaaggaaattaagctcaaaacagataagaaagtcattttactaggccactcagaaacgacagttatactaatggaaagggaatggaattcccccattaaagaattatatagtgtcgtattccaagaaggagaaaaagtatcgaggaaattttttgttattattgattcaccatcaatagttgatttaataaagacaaattttcatgtagttggtcaggtttggtag

SEQ ID NO: 18650 - protein, 168 aa, Unknown
  Obtained from environmental sample
  misc_feature (1)..(168): Xaa is any amino acid
MKPIDVEENYLELRVINLLKYRLNRFARALSILLFPLLFMVFIVNRFGKPSFSELFEWPTYVRWIGVALFIFDIPVILYFLKNRMGNHRFIILEKEIKLKTDKKVILLGHSETTVILMEREWNSPIKELYSVVFQEGEKVSRKFFVIIDSPSIVDLIKTNFHVVGQVW

SEQ ID NO: 18651 - DNA, 387 bp, Unknown
  Obtained from environmental sample
  misc_feature (1)..(387): n is a, c, g, or t
gtgatagtaaacaccgatgaaccatttgagttgaaagatgtgataagggactttaagaagtttacatccaagaaaataatagaacagatagaaagcgaacctgaaagcaggagggagtggatgctgaatttgttctcctttgtaggcagaaacgacaaaaagaacaaggatttcaagttctggcaaacaggaagccatgccattgagctgcacaatgagggctttgtgtgggataaggtgaattatatccacaataaccccgtgaaggacggttttgttgaaaaggcggaagactggcggtattcctcagcctcaaattacctggaaaaagaaaatagtattctaaatgaagtgatatgcctgaagcctattttgaaaacttattga

SEQ ID NO: 18652 - protein, 128 aa, Unknown
  Obtained from environmental sample
  misc_feature (1)..(128): Xaa is any amino acid
MIVNTDEPFELKDVIRDFKKFTSKKIIEQIESEPESRREWMLNLFSFVGRNDKKNKDFKFWQTGSHAIELHNEGFVWDKVNYIHNNPVKDGFVEKAEDWRYSSASNYLEKENSILNEVICLKPILKTY

SEQ ID NO: 18653 - DNA, 735 bp, Unknown
  Obtained from environmental sample
  misc_feature (1)..(735): n is a, c, g, or t
atgtatgtgtatatgggacacctaaaatttgagcacacacagccatatgaatcttggttttggaaaaaaaatcgcatcaaccttaaaaaaggatttgtatcaaaaataaattctgatgtaaatgaacttgaattttttaacggagaaaaattaacttacgacaaactcattatcgcgacaggttctaagcccaataaatttggctggccaggtcaagatttaaatggtgttatgggaatgtatcataaacaagatttagaaaacttagaaaaatatgcgccaaataattcagcttgtaaacgtgctgtaattgttggtggtggtttaatcggaattgagttggtagaaatgttacatagcagaaatattccggttacttttttagtaagagaaccaagtttttggggaaatgtactgccaaaagaagaatctgcaatcatcaataaagaaattacagacaatcatatcgatttgcgattgggagtcaatttaaaagaaattattgctgatgaaaacggaaatgtaaaatcggtcattattgctgaaaccaatgaagaaatagcatgtaatgtagttggattaaccgctggagtttcgccaaatgttgattttcttaaaaactctgagttagaaattggtcgtggtgtaaaagtgaatcgcttcttagaaaccaatattgaaaatatttatgccattggtgattgtgcagaacaacacgaagcaatcggacaatga

SEQ ID NO: 18654 - protein, 244 aa, Unknown
  Obtained from environmental sample
  DOMAIN (1)...(244): Pyridine nucleotide-disulphide oxidoreductase
  misc_feature (1)..(244): Xaa is any amino acid
MYVYMGHLKFEHTQPYESWFWKKNRINLKKGFVSKINSDVNELEFFNGEKLTYDKLIIATGSKPNKFGWPGQDLNGVMGMYHKQDLENLEKYAPNNSACKRAVIVGGGLIGIELVEMLHSRNIPVTFLVREPSFWGNVLPKEESAIINKEITDNHIDLRLGVNLKEIIADENGNVKSVIIAETNEEIACNVVGLTAGVSPNVDFLKNSELEIGRGVKVNRFLETNIENIYAIGDCAEQHEAIGQ

SEQ ID NO: 18655 - DNA, 381 bp, Unknown
  Obtained from environmental sample
  misc_feature (1)..(381): n is a, c, g, or t
gtgaactccggatctgaggcagtgggtttcagggataaattcgaggcaaaacaccggagcgccgatggccattttgtccgatccaaggcagaaatgctcatcgataactggttatatatggctgaaatagtccacgcatatgaaaggaaacttccgatagaggaagatgtctattcggatttctatattccgacaggcaaagtttacattgaatattggggttacgaaaacgaccagaagtatattgccaggaagcaaaagaagattgacctttataataaatatggcttcaatctgatagagctgcaagacaaggaagttcaaaatcttgatgacatactgccaagattgttgcttaagtatggggttcaggcgtattag

SEQ ID NO: 18656 - protein, 126 aa, Unknown
  Obtained from environmental sample
  misc_feature (1)..(126): Xaa is any amino acid
MNSGSEAVGFRDKFEAKHRSADGHFVRSKAEMLIDNWLYMAEIVHAYERKLPIEEDVYSDFYIPTGKVYIEYWGYENDQKYIARKQKKIDLYNKYGFNLIELQDKEVQNLDDILPRLLLKYGVQAY

SEQ ID NO: 18657 - DNA, 312 bp, Unknown
  Obtained from environmental sample
  misc_feature (1)..(312): n is a, c, g, or t
gtgaagttttacaaacagagaacaaagtatgttatttctagacaattgttaaaatctagaacaagcattggagcaaatgtacatgaagctccaaatgcagaaagcaaagcagattttattcataacataaaaatagcaacgaaagaattagaagaaacaaagtatcagttaattctttgcgacaaatctaaaagttatccttcaaataccattctacacgacaacgtacctgaatgggggttgaattcatatacaatactaagcccaggtttaactctcgtaatcagaagtgactccttgataacttcttaa

SEQ ID NO: 18658 - protein, 103 aa, Unknown
  Obtained from environmental sample
  misc_feature (1)..(103): Xaa is any amino acid
MKFYKQRTKYVISRQLLKSRTSIGANVHEAPNAESKADFIHNIKIATKELEETKYQLILCDKSKSYPSNTILHDNVPEWGLNSYTILSPGLTLVIRSDSLITS

SEQ ID NO: 18659 - DNA, 549 bp, Unknown
  Obtained from environmental sample
  misc_feature (1)..(549): n is a, c, g, or t
atgagcaaagggaaagcccataagagatttgagtttgggtcaaaagtctcgattacattaacaaagaatagtggagtagcagtaggagcatataattttgaagaaaatatttatgatgggcatactttaccagaagtattagaacaaacaaaaagactaactggaaaagagcccaaagttgccatagttgatagaggttatcgcggagtatcaactgttgggaatactgtaattataagaccgaagaacccaaagaaaaatgctactccatatgaaaaaactaaagcaagaaaacgttttagaagaagagctggaatagaaccaataataggtcacttaaaacaagattttaggttatctcgcaattacttaaaaggaactaatggcgatatggctaatgttatactcgctgcaactgcttacaacttaaaaaagtggatgaatatagaatctaaaaaattaactctttttatatattccaaaatctcaaacatttttgaagttattaataatcataaaaataaaaaagcttatctcttggctttttaa

SEQ ID NO: 18660 - protein, 182 aa, Unknown
  Obtained from environmental sample
  DOMAIN (1)...(143): Transposase DDE domain
  misc_feature (1)..(182): Xaa is any amino acid
MSKGKAHKRFEFGSKVSITLTKNSGVAVGAYNFEENIYDGHTLPEVLEQTKRLTGKEPKVAIVDRGYRGVSTVGNTVIIRPKNPKKNATPYEKTKARKRFRRRAGIEPIIGHLKQDFRLSRNYLKGTNGDMANVILAATAYNLKKWMNIESKKLTLFIYSKISNIFEVINNHKNKKAYLLAF

SEQ ID NO: 18661 - DNA, 687 bp, Unknown
  Obtained from environmental sample
  misc_feature (1)..(687): n is a, c, g, or t
atggatgccgatttacaagacaatccagaagaaatccctgaattatacgatttaattatcaacaaaaattacgatttaatttctggttggaaaaagaaacgttacgattcaaaaattagaaaaaacattccatcaaaattatttaatgctgctgctagaaaaacttctggattaaaattacacgattttaactgcggattaaaagcctataaaaacgaagttgtaaaaagcgtaaaagttagcggagaaatgcatcgttatattccggttttagctaaaaacgaaggttttacgaaaattggagaaaaagtagtacaacatcaagcaagaaaatacggcgtcacaaaatttggcatgagccgttttataaacggatttctagatttaattaccatttcttttctatcaaaattcggaaaacgaccaatgcacatattcggactttggggtacgttaatgtttatttgcggatttatgtctgcagcctttattggagttttaaaaatctataaattatctaccggattaaaaacgatcttagtcacagacaatccttggttttacattgcattaacagccatgattttaggaacacaattattcttggctggttttcttggagagcttttaattaaaacaaaaagccacgaaaagcattacacaattaaagaaaccttaaatatctaa

SEQ ID NO: 18662 - protein, 228 aa, Unknown
  Obtained from environmental sample
  misc_feature (1)..(228): Xaa is any amino acid
MDADLQDNPEEIPELYDLIINKNYDLISGWKKKRYDSKIRKNIPSKLFNAAARKTSGLKLHDFNCGLKAYKNEVVKSVKVSGEMHRYIPVLAKNEGFTKIGEKVVQHQARKYGVTKFGMSRFINGFLDLITISFLSKFGKRPMHIFGLWGTLMFICGFMSAAFIGVLKIYKLSTGLKTILVTDNPWFYIALTAMILGTQLFLAGFLGELLIKTKSHEKHYTIKETLNI

SEQ ID NO: 18663 - DNA, 945 bp, Unknown
  Obtained from environmental sample
  misc_feature (1)..(945): n is a, c, g, or t
atggttgctgatgacatggaattgattgataagatttatccaaagaatccgggaaaagttccacacacatacaatcctgttggttcgtatcgcagagattttgagattgatagcacttggaccgataaagaaattttcttgcatattggcgcgttaaaatctggcggatttgtttggttaaatggtagatatattggctattctcaaggaagcaaattaccgagtgaattcaacatcaccaaagctgctaaaaaaggaaaaaacacgattgcaattcagatttttagatggacagacggaagttatttagaagcacaagatttttggcgaattagcggaattgaacgcgatgtttatatatatgcacaaccaaaagttcgaattcaagatttagacattcaagcaactttagacaacacatttacagaaggttttttaaatgtaagcgtagattttcaaaatcatgaaaaatataataaagagctttttgttttatatcaattgtttgatgaagacaattacctaattgcagaacagcaaaataacaccgctgtttctccaaaatttcctaaaacttcaagtttttctaccaatattattcgtccaaaaaaatggagcgcagaacatccaaacttatatacaatccgaattacaaccaaagacgctcgtcaaagtttaattgaagttacagaacgcaaaattggttttagaaaagtagaaatcaaaaacggattgttgttggtaaacggacaacgaattacgttaaaaggtgtaaatgcacatgaagcaagccctgaaacaggtcatgtaatgaatgaagaactgatgttaaaagacatcagaatgtggaaagaaaataatatcaacgctgttcgtttaagtcattatccaagagcgagtcgtttttatgaaatggtgggatttggatggaatctatgttgttga

SEQ ID NO: 18664 - protein, 314 aa, Unknown
  Obtained from environmental sample
  DOMAIN (126)...(237): Glycosyl hydrolases family 2, immunoglobulin-like beta-sandwich domain
  misc_feature (1)..(314): Xaa is any amino acid
MVADDMELIDKIYPKNPGKVPHTYNPVGSYRRDFEIDSTWTDKEIFLHIGALKSGGFVWLNGRYIGYSQGSKLPSEFNITKAAKKGKNTIAIQIFRWTDGSYLEAQDFWRISGIERDVYIYAQPKVRIQDLDIQATLDNTFTEGFLNVSVDFQNHEKYNKELFVLYQLFDEDNYLIAEQQNNTAVSPKFPKTSSFSTNIIRPKKWSAEHPNLYTIRITTKDARQSLIEVTERKIGFRKVEIKNGLLLVNGQRITLKGVNAHEASPETGHVMNEELMLKDIRMWKENNINAVRLSHYPRASRFYEMVGFGWNLCC

SEQ ID NO: 18665 - DNA, 504 bp, Unknown
  Obtained from environmental sample
  misc_feature (1)..(504): n is a, c, g, or t
atgaattactacgaactaatatatttaaagaacgtcttaaaacacaatttgataggtgctcaaattgtattgtctaccacaagattcaaaaatctaatagagtttcatgtggaatcagagcgggaacgagtgaagctagtttttagtactgctcctggaaatattgcgttatttttggatgtgtattctcaacctaaacagaaaaatagactaaccttttttgaagaaattgacggcctaaatatttatgatgttagtattgcagaaacagaccgaatactcacaatagttattgagaatgattatgaattagtctttaagctattcagtaatcaagcgaatgtatttctcacaaaaaaggatgtttttgtagaagcttttaaaggaaattcaaatgatttgccgagttcaaagcaaatcacactttataaagaaccaagttctgatttaagtattaaggaaaaaatcacttttataatcctttacttcctagagcacatttag

SEQ ID NO: 18666 - protein, 167 aa, Unknown
  Obtained from environmental sample
  misc_feature (1)..(167): Xaa is any amino acid
MNYYELIYLKNVLKHNLIGAQIVLSTTRFKNLIEFHVESERERVKLVFSTAPGNIALFLDVYSQPKQKNRLTFFEEIDGLNIYDVSIAETDRILTIVIENDYELVFKLFSNQANVFLTKKDVFVEAFKGNSNDLPSSKQITLYKEPSSDLSIKEKITFIILYFLEHI

SEQ ID NO: 18667 - DNA, 459 bp, Unknown
  Obtained from environmental sample
  misc_feature (1)..(459): n is a, c, g, or t
ttgggcggttctcctcgattggaaggaaggcggctggatgtcggtcatgtgataaaggggattacacaacttgatgttgacaattttcaatcttaccaaaacagttttgaagtttcaactgatcagataggacacgcaattatgtattgcaaggaccagatttgcgaattacaaatggttccccaatcatgcaacggttgtagtaaagaattcaggaaagacgctgaaacctgggagaaattcctaatagaaatggggggatttgaaaagattgaaaatgacggagatcctatcattaagttgggagaaaattcaatttacctcggcgaattggaagaactaaaagaagagtttgagggcattgacatttgggaaatggcccaagttctacaccggaaattgaaagccaaactcaatctgccggagacttatgaacagctgatcaatcatgtgaaatga

SEQ ID NO: 18668 - protein, 152 aa, Unknown
  Obtained from environmental sample
  misc_feature (1)..(152): Xaa is any amino acid
MGGSPRLEGRRLDVGHVIKGITQLDVDNFQSYQNSFEVSTDQIGHAIMYCKDQICELQMVPQSCNGCSKEFRKDAETWEKFLIEMGGFEKIENDGDPIIKLGENSIYLGELEELKEEFEGIDIWEMAQVLHRKLKAKLNLPETYEQLINHVK

SEQ ID NO: 18669 - DNA, 582 bp, Unknown
  Obtained from environmental sample
  misc_feature (1)..(582): n is a, c, g, or t
gtgcaaatgacgagaggagtgaatattattgataaatgtaatgctaggtttcaagaagtttttaccgcttttggtaaggctgctgatgggaaaataacggtttcacattttggtgaattctctcaagacttggtcaattctttaacaatttcgatagaaaatgccatgtatgattctggtgataaaaaaggaattgtaaaaagaatgttttctgttttgattgaaggattacaaaatattagaatacatggtgaaagggacgagtatggaacacaagtttcttttttagtcattcatcaaaatattgaaacttataaaataacttttggcaacttggttaaaaatgataaaataaaaaaaatagaagacattttactttttttaaattcagaagatcaagttgtggtgaaacaaaaatatatggaagtcctttcgaatggaaacatttcgagtaagggtggtgcaggattaggttttattaccatggcattaaaaactaaacagcccattacttttcacgcacttccggtttcagatgaactttcttgtttgtcaatagaattaactttaccgagggtttaa

SEQ ID NO: 18670 - protein, 193 aa, Unknown
  Obtained from environmental sample
  misc_feature (1)..(193): Xaa is any amino acid
MQMTRGVNIIDKCNARFQEVFTAFGKAADGKITVSHFGEFSQDLVNSLTISIENAMYDSGDKKGIVKRMFSVLIEGLQNIRIHGERDEYGTQVSFLVIHQNIETYKITFGNLVKNDKIKKIEDILLFLNSEDQVVVKQKYMEVLSNGNISSKGGAGLGFITMALKTKQPITFHALPVSDELSCLSIELTLPRV

SEQ ID NO: 18671 - DNA, 786 bp, Unknown
  Obtained from environmental sample
  misc_feature (1)..(786): n is a, c, g, or t
gtggatcaagaatcggcccagcacttagattacgcttcatcgtgcaaccagcaggtaagattcaacttaaagcgacttgagcgttatttggcaatctgttataccgcaaacatcaaacccattcttctgctttctaaaacagatttgattagtggtgaagaaaaatccgcattgatagctcaaatcaatgaacgcataaaagatgtaccggttattcctcttagtatccacataagcgaaagttttgaggcggtttctgaaatcatggaagcatataaaacttattgcttcattggctcatcaggtgtgggtaaatccaccatcgtaaatcagttaaaagacgaagaaactcttaaaaccagcgaagtaagctcaagtaataataaaggtcggcataccacaacccatcgtgaattattggtactatccaaccaaagtattgtgattgatacacccggaatgcgtgaaattggaatgactgataacgcaaagggcatcgaattaacctacgacgagattcaagaaatttcgaatgaatgtaagttcaatgattgtagtcacgttcatgaagttggatgtgcagtgcttcaagctgttgaagaaggtcgaatttctaaaagtgcgtacgataactatcacaaaatgaaaagagaacagcttcacttctctagttctgtacatgagaaaagacacgctccaaaagccaggttaaaatgtatcgcgaggtacaaacagaacggcgcaaaagaaagtattagaagaaccctctacatgtcattcatgtaa

SEQ ID NO: 18672 - protein, 261 aa, Unknown
  Obtained from environmental sample
  DOMAIN (15)...(233): GTPase of unknown function
  misc_feature (1)..(261): Xaa is any amino acid
MDQESAQHLDYASSCNQQVRFNLKRLERYLAICYTANIKPILLLSKTDLISGEEKSALIAQINERIKDVPVIPLSIHISESFEAVSEIMEAYKTYCFIGSSGVGKSTIVNQLKDEETLKTSEVSSSNNKGRHTTTHRELLVLSNQSIVIDTPGMREIGMTDNAKGIELTYDEIQEISNECKFNDCSHVHEVGCAVLQAVEEGRISKSAYDNYHKMKREQLHFSSSVHEKRHAPKARLKCIARYKQNGAKESIRRTLYMSFM

SEQ ID NO: 18673 - DNA, 546 bp, Unknown
  Obtained from environmental sample
  misc_feature (1)..(546): n is a, c, g, or t
atgagtatggatgattgggagttagttgtacaagaagcgcgtcgcacttttaacaaaagcgggggaacggttcagcatcttggaaaatcgtttgaatggatgagcccagatcataaattcattcatgctagcttaaccgctactccacttaaaaaccaaactcggttttatgtaagctcgcattatggcaaaattgctttctttgcgtattactttccttttgtgttgttggtaatgggacttggaatctttttaggtagcgcaaccctttctccattaatcaacattgccattgcagtggctagcatcacaagtgttcttgctggatcgcgttacttttttgggaaatgggttcagaatcgaaaaaagaaaatggacgatatgatttctcgctttggaaagcttatcggtttggatgataaaagaacttcaaccaagagtgatgtccttccacaaaaggagaatgagcctcaaatctctattcccgatgaacatttagagaacaattcctctgaaacagaaaaccgaactaaaacacgttcataa

SEQ ID NO: 18674 - protein, 181 aa, Unknown
  Obtained from environmental sample
  misc_feature (1)..(181): Xaa is any amino acid
MSMDDWELVVQEARRTFNKSGGTVQHLGKSFEWMSPDHKFIHASLTATPLKNQTRFYVSSHYGKIAFFAYYFPFVLLVMGLGIFLGSATLSPLINIAIAVASITSVLAGSRYFFGKWVQNRKKKMDDMISRFGKLIGLDDKRTSTKSDVLPQKENEPQISIPDEHLENNSSETENRTKTRS

SEQ ID NO: 18675 - DNA, 363 bp, Unknown
  Obtained from environmental sample
  misc_feature (1)..(363): n is a, c, g, or t
atggatatacatgtaggggcgctgataaaacagcgagccaaagatctaaggatcggccccactgaattgggtgcgaaaatcaatacatccaagcaaaacgtatatggaatttacaagcgtaaatcaattgatacgcgattgttgatgaagttatgcaatgctttgagttatgatttttttcgcctttacagtgaaagcctgagacttaacgatggctcagccccagaagatgattatgcaaaatgtatttctgaaaagaccctgctcgaaagggaaaaggacgttttgaaaaatgaaaatgcttatctgaaaaagatcaattctttgttggaggagcggttcagtaaagaaaaacttgattga

SEQ ID NO: 18676 - protein, 120 aa, Unknown
  Obtained from environmental sample
  misc_feature (1)..(120): Xaa is any amino acid
MDIHVGALIKQRAKDLRIGPTELGAKINTSKQNVYGIYKRKSIDTRLLMKLCNALSYDFFRLYSESLRLNDGSAPEDDYAKCISEKTLLEREKDVLKNENAYLKKINSLLEERFSKEKLD

SEQ ID NO: 18677 - DNA, 534 bp, Unknown
  Obtained from environmental sample
  misc_feature (1)..(534): n is a, c, g, or t
ttggaatataaatatattatgtcaccacatgtgtatatagaaattttagatgataataataaccctgttcctaatggagaaattggaaacgtagtagtaaccagattagatggtttttctatgccattaatacgttataaaataggtgatttagcaattaaactgccaaaagaaaaataccctaaaaatagagcgtttaactatcctttattgcaacaaatagttggtagagaaacagatgttgttattttacctaatggcaaaaagttaattgtgcattcttttacaggaatttttgaatatattactgaaattaagcaatttaaagttgttcaagaaagcactaatgaaataataatagaatacattaaagcaactaactttacaaaagatgtattacagagaataacagagaaactacaaaaatatatacaagacaaaaattttaaaattaattataaagaagttgattttatttcttcaactaaatcaggaaaacctcaaattatagaatctaaactattaaaaaaatga

SEQ ID NO: 18678 - protein, 177 aa, Unknown
  Obtained from environmental sample
  misc_feature (1)..(177): Xaa is any amino acid
MEYKYIMSPHVYIEILDDNNNPVPNGEIGNVVVTRLDGFSMPLIRYKIGDLAIKLPKEKYPKNRAFNYPLLQQIVGRETDVVILPNGKKLIVHSFTGIFEYITEIKQFKVVQESTNEIIIEYIKATNFTKDVLQRITEKLQKYIQDKNFKINYKEVDFISSTKSGKPQIIESKLLKK

SEQ ID NO: 18679 - DNA, 723 bp, Unknown
  Obtained from environmental sample
  misc_feature (1)..(723): n is a, c, g, or t
ttgattcggctgagaatggtagatgaagaaagcgttaaaaaagaagatattgccgtacaatcaaacggtattttagacaacttaaacttacattgggcaaatgaagcagcaagacataagttattagatgtaattggtgacttggctttaaccggaattcgaattagaggaaaagtgattgcaaacaaacctggtcatttagtaaacacacagtttgctaaaaaattgtctaaaattattaaaatggagaaacgaaataacgttcctcaagttgatttaaatcaacctccattaatggatattcatcaaattatggatattcttccgcacagacccccttttttattgattgatagaattatagaactttctgacaaacacgttatcggaatgaaaaatgtgacaatgaatgagaatttctttgttggacatttccctggagcaccagtaatgccaggagttttgcaagtagaagcaatggcgcaatgtggtggagttttggtgttaagcacggttccagatccagaaaattatttgacttatttcatgaaaatggataatgtaaagttcaaacaaaaagtgttgcctggagatacattaatctttaaagcagaattaatttctccgataagaagaggtatttgtcatatgcaagcctatgggtatgcaaacggaaaattagtggtagaagctgagttaatggcacaaataataaaaaaataa

SEQ ID NO: 18680 - protein, 240 aa, Unknown
  Obtained from environmental sample
  DOMAIN (142)...(230): Thioesterase superfamily
  misc_feature (1)..(240): Xaa is any amino acid
MIRLRMVDEESVKKEDIAVQSNGILDNLNLHWANEAARHKLLDVIGDLALTGIRIRGKVIANKPGHLVNTQFAKKLSKIIKMEKRNNVPQVDLNQPPLMDIHQIMDILPHRPPFLLIDRIIELSDKHVIGMKNVTMNENFFVGHFPGAPVMPGVLQVEAMAQCGGVLVLSTVPDPENYLTYFMKMDNVKFKQKVLPGDTLIFKAELISPIRRGICHMQAYGYANGKLVVEAELMAQIIKK

SEQ ID NO: 18681 - DNA, 315 bp, Unknown
  Obtained from environmental sample
  misc_feature (1)..(315): n is a, c, g, or t
atggcaacaacatcagatattagaaacggattgtgcattagatataataatgatatttataaaataattgaatttttacatgtaaaaccaggtaaaggtccagcatttgtaagaaccaaattaaaaagtgttaccaacggaaaaaccatcgacaatacatttcctgctggaagaaaaattgacgacgttcgtgtagaaacacataaatttcaatttttatatcacgatggtgagttttatcattttatgaatgaacaagattattctcaaattcgtttgttagaagcagctcgagccgattcttggatccactag

SEQ ID NO: 18682 - protein, 104 aa, Unknown
  Obtained from environmental sample
  DOMAIN (1)...(99): Elongation factor P (EF-P)
  misc_feature (1)..(104): Xaa is any amino acid
MATTSDIRNGLCIRYNNDIYKIIEFLHVKPGKGPAFVRTKLKSVTNGKTIDNTFPAGRKIDDVRVETHKFQFLYHDGEFYHFMNEQDYSQIRLLEAARADSWIH

SEQ ID NO: 18683 - DNA, 327 bp, Unknown
  Obtained from environmental sample
  misc_feature (1)..(327): n is a, c, g, or t
atggcagagcaaaaaagcagttttcagaatttagtcaacaactcggatgtccctattttggtggatgtctattcggagacttgcgggccatgtattgcgatgaaacccgtcctgaaagatgtcaagcagcgttttggggacaatcttcggattatcaaaatcaatggtcccaaaaacatgaagttcatgcaagaatttcaaatccaggccttccctactctgctgttgttcgaaaacggcaagatcgtttggtcccgaatgggatacatagcgaccggaatgcttgaaaaaatgattaagagcaatgtaaaattgcaaaacgcctga

SEQ ID NO: 18684 - protein, 108 aa, Unknown
  Obtained from environmental sample
  DOMAIN (2)...(104): Thioredoxin
  misc_feature (1)..(108): Xaa is any amino acid
MAEQKSSFQNLVNNSDVPILVDVYSETCGPCIAMKPVLKDVKQRFGDNLRIIKINGPKNMKFMQEFQIQAFPTLLLFENGKIVWSRMGYIATGMLEKMIKSNVKLQNA

SEQ ID NO: 18685 - DNA, 405 bp, Unknown
  Obtained from environmental sample
  misc_feature (1)..(405): n is a, c, g, or t
atgaacaacatgaatcctaaggttgatttcttctttaacaaagattctaagtggcaagaagaatatgcgaaattaagaatgctcattctagactgcgggttagttgaagaactgaaatggggtgttccttgctacacttataaaaaaagtaacattgtgctaattcatgggtttaaaaattactgtgccctcctatttcacaaaggtgttttgctaaatgatgcagaaggcattcttattcaacagaccaagaatgtgcagtctgctcgacaaattcgttttactgatgtctcactaataattgaaatggaagccaccttaaaaacttacatttttgaagccattgaagtagaaaaagctggtttggagtcaaactcaaaaagacagaagagttnacatgcctga

SEQ ID NO: 18686 - protein, 134 aa, Unknown
  Obtained from environmental sample
  misc_feature (1)..(134): Xaa is any amino acid
MNNMNPKVDFFFNKDSKWQEEYAKLRMLILDCGLVEELKWGVPCYTYKKSNIVLIHGFKNYCALLFHKGVLLNDAEGILIQQTKNVQSARQIRFTDVSLIIEMEATLKTYIFEAIEVEKAGLESNSKRQKSXHA

SEQ ID NO: 18687 - DNA, 657 bp, Unknown
  Obtained from environmental sample
  misc_feature (1)..(657): n is a, c, g, or t
atggctcttaaaacaaagttatcgagtattgagcaggaaaaattcgaacagattgatgcttcgggctcatcaatattgactgattgtaaaaccaaaatcgaggatgaaaatttaaccatccaaaaagtgggtttgaagtttgcacccgcggctatcaatacaaatgttcaaaatctaactctgggtaaaagtgattttaacttttctggaaatgttcaaaactacttgggatatttcttaagcgatggcgtgttgaaagggcaatttaaactaacttcctctaatgtagacgtcaatgaattaatgcaatttgtttcttctgatacaagcgataccaccaccttagatttaagcttggctgatagaatggataaacagtttgtttcaactattcagaagctcaactatgaacagtacgaactaaaagaagtgcaagctaatattggcgttgctgataataaagttctatttaatcctttgcaggctgaattatttggcggcgaagtaagaatatccggtatacttgatgtgattgataaaaaatcaccacttttcaatttcgattttaaattagcaagtatgatattcctactgcatatcaattacncacttgttaagtcagccgcacctattcaagcgccttgggccgattcttga

SEQ ID NO: 18688 - protein, 218 aa, Unknown
  Obtained from environmental sample
  misc_feature (1)..(218): Xaa is any amino acid
MALKTKLSSIEQEKFEQIDASGSSILTDCKTKIEDENLTIQKVGLKFAPAAINTNVQNLTLGKSDFNFSGNVQNYLGYFLSDGVLKGQFKLTSSNVDVNELMQFVSSDTSDTTTLDLSLADRMDKQFVSTIQKLNYEQYELKEVQANIGVADNKVLFNPLQAELFGGEVRISGILDVIDKKSPLFNFDFKLASMIFLLHINYXLVKSAAPIQAPWADS

SEQ ID NO: 18689 - DNA, 672 bp, Unknown
  Obtained from environmental sample
  misc_feature (1)..(672): n is a, c, g, or t
atggcaagagaaatattggtctcttatgtagaaaaaacatcaaatttagaattgataaaaagctgtaaaaatgcattggaagcttttgaagtcatcaatgttcaaaaaattgatttattatttttagacatcaatatgccagaagtttcgggtttgtctttggcaaaaatgattgggaaagaatcgaaagttatttttactacagcctatagagattacgcggttgaaggattcaatttaaaggcggtagattatttgttaaaaccaattgcttttgatcgttttttagaagcggtaactactttctttgacaccatttctgttgcggaaaaattaccgaaagaaaataataatgcgactgctgatttcttttttgttcggtcagaacgtaaaatggtaaaagtaaattttgatgaaattttatatgtagaaagtttgagtgattatataaaaatctgtactcaaaacaacaccataatcaccagagaaaccattacaaatgtagaagcgaagttgccctcgcaacaatttttaagagtgcacagatcgtacattgtttctttaaaaaggattgattcttataccaatgaatttatagaaataactcaaaaagcaattccgattagtagaaaatacaaagatgttgtcttaaaaaaactagaaaatatgtga

SEQ ID NO: 18690 - protein, 223 aa, Unknown
  Obtained from environmental sample
  DOMAIN (1)...(107): Response regulator receiver domain
  misc_feature (1)..(223): Xaa is any amino acid
MAREILVSYVEKTSNLELIKSCKNALEAFEVINVQKIDLLFLDINMPEVSGLSLAKMIGKESKVIFTTAYRDYAVEGFNLKAVDYLLKPIAFDRFLEAVTTFFDTISVAEKLPKENNNATADFFFVRSERKMVKVNFDEILYVESLSDYIKICTQNNTIITRETITNVEAKLPSQQFLRVHRSYIVSLKRIDSYTNEFIEITQKAIPISRKYKDVVLKKLENM

SEQ ID NO: 18691 - DNA, 459 bp, Unknown
  Obtained from environmental sample
  misc_feature (1)..(459): n is a, c, g, or t
atgtacgctatagtagaaatcggcggacatcaatacaaagtagctgagaaagacgttctttttgttgataagcaaaattcagattcagattccgttacttttgacaatgttcttttactaaaagatgacaaaggtgctgtaaaagtaggaacgccagttgttagtggcgcttctgtaacggcaactattcttgatactgttaaatctgataaagttcttattttcaaaaagaaaagaagaccaggatatcagaaattgaatggtcacagacaagtaatgtctcagattcaaattgagtctatctctgcatctggaagtacgaaaaaagcgcttcaaaatcagctcctaaaaagaagaaataaaattgagttaaagctgagaaagcccttcagattttcaatcgacactgttgttaagttanaaaatgcgtctgataaaggcttatggtatctaatttga

SEQ ID NO: 18692 - protein, 152 aa, Unknown
  Obtained from environmental sample
  DOMAIN (1)...(96): Ribosomal prokaryotic L21 protein
  misc_feature (1)..(152): Xaa is any amino acid
MYAIVEIGGHQYKVAEKDVLFVDKQNSDSDSVTFDNVLLLKDDKGAVKVGTPVVSGASVTATILDTVKSDKVLIFKKKRRPGYQKLNGHRQVMSQIQIESISASGSTKKALQNQLLKRRNKIELKLRKPFRFSIDTVVKLXNASDKGLWYLI

SEQ ID NO: 18693 - DNA, 789 bp, Unknown
  Obtained from environmental sample
  misc_feature (1)..(789): n is a, c, g, or t
ttgaattcggctctgagattggcgaagtatttaaaacaggaaatggcgcaaaatataaagcgganacttaccgaaaaagaatatcaagacttaatagattttgaaggaaatgccaacggatttaaaatattaacagaaacaagaaaaggtatttctggcggattgcgtttgtcgtacgcaacgttgggtacgtttttaaaatatccaaaagagtccttgccaaaaaaaccaaccaaacacattgtagataaaaaatatggcttttttcaatcagaaaaagaggcttttttagatgtggcaaacgaattgggtttgttgcgtaaatctaccacaaacgatgtttctttttacagacatccattggcgtatttagtagaagctgctgatgatatttgttataccattatcgattttgaagacggtatcaacttaggtttaatcgaagaagattttgcactagagtttatgattaagcttgtaaaagataccatcgacacaaagaaatatcattctttacaacataaaaaagacagagttagttatttacgtgcattggcaatcggtgtttgggtaaatgaaacagtggatatctttttagcaaatgaagaagctattttaaaaggagaatttgataaaggtttgttagacagatgtaagtacgaagcacaaattaacgacatactaaaaattagcgtagacaaaatctataaaagcaatgatgttgtacaacaagaagttgctggttataaaattattgctgatgtgctagatgtatccgtaaatgcctaa

SEQ ID NO: 18694 - protein, 262 aa, Unknown
  Obtained from environmental sample
  misc_feature (1)..(262): Xaa is any amino acid
MNSALRLAKYLKQEMAQNIKRXLTEKEYQDLIDFEGNANGFKILTETRKGISGGLRLSYATLGTFLKYPKESLPKKPTKHIVDKKYGFFQSEKEAFLDVANELGLLRKSTTNDVSFYRHPLAYLVEAADDICYTIIDFEDGINLGLIEEDFALEFMIKLVKDTIDTKKYHSLQHKKDRVSYLRALAIGVWVNETVDIFLANEEAILKGEFDKGLLDRCKYEAQINDILKISVDKIYKSNDVVQQEVAGYKIIADVLDVSVNA

SEQ ID NO: 18695 - DNA, 606 bp, Unknown
  Obtained from environmental sample
  misc_feature (1)..(606): n is a, c, g, or t
atgctcagcttgctttcttcattgaaagaagagacaggggaatcgaaaatagatgagcttgtgaaaagactcaaaatggttcaaaatccatttagaaaggatgtgctttccgcagctagaaaagcattatacaatactacgaatacttctggaacagcacgagatgcaatcaaagaatggattaagcaaagcgaagaagataataaagaacgatttaattctcatttaataagtgaatccgaaaaatctcctttaaacatcaaagaagtcaagcctacattttctgaagacgcaaaaagtgtcgatggtagggtggtaataagagacaattttgataaaatctttgaactataccctaacacgcttgtttttggagaagatgccggaaaattaggcgatgtaaataaaggcttggaaggaatgcaggataaatacggggagatccgtgttactgatacaggaattcgtgaagcaacaatccttggccagggaattggaatgtcaatacgtgggctaagacccattgcagatattcaatatctggattatgttgatgtattgctttcaggtactgatgatgaactaatttctcaagatacgaactaa

SEQ ID NO: 18696 - protein, 201 aa, Unknown
  Obtained from environmental sample
  misc_feature (1)..(201): Xaa is any amino acid
MLSLLSSLKEETGESKIDELVKRLKMVQNPFRKDVLSAARKALYNTTNTSGTARDAIKEWIKQSEEDNKERFNSHLISESEKSPLNIKEVKPTFSEDAKSVDGRVVIRDNFDKIFELYPNTLVFGEDAGKLGDVNKGLEGMQDKYGEIRVTDTGIREATILGQGIGMSIRGLRPIADIQYLDYVDVLLSGTDDELISQDTN

SEQ ID NO: 18697 - DNA, 858 bp, Unknown
  Obtained from environmental sample
  misc_feature (1)..(858): n is a, c, g, or t
ttgcggtcttatgaaggtcaccttcgtctctatatagacgccaagatgggttctatagtattacaagaccttacatcagcaatggtggtggacttttatgagagtgtcataattgaaaagtcacatgctacagcgaagaaagttctttgcagtttgaaagcaataatctctgaggtacaaagacgcgattgggtgctcaaaaatgttgcccgcacagttcccgcttacaattcacgtaagcaaaaacataaacgcgttatgcccaccaaagatgaaatcaggcttttactaacaaccgttaataagaaacatgaacctttaatcatgactgcaatatttactggtatgagagcatcagagcttcgaggattgatatgggagtatgttgatctcgagaaggggcttattcatgtgaagcaaagagcagatcgcttcaatgagatcggtgaaccgaaaagtgattccggataccgaagtatccccttgacgcccaaccttgttaaaactttgaaggtatggaaaatgaaatgccctaccggtgagtatgaccttgtattccctaatgggaaaggtaatattgaaacgcattcgaatatatataaccgtgtatttaaaccgttaatggtcgaatgtggactgttagatagtgaaggtaaacccttatttggtattcacgctatgagacatgccgcagcatcgcttatgatagaccaaggatggttgccaaagcgtatacaaaccataatgggacatagttcaataaatatgacatttgatgtttacggtcacctatttgatgatccagaggcagatgtagaagctatggcaaagcttgaaagtgatttgttagcggcataa

SEQ ID NO: 18698 - protein, 285 aa, Unknown
  Obtained from environmental sample
  DOMAIN (88)...(271): Phage integrase family
  misc_feature (1)..(285): Xaa is any amino acid
MRSYEGHLRLYIDAKMGSIVLQDLTSAMVVDFYESVIIEKSHATAKKVLCSLKAIISEVQRRDWVLKNVARTVPAYNSRKQKHKRVMPTKDEIRLLLTTVNKKHEPLIMTAIFTGMRASELRGLIWEYVDLEKGLIHVKQRADRFNEIGEPKSDSGYRSIPLTPNLVKTLKVWKMKCPTGEYDLVFPNGKGNIETHSNIYNRVFKPLMVECGLLDSEGKPLFGIHAMRHAAASLMIDQGWLPKRIQTIMGHSSINMTFDVYGHLFDDPEADVEAMAKLESDLLAA

SEQ ID NO: 18699 - DNA, 312 bp, Unknown
  Obtained from environmental sample
  misc_feature (1)..(312): n is a, c, g, or t
ttgacgaacccaacgtgttgcttctataaaatcaagtgccttttacgatgctctccattcctgttgcccaggaattttgttactcgaaatatatctcggtgccagtggacttgtcccatattctacgacggtngtattcaagcgcgacgaaaaagtgccatttacaaggctaaatccgaggcaactagtgtgggccaaaattttcctttaaaaaaaacgcttctaatggccgcaatcctaaagaaaggacattgggggaaaaacttctcaaaatattgccctctgaatataaataggcaaaaactcgcntta

SEQ ID NO: 18700 - protein, 104 aa, Unknown
  Obtained from environmental sample
  misc_feature (1)..(104): Xaa is any amino acid
MTNPTCCFYKIKCLLRCSPFLLPRNFVTRNISRCQWTCPIFYDGXIQARRKSAIYKAKSEATSVGQNFPLKKTLLMAAILKKGHWGKNFSKYCPLNINRQKLAL

SEQ ID NO: 18701 - DNA, 372 bp, Unknown
  Obtained from environmental sample
  misc_feature (1)..(372): n is a, c, g, or t
ttgaaagttgccgaatttttagagacgcatccaaaagtaaatctggtaaaatatccttttttaaaatcgcatccgcagtataaaattgcaaaaaaacaaatgcttttaggtggaaatattattgcttttgaagtacaaggaggaattgaaaaagggagaagttttttaaatgccgttgcgctttgttcattatcagcaaatctaggagatacaagaaccatagttacacatcctgcgagtacaacacatagtaaattattaattgaagatagattagaagtcggaattaccgacgatttggttcgaatttctgtcggattagaacatgtaaatgatattataaacgatttaaaacaagcgttagatttataa

SEQ ID NO: 18702 - protein, 123 aa, Unknown
  Obtained from environmental sample
  DOMAIN (1)...(122): Cys/Met metabolism PLP-dependent enzyme
  misc_feature (1)..(123): Xaa is any amino acid
MKVAEFLETHPKVNLVKYPFLKSHPQYKIAKKQMLLGGNIIAFEVQGGIEKGRSFLNAVALCSLSANLGDTRTIVTHPASTTHSKLLIEDRLEVGITDDLVRISVGLEHVNDIINDLKQALDL

SEQ ID NO: 18703 - DNA, 720 bp, Unknown
  Obtained from environmental sample
  misc_feature (1)..(720): n is a, c, g, or t
atgtcagacgctttagtaatcattcctacatataacgaaaaagaaaatatcgaggcgataattagagcggtatttaaacaaaaaaaagcatttgatattttagtggttgatgacaattctcctgacggaacttcagcaattgttgcgcatcttatcaacgaattttcagacaggttatttatagaaaatagaactgaaaaaaacggaataggaactgcatatattcacggatttaaatgggcaatcgaaaaaaaatacgactacattatagaaatggatgccgatttttctcacaacccaaaagatttaattaaactgtacaatgcgtgtgcaaaaaacggtgctgatttgtcaattggttctagatactccaaaggagtaaacgtggtaaattggccaatgaaacgcgtattgctttcatattttgcctctaaatatgtgcgttttatcaccagaattcctgttcacgataccactgccggttttgtgtgttataaacgaaaagtattagaaactataaagctcgacaaaattagatttgtcggttatgcgtttcaaatagaaatgaaatttaaagcgtggaaacacaaattcaatattcaagaagtttctgtgatttttactgatagaactttaggagaatctaaaatgagcggctcaattgtgtacgaagcattgtttggtgttttaaaattaagactaaaaggaattccgaaataa

SEQ ID NO: 18704 - protein, 239 aa, Unknown
  Obtained from environmental sample
  DOMAIN (5)...(174): Glycosyl transferase
  misc_feature (1)..(239): Xaa is any amino acid
MSDALVIIPTYNEKENIEAIIRAVFKQKKAFDILVVDDNSPDGTSAIVAHLINEFSDRLFIENRTEKNGIGTAYIHGFKWAIEKKYDYIIEMDADFSHNPKDLIKLYNACAKNGADLSIGSRYSKGVNVVNWPMKRVLLSYFASKYVRFITRIPVHDTTAGFVCYKRKVLETIKLDKIRFVGYAFQIEMKFKAWKHKFNIQEVSVIFTDRTLGESKMSGSIVYEALFGVLKLRLKGIPK

SEQ ID NO: 18705 - DNA, 324 bp, Unknown
  Obtained from environmental sample
  misc_feature (1)..(324): n is a, c, g, or t
ttggttcgaacttctcaaccgtggtcggagagaaccaaacttcacactagcgtgaagttctatatctggattgaatttcttaaccaccgcaatttttggtacaatttgtggagaagaatcagttctataaaacccagtagtgtcgtcggtaacattggtaaccaatcgttcaatatcgtaccggagattattataactcgcgccaagagtcagataaaatcgcgcttcaaatccaattctacggaagcaaaatacaaggcacttttaattctgatatcgtcatcaaagtttaaactagaaatcttgccagcatcattgccataa

SEQ ID NO: 18706 - protein, 107 aa, Unknown
  Obtained from environmental sample
  misc_feature (1)..(107): Xaa is any amino acid
MVRTSQPWSERTKLHTSVKFYIWIEFLNHRNFWYNLWRRISSIKPSSVVGNIGNQSFNIVPEIIITRAKSQIKSRFKSNSTEAKYKALLILISSSKFKLEILPASLP

SEQ ID NO: 18707 - DNA, 537 bp, Unknown
  Obtained from environmental sample
  misc_feature (1)..(537): n is a, c, g, or t
ttgagagattggcgaataaaagtagcaagtcagtatgtgagatctaatgataaactacttgatattggatgctttgatggttttctttttaatgcgttaaaacagaaaaatattcaaccgagtattggtatagatcctttattagaagagacagaggccaaaggtaaacatcttttgatttctggagtttttccgaatgatattcctgtacacactacttttgattgtattactatgctcgcggttttagaacatattcctagagagcaacaacaagtatttgatgagcagttttatgagtttttaaatccttctggtcgaattattattactgtgccgtctccttttgtagatcagattttatgggttttaaggaaattaaacctagtagacggtatgtcactagacgaacactatggttttaaaaccaaggaagtcttttccttatttgataagaaaaactatcatttattaaaatataaaagatttcaactcggactaaacaatctatttgtttttgaaaaaagagttgagtga

SEQ ID NO: 18708 - protein, 178 aa, Unknown
  Obtained from environmental sample
  misc_feature (1)..(178): Xaa is any amino acid
MRDWRIKVASQYVRSNDKLLDIGCFDGFLFNALKQKNIQPSIGIDPLLEETEAKGKHLLISGVFPNDIPVHTTFDCITMLAVLEHIPREQQQVFDEQFYEFLNPSGRIIITVPSPFVDQILWVLRKLNLVDGMSLDEHYGFKTKEVFSLFDKKNYHLLKYKRFQLGLNNLFVFEKRVE

SEQ ID NO: 18709 - DNA, 657 bp, Unknown
  Obtained from environmental sample
  misc_feature (1)..(657): n is a, c, g, or t
atgagcaatgacgaaaattcacctgaattattgaaaggccggggagcgcaattcaattcgcgcaaccggtttctgaagcatgaatatgtgcaagagcattttgaagggctggatgagcctttgttgagcaattcggccacggagtacatcgaggagaatcccaaaaagatcgtgaacaagatcaacagcccggatcttcctatgccgtattccatgaatccgtatcaaggttgcgaacacggctgcatatattgttatgcccgcaatacccatcaatattggggattcagtgcgggcctggattttgagcggaagatcattgttaagaaaaatgcacctgagctgctggctcagcagttgagcaagaagacctggaagcccgatgccatcatgctgtctggcaataccgattgttaccagccgattgaaaggaagctgaaaatcactcgtaagatcctggaaatccttttggagtaccgtcaaccggtcggcatcatcaccaaaaacagcctcatcttgcgtgatttggacctgttaagcgagattggctcgatgcaattggcccaggtcagcatttcgattacaacccttggacgagaagttgaggtgggcatggaaccccggacagctaccggaaaagcgcgatcaaaacattga

SEQ ID NO: 18710 - protein, 218 aa, Unknown
  Obtained from environmental sample
  misc_feature (1)..(218): Xaa is any amino acid
MSNDENSPELLKGRGAQFNSRNRFLKHEYVQEHFEGLDEPLLSNSATEYIEENPKKIVNKINSPDLPMPYSMNPYQGCEHGCIYCYARNTHQYWGFSAGLDFERKIIVKKNAPELLAQQLSKKTWKPDAIMLSGNTDCYQPIERKLKITRKILEILLEYRQPVGIITKNSLILRDLDLLSEIGSMQLAQVSISITTLGREVEVGMEPRTATGKARSKH

SEQ ID NO: 18711 - DNA, 471 bp, Unknown
  Obtained from environmental sample
  misc_feature (1)..(471): n is a, c, g, or t
ttgactcggcncgagaaactgtggtgttgtttgagaaaggttacgtttatttgtttagtaaatgtaggattaaatggtttattcgtttatttgttaaaaaaagacgctatgaaaatatattcatttgaaaaattaattgtctggcaagaatcaaaaaacctaataatcgagatatataaaatcacaaaaggttttccgtctaatgaaaaatttggattaattagtcaattaagaagagcatctgtatctattgcttcaaatttagcagaaggtacatcgagaaaaacaacgaaagacaaagctcattttacaacaattgcatttagttctgcaatggaagtgttaaatcaaatcataatttctaaagaattgaactttgtttctgaaaaagattatattttagtccgagaaaaattagaaaaaattacaaacatgctaaatgggttaagaaaaacgcaactaaacccataa

SEQ ID NO: 18712 - protein, 156 aa, Unknown
  Obtained from environmental sample
  DOMAIN (40)...(149): S23 ribosomal protein
  misc_feature (1)..(156): Xaa is any amino acid
MTRXEKLWCCLRKVTFICLVNVGLNGLFVYLLKKDAMKIYSFEKLIVWQESKNLIIEIYKITKGFPSNEKFGLISQLRRASVSIASNLAEGTSRKTTKDKAHFTTIAFSSAMEVLNQIIISKELNFVSEKDYILVREKLEKITNMLNGLRKTQLNP

SEQ ID NO: 18713 - DNA, 678 bp, Unknown
  Obtained from environmental sample
  misc_feature (1)..(678): n is a, c, g, or t
atgaaaaaaacactactattatttttgtttttgtccaccttggttgtacaagcacaagaatattttccaacaaactctggtgttaagactacaaaaaataccactgtagcttttaccaatgcaaaaatttatgtgacaccaacacaaattatcaaaaaaggaactttactcataaaagatggtaaagttgtttcggttggtaaaaatgtgaagattcctcatggagctaaaactgtagatctatcaggaaaaacaatgtatccttcttttatagaagtatattctaatttcggaattaaaaatccaactccgccaagaaacacaagcagatctcaacaatacgaaaccaatagaaaaggctattattggaatgatcatatcagaccagaaaccgatgcttttgacagttttacttttgatgataaaaaagcaaaagatttattaaaagctggttttggagttgtaaacacgcatttagaagatggaattattcgtggtaacggagttttagttgctttaaatgcaaattctacagatgcgtacagaattattgacacaaaatctgcacaatatttttcttttaataaaagtagaatgtcaagacaatcatatccaaattcatttatgggtaaaacnggcattattaagacaagtatatatggatgcaaaatggtatga

SEQ ID NO: 18714 - protein, 225 aa, Unknown
  Obtained from environmental sample
  SIGNAL (1)...(18)
  misc_feature (1)..(225): Xaa is any amino acid
MKKTLLLFLFLSTLVVQAQEYFPTNSGVKTTKNTTVAFTNAKIYVTPTQIIKKGTLLIKDGKVVSVGKNVKIPHGAKTVDLSGKTMYPSFIEVYSNFGIKNPTPPRNTSRSQQYETNRKGYYWNDHIRPETDAFDSFTFDDKKAKDLLKAGFGVVNTHLEDGIIRGNGVLVALNANSTDAYRIIDTKSAQYFSFNKSRMSRQSYPNSFMGKTGIIKTSIYGCKMV

SEQ ID NO: 18715 - DNA, 741 bp, Unknown
  Obtained from environmental sample
  misc_feature (1)..(741): n is a, c, g, or t
atgaaaaacaaaaaattaactatttatctttctgttttactcgtatttcaacttgtatttgtacaattgataagcaagtatccacgttttattgagcaatactactcaaacggaatctacctttttacaagtaaattactgcgtattctttttggttggattcctttttcgtttggtgatttggtgattggttttttagtgttggtttgtttccgatttatctatcgtttatttacaagtaaatttaaaaatttaaaacaaaaatcactgcaaacaattgcttttatttctattttgtacagttgtttttattggttttggggattcaattattttagagaacccttagcaaaaaacttaggctatgatcaaacaaaatacaccacagaagaactcacagaagtttctaaaaacatcattcaacatttaaacgaagcacagtttttaattacaaaaagcgatactgtaaaggttgaaaatccatattctcaaaaagaaatgtatcagaaagcactttctggatatgcaactttagcaatcacatttccgcaatttgaatatcgtttttcatctgtaaaaagttcgttgatgagtttattgcaaacctataacggaacttcaggatattttaatccgtttaccggagaagcgcaagtaaatgatcggattccaaaaacaggttatccaacaacggtttgtcatgaaatggcgcatcaattggggaattgcagcagaaaatga

SEQ ID NO: 18716 - protein, 246 aa, Unknown
  Obtained from environmental sample
  misc_feature (1)..(246): Xaa is any amino acid
MKNKKLTIYLSVLLVFQLVFVQLISKYPRFIEQYYSNGIYLFTSKLLRILFGWIPFSFGDLVIGFLVLVCFRFIYRLFTSKFKNLKQKSLQTIAFISILYSCFYWFWGFNYFREPLAKNLGYDQTKYTTEELTEVSKNIIQHLNEAQFLITKSDTVKVENPYSQKEMYQKALSGYATLAITFPQFEYRFSSVKSSLMSLLQTYNGTSGYFNPFTGEAQVNDRIPKTGYPTTVCHEMAHQLGNCSRK

SEQ ID NO: 18717 - DNA, 750 bp, Unknown
  Obtained from environmental sample
  misc_feature (1)..(750): n is a, c, g, or t
atgatttggagaaagattggattcaaaaaagttatgaacgattcacttcttgaacagaaatatggtcatctttgggaaagcatacaaaatgtaattgataaactacgaagcaatgcaaatgaatatttcggctattcgccaccaatatatagcgcatcaaaatattttgccattgcaaagaagttaataacatacgcaaaggaaatgaagaagcccgaggaggaaaggagcattttatataaagaagatgttattaacgatactcgtgaaattatatttcctgatgattttgataaagaactaaatgataaattattgagagtgcattcaaacgtgactacatattatttgggtagggaggataaatttttaaaaaatttatatggaggaaatactggcgaagaagctgttgaatatgctttatcaaaatcgttaataacaaataaagaggacgtagctaaattgttaataaaatctccggatgagattttgcattctgatgatccattcatttatttccttgttaacacacgagatatctatgacgagctcgattttcaacgcacagaggcaaaaaatactcttgcaattcttaatcaagatttggncgaattaatctttaaagtattcggctcagccatttccccagatgcaacgatgtctctaagaattcctgatggtgtgataaagggttacgaatataacggaacaattgctccgggaaaaaccaccttttatgattgtggatag

SEQ ID NO: 18718 - protein, 249 aa, Unknown
  Obtained from environmental sample
  misc_feature (1)..(249): Xaa is any amino acid
MIWRKIGFKKVMNDSLLEQKYGHLWESIQNVIDKLRSNANEYFGYSPPIYSASKYFAIAKKLITYAKEMKKPEEERSILYKEDVINDTREIIFPDDFDKELNDKLLRVHSNVTTYYLGREDKFLKNLYGGNTGEEAVEYALSKSLITNKEDVAKLLIKSPDEILHSDDPFIYFLVNTRDIYDELDFQRTEAKNTLAILNQDLXELIFKVFGSAISPDATMSLRIPDGVIKGYEYNGTIAPGKTTFYDCG

SEQ ID NO: 18719 - DNA, 486 bp, Unknown
  Obtained from environmental sample
  misc_feature (1)..(486): n is a, c, g, or t
atgttttttggcccccacaaggcaatgggggttggccacccccttttattttattttttgggggcccctaatttttccccaaaaagggacaaaagggttagggaccaaagacatttttacatttcaaggatgcctatggcccccaatttttggatattgcggggggtagaaaaaccgaattatgtggagtttaatagtctttggggtctaattcaaggaaatgaggagcagatttatgaagacatttatggggcttatttgaaaaatcaacggatgataaaaaaagatggttataagctcactgtctatccgaaggcaaaaaaaatacttttattcgatatgaaaaaagacccatttgaaatgaatgatttagcagatcagccagaatatcaagaaagaattaaatccttatttgcagaacttcagcaaaaacaaattctattaaatgatgcattggttttaaacgcaacggattatgatatttaa

SEQ ID NO: 18720 - protein, 161 aa, Unknown
  Obtained from environmental sample
  misc_feature (1)..(161): Xaa is any amino acid
MFFGPHKAMGVGHPLLFYFLGAPNFSPKRDKRVRDQRHFYISRMPMAPNFWILRGVEKPNYVEFNSLWGLIQGNEEQIYEDIYGAYLKNQRMIKKDGYKLTVYPKAKKILLFDMKKDPFEMNDLADQPEYQERIKSLFAELQQKQILLNDALVLNATDYDI

SEQ ID NO: 18721 - DNA, 735 bp, Unknown
  Obtained from environmental sample
  misc_feature (1)..(735): n is a, c, g, or t
ttgactcggctgcagggcccccggncagaaaaactgacagagatccttggtgagaaggtggtttatcagcaacctaaaggctggcttttttatcagcgagatatgcgcacggataaatttgacatcgtttttgatgggccgcatttcatatcctggcgaataaaacgctttggccacacacctgtagcaaagctgccaggtacacttggttttgttgtcatcactgcaaaagatgtaagaggctacaatggaagaaaaattaatggggtcaacgatcttaagaacgttactgtctgttcgattgcgccacctaatctttcttctctgacagtgctaacagagtataaagatccggtaagtctgccagtaatgataaataccaaaggtggtatgaatggggtctatagtgcctttaaaaagggtaaatgcaaggtcgctatcttacgtgacaagtattatgctaaaaaaataccagcgcaagaacgtgaaagtttaaagatcatattcaggagtgaacaagttgctaatcagggtgtcactgtgagcagacggattagcgaagagcaacgcatcctcattactgcggctcttactgaagtgagtcatagcacaatgcccactttgaagcgcttcacgcctaaggcggaaaaaatgctgtatacggataattctgactacgataattactatcgattactcacagacgtggtctatggttgggggataggtgagtag

SEQ ID NO: 18722 - protein, 244 aa, Unknown
  Obtained from environmental sample
  misc_feature (1)..(244): Xaa is any amino acid
MTRLQGPRXEKLTEILGEKVVYQQPKGWLFYQRDMRTDKFDIVFDGPHFISWRIKRFGHTPVAKLPGTLGFVVITAKDVRGYNGRKINGVNDLKNVTVCSIAPPNLSSLTVLTEYKDPVSLPVMINTKGGMNGVYSAFKKGKCKVAILRDKYYAKKIPAQERESLKIIFRSEQVANQGVTVSRRISEEQRILITAALTEVSHSTMPTLKRFTPKAEKMLYTDNSDYDNYYRLLTDVVYGWGIGE

SEQ ID NO: 18723 - DNA, 387 bp, Unknown
  Obtained from environmental sample
  misc_feature (1)..(387): n is a, c, g, or t
ttgaaatttggtatttttaaagttatggcaacgcacaacgaactcggaaaaataggggaagaaatagccgcgcaatatttgcttcgcaacggttataaaatcctgcgccgaaatttctattttgacaaagccgaaatagacatcatcgcccaaaaggaagaaggcacagttgtcatggtggaagtaaaaacacgaaatagctcattttttggtaacccgcaagatttcgtaaccaaaaacaaaatcaaacttttggtaaaagcagccaatgaatatatcgtttcaaatgagcttgatgtggaagttcgctttgatattattgcggttttaaagaaccaaaaaatggaacaacttcagcattttgaaaatgctttttatcatttttaa

SEQ ID NO: 18724 - protein, 128 aa, Unknown
  Obtained from environmental sample
  DOMAIN (18)...(110): Uncharacterised protein family UPF0102
  misc_feature (1)..(128): Xaa is any amino acid
MKFGIFKVMATHNELGKIGEEIAAQYLLRNGYKILRRNFYFDKAEIDIIAQKEEGTVVMVEVKTRNSSFFGNPQDFVTKNKIKLLVKAANEYIVSNELDVEVRFDIIAVLKNQKMEQLQHFENAFYHF

SEQ ID NO: 18725 - DNA, 537 bp, Unknown
  Obtained from environmental sample
  misc_feature (1)..(537): n is a, c, g, or t
ttgttgaaagcacaactttccgaatttacaacggttcatttaaaaaacaacaaagctcccctcctctcgggaggggctgggggtcggctttcgttttcaactaanacacaagcgtcgttcaacaaacagttcaatttactgattgaaaacctgaatgaaaacaccgaaaaaggttataaaaactacattttctgcagtagcgagcaacaggcaaagcgttttcacgacatttttgaagatgcccaacaaaatgtggaacagtttgaaactattgtttttccgctgtttcaaggctctattgatgacgatttaaaactagtttgctataccgatcatcaaatttttgagcgttaccataaatttcaactgaaaaacggttacgccaaaaagcaggcgatcactttaaaggaaattaccaatctggaagtgggcgattacgtaacgcatattgaccacggaattgggaaatttggtggtatgcaaaaacttgaagtagagggaaaactgccggaagccatcaaaacttctttatggtga

SEQ ID NO: 18726 - protein, 178 aa, Unknown
  Obtained from environmental sample
  misc_feature (1)..(178): Xaa is any amino acid
MLKAQLSEFTTVHLKNNKAPLLSGGAGGRLSFSTXTQASFNKQFNLLIENLNENTEKGYKNYIFCSSEQQAKRFHDIFEDAQQNVEQFETIVFPLFQGSIDDDLKLVCYTDHQIFERYHKFQLKNGYAKKQAITLKEITNLEVGDYVTHIDHGIGKFGGMQKLEVEGKLPEAIKTSLW

SEQ ID NO: 18727 - DNA, 321 bp, Unknown
  Obtained from environmental sample
  misc_feature (1)..(321): n is a, c, g, or t
atggttaataaattgttaatacaaaatagtaaagagcttaaaaaccaaccaaaatctgttatagatttacaagaattagagcatgctgtacttttaaatccatatatagaaagtgcaacggttttttacacaatagacggcgagttaaaaacaatcgtaaaacagcgcacaccaatcgctagaattaacaatgttggttcgtcttattatattgataaacatggatttaacgtccctttgtcagataattactcagcaagagtaatcttgataacgggcactataaataaaggaaatttacaagaatttacaagtttgtaa

SEQ ID NO: 18728 - protein, 106 aa, Unknown
  Obtained from environmental sample
  misc_feature (1)..(106): Xaa is any amino acid
MVNKLLIQNSKELKNQPKSVIDLQELEHAVLLNPYIESATVFYTIDGELKTIVKQRTPIARINNVGSSYYIDKHGFNVPLSDNYSARVILITGTINKGNLQEFTSL

SEQ ID NO: 18729 - DNA, 483 bp, Unknown
  Obtained from environmental sample
  misc_feature (1)..(483): n is a, c, g, or t
gtgtcagtggctaatctcctaatatatagtactacccacatagcgtcatctttctatgatgacaaaactaaggcagggctgtttccgaaaaactggatatcactgaatgaaaagccagatccgaattttacctttgcagcacttttttctcaactaagtcaatttttgacctccactgtaatgcttgcccagtccggattggatagctccgctaaggttatcctcaggtcagcaatagaactatcatctcagatttctattctcttattttttagggaagatttaaagaaatacgttgaggcagggactgatgacgaaatgagaaatgtgtggttcaaaatttttgctaaaaagaaaatccccaataaacttaaagatatcaattattggttttatgaggataaaagaatagcagaagttttagtagacgaacggagtgaaatgagcagttttctttcgagtacaacccactcagacacttag

SEQ ID NO: 18730 - protein, 160 aa, Unknown
  Obtained from environmental sample
  misc_feature (1)..(160): Xaa is any amino acid
MSVANLLIYSTTHIASSFYDDKTKAGLFPKNWISLNEKPDPNFTFAALFSQLSQFLTSTVMLAQSGLDSSAKVILRSAIELSSQISILLFFREDLKKYVEAGTDDEMRNVWFKIFAKKKIPNKLKDINYWFYEDKRIAEVLVDERSEMSSFLSSTTHSDT

SEQ ID NO: 18731 - DNA, 648 bp, Unknown
  Obtained from environmental sample
  misc_feature (1)..(648): n is a, c, g, or t
ttgaataaagcacttattaaaaagttgaatatcaaagaaggacaaaagctcttgctgattaattgtccagaagaacaaaaattcaattttggcggattggatgttaaaacatcagctaaaggtgtatttgattgtgtgatcatatttgtcagtaacgagaaagaactaaaagagtttctcccaaagaatcaaagtaaagtcaataaggatggtaagctgtgggtgacttaccctaaaaaaagcggagatatattttcagatttgaccagagattctatttggaagtatgttaacgagttgaaaatgaatcccaataaaatagtttctttggatgcaaactggtcaatgataagtttggtcgatcaaagtgctctgagaaaagaatctaagtttggacaagaaccgccaggcgttgaccgtacaaacaaaacggtaattccacctaaagatctacaagttaaattagacgcaaatcccaaagcgaacggttttttggaatcactagcttttagccataaaagagaatatgtaggctggattccatacggtaagacagaaaaaccagagatcgtaaatcacaaaaagatcaactttactggaaggaagaaaagtagaattagttactttacatttgtactttttgtaaan

SEQ ID NO: 18732 - protein, 216 aa, Unknown
  Obtained from environmental sample
  misc_feature (1)..(216): Xaa is any amino acid
MNKALIKKLNIKEGQKLLLINCPEEQKFNFGGLDVKTSAKGVFDCVIIFVSNEKELKEFLPKNQSKVNKDGKLWVTYPKKSGDIFSDLTRDSIWKYVNELKMNPNKIVSLDANWSMISLVDQSALRKESKFGQEPPGVDRTNKTVIPPKDLQVKLDANPKANGFLESLAFSHKREYVGWIPYGKTEKPEIVNHKKINFTGRKKSRISYFTFVLFVX

SEQ ID NO: 18733 - DNA, 495 bp, Unknown
  Obtained from environmental sample
  misc_feature (1)..(495): n is a, c, g, or t
atgatactcattagtgttttattttatggctacatcatttgcattttactttttgtaatttgtttttttaaagtgaaagattttaaaagcacaataacttcagaaaaaacagccttttcggtcatcattccgtttagaaatgaagcaaaaaatttatcaaatttattagcctcaattcagcaattaaagtattcagaaaacttggttgaatttctttttgttgatgatgattctacagataattcggttgaaattattaattgtcacttcgagtgcattcgagaaacttcaaaattaggtctcgactccgctcgaccagacattcgagttttaaacaacaaaagagtttctaattctccaaaaaaagacgccatttctacagctttaaaaaaagcaaaaaacaattgggttattaccacagatgcagattgtattgtgccagagaactggctaaaaaccatcgataattttatccaacaaaacaatgcaacatga

SEQ ID NO: 18734 - protein, 164 aa, Unknown
  Obtained from environmental sample
  misc_feature (1)..(164): Xaa is any amino acid
MILISVLFYGYIICILLFVICFFKVKDFKSTITSEKTAFSVIIPFRNEAKNLSNLLASIQQLKYSENLVEFLFVDDDSTDNSVEIINCHFECIRETSKLGLDSARPDIRVLNNKRVSNSPKKDAISTALKKAKNNWVITTDADCIVPENWLKTIDNFIQQNNAT

SEQ ID NO: 18735 - DNA, 609 bp, Unknown
  Obtained from environmental sample
  misc_feature (1)..(609): n is a, c, g, or t
ttgaaaaatagaaatgaattcttgccagatgtgtatgtaacctgcgaaacatgcaatgctaaacgctacaatagggaaacactagaaatattctataagcacaagaatatttcagatgtattaaatatgcccgtttctgatgcggctgaattttttgacgcccaacctacaataagtcgcgtacttaaaactctaacatcggttggtttaggatatttaacgcttgggcaatctagcacaacactttctggtggagaagcccagcgaataaagcttgccagagaactttccaaaattggaacgggagacacactttacgtaatggatgaacccactacaggtttacactttcaagatgtacaaatgcttgtaaatgtaattcagaaactggtagacaaaggaaatactgttgtagtaattgaacataatctcgatctaataaaagcatcagatttagttattgatgttgggcctgaaggtggtaaaggtggtggcacaattctagtaacaggctctcctactgaagttgctaagaataaaacatcttatacaggaatcttcctaaagcaagaatttgagcgattaaaaaaccctaaaattatcgtttag

SEQ ID NO: 18736 - protein, 202 aa, Unknown
  Obtained from environmental sample
  DOMAIN (20)...(157): ABC transporter
  misc_feature (1)..(202): Xaa is any amino acid
MKNRNEFLPDVYVTCETCNAKRYNRETLEIFYKHKNISDVLNMPVSDAAEFFDAQPTISRVLKTLTSVGLGYLTLGQSSTTLSGGEAQRIKLARELSKIGTGDTLYVMDEPTTGLHFQDVQMLVNVIQKLVDKGNTVVVIEHNLDLIKASDLVIDVGPEGGKGGGTILVTGSPTEVAKNKTSYTGIFLKQEFERLKNPKIIV

SEQ ID NO: 18737 - DNA, 540 bp, Unknown
  Obtained from environmental sample
  misc_feature (1)..(540): n is a, c, g, or t
atgaagaacaaaaatttattaaaagctatctgtaaagatatagcccagtacacgccaaaattaaaagaattaaagaagaattatgaggcatttcaattgtcaaaattcgacaacttgatctttaaggaactcataaacaagggttctgttgggataattaccaaatatcacgaatccctagaaaagcagttagatgcgctaaaaatcaaatctacagtaatgagaaggaacctcctcgataaacacgatatttttgttaaagattttaaagaagccctccttgatgttacttcgttctatccccaccgtttttctagagataatagcccaacattagaactggtattcatctcttatagtgataatggatttaagatcctaggtgatgaccttgaaaaaatcaccgagaaatattgccggacttacttagttacagatacggaagttaaagcatggaaaacgattaacaaattgaatgaagcctacagtgatctaaaggacattttgtcggatattggttatgatagcttccgtggtcna

SEQ ID NO: 18738 - protein, 180 aa, Unknown
  Obtained from environmental sample
  misc_feature (1)..(180): Xaa is any amino acid
MKNKNLLKAICKDIAQYTPKLKELKKNYEAFQLSKFDNLIFKELINKGSVGIITKYHESLEKQLDALKIKSTVMRRNLLDKHDIFVKDFKEALLDVTSFYPHRFSRDNSPTLELVFISYSDNGFKILGDDLEKITEKYCRTYLVTDTEVKAWKTINKLNEAYSDLKDILSDIGYDSFRGX

SEQ ID NO: 18739 - DNA, 492 bp, Unknown
  Obtained from environmental sample
  misc_feature (1)..(492): n is a, c, g, or t
gtgattagtcgttttggttcgggttcacatttaatggctttcttgttagctgaatctttaggtttggatttaggttcattaaagtttaagatcataaataacttagatggcgcacgagaattgttcaaaaatggtggcaattatgcttttctttgggaaaaattcatgactaagccctacgttgataatggtgaaatgcaacgattgtctgatttcccaacaccgtggtcgtgtttcgttacgtgtgtaaggaaatcaatactcgaaaccaataagccacaaattgatgaactcattaaaaacgtattaaacacagccaataaccttaaaaaatcaccattagccgagaaacttattgccagagaatacaaattagaaattccggatgttcacaattggcttcaaaccattgagtggcaagctaaaattaatctaaataaaagactagtaaataaagtcaaaaagaagctaaaacaattaaatttaatttaa

SEQ ID NO: 18740 - protein, 163 aa, Unknown
  Obtained from environmental sample
  misc_feature (1)..(163): Xaa is any amino acid
MISRFGSGSHLMAFLLAESLGLDLGSLKFKIINNLDGARELFKNGGNYAFLWEKFMTKPYVDNGEMQRLSDFPTPWSCFVTCVRKSILETNKPQIDELIKNVLNTANNLKKSPLAEKLIAREYKLEIPDVHNWLQTIEWQAKINLNKRLVNKVKKKLKQLNLI

SEQ ID NO: 18741 - DNA, 591 bp, Unknown
  Obtained from environmental sample
  misc_feature (1)..(591): n is a, c, g, or t
ttggataggctgattgtatccattgatggcaccacccaagaggtatacgagaactaccgcattggtggaaagctggataaggtaattgaaggtaccaaaaacatcatcaagtggaaaaaggagttgaactcaaaaaccccacacattatcttccaatttctggtagtgaagcctaacgagcaccaaatagaagacgtaaagaaacttggtgcagaagtaggtgtggatgaagtgcgttttaaaacggcgcaggtgtacgactatgagaacgaccctaatcaactgatacctaccattgacaagtattcccgttacaagaaggataaagatggcgacttgaaactaaaaaacccccttatcaatcattgctggaaactgtggcattcctgcgtacttacttgggatggcttggttgtgccctgctgctttgataaggatgctacccatcaattgggcgacttgaaacaaaagcctttcaaggagatttggcaagatgagaaatatcaagcttttagggcttccatcatgcgctcacgcagtgagattgatatttgcgccaactgcaccgaaggcacccaagtgtgggcctag

SEQ ID NO: 18742 - protein, 196 aa, Unknown
  Obtained from environmental sample
  misc_feature (1)..(196): Xaa is any amino acid
MDRLIVSIDGTTQEVYENYRIGGKLDKVIEGTKNIIKWKKELNSKTPHIIFQFLVVKPNEHQIEDVKKLGAEVGVDEVRFKTAQVYDYENDPNQLIPTIDKYSRYKKDKDGDLKLKNPLINHCWKLWHSCVLTWDGLVVPCCFDKDATHQLGDLKQKPFKEIWQDEKYQAFRASIMRSRSEIDICANCTEGTQVWA

SEQ ID NO: 18743 - DNA, 555 bp, Unknown
  Obtained from environmental sample
  misc_feature (1)..(555): n is a, c, g, or t
atgtctcgaataggaaaattacctgtaccacttacctccaaagtcgatttcagcattggtgctgacaatttgattactgtaaaaggtgagaaaggtacctctacattacaagtgcatcctaatatttcaattgagaaaactgaaagtgaagtattagtaaaaaggatgaatgatgaaaagcagaataaagctcttcatggtttatttcgcgcactcataaacaacatggttgttggcgttacagatggttatactaaaaaactagaaatagttggtgttggttatcgtgcggctattaatggtgatgttttagagttgaacttaggatactcacacccgatattttttgtagcgcctgaaggcattactatcgaagtggatactaaaacaagcaagaacgctattattgttattagcgggattgataaagaattagttggtcaggtttctgcaaagattcgctctttcagaaaaccagagccatacacaggaaaaggtattcgttatgttggtgaacaagtccgtcgtaaagcgggtaaatcagttggtaaataa

SEQ ID NO: 18744 - protein, 184 aa, Unknown
  Obtained from environmental sample
  DOMAIN (11)...(83): Ribosomal protein L6
  misc_feature (1)..(184): Xaa is any amino acid
MSRIGKLPVPLTSKVDFSIGADNLITVKGEKGTSTLQVHPNISIEKTESEVLVKRMNDEKQNKALHGLFRALINNMVVGVTDGYTKKLEIVGVGYRAAINGDVLELNLGYSHPIFFVAPEGITIEVDTKTSKNAIIVISGIDKELVGQVSAKIRSFRKPEPYTGKGIRYVGEQVRRKAGKSVGK

SEQ ID NO: 18745 - DNA, 387 bp, Unknown
  Obtained from environmental sample
  misc_feature (1)..(387): n is a, c, g, or t
atgaaaaacaaaatcgcagcagtcactaaatttcacaccgcttttaaattaaatatgaatcaaaaaccaattgctcatattggagaagatagaaatttattgcgtttcaatttaatgaaagaagaaaacgaagaatatttagaagcggctcaaaacaacgatttagttgaagttgctgatgctttgggggatatgctatacattttatgtggtacaattatagagcacggaatgcaagataaaattgaggaggtttttaatgaaattcaacgtagtaacatgagtaaattaggagaagacggaaacccaatttatcgtgaagatggaaaagtattgaaagggcccaattattttaaaccaaatattgccaagatattagatcaataa

SEQ ID NO: 18746 - protein, 128 aa, Unknown
  Obtained from environmental sample
  misc_feature (1)..(128): Xaa is any amino acid
MKNKIAAVTKFHTAFKLNMNQKPIAHIGEDRNLLRFNLMKEENEEYLEAAQNNDLVEVADALGDMLYILCGTIIEHGMQDKIEEVFNEIQRSNMSKLGEDGNPIYREDGKVLKGPNYFKPNIAKILDQ

SEQ ID NO: 18747 - DNA, 429 bp, Unknown
  Obtained from environmental sample
  misc_feature (1)..(429): n is a, c, g, or t
atgaaaaaaataatttacatttttgttattttactttcggtttctgttagtgggcaatcattaaaaaagttattgaaaaaatacaatactgaaagtgttgcgtatgcaacagttgataatctaagcacattaataagaagacctttcgactccgctcaaggagacaatgctatagttttgctagatgcaagagaacctaaagaatataaagtaagtcatatagagaacgctgttctggttgggtatgatcatttcgatttagaaaaaacgaagtcaaaattaacagataaaaacgcaactattgtagtgtattgttccgtcggaattcgttctgaagacatcgctgaaaaactgcaaaaagcgggttataaaatgtttctaatttatatggcggaattttcgaatggaaaaacaaacaaaatatcgtag

SEQ ID NO: 18748 - protein, 142 aa, Unknown
  Obtained from environmental sample
  SIGNAL (1)...(18)
  DOMAIN (45)...(139): Rhodanese-like domain
  misc_feature (1)..(142): Xaa is any amino acid
MKKIIYIFVILLSVSVSGQSLKKLLKKYNTESVAYATVDNLSTLIRRPFDSAQGDNAIVLLDAREPKEYKVSHIENAVLVGYDHFDLEKTKSKLTDKNATIVVYCSVGIRSEDIAEKLQKAGYKMFLIYMAEFSNGKTNKIS

SEQ ID NO: 18749 - DNA, 630 bp, Unknown
  Obtained from environmental sample
  misc_feature (1)..(630): n is a, c, g, or t
atgaaacaaggcgctttatcttttgataaaacagaagtaaaatttcatttagatgcagattttaatccaactggagtttatgtaaaagaatcaaaagatgctaataaattgattgaagaatttatgttacttgccaatagaaaagtagctgaatttataggtaaaaagagagaaaataataaaccaaaaacttttgtatatcgtattcacgatgaaccaaatattgataaactagttgctttacaaggtattatatctaaatttggatataaaattaatacagaaacaaaaaaagatactacagcttctttaaataaattattagcagatgttcatggtaaagcagagtcgaatatggttgaaactttaaccattcgttctatgagtaaagcaatttatacaaccaataatattggtcattatggtttagcttttgattactatacacattttacatcgcctattcgccgttatccagatgtaatggtacatcgtttacttcaacattatttagatggcggtaaatcacctaaaacagaaatttatgaagataaatgtaagcactccagcgaaagagagtttatggcaagtaaagcagaaagagnttctatcactcgagccgattcttga

SEQ ID NO: 18750 - protein, 209 aa, Unknown
  Obtained from environmental sample
  misc_feature (1)..(209): Xaa is any amino acid
MKQGALSFDKTEVKFHLDADFNPTGVYVKESKDANKLIEEFMLLANRKVAEFIGKKRENNKPKTFVYRIHDEPNIDKLVALQGIISKFGYKINTETKKDTTASLNKLLADVHGKAESNMVETLTIRSMSKAIYTTNNIGHYGLAFDYYTHFTSPIRRYPDVMVHRLLQHYLDGGKSPKTEIYEDKCKHSSEREFMASKAERXSITRADS

SEQ ID NO: 18751 - DNA, 576 bp, Unknown
  Obtained from environmental sample
  misc_feature (1)..(576): n is a, c, g, or t
ttggaaaagctaatcaaaaaataccaaaataaaatgaagcacaagtcgatactctttcttttcatttcaattatttcatttcaattaactgcacaaaaacttcagactccaagcgagtttttaggatacaaattaggttctcgttttacgagacatcataaagtagttgactattttaaatacatttctgaaaacacagacaaagtaaaatttcaagaatacggaaaaaccaacgaactaagaaccttagcaatcgcttatgtttcttctgctgaaaatattaaaaatttagaaaccattcgcaaacaacatttaacaagtgctggtatcgaacacacttctgaattaaaagacaaagcgattgtttggttgagttataatgtgcacggaaacgaagcttcttctacagaagcatcaatgttaacattgtataaattgataacagaaaacagcaattatttagaaaatactattgtaattatcgatccttgtatcaatcctgacggtagagatcggtatgcaaattggtacaatcaagtgatggcttcaccaaataatgtctcgaccgattcttga

SEQ ID NO: 18752 - protein, 191 aa, Unknown
  Obtained from environmental sample
  misc_feature (1)..(191): Xaa is any amino acid
MEKLIKKYQNKMKHKSILFLFISIISFQLTAQKLQTPSEFLGYKLGSRFTRHHKVVDYFKYISENTDKVKFQEYGKTNELRTLAIAYVSSAENIKNLETIRKQHLTSAGIEHTSELKDKAIVWLSYNVHGNEASSTEASMLTLYKLITENSNYLENTIVIIDPCINPDGRDRYANWYNQVMASPNNVSTDS

SEQ ID NO: 18753 - DNA, 318 bp, Unknown
  Obtained from environmental sample
  misc_feature (1)..(318): n is a, c, g, or t
atggttttctatcatcgggttttgaaatgccacgtccttatcgatctaaaagtggaagaattctcccattcgaatgttggccagctgaatacttacctgaattactacaggaaaaatatcgttttggaggatgataatccgcccattggaatcttgatggtgaccgataaaaatgattctttggtggaatatgccactgctgggatggacgaaaatctgtttgtgaagaaatacctggtcaaccttccttcgattcaagaattgaatgcgattattcaaaaggaactagaccagagattcacggggaatttaaaatga

SEQ ID NO: 18754 - protein, 105 aa, Unknown
  Obtained from environmental sample
  misc_feature (1)..(105): Xaa is any amino acid
MVFYHRVLKCHVLIDLKVEEFSHSNVGQLNTYLNYYRKNIVLEDDNPPIGILMVTDKNDSLVEYATAGMDENLFVKKYLVNLPSIQELNAIIQKELDQRFTGNLK

SEQ ID NO: 18755 - DNA, 645 bp, Unknown
  Obtained from environmental sample
  misc_feature (1)..(645): n is a, c, g, or t
ttgaattgctggtttttaacagcaacaattccttgggtaaatcgaaaaatgatgatcaagaactccaataaattgatggagttgttagacaatgctccgtatgattttattttaaatcatcaagaatcagatgtagaacggtttcaagattttgtacacagaacatttaattcggtagatgcaattcagtttgtaaaatccctgcaacacatttacataaaccacaacggattagagcaatcacttactattaaagacaatacacaaaattacagaacagcaatttctaattttaaatcattattttttgaaattccacatcaacaaagaacacaaaaacacatttcggatcccataaaaggttcagcagcaaaaagaataaatatgtttttacgctggatggtaagaaacgacacttgtggcgttgacttcggaatttggaaaacacacaatccagcacatatttcttgtccgattgatgtacattctgggaatgtagcacggaaactcgggttgctaaaaagaaaacaaaatgattggaaagcagttctagaattggataaaagtttacggcttttagataaaaaggatccttctaaatacgattttgctttattcggattaggcgtttttgaaaaattttaa

SEQ ID NO: 18756 - protein, 214 aa, Unknown
  Obtained from environmental sample
  misc_feature (1)..(214): Xaa is any amino acid
MNCWFLTATIPWVNRKMMIKNSNKLMELLDNAPYDFILNHQESDVERFQDFVHRTFNSVDAIQFVKSLQHIYINHNGLEQSLTIKDNTQNYRTAISNFKSLFFEIPHQQRTQKHISDPIKGSAAKRINMFLRWMVRNDTCGVDFGIWKTHNPAHISCPIDVHSGNVARKLGLLKRKQNDWKAVLELDKSLRLLDKKDPSKYDFALFGLGVFEKF

SEQ ID NO: 18757 - DNA, 804 bp, Unknown
  Obtained from environmental sample
  misc_feature (1)..(804): n is a, c, g, or t
atggatcaagaatcggctcgagagttgaggaaattaaatacaagaagagaaagacaatcttggtttccgcacaaagcagaaactgtaaagccatatcattataaagtgtatttggccgattatgatgtggttgcagaagttgcgccaacagaaagagccgcgcattttaaatttacatttccaaaatcggactcttcttatattatgctcgatgctttttttaaaggttctatggttaaaataattcctaaagaacgtaaaattattggttatagtagaaataatagtggcggagttccagataattttcacaattattttgtggcagaatttgataaagattttgaaattaatcatacgtggacagatggttggaaattgttagaaaacacattagatagcgaaggaaaacatgttggagccattattggttttaaaaccaaaaaaggagaagttgttcatgtaaaagtagcatcttcatttatcagtccagaacaagcacaactaaatttagatagagaaattggtaaagattcttttgatcaaaccaaagaaaaagcaaaacaagcttgggaaaaagagctgaataaaattcaggtagaagatgataatattgataatattagaactttttattcttgtttgtaccgtgttttattgtttccaagaaaattttatgagtttgataaagacaataaagttgttcattacagtccgtataacggaaaagttttacgggttatatgtctacagacaacggtttttgggacacttatacagcggtttatccattttttaatatga

SEQ ID NO: 18758 - protein, 267 aa, Unknown
  Obtained from environmental sample
  misc_feature (1)..(267): Xaa is any amino acid
MDQESARELRKLNTRRERQSWFPHKAETVKPYHYKVYLADYDVVAEVAPTERAAHFKFTFPKSDSSYIMLDAFFKGSMVKIIPKERKIIGYSRNNSGGVPDNFHNYFVAEFDKDFEINHTWTDGWKLLENTLDSEGKHVGAIIGFKTKKGEVVHVKVASSFISPEQAQLNLDREIGKDSFDQTKEKAKQAWEKELNKIQVEDDNIDNIRTFYSCLYRVLLFPRKFYEFDKDNKVVHYSPYNGKVLRVICLQTTVFGTLIQRFIHFLI

SEQ ID NO: 18759 - DNA, 414 bp, Unknown
  Obtained from environmental sample
  misc_feature (1)..(414): n is a, c, g, or t
atgcaaatgctcgcccaccacatcaataccgtcctcaaagccttcatcatcctactcaaaggcgacaagaaggtccttggcaacatcgaactgatcaccctcgaccagatccgactttggatttcggcgcgggtgacggaccttcccctggaagtccggagtgcggttgcccacgaactcaaaaagaaatcccaggtaaggcgcctactcaaaaagaccgttgatgaccaaaccctgacccaggatgtctatcgaatagtggcagctaccgtattcaattacgccaaaaccaaggatttcgcgcagatgcgggtggatgaagaatgggtgcgcatgtttgtttttctctacaacttgttccaacaacttcccgaaaaccacgttgatcaccatattttatacagcaattattaa

SEQ ID NO: 18760 - protein, 137 aa, Unknown
  Obtained from environmental sample
  misc_feature (1)..(137): Xaa is any amino acid
MQMLAHHINTVLKAFIILLKGDKKVLGNIELITLDQIRLWISARVTDLPLEVRSAVAHELKKKSQVRRLLKKTVDDQTLTQDVYRIVAATVFNYAKTKDFAQMRVDEEWVRMFVFLYNLFQQLPENHVDHHILYSNY

SEQ ID NO: 18761 - DNA, 897 bp, Unknown
  Obtained from environmental sample
  misc_feature (1)..(897): n is a, c, g, or t
atgaaagcagaaatcatctcaattggcaacgaacttctcatcggcgacactataaacacgaacgccacatggatgggggaatttatgactgagcacggatttgaggttgctcgagtctatactatatcagataatatcaatgatataaaagaaacagttacgaatgcgctgaatatagcggatattgttttgtgcacaggcgggcttggcccaactcatgatgacatcacaaaaaaagcactcgcagatctttttgatatgaagatgagaactgaccctgaagtgctagaatttgttaaaagcatgtttgctgagcgtaatattccgttctcaccatcaaattttggacaggctgaagttccagaaaattgcgacgtattatttaacaaagcaggtactgcgcctggtatgtggtttaatatcgatgggaaattcctagcagtgatgccaggtgtaccttatgagatgaagtacataatgaaaaacggagttgctccaaaattgaaagaaaatttcggcgatgttggctatttgtactctcactatatcaaaactgctgggataggagaaagtactttaagcgataacgtactgggaaatctggatacttttttaacaaatggcgtaagccttgcttttctgccgatgcccggtggagttacgctgagagtaaatgggcaaggaactacgaaagaagaagcacaaaaaaatattaagccacttttaacttatatcttagataaagcgaaagagtttataattggcgaaggaaaaaatctcactgtaagcgaagtaaatggtaaactatttaataatcaaaaactgaacattgctaccgctgaaaagtgtactggcggaatgatagttaacgagctaacaaatatcgcttggaagtag

SEQ ID NO: 18762 - protein, 298 aa, Unknown
  Obtained from environmental sample
  DOMAIN (1)...(131): Probable molybdopterin binding domain
  misc_feature (1)..(298): Xaa is any amino acid
MKAEIISIGNELLIGDTINTNATWMGEFMTEHGFEVARVYTISDNINDIKETVTNALNIADIVLCTGGLGPTHDDITKKALADLFDMKMRTDPEVLEFVKSMFAERNIPFSPSNFGQAEVPENCDVLFNKAGTAPGMWFNIDGKFLAVMPGVPYEMKYIMKNGVAPKLKENFGDVGYLYSHYIKTAGIGESTLSDNVLGNLDTFLTNGVSLAFLPMPGGVTLRVNGQGTTKEEAQKNIKPLLTYILDKAKEFIIGEGKNLTVSEVNGKLFNNQKLNIATAEKCTGGMIVNELTNIAWK

SEQ ID NO: 18763 - DNA, 843 bp, Unknown
  Obtained from environmental sample
  misc_feature (1)..(843): n is a, c, g, or t
gtgagaatctcaccaacagaggagcgccaatattggtggttgaatgccaatccgaaggtttgggatttcaagaacataggggttggagagaccgaggactttactgcttacaacgaacagggcaataaacggcaaaagttcaagtacttcgagcaggttcgcccgaatgacctggtcatcggctatctgtcgacgccttccaagcagatcgtttctatctgcgagatcaccaaggggatgaaggagaccggtggcgaaggctttgagattcgcaaactggaggacgtgccccgtccgatcgcctgggagaatctgaaagggattccgcaactcaaagagtgcgaaccccttctcaacaatcagggaagtctgttcaagctgaccgccgacgagttcgagtttcttcgcagtctcatcgacgaccaggaagtcgagcaggaagcggtcgttccctacagccgggaagatgcgttgaaagatctcttcatggacgagcaggagtttgaccggattctgtcgctgttgaaacggaagaaaaacatcgttctgcaggggccacccggagtcggcaagacctttgtcgctcggaggcttgcgtatgccctgatgaagctgaaggacgagcaacgggcgccaatggtgcagtttcaccagtcctactcctacgaggactttatccagggataccggccggacgggaagggatcgtttcatatgcgcagcggcacctttcataccctctgccgccaggcgcagcgggacacgggccgggactactttctcatcattgacgaaatcaatcgcggcaatctcagcaagatcttcggagagctcatgatgngn

SEQ ID NO: 18764 - protein, 281 aa, Unknown
  Obtained from environmental sample
  DOMAIN (9)...(140): Family of unknown function (DUF589)
  misc_feature (1)..(281): Xaa is any amino acid
MRISPTEERQYWWLNANPKVWDFKNIGVGETEDFTAYNEQGNKRQKFKYFEQVRPNDLVIGYLSTPSKQIVSICEITKGMKETGGEGFEIRKLEDVPRPIAWENLKGIPQLKECEPLLNNQGSLFKLTADEFEFLRSLIDDQEVEQEAVVPYSREDALKDLFMDEQEFDRILSLLKRKKNIVLQGPPGVGKTFVARRLAYALMKLKDEQRAPMVQFHQSYSYEDFIQGYRPDGKGSFHMRSGTFHTLCRQAQRDTGRDYFLIIDEINRGNLSKIFGELMMX

SEQ ID NO: 18765 - DNA, 387 bp, Unknown
  Obtained from environmental sample
  misc_feature (1)..(387): n is a, c, g, or t
atgattaacgtaggagcatcctcatatttattaaaaaatacaagtccaaaaattgtaattcacaccataaatgaagtctttgaaaaaggtttttattatgatgaaaaagtactaaaaaccattcatgaaaacctactttcttctagtggtaaaaagattaaaaacgacttagatgaaaacttactctctaaaagagagcgcgaagttttagaattaatctgtgcgcaattaactacaggcgaaattgccgaaaaattatttataagcccaagaacaattgaaggacatcgtaaaagtttgttgttaaaaacagcatctaaaaatgttgcgggtttagttatttacggaattcaaaagaaattaatagaactatcaatagaattataa

SEQ ID NO: 18766 - protein, 128 aa, Unknown
  Obtained from environmental sample
  DOMAIN (59)...(116): Bacterial regulatory proteins, luxR family
  misc_feature (1)..(128): Xaa is any amino acid
MINVGASSYLLKNTSPKIVIHTINEVFEKGFYYDEKVLKTIHENLLSSSGKKIKNDLDENLLSKREREVLELICAQLTTGEIAEKLFISPRTIEGHRKSLLLKTASKNVAGLVIYGIQKKLIELSIEL

SEQ ID NO: 18767 - DNA, 306 bp, Unknown
  Obtained from environmental sample
  misc_feature (1)..(306): n is a, c, g, or t
atgtttgctactgttgagtttccaatagaaagaaaagcaacttctaacatggtattgttgcctaaagaagcaattattacaaacggacaattatcgggtgtttacacaacaagtcaaagtaatactgctgttttacgttggttgcgtttggggaaaacctatggaaatcaagttgaggttttatctggattaaaatctggagaaacctatatcatttctgcggaagggaaattgtacaacggagttaaaataatcccatcctcaatccttcccaaagggaaggaagctagtacgaaaataaaataa

SEQ ID NO: 18768 - protein, 101 aa, Unknown
  Obtained from environmental sample
  misc_feature (1)..(101): Xaa is any amino acid
MFATVEFPIERKATSNMVLLPKEAIITNGQLSGVYTTSQSNTAVLRWLRLGKTYGNQVEVLSGLKSGETYIISAEGKLYNGVKIIPSSILPKGKEASTKIK

SEQ ID NO: 18769 - DNA, 846 bp, Unknown
  Obtained from environmental sample
  misc_feature (1)..(846): n is a, c, g, or t
ttgatttcgaatatcaaaggagttgagtatgtgtattctacttctatggatgaaaaagcgatggtaattgtgcagttttatgtgggcgaagatattgagcgttcgtttgtaaaattatacaacgaaattaacaaacacatggatgaaatgccaaaaggagttacgtttcctttggtaaaaacacgcgctattgatgatgtacccatgttgggtttaacgttgtggagtaaaaactacagtgattatcagttaagtcagatagcacaagaattagaaaacgaaatcaaaaaagtaaatgatgtttctatcacgcataaaataggcggtagaaatcgtcaattacgggtggttttaaacaaagataaattggcggcaagcggattagatttcttgtctgtttctaaaatgataaaagccaataatacgcaattaagttcagggagttttgataaaaatgatacagaatttttagtaacaactggtacatttttgtcttctgcaacagacgttgaaaatttagtggtgggcgtgcaacaaaatcgtcccatttatttaaaacaaattgccacgattattgatggtccagaaataccacaaaattatgtgtctttaggttttggtaaggcgagcgaaaaaaagcaaacgtacaaatctgaatatcctgcggttacgatttctgtagccaaaagaaaaggagcagatgccatgaaaattgcggaggtaattattgataaagtaaatcatttaaaaaccactttaattccagatgatgttcatgtagaaattacaagaaattatggagaaacagcatcacataaagtgtcagaattctcgagccgattctga

SEQ ID NO: 18770 - protein, 281 aa, Unknown
  Obtained from environmental sample
  misc_feature (1)..(281): Xaa is any amino acid
MISNIKGVEYVYSTSMDEKAMVIVQFYVGEDIERSFVKLYNEINKHMDEMPKGVTFPLVKTRAIDDVPMLGLTLWSKNYSDYQLSQIAQELENEIKKVNDVSITHKIGGRNRQLRVVLNKDKLAASGLDFLSVSKMIKANNTQLSSGSFDKNDTEFLVTTGTFLSSATDVENLVVGVQQNRPIYLKQIATIIDGPEIPQNYVSLGFGKASEKKQTYKSEYPAVTISVAKRKGADAMKIAEVIIDKVNHLKTTLIPDDVHVEITRNYGETASHKVSEFSSRF

SEQ ID NO: 18771 - DNA, 312 bp, Unknown
  Obtained from environmental sample
  misc_feature (1)..(312): n is a, c, g, or t
ttgtggattaaaaacacagtacatcatcaggcaactttttatagaagagaattatttaaagagagtcagtataatacagattataaaatattggcagattatgagtttaatttacgtttgtttaaaaagaaaaagagggtaaaaattattcctaatatcatagctctctgtggtactcaaggtatttctaaaaactacaattggtcattatataaagaagaaattaaatttaaaacaaaattgtcatcaaaattattgtggcctttgttttttaaaatagcgttgttaaagtatctttttaagaaagtataa

SEQ ID NO: 18772 - protein, 103 aa, Unknown
  Obtained from environmental sample
  misc_feature (1)..(103): Xaa is any amino acid
MWIKNTVHHQATFYRRELFKESQYNTDYKILADYEFNLRLFKKKKRVKIIPNIIALCGTQGISKNYNWSLYKEEIKFKTKLSSKLLWPLFFKIALLKYLFKKV

SEQ ID NO: 18773 - DNA, 621 bp, Unknown
  Obtained from environmental sample
  misc_feature (1)..(621): n is a, c, g, or t
atgagatttacacagcctccatacccaacagttttttttagcgaaaaaatagttgtaaaatgtaatgaatgtaatggtgttggaatcgttaaaacaacgttgggtaagtacataattccattccctcatgatcacaaatctacgtttacttgtacaagttgtggagttataaaaaagcactcaaaagagtggcacggatattatcaaggttttttaacgatagcttgtggatattgtggtagtaatattgttcacgctaccaaaccagtcaaaaaaattacaaaaaccgctcaaataaaatgtgaagcttgtaagaaagaaaaagaatatcaattaaaatggtatcgatatcgaaaagacaaatctatcgacccttattttggattagatttatggcttcaaattaattttaaaaaccattttttatgggtgtataatttagagcatttaaaatatttaaaagaatatgtcactgctaaattaagagaagataatgataggcataagtattctatgattacaaaccttccacaatggattaaatctgctaaaaatcgtgaaggtcttttaaaaaaactgaatacactagaaaacgactttaccacattaactatggnttaa

SEQ ID NO: 18774 - protein, 206 aa, Unknown
  Obtained from environmental sample
  misc_feature (1)..(206): Xaa is any amino acid
MRFTQPPYPTVFFSEKIVVKCNECNGVGIVKTTLGKYIIPFPHDHKSTFTCTSCGVIKKHSKEWHGYYQGFLTIACGYCGSNIVHATKPVKKITKTAQIKCEACKKEKEYQLKWYRYRKDKSIDPYFGLDLWLQINFKNHFLWVYNLEHLKYLKEYVTAKLREDNDRHKYSMITNLPQWIKSAKNREGLLKKLNTLENDFTTLTMX

SEQ ID NO: 18775 - DNA, 372 bp, Unknown
  Obtained from environmental sample
  misc_feature (1)..(372): n is a, c, g, or t
ttgattcggctcagcgatcgcatgctgaagcggctggttccgttgacactgaaaactaaaactggatctcncattggaggcgacgttgtcaattctgatcccgtcggcagctccgtttgcttctatatgcagcttggtattgggatttgcggtccctatacccacattttgcccttcaaccaaagcggtaaggagcagcgtgcacaggcaagcagaaaagtatttaaagtaaattttcaacatacacagacaaaaattaaccgatgcggtacagaaacagcatttcacttgaatatcaatttaagaaaaatcagaccacagaccaacaatccctcaaaaaaaatgccgcccctgaaacagggcagcatttga

SEQ ID NO: 18776 - protein, 123 aa, Unknown
  Obtained from environmental sample
  misc_feature (1)..(123): Xaa is any amino acid
MIRLSDRMLKRLVPLTLKTKTGSXIGGDVVNSDPVGSSVCFYMQLGIGICGPYTHILPFNQSGKEQRAQASRKVFKVNFQHTQTKINRCGTETAFHLNINLRKIRPQTNNPSKKMPPLKQGSI

SEQ ID NO: 18777 - DNA, 387 bp, Unknown
  Obtained from environmental sample
  misc_feature (1)..(387): n is a, c, g, or t
ttgttacttataattaaccataatgttataaaatgtacaggaaacaacatagagaaaaccatgccttcaaaatttatatctcagccaacaaggaaacacattgatgatcaattcagtattttacagctctgttctggtcaagacgccaaaggccgtgatttttatgcctatataaacattcctcccgacaagtatgaagaatacctaaccttgtctttatctcataaaactttagacctgacatcatttggagatatcatacatgcaggttttggtataatgcctactgcaaatacacaaagaaaaatggaagaacagtatggagtcaatcataataattttttagataacaatattttaaaggaaattataaaacatgaacaatga

SEQ ID NO: 18778 - protein, 128 aa, Unknown
  Obtained from environmental sample
  misc_feature (1)..(128): Xaa is any amino acid
MLLIINHNVIKCTGNNIEKTMPSKFISQPTRKHIDDQFSILQLCSGQDAKGRDFYAYINIPPDKYEEYLTLSLSHKTLDLTSFGDIIHAGFGIMPTANTQRKMEEQYGVNHNNFLDNNILKEIIKHEQ

SEQ ID NO: 18779 - DNA, 333 bp, Unknown
  Obtained from environmental sample
  misc_feature (1)..(333): n is a, c, g, or t
ttgatcggtcagatacgggagcttagtattgtgtctgatattctaaaacctaaattgggcagatatgaatacgaatcagttagagaatttagcaaatcaactcacaaaaggagttataacgcaaatggaagaactacttttaaagacgagtttgtaactgctggtggaatcgatttaaaagaaattaattttaaaagttttaaaagtagaaaacacaacaacttattttttgttggagaaattttaaatattgatgccgtaacaggtggatttaattttcagaatgcgtggactggtggttttattgctgcaaaagcgattgctgagaattaa

SEQ ID NO: 18780 - protein, 110 aa, Unknown
  Obtained from environmental sample
  misc_feature (1)..(110): Xaa is any amino acid
MIGQIRELSIVSDILKPKLGRYEYESVREFSKSTHKRSYNANGRTTFKDEFVTAGGIDLKEINFKSFKSRKHNNLFFVGEILNIDAVTGGFNFQNAWTGGFIAAKAIAEN

SEQ ID NO: 18781 - DNA, 759 bp, Unknown
  Obtained from environmental sample
  misc_feature (1)..(759): n is a, c, g, or t
gtgctggtattcggcaagccccgcactgccattttcgcgcatatggattccatcggtttcaccgtaaggtacggcaaggaattggtgaaaattggcggcccacgggtaaagcctgagtacaaactggtaggcagcgacagcaaaggcgatattgaatgccaactaggtgttaccgaaaacgccgacataaaatacacctacaaaagggaacttgataggggcactaccctcacctttaagcccaactttagggagacaaaaaactacgtgcagtgctgctacatggataaccgcctaggcatgtggaatgccctgcaagtagcagaaacactggagaatggtatcatttgctttagcacctacgaggaacacagcggcggctcagtgggtttcctagccaagtttatttatgagaagtataaggtaagccaaaccctcatctccgacattacctgggtaaccgatggcgtaaaagctggcaaaggcgtggcagtgagtatgcgcgactcaggtataccacgcaggcaatacatcaaccgcattattgatattgcgcaaaaaagtaaagtcccctttcaactggaagtggaaggcagcggcggcagcgatggcaaccagatacaggcatcgccctaccctgttgactggtgttttgtaggcgcacccgagcaaaacgtacatacccccgacgagaaagtgcacaaagccgatatacaagccatggttgatttgtataaggtattgatgagggaattgtag

SEQ ID NO: 18782 - protein, 252 aa, Unknown
  Obtained from environmental sample
  DOMAIN (5)...(244): M42 glutamyl aminopeptidase
  misc_feature (1)..(252): Xaa is any amino acid
MLVFGKPRTAIFAHMDSIGFTVRYGKELVKIGGPRVKPEYKLVGSDSKGDIECQLGVTENADIKYTYKRELDRGTTLTFKPNFRETKNYVQCCYMDNRLGMWNALQVAETLENGIICFSTYEEHSGGSVGFLAKFIYEKYKVSQTLISDITWVTDGVKAGKGVAVSMRDSGIPRRQYINRIIDIAQKSKVPFQLEVEGSGGSDGNQIQASPYPVDWCFVGAPEQNVHTPDEKVHKADIQAMVDLYKVLMREL

SEQ ID NO: 18783 - DNA, 486 bp, Unknown
  Obtained from environmental sample
  misc_feature (1)..(486): n is a, c, g, or t
gtgatcaagaatcggtcgagcggtcgagaaatcaaggaaattattcgtccgtgtggtttatcacccatgaaaagcaaaggcatttacggattgtcaaaaattttgattgaaaaatacaacggggaagttccgcaaagttttgaaggattggaagaattgcctgccgttggacacaaaacagcaagtgtggtgatgagtcaagcttttggaattcctgcttttccggttgatacacatattcacagattaatgtatcgttggaatttatccaacggaaaaaacgttacacaaacagaaaaagatgcaaaacgattatttccaaaagaactttggaacgaattgcatttacaaattatttggtacggacgtgaatattctccagcgcgtggttgggatttagaaaaagatatcattacaaaaacaattggacgacaagctgttttagatgactattataaaaatagactcaagaaaaaagataaatag

SEQ ID NO: 18784 - protein, 161 aa, Unknown
  Obtained from environmental sample
  DOMAIN (1)...(108): HhH-GPD superfamily base excision DNA repair protein
  misc_feature (1)..(161): Xaa is any amino acid
MIKNRSSGREIKEIIRPCGLSPMKSKGIYGLSKILIEKYNGEVPQSFEGLEELPAVGHKTASVVMSQAFGIPAFPVDTHIHRLMYRWNLSNGKNVTQTEKDAKRLFPKELWNELHLQIIWYGREYSPARGWDLEKDIITKTIGRQAVLDDYYKNRLKKKDK

SEQ ID NO: 18785 - DNA, 336 bp, Unknown
  Obtained from environmental sample
  misc_feature (1)..(336): n is a, c, g, or t
gtggatcacagaattcggctcgagctattatcgttatgctttgtgttatctggatgtgcgaatagtgcaaatcacgaagttgtaacctcaacgaaaagcagtgataaatatcttacttgcaaagatatacgcattgagaaaaagcgtattgaaggtattattgacggtgtcaatcaagataagcaagatatgacaggggcagatgttgtggacgggttgctttggtttccgtttaacgtgattgcaaagcagtccaattattcaaatgcgattaaggccgcagaaaaaagattggatcatttgattgttttggaaaaagaaaataaatgtaaataa

SEQ ID NO: 18786 - protein, 111 aa, Unknown
  Obtained from environmental sample
  misc_feature (1)..(111): Xaa is any amino acid
MDHRIRLELLSLCFVLSGCANSANHEVVTSTKSSDKYLTCKDIRIEKKRIEGIIDGVNQDKQDMTGADVVDGLLWFPFNVIAKQSNYSNAIKAAEKRLDHLIVLEKENKCK

SEQ ID NO: 18787 - DNA, 504 bp, Unknown
  Obtained from environmental sample
  misc_feature (1)..(504): n is a, c, g, or t
atgagaatcataccagcaatagacatcatcgacggaaaatgcgtccgtttgtcaaaaggagattataacaccaaaaaaatatacaatgaaaatccgttagaagttgccaaagaatttgagcaagcaggtattgagtatttgcatttagtggatttagatggcgcaaaagcaagtaaaatcatcaattataacgtcttagaactaattgcatcgaaaaccaatttaaaaatcgattttggtggcggtttaaaatctgataaagatgtagaaattgcgtttaattcaggcgcaaatcaaattactggtggaagtatcgctgtaaaaaacagagaggtttttaaaagttggattgaaaattatggttcacaaaaaatcattttaggagccgatttttatcctgatcatataggcggaaagattgcaacaaatggttggcaagaagaaagttctttagagttgattccgtttgtaaaagaatatcagcaaaaaggaattcagtattaa

SEQ ID NO: 18788 - protein, 167 aa, Unknown
  Obtained from environmental sample
  DOMAIN (2)...(165): Histidine biosynthesis protein
  misc_feature (1)..(167): Xaa is any amino acid
MRIIPAIDIIDGKCVRLSKGDYNTKKIYNENPLEVAKEFEQAGIEYLHLVDLDGAKASKIINYNVLELIASKTNLKIDFGGGLKSDKDVEIAFNSGANQITGGSIAVKNREVFKSWIENYGSQKIILGADFYPDHIGGKIATNGWQEESSLELIPFVKEYQQKGIQY

SEQ ID NO: 18789 - DNA, 432 bp, Unknown
  Obtained from environmental sample
  misc_feature (1)..(432): n is a, c, g, or t
atgctattaaaaacaaaaaaaatgagtacaaaaatactcaatataatttatatgagtctattactggttaatgcctggagtaatttatcgtttgcaaatgaactcacaccagtaatctatgaaacccctaaatctttgataacttataaaatggacacaaaacaagacgccatttttttgttatcttcagatgactttaaaaaagaattaattaacttagctaagcttatagattctgtagataaaaaagaaatacttgaacgtgaaaacattgcattgagttcttttttaggacaattcagtaaatgcattgccataattgatcagaacaaatacccattaaaattttatcattattccttgtatgcgaatagtcattctcaatctttatccaatgctggctctctagataataatattgaaaaaacctga

SEQ ID NO: 18790 - protein, 143 aa, Unknown
  Obtained from environmental sample
  misc_feature (1)..(143): Xaa is any amino acid
MLLKTKKMSTKILNIIYMSLLLVNAWSNLSFANELTPVIYETPKSLITYKMDTKQDAIFLLSSDDFKKELINLAKLIDSVDKKEILERENIALSSFLGQFSKCIAIIDQNKYPLKFYHYSLYANSHSQSLSNAGSLDNNIEKT

SEQ ID NO: 18791 - DNA, 888 bp, Unknown
  Obtained from environmental sample
  misc_feature (1)..(888): n is a, c, g, or t
atgtcaattatcaaaagaattggtggaattattacgcaccaagatttggaaagttacaaagctatttggcgtaaacccattgtttttaattacaaagggtacaaaattacatcaatgacattgcctgcaagtggcggaatttgtttggcacaaattttaaaatcgattgagccgtatgatttatcaaacatcaaacacaactcaacgaaatacattcaattattaaccgaagcagaacgaagatcgtatgcagatagagcacattttttaggtgatattgattttgtagatgtgccaattgatagtttaaccgctccaaaatatatcaaagaaagaatgagtactttttcgtgggacaaagcaacaaaatcttcagacgtttctcatggaaatgttttaggatatgaaagtaatgaaaccacacattattctattgtagataaagacggaaatgctgtttctgtaaccacaacattaaatacaggttacggctctaaagtgttggtaaaaggtgcaggatttttcttaaataatgaaatggacgatttttctgcaaaacctggtgtaccaaatgtgtacggtttattaggatcttctgcaaacgcaattgcgccagaaaaaagaatgttaagttctatgacgccaaccattgtagaaaaagatggaaaattgaaaatggtggttggaactcctggaggatcaacaataataacttcggttttgcaaaatattttaaatgtagtagaatatgatatgggaatgcaagaatctgtaaacaaagcacgttttcatcatcaatggatgccagacaatattagaatggaaccaaacgggtttgacagcattaccaaagtaaatttaaagctcgagccgattcttgatccgtag

SEQ ID NO: 18792 - protein, 295 aa, Unknown
  Obtained from environmental sample
  DOMAIN (2)...(295): Gamma-glutamyltranspeptidase
  misc_feature (1)..(295): Xaa is any amino acid
MSIIKRIGGIITHQDLESYKAIWRKPIVFNYKGYKITSMTLPASGGICLAQILKSIEPYDLSNIKHNSTKYIQLLTEAERRSYADRAHFLGDIDFVDVPIDSLTAPKYIKERMSTFSWDKATKSSDVSHGNVLGYESNETTHYSIVDKDGNAVSVTTTLNTGYGSKVLVKGAGFFLNNEMDDFSAKPGVPNVYGLLGSSANAIAPEKRMLSSMTPTIVEKDGKLKMVVGTPGGSTIITSVLQNILNVVEYDMGMQESVNKARFHHQWMPDNIRMEPNGFDSITKVNLKLEPILDP

SEQ ID NO: 18793 - DNA, 351 bp, Unknown
  Obtained from environmental sample
  misc_feature (1)..(351): n is a, c, g, or t
atgttcaaaacctggaaatccggcctggacatggacaaagtgcgagctattggtcccctgcaattccaatgcatgttcctgagaaagctgataaaaatgctgctctgctttaaaatattctggagctcaaagctgcagatttggaaccaaaagcgaatcgaaatcagcgagagcaaagggatgaaatatatcggcagtttgatatcggaaatcaaggaatggcttgttgggaggaaagccaagagcaaaaatctactgaataaaattgcgaatacaatgagtaaaacatgcatcaaacaagccaaaaagggcgatttaagtcctctggaaactatacaatgttatgcttaa

SEQ ID NO: 18794 - protein, 116 aa, Unknown
  Obtained from environmental sample
  misc_feature (1)..(116): Xaa is any amino acid
MFKTWKSGLDMDKVRAIGPLQFQCMFLRKLIKMLLCFKIFWSSKLQIWNQKRIEISESKGMKYIGSLISEIKEWLVGRKAKSKNLLNKIANTMSKTCIKQAKKGDLSPLETIQCYA

SEQ ID NO: 18795 - DNA, 321 bp, Unknown
  Obtained from environmental sample
  misc_feature (1)..(321): n is a, c, g, or t
gtgaaaaccagccgatcttttcaggaaatgctaaaattgaatgctatatttcactttgcaggtcagctaaatacacaattgaccgcgatttacctggcaccggacatcatcccgcagggaaccatcggttcgagattttccctcgattgtggagtcaaaaagggaattcaaaagggcaaaggtgagctgtttgtgaacgcaaccgatttgctcaataccatgatcattaagaaaacgattgttggcaacaatttcacttataccagcgccaattactacgaaacccaggtcattcggctgggttacaactataagttttag

SEQ ID NO: 18796 - protein, 106 aa, Unknown
  Obtained from environmental sample
  misc_feature (1)..(106): Xaa is any amino acid
MKTSRSFQEMLKLNAIFHFAGQLNTQLTAIYLAPDIIPQGTIGSRFSLDCGVKKGIQKGKGELFVNATDLLNTMIIKKTIVGNNFTYTSANYYETQVIRLGYNYKF

SEQ ID NO: 18797 - DNA, 495 bp, Unknown
  Obtained from environmental sample
  misc_feature (1)..(495): n is a, c, g, or t
atggctgaagcaagactatacacacagtacaaagaggagattgttcctaaattaaaggaagaattttctattgaaaatgtgatgagcataccaaaacttgagaaaattgttatcaacgtaggtgttggtgaagcaattcaagataaaaaagtactcgacactatcgttgcaaacgtagcgcaaattacagggcaaatgccagtaactacaaaagcaaagacatctatctctaactttaagttaagagaaggaatgcctattggttgtaaagttacaatgcgctctcgcattatgtatgaatttttagatcgattcgtaaacttagcattaccaagaacacgagattttcaaggtgttcctgataagagttttgatggtcgtggaaattatacggttgggattaaggaacatacaatatttcctgaaatcgataccgataaagctacaaagatccatggtatggatataacctttgtaacctcgaccgattcttga

SEQ ID NO: 18798 - protein, 164 aa, Unknown
  Obtained from environmental sample
  DOMAIN (26)...(82): Ribosomal protein L5
  misc_feature (1)..(164): Xaa is any amino acid
MAEARLYTQYKEEIVPKLKEEFSIENVMSIPKLEKIVINVGVGEAIQDKKVLDTIVANVAQITGQMPVTTKAKTSISNFKLREGMPIGCKVTMRSRIMYEFLDRFVNLALPRTRDFQGVPDKSFDGRGNYTVGIKEHTIFPEIDTDKATKIHGMDITFVTSTDS

SEQ ID NO: 18799 - DNA, 519 bp, Unknown
  Obtained from environmental sample
  misc_feature (1)..(519): n is a, c, g, or t
ttgtttgtcaatattaaaactactggcgcagtaacatttagttcaaagtcccttgtgaataaaatgttgtcttttgccgagtttaaaggtgcaaaggtcattgtagaacttggcggaggagatggtagtataactaaaggaatcgttgaaaggatggacaaggatgccaccctgtatgtatttgagattagtgagcatttttgtgaaaaccttaaaaaagaatttgcttcagacaacgtggtaattatctgtgattctgcagaaaatatggacaaacacctgaaaggagagcctgttgatttgatcttatcttccttgccttttagccttatttccaaagaagccagaacggccatttacgagaaaagtagcctgatgcttaagccaagcggttattttatccaaatttgctattcctaccttttgcggttccaatttgctagtcattttagcaccataaaaacagcctttaccctaaagaattttcctccggcttttataatggtctgtaacagctga

SEQ ID NO: 18800 - protein, 172 aa, Unknown
  Obtained from environmental sample
  misc_feature (1)..(172): Xaa is any amino acid
MFVNIKTTGAVTFSSKSLVNKMLSFAEFKGAKVIVELGGGDGSITKGIVERMDKDATLYVFEISEHFCENLKKEFASDNVVIICDSAENMDKHLKGEPVDLILSSLPFSLISKEARTAIYEKSSLMLKPSGYFIQICYSYLLRFQFASHFSTIKTAFTLKNFPPAFIMVCNS

SEQ ID NO: 18801 - DNA, 894 bp, Unknown
  Obtained from environmental sample
  misc_feature (1)..(894): n is a, c, g, or t
gtggatcaagaatcggtcgagaacactaataaaaaaggagaggtaataagtttaagaggagtagtacaagacataacagagcaaaaactaattagaattaaaatagcaaagagtcaagaaatgcaacttttgctagccaataacaccagtgatattatttgtttgcaagatgaagagggtatttttagatacattaccccttctataaaaaatattttaggatataagcaatctgattttattggtaaaacaatttttaaaatagtacacaaagaagatgttattgcactaagaaatgaaatgaaaaccctaatttttaaaggcaaaaataaagaggcatttacttttagggctcgtcataaaaaagggcattatatatggctagaatttttaacatctcctatctttaaagataaaaaaataagtcattttgttacgtctgcaagagatattacacaatggattttagccaaagaaaagattgaaaaacatcaatcatcacttcaacgcctaacaaatgaaataataataattgaagaaaaacagaaaaaagaaatagcttctaatatacacgatcatcttagtcaatctttagtgatttctaaaatgaaaattaatcaattaaagaaaaattctaaattagaagcaatcaacaacgatttaaagtttatagaagatcatatcactgaagccttagaaaatagccgtaaaattacttatgaactttcacctccagtgttatatcaattaggaatcatagaagccttaagctggttgctggatgatttagaagccaagcatcaaattacatttaaactgaacacacaaaacacaaattttaaacttagggaaataaaatctataatactctatagaaggctacaagaagtttaa

SEQ ID NO: 18802 - protein, 297 aa, Unknown
  Obtained from environmental sample
  DOMAIN (113)...(154): PAC motif
  misc_feature (1)..(297): Xaa is any amino acid
MDQESVENTNKKGEVISLRGVVQDITEQKLIRIKIAKSQEMQLLLANNTSDIICLQDEEGIFRYITPSIKNILGYKQSDFIGKTIFKIVHKEDVIALRNEMKTLIFKGKNKEAFTFRARHKKGHYIWLEFLTSPIFKDKKISHFVTSARDITQWILAKEKIEKHQSSLQRLTNEIIIIEEKQKKEIASNIHDHLSQSLVISKMKINQLKKNSKLEAINNDLKFIEDHITEALENSRKITYELSPPVLYQLGIIEALSWLLDDLEAKHQITFKLNTQNTNFKLREIKSIILYRRLQEV

SEQ ID NO: 18803 - DNA, 867 bp, Unknown
  Obtained from environmental sample
  misc_feature (1)..(867): n is a, c, g, or t
gtgacaatgggagtagccaagaaaaatcaaagcattcaagattggattactcaacaatgggttattctttttggagaaagaattgacacctcgaaatacaagtggcttttaggtccatttggtgaaactcatggaatagggatgaaatttgttgagcaattggctaaagatgaaaacttggtaattgataatctaaaaaatgataagggattactagattcaattaagcatttaagactacctgacactgactttcaaagactatctccaaaagtaatagatttctatgaaaacacatcaaattatgacctactgctaaaagcgaaatggaatccaattttcaaaatttttggctcgttagtcagaatgattttcagcaatagaattgaacaacttaatgttccaattcaaaacttagaagatggatcaggtctaactaacgaaataattaaactactcgattccaaaacaaatgaagtcaaaaggactatttggttaagggcttttaaatcgacaggtcacgttgtttactcaggagtttatgagacatgttctttaccgaataaagaaacttgcatcaaagctgttttccctctacctaatggaaacgcaacggtgattctaactcccagtgtcggtaaaaatggagactcattttggattcatcagacaaagagttgtgatagcggatttataaagcctagagattctcgagccgaatcaaactcccaacggccgcgcnnnngatttgtgtctttgtcgtctgctttcgttcttctctctgtatttgccgcagttggtctgcggcagattttttctgcnctgctcgctctattgatccttctctgtgatgtgtttggctgttag

SEQ ID NO: 18804 - protein, 288 aa, Unknown
  Obtained from environmental sample
  misc_feature (1)..(288): Xaa is any amino acid
MTMGVAKKNQSIQDWITQQWVILFGERIDTSKYKWLLGPFGETHGIGMKFVEQLAKDENLVIDNLKNDKGLLDSIKHLRLPDTDFQRLSPKVIDFYENTSNYDLLLKAKWNPIFKIFGSLVRMIFSNRIEQLNVPIQNLEDGSGLTNEIIKLLDSKTNEVKRTIWLRAFKSTGHVVYSGVYETCSLPNKETCIKAVFPLPNGNATVILTPSVGKNGDSFWIHQTKSCDSGFIKPRDSRAESNSQRPRXXFVSLSSAFVLLSVFAAVGLRQIFSALLALLILLCDVFGC

SEQ ID NO: 18805 - DNA, 381 bp, Unknown
  Obtained from environmental sample
  misc_feature (1)..(381): n is a, c, g, or t
ttgaaccatcgagagctcaagggtagaaattgggatagactcgttggnttgatgtacaccagtaaaatcgtcgttgggaccgatgcccaaatatggatgatcctttacgatatgattcagatatgggcattgatgttgcccaaatgctttgttgaggaagcgatcggcttgaaagcttttccggccgaagtctccggcaacgtcagcaagcattccaacaagtttattcaagagaaaaaatggattcttgaccaagaaccgctgatctcctgtttcattaaaatatccggtttcttccaaccaaagaactgcctcaggcaaatccaatataggaaaaatttcatgtgcaaaaggactcgcaatttcctcctctccttgtaa

SEQ ID NO: 18806 - protein, 126 aa, Unknown
  Obtained from environmental sample
  misc_feature (1)..(126): Xaa is any amino acid
MNHRELKGRNWDRLVGLMYTSKIVVGTDAQIWMILYDMIQIWALMLPKCFVEEAIGLKAFPAEVSGNVSKHSNKFIQEKKWILDQEPLISCFIKISGFFQPKNCLRQIQYRKNFMCKRTRNFLLSL

SEQ ID NO: 18807 - DNA, 708 bp, Unknown
  Obtained from environmental sample
  misc_feature (1)..(708): n is a, c, g, or t
ttggagcatattccaccctataagtttagcgttatacgtaacgaacaggcacaacttttggcgacgataatggatgctttgcctactaaatttgaaggctataaaaatcagtttcattctattagattgctgtcttttgataattgggttttgtttcctgattttcagttcatatcgttttcttatcctagagaaagtattttccaattcaaaaggagaaaggttaatttcaagattttggggataacgatttattcaaaaaggaatcagaaatttgaagaggttgaaatactgattatctccaatttaattaagggtttaaaaatcacgaactcagattataatgtatcggagtttgatttgaaaagaatagatgccaataaggcccaaaccctggatattgaagctccaccagcatctatagatatatttattgaatcattggatggagaaataaaagggaagctagatgttgataagattgaagaaattgattttaacaacagaacttattacagcatttataatctggaggatggaaattatttggtgatggataaaaatgagcaggtatattcattggtgcatgatgccatacccaagagtaaaaaaatgaaagctagtttaagggaaattcttaatgatatttcaagcggcaaatttgatgcggaagagcatttggatgagcgatatagcaatagtaaataa

SEQ ID NO: 18808 - protein, 235 aa, Unknown
  Obtained from environmental sample
  misc_feature (1)..(235): Xaa is any amino acid
MEHIPPYKFSVIRNEQAQLLATIMDALPTKFEGYKNQFHSIRLLSFDNWVLFPDFQFISFSYPRESIFQFKRRKVNFKILGITIYSKRNQKFEEVEILIISNLIKGLKITNSDYNVSEFDLKRIDANKAQTLDIEAPPASIDIFIESLDGEIKGKLDVDKIEEIDFNNRTYYSIYNLEDGNYLVMDKNEQVYSLVHDAIPKSKKMKASLREILNDISSGKFDAEEHLDERYSNSK

SEQ ID NO: 18809 - DNA, 654 bp, Unknown
  Obtained from environmental sample
  misc_feature (1)..(654): n is a, c, g, or t
gtgacaccgccgaagcttttgtttcggctaattagatatgaatttaaatggtatccaaaacaaaagcttcggctcggtgcaacttggcaagaaagtgctataaaatgcccgacttgccataccagagtcgttagcaataatattaatatgacaaattcaattgagagtataataaaggaactaaggttagaaccacatccagaaggtggttattttaaagagacatatcgaagtcttggagaaataaatgaggaaagtttagaaagagagtatgaaggtaaaagaaattattctacctgtatttatttcctcttaacctcagacaacttttcagcctttcatagaataaaacaagatgaaatttggcatttttatgatggctctccaatacgcttacatatgatttctgaattaggtattcattcgcagcatattatcggacgtgatttaaaaaaaggggaagttccacagtttattgttccaggtggtaactggtttgcagcagaagtaataaataaagacgattattctttagttggttgtacagtatctccagggtttagctttaaagattttgagcttaaatctagaaaagatcttatttcattgttccctgataaagaaaaagtaatttcaaaattaacgcatcattaa

SEQ ID NO: 18810 - protein, 217 aa, Unknown
  Obtained from environmental sample
  DOMAIN (54)...(196): Protein of unknown function (DUF985)
  misc_feature (1)..(217): Xaa is any amino acid
MTPPKLLFRLIRYEFKWYPKQKLRLGATWQESAIKCPTCHTRVVSNNINMTNSIESIIKELRLEPHPEGGYFKETYRSLGEINEESLEREYEGKRNYSTCIYFLLTSDNFSAFHRIKQDEIWHFYDGSPIRLHMISELGIHSQHIIGRDLKKGEVPQFIVPGGNWFAAEVINKDDYSLVGCTVSPGFSFKDFELKSRKDLISLFPDKEKVISKLTHH

SEQ ID NO: 18811 - DNA, 438 bp, Unknown
  Obtained from environmental sample
  misc_feature (1)..(438): n is a, c, g, or t
atgggactcctcggatacttcggtaagaaaaagaacaaagataaccttgaaaaagggttggaaaaaaccaagacaaacttgcttggtcggatcggaaaagcgatcgttggcaaatcacggatcgacgacgaagtactggatgatctggaagatgtgctgatttccagcgatgtaggagttgatactacggttaaaatcatcgaccggatccgcaagcgggtcgccagggacaagtataccaatccaaaagaactggacttcctcctgcgggatgagatttccaaaatgctggccgaaaactccggcgcaggcacttccgaattcaccgtgccgaaaatggagcacgaaggcaaaaaagtaccttacatcatcatggtgtacgcgtcaatgccgttggganacaactntaatcgnctgaccgatgtcttgatccactag

SEQ ID NO: 18812 - protein, 145 aa, Unknown
  Obtained from environmental sample
  DOMAIN (16)...(98): SRP54-type protein, helical bundle domain
  misc_feature (1)..(145): Xaa is any amino acid
MGLLGYFGKKKNKDNLEKGLEKTKTNLLGRIGKAIVGKSRIDDEVLDDLEDVLISSDVGVDTTVKIIDRIRKRVARDKYTNPKELDFLLRDEISKMLAENSGAGTSEFTVPKMEHEGKKVPYIIMVYASMPLGXNXNRLTDVLIH

SEQ ID NO: 18813 - DNA, 744 bp, Unknown
  Obtained from environmental sample
  misc_feature (1)..(744): n is a, c, g, or t
gtgccaagtgaaggcgggcgcatcatccgcgccaatgtcccgaatgcccatataggaagtactttttcggccagccacgtcatccccaaaaacgactccgacaagcacgtaaaagccgccgcccgggtcgatgccatgctcaaccggcttttccttgaacccactctgggcatgggctaccccgtagagaacttccccgccctcggcaaaatctacgaccacgtcaaagcaggcgatgcggagaagttgccctttgatttcgacttcattggcctgcagaactatacccgggagatggtcaaaaaatccatcattccttatatccacgccaactttgtgaagccgaaaaagcgaggtgtacccccggaagacattaccgaaatgggatgggaagtgtaccctgaaggcatctaccacctgctcaagaagtttgccgcctatccccaaatcaaaaagatactggtcacagaaaacggagcctctttccacgacaccgtcaccggagaggcggtccacgatccccggcgcaccaaatatattcaggattatctggcgcagattctgcgcgctcaacaggaaggcgttccggtcaaaggctattttgtctggacgtttatggacaattttgaatggcgggaagggtatgaaccccgctttggattggtgcatgtggattttgaaacgcaaaagcgcaccgtgaaagacagcggattgtggtacaaggattttctcgcaggaaaataa

SEQ ID NO: 18814 - protein, 247 aa, Unknown
  Obtained from environmental sample
  DOMAIN (1)...(247): Glycosyl hydrolase family 1
  misc_feature (1)..(247): Xaa is any amino acid
MPSEGGRIIRANVPNAHIGSTFSASHVIPKNDSDKHVKAAARVDAMLNRLFLEPTLGMGYPVENFPALGKIYDHVKAGDAEKLPFDFDFIGLQNYTREMVKKSIIPYIHANFVKPKKRGVPPEDITEMGWEVYPEGIYHLLKKFAAYPQIKKILVTENGASFHDTVTGEAVHDPRRTKYIQDYLAQILRAQQEGVPVKGYFVWTFMDNFEWREGYEPRFGLVHVDFETQKRTVKDSGLWYKDFLAGK

SEQ ID NO: 18815 - DNA, 972 bp, Unknown
  Obtained from environmental sample
  misc_feature (1)..(972): n is a, c, g, or t
ttggttcctgatgattttgattctggcaatgtcagtcagcacgtagctattgtcagattggtggaactgaaaacaagagaatatatccatcagtttatcatctccccttggtttcaaaagcgaatcatggatgttcaagttggagtttcgcgtgaagggttgtcaatgtccaagctcaagatgtttccaacacctttgccaccactaaaagaacaaaaagccatcgtagaagtcgtcaacgagctattcaccgaagtagagcaactggaaactctgaccaaagaccgcatcgccctgaaagaagactttgtcagctcagcattgcggcgcttgacccaggcagatgacaccacgaaggaatggatatttctgcaagaacatttccctggcttctttaccgaaaaaaccaatgtgaaaaagctgcgggaagccatcttgcaactggccgtacaaggcaagctcaccagcaagtggaggcgtgcccatcccgacgcagagccagcctcagaactcctgaaacgcatacaggcggaaaagcagcaactcattaaggagaagaagatcaagaaggaaaagccgctgcctgcgattgaggaagaggatattccttatgaattgccggaggggtgggtttggtgtcggtttggtgaaattttaacctattcagattctggcaaaagcccagattgtgaaaagagaccagttgtaaaaggtgaatggggcgttcttaccaccacagcgatacagaaaggtttttttgtagaaaatgcaaacaaggtactgccggtaaagtatgaaattaacccgaagcaagtggtcgaggaaaatgacatcttgattacgagggcggggccgatcaacagaacaggaatcgcatgtatggttgaaaaatataatttcaatctaatattatctgataagactatccgcctcaattattatcaaaacctagtttccccagaattcatagtc

SEQ ID NO: 18816 - protein, 324 aa, Unknown
  Obtained from environmental sample
  misc_feature (1)..(324): Xaa is any amino acid
MVPDDFDSGNVSQHVAIVRLVELKTREYIHQFIISPWFQKRIMDVQVGVSREGLSMSKLKMFPTPLPPLKEQKAIVEVVNELFTEVEQLETLTKDRIALKEDFVSSALRRLTQADDTTKEWIFLQEHFPGFFTEKTNVKKLREAILQLAVQGKLTSKWRRAHPDAEPASELLKRIQAEKQQLIKEKKIKKEKPLPAIEEEDIPYELPEGWVWCRFGEILTYSDSGKSPDCEKRPVVKGEWGVLTTTAIQKGFFVENANKVLPVKYEINPKQVVEENDILITRAGPINRTGIACMVEKYNFNLILSDKTIRLNYYQNLVSPEFIV

SEQ ID NO: 18817 - DNA, 903 bp, Unknown
  Obtained from environmental sample
  misc_feature (1)..(903): n is a, c, g, or t
ttgagattaatgaaggaacttttatttgaaaaatatgatattatttttgttcaaagggaagcctttatgttaggcacttctttttttgagcgtcaattttctaaaaaggcaaaattaatttttgattttgatgattcaatatggttgactcaaaccggtgacttgaaaagtgaaaacaaattattgtactttttgaaaaatcctaaaaagacaattgaaatcataaaaacagctcatatggtttttgcagggaataagtatctttcaaaatatgccaggcaatttaaccaaaatacaaaaatcattccgacgacaattgataccactaattatataaaaattacaaaatccgtaaaagacaaaatttgtattggttggagtggtagtttttcaaccattattcatttcgaatatataattgaagtgttaaaaaggattaaagctaaatataaagataggatttacttcaaagtgataggagatgccatgttcaaaaacaaagatttgaatattaatgggacggcatggaacaaagaaactgaaatagaagatttgtccgaaatcgatataggtttaatgccattgccaaatgatgaatggactgaaggaaagtgtggattgaaaggtttgcagtatatgggtttaggtattccgtgtattatgtcacgtgtaggagtgaatattgaaataatagaggatggcattaatggatatctggctaattctgagcgtgattggatagataaaatatcacttttagtggagagtcatgatttaagaaagagtattggtcattgtggcagaaaaacagttgaggatcattattcagttgcatctaccaaagacatgtatttgtgtcatttttcagaattatttcaaggttccaaagcaataccgacaaan

SEQ ID NO: 18818 - protein, 301 aa, Unknown
  Obtained from environmental sample
  DOMAIN (108)...(270): Glycosyl transferases group 1
  misc_feature (1)..(301): Xaa is any amino acid
MRLMKELLFEKYDIIFVQREAFMLGTSFFERQFSKKAKLIFDFDDSIWLTQTGDLKSENKLLYFLKNPKKTIEIIKTAHMVFAGNKYLSKYARQFNQNTKIIPTTIDTTNYIKITKSVKDKICIGWSGSFSTIIHFEYIIEVLKRIKAKYKDRIYFKVIGDAMFKNKDLNINGTAWNKETEIEDLSEIDIGLMPLPNDEWTEGKCGLKGLQYMGLGIPCIMSRVGVNIEIIEDGINGYLANSERDWIDKISLLVESHDLRKSIGHCGRKTVEDHYSVASTKDMYLCHFSELFQGSKAIPTX

SEQ ID NO: 18819 - DNA, 786 bp, Unknown
  Obtained from environmental sample
  misc_feature (1)..(786): n is a, c, g, or t
gtgaatctggaaagatggggtttacggggtggataccgagatatccttttccacacgataatcagtgatccaaatattaaggagatatattcttatgctggcaagacatatattctggcacttacgaaaatcctttatgtcaaaaatgnccatgctctaaaagaagaattttactacgaagatgctggtccaaatgatccaatcccatcagctgcatatgattacacttcaaatgtaaattcttcgaaggaggcagatgacaaagagtatatcagttccaattatttcattccaggcttgtacaggatactagccagggacataaaggccccagacaacaacgttgttcttgaggatatagaggtgctcgcattagcgctccctatcaaaggtccagggaaaagtcaaggaggatacaaatcgccatcagccaaagacttgtctataaaaactctcaaggatagaaaacaaggtaagccgcttgacatatttggaaatattcagacgtttggtagtaaaggttcgaaaaatgacattttcatttatgatttgttctattttgaaaagatcaatgctgccgaatttacaagtatacaaggagtcttggcgggtatagagaaacaagcgcgaagtaaaggtgccacgaaagtcattgttaaaggctattccgttcagaaagcagaattgtacgatttatttctaaagattaaaaaaaaatggaggcaagttgggcgaatggaaggtttcaggaaattgggaagaattcaggctttggaaggagattaa

SEQ ID NO: 18820 - protein, 261 aa, Unknown
  Obtained from environmental sample
  misc_feature (1)..(261): Xaa is any amino acid
MNLERWGLRGGYRDILFHTIISDPNIKEIYSYAGKTYILALTKILYVKNXHALKEEFYYEDAGPNDPIPSAAYDYTSNVNSSKEADDKEYISSNYFIPGLYRILARDIKAPDNNVVLEDIEVLALALPIKGPGKSQGGYKSPSAKDLSIKTLKDRKQGKPLDIFGNIQTFGSKGSKNDIFIYDLFYFEKINAAEFTSIQGVLAGIEKQARSKGATKVIVKGYSVQKAELYDLFLKIKKKWRQVGRMEGFRKLGRIQALEGD

SEQ ID NO: 18821 - DNA, 627 bp, Unknown
  Obtained from environmental sample
  misc_feature (1)..(627): n is a, c, g, or t
gtgtntcttgtncaagttgaaggtcaaaggcaatgggcatatagtcaagataaaataatcaatcctaaatttaaaccggatttagaacttaaattaatgtcaaattttaaagcggatgaaattcacactttaaacccaggagatgttttatatattccacctcaagtcggacattatggcattgccaaaacagaggattgcgtcacttgctctgtcggcacaagaacaccttcgcattctgaattaatgacctcctatgtggattttatctctcaagaaaaatcagaaaatttcagatttgtcgaaccaaaatttgaaaagcaaccgcaagttggagaaataaccaaaaaagacctctctaatatttcacaaatactaactgaaaatttaaaactgaataataatgccatcaatcattggtttggtaaatacatcacagaatatcgcagtttattttttgagtttaataattaccaagacattgaagattttgatgctaaaaaagaccttaaactcagcgaatttagcaaagcctgttatttcaacaataaagaagatgctgatttatttgttaatggtcaacatttcaaaagctccttaactttagcacaatctatttgccaatga

SEQ ID NO: 18822 - protein, 208 aa, Unknown
  Obtained from environmental sample
  misc_feature (1)..(208): Xaa is any amino acid
MXLVQVEGQRQWAYSQDKIINPKFKPDLELKLMSNFKADEIHTLNPGDVLYIPPQVGHYGIAKTEDCVTCSVGTRTPSHSELMTSYVDFISQEKSENFRFVEPKFEKQPQVGEITKKDLSNISQILTENLKLNNNAINHWFGKYITEYRSLFFEFNNYQDIEDFDAKKDLKLSEFSKACYFNNKEDADLFVNGQHFKSSLTLAQSICQ

SEQ ID NO: 18823 - DNA, 603 bp, Unknown
  Obtained from environmental sample
  misc_feature (1)..(603): n is a, c, g, or t
gtggatgagcctttaattgcaggggttgagtctaaagtaggtgataaaattcaaaatctgcttttaaatgttaagactgataaaaatgagaacccttattatgaattaaaatccagaggttctgaaagttatattgatggtacatttgtttctgccgaacgactttctggaatggttgatattcttaatgaactcagagacgaaaatattttcagctctaccctgagtatctctggtatcgagaatattacctttcgttttgctttagaagacagtacagaatggctaatggaacgtactgttgctaaaacggaagatactcaacctacaattcgaaaagctccatttgataatgactttgtttacaaaggacaaaaccttgttcaatggcaaactccaatacctccctctgagaacaatgaaattttagcaaagctaaatacctttgaaaatatcaatgtttactacgcggcaacatctatgctgggagaaaaagtttatgctatggatttgcttccaaagaccaattcaaaatacatatctcaatcaaagttaaaatgcactaaaacccacactttttatatctggtcgccaacatgctaa

SEQ ID NO: 18824 - protein, 200 aa, Unknown
  Obtained from environmental sample
  misc_feature (1)..(200): Xaa is any amino acid
MDEPLIAGVESKVGDKIQNLLLNVKTDKNENPYYELKSRGSESYIDGTFVSAERLSGMVDILNELRDENIFSSTLSISGIENITFRFALEDSTEWLMERTVAKTEDTQPTIRKAPFDNDFVYKGQNLVQWQTPIPPSENNEILAKLNTFENINVYYAATSMLGEKVYAMDLLPKTNSKYISQSKLKCTKTHTFYIWSPTC

SEQ ID NO: 18825 - DNA, 546 bp, Unknown
  Obtained from environmental sample
  misc_feature (1)..(546): n is a, c, g, or t
atgaaatttatattattagcatttttcacattgatatcgaactatgctttaagctctgaatatttaagatattcatataaatatcctatttatggtttgaaatctgatattgttgaaagtttttcgtttgacgacaatagcagaatatattcttcaaatgggactggaataatccaaaatgattgtaatgatggttatttatgttttatgtacgatcatattaaaatagccattcctaaaacatgtgatagagttaacaatgggagttggaaatacgataacattagttataatattgttactaatctcgaagcttttaatcccaatgatttagaggatcgtaaaagaacaaaatttattgttaatgcaaaagtgaataaaaaagacattggatatttcatttattcttcagataaaggtgttgatagtttttcatttattagaaaaaggaataagagtacggattttcataaaaaatcagatttaggcatgttaagtaatgggtgtgtattaacacaagaatataaaggtagacgcgagaactaa

SEQ ID NO: 18826 - protein, 181 aa, Unknown
  Obtained from environmental sample
  SIGNAL (1)...(18)
  misc_feature (1)..(181): Xaa is any amino acid
MKFILLAFFTLISNYALSSEYLRYSYKYPIYGLKSDIVESFSFDDNSRIYSSNGTGIIQNDCNDGYLCFMYDHIKIAIPKTCDRVNNGSWKYDNISYNIVTNLEAFNPNDLEDRKRTKFIVNAKVNKKDIGYFIYSSDKGVDSFSFIRKRNKSTDFHKKSDLGMLSNGCVLTQEYKGRREN

SEQ ID NO: 18827 - DNA, 534 bp, Unknown
  Obtained from environmental sample
  misc_feature (1)..(534): n is a, c, g, or t
atgtatggcatttacgttgatataacagatcgtaaaaaagcagaggagcagttgaaatcaaaccttcgtgaaaaagaagttctattagcagaggtccatcatagggttaaaaataatctagctgttattaccggactacttgaactacaggctctaaattctgaaaatgaagacgcaaaaaaggtattaaaagatagtcaaatgcgtgttcattctattgcattggttcatgagcttttatatcaaagtgatgatttttcgcaagtggatataccaagttatttaaaggatttgacaagagtgatttcaaattctttggagagggatgtaatacctgtgcacatcgaatttgatcttgataaagtagaacttgaaataacacaagctataccgtgtggtttaattttgaatgaagtgcttactaatagttataaacatgcttttacacggagagaagttggaaaaatctctatttcatttcaaaataagggagacggtatcgtttacaaaattcgagattatgcaattggttaa

SEQ ID NO: 18828 - protein, 177 aa, Unknown
  Obtained from environmental sample
  DOMAIN (31)...(119): Histidine kinase
  misc_feature (1)..(177): Xaa is any amino acid
MYGIYVDITDRKKAEEQLKSNLREKEVLLAEVHHRVKNNLAVITGLLELQALNSENEDAKKVLKDSQMRVHSIALVHELLYQSDDFSQVDIPSYLKDLTRVISNSLERDVIPVHIEFDLDKVELEITQAIPCGLILNEVLTNSYKHAFTRREVGKISISFQNKGDGIVYKIRDYAIG

SEQ ID NO: 18829 - DNA, 477 bp, Unknown
  Obtained from environmental sample
  misc_feature (1)..(477): n is a, c, g, or t
gtgagatttttacagaaaattcatcagataaaggattttctattgacgaaaccaaaagagctaaagcgcaaaccggcaaaaccagaaagcattacattttatagagaaggagatgtcatatccatcaatgttgatggtaaatattacctggcgtatgtgcataagctaactggaacaaatgaaagtccaatcatagaattttatgatgccgtctttgatgaaaagccaacactgaaggatatcagttcactaaaagccaaaggagagaagttcaatgatggaaaaacacgaagggctcgttttgctatctatggaatgaaataccagccagatttagcaaatcagattcacttgataaaatcgtgttcagaatcggaaatgatgcctgaaaatagccacctggaagaatctatcgggctttttacggttagcaatctatttttcattcaggacaaagtaaaagcgatgtttgcgtaa

SEQ ID NO: 18830 - protein, 158 aa, Unknown
  Obtained from environmental sample
  misc_feature (1)..(158): Xaa is any amino acid
MRFLQKIHQIKDFLLTKPKELKRKPAKPESITFYREGDVISINVDGKYYLAYVHKLTGTNESPIIEFYDAVFDEKPTLKDISSLKAKGEKFNDGKTRRARFAIYGMKYQPDLANQIHLIKSCSESEMMPENSHLEESIGLFTVSNLFFIQDKVKAMFA

SEQ ID NO: 18831 - DNA, 603 bp, Unknown
  Obtained from environmental sample
  misc_feature (1)..(603): n is a, c, g, or t
ttgcctccaatgtatgctcaatttgttgataaaagtatgtcgaatattctaatccgattaagcagatataaatttgtagcaaaaatgttaaaagaaagtgatactgtattagaagttggatgtggttctggattaggagctatatatttatcacaaaactgccaaagtgtctatggtatagatgttcaagagcaagaaattctagaggctcaaaatataagcaagagagaaaatgtcaagtttgaagtacaagatttatttttactagatgaaaataaaaaatatgatacaatagtttgtttagatgttttagaacacttaagtattgaagatggtagaaattttgtcaaaaaaatatcaaaattattaaagccaaatggtttttttgcgtgtggagtccctagtatatattcttatgaatttcagagccctttaagtcaagcatctcatataaattgtcctgatagagatgatttggaaaaagaattagcattatcatttgatagaatattcccattttctatgaatgatgaagttgtccatactggttttcaaaaattagcttggtattatattatgctttgtactgctcctaaggtttaa

SEQ ID NO: 18832 - protein, 200 aa, Unknown
  Obtained from environmental sample
  DOMAIN (1)...(174): Nodulation protein S (NodS)
  misc_feature (1)..(200): Xaa is any amino acid
MPPMYAQFVDKSMSNILIRLSRYKFVAKMLKESDTVLEVGCGSGLGAIYLSQNCQSVYGIDVQEQEILEAQNISKRENVKFEVQDLFLLDENKKYDTIVCLDVLEHLSIEDGRNFVKKISKLLKPNGFFACGVPSIYSYEFQSPLSQASHINCPDRDDLEKELALSFDRIFPFSMNDEVVHTGFQKLAWYYIMLCTAPKV

SEQ ID NO: 18833 - DNA, 765 bp, Unknown
  Obtained from environmental sample
  misc_feature (1)..(765): n is a, c, g, or t
gtggagcgaanaggagaaaaaagattgaaaatgaaatttggaggacgagactcgttttccagaagagaactattcgactttctcgtaaatattgatccggaattaaaagaaggaaccttcagttggcgaatttatgacttgaagaaaagaaacatcatcaagacaatcaaaagaggaaaatatacgatctcatcgcaggcaaagtacgaaccggtaatatcagcagaactcctgaaaatggcgaagtttgcgtcgcaacatttcgcaggtattaaattttgcttgtgggagacttcatggctgaatcaattctctcgacaccaatcagggaaaaacttaattgtaatcgaaattgagaaagaattcgttaaatcgctgtattacgaaatgaaagatgcttttagttttgatttctatgtgaatccgaaagaaaatgtcattgatctgtatatatcagaaagccccaaaccggtaattcttaagaagttggtaacaaggtcgccggttgtgaagcggaaggaaaagagaatagagtttgaaattcctaaattggaaaaaatattggtggatctttttgcagaaagcaagttgttttatttctaccaaatggcagaactgatccacatatttgaaaatgctatcaaaaactatcccgtgaattataccactttattcagctatgccgcacgacgggaaaaagaagaagaaatcaggaagtttctgatcgataatttgtctcaccttgtaaatgatgtaatctcatga

SEQ ID NO: 18834 - protein, 254 aa, Unknown
  Obtained from environmental sample
  misc_feature (1)..(254): Xaa is any amino acid
MERXGEKRLKMKFGGRDSFSRRELFDFLVNIDPELKEGTFSWRIYDLKKRNIIKTIKRGKYTISSQAKYEPVISAELLKMAKFASQHFAGIKFCLWETSWLNQFSRHQSGKNLIVIEIEKEFVKSLYYEMKDAFSFDFYVNPKENVIDLYISESPKPVILKKLVTRSPVVKRKEKRIEFEIPKLEKILVDLFAESKLFYFYQMAELIHIFENAIKNYPVNYTTLFSYAARREKEEEIRKFLIDNLSHLVNDVIS

SEQ ID NO: 18835 - DNA, 411 bp, Unknown
  Obtained from environmental sample
  misc_feature (1)..(411): n is a, c, g, or t
ttgaataatgatgtgtataccttggcaaatactccagctttgaatttaaccggcattaccgatttaatttatgatgacaacggccttatttttattcagagtggcaacaaacctgaacgtataatgcgattagctttaaacaaatcgaagtttgtgattgaaaatatatttcctattgatgtggcaaacccagtgtttaactcgccaacaaaaggcgttgtcattggtgaaggtctgtattatattgccaatactcaaatcataaaaactaatatgttgggaggtttattaaatggagaagaatgggagcatatggtaattcttagttcaaataaacattataaagaacaagagaccttagattatcaaaaagaaatagctgaaaaaaagaaaaacacagggtctaaataa

SEQ ID NO: 18836 - protein, 136 aa, Unknown
  Obtained from environmental sample
  misc_feature (1)..(136): Xaa is any amino acid
MNNDVYTLANTPALNLTGITDLIYDDNGLIFIQSGNKPERIMRLALNKSKFVIENIFPIDVANPVFNSPTKGVVIGEGLYYIANTQIIKTNMLGGLLNGEEWEHMVILSSNKHYKEQETLDYQKEIAEKKKNTGSK

SEQ ID NO: 18837 - DNA, 666 bp, Unknown
  Obtained from environmental sample
  misc_feature (1)..(666): n is a, c, g, or t
atggccggtgaagccaaaaaaaataaagattacaaaaacctagaaattattttggaaaaagccgtttcactaaaaccaaatattccagtattgaaatatcgattagctgaagcctatgcgcttagcgataaaaaaacagaagcttttaatgccttgattactattcaaaagcaagggtactactatgatattgggaataataaaaatttagctaatattaatacttaccctgtttttaaatacattaaagaaaacatggaagcaaataaccaacactttggcgaaggacttgaagcttttaacattaataaaagtttcagtggactgttgtttgaaagcatggtttttgatcctacaacccctgcatttttaatgggcagcctacgagatggaagaataattaaaatcactaatgatggagaaataacaacatttattgaagcaagcaaaggaggcatggagggaccttggtcaacaattgatatgtctgttgatgaaaaaaacaatgtgttatggattgctagtggagaggtttcacaatttggaaaatcaaccaaagaatctaaaggaatggctggtattttcaaatatgaattaaattctgggaaactattaaagtcttttattttacctgaaaaaaaagaccattttttattgcttcaatga

SEQ ID NO: 18838 - protein, 221 aa, Unknown
  Obtained from environmental sample
  misc_feature (1)..(221): Xaa is any amino acid
MAGEAKKNKDYKNLEIILEKAVSLKPNIPVLKYRLAEAYALSDKKTEAFNALITIQKQGYYYDIGNNKNLANINTYPVFKYIKENMEANNQHFGEGLEAFNINKSFSGLLFESMVFDPTTPAFLMGSLRDGRIIKITNDGEITTFIEASKGGMEGPWSTIDMSVDEKNNVLWIASGEVSQFGKSTKESKGMAGIFKYELNSGKLLKSFILPEKKDHFLLLQ

SEQ ID NO: 18839 - DNA, 432 bp, Unknown; identical to SEQ ID NO: 18073
  Obtained from environmental sample
  misc_feature (1)..(432): n is a, c, g, or t

SEQ ID NO: 18840 - protein, 143 aa, Unknown; identical to SEQ ID NO: 18074
  Obtained from environmental sample
  DOMAIN (28)...(136): ArsC family
  misc_feature (1)..(143): Xaa is any amino acid

SEQ ID NO: 18841 - DNA, 606 bp, Unknown
  Obtained from environmental sample
  misc_feature (1)..(606): n is a, c, g, or t
atgcttaaatcagcgattttcctggtattgctgagtcttgtcggttcggcatttgggcagatcggcatcggccgaatcgaaggcgtgaagctcagatccgggaattttgacgagaccgatctggctgcgttgaaggcgagtgagaccatttttatttgcctcaattcagacgatccggccatactggaaaatgaaatccgtaaggtctggaaatacacacctatcaaagtgctcaagtattctgatgccaaatcgcttgatttgtctggaaaatcggtgttttcactgggagccttggtcaaaacctcgcaagctgtgaattcgactggtatgacgtatgggcctacttcccgcgacattcattgttatctgaatttgtggatgccgaccgagaataaaaagggtaaaaaaggcaagctctcgttttgccgtttggagatgtttttgcctgtttattacgaaaaggtcctgggatataaaatttatgccgatgagagtttgaccgaggaggcggaaatcgatcgcattggtatagtttacaaatatgctaccatcaaaaactggaaccccggatttttgaatcaattatttccgaatggtaaatga

SEQ ID NO: 18842 - protein, 201 aa, Unknown
  Obtained from environmental sample
  SIGNAL (1)...(19)
  misc_feature (1)..(201): Xaa is any amino acid
MLKSAIFLVLLSLVGSAFGQIGIGRIEGVKLRSGNFDETDLAALKASETIFICLNSDDPAILENEIRKVWKYTPIKVLKYSDAKSLDLSGKSVFSLGALVKTSQAVNSTGMTYGPTSRDIHCYLNLWMPTENKKGKKGKLSFCRLEMFLPVYYEKVLGYKIYADESLTEEAEIDRIGIVYKYATIKNWNPGFLNQLFPNGK

SEQ ID NO: 18843 - DNA, 639 bp, Unknown
  Obtained from environmental sample
  misc_feature (1)..(639): n is a, c, g, or t
atgtggatcaagaattcggctcagacgattataaatatacattttnggcattcttctgctcatatattggcagaagcagtacaagacttatacccagaagctaagtttggaatagggcctcccatcgagtctggattttattacgacatcgactttggtgacaaatctattacaccagacgatttatctaacattgaaaaaaagtttttagagaaggctcgaaataaaaatagttttactcgtagagatatttcaaaaaaagaagctttagatttttattcgcaaaaaggcaatgagtataaagtagatttaatagatgggttagacgatggcaccatcactttctacactcaaggcgacttcactgatctttgccgtggaccacacattccgaatacaggtgctgtaaaagctatcaagctaacaagtattgccggtgcgtattggcgtggagataataacagcaagcagcttactcgtatttatgggattactttcccaaagcagaaaatgctagaagaacaccttcacctccaagaagaagcgaagaaaagagatcaccgcaaattaggtaaagagctcggtatatatatgattgacaaaatggttggcagtggcctcccaattttggctgcctaa

SEQ ID NO: 18844 - protein, 212 aa, Unknown
  Obtained from environmental sample
  misc_feature (1)..(212): Xaa is any amino acid
MWIKNSAQTIINIHFXHSSAHILAEAVQDLYPEAKFGIGPPIESGFYYDIDFGDKSITPDDLSNIEKKFLEKARNKNSFTRRDISKKEALDFYSQKGNEYKVDLIDGLDDGTITFYTQGDFTDLCRGPHIPNTGAVKAIKLTSIAGAYWRGDNNSKQLTRIYGITFPKQKMLEEHLHLQEEAKKRDHRKLGKELGIYMIDKMVGSGLPILAA

SEQ ID NO: 18845 - DNA, 537 bp, Unknown
  Obtained from environmental sample
  misc_feature (1)..(537): n is a, c, g, or t
atggaaggttttgaggtcaccactctggaggacgccatcgcggaaggcgatatttacgtcaccactaccggttgtgaagacatcatacgcattgatcacatggaaaagatgaaagacacggccatcgtctgcaacatcggccacttcgactgcgaaatccaggtggaaaaattgaataattttcctggtatcaaaaaagaggaaatcaagccgcaggtggacaagtatacgtttccggacggtcattgtatcgttttgttggcggagggccgtttggtgaacctgggttgcgctaccggccacccctcgttcgtcatgtccaactccttcaccaatcaggtactggcacagattgaattgtacgagaaaaaatatgaagtgggggtttacgtgctgcccaagaaactggatgaggaagtggcgcgcctgcacctcgaaaaactaggcgtcaaactgaccaagctgaccggcaagcaagccaagtatttgaatcttccggtcgaaggcccctacaaaccggatcattatcgatattaa

SEQ ID NO: 18846 - protein, 178 aa, Unknown
  Obtained from environmental sample
  DOMAIN (2)...(177): S-adenosyl-L-homocysteine hydrolase
  misc_feature (1)..(178): Xaa is any amino acid
MEGFEVTTLEDAIAEGDIYVTTTGCEDIIRIDHMEKMKDTAIVCNIGHFDCEIQVEKLNNFPGIKKEEIKPQVDKYTFPDGHCIVLLAEGRLVNLGCATGHPSFVMSNSFTNQVLAQIELYEKKYEVGVYVLPKKLDEEVARLHLEKLGVKLTKLTGKQAKYLNLPVEGPYKPDHYRY

SEQ ID NO: 18847 - DNA, 480 bp, Unknown
  Obtained from environmental sample
  misc_feature (1)..(480): n is a, c, g, or t
ttgtcagcaacgaacaaaaaactgtcaaaagcttacaccgataaaaacattatcggtattttatcgttcagtaaaggaaaggaaatagagaattacatacctttggacctaataagatcacacaaaataagaccagaatacaaacagttcgatgaacttgaaaaaattcaagagactgggcaagtagatatttggctatactttgacttgaaactaggaataagcaaggacaagcttaagacctacaaaataagctcagaaaagaaagattggcttgcgaaaaattttctttccacaaatgctaatgtagcaggatttggcgaaaatatcatggacagcttcttgaaatgccatgaggcttcaaaagaactcaacaaaagatgcaagtcaccagattggctggaaaagtttggatctgaatttgtccaactttattggtacttcatcaccgagaaacccaaagccacaaaagcaagttaa

SEQ ID NO: 18848 - protein, 159 aa, Unknown
  Obtained from environmental sample
  misc_feature (1)..(159): Xaa is any amino acid
MSATNKKLSKAYTDKNIIGILSFSKGKEIENYIPLDLIRSHKIRPEYKQFDELEKIQETGQVDIWLYFDLKLGISKDKLKTYKISSEKKDWLAKNFLSTNANVAGFGENIMDSFLKCHEASKELNKRCKSPDWLEKFGSEFVQLYWYFITEKPKATKAS

SEQ ID NO: 18849 - DNA, 624 bp, Unknown
  Obtained from environmental sample
  misc_feature (1)..(624): n is a, c, g, or t
atggaatacttgcgacacgctgttgaaagtaaatttaaaatggggctggaagagattgtcgactctttagtttttaagcccttaaaaatgaaagatgccaaaatgggttggttagctgataaagatacagtcagatttgccaagtggtatgatacgagaggaaatttacatcccacaaactacaaaataacaagaatcaacgctgccgacgatatgttgctgacagtaaatgatttattactttttggcaaagccataatggacaggaaagtagttgatggcaagttatacgatgagatggttaaaccacaatctgccatcaatgataaattgaaccaaggacttggttgggtagtgtatgataaattaagtaatggagaatatatcataaaccacgatggtggcgatccaggtgtgatcacgacgctgatactattcccaaaaagcaagaacggtattgttatttttgtaaacagtgataatggtgcaagtattaccaataatatcgtaaaggcaatagttataaacggaatggaagtcattgaaagtttgcattgggacacaaaattcccagatgttattgaggtaaatgagagtattcttaaaaaatatgtaggtacttaa

SEQ ID NO: 18850 - protein, 207 aa, Unknown
  Obtained from environmental sample
  misc_feature (1)..(207): Xaa is any amino acid
MEYLRHAVESKFKMGLEEIVDSLVFKPLKMKDAKMGWLADKDTVRFAKWYDTRGNLHPTNYKITRINAADDMLLTVNDLLLFGKAIMDRKVVDGKLYDEMVKPQSAINDKLNQGLGWVVYDKLSNGEYIINHDGGDPGVITTLILFPKSKNGIVIFVNSDNGASITNNIVKAIVINGMEVIESLHWDTKFPDVIEVNESILKKYVGT

SEQ ID NO: 18851 - DNA, 318 bp, Unknown
  Obtained from environmental sample
  misc_feature (1)..(318): n is a, c, g, or t
atggattcaagtgatgctaataaattcttatgtgtattaaaaacacaccaacgattcatgagagttcgtgaaattgcagaatatttagcaatcgaaactggggaagatgttgataaatggatttcaaagatgtctagaaaaactagagaattaaaaaaagctaatagaattgtaaaatatcaagtaggtacaagaaatacaaatgtattttggggtagtcctaattggatcaatgaaaatggagaaattaaagagaaattcaaatattctacaaaaaatctaacaagttctataaaagacaacttattagatttataa

SEQ ID NO: 18852 - protein, 105 aa, Unknown
  Obtained from environmental sample
  misc_feature (1)..(105): Xaa is any amino acid
MDSSDANKFLCVLKTHQRFMRVREIAEYLAIETGEDVDKWISKMSRKTRELKKANRIVKYQVGTRNTNVFWGSPNWINENGEIKEKFKYSTKNLTSSIKDNLLDL

SEQ ID NO: 18853 - DNA, 849 bp, Unknown
  Obtained from environmental sample
  misc_feature (1)..(849): n is a, c, g, or t
atgacggctctttgcacattgttcgagaatattggctcgcgtgcggacatttattccggtgaccatggtcaggatactttggtattaaatctctcgggggctgaatatacggaagaacttcgcttggaaattttggagtatatcgaatttatctccaataatacgggaggtcgaggcgaggcgagtggccggacgttctcgtttgactccataaatttacgtgctcgaagtattgagaacgtggaagtcattgtggatgggaatgttgttgacccggccttgccgcctaactctgatccagaggcaaatgatgttgcaattagtgcagccgaggatgatgtgtctgtgctgatcagcgcagattttatcgatagtgatattgacgatgtccatacgtttaccgtggacgatagcggtacgcttggaactgtaacaaataatggtgacggaacttttagctataatccgaacggtcagttcgatgatttggatacgggcgaaacagcgacggatagctttagctattcggtcgacgatgggaatggcggtatttcgacggcaacggtcacagtgacgattgatggcgtaacgaacaataccgcacccgtcgccacggatatgatattgcatggcagtgtctctaatcttaattatggcccaacgtggcgttccatgatttcggggcaaattgaagcgtctgacattgacggtgataatttaacttactcgctgatttccagcgaaggtccgacagtttatcttcaaagcgatggccggtttcttattatatcaccgacggtcgaaatgccgcaacgttcacctatagtgtctcagacggaaatggcgnnc

SEQ ID NO: 18854 - protein, 283 aa, Unknown
  Obtained from environmental sample
  misc_feature (1)..(283): Xaa is any amino acid
MTALCTLFENIGSRADIYSGDHGQDTLVLNLSGAEYTEELRLEILEYIEFISNNTGGRGEASGRTFSFDSINLRARSIENVEVIVDGNVVDPALPPNSDPEANDVAISAAEDDVSVLISADFIDSDIDDVHTFTVDDSGTLGTVTNNGDGTFSYNPNGQFDDLDTGETATDSFSYSVDDGNGGISTATVTVTIDGVTNNTAPVATDMILHGSVSNLNYGPTWRSMISGQIEASDIDGDNLTYSLISSEGPTVYLQSDGRFLIISPTVEMPQRSPIVSQTEMAX

SEQ ID NO: 18855 - DNA, 375 bp, Unknown
  Obtained from environmental sample
  misc_feature (1)..(375): n is a, c, g, or t
gtgtctttccgaacagataagaagaaaggtaataacagtgtaattttaactgcgggtaatataggaaggttaaacctcagtaataatcagattaaaactgaacatgtagaagacattgggttttacctaagttggaaggatggctacttgaagtttaaggatgagtcaatgaaagaggtggctaaacaacttgagcggaaatatgatatcgaagttgtttttgactctaaagaaattgctgaaatgaacttaactgcggaattaagaagtcgatcgttggctagggtgttggagacaatatctatgtctttaaaaattgattatacgttggttaaggatcgtgtaagctttgaattatcggataaaccgaattaa

SEQ ID NO: 18856 - protein, 124 aa, Unknown
  Obtained from environmental sample
  misc_feature (1)..(124): Xaa is any amino acid
MSFRTDKKKGNNSVILTAGNIGRLNLSNNQIKTEHVEDIGFYLSWKDGYLKFKDESMKEVAKQLERKYDIEVVFDSKEIAEMNLTAELRSRSLARVLETISMSLKIDYTLVKDRVSFELSDKPN

SEQ ID NO: 18857 - DNA, 426 bp, Unknown
  Obtained from environmental sample
  misc_feature (1)..(426): n is a, c, g, or t
ttgaattatcggataaaccgaattaatgatcagtatttattaaacatattctggaagcgcttcttgctatttcggggtatcaattttaacaagttacagaggaaacgtatgagaacattagttaacaaaatgatacgggttgcttcttgctattgtcttattggagtttttctgcttcagtttggtaatccatcaagtgtaagggcgcagttaatcgcttcaacttcaaacagtattcaaactaatagttattatcctgttcagatatataaaaacagtatacctgagttaccgactttaatttctataaacaaagataatgagcttcttaaagttgttcttacagagatcgctcaaaaatccaaacttggaatagcatataattcagatcttgaagtgctaaacaaaaaagtaactgccaagtcn

SEQ ID NO: 18858 - protein, 142 aa, Unknown
  Obtained from environmental sample
  misc_feature (1)..(142): Xaa is any amino acid
MNYRINRINDQYLLNIFWKRFLLFRGINFNKLQRKRMRTLVNKMIRVASCYCLIGVFLLQFGNPSSVRAQLIASTSNSIQTNSYYPVQIYKNSIPELPTLISINKDNELLKVVLTEIAQKSKLGIAYNSDLEVLNKKVTAKS

SEQ ID NO: 18859 - DNA, 450 bp, Unknown
  Obtained from environmental sample
  misc_feature (1)..(450): n is a, c, g, or t
ttgaataagctgctagaagttgactttgtggaacattcaaaaaacatgatggttcgtgccagaaagagaaaatcttctcacttgaagattaatttttatcatctttcgattttagatttagaaaaagcaggttatgatattgtaattactaacttcttttttgatcaattttcggtaagcaaagctaacctgattttgcagcacctaaagcctaaacttaagccaaacgggctgctgatatttagtgattttattagtacaaatcacctatgggatagtttaataaaccgtacgatgtacaccttttttcaattaactgctcagattagaacaaatagttttccaccatataatacactgttttcatcgcatggatttcatgcagaacagtataaaaaaattagtcgaaatatattggcaactacttattctctcctgccaccaaattag

SEQ ID NO: 18860 - protein, 149 aa, Unknown
  Obtained from environmental sample
  misc_feature (1)..(149): Xaa is any amino acid
MNKLLEVDFVEHSKNMMVRARKRKSSHLKINFYHLSILDLEKAGYDIVITNFFFDQFSVSKANLILQHLKPKLKPNGLLIFSDFISTNHLWDSLINRTMYTFFQLTAQIRTNSFPPYNTLFSSHGFHAEQYKKISRNILATTYSLLPPN

SEQ ID NO: 18861 - DNA, 459 bp, Unknown
  Obtained from environmental sample
  misc_feature (1)..(459): n is a, c, g, or t
atgataaatggttataaaaagttagtccctcaaaacaaggggtttgttgaatacaaaatgaaacacggtttgacttctcagttccaaaggtatgtaaaaaatcgtttggtttggcgaaaaaatgatcagtttctaattcagcgtatcaccggtaccaatcagatagtccttctcattgagcgaatcaatctgctttccatcgatgcgatagaccagcttgttagccaggcaatgcgccttaacaataagccggacaatgccttccacatcgttcccgcaaaggagatggggaatcctaaagctatcggaaccgatcccagcaaatgtgctgatcttccgggaattccgcatggggcgggccttggggcccaggtccaaacttgcctgtttttagtccaaatctggcgcaataaaacgttgtccggcacaaggcctggacagcatcggttactcacttaa

SEQ ID NO: 18862 - protein, 152 aa, Unknown
  Obtained from environmental sample
  misc_feature (1)..(152): Xaa is any amino acid
MINGYKKLVPQNKGFVEYKMKHGLTSQFQRYVKNRLVWRKNDQFLIQRITGTNQIVLLIERINLLSIDAIDQLVSQAMRLNNKPDNAFHIVPAKEMGNPKAIGTDPSKCADLPGIPHGAGLGAQVQTCLFLVQIWRNKTLSGTRPGQHRLLT

SEQ ID NO: 18863 - DNA, 768 bp, Unknown
  Obtained from environmental sample
  misc_feature (1)..(768): n is a, c, g, or t
atggtgcgacacgattcaacaatcgtccatggaagacttttgggatactaccctaccgggaacacacgcatctgttttcacaggattgacgcaccggaggaggatcaattggtcacaaaagtcaaaatggggtcaggcttccgcaacaaaagaatcaaagtgtttcgcaaccaacttttgctttcaaaattcgggggcgaagaggccgacgaaacattgggaggtgtttacatctgcttgcaagaattgatggtaatcaacgcttgtgacgaattcgccgtcaatactgtaagaacagttgtacttgaccttcttgaaaaggaaaaaggaatccataccaaattggatcagctaattcacaatgctgacataaaaatcaaaggaaccgaaattattgaacagaaggaggatgattataaattcccgcccaactttccagaggaagacaaagaaaaaatcataaaaacctaccgctatcaggtattcggagttcacgacctttttcagaaccgcaaaccgattgatacaatcaaaatccccttcgatgaagagtcacatgggaccaataccttgtttgtattgggcgggctaatcttactgaagatacggagaggaggaatcatattcatcgacgaactcgataccagcctgcatcccgatttgacccgaatgttggttgactcttccagaatgaagccacaaatcccaacaacgcccaattggtttttaccacccacgacaccaacctcatggacagtgccttgctga

SEQ ID NO: 18864 - protein, 255 aa, Unknown
  Obtained from environmental sample
  misc_feature (1)..(255): Xaa is any amino acid
MVRHDSTIVHGRLLGYYPTGNTRICFHRIDAPEEDQLVTKVKMGSGFRNKRIKVFRNQLLLSKFGGEEADETLGGVYICLQELMVINACDEFAVNTVRTVVLDLLEKEKGIHTKLDQLIHNADIKIKGTEIIEQKEDDYKFPPNFPEEDKEKIIKTYRYQVFGVHDLFQNRKPIDTIKIPFDEESHGTNTLFVLGGLILLKIRRGGIIFIDELDTSLHPDLTRMLVDSSRMKPQIPTTPNWFLPPTTPTSWTVPC

SEQ ID NO: 18865 - DNA, 885 bp, Unknown
  Obtained from environmental sample
  misc_feature (1)..(885): n is a, c, g, or t
gtggaatcaagaatcggctcgagatcagatttgttgaaaataggtttaaaaaaatcaccccggagaattaccgattacaaaacaagtaaaactgacaaaaatataattactatccgccatggttttaatcttttagctcgtacaaagcagtgggataaattaaagcgagacataattagagagaaagatttttgtaatatagatagtgacaactttgttgatacattctccaattttttaaccgaaataggtcctgaaagtataatttcaaaaattgaaaatgcatttggatcattacaagtacccgctaattacaagcaagaatgtattgacattattactgctttacagatttacaccacatcctttgatgaaactgtagaggttttaaaatcacattgcaacaaagctcaaaaaaaagaattaaatacaatcttagaaagcattcgactttataaaattgaaaagccctttgtcgctaatgcttctaattacggtgtgccacaaaaccgagaaagggtcctttttattggctgtagaaaagaccagaagtatatccctgaaatacccccgactgtttctgaaaaagaaaaagtaacagtttttgaagccttatatgatttagactttattgggaataatcagcaagcccatcggtatgaattggttgatatttctaagcaatacaatggaactgccaaaaaaatgactgggcttttaaaaaagagaagtattgatggaaaaccaaactcaaatggcgggaaatcattctcagaatggtctaaagaaggaagactcattgaacgctataaaacacaatcaaaggcaatttacgtgagaaacactgaaggtcttgaaaatggagagaatattttgactgtttaa

SEQ ID NO: 18866 - protein, 294 aa, Unknown
  Obtained from environmental sample
  misc_feature (1)..(294): Xaa is any amino acid
MESRIGSRSDLLKIGLKKSPRRITDYKTSKTDKNIITIRHGFNLLARTKQWDKLKRDIIREKDFCNIDSDNFVDTFSNFLTEIGPESIISKIENAFGSLQVPANYKQECIDIITALQIYTTSFDETVEVLKSHCNKAQKKELNTILESIRLYKIEKPFVANASNYGVPQNRERVLFIGCRKDQKYIPEIPPTVSEKEKVTVFEALYDLDFIGNNQQAHRYELVDISKQYNGTAKKMTGLLKKRSIDGKPNSNGGKSFSEWSKEGRLIERYKTQSKAIYVRNTEGLENGENILTV

SEQ ID NO: 18867 - DNA, 351 bp, Unknown
  Obtained from environmental sample
  misc_feature (1)..(351): n is a, c, g, or t
atggaactaggaactcattcaacatcacttgcagtaaaagacatcaaagcctctaaagctttctatgaaaagctagggtttaaaaagcttgaaggtcttggctcggtagaagaaaaatggcttatcatgataaatgaggatgttaaaatcgggctttttgaaggtatgttcgaaaacaacatcatcacctttaacccagaaaatgcacgagccaactacacagaacttagagaagcgggagttccttttttgatggaatctgcttccatccaggaagaaaaaggtccttgccatttttccatctccgaccccgatggaaaccagattttatttgatcaacatacggattag

SEQ ID NO: 18868 - protein, 116 aa, Unknown
  Obtained from environmental sample
  DOMAIN (4)...(111): Glyoxalase/Bleomycin resistance protein/Dioxygenase superfamily
  misc_feature (1)..(116): Xaa is any amino acid
MELGTHSTSLAVKDIKASKAFYEKLGFKKLEGLGSVEEKWLIMINEDVKIGLFEGMFENNIITFNPENARANYTELREAGVPFLMESASIQEEKGPCHFSISDPDGNQILFDQHTD

SEQ ID NO: 18869 - DNA, 348 bp, Unknown
  Obtained from environmental sample
  misc_feature (1)..(348): n is a, c, g, or t
gtgggtcatctgacccgaaacaccctggagctgatcggcaagggtggcgatttcattgaccgctgtttcgacttcatcctgaagtgtatcagccagaccaagaagctcgtcgcgcagcgcttcattgcgttcacggttaaggtgctcttcttcggcctgcatatcgcggaccttgatcgcattttccttaaacacatcaacagcgcgtcccatagcggaaatttcgtcatgccctttggacggaacatcgacgtcaagatcaccatccgccagcgaaaccatggttttctgcaaaccggccaaacgacgcaaaaggttgccacgcacatagacgacaaagatcagtaa

SEQ ID NO: 18870 - protein, 115 aa, Unknown
  Obtained from environmental sample
  misc_feature (1)..(115): Xaa is any amino acid
MGHLTRNTLELIGKGGDFIDRCFDFILKCISQTKKLVAQRFIAFTVKVLFFGLHIADLDRIFLKHINSASHSGNFVMPFGRNIDVKITIRQRNHGFLQTGQTTQKVATHIDDKDQ

SEQ ID NO: 18871 - DNA, 528 bp, Unknown
  Obtained from environmental sample
  misc_feature (1)..(528): n is a, c, g, or t
atgccaaaccttattagaaaaggaatgttttatttcaatagaattttaaaaatgataaacaaacgccttttgattaaaaacttactttctcataatgatgagaatagtttttatgataaaaagcaaaaattatcattgcataacaaagaaggaaaagcaaaatttataaaacacgtttgtgcgttgtcaaattcgaatccaacaaacaattcttatattgtaattggcatagaagacgaagaaaataaaattattggtgtcgatttttttgatgacagcaaaattcaaaatttggcaaatgcgtatttaacaaacccgccaaagatacaatacgaaaatgttccgtttccaacattaccgcgtcataaagtaattggattggttactgttttgccaaataataagattacatcactctncaaaacatgcttggaatacaaacaaggttccgttttttttagacgcggaagtaattcgatgtcatcaaaaggaggttttgaacttaaaaacaaaaacaaaaattgttga

SEQ ID NO: 18872 - protein, 175 aa, Unknown
  Obtained from environmental sample
  misc_feature (1)..(175): Xaa is any amino acid
MPNLIRKGMFYFNRILKMINKRLLIKNLLSHNDENSFYDKKQKLSLHNKEGKAKFIKHVCALSNSNPTNNSYIVIGIEDEENKIIGVDFFDDSKIQNLANAYLTNPPKIQYENVPFPTLPRHKVIGLVTVLPNNKITSLXKTCLEYKQGSVFFRRGSNSMSSKGGFELKNKNKNC

SEQ ID NO: 18873 - DNA, 942 bp, Unknown
  Obtained from environmental sample
  misc_feature (1)..(942): n is a, c, g, or t
ttgttgaaaatatatactcaactaaataagcatattcaatttgcaaaaacaatgcagatatcattactgatccgcaaaatacttatggatactggctattgggtagtgctatctacaaaaagtaacagcggacagtttatttcgaacattgaaaaactaattgccactgcaaatgattttagttcaaaaggtttgcgtactctttttgattttgtgaattatttagaggatgcaattaactcaactggagatgagagtcaggcatcattgctatcgagtgataatgctgttaagctaatgacaatacatgcttcaaaaggtttggaatttccagttgtctttttaatcgattcaaatagtcaagggatggatgataaagttaaagctaaagatataagtgttgataaaaattttggaattcttacaaaaatgccaatcaacaataactactttggtaaataccaatcagctccaattgtttgcctctataattatataatacaaaagaaatcaatagccgagctgaagcgattactctatgttggtgtaactcgggcgcaaaaattcttatacattactgccggaattaaaaaaaacaaagatggtttgataaaaccaaagaagggctcatttttatctttgatgaaggagggattacagattgataattttgatgaaacactaaatattgatggcactgttaattttatgcttgaagaccatgacgagtttcaaaattctgaaaagaaaatatctatttctattcctataactaatcttatcgaaaaacctcaagttcaatatgaaatcccganattgcgttaccaaatattttcaaatatcagcacaactattcgcgatctgaccacgccgaattattctggcacaaactggtgctttatccagtcggttaatatatcaattccaactggtatcgcttaa

SEQ ID NO: 18874 - protein, 313 aa, Unknown
  Obtained from environmental sample
  misc_feature (1)..(313): Xaa is any amino acid
MLKIYTQLNKHIQFAKTMQISLLIRKILMDTGYWVVLSTKSNSGQFISNIEKLIATANDFSSKGLRTLFDFVNYLEDAINSTGDESQASLLSSDNAVKLMTIHASKGLEFPVVFLIDSNSQGMDDKVKAKDISVDKNFGILTKMPINNNYFGKYQSAPIVCLYNYIIQKKSIAELKRLLYVGVTRAQKFLYITAGIKKNKDGLIKPKKGSFLSLMKEGLQIDNFDETLNIDGTVNFMLEDHDEFQNSEKKISISIPITNLIEKPQVQYEIPXLRYQIFSNISTTIRDLTTPNYSGTNWCFIQSVNISIPTGIA

SEQ ID NO: 18875 - DNA, 393 bp, Unknown
  Obtained from environmental sample
  misc_feature (1)..(393): n is a, c, g, or t
ttgaaaaaccttttttcatcagacgtaaattcaggcggtttgcttgagcgagataagattgaagattcctataaatggaatttaaaagatatttattatagtaataatgaatgggaaaatgattttgcatcattggaaataaaagcaaataagcttccggaatttaagggaaccttaaagcaatcagcaaagtttcttttagattgtcttaaatatgacgaagaaattggaattattttagacaagctccatctttattcaatgcttgcgaaagatgttgatcttgggaacgaaaaatatcaaggtatgtatgatcggcttatggtactcgcctcaaagatagctgccttatcggcatatatcaaacctaaactctcgagccgaattctgtga

SEQ ID NO: 18876 - protein, 130 aa, Unknown
  Obtained from environmental sample
  misc_feature (1)..(130): Xaa is any amino acid
MKNLFSSDVNSGGLLERDKIEDSYKWNLKDIYYSNNEWENDFASLEIKANKLPEFKGTLKQSAKFLLDCLKYDEEIGIILDKLHLYSMLAKDVDLGNEKYQGMYDRLMVLASKIAALSAYIKPKLSSRIL

SEQ ID NO: 18877 - DNA, 360 bp, Unknown
  Obtained from environmental sample
  misc_feature (1)..(360): n is a, c, g, or t
atggacaaagaatttttgatgggtgacaaagcattaatttatgattacaaaactgatagtctctcaaaatcttctccacaagaaaaacttgaaaactacagagcgcaattaacattttatgctcttcttatcagcaaattatttgagaatattaaacaaataaaatgtagtctgatttttatcgaaaactcaaaagaagtcccctcattttcaattgatgtaaaagcattaaaaaatattgaacaagaattagatgagattgtcaactctattagatatgaaaaatttaaaacaaaaaattctcattgtaaaagttgttatttttccgattcaaaaaataagtgtgttgttaaacactaa

SEQ ID NO: 18878 - protein, 119 aa, Unknown
  Obtained from environmental sample
  misc_feature (1)..(119): Xaa is any amino acid
MDKEFLMGDKALIYDYKTDSLSKSSPQEKLENYRAQLTFYALLISKLFENIKQIKCSLIFIENSKEVPSFSIDVKALKNIEQELDEIVNSIRYEKFKTKNSHCKSCYFSDSKNKCVVKH

SEQ ID NO: 18879 - DNA, 675 bp, Unknown
  Obtained from environmental sample
  misc_feature (1)..(675): n is a, c, g, or t
atggacgtacgtccacacccgcatattggtttgtctacactcacatggttgttagagggggaaattgtccatcgtgacagtctgggctataggcaaactattcgcccgggtgaagtgaactggatgaccgcagggcgcggaatcgtccattcagaacgttccccacatgatggccgcaatgggcagtgctccttgtatggcttgcaggtttgggtggctttacccagtgataaacaagaaatagaccccagctttcagcatgtaaaagcgaatgccttaccgaagctaaaaaaagaaaatgccaagatcaccgtgattgctggtgaagcttatggggagaaatcccccgttcaggtccagtcccccaccatttatttggatatcaaggtgaaagacggcggcttgaccttgccaaatgattatgaagaacaagctgtctatatcatcaaagggcagggcgtttttaatggtcaaaaggttaaccaaggcagcttttttgttttacccaacaaacagaaaacgacaattgatcaggcgatggggttgcattttgttctgcttggagggcgagcacttaaaaacaagcgatatttatggtggaactttgcctcaanctctaaagaacgttttgaaaaagcaaagacgattgggaaaatggacggtttgataaggtga

SEQ ID NO: 18880 - protein, 224 aa, Unknown
  Obtained from environmental sample
  DOMAIN (125)...(220): Pirin C-terminal region
  misc_feature (1)..(224): Xaa is any amino acid
MDVRPHPHIGLSTLTWLLEGEIVHRDSLGYRQTIRPGEVNWMTAGRGIVHSERSPHDGRNGQCSLYGLQVWVALPSDKQEIDPSFQHVKANALPKLKKENAKITVIAGEAYGEKSPVQVQSPTIYLDIKVKDGGLTLPNDYEEQAVYIIKGQGVFNGQKVNQGSFFVLPNKQKTTIDQAMGLHFVLLGGRALKNKRYLWWNFASXSKERFEKAKTIGKMDGLIR

SEQ ID NO: 18881 - DNA, 813 bp, Unknown
  Obtained from environmental sample
  misc_feature (1)..(813): n is a, c, g, or t
ttgncggctcatagtattctgcctctcgaaaatgcttttatttctacatttggcttgatgttgggcatcactgctcactcagtgggttggccaattgctaaaggaggttccaaaagtattacagatgctctcgcttcacattttctttctttaggaggaactattgaagtaaatcgtcacatcgaatctattgatggtattcccaaagacaaacccattttattcgacctcacccctcgccaagtggtagaaattggggggaagcgaataccagattctattcaatcaaaacttaaaaaatacacttatggcccaggtgtttttaagatggattttgcactttcagaggaagttccttggaaggacgctgaatgtagaaaggccggtactttacaccttggtggatgttttgctgaaatatctcgctctgaaagtgatatttggaaaggtaaacacaacgagagtccttacgttttgatctcccagccaagtctttttgatgataccagagctcccaaaggcaaacataccctttgggcttattgccatgttcctgcaggaagcacacaagacatgacatccgaaattgagaaccaaattgaacgcttcgctcctggtttcaaagataccatcatttcgaaagccgtaatgactactatggatttcgaaaagtataatcccaactatatcggtggtgatattaatggcggagcacagtttgtaaaacaactttttggacgcccactcttgaaatggaatccatataagctaggcaacgacggtatttatatctgtacatcctcagcaccctga

SEQ ID NO: 18882 - protein, 270 aa, Unknown
  Obtained from environmental sample
  misc_feature (1)..(270): Xaa is any amino acid
MXAHSILPLENAFISTFGLMLGITAHSVGWPIAKGGSKSITDALASHFLSLGGTIEVNRHIESIDGIPKDKPILFDLTPRQVVEIGGKRIPDSIQSKLKKYTYGPGVFKMDFALSEEVPWKDAECRKAGTLHLGGCFAEISRSESDIWKGKHNESPYVLISQPSLFDDTRAPKGKHTLWAYCHVPAGSTQDMTSEIENQIERFAPGFKDTIISKAVMTTMDFEKYNPNYIGGDINGGAQFVKQLFGRPLLKWNPYKLGNDGIYICTSSAP

SEQ ID NO: 18883 - DNA, 357 bp, Unknown
  Obtained from environmental sample
  misc_feature (1)..(357): n is a, c, g, or t
atgaacaaagtagtcgtaaaaaaaattgaagacaaagaaatagtttggtttaaaaactccaattcgtatttagtattagaaccggttgctgcagctattatattaaaaataaataaaaataattctcttgaagagataaaaacttgggcttttaaaaaaaatactacaccaaaaaaggtcgtcaaaaaatttattgaagatattttcttgttatatacagttaataacactttaaaaaaagaagttcaaaataattctgaaacttataaaattccaacaaaatattattcagaaaaatactattcaatacataattacatttttacagttcaatttgaaactaatttcatttgttaa

SEQ ID NO: 18884 - protein, 118 aa, Unknown
  Obtained from environmental sample
  misc_feature (1)..(118): Xaa is any amino acid
MNKVVVKKIEDKEIVWFKNSNSYLVLEPVAAAIILKINKNNSLEEIKTWAFKKNTTPKKVVKKFIEDIFLLYTVNNTLKKEVQNNSETYKIPTKYYSEKYYSIHNYIFTVQFETNFIC

SEQ ID NO: 18885 - DNA, 303 bp, Unknown
  Obtained from environmental sample
  misc_feature (1)..(303): n is a, c, g, or t
ttggacgtttttctaaagacattcaacaacagaggtaagaaaacattaaatggtgatgatttcaacttagaacagataagtatgtatttaagttcagaacgtacgttaagaatttctgggttaaaaagcgttagtgcttcactaactgtttttaatattttaggtaaaaaagtatttcataaaaagttaaaatctagttcagccttagatattactttatcaaattctataaaacaaggaatttatattgtaaaacttgaaactgataaagggaatattaacaagaaaatattcttaaactaa

SEQ ID NO: 18886 - protein, 100 aa, Unknown
  Obtained from environmental sample
  misc_feature (1)..(100): Xaa is any amino acid
MDVFLKTFNNRGKKTLNGDDFNLEQISMYLSSERTLRISGLKSVSASLTVFNILGKKVFHKKLKSSSALDITLSNSIKQGIYIVKLETDKGNINKKIFLN

SEQ ID NO: 18887 - DNA, 300 bp, Unknown
  Obtained from environmental sample
  misc_feature (1)..(300): n is a, c, g, or t
atggcggttctgcaacacgacttacttttcattctgcaaacgaatccccttattctttttcttcaactaataaagaggtcatttttggcgcacaacgtcaagatgatgtcaaacacagacaatatccaacgggttctcaaccagaattatacagcgttcctgttaagggcggaaaagtgtctcaaatttttacaattccagcagaatatgtgcaagtatcaaaaaatggaaaaacgatggtgtatcacgataaaaaaggtggtgaaaatgagtttagaaaacaccacagatcttcgataa

SEQ ID NO: 18888 - protein, 99 aa, Unknown
  Obtained from environmental sample
  misc_feature (1)..(99): Xaa is any amino acid
MAVLQHDLLFILQTNPLILFLQLIKRSFLAHNVKMMSNTDNIQRVLNQNYTAFLLRAEKCLKFLQFQQNMCKYQKMEKRWCITIKKVVKMSLENTTDLR

SEQ ID NO: 18889 - DNA, 480 bp, Unknown
  Obtained from environmental sample
  misc_feature (1)..(480): n is a, c, g, or t
atgaatatatatttcttgtcagatcagttttttccaaggacctcagctgattctgaacaaatagtgtcgtctttatcagggcttgcaatgtcgaaccatgttaccctcgtatctgctaagtatagagggagtcaacaagttagtatcaaagaattaaattcatattataatactaacggccatttcaatttagaattcgtatctcattggtttaaaaatataagaggaattgagaaaatagtattctcattgtctgttattaagctcttaaaacagtcaaaagcagatgttattataactagaaatattccgattctattgtctgtacttgtcttcacgaacattcctattttatttgaatcctatagaccatggccctcaaggaatttatttgccaagaaagtctttcaatttctctcccataaaaagcaattattgggagtcattcttcattcaaaatttgcagggagaaagctttaa

SEQ ID NO: 18890 - protein, 159 aa, Unknown
  Obtained from environmental sample
  misc_feature (1)..(159): Xaa is any amino acid
MNIYFLSDQFFPRTSADSEQIVSSLSGLAMSNHVTLVSAKYRGSQQVSIKELNSYYNTNGHFNLEFVSHWFKNIRGIEKIVFSLSVIKLLKQSKADVIITRNIPILLSVLVFTNIPILFESYRPWPSRNLFAKKVFQFLSHKKQLLGVILHSKFAGRKL

SEQ ID NO: 18891 - DNA, 684 bp, Unknown
  Obtained from environmental sample
  misc_feature (1)..(684): n is a, c, g, or t
atgatgacaggtattcctgtaaatagagtagcgaagctgaaagtagtcgttaagcgaattacaaatctaattaaaggaaaagtaatcggtcaagacgaggcagttactaaggttgtaaaagccattcagagaaatagagttggactaaaagatcctaataaaccaattggttcatttatctttttagggcaaactggagttgggaaaactcagttagcaaaagtcttagcaaaagaattatttgactctgaagattctttaattagaatcgacatgagtgaatacatggaaaaatttgctatttctagattgattggagcgcctccaggatatgttggttatgaagaaggcggccaattaacagaaaaagtgagacgtaaaccttacgctgtagttttacttgatgaaattgaaaaagcgcatccagatgtttttaatatgttgcttcaaattttagatgatggctttattactgatagtttaggaagaagaatcgattttagaaatactattattatcatgacttctaatattggtgctagacaattaaaagattttggtgctggagttggatttggaacttcatctaaagttgcacaagcagatgaaaatgccaaaggaattatagaaaatgccttaaaaaaatcatttgcgccagaatttttaacagaattgatgatgtag

SEQ ID NO: 18892 - protein, 227 aa, Unknown
  Obtained from environmental sample
  misc_feature (1)..(227): Xaa is any amino acid
MMTGIPVNRVAKLKVVVKRITNLIKGKVIGQDEAVTKVVKAIQRNRVGLKDPNKPIGSFIFLGQTGVGKTQLAKVLAKELFDSEDSLIRIDMSEYMEKFAISRLIGAPPGYVGYEEGGQLTEKVRRKPYAVVLLDEIEKAHPDVFNMLLQILDDGFITDSLGRRIDFRNTIIIMTSNIGARQLKDFGAGVGFGTSSKVAQADENAKGIIENALKKSFAPEFLTELMM

SEQ ID NO: 18893 - DNA, 798 bp, Unknown
  Obtained from environmental sample
  misc_feature (1)..(798): n is a, c, g, or t
gtggatgtaaaatgcaatacaagaaaagtatttaaatcaattgaagatcaaaataattggtttgaagcttctgataaaccgctactttctagatttatgaattcaacgattattcacgaaaaaataaatggtgttattgctaattttggttttggagaagtacaacaaacaggaagaattgacaccgaaaaactcgttacttcgtatagaaaatatttagaaaaagaattaaaaattgtatttgaaaagtttgaatatgatttgatagcatttaataaggatgtgatttcttataaagaaatagaaacctctcgaattgttttttgtgaaggattcggaatcaagcaaaatccattttttaatgacttgccattaaaagaagcaaaaggcgaactattgacaattcacgctccagaattagacatcgattttttattaaaatctacgttgtttgttttgcctttaggaaatcagtactacaaagttggtgcaacatttaattggaaagacaaaacctcaaatccgtcagaagaaggaaaggtagaattggtagagaaacttaaaaaagtacttaccgttccgtatacaattacaaatcaaacagccggaattagaccaacagtaaaagatcggagacctttggttggcgttcatcaagagaacaaacaattagcggttttaaacggtttaggaactcgtggagttatgattgccccaacggtagctaaaaacttattcaatcatctagaaaaaggcgagatgttggatgaagaaattgatataaaaagattttattaa

SEQ ID NO: 18894 - protein, 265 aa, Unknown
  Obtained from environmental sample
  misc_feature (1)..(265): Xaa is any amino acid
MDVKCNTRKVFKSIEDQNNWFEASDKPLLSRFMNSTIIHEKINGVIANFGFGEVQQTGRIDTEKLVTSYRKYLEKELKIVFEKFEYDLIAFNKDVISYKEIETSRIVFCEGFGIKQNPFFNDLPLKEAKGELLTIHAPELDIDFLLKSTLFVLPLGNQYYKVGATFNWKDKTSNPSEEGKVELVEKLKKVLTVPYTITNQTAGIRPTVKDRRPLVGVHQENKQLAVLNGLGTRGVMIAPTVAKNLFNHLEKGEMLDEEIDIKRFY

SEQ ID NO: 18895 - DNA, 981 bp, Unknown
  Obtained from environmental sample
  misc_feature (1)..(981): n is a, c, g, or t
ttgaaaaaacaagacaatctaattatagaacatgaaaaggcacacattaaattaaaacattcaattgatattatacttatagaactatttatcgcattcctctggtacaatccctttgtgtatttttttaggagagaactaaaatcagtccacgaatttcaagcagataccaatgttttaagtaaaaagattaagacctcacagtatctacaagtattattacaaaacctagaggttaaaaaaccaaataatatttatagttatttaaattatcccgttttgaaaagaagaatagatatgattacaaaaactaaatcaactcaattatcaaaactgaaatacttaatcttattgtccgtttgtactttactatcattggcgtttacaaaacccaaaatcaaaagcataccagttctagccacctttagtttgagtactgatatgccatcagtattccctgtaaagaatatgacaaaaaatgatattacagcattttttaccctaaaaagcgagcatcctaaaactaaagaaactataattcatggtggaatagacataagagctagaataggaacacctattattgcaacagcagatggaataatttctaaagcaaatatagaaggtgattggggaaatttaattgttattgcacatgataataattaccagacttggtatgcccatttaaaagattttaatattacagaaaatcaaatggttaaaaaaggcgatgttattggctatgttggtaatactgggaagtctactgggtcacatcttcattatgaagtaaaacacaatggaaaaagtggtaatccggatcgattacatagccggagtaaaaaggcggcttaccgatattacattaaactaagacttttattacaatttattatatcccctccgggttttttaaaccagaaacagggaaaagaatttgcccccaaaaaatcccaatcccaaaataatttatcctaa

SEQ ID NO: 18896 - protein, 326 aa, Unknown
  Obtained from environmental sample
  DOMAIN (2)...(74): BlaR1 peptidase M56
  misc_feature (1)..(326): Xaa is any amino acid
MKKQDNLIIEHEKAHIKLKHSIDIILIELFIAFLWYNPFVYFFRRELKSVHEFQADTNVLSKKIKTSQYLQVLLQNLEVKKPNNIYSYLNYPVLKRRIDMITKTKSTQLSKLKYLILLSVCTLLSLAFTKPKIKSIPVLATFSLSTDMPSVFPVKNMTKNDITAFFTLKSEHPKTKETIIHGGIDIRARIGTPIIATADGIISKANIEGDWGNLIVIAHDNNYQTWYAHLKDFNITENQMVKKGDVIGYVGNTGKSTGSHLHYEVKHNGKSGNPDRLHSRSKKAAYRYYIKLRLLLQFIISPPGFLNQKQGKEFAPKKSQSQNNLS

SEQ ID NO: 18897 - DNA, 513 bp, Unknown
  Obtained from environmental sample
  misc_feature (1)..(513): n is a, c, g, or t
gtgaagaaggaaaacaatttagatagaatattaaagtacttcgtgaacgaaaaatctcaacggaatacaacagcatcaatattaaaatttaagttatttaaggaagatttagaacaagaagaaataaacgaacttcttttagaaattcataatcatagaccaagaatagttgaaagtagtgtaaactcgaaaggaaaggtctttgcaaaaccaataatatctaaatgtcaagagtttttagatgaaggtggttttaagaatctatcaaaagaacacaaaaacgataatttaaaggttgaatttaatgttgaaaattttataggtcgagataatttaggtattcaatcctcagatagtgaaattataaaacctaatatacaaaatactaaaaagaatattgaaccaagtaaaccaacgaagtcagtgttaaaaacaatatattggatatttggaatattagtagctatcactatattatatacatttattatgggtgtaacaaataacacatga

SEQ ID NO: 18898 - protein, 170 aa, Unknown
  Obtained from environmental sample
  misc_feature (1)..(170): Xaa is any amino acid
MKKENNLDRILKYFVNEKSQRNTTASILKFKLFKEDLEQEEINELLLEIHNHRPRIVESSVNSKGKVFAKPIISKCQEFLDEGGFKNLSKEHKNDNLKVEFNVENFIGRDNLGIQSSDSEIIKPNIQNTKKNIEPSKPTKSVLKTIYWIFGILVAITILYTFIMGVTNNT

SEQ ID NO: 18899 - DNA, 333 bp, Unknown
  Obtained from environmental sample
  misc_feature (1)..(333): n is a, c, g, or t
atgtcaaaaaaaagcgaaacaattaccgaaaatatatttagagaatattacggttcatctacatttcttgaaaaatctgcaattcctgacgaattaggttttaagtcaaaaaaaacaacgaattttaaaggctatcccgattttctaaaagaggaggaagattatattatagttgtggaagcgaaagcaacagaacaaaaccaagctataagcgaagtaaaacattatatgcttaaaaataatattactaaagatataatcggcattgctgtttcaggacaaaaattagaaactttaaaagttgattattttctaaaaataaatgatgaataa

SEQ ID NO: 18900 - protein, 110 aa, Unknown
  Obtained from environmental sample
  misc_feature (1)..(110): Xaa is any amino acid
MSKKSETITENIFREYYGSSTFLEKSAIPDELGFKSKKTTNFKGYPDFLKEEEDYIIVVEAKATEQNQAISEVKHYMLKNNITKDIIGIAVSGQKLETLKVDYFLKINDE

SEQ ID NO: 18901 - DNA, 555 bp, Unknown
  Obtained from environmental sample
  misc_feature (1)..(555): n is a, c, g, or t
ttgtcgctcttaaaaaagataaagatgttacaggttcagtttattagagacaacaaacaaactgttttagacggtttggctaaacgtaattttgcaaacgcagaaacaataattaatgctgttttatctacggatgaaaatcgtagaaacacacaaacatcacttgataatattttagcagaatctaataccctttcgaaagaaattggagaattttttaaatctggtcaagctcaaaaagcaaatcttttaaaagaaaaaaccacacaacttaaagagcagtctaaagagttaacagagcaattaaacgattttacaaatacgttacaagagttgttgtatcaaattccgaatgtaccacacgcatcagtaaaagctggaaaatctgaagaagataatgagaacatttttagcgaaggcacaattcctgatttaggaaaaaatgcgttacctcattgggaattagcaaaaaaatacgacatcatcgattttgaacttggaaccaaaattactggcgcaggatttcctggttataccggacaccgagcagattga

SEQ ID NO: 18902 - protein, 184 aa, Unknown
  Obtained from environmental sample
  DOMAIN (9)...(120): Seryl-tRNA synthetase N-terminal domain
  misc_feature (1)..(184): Xaa is any amino acid
MSLLKKIKMLQVQFIRDNKQTVLDGLAKRNFANAETIINAVLSTDENRRNTQTSLDNILAESNTLSKEIGEFFKSGQAQKANLLKEKTTQLKEQSKELTEQLNDFTNTLQELLYQIPNVPHASVKAGKSEEDNENIFSEGTIPDLGKNALPHWELAKKYDIIDFELGTKITGAGFPGYTGHRAD

SEQ ID NO: 18903 - DNA, 768 bp, Unknown
  Obtained from environmental sample
  misc_feature (1)..(768): n is a, c, g, or t
atgagttttggttctttgagtgatgagaaagaagcttttaaaattatggataaatcagttgatagaggtattaatttttttgatacagctgaaatatatccaattccaccagatgctaaatatatgggtcgtacagaagagattattggaaagtggctcaaagggaaacaaagagataaattaattattgcttcaaaagtagcaggggcagcaaatggttggtttgtaccaccagtgaggcatgggcttactgcaattgataagtttcatatcaaaaaagcaattgagggaagtttaaaaagactagggactgactatattgatttatatcaaatgcattggcctgatactattatacctattgaagagtcactgaaagcttttgaagagttagttaaagagggaaaagtaagatatctgggaacctcaaatgatactgcttatggtttaacaaaagcaaatgaaacatcaaaaagattgggtattagtagatttgaatctattcaaaataatttctctttaaataatcctagatttttagacgagttagctgatgtgtgtaggaaagagcagatttcactacttccatattctcctattgcaggtggggttttaagtggaaaatataatggaaaattttatccagaggttgctcgatattcagattatttaaaaagtgataatccaagaattcaagggcaagcaacaagatatgtacatgaaaatcactttaactactgcgaaattattgaacttgcaaggaattaa

SEQ ID NO: 18904 - protein, 255 aa, Unknown
  Obtained from environmental sample
  DOMAIN (1)...(254): Aldo/keto reductase family
  misc_feature (1)..(255): Xaa is any amino acid
MSFGSLSDEKEAFKIMDKSVDRGINFFDTAEIYPIPPDAKYMGRTEEIIGKWLKGKQRDKLIIASKVAGAANGWFVPPVRHGLTAIDKFHIKKAIEGSLKRLGTDYIDLYQMHWPDTIIPIEESLKAFEELVKEGKVRYLGTSNDTAYGLTKANETSKRLGISRFESIQNNFSLNNPRFLDELADVCRKEQISLLPYSPIAGGVLSGKYNGKFYPEVARYSDYLKSDNPRIQGQATRYVHENHFNYCEIIELARN

SEQ ID NO: 18905 - DNA, 504 bp, Unknown
  Obtained from environmental sample
  misc_feature (1)..(504): n is a, c, g, or t
atggataccaataaagcttctgttatcatcgagctgtatccggaaaaagcacccgagacggtaaaaaactttttgcattatgtaaatgaagggaaatataacaagactatatttcatcgggtggtgaaaggttttgtcaatcagggtggaggttataatcatgattacaaattggtcgatacattcgaacccgtcaaaaatgaagcggataacggtttaaagaatctacgtggcacgatcgccatggcgcgtaaaagtgatccggactctgcaaggaaccaattttttatcaatactgctgataacaagatacttgatcacaaggatgaaaaaccctctggctggggttattgcgtatttggaaaggttgtggaaggtatgaatgtaatggataggatagcgaaagtaaggacgcggggttttgggccatttgctgccgaggtgcctgtgtctcctgtatcgatacatagtattgctgtcattaaggctgaggagaataattaa

SEQ ID NO: 18906 - protein, 167 aa, Unknown
  Obtained from environmental sample
  DOMAIN (1)...(161): Cyclophilin type peptidyl-prolyl cis-trans isomerase
  misc_feature (1)..(167): Xaa is any amino acid
MDTNKASVIIELYPEKAPETVKNFLHYVNEGKYNKTIFHRVVKGFVNQGGGYNHDYKLVDTFEPVKNEADNGLKNLRGTIAMARKSDPDSARNQFFINTADNKILDHKDEKPSGWGYCVFGKVVEGMNVMDRIAKVRTRGFGPFAAEVPVSPVSIHSIAVIKAEENN

SEQ ID NO: 18907 - DNA, 678 bp, Unknown
  Obtained from environmental sample
  misc_feature (1)..(678): n is a, c, g, or t
atgtgcccgcgctcattaganataagtctaattagcgtgggcatagtgcgaaagtataataagcgtaatatgaatcaaaacactacgagaatcttgctgataaatggattaaacaaacttgagaataaacagatgaaatttatattattagcatttttcacattgatatcgaactatgctttaagctctgaatatttaagatattcatataaatatcctatttatggtttgaaatctgatattgttgaaagtttttcgtttgacgacaatagcagaatatattgttcaaatgggactggaataatccaaaatgattgtaatgatggttatttatgttttatgtacgatcatattaaaatagccattcctaaaacatgtgatagagttaacaatgggagttggaaatacgataacattagttataatattgttactaatctcgaagcttttaatcccaatgatttagaggatcgtaaaagaacaaaatttattgttaatgcaaaagtgaataaaaaagacattggatatttcatttattcttcagataaaggtgttgatagtttttcatttattagaaaaaggaataagagtacggattttcataaaaaatcagatttaggcatgttaagtaatgggtgtgtattaacacaagaatataaaggtagacgcgagaactaa

SEQ ID NO: 18908 - protein, 225 aa, Unknown
  Obtained from environmental sample
  misc_feature (1)..(225): Xaa is any amino acid
MCPRSLXISLISVGIVRKYNKRNMNQNTTRILLINGLNKLENKQMKFILLAFFTLISNYALSSEYLRYSYKYPIYGLKSDIVESFSFDDNSRIYCSNGTGIIQNDCNDGYLCFMYDHIKIAIPKTCDRVNNGSWKYDNISYNIVTNLEAFNPNDLEDRKRTKFIVNAKVNKKDIGYFIYSSDKGVDSFSFIRKRNKSTDFHKKSDLGMLSNGCVLTQEYKGRREN

SEQ ID NO: 18909 - DNA, 591 bp, Unknown
  Obtained from environmental sample
  misc_feature (1)..(591): n is a, c, g, or t
atgaaattagataacctttattcacttaggagaaacttcactgttattggcttaacaggaagaacaggatcaggatgtactaaaatagccagcctactaggaaaaacttacaataacctcaagaaagatggtttaagaagctttgatgattcaaatgataatttgtttattaaaaaatttaatattgttgagaattatataagtcataataaaaattggcagaaatttgatgtaattaattatagaaatgtcctattattcttcttaattaataaaatatctagaggtaatactaacgaagatctttttcttattttatctaagtactatagagagagccctgaagaagacaataaaaatatagttttaagaaaactttcttttgtcttagaattattgaagacgaatcaaactctagtagatgaaattgcgaagtttaatgattttaatggtattaaagaaaaaaatgaacttataaaattaaatgaactattctttaatactgaattcaaagaattcagtaaagaaatatttaaaatattaatatctgatggaggatattttagaagtcagtactcgaccgattcttga

SEQ ID NO: 18910 - protein, 196 aa, Unknown
  Obtained from environmental sample
  misc_feature (1)..(196): Xaa is any amino acid
MKLDNLYSLRRNFTVIGLTGRTGSGCTKIASLLGKTYNNLKKDGLRSFDDSNDNLFIKKFNIVENYISHNKNWQKFDVINYRNVLLFFLINKISRGNTNEDLFLILSKYYRESPEEDNKNIVLRKLSFVLELLKTNQTLVDEIAKFNDFNGIKEKNELIKLNELFFNTEFKEFSKEIFKILISDGGYFRSQYSTDS

SEQ ID NO: 18911 - DNA, 369 bp, Unknown
  Obtained from environmental sample
  misc_feature (1)..(369): n is a, c, g, or t
atgatgtcgtatttcatttttaatgtaattttggagtacaaaagtaaacattattgtttaaaaacgatagatttcagaagaattactatctttaaatccttaaatattttagatatgaaaattttaaaaaaaataggctggacattgttattcattttgatagttgctcagttttttagcccagaaaaaaacgaaggagatgtaacttctttaacaacttttgtagaggagacaaatctgccagatgaagtgcataaaataatgaaaacatcttgctttgattgtcattcaaattctactcggtacccttggtatagcaatataactccagttaattactggatggcagatcatgttaacgaacgttaa

SEQ ID NO: 18912 - protein, 122 aa, Unknown
  Obtained from environmental sample
  misc_feature (1)..(122): Xaa is any amino acid
MMSYFIFNVILEYKSKHYCLKTIDFRRITIFKSLNILDMKILKKIGWTLLFILIVAQFFSPEKNEGDVTSLTTFVEETNLPDEVHKIMKTSCFDCHSNSTRYPWYSNITPVNYWMADHVNER

SEQ ID NO: 18913 - DNA, 387 bp, Unknown
  Obtained from environmental sample
  misc_feature (1)..(387): n is a, c, g, or t
atgataatgaaaatagatcataacacgaaaattatactactaagacatggtgaagtcgatattaaaagttacaaaaagatttcagcttctcaatttagaaaatggattaatgagtataatagttcaaatatcaaatctgaattcacagcaaaaaatgaaataaaaaatttatttaatgaagcggatgttttaatttgtagtaatttaaaaagaacaattcagtctgttgaaatatttgataaaacgccatttgaaataaacgaactttttaacgaggctgaattgccctctttaactttagatttattgaaatttaatccaaaaatttggttgattgtatttagaatattatggttctttggatattcacaaaattgtgaatcataa

SEQ ID NO: 18914 - protein, 128 aa, Unknown
  Obtained from environmental sample
  misc_feature (1)..(128): Xaa is any amino acid
MIMKIDHNTKIILLRHGEVDIKSYKKISASQFRKWINEYNSSNIKSEFTAKNEIKNLFNEADVLICSNLKRTIQSVEIFDKTPFEINELFNEAELPSLTLDLLKFNPKIWLIVFRILWFFGYSQNCES

SEQ ID NO: 18915 - DNA, 774 bp, Unknown
  Obtained from environmental sample
  misc_feature (1)..(774): n is a, c, g, or t
ttgcaagtgatgttggatagggacttggcaaaattgtatgaggtagaaacaaaagtttttaaacaagcagtaaatagaaatattgataggtttcctcaagattttatgtttgagcttacaaaagaggagttagaaaattggaggtcacaatttgtgacctccaattctgataagatgggattaagacgagcaccgtatgcatttacagagcaaggtgtatcgatgttaagtggtattttaaaaagtaaagtagcaatagaggtaagtgtaaatatcataagaacatttattaatatgagaaaacttatctcttcaaactctatgctatttcaaaaatttgaatacattgaacaaaaactattacaacatgatgtaaaatttgataaagtatttgaagctatagaacaaaaagagataaaaccatcattcggtatattttatgatggtcagatgtttgatgcatatatttttatatctgatttaataagaggtgcaaaatcaaagattgtacttatagataattatattgatgatagtgtgctaacattttttagtaaaaatcaagatgtcgatgtaacgatttatactcatactgtatctaaacagctgaaattagatatagaaaaatacaactctcaatacaaagctatcacaatcaaaagttttaaagattctcacgataggtttatgataatagatgacaatgaagtttatcatatcggggcaagtttgaaagacttggcaaaaagtgttgctttctcgaccgattcttga

SEQ ID NO: 18916 - protein, 257 aa, Unknown
  Obtained from environmental sample
  misc_feature (1)..(257): Xaa is any amino acid
MQVMLDRDLAKLYEVETKVFKQAVNRNIDRFPQDFMFELTKEELENWRSQFVTSNSDKMGLRRAPYAFTEQGVSMLSGILKSKVAIEVSVNIIRTFINMRKLISSNSMLFQKFEYIEQKLLQHDVKFDKVFEAIEQKEIKPSFGIFYDGQMFDAYIFISDLIRGAKSKIVLIDNYIDDSVLTFFSKNQDVDVTIYTHTVSKQLKLDIEKYNSQYKAITIKSFKDSHDRFMIIDDNEVYHIGASLKDLAKSVAFSTDS

SEQ ID NO: 18917 - DNA, 747 bp, Unknown
  Obtained from environmental sample
  misc_feature (1)..(747): n is a, c, g, or t
gtgtcaaccacagataaaaataacgcagtaaaaaagaatagaattctaccttgggctacagcaataatgctgataggtggaattgctgtacttgcggcaatctattggaatagaaatgtaacggttgatagtgcgtcatttacagggaataaaatgattgagactgaacaacttcttgaagtagctgaaatcccctttggcattcatcctgatagcttggatctgactgccgttattgagcgattgaagaaagtggattatgtaaaacaagctgttctttatgtagaaccgagtggagaattgaatattcagattaaagagcgggttccaatagctcttttgatgaaaggttctcacaaaagttatgtcgatgctgacggggtaaaacttccggttttgagtaacaagaactttgatgtccctttggtttatggatttgatgcttctttgaatggagacaccctcaaaaatgaaggtttcaagcaaataagttcttttctgatagatgcaaaggaaaataaatttggatggattaccatcagcgaagtggcctacaacagagaagaaggcgttgtagcattgagccaagaaaatggagttaagcttttattcggtagtaataacttccgagtaaaattagagaattgggaagccttttatacggaagtaattcgtgttaaaggtattcaagccatgcaacaggtagatttaagatttaccaaccaagtggtaaccagagaaagttaa

SEQ ID NO: 18918 - protein, 248 aa, Unknown
  Obtained from environmental sample
  DOMAIN (12)...(238): Cell division protein FtsQ
  misc_feature (1)..(248): Xaa is any amino acid
MSTTDKNNAVKKNRILPWATAIMLIGGIAVLAAIYWNRNVTVDSASFTGNKMIETEQLLEVAEIPFGIHPDSLDLTAVIERLKKVDYVKQAVLYVEPSGELNIQIKERVPIALLMKGSHKSYVDADGVKLPVLSNKNFDVPLVYGFDASLNGDTLKNEGFKQISSFLIDAKENKFGWITISEVAYNREEGVVALSQENGVKLLFGSNNFRVKLENWEAFYTEVIRVKGIQAMQQVDLRFTNQVVTRES

SEQ ID NO: 18919 - DNA, 723 bp, Unknown
  Obtained from environmental sample
  misc_feature (1)..(723): n is a, c, g, or t
atgcatatatttttaaagtcttttatcctctttatatttttatcatttattttacaagcttcatcatttgacgtaaaacagttacaaaaagactttcacaatacagtagttttaaaaccgctatatatcaagtacaataaaaaatctttagtagataaagccctgcaaaaaagagctaaaaagtttcgcgtttataactactactggaaaagagcgaagaaacttcttagcaaacaaagtaagcatctatcttcttcacagttcctgactttaattgacctctcaaaacaagtactcatagtcgttctatgggataaagaagcaaatgacttctaccctataggctttgactttatctctagtggaaatattaaaagagaaaaagaagtgacaaacggagatgcccactactttaaaacacctgccggtttctttaacatcaaaagtggttggcgttctgatggaaaaatatacaaagacaatataacgatgccatatggtaaaaaagagagatttgttttttattttggtgagcaaaaaggtcttcgctacaacacgtttgataaaaacaatacaaagatcaaagaccccaaaaagtggacactaataactgacaaacttaagtttgctatgcatgctcacactagcacagctccactaggaattcctcaatcacacggatgcatacgcatgagtaatgagctaaatctcagccgaatctga

SEQ ID NO: 18920 - protein, 240 aa, Unknown
  Obtained from environmental sample
  SIGNAL (1)...(20)
  misc_feature (1)..(240): Xaa is any amino acid
MHIFLKSFILFIFLSFILQASSFDVKQLQKDFHNTVVLKPLYIKYNKKSLVDKALQKRAKKFRVYNYYWKRAKKLLSKQSKHLSSSQFLTLIDLSKQVLIVVLWDKEANDFYPIGFDFISSGNIKREKEVTNGDAHYFKTPAGFFNIKSGWRSDGKIYKDNITMPYGKKERFVFYFGEQKGLRYNTFDKNNTKIKDPKKWTLITDKLKFAMHAHTSTAPLGIPQSHGCIRMSNELNLSRI

SEQ ID NO: 18921 - DNA, 513 bp, Unknown
  Obtained from environmental sample
  misc_feature (1)..(513): n is a, c, g, or t
atgaaaaatttaatcgtattaatttttgttgttttgacgcaattgtcagtggcacaaaccgaattaatagcctacaaaagtcacagtagtgatatgactaatttcaagtctgatagctatgaaaatttagggattcctccaatgcgaattgataccattattattctaaatgattcaaccattgtagagataagttcaaggcaatggagtggaagacctggtttttgtgtaaaagacacagttgtgcatcatcctatgtatcaagaaaattctgattatgaaaaattaagaggtaattattacgacacctctatcgtttttattaatcacgatacgcttaccgtgaaacaaaaaaagaaacaagcaaaaaaagataagaagaaaaattctgctactccaattggagtagattttcctaagtctaataataattttctgttgattttaagtgtttttatgagtttgtgtgttttcatcatatggaaagtgaataagtataaaattacagcctaa

SEQ ID NO: 18922 - protein, 170 aa, Unknown
  Obtained from environmental sample
  SIGNAL (1)...(18)
  misc_feature (1)..(170): Xaa is any amino acid
MKNLIVLIFVVLTQLSVAQTELIAYKSHSSDMTNFKSDSYENLGIPPMRIDTIIILNDSTIVEISSRQWSGRPGFCVKDTVVHHPMYQENSDYEKLRGNYYDTSIVFINHDTLTVKQKKKQAKKDKKKNSATPIGVDFPKSNNNFLLILSVFMSLCVFIIWKVNKYKITA

SEQ ID NO: 18923 - DNA, 795 bp, Unknown
  Obtained from environmental sample
  misc_feature (1)..(795): n is a, c, g, or t
gtgaaggacagcatccactacgctaaaaggcttcaagacgctattttgccatctgcatctatgttagaaaataacttcaaagattattttgttttatttaatcctaaagacgtagtaagtggcgactttttttggcatgaaagaataaagaacaatacttatttagcagtagcagactgtacgggccatggtgtaccaggtgctttggtaagtgtcgtttgtgccaatgcacttaaccgtgcattatttgaatttaattgtatagctccaaatgatatcttaaataaaactagagaaatcgttattgaaacattttcaaaaagcggaaacgaaatcaaagacggaatggatatttctttaatttgcatcaatggtgataatattattttttctggtgcaaataatcctctttggattgttagagaaacaaatctgctaactgatgatcaaaaatcaaacaagaattcgataattgacactgattattctttaattgaaatgaaacccgacagaatgccgataggaatacatgacaatatggattcattcacaaatcatagcatgaaagtacataatactgatacatattacttatttacggatggatatgcagatcaatttggtggtgaaaaaggaaagaaaatgaaatacaaaccatttaaaaagatactgttaaaaaattccaatttagaactaaataaacaaaaaacagctttaaatgaactgtttgaaaaatggagatctgaattagaacaaattgatgatgtttgtataatcggaatcaagtctctctga

SEQ ID NO: 18924 - protein, 264 aa, Unknown
  Obtained from environmental sample
  DOMAIN (49)...(264): Stage II sporulation protein E (SpoIIE)
  misc_feature (1)..(264): Xaa is any amino acid
MKDSIHYAKRLQDAILPSASMLENNFKDYFVLFNPKDVVSGDFFWHERIKNNTYLAVADCTGHGVPGALVSVVCANALNRALFEFNCIAPNDILNKTREIVIETFSKSGNEIKDGMDISLICINGDNIIFSGANNPLWIVRETNLLTDDQKSNKNSIIDTDYSLIEMKPDRMPIGIHDNMDSFTNHSMKVHNTDTYYLFTDGYADQFGGEKGKKMKYKPFKKILLKNSNLELNKQKTALNELFEKWRSELEQIDDVCIIGIKSL

SEQ ID NO: 18925 - DNA, 303 bp, Unknown
  Obtained from environmental sample
  misc_feature (1)..(303): n is a, c, g, or t
atgaagaaactaaaaagcttttacccttcgataagctggaaatactacgttttatgttatttatttcttcttgtgggctctttcttttatggggcattatctaagaatgttagttcaaatgattttttaacaaagctaagttctgatagtactcagaaaccaattgtcttacttattccagatcagcaaaatcttggaaatataggaggattggatacatttcttagcaccaatttcaatcttcttattgctgattataaagaattatataccaagaagatacgaaatcgattcatgttctga

SEQ ID NO: 18926 - protein, 100 aa, Unknown
  Obtained from environmental sample
  misc_feature (1)..(100): Xaa is any amino acid
MKKLKSFYPSISWKYYVLCYLFLLVGSFFYGALSKNVSSNDFLTKLSSDSTQKPIVLLIPDQQNLGNIGGLDTFLSTNFNLLIADYKELYTKKIRNRFMF

SEQ ID NO: 18927 - DNA, 579 bp, Unknown
  Obtained from environmental sample
  misc_feature (1)..(579): n is a, c, g, or t
ttgtttcacaacatcttttgctgcgtaatgagagcttatatctcaatgctcaatcaattcacctgcggattggcccgaaaattgccactgattatgtattattaccaaacccggaattcgcaatcatctaccagcatgaaaaaaaagacagttccccttctcctcctggtactcctttccatttctgtttttgcgcagcaggggggaatatcaatttcggccaatcaaaccccttccggactaacggaaaaagtgatcctgaaaggcaagctcatccacaaaccctggaccaaatcctcccagagctattgcgcacggggtagcgactactacgtgctgctggtcaatggccaggagcatatcctcgcagcagacgaggcccaatggaaaaagctgaagcgccgcatcgggaaaaaggtcaaagttcgcggagaattcatcacccggaccatttcagctcccgatgaagataaaatctcgcaacgtcccgtttctttgaatccggaaaccggcctttctgaacctataaaggattataattgtacggtattccgcgtcagctccagcggtaaaaaataa

SEQ ID NO: 18928 - protein, 192 aa, Unknown
  Obtained from environmental sample
  misc_feature (1)..(192): Xaa is any amino acid
MFHNIFCCVMRAYISMLNQFTCGLARKLPLIMYYYQTRNSQSSTSMKKKTVPLLLLVLLSISVFAQQGGISISANQTPSGLTEKVILKGKLIHKPWTKSSQSYCARGSDYYVLLVNGQEHILAADEAQWKKLKRRIGKKVKVRGEFITRTISAPDEDKISQRPVSLNPETGLSEPIKDYNCTVFRVSSSGKK

SEQ ID NO: 18929 - DNA, 417 bp, Unknown
  Obtained from environmental sample
  misc_feature (1)..(417): n is a, c, g, or t
ttgtggaaagcggcgcatgatcggggaggaaagcatataaaaactaaaaaaggagaggatatgagtgtttcaattcaaattgtacttagcgaaaaattctatctgcgcgatcctgaacaaaccagcctgggcagaaaaatcgtggattcggggatcaaaatgatcgacgaattgggttttgaaaagtttacctttaagaaactggcctttgaaattgactccactgaggcatccgtctaccgctatttcgaaaacaagcacaaattcctgatctatttggtttcctggtactggacctggttggaatacctgattgattaccaaaccaataacgtcgacgatgcggagcgttgtctgcgcattgcgatcaaagtcctggccaattcttccagctacgacctcgagccgaatcaatga

SEQ ID NO: 18930 - protein, 138 aa, Unknown
  Obtained from environmental sample
  DOMAIN (47)...(93): Bacterial regulatory proteins, tetR family
  misc_feature (1)..(138): Xaa is any amino acid
MWKAAHDRGGKHIKTKKGEDMSVSIQIVLSEKFYLRDPEQTSLGRKIVDSGIKMIDELGFEKFTFKKLAFEIDSTEASVYRYFENKHKFLIYLVSWYWTWLEYLIDYQTNNVDDAERCLRIAIKVLANSSSYDLEPNQ

SEQ ID NO: 18931 - DNA, 951 bp, Unknown
  Obtained from environmental sample
  misc_feature (1)..(951): n is a, c, g, or t
atgggtttacttctcaaaccagtaaagataaatggcaattgcataacggtggcatcaatagaaccaaagggcaaggtaatttctgctttgctactgcccatgattagcgactctccaattaatagggaaaatgaggcatattcgttaataaatgagattaatacacgtgcggaagctatactgcataaaaaggggaaacgacagtttaaagactatatttccatagccgtacccccaaccccggataatcatgttagattcaggcgtgcattgctcgatacaatacaagagcttgaaagcataaatatccgttcagcaatgaactctggcacggatgtgcttggtaggttttacgagcaatttctaaaatatggtaacggagcaaaggagataggcattgtactaactccaaggcacattacaaggtttggcgcagatgcactggatgtaacatataaagataaagtgttagaccccgcatgtggcactggcgggtttttggttgctgcgtttgacagagtgaaaaaagctgtagatgaaagtattttaaacgattttaagcagacaggcatatatgggattgaacaagaccctgaagttgtctcgctggcgttagtgaacatgatttttagaggtgacggcagaaataacatcgaagaggggaattgctttacatctaataagtttaaaggcgtgaaaatgtctaaagtgttaatgaacccgccatttgcacttaaaaaacaagatgaaaaagaatataagtttatggattttgctttgaacaagatggataagggcggcttgttatttgccgtcatcccaagtccaataatgtttagagaaaaaaactttaaagagtggcggcaaacaatgcttgcagagcataccctaagagctgttattaagttgccagatgacctttacaccctcgaccgattcttgatccactag

SEQ ID NO: 18932 - protein, 316 aa, Unknown
  Obtained from environmental sample
  misc_feature (1)..(316): Xaa is any amino acid
MGLLLKPVKINGNCITVASIEPKGKVISALLLPMISDSPINRENEAYSLINEINTRAEAILHKKGKRQFKDYISIAVPPTPDNHVRFRRALLDTIQELESINIRSAMNSGTDVLGRFYEQFLKYGNGAKEIGIVLTPRHITRFGADALDVTYKDKVLDPACGTGGFLVAAFDRVKKAVDESILNDFKQTGIYGIEQDPEVVSLALVNMIFRGDGRNNIEEGNCFTSNKFKGVKMSKVLMNPPFALKKQDEKEYKFMDFALNKMDKGGLLFAVIPSPIMFREKNFKEWRQTMLAEHTLRAVIKLPDDLYTLDRFLIH

SEQ ID NO: 18933 - DNA, 747 bp, Unknown
  Obtained from environmental sample
  misc_feature (1)..(747): n is a, c, g, or t
atgacagatcgctgggctttttgtgatgatatgccacaagcattagaaatgttagcacaagatatttctaacaatcatccaattataaaaattattggcactgcaagtagtgtggtttctgctgctaaaatcttacaaaaaaaacaaccagatatgttgtttctagacattatgttgggagacggaactggttttgatttgttagaaatcattccgaatttaacttctaaaattatctttgttaccgcaagtgacgagtttgctataagagcttttaaatttgctgccatagattatattttaaaaccttactctgatgaagagttgaaaaatgcaattgacaaagcaatgcatcaaattcagccaaaaaacgagcaattatcagtcttacaagaatctattgctacaccaaatcaattgccaaaaaaaatatcattacacactttagataaaattgtggtggtttctttggatgaagtaatccgatgtaaatccgacaataattatactactttttattttgaaaacggttctaaaattatggttaccaaaaccttaaaattttatgcagatttattaaaagacaattctttcttacgcgttcatcaaagtcatttgataaacaccaaatacatcaaagaatttataaaatcagatggaggttatttagtgttaaaagacaaaagtaccgtttcagtttccgttcgtaaacgagcagaagttattgaagcacttgccaatctttaa

SEQ ID NO: 18934 - protein, 248 aa, Unknown
  Obtained from environmental sample
  DOMAIN (8)...(121): Response regulator receiver domain
  misc_feature (1)..(248): Xaa is any amino acid
MTDRWAFCDDMPQALEMLAQDISNNHPIIKIIGTASSVVSAAKILQKKQPDMLFLDIMLGDGTGFDLLEIIPNLTSKIIFVTASDEFAIRAFKFAAIDYILKPYSDEELKNAIDKAMHQIQPKNEQLSVLQESIATPNQLPKKISLHTLDKIVVVSLDEVIRCKSDNNYTTFYFENGSKIMVTKTLKFYADLLKDNSFLRVHQSHLINTKYIKEFIKSDGGYLVLKDKSTVSVSVRKRAEVIEALANL

SEQ ID NO: 18935 - DNA, 822 bp, Unknown
  Obtained from environmental sample
  misc_feature (1)..(822): n is a, c, g, or t
atgactccaactacacttttctatattttaatagcaattcttcttatcaattttatcattgataaaatactagatgctttaaatacaaaacactttgatgatgcaattccggctgaattacaagatgtgtatgaaaaagaggagtacgaaaaatcgcaagcgtataaaaaagtaaatgcgcaattttctaacatcacaggacttttctctttggcacttacacttgcttttttctttttagacggatttcaatttgtggatgagttggcaaaaagttacagttcaaatgctattgtaattgcattgattttcttcggaattattatcatcggttcagatattataaacacccctttttcgtattacaaaacctttgtaattgaagaaaaatttggatttaataaaaccactaaaaaaacgtttattgttgataaaatcaaaggattattgatgactacactacttggtggtggaattttagcactcattatttggttttatcagtttgcaggaactcatttttgggtgtatgcttggattttagttgccgttttttctttgttgatgaatctattttatgccaaattaattgtgccgttatctaataaacaaactccgttagaagatggagaattaccaagagcaattgaaaaatacgcaacgaaagtgggttttacacttacaaatgtctgcgtactcgatggttctaaacgttctacaaaagcaatgcgtatatctctggattggttcaccaaacgaatacgctgtacgacccgtgatcaacgattagaattggtcaactcgtgccgtttggcccccaan

SEQ ID NO: 18936 - protein, 274 aa, Unknown
  Obtained from environmental sample
  misc_feature (1)..(274): Xaa is any amino acid
MTPTTLFYILIAILLINFIIDKILDALNTKHFDDAIPAELQDVYEKEEYEKSQAYKKVNAQFSNITGLFSLALTLAFFFLDGFQFVDELAKSYSSNAIVIALIFFGIIIIGSDIINTPFSYYKTFVIEEKFGFNKTTKKTFIVDKIKGLLMTTLLGGGILALIIWFYQFAGTHFWVYAWILVAVFSLLMNLFYAKLIVPLSNKQTPLEDGELPRAIEKYATKVGFTLTNVCVLDGSKRSTKAMRISLDWFTKRIRCTTRDQRLELVNSCRLAPX

SEQ ID NO: 18937 - DNA, 852 bp, Unknown
  Obtained from environmental sample
  misc_feature (1)..(852): n is a, c, g, or t
ttggctaacaaatacaatattgaaattgaagaaactgagcaatcagacgaacaaaaacaacaattaaacgaacgtgaaagtatgtttttggtgtctaaattcgctgcagaatattttcatgatttaatgctacatacgcagcaaggaaaagcaattggactttcgtattttaaagagcgtggttttagagatgatataattgaaaaatttgatttaggatattgtaaagacgaatgggataattttacaaaatcagctttaaaaaaaggctatgacatcaaatatttagcatcaaccggattaaccattgtaaaagaaaacaaacagtttgatcgatttaaagggcgtgttttatttccaattcattccatgtctggcagaattcttggttttggtgggcgaattttaactgcggataaaaaagcagccaaatatttaaattctccagaaagtgatatttaccacaagagtaaaattttatacggaatttatcaggcaaagaaagaaattgccaaacaagacaattgttttttagtagaaggatatacagatgtaatttcgtttcatcagtcaggaatagaaaatgtggttgcgtcttctggaacagcgttaacttcagatcaaattcgtttagtaagaagattaacacaaaatataacagtactttttgatggagatgcagctggtttaagagcttcgattcgtgggatcgatttgattttagagcaaggaatgaatgtgacagtggtgacttttcctgaaggagaagatccagatagttttgcaaaatcgcattctgatgctgaattacaagagtatttagaacatactgctcaagatttatcactttaa

SEQ ID NO: 18938 - protein, 283 aa, Unknown
  Obtained from environmental sample
  DOMAIN (174)...(253): Toprim domain
  misc_feature (1)..(283): Xaa is any amino acid
MANKYNIEIEETEQSDEQKQQLNERESMFLVSKFAAEYFHDLMLHTQQGKAIGLSYFKERGFRDDIIEKFDLGYCKDEWDNFTKSALKKGYDIKYLASTGLTIVKENKQFDRFKGRVLFPIHSMSGRILGFGGRILTADKKAAKYLNSPESDIYHKSKILYGIYQAKKEIAKQDNCFLVEGYTDVISFHQSGIENVVASSGTALTSDQIRLVRRLTQNITVLFDGDAAGLRASIRGIDLILEQGMNVTVVTFPEGEDPDSFAKSHSDAELQEYLEHTAQDLSL

SEQ ID NO: 18939 - DNA, 555 bp, Unknown
  Obtained from environmental sample
  misc_feature (1)..(555): n is a, c, g, or t
atgaatttacttgataaactaaaaactattctgcctgaatcgcaaatatcgaatcagatagaccatctgaaagttgtatccgaggatgagtccactctccccggcgttatccctctagctgttgtctggacggaaaccgaacaggaaatacaaaaagttgtaaagttctgttttgaaaataaaattaaacttacaacacgcggagcaggttcggctctggagggttcaactatcccctcagaagatggtattgttttggatgtaagcaggatgactaagatacttgagttctggcccgatgatcttcaggttaaagtcgagccggggttaatctatgataatttaaatctaaaattaaaaaacgatggccttttctttccgccatcaccgggcggatcaggtgacattgccactatcggcgggatggtctcaaccaatgccagcggtatctattccgttaaatacggcggtaccaaagaatatattctggcacttgaagctatcacaggaacaggagagaaaatcacagttggtaaccgggcggttaaaagataa

SEQ ID NO: 18940 - protein, 184 aa, Unknown
  Obtained from environmental sample
  DOMAIN (38)...(182): FAD binding domain
  misc_feature (1)..(184): Xaa is any amino acid
MNLLDKLKTILPESQISNQIDHLKVVSEDESTLPGVIPLAVVWTETEQEIQKVVKFCFENKIKLTTRGAGSALEGSTIPSEDGIVLDVSRMTKILEFWPDDLQVKVEPGLIYDNLNLKLKNDGLFFPPSPGGSGDIATIGGMVSTNASGIYSVKYGGTKEYILALEAITGTGEKITVGNRAVKR

SEQ ID NO: 18941 - DNA, 582 bp, Unknown
  Obtained from environmental sample
  misc_feature (1)..(582): n is a, c, g, or t
atgcaagaagtattgatttccggaaagacttcttttaagattgaagttccttataaattatatgagacaggtggaaaaaagaaaaaaccacttattgtttatttgcatggctataaacagaatattgatggttttgaaaatctagtaaaagagctcttagagattgaagcatatcatctttttatacaagcaccttatccaatttatgatgaaacccgaaaaagaaaagtagaagagtggggaagatcttggtatttatatgatggagaacaacagcaatttgtgaaatctatggagctttcatcagaatttatccaagagataatagatggacttcttccaaatatagatgttaacagaatctgcttgtttgggtattcgatgggtggttatttagctgggtattttatgctctcaagatggaaacacgtgaatgaagctattataataggagctcgaattaagacagaagtatttgagggtcgacttgaagaagcaaagcatataagagtattagcattacatggtaataaagatgagaatgtgcttccaatgcctcaaatgaaggagatagagacttaa

SEQ ID NO: 18942 - protein, 193 aa, Unknown
  Obtained from environmental sample
  misc_feature (1)..(193): Xaa is any amino acid
MQEVLISGKTSFKIEVPYKLYETGGKKKKPLIVYLHGYKQNIDGFENLVKELLEIEAYHLFIQAPYPIYDETRKRKVEEWGRSWYLYDGEQQQFVKSMELSSEFIQEIIDGLLPNIDVNRICLFGYSMGGYLAGYFMLSRWKHVNEAIIIGARIKTEVFEGRLEEAKHIRVLALHGNKDENVLPMPQMKEIET

SEQ ID NO: 18943 - DNA, 405 bp, Unknown
  Obtained from environmental sample
  misc_feature (1)..(405): n is a, c, g, or t
atgtcatcttcactaaaatcattgggttggaacgaaatcaaacccaatgcatggaaggatgtttggaatgccctaagagctgatgaaaaagatgaaaaagtaccttttattcccacaaccaataatggcaagattgaaactgtaatttacactaaaagaattgacgataatttatttgcattgcatttatgggaacgcccgttaaaaataacatcatctgaccaacacttatatgcaggttatgtttctcaaaatcacataggtaaaaattgggggctcacattttggaaaaatagttataacaatgatgccatattgacttttataaaagccattgagaaaagcaatcaactgtattacagtaaaagtgataatcagttttttatccaagtcagggaaaattaa

SEQ ID NO: 18944 - protein, 134 aa, Unknown
  Obtained from environmental sample
  misc_feature (1)..(134): Xaa is any amino acid
MSSSLKSLGWNEIKPNAWKDVWNALRADEKDEKVPFIPTTNNGKIETVIYTKRIDDNLFALHLWERPLKITSSDQHLYAGYVSQNHIGKNWGLTFWKNSYNNDAILTFIKAIEKSNQLYYSKSDNQFFIQVREN

SEQ ID NO: 18945 - DNA, 414 bp, Unknown
  Obtained from environmental sample
  misc_feature (1)..(414): n is a, c, g, or t
ttgattttgaattacaccataaaaaacgagcagctttcagcttctgtagcacataatggcattgaactttgttctatcaagtcgctttcaacaggaactgaatatatgtggcaaggagattccaatatctgggccagtcacgctcctgtgctttttccaatcattggtatgcttaaagacgacacctacttttttgaagggaaaagctattcgttacccaaacatggtgtagttcgtaattccgataagaatattcttgttaaacgcaccgagaagagtcttcttttttctatgaaatgggacgaagagcttctgaaacaatatccattcaaattcgaaattcaaacaaggtttgcattaaaaggtagatcgctattcgttcagcacaccgttttgaatcatggagataagaat

SEQ ID NO: 18946 - protein, 138 aa, Unknown
  Obtained from environmental sample
  misc_feature (1)..(138): Xaa is any amino acid
MILNYTIKNEQLSASVAHNGIELCSIKSLSTGTEYMWQGDSNIWASHAPVLFPIIGMLKDDTYFFEGKSYSLPKHGVVRNSDKNILVKRTEKSLLFSMKWDEELLKQYPFKFEIQTRFALKGRSLFVQHTVLNHGDKN

SEQ ID NO: 18947 - DNA, 534 bp, Unknown
  Obtained from environmental sample
  misc_feature (1)..(534): n is a, c, g, or t
atgtctcaacggaaactcatcctttatatagcatgctctttagatgggtatatcgcaaagcctaacgacgacctcagctttttggattccatgcaaaaggaaggtgaagattatggctataacgagttctcagcctccgtggataccgtgattttgggacgaaaaacttatgattgggtgatggaacgagttccagaatttccccatgctgataaaaaagcttatgtaattactcgatccaaccgaccccatatcgaaaatatcacattttattctggtgatttaactaagctagttaaaaaattaaaaacagagactggaaagaatatcttttgtgatggtggagctgaagtagttaatgaattattgaaagcatgcttaatcgatgagtttataatttctgtgattcctattttggttggcgatggaacgagactttttaaagacggccgaccagaacaacttctagaacttatttcctctaaaacatttgagactgggcttactcaactgcattataaagttgctcacaan

SEQ ID NO: 18948 - protein, 178 aa, Unknown
  Obtained from environmental sample
  DOMAIN (4)...(170): RibD C-terminal domain
  misc_feature (1)..(178): Xaa is any amino acid
MSQRKLILYIACSLDGYIAKPNDDLSFLDSMQKEGEDYGYNEFSASVDTVILGRKTYDWVMERVPEFPHADKKAYVITRSNRPHIENITFYSGDLTKLVKKLKTETGKNIFCDGGAEVVNELLKACLIDEFIISVIPILVGDGTRLFKDGRPEQLLELISSKTFETGLTQLHYKVAHX

SEQ ID NO: 18949 - DNA, 693 bp, Unknown
  Obtained from environmental sample
  misc_feature (1)..(693): n is a, c, g, or t
atgaattcgacttcatcccaagccccattcccatggttggcccaatatcccgaaggcgtaggcgccaccatcaacccggatcagtacagttcacttctggatctgtttgagcatggcttcaaaagttatgcagaccgtcccgcctttgtcaacatgggcaaaaccatttcttaccgcgatttggaggtacaaagtcgcaattttgccgcctggctgcagtcaatcggactgaaaaagggagaccgcattgccattcagatgcccaatttgctgcaatttccagtggtgatgtttggtgccttgcgggctggtttgatcgtggtcaataccaatccattgtataccccacgtgaaatggagcaccagtttcaggattccggcgccaaagccatcgtgatcctggccaactttgccgacaagctggaagaggtccttcccaaaacccagatcaagcacgtgatcgtcagtaaaatcggcgatatgctgggtttcaaaggagcgattgtgaattttgtggtcaagaacatcaaaaagatggtgcccaaataccatctgcccggccatcatacacttccgcaggtcctctccaaaggcaaatcgctcaagtatacccgaccgcaattgaacaaccaggagattgccttcctgcaatataccggcggaaccaccggcccatccaaagtgcttctatag

SEQ ID NO: 18950 - protein, 230 aa, Unknown
  Obtained from environmental sample
  misc_feature (1)..(230): Xaa is any amino acid
MNSTSSQAPFPWLAQYPEGVGATINPDQYSSLLDLFEHGFKSYADRPAFVNMGKTISYRDLEVQSRNFAAWLQSIGLKKGDRIAIQMPNLLQFPVVMFGALRAGLIVVNTNPLYTPREMEHQFQDSGAKAIVILANFADKLEEVLPKTQIKHVIVSKIGDMLGFKGAIVNFVVKNIKKMVPKYHLPGHHTLPQVLSKGKSLKYTRPQLNNQEIAFLQYTGGTTGPSKVLL

SEQ ID NO: 18951 - DNA, 630 bp, Unknown
  Obtained from environmental sample
  misc_feature (1)..(630): n is a, c, g, or t
atggactacgccctcaccaaggacgccggccttttcgctgacgtagaattcaaggtgcaggactaccgggccaagctgatcatgagctcctacgaagccaatctggtggaggacgaaatggagaaggacatctccatgacggagattcgcagctactatgaagcgaacaaggacaactttcgcagcaaagagaatcagtacaattatttttacatcgtttctaccagtcgggacctctccgaagtcgaaggttggttgcgcagcgaccacaaagagaatctcccaaagctgaaagaatgggcagaagccaatgccatgacggccaagctcgacagcacctatcacggcgacaataaaatcgacgatgtgtccaaaggatatttcggaaatttgaaaaaagcgagcataggaaaattaattcgctggaatggcgttatccaaggggaacgcagacgctatcttttcaaaatgatcgatatagtgaagccaggtgaatatttgcctgtgatcctttgtcgagataaaatccgcgatttgctcctgaacgagcgcaagatcaaactgatcaagagtactgaagaaaaaatcctgagcaacgccagggccagcaattatatccgcaagaattaa

SEQ ID NO: 18952 - protein, 209 aa, Unknown
  Obtained from environmental sample
  misc_feature (1)..(209): Xaa is any amino acid
MDYALTKDAGLFADVEFKVQDYRAKLIMSSYEANLVEDEMEKDISMTEIRSYYEANKDNFRSKENQYNYFYIVSTSRDLSEVEGWLRSDHKENLPKLKEWAEANAMTAKLDSTYHGDNKIDDVSKGYFGNLKKASIGKLIRWNGVIQGERRRYLFKMIDIVKPGEYLPVILCRDKIRDLLLNERKIKLIKSTEEKILSNARASNYIRKN

SEQ ID NO: 18953 - DNA, 564 bp, Unknown
  Obtained from environmental sample
  misc_feature (1)..(564): n is a, c, g, or t
atgacttttcacagagggtttatgcactcaattatgtttgctgttttgggttcttttctcttcggatggattacatataaactttacgatactggcaaacgaaaaggaacaacaacatctaaaaactgggtttggttgttctttttatctcttggaacacatcccattttagattgttttacaccttacggaacacaattgtttgcacctttttctgattacagagttgcatttaacaatatttctgttgtggatcctttatatacactcccgtttttgatatgtatgattgttgtattgttctttaaaagaacaaacaccaaacgtttaaaatgggcaaaagtggggatttacatcagctctgcatacatgctttttaccattttaaataaaatttacattgacagtgtttttaaaaaatcttttgaaaaagcagatatttcttatctccgatatagaacacaaccaaccattttaagcaattttctttggtacggaattgcagaaaccaacaccgattataaattgcatattattctctttttgacacaaaaacacagctga

SEQ ID NO: 18954 - protein, 187 aa, Unknown
  Obtained from environmental sample
  DOMAIN (2)...(74): Predicted membrane-bound metal-dependent hydrolase (DUF457)
  misc_feature (1)..(187): Xaa is any amino acid
MTFHRGFMHSIMFAVLGSFLFGWITYKLYDTGKRKGTTTSKNWVWLFFLSLGTHPILDCFTPYGTQLFAPFSDYRVAFNNISVVDPLYTLPFLICMIVVLFFKRTNTKRLKWAKVGIYISSAYMLFTILNKIYIDSVFKKSFEKADISYLRYRTQPTILSNFLWYGIAETNTDYKLHIILFLTQKHS

SEQ ID NO: 18955 - DNA, 720 bp, Unknown
  Obtained from environmental sample
  misc_feature (1)..(720): n is a, c, g, or t
atggttcaaagaaaaaataacgaagctttattatatgttcgggtgtcgagtaaagaacaagagaaggatggatactctctcgatgctcaggaaaaacttggaagagaatatgctaaacgtcaaaatttagaaattgtccgtatgtggaaagtttctgaatcagcttggaaaaaagaacggacagcattcaatctgatggttgattattctaaaaaacactcagaagtaaagcatattatttttgacataacagatagaatgacaagaaacgattttgataaacttaaaattgtttcattgattaaagagcatgataagagtatacatttttccagaacaaacaagataatagataaggattccggttctgatgctgagttcatgtttgatattgaagttgcagtcgcaaagaagatgtcaaatgatatatcaagaaaagccaaaatgggtttagaagagaaagccgaacaaggcgaatatccttcaactgcaccaattggttatataaataataaagaaactcatttaatcgatattgatcctgaaaggtctgcatttattaaatcggcatttcttgaaatgggatcagggaattattcactaagcactttagcagaaaaattatatagagatggcttaaggtcaaaaagaggtcttaaagttataaagccaacattagctcatttgttgaagaaccccttttattatggttgttcctcn

SEQ ID NO: 18956 - protein, 240 aa, Unknown
  Obtained from environmental sample
  DOMAIN (9)...(160): Resolvase, N terminal domain
  misc_feature (1)..(240): Xaa is any amino acid
MVQRKNNEALLYVRVSSKEQEKDGYSLDAQEKLGREYAKRQNLEIVRMWKVSESAWKKERTAFNLMVDYSKKHSEVKHIIFDITDRMTRNDFDKLKIVSLIKEHDKSIHFSRTNKIIDKDSGSDAEFMFDIEVAVAKKMSNDISRKAKMGLEEKAEQGEYPSTAPIGYINNKETHLIDIDPERSAFIKSAFLEMGSGNYSLSTLAEKLYRDGLRSKRGLKVIKPTLAHLLKNPFYYGCSS

SEQ ID NO: 18957 - DNA, 771 bp, Unknown
  Obtained from environmental sample
  misc_feature (1)..(771): n is a, c, g, or t
ttgaaaacaaaaacgttattaactgtattaacaatactctttagtttgcaaagttttgcacaattattttctggacgtatcataaatgcaagtaaagagcctttagaaaatgtatatgtatataatacaacatcaaacagtcatacacatacaaaagtaaacggaggttttatcctcgagaattctaccgttggcgatgttattgaaataggacttttaggatataaaaagcagcaattttccttgaaagaatctgaacttaaaaacaaagtaacgctaattttagaagacaaagtatttttgttagatgaattgattttaactaaaaaaatagatcccattcaaactgttgtaaaaatagatttggcaaaaaaccctgtaaactcttcgcaagaaattttacaaaaagtaccaggtttatttattggtcaacatgctggtggaggtaaagcagaacaaatatttttacgtggttttgatatagatcatggaacagatttaagtttgtctgtagacggaatgcccgtaaatatggtttcgcatgcacacggacaagggtatagcgatttgcattttttgattccagaaaccattcaaaaaataaattttggtaaaggaccttattatgcaaatcatggagattttaatactgcaggatatgtagattttaaaacaaaaacagcaatacaaaaaagtcaaattactattggtatcggtcagttaatacttttagaccttaggactgttaaattattaggcacaaaagcatga

SEQ ID NO: 18958 - protein, 256 aa, Unknown
  Obtained from environmental sample
  SIGNAL (1)...(18)
  misc_feature (1)..(256): Xaa is any amino acid
MKTKTLLTVLTILFSLQSFAQLFSGRIINASKEPLENVYVYNTTSNSHTHTKVNGGFILENSTVGDVIEIGLLGYKKQQFSLKESELKNKVTLILEDKVFLLDELILTKKIDPIQTVVKIDLAKNPVNSSQEILQKVPGLFIGQHAGGGKAEQIFLRGFDIDHGTDLSLSVDGMPVNMVSHAHGQGYSDLHFLIPETIQKINFGKGPYYANHGDFNTAGYVDFKTKTAIQKSQITIGIGQLILLDLRTVKLLGTKA

SEQ ID NO: 18959 - DNA, 717 bp, Unknown
  Obtained from environmental sample
  misc_feature (1)..(717): n is a, c, g, or t
ttgaatatcaaaatagagaacgacgctttggtaaaacaagcgaacaaattgaaacaccaaatgagtaaatatactattgtagtactatttttattaagttttttaactgtaaatgttaacggacaaaccaataattcaacgattaaagatacaattcccacaaaagtaccttatgtaaaagggcaagaatatgtcttaggcggaattacagttactggtttaaaaaagtttagcgaagaaacagtaaaaatatttacgggtttaagaaatggacagcttattaagctccctggagataaattaaccagtgctattaaaaaattatacgacagtaaacagtttagtgatgttgatgtgtatttagcaaaacttgatggaaatgttgcttatttacaatttaacgtaaaagaattaccacagctaaacttagttactttttctggagttaaaaaagcaaaaagaaaagaattaaaaaaagacaccgaccttaaaaaaggcgcaatggttactgataacctaattgttacttctaccaattactttaaaaagaaatttacagacaaagggtttttaaaaaccaaagtttctataaatacatctaaagacacttccgatattaatgttgtaaatatggctgttcatatagaccgaggaactcgtatcaaaattaaagacatttcttttaaaggcaacaaagagtctcgatcccagcgataa

SEQ ID NO: 18960 - protein, 238 aa, Unknown
  Obtained from environmental sample
  misc_feature (1)..(238): Xaa is any amino acid
MNIKIENDALVKQANKLKHQMSKYTIVVLFLLSFLTVNVNGQTNNSTIKDTIPTKVPYVKGQEYVLGGITVTGLKKFSEETVKIFTGLRNGQLIKLPGDKLTSAIKKLYDSKQFSDVDVYLAKLDGNVAYLQFNVKELPQLNLVTFSGVKKAKRKELKKDTDLKKGAMVTDNLIVTSTNYFKKKFTDKGFLKTKVSINTSKDTSDINVVNMAVHIDRGTRIKIKDISFKGNKESRSQR

SEQ ID NO: 18961 - DNA, 660 bp, Unknown
  Obtained from environmental sample
  misc_feature (1)..(660): n is a, c, g, or t
atggataaaaaattacacattaatttacaaaaagtaccacaacatgttgctgttattatggacggcaatggtcgctgggctaaaagtaaaggaatggagcgaatttttggacatagaaatgcattaacagctgtaagagaatctatagaagctgctgcagaaattggcataaaagcaattacattgtacgccttctctaccgaaaactggaatcgcccaaaaatggaggtaaatgctttaatgaagctcttaattacatcactaaaaaaagaactaccaacttttcaagaaaacagtgttaaagtaaatgcaattggagatattactagtttgccccaaaaagcgcaaaaagtattatctgaagtaataaatgacactaaaaacaattctaaaataacattaactatggcattaagttatggttctagagaggaaattgttaatactatcaaaaacatatctaaaaaagttgttaataacgaacttcnaatagaagaaattgacgaaaaagttattaataatcatttatatacatttaatttgcccgatggtgatttaatggatcgcacaagtggcgaacagcgcatcagtaatttntttgctttggcagatggcatatggcgaaatatactttacgaaagtactttgggcagaatttaa

SEQ ID NO: 18962 - protein, 219 aa, Unknown
  Obtained from environmental sample
  DOMAIN (19)...(214): Putative undecaprenyl diphosphate synthase
  misc_feature (1)..(219): Xaa is any amino acid
MDKKLHINLQKVPQHVAVIMDGNGRWAKSKGMERIFGHRNALTAVRESIEAAAEIGIKAITLYAFSTENWNRPKMEVNALMKLLITSLKKELPTFQENSVKVNAIGDITSLPQKAQKVLSEVINDTKNNSKITLTMALSYGSREEIVNTIKNISKKVVNNELXIEEIDEKVINNHLYTFNLPDGDLMDRTSGEQRISNXFALADGIWRNILYESTLGRI

SEQ ID NO: 18963 - DNA, 666 bp, Unknown
  Obtained from environmental sample
  misc_feature (1)..(666): n is a, c, g, or t
ttgattaatttaaacaacccaattagctatataaatggtatgacagccaatagagcgtcattgctttatcaagagttgcacgttaaaacgagtagcgatttattacacctttttccttttagatatatcgataaaacacagttttataaaatcaatcaattacaagatagtggcgccgatgtgcaaattatcggaaaaataactagaattaaaaccgtacaacaaaaacgtggtagtagattggttgcaacatttatggatgaaactggagctatggaattggtctggtttaaaggtgtaaaatggattaaagagtctttaaaagtaaatacaccttatgttatttatggaaagataaacagttttaacaattcgttttcgatgccgcatccagaaatggaattgctttctgagcataaaaagaaagtgcaaagcgccatgcaacctgtatacccatccaccgaaactttaggaaataacaatattagcaataaagtagttagaacgcttatccaaaatttgtttattcagctagatggaaaaataaacgaaactttatcagaagcttttatcaaacaatacgggttgatgtctaaaaaagaagcattgttaaatattcattctcctaaaagtcaagaaaactggccaaaggaccatatcgattaa

SEQ ID NO: 18964 - protein, 221 aa, Unknown
  Obtained from environmental sample
  DOMAIN (61)...(136): OB-fold nucleic acid binding domain
  misc_feature (1)..(221): Xaa is any amino acid
MINLNNPISYINGMTANRASLLYQELHVKTSSDLLHLFPFRYIDKTQFYKINQLQDSGADVQIIGKITRIKTVQQKRGSRLVATFMDETGAMELVWFKGVKWIKESLKVNTPYVIYGKINSFNNSFSMPHPEMELLSEHKKKVQSAMQPVYPSTETLGNNNISNKVVRTLIQNLFIQLDGKINETLSEAFIKQYGLMSKKEALLNIHSPKSQENWPKDHID

SEQ ID NO: 18965 - DNA, 300 bp, Unknown
  Obtained from environmental sample
  misc_feature (1)..(300): n is a, c, g, or t
atggaatggttcaagaaatcgtacgggacagatgtctatgaaagtattcagtatcaatcgttgttgcccgaaaatgtctacgagaagataaactcttatatcaagcaatatgagtttgaactattggtgatgcttgaaaaagaacgggatggaattattgatacattgttccactctgacctggttaagaaaatggaattccatctgtctattcctttgttgagttttagcgagcaatatttgcgcgtgcaggacaaagaaggaatgaatgttgaggcaaaaaataaatcaaaaaagtaa

SEQ ID NO: 18966 - protein, 99 aa, Unknown
  Obtained from environmental sample
  misc_feature (1)..(99): Xaa is any amino acid
MEWFKKSYGTDVYESIQYQSLLPENVYEKINSYIKQYEFELLVMLEKERDGIIDTLFHSDLVKKMEFHLSIPLLSFSEQYLRVQDKEGMNVEAKNKSKK

SEQ ID NO: 18967 - DNA, 816 bp, Unknown
  Obtained from environmental sample
  misc_feature (1)..(816): n is a, c, g, or t
ttgtttcgggttgctggcggattgtttgatgctttaattaatgatggattaaaagaatctgttacagtaaaacaattagctgcaagacttgatcaatcaataagaatgatcactgttccaaacagtaaagatgaaaggcattataaagaactaaccaataattttctttattatgtcgctctttcagataataaagacagaagaatcaacgaaatccaagagttttttaatttatcaagctttatttcagatgataaagaaattgagcacgcacaaagcagtttgtctggtaagaatagagagttattggagtcagtaactagtgtaattaaagaagatttacttactattcaagaaagtttagatttgtataatagaaatactcatgcctcatcatcagatttagaatcaattatagattcgatgcgtaaaatatctgatacattgggaattattggtgtaggaattgcccgtgaaaaaataagggatgatattttaataatagaaaaaggcttagaaagtgatgaaaaattagaaaatgatgcaattatgcacattgcagaaacattgctttttgttgaatcgtcattagatgaaaacattctacaattgggtgaagtcaaagagaaaaaatctaatgtagaccaaggttcagtttcatcatctgaaatgaaaaaaatcatggatactttggcaaaagagtccatattgaatttccaaaaaattaaacataattctgtccaatatatcgaagagcctgcgaaattgaaaccattcaatcctcacaaaattattaaagatatagccgggctttaa

SEQ ID NO: 18968 - protein, 271 aa, Unknown
  Obtained from environmental sample
  misc_feature (1)..(271): Xaa is any amino acid
MFRVAGGLFDALINDGLKESVTVKQLAARLDQSIRMITVPNSKDERHYKELTNNFLYYVALSDNKDRRINEIQEFFNLSSFISDDKEIEHAQSSLSGKNRELLESVTSVIKEDLLTIQESLDLYNRNTHASSSDLESIIDSMRKISDTLGIIGVGIAREKIRDDILIIEKGLESDEKLENDAIMHIAETLLFVESSLDENILQLGEVKEKKSNVDQGSVSSSEMKKIMDTLAKESILNFQKIKHNSVQYIEEPAKLKPFNPHKIIKDIAGL

SEQ ID NO: 18969 - DNA, 522 bp, Unknown
  Obtained from environmental sample
  misc_feature (1)..(522): n is a, c, g, or t
atgtattctttattaaaaattaatttcgttttgaaactaaaactaatctttgcattttttcttttattatttgtgaatcggatttgcgcgcaaacaaattcgattcgaattaatgcagttttagatgcaaaaaatgatgtattaaaaattcagcaagaacttgtttaccacaacaattctaaccaatctttaagcgaaatatatcttcttaattgggcaaatagttttaaagataaaaacacgccgctaacaaaaagattgattgaagattatgataaatcactctattttgcaaaagagaatgagcgtggttttagcaagattttaaacctatcagtaaactataaaccgacaccatttacttcggataaaaatactgaagacattttaaagatcgatttagccgaagcgttaaatcctgcagattctattgtcatcagtgcttcgtttactgttaaaattccagatgctaaatttacaggttacgggaaaacaaaaacaggtatctcgaccgattcttga

SEQ ID NO: 18970 - protein, 173 aa, Unknown
  Obtained from environmental sample
  misc_feature (1)..(173): Xaa is any amino acid
MYSLLKINFVLKLKLIFAFFLLLFVNRICAQTNSIRINAVLDAKNDVLKIQQELVYHNNSNQSLSEIYLLNWANSFKDKNTPLTKRLIEDYDKSLYFAKENERGFSKILNLSVNYKPTPFTSDKNTEDILKIDLAEALNPADSIVISASFTVKIPDAKFTGYGKTKTGISTDS

SEQ ID NO: 18971 - DNA, 552 bp, Unknown
  Obtained from environmental sample
  misc_feature (1)..(552): n is a, c, g, or t
atgaaaaagcttattgcccttttctttttatgcattcttatttcgtgcaacaacacaaaaaaagacgattatgttaaaaaaattgaagattatcaatacgaagagaatttaaaattccatgacgacagtgaatctccgttgacaaaagaagatatgaaaacctttaagtcattagagttttatcctattgataaaaaatatagggttgttgcaaagctagaaaaaacagttgatgctccgatttttgaaatgaagactacaaaagaaagaagacctttatatataaaatacggaactgttacctttactttagacggcaaagaacaaaagattccgatttatcaaagcaaagatatagaaagagatccgcagtatattaattatttatttttcccttttacagataaaacgagcggaaaaagctcttatggcggaggtcgttatattgatgtatatacgacagatgaaaagccagacggaactattcttatcgattttaataaagcatacaatccgtattgtgcgtatagcgatcgttatcttgtccgttaa

SEQ ID NO: 18972 - protein, 183 aa, Unknown
  Obtained from environmental sample
  SIGNAL (1)...(17)
  misc_feature (1)..(183): Xaa is any amino acid
MKKLIALFFLCILISCNNTKKDDYVKKIEDYQYEENLKFHDDSESPLTKEDMKTFKSLEFYPIDKKYRVVAKLEKTVDAPIFEMKTTKERRPLYIKYGTVTFTLDGKEQKIPIYQSKDIERDPQYINYLFFPFTDKTSGKSSYGGGRYIDVYTTDEKPDGTILIDFNKAYNPYCAYSDRYLVR

SEQ ID NO: 18973 - DNA, 375 bp, Unknown
  Obtained from environmental sample
  misc_feature (1)..(375): n is a, c, g, or t
atgaaatatgcgatgggcaaccgattgacgggggctgcgtttggaaaacaaatgaatgatatacctgttgtgccttttggcattaatgggaaagtgtataacgagatgacgcctgtaattagtggatattatttgnttgattacgataataatatcaaaagtgcatattgtcgatttccacgaggagcgaagtctgtaaaagtcagctatgcaaaagctatggggtattgtgttctttctgcaatgggcttatcaaacttagaaactattgatgatcgaaactttgaatatcttgacattttatataacgaaaaccttaaatctggaatgacagagaacgaagtaaaacaagcaataaagggagagattaaatag

SEQ ID NO: 18974 - protein, 124 aa, Unknown
  Obtained from environmental sample
  misc_feature (1)..(124): Xaa is any amino acid
MKYAMGNRLTGAAFGKQMNDIPVVPFGINGKVYNEMTPVISGYYLXDYDNNIKSAYCRFPRGAKSVKVSYAKAMGYCVLSAMGLSNLETIDDRNFEYLDILYNENLKSGMTENEVKQAIKGEIK

SEQ ID NO: 18975 - DNA, 453 bp, Unknown
  Obtained from environmental sample
  misc_feature (1)..(453): n is a, c, g, or t
atgcattggcagtatgaaatgtataattatggtttcgaaagattttacaaaatgttggaaaaatatcccaaggtaaatttcataggccatgcgcaaacttggtgggctaatattgacaaatatcatacagatcaatcgatcctttatcctaaaaaaacggttacccctggggggattacagaccggtatcttagcgattactcgaacatgtatggcgatctatctgcgggctcaggtcttaatgcacttacaagagatgaagaccatgcgatagcttttttggaaagacaccaagacaaattattgtatggaagcgattgtgcagacccaacaggttctgatatagaaagttgttccggcaccctagatattgcagaaatccgtaaactagtatctaagcagaccgaacgtaaaatattatatgaaaatgctaagaaattattccgcctttaa

SEQ ID NO: 18976 - protein, 150 aa, Unknown
  Obtained from environmental sample
  misc_feature (1)..(150): Xaa is any amino acid
MHWQYEMYNYGFERFYKMLEKYPKVNFIGHAQTWWANIDKYHTDQSILYPKKTVTPGGITDRYLSDYSNMYGDLSAGSGLNALTRDEDHAIAFLERHQDKLLYGSDCADPTGSDIESCSGTLDIAEIRKLVSKQTERKILYENAKKLFRL

SEQ ID NO: 18977 - DNA, 477 bp, Unknown
  Obtained from environmental sample
  misc_feature (1)..(477): n is a, c, g, or t
gtgaaaaaacttttccttttaattttaatgctgccgttttcgcttcttgcgcaaaatacaacaaccctaaaaggtgttgtttccaacaagcagaatttacccattaaagatgttgctgtttcgtatttaaataccggaaccacaaccgacgcaaaagggtattacgaaatcacaattcctgttagaaaaacgatagaagttgtttttagccatgtttcttatttaaaacacactaaaaaaattactttacgaagcaaaagaatccttacctactcgcctattttaacttctttaaacaacgaattgaatgaagtcgttgtaaaaaacaataaaaactcagcanaaggaatcaaaacaattgacgttgctaaagtaaaacgattgcctggtgtaaatgctggcgtagaacatttattgatgacccttcctggcgtaaataacaacaacgaattaagcacacaatacaatgttagagng

SEQ ID NO: 18978 - protein, 159 aa, Unknown
  Obtained from environmental sample
  SIGNAL (1)...(17)
  misc_feature (1)..(159): Xaa is any amino acid
MKKLFLLILMLPFSLLAQNTTTLKGVVSNKQNLPIKDVAVSYLNTGTTTDAKGYYEITIPVRKTIEVVFSHVSYLKHTKKITLRSKRILTYSPILTSLNNELNEVVVKNNKNSAXGIKTIDVAKVKRLPGVNAGVEHLLMTLPGVNNNNELSTQYNVRX

SEQ ID NO: 18979 - DNA, 330 bp, Unknown
  Obtained from environmental sample
  misc_feature (1)..(330): n is a, c, g, or t
ttgaataaattggtgaattttctaagcgatgaaaacaaggatcaaactgaagaaattaatcggatactcttcattaatcacccgatgaatgctgaattcaaagagcacctaaaaattccttacaatttctacatcgaggggtttgatgatttatcggagctactgaaggccaggggatttaagcaattagaagattcaaccaaaaaaaagatatatcaattttctcgaaaatcatcaactaaaattcatacactttcaatatataatccttgtttgaaaagacgggaaattaaagttcattcgaattcggattggaaagaagatatataa

SEQ ID NO: 18980 - protein, 109 aa, Unknown
  Obtained from environmental sample
  misc_feature (1)..(109): Xaa is any amino acid
MNKLVNFLSDENKDQTEEINRILFINHPMNAEFKEHLKIPYNFYIEGFDDLSELLKARGFKQLEDSTKKKIYQFSRKSSTKIHTLSIYNPCLKRREIKVHSNSDWKEDI

SEQ ID NO: 18981 - DNA, 513 bp, Unknown
  Obtained from environmental sample
  misc_feature (1)..(513): n is a, c, g, or t
atgattcataaaacatcagatgttcaatctatcaacataggtaaaaatacaaatatttggcaattctgtgttgtcttaaaagaggcaaaaataggagataattgtaatataaatgctcaagtttttatagaaaatgatgttacaataggagataatgtaacaataaaaagtggtgttcaaatttgggatggagtaaagttagaggataatgtttttattggtcctaatgtaacttttacaaatgactttttaccaagaagtaaactgtatccaaaagagttcttaaaaacgatagtaaaaaagggagcttccgttggggctaatactactttagttggaagtgtaattgttggtgaatattctatgataggtgcaggaagtgtcgtaactaaaagtgttggaattcaagaattatggtatggtaatccagctaagcataaaggttatgtatgcaaatgtggtcaaaaatgtagtaaaacattaatatgtgatagatgcaatgaagatttttaa

SEQ ID NO: 18982 - protein, 170 aa, Unknown
  Obtained from environmental sample
  DOMAIN (46)...(63): Bacterial transferase hexapeptide (three repeats)
  misc_feature (1)..(170): Xaa is any amino acid
MIHKTSDVQSINIGKNTNIWQFCVVLKEAKIGDNCNINAQVFIENDVTIGDNVTIKSGVQIWDGVKLEDNVFIGPNVTFTNDFLPRSKLYPKEFLKTIVKKGASVGANTTLVGSVIVGEYSMIGAGSVVTKSVGIQELWYGNPAKHKGYVCKCGQKCSKTLICDRCNEDF

SEQ ID NO: 18983 - DNA, 756 bp, Unknown
  Obtained from environmental sample
  misc_feature (1)..(756): n is a, c, g, or t
gtggatcaagatcggctcgagagtatatgggccgaacagcctctagcagacggtatagcagatactcttagacttaataatataaattgttttggtcctagtaaatacgcttcacaattagagtcgtctaagtcgtttgctaaagaatttatggatgagttcaatatccctactgctaagtacaaaacatttgaggcaaaagacttaagtgcttgtggtagatatatcgacaaaagtgaaatgccaattgttattaaagcagatggtttagctggtgggaaaggtgtttatataactgataacaaagaagaagcaaagaatatagtagaagatttttttgaaggtaaatttggcgaagcaagcaaaaaaatagtaattgaacaatatttagatggtgtagaagcttctatttttggtatctgtgatggaagtgattttctattacttccagcttcacaagattacaaaagagccaaagatggtgatcttggtcttaatacaggtggtatgggttcgtttagtccaactccatttgtagacgcggctattattaagaaagtccgagaaaaaattgttacacaagttctcttaggaatgaaatcgcgtaagaatagtttagttggttgtcttttcgtaggtataatgatagttgatagtgagccatacgtaatagaattcaatgtaaggtttggtgacccagaaacacaatcagtactctcacttatagaaggtgatatggcaaacttgttctattnn

SEQ ID NO: 18984 - protein, 252 aa, Unknown
  Obtained from environmental sample
  DOMAIN (43)...(126): Phosphoribosylglycinamide synthetase, B domain
  misc_feature (1)..(252): Xaa is any amino acid
MDQDRLESIWAEQPLADGIADTLRLNNINCFGPSKYASQLESSKSFAKEFMDEFNIPTAKYKTFEAKDLSACGRYIDKSEMPIVIKADGLAGGKGVYITDNKEEAKNIVEDFFEGKFGEASKKIVIEQYLDGVEASIFGICDGSDFLLLPASQDYKRAKDGDLGLNTGGMGSFSPTPFVDAAIIKKVREKIVTQVLLGMKSRKNSLVGCLFVGIMIVDSEPYVIEFNVRFGDPETQSVLSLIEGDMANLFYX

SEQ ID NO: 18985 - DNA, 585 bp, Unknown
  Obtained from environmental sample
  misc_feature (1)..(585): n is a, c, g, or t
ttggaaatggggtgtggaattggtacagtcagtcagttaattgcaaaaaacacccctaagggggaagtgcttgctgtggatatcagtccagaaagtgttgagcaggcaaaatccatctggaaaggtttagacaaccttcgttttgaagtgtctgatatgaaaaattttcacaaaccagacctactttttgacgtcattgtgtttccggatgtattggaacatatccctgttgaagatcacttcgctttgtttgaaaccataaaaaatcacagccattcagatacttttattttcatccatattccatctccaaggtttctggaatggatgattgccaatgaacctcaaaagcttcaggtgatcgaccaacctttagacagcggagaattggttagtaagctttcttctaatgatttctaccttgaaaaaatggatacctatcctcttttctataaagaaaaagattaccagtactttgtatttaaaaagaaacaccccattaaaaaaaccaatcacagggataaatataccattttgaaagaaagactatggatcaagatcaaacagaagctttctgctttttaa

SEQ ID NO: 18986 - protein, 194 aa, Unknown
  Obtained from environmental sample
  misc_feature (1)..(194): Xaa is any amino acid
MEMGCGIGTVSQLIAKNTPKGEVLAVDISPESVEQAKSIWKGLDNLRFEVSDMKNFHKPDLLFDVIVFPDVLEHIPVEDHFALFETIKNHSHSDTFIFIHIPSPRFLEWMIANEPQKLQVIDQPLDSGELVSKLSSNDFYLEKMDTYPLFYKEKDYQYFVFKKKHPIKKTNHRDKYTILKERLWIKIKQKLSAF

SEQ ID NO: 18987 - DNA, 618 bp, Unknown
  Obtained from environmental sample
  misc_feature (1)..(618): n is a, c, g, or t
gtgttggtttttgtagcaagtaaaaaaaatgctgatcttttattcgaagctttggagatggattttagtagtgaaatttgcgtcatccattccaacaaatcacagaattacagattccgttctattcaacaatttgatgatggagtaaaccgaatattactgacaaccgatgtaatggctcgcggattagacttggataaaatttcgcatgtcatcaattttgatacgccaaactatcccgagaattatatgcatcgtattggcagaagcggtagagcagaagaagaaggaaaaacaatattattttatacagagaaggaagaaaaagcaaaagaagccatcgaatccttgatggattataaaatcccattaattgactttccggaagaagtagaaatttcaaaacagttaacagctgatgaacgacctaaaattattgaaataagtcaaaaacacaaacacaaaaaactacctgaaggtggtggtgcttttcacgagaagaaagaaaaaaacctgaaagtaaatcaaggtggatcttatctccgtaagggtaaaaaatataaaaaacccaaaacccgtggagacaaaaacatgaatactaagggtaaaagaaaatag

SEQ ID NO: 18988 - protein, 205 aa, Unknown
  Obtained from environmental sample
  DOMAIN (18)...(94): Helicase conserved C-terminal domain
  misc_feature (1)..(205): Xaa is any amino acid
MLVFVASKKNADLLFEALEMDFSSEICVIHSNKSQNYRFRSIQQFDDGVNRILLTTDVMARGLDLDKISHVINFDTPNYPENYMHRIGRSGRAEEEGKTILFYTEKEEKAKEAIESLMDYKIPLIDFPEEVEISKQLTADERPKIIEISQKHKHKKLPEGGGAFHEKKEKNLKVNQGGSYLRKGKKYKKPKTRGDKNMNTKGKRK

SEQ ID NO: 18989 - DNA, 384 bp, Unknown
  Obtained from environmental sample
  misc_feature (1)..(384): n is a, c, g, or t
atgaaaaacaaacatatgattgcttggtttgaaattccagtaacggatattaaaagagcaaaaaaattctacgaaacgattttagatgtagaactttcaagtatggatatgggggatgaatttaaaatggaagtattcccgggaggccaagattcagtaagtggagctctcgtttataatgcttcttggtataaaccgagtattacggatggaccattaatttatttgaatgggaatcctgaccttcaaactattgaagataggatagaaactgcaggaggaaaagtgaccattcctaaaagacagatatcacctgattatggaaatatggcagtttttgaagatacggaagggaacaggatagctttacattcggataaataa

SEQ ID NO: 18990 - protein, 127 aa, Unknown
  Obtained from environmental sample
  DOMAIN (6)...(123): Glyoxalase/Bleomycin resistance protein/Dioxygenase superfamily
  misc_feature (1)..(127): Xaa is any amino acid
MKNKHMIAWFEIPVTDIKRAKKFYETILDVELSSMDMGDEFKMEVFPGGQDSVSGALVYNASWYKPSITDGPLIYLNGNPDLQTIEDRIETAGGKVTIPKRQISPDYGNMAVFEDTEGNRIALHSDK

SEQ ID NO: 18991 - DNA, 669 bp, Unknown
  Obtained from environmental sample
  misc_feature (1)..(669): n is a, c, g, or t
ttgctaaaagagctatttacaaaaatacaaacccaaaacaattcttactcagagcttgaattaaatgaaataaagaaatttataaaaaaaggtattgttattaaattagataatgatacttatgaacttaattcaaaatataaagtggcaattgtcaatgtaggtaaaaatttagtaatattagaagatttacttagtgaacacaaaaatattaaaattgaatttgataacttaaacggtgcgtacaatggagacttagtattagcaaaaagaatttttaatccaagatcaagaattaaagctaatattattgaagtattagatggcaaaaaaaatgatattttagtttatataaaagataagtcttttcatacagtaaaagacaatataaagttagaaaataaaggtgcatcacaatatgaagagggcgatgttcttttagttgataatcagtctttagatttggtaaaaaatttagggaatattgaaaaccctaaagttgatgaattaatatctctatacttatacaatgaagaaataagattaaataaacccttcgaagtagatgcaaagatgagtgatcctaaggaaagagtagatttaactcatcttccttttggtacattgatccaaatctgtaaagatcctgatgatgtatttatatggtga

SEQ ID NO: 18992 - protein, 222 aa, Unknown
  Obtained from environmental sample
  misc_feature (1)..(222): Xaa is any amino acid
MLKELFTKIQTQNNSYSELELNEIKKFIKKGIVIKLDNDTYELNSKYKVAIVNVGKNLVILEDLLSEHKNIKIEFDNLNGAYNGDLVLAKRIFNPRSRIKANIIEVLDGKKNDILVYIKDKSFHTVKDNIKLENKGASQYEEGDVLLVDNQSLDLVKNLGNIENPKVDELISLYLYNEEIRLNKPFEVDAKMSDPKERVDLTHLPFGTLIQICKDPDDVFIW

SEQ ID NO: 18993 - DNA, 939 bp, Unknown
  Obtained from environmental sample
  misc_feature (1)..(939): n is a, c, g, or t
ttgctcatcgacattaaagcaacaaccaacaaagggtcacaacttacgattccaatttacgatgattcagacaataccttggtcgaatatatacagtttaaaaaaatagttcaagattccgttaagaatgaaattgttgaagttgatgaagaacaaaagctgaaaatgaaatttgagtttaacttgaccgaggatgcagaatttattcttctctttgatgaggttttggatgataagatttctggtaaggggtttgggaatgtgaaaattgaatttgccaccggggaagatttgtttatgtacggtcgctttgaaattactgatggaatctatccattttcatctccgtctatggttagcgagaaatttgatattcgaaaaggagggcaggtaatatggaatggggatccttataacgctctaattgatttacaagcttctgtatctagaaatcgtgccaatcccgcagatttgatggtaggtatggatgccaatgaggataaatttaatacccaaattaagatgaatgtattgatgagtctgaaaggagaactctttaatcctgatattagttttgggtgggagttcccagatttgtctaatagtttcacagagtttaattccttaataaagaaaatcgaatcggatccagatgagttaaacaggcaggttttttccttgattacctttggttcctttacgccaacttcaaactttggtgctggattaaagccaaataataactacatcgatattgttagttccagtgtggggacgtttttatctaatcaggtgaacaattggatatctgaatatgacaaaagtttagaactgggtgttgactacaaaacaaaaaaagggataactgacccagagaaagcagaagttattatttcggcnagaaaggagattatggacgaaaggttgaattggctgtag

SEQ ID NO: 18994 - protein, 312 aa, Unknown
  Obtained from environmental sample
  misc_feature (1)..(312): Xaa is any amino acid
MLIDIKATTNKGSQLTIPIYDDSDNTLVEYIQFKKIVQDSVKNEIVEVDEEQKLKMKFEFNLTEDAEFILLFDEVLDDKISGKGFGNVKIEFATGEDLFMYGRFEITDGIYPFSSPSMVSEKFDIRKGGQVIWNGDPYNALIDLQASVSRNRANPADLMVGMDANEDKFNTQIKMNVLMSLKGELFNPDISFGWEFPDLSNSFTEFNSLIKKIESDPDELNRQVFSLITFGSFTPTSNFGAGLKPNNNYIDIVSSSVGTFLSNQVNNWISEYDKSLELGVDYKTKKGITDPEKAEVIISARKEIMDERLNWL

SEQ ID NO: 18995 - DNA, 393 bp, Unknown
  Obtained from environmental sample
  misc_feature (1)..(393): n is a, c, g, or t
atgtttgcacaatctattagttatatttctagagcaagttttaaacacgtaaataacaatcataaaaatcttaaaaaagcacagttaaaggatttaaaagaaattgacaatcaattaacagacttgctagataaagtaagtgatgtttttgaaaacagaacttttgatcgtttagatggcattttaattgaaaaacaagaattattaaacgatgtttctgaatctattgaaaaacaagttgctagaattagaacggatgaaacaagtccaaaaaacacgacattgtattttagtattttattagaaacgaaagatttggttggtgcattattaaatttattacaaacctatcaagagtttcatttatctacaaaagagatagaagaactttaa

SEQ ID NO: 18996 - protein, 130 aa, Unknown
  Obtained from environmental sample
  misc_feature (1)..(130): Xaa is any amino acid
MFAQSISYISRASFKHVNNNHKNLKKAQLKDLKEIDNQLTDLLDKVSDVFENRTFDRLDGILIEKQELLNDVSESIEKQVARIRTDETSPKNTTLYFSILLETKDLVGALLNLLQTYQEFHLSTKEIEEL

SEQ ID NO: 18997 - DNA, 729 bp, Unknown
  Obtained from environmental sample
  misc_feature (1)..(729): n is a, c, g, or t
ttgatggaacaatgggcaacttctggttcttattctccaaacggaaaacaactagttattgataaaatgagacgttgggatgttgaatggagagattatcgtggtgggcaaaatacaccacttatcattgttgatttaaaaaccttgaacgaaaccttattaccaaataacaaaactacagacagacatcctgtttggttaaatgatatggtatatttcctttcggatagaacgcatacttcgaatgtttggtcttacaacaccaaaacaaaagcagtaaaacaaattacaaaatttaaaggaactgcggtaaaatcgttaagcggatataaaaacacattgatttttgagcaagacggttatttacatacgttagacttaaaaaacaatcgttcaaaacgattaaaaatttctgtaaaaggagattttccttggacagcaacgaaatgggaaaacgtaaatgatcgtgtagatttcgcgagcatttctccaaacggaaaaagagttgtgatggcttctcgtggagatatttttacaacgcctgttgaatttggtgattctagaaacattacacaaacttctggagttgcagatagagcgccaatttggtctccaaaaggagatgaaatagcgtggttttctgatgcaaacggaaaaaattacgccttacatatcaccaatcaagacggaacagcaaaaacagaaatcatttctattgggcatttctaa

SEQ ID NO: 18998 - protein, 242 aa, Unknown
  Obtained from environmental sample
  misc_feature (1)..(242): Xaa is any amino acid
MMEQWATSGSYSPNGKQLVIDKMRRWDVEWRDYRGGQNTPLIIVDLKTLNETLLPNNKTTDRHPVWLNDMVYFLSDRTHTSNVWSYNTKTKAVKQITKFKGTAVKSLSGYKNTLIFEQDGYLHTLDLKNNRSKRLKISVKGDFPWTATKWENVNDRVDFASISPNGKRVVMASRGDIFTTPVEFGDSRNITQTSGVADRAPIWSPKGDEIAWFSDANGKNYALHITNQDGTAKTEIISIGHF

SEQ ID NO: 18999 - DNA, 549 bp, Unknown
  Obtained from environmental sample
  misc_feature (1)..(549): n is a, c, g, or t
ttgggncttgaacaagtttgccggcaaattcaactatggattaatagtggcatgaagaaattttttatancggttaatgtgtcagtgaaacaaattcaagaagatatcttttttgaaaaaattaaagctttggttcataaatacaaaattcctgctaattatttggaaatagaagtcaccgaatctgtgttgatggaagaaacagagaggaccattaatgtgtttaagaaattaaaattattaggcattaaaatatcattagatgattttggaacgggctatgcctcattcaattatttaatgaattttcccttagataaaataaaaatagatcaatcatttgttaaaaaactaccagatgatcccaatagtatcactatcgtttcaacaattctacgcatgtcccaagaattaggcatggatgttgtagcagaaggaattgaaaataaaaaacaatacaattttttaaaggcaaaatcatgtcaatattatcaaggctattattttcataaacctctcagcattgaaaatatgcaaaaactcatctag

SEQ ID NO: 19000 - protein, 182 aa, Unknown
  Obtained from environmental sample
  DOMAIN (1)...(172): EAL domain
  misc_feature (1)..(182): Xaa is any amino acid
MGLEQVCRQIQLWINSGMKKFFIXVNVSVKQIQEDIFFEKIKALVHKYKIPANYLEIEVTESVLMEETERTINVFKKLKLLGIKISLDDFGTGYASFNYLMNFPLDKIKIDQSFVKKLPDDPNSITIVSTILRMSQELGMDVVAEGIENKKQYNFLKAKSCQYYQGYYFHKPLSIENMQKLI

SEQ ID NO: 19001 - DNA, 729 bp, Unknown
  Obtained from environmental sample
  misc_feature (1)..(729): n is a, c, g, or t
ttgatattgggtcttttactttttgctttgattgccattgtgtttttatttttattaaagaaacaagtaaataaaagagtcgtggaattaaccaaaagtgaattacagttaaaacaaatcattaatcttgtgcctcatatgatttatgtgacaaatagtaatggagatgtattgttagcaaatgaaacagccagcaggtattttggtatgtcattatcagaatttgaaaacagtaatattcgtgatttaagcaaagaatataaacgatttaaaaaattaataaatgaggatggctatcataaaaatgatgatttacatcataatgtagagattagtgccagggattcccaaggttcaagacatactttgtttttatcaaaaaaatcttatgtcggcagtaataaatttgaagaatcaacagtaacagtcgcagttgacattacagatattaaagactttgaagagaaaattaaatttatggatcaacacgattcattaacgaaattacctaatagaattttacttaaagatcgcattaatcattcgctaacattagcaaaaatacaccatcataatggagccatattatttatcgggttagatcattttaagaatattaatgattcacaagggcataaaattggagatctattgataaaagaggtggctaaaagatcagaaaaactagccagaattggcgacacgatagccaggcttggtgggagatga

SEQ ID NO: 19002 - protein, 242 aa, Unknown
  Obtained from environmental sample
  DOMAIN (35)...(95): PAS domain
  misc_feature (1)..(242): Xaa is any amino acid
MILGLLLFALIAIVFLFLLKKQVNKRVVELTKSELQLKQIINLVPHMIYVTNSNGDVLLANETASRYFGMSLSEFENSNIRDLSKEYKRFKKLINEDGYHKNDDLHHNVEISARDSQGSRHTLFLSKKSYVGSNKFEESTVTVAVDITDIKDFEEKIKFMDQHDSLTKLPNRILLKDRINHSLTLAKIHHHNGAILFIGLDHFKNINDSQGHKIGDLLIKEVAKRSEKLARIGDTIARLGGR

SEQ ID NO: 19003 - DNA, 618 bp, Unknown
  Obtained from environmental sample
  misc_feature (1)..(618): n is a, c, g, or t
ttgttaaaaaagatggatcaggaaggttatccagatattatttttggaaaatgctctgaccaatttaaaaagcaaatagagcgcaaaaacccgcaaacctatatcatgaatacattaaatgaaacaatgtcacggctttgtatggggagcgtggatatcgtcgcacatcatttaacggccgataaattcgaagaagaaggcgtcatctttgacgaaaaatttggttatttagataaaccgatattggccgtgatcatgacccgcacattcgaagatgatatggataaatgcgtggataatatcgcgcgcgctttaaagaaagagccaaatagcactgttttcgtcagcacaatctggcgcacagaacagggtcattacaaaaagtttatggataaattaaaagatatattaccagaacaagcaaccgtgatgggatatgatgttaataatgccgatgaatggcaggggtataatccatatgtgggattattggatcaggcggatcattttttggtctggggtgattccagatcgattgcatctgagattttatcaacgggtaaaacaccatatgttttcgaaggacggggcgtgtatgacgcgattttggaannnngn

SEQ ID NO: 19004 - protein, 206 aa, Unknown
  Obtained from environmental sample
  misc_feature (1)..(206): Xaa is any amino acid
MLKKMDQEGYPDIIFGKCSDQFKKQIERKNPQTYIMNTLNETMSRLCMGSVDIVAHHLTADKFEEEGVIFDEKFGYLDKPILAVIMTRTFEDDMDKCVDNIARALKKEPNSTVFVSTIWRTEQGHYKKFMDKLKDILPEQATVMGYDVNNADEWQGYNPYVGLLDQADHFLVWGDSRSIASEILSTGKTPYVFEGRGVYDAILEXX

SEQ ID NO: 19005 - DNA, 630 bp, Unknown
  Obtained from environmental sample
  misc_feature (1)..(630): n is a, c, g, or t
atgaccatcggcagtctttggctgccctctgacttaagagtagatttaaaacaaaaaatttccaaactccgtaaggctcataacaagcatggagaaattaaatggagcaaaatatctccatcctccatcgaattttataaagagttaattgacctctttatgtcctacggaaaagaagttcgttttcgatgtatagcggttgaagccgacaaaatagattgggatattcacggagaagaccgagaattagggttttataaattttattatcaaatgctgcaccactggatattagacttcaataaatactccatcttttgtgaccacaaaacaaatagagttaaaaatgaactacatgttctaaaaaaatgcctttcctcttccaatatttcatctgaaattatgcaagtccaggcactctattccaaacaaaacgtcttaattcagcttacagatttacttttagggcttgcatcaggacgaataaacaatactattcaacaagatggggctaaagacaatctcatccgtcacttagaaaaaaagttagacttagataaattacaacccactccaaaatatgaacaaaaattcaatatttttaagataaatttagatggaggatggtag

SEQ ID NO: 19006 - protein, 209 aa, Unknown
  Obtained from environmental sample
  misc_feature (1)..(209): Xaa is any amino acid
MTIGSLWLPSDLRVDLKQKISKLRKAHNKHGEIKWSKISPSSIEFYKELIDLFMSYGKEVRFRCIAVEADKIDWDIHGEDRELGFYKFYYQMLHHWILDFNKYSIFCDHKTNRVKNELHVLKKCLSSSNISSEIMQVQALYSKQNVLIQLTDLLLGLASGRINNTIQQDGAKDNLIRHLEKKLDLDKLQPTPKYEQKFNIFKINLDGGW

SEQ ID NO: 19007 - DNA, 432 bp, Unknown
  Obtained from environmental sample
  misc_feature (1)..(432): n is a, c, g, or t
ttgtttattgggattttaaatggttcatttatgtttgtttcagattttgcgaaagcttacaaaggtgattgcgaaatttcttttgtaaaattagcttcttatgaaggcacctcatcaacagaaaaagtaaaacaactcgttggacttaacgaaaatattgaaggtagaactgttgttattttagaagatattattgatacaggaaatacattaaaagagatttacgagatttttaaagacaaaaaagtaaagcaattaaaaattgctacccttttctttaaaccagatgtatttaaaaaagatttaccaatagattatatcggaaaaagcattccagataaatttattgtcggctacggcttagattacaatggattgggaaggaactatcctgccatttatcaactaacaacaacaacacaacaagaataa

SEQ ID NO: 19008 - protein, 143 aa, Unknown
  Obtained from environmental sample
  DOMAIN (1)...(112): Phosphoribosyl transferase domain
  misc_feature (1)..(143): Xaa is any amino acid
MFIGILNGSFMFVSDFAKAYKGDCEISFVKLASYEGTSSTEKVKQLVGLNENIEGRTVVILEDIIDTGNTLKEIYEIFKDKKVKQLKIATLFFKPDVFKKDLPIDYIGKSIPDKFIVGYGLDYNGLGRNYPAIYQLTTTTQQE

SEQ ID NO: 19009 - DNA, 348 bp, Unknown
  Obtained from environmental sample
  misc_feature (1)..(348): n is a, c, g, or t
atgaaaaacattgtattatttggtcctccaggagcaggaaaaggtacacaagcaacattgctaaaagaaaaataccatctaattcacatttctaccggagatgtttttagatacaatattaaaaatcaaacgaaactaggtttgcttgctaaaaaatacatggatgaaggagatttagttccagatgaagtgactattgaaatgctaaaagcagaagtagataaaaatgcagacgccaacggttttatctttggtggattccaagaacaaatctcagcaaagcttggatgttttttagctgaaacggaaaaaatacggatggtgcttaaagttctgaaattctattga

SEQ ID NO: 19010 - protein, 115 aa, Unknown
  Obtained from environmental sample
  DOMAIN (6)...(115): Adenylate kinase
  misc_feature (1)..(115): Xaa is any amino acid
MKNIVLFGPPGAGKGTQATLLKEKYHLIHISTGDVFRYNIKNQTKLGLLAKKYMDEGDLVPDEVTIEMLKAEVDKNADANGFIFGGFQEQISAKLGCFLAETEKIRMVLKVLKFY

SEQ ID NO: 19011 - DNA, 654 bp, Unknown
  Obtained from environmental sample
  misc_feature (1)..(654): n is a, c, g, or t
gtgtatcaattagcaaggacattttcgttgataagaaaaagagattcgtcaaggttatttaccgatataggtttgcgattagatagtttacatatcaatttaaatagattaaaaattaatgaactttttcgggataaaaaatataaaaaagcaatacttcgtttaaaaaaattagactccataattcctaataatctttataataaaaagatgttaggaagatcttattttaatatcgattcgttagatttagctaaaacttactttaggtccgctagaaatcttgataaaaaagattttaaaattttgacttatttgggtcatatttataaagccgaaaaaaaatatgccaatgcaatttttacttataaaatggcaacaacaattggtaaaaaacctagagatgaagaatattatagtttagcactattgtatttagaaatgaaaaaaccaaagaaggctattgaaatgtttaaaacgtctattaaagaaaataacagacaacataaggttttatatcaattagctttgacttccgattcttattataaagataaaaagatagcgtataaatattacgaagagtacatctcgaggtttgaaaaaacggacaaagatttcacagatctcgtacaaaaaggaatgaaagaataa

SEQ ID NO: 19012 - protein, 217 aa, Unknown
  Obtained from environmental sample
  DOMAIN (135)...(168): TPR Domain
  misc_feature (1)..(217): Xaa is any amino acid
MYQLARTFSLIRKRDSSRLFTDIGLRLDSLHINLNRLKINELFRDKKYKKAILRLKKLDSIIPNNLYNKKMLGRSYFNIDSLDLAKTYFRSARNLDKKDFKILTYLGHIYKAEKKYANAIFTYKMATTIGKKPRDEEYYSLALLYLEMKKPKKAIEMFKTSIKENNRQHKVLYQLALTSDSYYKDKKIAYKYYEEYISRFEKTDKDFTDLVQKGMKE

SEQ ID NO: 19013 - DNA, 300 bp, Unknown
  Obtained from environmental sample
  misc_feature (1)..(300): n is a, c, g, or t
gtgcatcagataatttctttacttttacatttagttgtgcccattcgtgcgcctctaaaattcctttacgcaggtttttctgatgttaaaccggtttcagaagaaatcatccgtgctattaattgtccagaagacatctctaaagagaacaatgcacaggatgaccaaatcgatcgccatatttttgccataaaatacaaagctgttttccatacagagttgagaataatattaatcggaagtgcaccaaagtcaggctctattaagaaccgtttaaccatattctttgataaaatttga

SEQ ID NO: 19014 - protein, 99 aa, Unknown
  Obtained from environmental sample
  misc_feature (1)..(99): Xaa is any amino acid
MHQIISLLLHLVVPIRAPLKFLYAGFSDVKPVSEEIIRAINCPEDISKENNAQDDQIDRHIFAIKYKAVFHTELRIILIGSAPKSGSIKNRLTIFFDKI

SEQ ID NO: 19015 - DNA, 456 bp, Unknown
  Obtained from environmental sample
  misc_feature (1)..(456): n is a, c, g, or t
atgggactcgaagttactgcatttgatattagcactgaaggtagaaaaaaggccttagcattggctataaaagaacaagtagaaatcacttacgaagttggtgattttttcgaattagatttacatgattctcagttcgattcagcggcactaatttatgcccattttccacctcctcttttatccaaatatcataaaaagatttccgatttagtaaagagcaatggctatataatcttggaaggattcagcaaaaacaatatcaaatatagagacgaaaacccaaatattggtgggccaaaagaagtctcgtttctgttttcaaaagaatcgattagaaaggattttcccaatttcgaggttattcaacttgaggaaattgaggtggaattgaaagaaggaaattatcacaatggattaggaagcgttatacgttttgttggaagaaaaaaatga

SEQ ID NO: 19016 - protein, 151 aa, Unknown
  Obtained from environmental sample
  misc_feature (1)..(151): Xaa is any amino acid
MGLEVTAFDISTEGRKKALALAIKEQVEITYEVGDFFELDLHDSQFDSAALIYAHFPPPLLSKYHKKISDLVKSNGYIILEGFSKNNIKYRDENPNIGGPKEVSFLFSKESIRKDFPNFEVIQLEEIEVELKEGNYHNGLGSVIRFVGRKK

SEQ ID NO: 19017 - DNA, 699 bp, Unknown
  Obtained from environmental sample
  misc_feature (1)..(699): n is a, c, g, or t
gtgccaatactaagggagggcagttctacaaagtctgccactgaaatcagtaatatacttgattattatggcgcctttctggatttaaaatcaggcttagagaatacaatcattagcctatacggtcgatccaagtttattaatgagctgataccacttcttgctgatattatcaaaaatccgatctttgacgagaccgcattatcaaagcataagcttaaaatgtttcagaagctttcaatagaccagcaaaaaacaagctattggtcaccaagactacttcgacaaaatatttttggttctgaccaccccaatagccagtttatctcggaagagaagattgataaaataacaagagatgatcttgtaggatttcataaggatcatcttttaaaaagcctgcaaaatattatcatagccggctcctttgattccaatgttgttgttactcaactacaggagcattttaaggtaataaataacgctggtaaacatgaagataaaataccattaagttctgaaaatactaaagtagttaccaagaagttgcccaataccagtcaagcaagtattgcgcttggcattggagttattggcatgaaaaaccctgattatccggaatacgcctttctcacaaaagtatcaggtgggttatttcggttccaggttaatgaaacgttagcggaagaagaggcttga

SEQ ID NO: 19018 - protein, 232 aa, Unknown
  Obtained from environmental sample
  misc_feature (1)..(232): Xaa is any amino acid
MPILREGSSTKSATEISNILDYYGAFLDLKSGLENTIISLYGRSKFINELIPLLADIIKNPIFDETALSKHKLKMFQKLSIDQQKTSYWSPRLLRQNIFGSDHPNSQFISEEKIDKITRDDLVGFHKDHLLKSLQNIIIAGSFDSNVVVTQLQEHFKVINNAGKHEDKIPLSSENTKVVTKKLPNTSQASIALGIGVIGMKNPDYPEYAFLTKVSGGLFRFQVNETLAEEEA

SEQ ID NO: 19019 - DNA, 843 bp, Unknown
  Obtained from environmental sample
  misc_feature (1)..(843): n is a, c, g, or t
ttgganagtgctgctaaaacactttatgaaccgtacaatagaaattgggaagagggtaatgttaatgatatgttggaaaattattataaagaaagctttaaaaatggtcacagaatccttttagtatctcactcacaaggtaacctttttgccaatagagtttatgataatataaatccgacagaatataaaaactacttcgcaaatctgcaagtagcatctcctgcaagtgaagtaaaagctgtcaaaggagattatgtaactttatcaacagatttgacttcgtttgatccaattataaatcctatccctggaagtatgagtgcaaatacttctggagatagtggacatgcttttgtatcagcttatttatcacaaatagatccattaacaaaaataacgaaaaaaatgaaacaactcctcgtcaggctagatgctgaaccttcacaatggaaaacagaccgagaaccaaataaagattataagataactgtaaaacatatatttgattctaatgtagttatgagtgaagaagtctatccattcgcagcatctaaaaagctatatcatgttgatggaaatatatcaggatatgtaaaagctagttgtggtggcagtgaagtctttgatgattggacgaataaaaaagagaatgaattttatttgattaataatccagaaaaagaaaagataatggncgaggtacctctatatgggctatcgcattctacatattatagtaatacaaattcaattataaatgctcaaggtgtaatctactcaggacaaggtgttgcatggattttaaatctagataatataatagtagttttaacacattaa

SEQ ID NO: 19020 - protein, 280 aa, Unknown
  Obtained from environmental sample
  misc_feature (1)..(280): Xaa is any amino acid
MXSAAKTLYEPYNRNWEEGNVNDMLENYYKESFKNGHRILLVSHSQGNLFANRVYDNINPTEYKNYFANLQVASPASEVKAVKGDYVTLSTDLTSFDPIINPIPGSMSANTSGDSGHAFVSAYLSQIDPLTKITKKMKQLLVRLDAEPSQWKTDREPNKDYKITVKHIFDSNVVMSEEVYPFAASKKLYHVDGNISGYVKASCGGSEVFDDWTNKKENEFYLINNPEKEKIMXEVPLYGLSHSTYYSNTNSIINAQGVIYSGQGVAWILNLDNIIVVLTH

SEQ ID NO: 19021 - DNA, 435 bp, Unknown
  Obtained from environmental sample
  misc_feature (1)..(435): n is a, c, g, or t
ttgaagatgttgtctcatcatttacagggtgccttaagtgacttaagggatttaataaaaattactgagtctgatatagcagatattaaagaagctaaaaatgatccacaatttgatagattatcactaaaagaagaaaagcttaaaagttttgaaactaaaaaagctatgattgatcatgaaatttcatctttaatgactcaaaatcctgatttggatttacctgagctaatcagtaaagaacaacacctacaacttgacgatttaaaagtagaacttaataaccttagagatgcaaacaaacactatgcaagacttgttttggtagttagtaatctttacaatacattcttagaaagaattgtacctacagagatgcaaggttataataaagttgcttctaaaaacccatctattttggaagtgagagtgtaa

SEQ ID NO: 19022 - protein, 144 aa, Unknown
  Obtained from environmental sample
  misc_feature (1)..(144): Xaa is any amino acid
MKMLSHHLQGALSDLRDLIKITESDIADIKEAKNDPQFDRLSLKEEKLKSFETKKAMIDHEISSLMTQNPDLDLPELISKEQHLQLDDLKVELNNLRDANKHYARLVLVVSNLYNTFLERIVPTEMQGYNKVASKNPSILEVRV

SEQ ID NO: 19023 - DNA, 888 bp, Unknown
  Obtained from environmental sample
  misc_feature (1)..(888): n is a, c, g, or t
ttgaatgctaaaaataaaaatagaatgaaattatcattccagagaaatcaggaatctattttttatgcacaattttcaattttaattatagttttttttttatttacaagcaatcttcaagcacaaacttcgtccttttacacaaaatctggtaccttaaatattaaaagaagaaatgctgttataattacggagtctactttagctatcggaactttaattgggttagatcaactttggtatgccgattttcctcgctcaaattttcattttaataatgacaatgcagaatggaaacaaatggataaaatggggcattttatgacttcttatgttgttggaaaaacaggtatggatgtgttggattgggctggagtttctaaaaaaaatcaattaatttatggtgccacattcggatttacttttttaaccgccgtagaaattttagatgggttttcaaaaaaatggggtgcttcttggggcgatatcatagcaaatgctagcggaacaggattcttaatcggacaagaattgttatggaaagagcagcggatttcattaaaatattcttttcatcaaactggatttgctaaaatcagaccaaatactttaggtgataactttattcaacaagcgttaaaagattacaacggacaaacctattggttgtctgccaatatttggtcttttgctaaagaaagcaattttccgaaatggttaatgttgcttttggttacggtgccgaaggaatgttgtatggagaatcaaatccaactaatcagttttctcaagatccgtacagacattttatctgagtctggacttggacttgacaacaataaaacgaaatcgaagtttcaagacggggtttccactactcattcttaa

SEQ ID NO: 19024 - protein, 295 aa, Unknown
  Obtained from environmental sample
  misc_feature (1)..(295): Xaa is any amino acid
MNAKNKNRMKLSFQRNQESIFYAQFSILIIVFFLFTSNLQAQTSSFYTKSGTLNIKRRNAVIITESTLAIGTLIGLDQLWYADFPRSNFHFNNDNAEWKQMDKMGHFMTSYVVGKTGMDVLDWAGVSKKNQLIYGATFGFTFLTAVEILDGFSKKWGASWGDIIANASGTGFLIGQELLWKEQRISLKYSFHQTGFAKIRPNTLGDNFIQQALKDYNGQTYWLSANIWSFAKESNFPKWLMLLLVTVPKECCMENQIQLISFLKIRTDILSESGLGLDNNKTKSKFQDGVSTTHS

SEQ ID NO: 19025 - DNA, 762 bp, Unknown
  Obtained from environmental sample
  misc_feature (1)..(762): n is a, c, g, or t
ttgaaggaaatgcttttaggaaaaagcatcatcttctctcaggctttaaagcagacactagttcaaacaaaaggaaattacccagcaccggaaaagataatcgattctgtaaaatatggtcttaaacatgggctagaaaaagggcttaaaaatgaagcaaaactttttggtgagcttggagcaactaaagaatcaagagctttagtaaatctcttttttggaataacaggtgcaaagaaaaacccacatccagagcttgtaaaatctgttcaaaaaattgcagtattaggagctggtctgatgggttctggaattgcggatgtaagcgtgaataaagggaagtatgctgtattgcttaaagatcgtgacttagaatccgctgcaaaaggagaaaaggttatctgggatgatctcaataaaaaatctcaaaagagaatcattaccaaatttgaaagagatgaaatagcgagccgtgtaacgggtgttgattcttataatggatttgagggagtcgatgtagtcattgaagctgtattcgaagacctaaatcttaaacataaaattctaaagcaagtggagagcgtcacttctaagaatactatttttgcttccaacacttcttcacttcctatttctgatattgctacagcatcttcacgaccagagactgtaattggaatgcattatttctctccggtacagaaaatgcactctcttggaaattatcactacagatcttacaccgctcganccaattcttaa

SEQ ID NO: 19026 - protein, 253 aa, Unknown
  Obtained from environmental sample
  DOMAIN (88)...(253): 3-hydroxyacyl-CoA dehydrogenase, NAD binding domain
  misc_feature (1)..(253): Xaa is any amino acid
MKEMLLGKSIIFSQALKQTLVQTKGNYPAPEKIIDSVKYGLKHGLEKGLKNEAKLFGELGATKESRALVNLFFGITGAKKNPHPELVKSVQKIAVLGAGLMGSGIADVSVNKGKYAVLLKDRDLESAAKGEKVIWDDLNKKSQKRIITKFERDEIASRVTGVDSYNGFEGVDVVIEAVFEDLNLKHKILKQVESVTSKNTIFASNTSSLPISDIATASSRPETVIGMHYFSPVQKMHSLGNYHYRSYTARXNS

SEQ ID NO: 19027 - DNA, 345 bp, Unknown
  Obtained from environmental sample
  misc_feature (1)..(345): n is a, c, g, or t
ttgagtacgggggtattgaatcttaacaacttaagggactatgagtccgataagacttccaataaaaacacgctgatagtgaaaatgggcgttaaaaacgggaaaatataccatgttttcctaatcataactagttttataagcatgttcgcctttacctttatacattatgagaattggaaaaatactatctatttagtagcatttgtacctatatttatacatctaaataaaatgtggaaactaaggaatacggtcctgctggatcccgaattgaaaaagcttgcactgagcacttttttattgtcgattctgttttattttagttttaataatttttcgtaa

SEQ ID NO: 19028 - protein, 114 aa, Unknown
  Obtained from environmental sample
  misc_feature (1)..(114): Xaa is any amino acid
MSTGVLNLNNLRDYESDKTSNKNTLIVKMGVKNGKIYHVFLIITSFISMFAFTFIHYENWKNTIYLVAFVPIFIHLNKMWKLRNTVLLDPELKKLALSTFLLSILFYFSFNNFS

SEQ ID NO: 19029 - DNA, 804 bp, Unknown
  Obtained from environmental sample
  misc_feature (1)..(804): n is a, c, g, or t
gtgcttcgcattaaaaatttaaaaacaggaaaaacctacaacgatgtaattaccaatacaaatggtggttcggtttgggcaaacgataataaaaccttgttttacacaaaaaaagatcctgtttctttaagaagttataaggtttttaaacatgttttaggaacgaatgaatctgaagatgttgaagtgtatcacgaaagcgatgaaacatttggaattggagttgcaaaaacaaaatcaaatgattttattgtaattgcctcttattcaacattatcaacagaatatagagttttggatgcaaataatccaaacggaagttttaaaatcattcaatcaagagaacgaaatttagaatatagtgtttcgcattatggcgatcatttttatctgttaactaataaagatggcgctaaaaattttaaattgatgaaaactccagtcgataaaacttctaaagaaaactgggttgatgtaattccgcatagagaagatacgctgttagaagatgtttctatttttaaaaactatttagtgctagaagaacgcactgaaggattgaataaaattagaattaaacgttgggacaataccaaagattattatttgccatttgatgaagaaacgtacactgcagatgtgtttgcaaatccagattttgataccaatacaattcgctattcatacaattcaatgacaaagncaagttctgtcattgatttaatattgatgaacatccaaagaattcaaaagaacagaagtttggaggaaatttataaaatagtcccgataagtgttgggtaa

SEQ ID NO: 19030 - protein, 267 aa, Unknown
  Obtained from environmental sample
  DOMAIN (1)...(254): Prolyl oligopeptidase, N-terminal beta-propeller domain
  misc_feature (1)..(267): Xaa is any amino acid
MLRIKNLKTGKTYNDVITNTNGGSVWANDNKTLFYTKKDPVSLRSYKVFKHVLGTNESEDVEVYHESDETFGIGVAKTKSNDFIVIASYSTLSTEYRVLDANNPNGSFKIIQSRERNLEYSVSHYGDHFYLLTNKDGAKNFKLMKTPVDKTSKENWVDVIPHREDTLLEDVSIFKNYLVLEERTEGLNKIRIKRWDNTKDYYLPFDEETYTADVFANPDFDTNTIRYSYNSMTKXSSVIDLILMNIQRIQKNRSLEEIYKIVPISVG

SEQ ID NO: 19031 - DNA, 510 bp, Unknown
  Obtained from environmental sample
  misc_feature (1)..(510): n is a, c, g, or t
atggccccaggttatgccctgttgggtgctggtacttcctatattccagaaggcaaaaaattcaacctacgcttggccccacttaccttcaagtctacctttgtgttggaccaaacattagctaacagtggtgcttttggggtccaaaaagcactgatagataccgatggcagcattataaaagagggcgaaaacgtttatctggaatttggttttttggtgtccaactcatgggaaaccatagtttatgacaatgtgaagttaaatcacaggttacaattgtactcggattacgtaaagaattttggaaatatagatgtggactgggaagtgaatatggatttgaccgtaaacaaatatgtaaaggcatccataggcacccatgttttatatgaccatgatattatattcgacgaggtaaaagctacagatggaaccattaccaccccaggaaaacgcaaaatacaattcaaacaattacttggcgttggtttggtctatgatttttaa

SEQ ID NO: 19032 - protein, 169 aa, Unknown
  Obtained from environmental sample
  misc_feature (1)..(169): Xaa is any amino acid
MAPGYALLGAGTSYIPEGKKFNLRLAPLTFKSTFVLDQTLANSGAFGVQKALIDTDGSIIKEGENVYLEFGFLVSNSWETIVYDNVKLNHRLQLYSDYVKNFGNIDVDWEVNMDLTVNKYVKASIGTHVLYDHDIIFDEVKATDGTITTPGKRKIQFKQLLGVGLVYDF

SEQ ID NO: 19033 - DNA, 555 bp, Unknown
  Obtained from environmental sample
  misc_feature (1)..(555): n is a, c, g, or t
gtgaatgggttgaaggtcaattttgaagaatacgttgtatatcatgatgaagaatggggtgttcctgttcatgatgatcttgttcattttgagtttctgattcttgaaggagctcaagccggattaagttgggcaaccgttcttaagaagagagatggttatcgaaaatcgtttgctgatttcgatcctgaaaaagtagcgctatttgatgaagctaaaattcaggaactacttcaatttgagggaataatccgaaataaattaaaaattcggagtgtcgttactaatgctcagaaatttctagaaatacaaaaggagtttggaagctttgataaatacatttggcaatttgtaaatggcaaacccattgttaaccactggacagcattaagtaaaatcccagcaactacaaaagagtctgatgcactaagtaaagaccttaaaaagcgaggatttaagtttgtaggtagcactattatgtacgctcatatgcaggcttgtggcttagtgaatgatcatacgattgattgtttttgctataaaaagttacgctaa

SEQ ID NO: 19034 - protein, 184 aa, Unknown
  Obtained from environmental sample
  DOMAIN (6)...(182): Methyladenine glycosylase
  misc_feature (1)..(184): Xaa is any amino acid
MNGLKVNFEEYVVYHDEEWGVPVHDDLVHFEFLILEGAQAGLSWATVLKKRDGYRKSFADFDPEKVALFDEAKIQELLQFEGIIRNKLKIRSVVTNAQKFLEIQKEFGSFDKYIWQFVNGKPIVNHWTALSKIPATTKESDALSKDLKKRGFKFVGSTIMYAHMQACGLVNDHTIDCFCYKKLR

SEQ ID NO: 19035 - DNA, 504 bp, Unknown
  Obtained from environmental sample
  misc_feature (1)..(504): n is a, c, g, or t
ttgattcaaagtgattcatcttatttatatgtagatgttggtggtggtagcacagaattcaccatattttctagaggaaaaatcatcaacagcaaatcttttaaaatgggaactgttcgtttgataaacaataccaaggcagaaaataaagtgatctttaaagaagtgcaaaaatgggttgaatcgaacacaaaagatttaaaaaaattgtctttaatcggttctggtggaaacatcaacaaactgtttaaaatgtctggaagaacacttggtaaaccgatttcttatatttacttaaatgcacaatatcaattcttaaaaaacatgagttttgatgatcgtatttctgaattaagtttaaatccagatagagccgatgtaattattccggcaacaaaaatctatttatctgccatgaaatggagcggagctagaaaaatttatgttcctaaaattgggttggcagacggaattataaaaagtttgtatcgcaataaattataa

SEQ ID NO: 19036 - protein, 167 aa, Unknown
  Obtained from environmental sample
  misc_feature (1)..(167): Xaa is any amino acid
MIQSDSSYLYVDVGGGSTEFTIFSRGKIINSKSFKMGTVRLINNTKAENKVIFKEVQKWVESNTKDLKKLSLIGSGGNINKLFKMSGRTLGKPISYIYLNAQYQFLKNMSFDDRISELSLNPDRADVIIPATKIYLSAMKWSGARKIYVPKIGLADGIIKSLYRNKL

SEQ ID NO: 19037 - DNA, 540 bp, Unknown
  Obtained from environmental sample
  misc_feature (1)..(540): n is a, c, g, or t
atgccggttatggatgggtttgagttgttacaacatttagacaaagtgcctgaggttatttttgtcactgcttttgaccaatatgccataaaagcttttcaacacaatgctctggactatttacaaaaacccattgaaccaacggatttatccagagccatcaataaattacaggattcaatttataataaaacagaaccaaataaaattgaattaatggaccgagtgtttgtaaaagacggagaaaattgttggtttatagacttttctgaaatcagatatttcgaagttgatggcaactataccactgttcattttcagagcaaccatccaatgataccaaaaacgcttaattacttagagtcccgattagacccaaaagtattttttagagccaatcgtaatcaaattattaatatcaaacacattaaaaaaatagagccttggatgcagggatttagggttattttaacaatgggagaacagattgaactttcacgtagacaaactcaaaaatttaaagacctcatgagcttttaa

SEQ ID NO: 19038 - protein, 179 aa, Unknown
  Obtained from environmental sample
  DOMAIN (82)...(178): LytTr DNA-binding domain
  misc_feature (1)..(179): Xaa is any amino acid
MPVMDGFELLQHLDKVPEVIFVTAFDQYAIKAFQHNALDYLQKPIEPTDLSRAINKLQDSIYNKTEPNKIELMDRVFVKDGENCWFIDFSEIRYFEVDGNYTTVHFQSNHPMIPKTLNYLESRLDPKVFFRANRNQIINIKHIKKIEPWMQGFRVILTMGEQIELSRRQTQKFKDLMSF

SEQ ID NO: 19039 - DNA, 807 bp, Unknown
  Obtained from environmental sample
  misc_feature (1)..(807): n is a, c, g, or t
ttggcaattgaaggccctgtgtttaaggacaagggatcatttctaattgccggaagaggttcatacaagcatttgttttttaaactttcagaagagttgaaagataatgtactctatttttatgatctgaaccttaaaagtaattatgaaataaatgagaataacagactttatctttctggttattttggcagagatgtttttaaatttggaaaaagttttagtaattcttatggtaattcatctggaaatgtaagatggaatcatatatttaatgaaaaattgttttcaaacctttcattgatctatagtaaatatgattatcaattgggtataaatgctctcgagtttgactggaatgcaaatattaataattttaattttaaatatgatcttcaatattatgccaatgataaattaaatgttgattttggaattagtggtatttattacaattttaatcctggagagattagtccaacgtcagaaacttcatccatcaatttttttaaattagataaaaaaaaggcttttgaaggaggagcttatgtaaatgctgagcaaaaaatttcaacccgatttaatctccagtatggtttgcgctttagttatttttcaagactgggaggagaacctttaaccgtttataaaaatgatcaaccagtagtttataatgaaaagatgagaatctacgaaagtggtactccaattggtcaggaagaatatattaaaggagaaagtatgaaacctttaataactttgaccacgttggcattatctttccagttaaatgaatatcatcactaa

SEQ ID NO: 19040 - protein, 268 aa, Unknown
  Obtained from environmental sample
  misc_feature (1)..(268): Xaa is any amino acid
MAIEGPVFKDKGSFLIAGRGSYKHLFFKLSEELKDNVLYFYDLNLKSNYEINENNRLYLSGYFGRDVFKFGKSFSNSYGNSSGNVRWNHIFNEKLFSNLSLIYSKYDYQLGINALEFDWNANINNFNFKYDLQYYANDKLNVDFGISGIYYNFNPGEISPTSETSSINFFKLDKKKAFEGGAYVNAEQKISTRFNLQYGLRFSYFSRLGGEPLTVYKNDQPVVYNEKMRIYESGTPIGQEEYIKGESMKPLITLTTLALSFQLNEYHH

SEQ ID NO: 19041 - DNA, 564 bp, Unknown
  Obtained from environmental sample
  misc_feature (1)..(564): n is a, c, g, or t
gtgaacagttcggatggtttgctgaaaatctattgctactattcggncgatgaaaaatacgcactcgaccaggagcaaattgatcaatcggcctggttgcgacaatttgccatagacgaacatttaacacaatctgaatcaaagcattacgaccttttcacgcacaagggcggcggtcctgccggcgcggaatggaacagcgatggagcgattctggtcttgtgtcaaatagcgctgccggctgatcaggtgggcgaaacagcaatcgcgctcaatggagaaaaaatctctccgccaagcttccgtggcacctttacgcagggaacgattgtattttttgaaattcctggtgaccaatggctctctcgcctcactcccatcaaaaagaaagattatccgctcctttacgattccaataccatagaaaacttcaagaatcagtccgaaagccctttgggagtcggggagatcctcaaagtccgaattgaaattgagcgaaaaacggatggcaagagcaaaactctccaaatcatgaaggcctttcaccgggcgacaggcgaataa

SEQ ID NO: 19042 - protein, 187 aa, Unknown
  Obtained from environmental sample
  misc_feature (1)..(187): Xaa is any amino acid
MNSSDGLLKIYCYYSXDEKYALDQEQIDQSAWLRQFAIDEHLTQSESKHYDLFTHKGGGPAGAEWNSDGAILVLCQIALPADQVGETAIALNGEKISPPSFRGTFTQGTIVFFEIPGDQWLSRLTPIKKKDYPLLYDSNTIENFKNQSESPLGVGEILKVRIEIERKTDGKSKTLQIMKAFHRATGE

SEQ ID NO: 19043 - DNA, 756 bp, Unknown
  Obtained from environmental sample
  misc_feature (1)..(756): n is a, c, g, or t
atgcatgaaggtattatcgatgagaacctttttgaaaaggtgcaaaagcaattaaacaccaattcaccgaccttaaaaaatgaagcaataaaaagtggcggccttttaaaggggcttctttatgattgcgatagtgtgatttatagcccaacttatacaataaaaaagggtaagcgatatagttactatattagtcagaatttacttcaatatcgcgatcatcccaagggtaacatggcacgtataccaagtcatgaaatcgaaaaatctgtgacgaatgccatcaaagatgaactgcaaaatataaatatgtggcagggctgctttcctgatgcgccacaagaaagtctgcaatggctcactcggaacaacacctatattcaggatagtttcattaaggtggttctatccagtgtcacagtgcaggcagagaagttagaaattaaaatagatacacaaaaactggaaatggaactttccaaagtgaccaaagtgtcagtcaactctcccacagaaaaagagatcataatagaggcatcctttaaaacaaaacgtgggaataatggtgcgattattattgaccaccaaaacagtggatatcaagacccgcttgacataccagcagataaattgaaacgtgtcgtcagaggtgtcatctggcgtgacaaacatttttccggtgcgacattaaaagagattgcgcaggccggtggccatggcgagaatatgtccataaatgcattcaagaaagtttga

SEQ ID NO: 19044 - protein, 251 aa, Unknown
  Obtained from environmental sample
  misc_feature (1)..(251): Xaa is any amino acid
MHEGIIDENLFEKVQKQLNTNSPTLKNEAIKSGGLLKGLLYDCDSVIYSPTYTIKKGKRYSYYISQNLLQYRDHPKGNMARIPSHEIEKSVTNAIKDELQNINMWQGCFPDAPQESLQWLTRNNTYIQDSFIKVVLSSVTVQAEKLEIKIDTQKLEMELSKVTKVSVNSPTEKEIIIEASFKTKRGNNGAIIIDHQNSGYQDPLDIPADKLKRVVRGVIWRDKHFSGATLKEIAQAGGHGENMSINAFKKV

SEQ ID NO: 19045 - DNA, 873 bp, Unknown
  Obtained from environmental sample
  misc_feature (1)..(873): n is a, c, g, or t
gtgatcaagaatcggtcgagatcattcacattaaggttatcaatcggaattactcatatcaatacagaagatggaaccgaatacttctatgactttcagtatctaactattctaaatgagaaagataaagttattggtgcttatgtaatcatccatgataaaactgaagatcgtcttttagatatcaaacgaaatgatatgataaacgtgatcatacatgagcttaaaaatcctattactggtgttgtcgggctttcgcgtctcattattgatagtaatacaatgagtgaagaggaatcaaaaacattgatgcaggaagtgcttaattctggtgaacgtatgaacgaactcgtaaatagatttttggatgtccaaaagcttgaagctggtaataccagtttaaatgtgactgttgttgacgttaagaaaactattgctgatgttaacgcgctttctaaaccattgctttcttcaaaaaaattggggttatctttttcagagacaggtacaaaatttattattgaagctgataaagaccttgtctttgacgccattcaaaatattttgagtaatgcagttaaatatggtgatccagaaagaattattaatattgaccttaaatcaactaaaacagacgtttctattgccatcacagattatggttatggaattagtatcgagaatcaaagtaaagtgttcgaaaaattcttccgcgttaaatcaaattataaagctgccaaggaaaaaggaacaggccttggtttagcgtatgtaaaagagattatgcaacgtcataatggagatatttcgcttgaatcttcttcaaaaattggtaatcggttcattctaacattcccaaaaaatacaccctga

SEQ ID NO: 19046 - protein, 290 aa, Unknown
  Obtained from environmental sample
  DOMAIN (63)...(130): His Kinase A (phosphoacceptor) domain
  misc_feature (1)..(290): Xaa is any amino acid
MIKNRSRSFTLRLSIGITHINTEDGTEYFYDFQYLTILNEKDKVIGAYVIIHDKTEDRLLDIKRNDMINVIIHELKNPITGVVGLSRLIIDSNTMSEEESKTLMQEVLNSGERMNELVNRFLDVQKLEAGNTSLNVTVVDVKKTIADVNALSKPLLSSKKLGLSFSETGTKFIIEADKDLVFDAIQNILSNAVKYGDPERIINIDLKSTKTDVSIAITDYGYGISIENQSKVFEKFFRVKSNYKAAKEKGTGLGLAYVKEIMQRHNGDISLESSSKIGNRFILTFPKNTP

SEQ ID NO: 19047 - DNA, 693 bp, Unknown
  Obtained from environmental sample
  misc_feature (1)..(693): n is a, c, g, or t
atggtgacggtggggtatgagtttccggagtattaccgccgacttgacagcagatgcgcattcttatggccccggatcacccttaacgacaaatacacagtttattaccctaaatacaacctttacccggctgaatgggaattgctggattcttccgcagcagatttgacctttttcattccttctgcgctttatgacgatgaaggaaaggcaaatgtggaaatgagctgtaaatgtacgcgtgggaggacgaggctgggttatgagaaggtggagttgaaacaggaaaaaaaggagaaggtgaaggtggagattgtggtggaaaagatggtgaggaaggagaaaatatctaaaacctaccccaatatgccactgaatctcaagatattgattggaggaatcatttacaaagtttctccaatttccaataagcctcctaaaaatcctcctgtttggtgttggaataaagaccttacaatgagcttggaaatattagaacaagattcaatcaatattcgagcggtaaatgaagcaaccgtcgaccatgaaatacaatactatacagcttcttttttccttccgattggtcagacaagcagcgaaaaggagaaaaggaaacttaaatttattagacaatccgaagtaatcaagaaaacctatttcctttttctgaagcctagtttcaaattttag

SEQ ID NO: 19048 - protein, 230 aa, Unknown
  Obtained from environmental sample
  misc_feature (1)..(230): Xaa is any amino acid
MVTVGYEFPEYYRRLDSRCAFLWPRITLNDKYTVYYPKYNLYPAEWELLDSSAADLTFFIPSALYDDEGKANVEMSCKCTRGRTRLGYEKVELKQEKKEKVKVEIVVEKMVRKEKISKTYPNMPLNLKILIGGIIYKVSPISNKPPKNPPVWCWNKDLTMSLEILEQDSINIRAVNEATVDHEIQYYTASFFLPIGQTSSEKEKRKLKFIRQSEVIKKTYFLFLKPSFKF

SEQ ID NO: 19049 - DNA, 621 bp, Unknown
  Obtained from environmental sample
  misc_feature (1)..(621): n is a, c, g, or t
ttgtcgattacgaagatggtagcaatcaaacatttattacagataaaaattggaaaacatatgattcaccaattattgaaactaccttatacaacggtgaaaaatatgatgccagattggaagagaaaggatggagcactacaaattttaatgattcaaagtggaagcaagctgaccatactcgaaaaagaaaaaggcaaacttgttgcacagcaagctccattattgcgtgtgaccaaagagataaaaccagttaaaatcacttctccggcagaaggagtttatgttgttgatatgggacagaattttgccggttgggcaaaactgaaagttaaaggtgaagctggaactcgtgttcaaatgcgttttgcagaaactcttcaaccggatggaaatgtttatgtggaaaatttaagaaaagccgaagctacagatatatatatactgaaaggtgaaggtgtcgaagaatggcagcctgattttacatatcatgggtatagatatgttgaaataactggattccccgaaaangctactctggatgcactaactggaattgtggctaattccgatgctccgaacattggagaactttcatgttccaatgaattactaacttaa

SEQ ID NO: 19050 - protein, 206 aa, Unknown
  Obtained from environmental sample
  misc_feature (1)..(206): Xaa is any amino acid
MSITKMVAIKHLLQIKIGKHMIHQLLKLPYTTVKNMMPDWKRKDGALQILMIQSGSKLTILEKEKGKLVAQQAPLLRVTKEIKPVKITSPAEGVYVVDMGQNFAGWAKLKVKGEAGTRVQMRFAETLQPDGNVYVENLRKAEATDIYILKGEGVEEWQPDFTYHGYRYVEITGFPEXATLDALTGIVANSDAPNIGELSCSNELLT

SEQ ID NO: 19051 - DNA, 459 bp, Unknown
  Obtained from environmental sample
  misc_feature (1)..(459): n is a, c, g, or t
atgaacaaagtagtcgtaaaaaaaattgaagacaaagaaatagtttggtttaaaaactccaattcgtatttagtattagaaccggttgctgcagctattatattaaaaataaataaaaataattctcttgaagagataaaaacttgggcttttaaaaaaaatactacaccaaaaaaggtcgtcaaaaaatttattgaagatattttcttgttatatacagttaataacactttaaaaaaagaagttcaaaataattctgaaacttataaaattccaacaaaatattattcagaaaaatactattcaatacataattacatttttaaagttcaatttgaaactaaatttcatttgttgaaaattcatccaacatttgcacatttagaaacagggaaagtcaaaataaatttcatttcaattatacaatttttaatgacaaagatttcttgtgttttttaa

SEQ ID NO: 19052 - protein, 152 aa, Unknown
  Obtained from environmental sample
  misc_feature (1)..(152): Xaa is any amino acid
MNKVVVKKIEDKEIVWFKNSNSYLVLEPVAAAIILKINKNNSLEEIKTWAFKKNTTPKKVVKKFIEDIFLLYTVNNTLKKEVQNNSETYKIPTKYYSEKYYSIHNYIFKVQFETKFHLLKIHPTFAHLETGKVKINFISIIQFLMTKISCVF

SEQ ID NO: 19053 - DNA, 621 bp, Unknown
  Obtained from environmental sample
  misc_feature (1)..(621): n is a, c, g, or t
gtgcaaagtaagtggattccttgnnataaaacatcttatttattcactcaagactttgtaaatattggggcctcggtttcctttttgggggcaaacaagaaattgagttcaatcttaaaggataaattagacaattcaaatatcgtagggtttctgaaatacaaaaaatataaaagtaaaaaacggtttcttgaattcgagcatattttcattaatgcaaataataaaaaggaaattgatgaatactggagatacgctgaaactttattgggtggaaaaccaatgaaggaaaagttcatcaaaatcgttaaatcaaccattattgacttcgaaaaggcgcaaattgaattctacattagaaactgttttgatactttcaatgtaagctcacaggcactaggaattactccgaaaaagcaaagggaattgctggagaaaatgcgaaatcaggaaaattttgactattcaaccttgagaaaagagattaaaaatgaatttgtagaggatttgattgattttttgacagaactggagaaaaaagatcaccaagattacctaaaaaggattgtaaatgaaatttatgagcaacggaatttcatccagcattctggtaaaattggn

SEQ ID NO: 19054 - protein, 207 aa, Unknown
  Obtained from environmental sample
  misc_feature (1)..(207): Xaa is any amino acid
MQSKWIPXXKTSYLFTQDFVNIGASVSFLGANKKLSSILKDKLDNSNIVGFLKYKKYKSKKRFLEFEHIFINANNKKEIDEYWRYAETLLGGKPMKEKFIKIVKSTIIDFEKAQIEFYIRNCFDTFNVSSQALGITPKKQRELLEKMRNQENFDYSTLRKEIKNEFVEDLIDFLTELEKKDHQDYLKRIVNEIYEQRNFIQHSGKIG

SEQ ID NO: 19055 - DNA, 588 bp, Unknown
  Obtained from environmental sample
  misc_feature (1)..(588): n is a, c, g, or t
atgaagttggattacaatacattaactaatgtatacaaatcacacaataagtatcttggaggcaaatctattcaattagaaaacttcaatattaaaaagcaactgactgaccttttttgtcctggtccaaatttttattttataatagattctcctacgcttactatagattttgtgagtgattctattcaagaaattttagggataaaacctaaaaatttagagttagcaaacttcttagaaattttacacccaggagatgtacaattttttgtaaaatgcgaagatttaatagcttattttttaacaaaaattgttaagcctaataaaataacaagctataaaataaattattgtttaagattaaaaaccaaagacaatagttataagttgtttttattgcaaatcattacactaaaggtagatgaaaaaggttctttattaaaggtttttgactcctttacaaatattaaccacttaacctctttaaataattttaaattatcattntttgggttggatggagaatcgtcttacccggaaatagatgtcttcaagaaaatccttttgacgattatgtcccgttaa

SEQ ID NO: 19056 - protein, 195 aa, Unknown
  Obtained from environmental sample
  misc_feature (1)..(195): Xaa is any amino acid
MKLDYNTLTNVYKSHNKYLGGKSIQLENFNIKKQLTDLFCPGPNFYFIIDSPTLTIDFVSDSIQEILGIKPKNLELANFLEILHPGDVQFFVKCEDLIAYFLTKIVKPNKITSYKINYCLRLKTKDNSYKLFLLQIITLKVDEKGSLLKVFDSFTNINHLTSLNNFKLSXFGLDGESSYPEIDVFKKILLTIMSR

SEQ ID NO: 19057 - DNA, 570 bp, Unknown
  Obtained from environmental sample
  misc_feature (1)..(570): n is a, c, g, or t
atggatcgcgaagtatttcaggaacaattcggtttattaggcacctcgcctgagattaaacatgttgtagataagataatgcaggtttcaaaaaccgatatttctgtactactacagggcgaaagtggtgtagggaaagatgttacggcacgtgctattcacgctatgagcaacagaaagcgtggaaatttagtaattgtgaactgtggcgccataccagaaggcattatagaaagcgaactttttgggcatgaaaaaggtgcttttactggtgccaacgattccagagaaggctatttcgaaaaagccgatggaggtaccattttccttgatgaaattggtgacaccccgaaaaatgtacaggttaaattacttagggttctagaaaatggagagtatttccgtgtaggatctagtaaaattcaaaagacggatgtccgtgttatagccgctacaaataaagatttgtgggaaatggttaaagaggacgaatccgtgaggacttgtataatcgcctcgataccgtacaaattcacttaccagcacttagagaacgccaagaagatatag

SEQ ID NO: 19058 - protein, 189 aa, Unknown
  Obtained from environmental sample
  DOMAIN (12)...(189): Sigma-54 interaction domain
  misc_feature (1)..(189): Xaa is any amino acid
MDREVFQEQFGLLGTSPEIKHVVDKIMQVSKTDISVLLQGESGVGKDVTARAIHAMSNRKRGNLVIVNCGAIPEGIIESELFGHEKGAFTGANDSREGYFEKADGGTIFLDEIGDTPKNVQVKLLRVLENGEYFRVGSSKIQKTDVRVIAATNKDLWEMVKEDESVRTCIIASIPYKFTYQHLENAKKI

SEQ ID NO: 19059 - DNA, 747 bp, Unknown
  Obtained from environmental sample
  misc_feature (1)..(747): n is a, c, g, or t
ttgactaatgatattcttgncgaaggaatattaaaaaataatattcttacactaagcaaatcatatgaaggcacacttcactattggttaaacttagatgaaagtcaatatttaaaaaatattattcaaggcctttctttcagtaaggaaacaagaacagatataacttcttgttcagcagttgaaagcttaaaagactttcttaaagactatgaagcttctgaagaaacatctgataaagaaaaagagtctatagaaactttgaatagtagattaacagcccaaattggagattcaacctcattagtttcagcctgctacaaaaaaattcaaaagcatatcccgaaatttatttacttcgacaaatacagcacgttaccctatacagtcaaaataaaagaaattcttgaagcagacgatacgaccttagatgacaatcaattaactgcaaaatctttactaagaatggctgcggctgatgatgactaccttttgaatcctgattatgaaagaagaaaaagagaacttgaaaatgtcgccaatgccttaactcaagacgtactcgaatattggagccaaaatacctcactccgtgttaaccctgatattgataaaactacagtcaacaagccaaatggtcagacgactataattgacgaattaaaaattaggatttgggatgacaaacatttcctttcattaccgtttaatgacattccacagttttcagtgttttttcttttctag

SEQ ID NO: 19060 - protein, 248 aa, Unknown
  Obtained from environmental sample
  misc_feature (1)..(248): Xaa is any amino acid
MTNDILXEGILKNNILTLSKSYEGTLHYWLNLDESQYLKNIIQGLSFSKETRTDITSCSAVESLKDFLKDYEASEETSDKEKESIETLNSRLTAQIGDSTSLVSACYKKIQKHIPKFIYFDKYSTLPYTVKIKEILEADDTTLDDNQLTAKSLLRMAAADDDYLLNPDYERRKRELENVANALTQDVLEYWSQNTSLRVNPDIDKTTVNKPNGQTTIIDELKIRIWDDKHFLSLPFNDIPQFSVFFLF

SEQ ID NO: 19061 - DNA, 660 bp, Unknown
  Obtained from environmental sample
  misc_feature (1)..(660): n is a, c, g, or t
atggttttaaaactaaacattggtgncggaagtttacaatgggataaagacatgaaaaatctatatctgttaagtagtggaagaatttctaaaatagatcctaaagctggaaaacaaacacctgtaaaaattaatggcgaaatgaaatttgatgaagctgcagagagagttgctatgtttaatcatgtttggattcgaaccaatgctattttttacgaacctacttttcatggtgtcaactggaaacaaatgaaaaaagaatatcaaaaatatttaccacatattggtaatggttttgagttttcagaaatgttatctgaaatgcttggggaattaaatgtttctcatgctggttctggttacagaggtgcaaccatttctaatgcagatgctacagcatcattaggaatctttatgaattacgattacaaaaaaaatggaattttaatcgatgaaatcatcaaaggcggacctttagacaaagcaaaatttaatttgaaagccggaatggtcattgaaaaaattaatggagaaactattgataaagaccaagatgttgccaaatatctaaacagaatgagtggtaaatttatgctcttagaagtgttagatccaaatactaaaaaatcgcaaaccattactgtaaacctatttctttag

SEQ ID NO: 19062 - protein, 219 aa, Unknown
  Obtained from environmental sample
  misc_feature (1)..(219): Xaa is any amino acid
MVLKLNIGXGSLQWDKDMKNLYLLSSGRISKIDPKAGKQTPVKINGEMKFDEAAERVAMFNHVWIRTNAIFYEPTFHGVNWKQMKKEYQKYLPHIGNGFEFSEMLSEMLGELNVSHAGSGYRGATISNADATASLGIFMNYDYKKNGILIDEIIKGGPLDKAKFNLKAGMVIEKINGETIDKDQDVAKYLNRMSGKFMLLEVLDPNTKKSQTITVNLFL

SEQ ID NO: 19063 - DNA, 702 bp, Unknown
  Obtained from environmental sample
  misc_feature (1)..(702): n is a, c, g, or t
ttgttttttttggtaaataaatcactttcaacgtacattacaacatcagatgtttctaaaattaattctggagattctaccgtaattgtggatgcattatttgcagaagtttttcaaaaatctaaacgaatttttaaagaaaccgatggctattttgatccaacggttggcaatttggtaaatgcttggggttttggacctaacaaatctaaaaaagaaatagatagtttgtctattcataaaatgatgcgatttgttggtttagacaaagtccaattgaaaaaaaataaaatcgaaaagcaatttcaagaaacctatttagattttaattcgatcgccaagggttttggaattgatgtcgtgggtcgttttttagaaagtaagaatgttcatgattatttggtagaaattggcggagaaataagagctagaggaaaaaataagaaagggaatttttggaatgtagccatagaaaaaccaaatacagacggaacacaatcattccaaacgacaattcggttagaaaatgcttccatggcaacttctggaaattatagaaactttagaattaccaaagacggtcaccaatatgttcatacggtaaatccaaaaacaggtttcggcaaagaaagtcatctgttaagcgctttctgtaattgcaaattcagattgtgccaatgtagatgcgtacgcaaaggtttn

SEQ ID NO: 19064 - protein, 234 aa, Unknown
  Obtained from environmental sample
  DOMAIN (1)...(234): ApbE family
  misc_feature (1)..(234): Xaa is any amino acid
MFFLVNKSLSTYITTSDVSKINSGDSTVIVDALFAEVFQKSKRIFKETDGYFDPTVGNLVNAWGFGPNKSKKEIDSLSIHKMMRFVGLDKVQLKKNKIEKQFQETYLDFNSIAKGFGIDVVGRFLESKNVHDYLVEIGGEIRARGKNKKGNFWNVAIEKPNTDGTQSFQTTIRLENASMATSGNYRNFRITKDGHQYVHTVNPKTGFGKESHLLSAFCNCKFRLCQCRCVRKGX

SEQ ID NO: 19065 - DNA, 663 bp, Unknown
  Obtained from environmental sample
  misc_feature (1)..(663): n is a, c, g, or t
ttggctgagaggttcgatgagggaggacaactgacagaagctgtccgtcgcaagccatactctgtagtgttgctggatgaaattgaaaaagcacacccggatacttttaatgtgttgctgcaggtgctagacgatggtcgactgacagataataaaggtcgactggtgaactttaaaaacactgtggtgattatgaccagcaacacaggtagccatatcatacaggagaattttgcggatatgaaaggcaaggatcttgatacggtcgtagaggcaaccaaggagcaggtgatggaagaactgaagcataatatgcgtcctgaatttttgaacagggtggatgatattatcatgttccgcccgttgatgaaggatgatatcaggaacattattaagatacagttgcaaggtttgcaaaaacagttgaagcaacaagatattgacttgcagttttctgactatgcactggattacctgagtgagcgtggcttcgaccctcaatatggtgcaaggccactgaaaagagtaatacagaaagatatcatcaacctgctgagtaagaaaataattgccggcgaagtggacaaggcaaaacctgtaatgattgatgtgtttgatggtgttgtggtgatacgcaacaacggaaatgaagtagaagcataa

SEQ ID NO: 19066 - protein, 220 aa, Unknown
  Obtained from environmental sample
  misc_feature (1)..(220): Xaa is any amino acid
MAERFDEGGQLTEAVRRKPYSVVLLDEIEKAHPDTFNVLLQVLDDGRLTDNKGRLVNFKNTVVIMTSNTGSHIIQENFADMKGKDLDTVVEATKEQVMEELKHNMRPEFLNRVDDIIMFRPLMKDDIRNIIKIQLQGLQKQLKQQDIDLQFSDYALDYLSERGFDPQYGARPLKRVIQKDIINLLSKKIIAGEVDKAKPVMIDVFDGVVVIRNNGNEVEA

SEQ ID NO: 19067 - DNA, 327 bp, Unknown
  Obtained from environmental sample
  misc_feature (1)..(327): n is a, c, g, or t
ttggttattatttttataaaaaggacaagaatgtttcctgaagaaaccgttgatattaaaaatttcaatatccaggtccaatccccctgttcaaaagaaaccgcaatcttaatgatttgtgatgcttcagaagcagcagcaaagagcattaaaaatccaactgcacaagctatagaaacattaatagataagattgtagaaaaacaaaaatctgataatcaatttattaattctgatattacttttagagaaatagaaaagataaaaaaagttgtaaaaaagaaattaatgaatatgtatcacttgcgaattgaatatccagattag

SEQ ID NO: 19068 - protein, 108 aa, Unknown
  Obtained from environmental sample
  misc_feature (1)..(108): Xaa is any amino acid
MVIIFIKRTRMFPEETVDIKNFNIQVQSPCSKETAILMICDASEAAAKSIKNPTAQAIETLIDKIVEKQKSDNQFINSDITFREIEKIKKVVKKKLMNMYHLRIEYPD

SEQ ID NO: 19069 - DNA, 483 bp, Unknown
  Obtained from environmental sample
  misc_feature (1)..(483): n is a, c, g, or t
ttggggggggtttttcatccaggttgggccgccactttccttggtcccattgggggaggtccattaaggatctttcaaacatccattaaatttttcttttgcccgcctagggtgttaccgttgaaaatcgccctctatgcaatttctaaactattcgggcagcgtccaaaaaccgtcgattttgtcatcaccggggttgaagaatatctgggagtcaccatcatatccgataaaagcgaggaaatcagattggccattatcgaaaaactgggccggggatgcaccatttacaccgggaaaaaaggatatgcaaaaagaggggaacccttaaaaccaaccgacattgtttataccctgctgacccgcctggaaatttccaaattaaaaacggaggtcgacaagattgactcaaaggcttttgtaatcatgcacagcatcaaagatgccaaaggaggcatgatcaagaagcggcccttgacttga

SEQ ID NO: 19070 - protein, 160 aa, Unknown
  Obtained from environmental sample
  misc_feature (1)..(160): Xaa is any amino acid
MGGVFHPGWAATFLGPIGGGPLRIFQTSIKFFFCPPRVLPLKIALYAISKLFGQRPKTVDFVITGVEEYLGVTIISDKSEEIRLAIIEKLGRGCTIYTGKKGYAKRGEPLKPTDIVYTLLTRLEISKLKTEVDKIDSKAFVIMHSIKDAKGGMIKKRPLT

SEQ ID NO: 19071 - DNA, 600 bp, Unknown
  Obtained from environmental sample
  misc_feature (1)..(600): n is a, c, g, or t
gtgagtcataaaagaatcattgtctttgttaaaaacacaattccaggaaaagtaaaaacaagattagccaaaactattggagatgaagaagcactagaggtttatctgcaattattaaatatcacgaaaaaagaagtgcttggattaaatatagaaagagaagtgtggtatgcttgggaaattggaaaggatgatatttgggacgaaaaccattttaacaagagagtgcaacaagatggagatcttggcgaaaaaatgaataacgctttcaggcaatcatttgaagaaggaatgaataaagtagtacttataggtagcgattgcccaactttaactagttcgattctggaagaagcgtttcaaaaactagatgaaagcgatgtggtatttggtccttcaaaagatggaggatactacttaataggaatgagttcctattatcctgaagtacttgataacatagcttggagcacagaaaaagtcatggatcaaacggaagaaaaagctaaccaaaataatattaagctatcaaaactagtgacattaaatgatatagacaatgagtcagattggaacgaatacttaggaagtattaaatga

SEQ ID NO: 19072 - protein, 199 aa, Unknown
  Obtained from environmental sample
  misc_feature (1)..(199): Xaa is any amino acid
MSHKRIIVFVKNTIPGKVKTRLAKTIGDEEALEVYLQLLNITKKEVLGLNIEREVWYAWEIGKDDIWDENHFNKRVQQDGDLGEKMNNAFRQSFEEGMNKVVLIGSDCPTLTSSILEEAFQKLDESDVVFGPSKDGGYYLIGMSSYYPEVLDNIAWSTEKVMDQTEEKANQNNIKLSKLVTLNDIDNESDWNEYLGSIK

SEQ ID NO: 19073 - DNA, 396 bp, Unknown
  Obtained from environmental sample
  misc_feature (1)..(396): n is a, c, g, or t
ttgcacacattaatcaaagccttagatatggaaagtcaaatttcgttgtttggtaaagccaatagagaggaagttagattgatgttacaaaaaagtgatgcctttgtgctatcaagcacctacgagacatttggcgttgttatcattgaagccatgtcctgtggactcccagtgttatcaaccaaatgtggtggcccgcaaagtatcataaaatctgataaaatgggtttattatctgaaataaatgaaaccaatctatcaaaaaatttaatcaccttgtataacaacaaggataattataacgctaaagagattaggcaatatgtgatagataatttttctcaacaagccatatgccaaaaactcacaagtatctataaaaaggtaataaaatga

SEQ ID NO: 19074 - protein, 131 aa, Unknown
  Obtained from environmental sample
  DOMAIN (1)...(108): Glycosyl transferases group 1
  misc_feature (1)..(131): Xaa is any amino acid
MHTLIKALDMESQISLFGKANREEVRLMLQKSDAFVLSSTYETFGVVIIEAMSCGLPVLSTKCGGPQSIIKSDKMGLLSEINETNLSKNLITLYNNKDNYNAKEIRQYVIDNFSQQAICQKLTSIYKKVIK

SEQ ID NO: 19075 - DNA, 351 bp, Unknown
  Obtained from environmental sample
  misc_feature (1)..(351): n is a, c, g, or t
ttggacaacgatctggctgatgcacacttccggctgtccagaacaatcatagaaaacctcgactggtttaaatgcatgcagaaatacgaccgaccaggcactgtgttttattgcgacccgccctactggaaaaccgaaggatatggcgtcgacttcccctttgaagagtacgaaaggcttgtgcggtttgcgtctgaatcgaaagggaaagtcattatcagcatcaatgaccaccccgatatccgtacattatttggctcgatgaaagtgacagaagttaattacggttacaccgttggcggcgctaaaaaccgcaaaaaagcgactgaactgatctatcaaaactattaa

SEQ ID NO: 19076 - protein, 116 aa, Unknown
  Obtained from environmental sample
  misc_feature (1)..(116): Xaa is any amino acid
MDNDLADAHFRLSRTIIENLDWFKCMQKYDRPGTVFYCDPPYWKTEGYGVDFPFEEYERLVRFASESKGKVIISINDHPDIRTLFGSMKVTEVNYGYTVGGAKNRKKATELIYQNY

SEQ ID NO: 19077 - DNA, 516 bp, Unknown
  Obtained from environmental sample
  misc_feature (1)..(516): n is a, c, g, or t
ttgagtagcatctcaatgcttaatagctccattgttgaacctaaaggcaaaacacgtaagaagattcttgaaggattgattacaatttatgaggcttgggaattacaactcaaagaattgggagtgccatactaccttaagatttggctatatgaacctcatttttcaaattctcaagttgtttgtgctattggcgaacacatagatttttatgaaatcacctttcataaacccgaagagacgaaacaactcaatctcaataatttcggcaacctttcctcaaaaatggctgagttcgactgggaattccgactagatgaaacacacttgaatgacgctgaaattggaaatccagacgaatattacagcatagaggattataaccaagagttagcatggttcaataaaatgctaacgaaaaaacatcgtgttactatatcaaccgatcctcgagttgatgccaaagaatactactcattcaaaattggcgaagtttggctaggtgggaagaaataa

SEQ ID NO: 19078 - protein, 171 aa, Unknown
  Obtained from environmental sample
  misc_feature (1)..(171): Xaa is any amino acid
MSSISMLNSSIVEPKGKTRKKILEGLITIYEAWELQLKELGVPYYLKIWLYEPHFSNSQVVCAIGEHIDFYEITFHKPEETKQLNLNNFGNLSSKMAEFDWEFRLDETHLNDAEIGNPDEYYSIEDYNQELAWFNKMLTKKHRVTISTDPRVDAKEYYSFKIGEVWLGGKK

SEQ ID NO: 19079 - DNA, 705 bp, Unknown
  Obtained from environmental sample
  misc_feature (1)..(705): n is a, c, g, or t
atgaaattttttagcgctttattaatcttaacgttagtaattacatcgtgtaaatctagtaaaacagttgttggaacttcggctgaaataaaatcactgtcagtaagaaaagtttctaaaaaatatcttcaaaatacgtttcataaaaacaccgttgaagcgaaacttaaagttgcatatcaagacaacaataacaaacaaaaattaagcgtaaaattacgaatagaaaaagacagtgttatttggctaaacgcaacgtatattggcgtaattgtggcaagagttaagataacacccaattcggttagttattacgaaaaactaaatagaacgtattttaaaggtgattttaatgtgttaaaaaacatgttaggaaccgatattaactttacacaattacaaaacgtattattgggtcaaacaatttttgatttaaatgctcaaaaatacagagcagttgtagatgcgaatgcacatctattgatgccagtacaacaaaaagcattgttcgatgttttcttttggatcaaccccgttcattttacactagacaaacaagaattgcgccaatcgtttaaaaatcaaacattaaaagttgcttataaaagatacacaaacttgatggagcaattttccgaagaactcgagattagagccacggacatgctccttaccaatttgcttcccattaccacagttatttaa

SEQ ID NO: 19080 - protein, 234 aa, Unknown
  Obtained from environmental sample
  SIGNAL (1)...(19)
  misc_feature (1)..(234): Xaa is any amino acid
MKFFSALLILTLVITSCKSSKTVVGTSAEIKSLSVRKVSKKYLQNTFHKNTVEAKLKVAYQDNNNKQKLSVKLRIEKDSVIWLNATYIGVIVARVKITPNSVSYYEKLNRTYFKGDFNVLKNMLGTDINFTQLQNVLLGQTIFDLNAQKYRAVVDANAHLLMPVQQKALFDVFFWINPVHFTLDKQELRQSFKNQTLKVAYKRYTNLMEQFSEELEIRATDMLLTNLLPITTVI

SEQ ID NO: 19081 - DNA, 810 bp, Unknown
  Obtained from environmental sample
  misc_feature (1)..(810): n is a, c, g, or t
gtgcagtatatgaaacaatatacgaagtttcgaaaaaaacaaggacaagaaattgttttgcaaacggatgtcatcaaaaaactaaacgattccctgttatttaaaaagcagtcaaaagacacgttgataagagtagaaacagaagagaaacagaagatagaaattgataaaaaaaacaaaacaaagcttgtttctctaatcaaaaagaaagaaaagcagtacatcaaagaaataaaagcgaagcaaaaagaagaccgtaaaatagctgctcagatagataaaattattaaagacgccattgcaaaatcaaacgcgaataaagcaaataaaaaatcaaccagttttgcattaacgccagccgcaaaagcattggcaaaaaagtttgaaagcaataaaggaaaattaccttggcctgtaaaaagtggtttggttgtaagaagattcggaaaacaaccacatccaacattacgtggaattacaattacaagttctggtttgcatattgccacagaaaaaggagcaacagctcaaagtgtttttaacggaaaagttttggcaatccaagttttatctggcggaagaaaagccgttttaattcagcacggaaactatattaccacgtataataatttagaaaccttagccgtaaataaaggcgataatgttgttactggacaagttttagggaaaatatttaccaataaagttaccggaaaaaccacgttaatatttgtgttacacaaagaaacgcaacgacaaaatcctgcaaattggttgttaaaagatagtttaattaaacaaggcttttaa

SEQ ID NO: 19082 - protein, 269 aa, Unknown
  Obtained from environmental sample
  DOMAIN (161)...(255): Peptidase family M23
  misc_feature (1)..(269): Xaa is any amino acid
MQYMKQYTKFRKKQGQEIVLQTDVIKKLNDSLLFKKQSKDTLIRVETEEKQKIEIDKKNKTKLVSLIKKKEKQYIKEIKAKQKEDRKIAAQIDKIIKDAIAKSNANKANKKSTSFALTPAAKALAKKFESNKGKLPWPVKSGLVVRRFGKQPHPTLRGITITSSGLHIATEKGATAQSVFNGKVLAIQVLSGGRKAVLIQHGNYITTYNNLETLAVNKGDNVVTGQVLGKIFTNKVTGKTTLIFVLHKETQRQNPANWLLKDSLIKQGF

SEQ ID NO: 19083 - DNA, 564 bp, Unknown
  Obtained from environmental sample
  misc_feature (1)..(564): n is a, c, g, or t
ttgcttataaaatttaagtatcatcagaaattaattgacttaattaagactgttgatggtgtgcgttggagcacttctttaaaatcttggtattttaaaaataccgataaaaatttacttttaattacaagtctttttgaaggaattacaactgtaaacaccagtaatatttcaaggaaaaaggtgtttacacgcaacttaactgaagatcaaaaaatactattaaataatttttacttgtatttaaaagggaaaagatacagtcaaagcaccataaatacctacactttttttattgctgattttattaattttcacacaaaaacacctttagaagatcttacaaatagaaatgtagaagagtttatagaaacggtatttatagaaagaaattattctgtaagttctcaacggcaatttataagtgccttaaagatttttatcgttttttatccgcagacagcaattaacgacttgcaattagaaagacccaaaaagtctagaaaattaccaaatgttttatcacaagaagagattttagaaattattagatgcacgcagnnc

SEQ ID NO: 19084 - protein, 188 aa, Unknown
  Obtained from environmental sample
  misc_feature (1)..(188): Xaa is any amino acid
MLIKFKYHQKLIDLIKTVDGVRWSTSLKSWYFKNTDKNLLLITSLFEGITTVNTSNISRKKVFTRNLTEDQKILLNNFYLYLKGKRYSQSTINTYTFFIADFINFHTKTPLEDLTNRNVEEFIETVFIERNYSVSSQRQFISALKIFIVFYPQTAINDLQLERPKKSRKLPNVLSQEEILEIIRCTQX

SEQ ID NO: 19085 - DNA, 870 bp, Unknown
  Obtained from environmental sample
  misc_feature (1)..(870): n is a, c, g, or t
atggaacgaagaattaaaaagctaaaaaagttattagatgagtggttagaaaagaaagatacacataagactatacaacttaaaagaaaagattatatagataaacttaaactagaatataataactcaagtatagattcaattatttctctaaataaagaaattcttatgagttctcaatacttttttgaattcacaaaaggggttgagattgattacaatcctttaaccaaaattttattagttgaatacacattgcctaatattgaggacatccctaacattaaagaaactaaatatttaacttcaaaaaaagagtataaagatatcttaatctcaaaacgtgatttaagtaatctctttgataatgctatttataatatcacacttcgctctatctatgaaatattagttagtaattctattaatattgaggctattaattttaatggttggattaaaacaaataataaagcaacaggtttaataaacaaaacttgtattatttcaatacaagttaaacgtgatgaatttttagagataaatcttcaaaatgttgatgcaaaaacttgttttaagcactttaaaggaattggaagtagtaaattatatggaatgactcccattcagccaattatgcaaattgaatatgaagacaaaaggtttgtcgattcttacttagtcaattataataacaaaacaaacttagctttaatggattgggaagatttcgagcatttaattagagagttgtttgaaaaagaatttagtagtaaaggcggcgaagtaaaagtaacaaaagcaagtagagatggtggcgtagatgcaattgcatttgatccagatccaattagaggaggcaaattgtaa

SEQ ID NO: 19086 - protein, 289 aa, Unknown
  Obtained from environmental sample
  misc_feature (1)..(289): Xaa is any amino acid
MERRIKKLKKLLDEWLEKKDTHKTIQLKRKDYIDKLKLEYNNSSIDSIISLNKEILMSSQYFFEFTKGVEIDYNPLTKILLVEYTLPNIEDIPNIKETKYLTSKKEYKDILISKRDLSNLFDNAIYNITLRSIYEILVSNSINIEAINFNGWIKTNNKATGLINKTCIISIQVKRDEFLEINLQNVDAKTCFKHFKGIGSSKLYGMTPIQPIMQIEYEDKRFVDSYLVNYNNKTNLALMDWEDFEHLIRELFEKEFSSKGGEVKVTKASRDGGVDAIAFDPDPIRGGKL

SEQ ID NO: 19087 - DNA, 870 bp, Unknown
  Obtained from environmental sample
  misc_feature (1)..(870): n is a, c, g, or t
atggcacttgataaacccaaagaattagatgcagagcttgtaatggcaaccgatcccgatgcagatagaattggagtgcctgtcaaagattcatcggttgaatggattctattgaatggcaatcaaacaggctctttgatcataaattacatgctcactgcgtggaaaaatgccgggaaattgactggtaatcagtatatagttaaaactgtagttacttcatatttgattgatcgtattgctgagtcctatgaggtagaatgttttaatacgcttacaggcttcaaatatattggagaattaatgaccaaatttgaaggtaaaaaagagtttattgtaggtggtgaagaaagttatggctatctcataggcgagcatgtaagagataaggatgctatcgtttctgctgttatcattgctgaaatggcagcgtattacaaagataatggaagtagtttatacgaagctttgcttgagatgtatgaagaacacggagtttttcaagaaaaactgatttcgatcacaaaaaagggaaaatcaggtgctgaagaaattcaacaaatgatgaaagaattccgaacaaatccccctaaaaaacttgggaattctaaagtaataaccatcaaagattatcaagcacaagaagaaacaaatacaacaactggaaataagtcggttattgatctacccacttcaaatgtgcttcagtttattacagaagatggagctatcatttcggcacgaccttcaggaacggagcctaagatcaagttttattgcagcgtaaacgacactattgcaaatactgacgagtatgattttgtagcaaataaactgaatcaaaagatcgaccgaataatgcaagaatga

SEQ ID NO: 19088 - protein, 289 aa, Unknown
  Obtained from environmental sample
  DOMAIN (39)...(161): Phosphoglucomutase/phosphomannomutase, alpha/beta/alpha domain III
  misc_feature (1)..(289): Xaa is any amino acid
MALDKPKELDAELVMATDPDADRIGVPVKDSSVEWILLNGNQTGSLIINYMLTAWKNAGKLTGNQYIVKTVVTSYLIDRIAESYEVECFNTLTGFKYIGELMTKFEGKKEFIVGGEESYGYLIGEHVRDKDAIVSAVIIAEMAAYYKDNGSSLYEALLEMYEEHGVFQEKLISITKKGKSGAEEIQQMMKEFRTNPPKKLGNSKVITIKDYQAQEETNTTTGNKSVIDLPTSNVLQFITEDGAIISARPSGTEPKIKFYCSVNDTIANTDEYDFVANKLNQKIDRIMQE

SEQ ID NO: 19089 - DNA, 633 bp, Unknown
  Obtained from environmental sample
  misc_feature (1)..(633): n is a, c, g, or t
atgattttaaaagaaagaaatcaattaaaattaacagataccgttaccaaatattttccaaaatttccttttaaaaatattactattctacaattactacatcacacttctggtttgccaaattatttttgggtagcagaaaatcagtgggaaaaagaaaaagcaccgagcaatatagagatgatgaaatttttagaaacaagtaaagtttctacgttttttagtcctggcagaaagtttgattattcgaatactggttattttgttttagcttctattattgagaaaatatcaaagatgagttattctaactttgtacaaggtgctatttttaaaccgctaaaaatgagccattcttttgcttttagttttgaaaaagataccgttaaatcaaatcaattaatcggatatagattgtatagaggttggagacatcggactataccaaacaccattaatgatgcaattgttggcgataaaaatatttatgccacaactcaagatttgttaaaatgggtaaatggtttaaatagcggaaaacttatttntaaagaatctttagaccttatgtacaccaaaggaaaaaccaaatatggacgaaatttccatatgttttctcgagccgattcttga

SEQ ID NO: 19090 - protein, 210 aa, Unknown
  Obtained from environmental sample
  DOMAIN (1)...(209): Beta-lactamase
  misc_feature (1)..(210): Xaa is any amino acid
MILKERNQLKLTDTVTKYFPKFPFKNITILQLLHHTSGLPNYFWVAENQWEKEKAPSNIEMMKFLETSKVSTFFSPGRKFDYSNTGYFVLASIIEKISKMSYSNFVQGAIFKPLKMSHSFAFSFEKDTVKSNQLIGYRLYRGWRHRTIPNTINDAIVGDKNIYATTQDLLKWVNGLNSGKLIXKESLDLMYTKGKTKYGRNFHMFSRADS

SEQ ID NO: 19091 - DNA, 327 bp, Unknown
  Obtained from environmental sample
  misc_feature (1)..(327): n is a, c, g, or t
atgaagatagaaaacacaaaagcacaaatgcgaaaaggagttttagaattctgcatattatccattttacaaaatgaagatgcatatacttctgagattctatccgaattgaagggcgcaaaactgcttgtagttgaaggaaccatttatcctttgttaacaagattaaagaatgccggtcttttaaattatcgatgggaggaatctacatctggaccgccacgaaaatattacggtttgacagaaaccgggaagatatttctaatcgaattgaattccacctggagtgatttggttaatgcggtaagtacgattaccaaatattaa

SEQ ID NO: 19092 - protein, 108 aa, Unknown
  Obtained from environmental sample
  DOMAIN (9)...(91): Transcriptional regulator PadR-like family
  misc_feature (1)..(108): Xaa is any amino acid
MKIENTKAQMRKGVLEFCILSILQNEDAYTSEILSELKGAKLLVVEGTIYPLLTRLKNAGLLNYRWEESTSGPPRKYYGLTETGKIFLIELNSTWSDLVNAVSTITKY

SEQ ID NO: 19093 - DNA, 777 bp, Unknown
  Obtained from environmental sample
  misc_feature (1)..(777): n is a, c, g, or t
atgatacgagtgccagccaaatacaaacgcttcggaataaaggtaaaatgcttgcaatgtgggtatcaagtatcgcatacctgcaaaggcaatggcaagggtataaactcctgcccgcataaggataagcaccgttttaacttaatagtggttgtgccaggaagtaagggaaagcgacggatgcgactgcttgaatcaagagattttaatcaggcattggttgaactcaaaaacttcaaggaggagcttgctgaacacggttatcacaaggtacaaagagcgactcttaaagaaccaaaaaccttaatcgattttggcataatttatctggatactttatccggaatcaacacccctgaacatctggttagaaaacgatcaccggaacatgtggcagatgtcgcgaggggcattgagaaattctttgatgctttgggtaaaaagggttacataaaagaaacattacttccctcagatattgttgataatgaagtaggaatctttcacagctacctattaaacgaccttggtcttgcgccgcgtacttataacaagtacatgacagttatgaaatcctttttttcttggttaattgagagtaaggacttacctattaggaattgctttaaagctgttgaattgcaaccattacctaagaaagaaaacgcgattataaccaagagcgagtttgaggctttattgacggtcatcacccctgaaaatggtgagtatatgcgcactgatggagcaagaaaaaanccttccgctcttggctaa

SEQ ID NO: 19094 - protein, 258 aa, Unknown
  Obtained from environmental sample
  misc_feature (1)..(258): Xaa is any amino acid
MIRVPAKYKRFGIKVKCLQCGYQVSHTCKGNGKGINSCPHKDKHRFNLIVVVPGSKGKRRMRLLESRDFNQALVELKNFKEELAEHGYHKVQRATLKEPKTLIDFGIIYLDTLSGINTPEHLVRKRSPEHVADVARGIEKFFDALGKKGYIKETLLPSDIVDNEVGIFHSYLLNDLGLAPRTYNKYMTVMKSFFSWLIESKDLPIRNCFKAVELQPLPKKENAIITKSEFEALLTVITPENGEYMRTDGARKXPSALG

SEQ ID NO: 19095 - DNA, 768 bp, Unknown
  Obtained from environmental sample
  misc_feature (1)..(768): n is a, c, g, or t
gtgggaactcgaagaacagcctactatacaaacttgcctccaggctcctttaccttcagagtaaaaggaaccaataacgaaggtgtttggagtacgacagatgcttctattgatatttttgtggcaccttttttttatgaaactcaggaattctatttactactaacagctctcctcattctatttataacgtactttatctgggtgcgtagtaaccttttttataagagagaagaggagcttaaaaaagaggtggcaaaccgaactaatgaactcctaaaagaaaaaaacaaaacagaactgcaagcaaaaaaactaaaggaactcgatgtagccaaatcgaagttttttgcaaatgtaagccacgaactccgaactccactcacactcattattggtccattagagcgaatcataaacggggacattcctaaagacagtaagttagaacgggaacaacaaaaaatgatgttgaggaacagcaaaagattgctctcccttatagatcaacttctagaaattgccaaactagaaagtagctcattaaaattacacgccgaagctgttcagattaatcaatacatagaacagattatcaactacttttatactctatgtgaagcaaaacaaatcagcctaacattcactccaaaagctagtccaggcatcgtctatattgacaaagacaagatggaaaagtgctcgggacttaatactaatgcgattaactactccatgctcgagccgatcaactacaacacacactga

SEQ ID NO: 19096 - protein, 255 aa, Unknown
  Obtained from environmental sample
  DOMAIN (112)...(180): His Kinase A (phosphoacceptor) domain
  misc_feature (1)..(255): Xaa is any amino acid
MGTRRTAYYTNLPPGSFTFRVKGTNNEGVWSTTDASIDIFVAPFFYETQEFYLLLTALLILFITYFIWVRSNLFYKREEELKKEVANRTNELLKEKNKTELQAKKLKELDVAKSKFFANVSHELRTPLTLIIGPLERIINGDIPKDSKLEREQQKMMLRNSKRLLSLIDQLLEIAKLESSSLKLHAEAVQINQYIEQIINYFYTLCEAKQISLTFTPKASPGIVYIDKDKMEKCSGLNTNAINYSMLEPINYNTH

SEQ ID NO: 19097 - DNA, 333 bp, Unknown
  Obtained from environmental sample
  misc_feature (1)..(333): n is a, c, g, or t
ttggaccgaagtgatccagactttaatttaagaaatgatccagcaatcattttaagaaaaaagaatgtaaaacatactgtgtatgcaagtgtaattgaacctcacggaagttataatccagtaactgaatcggcaaaaaatgcttatagtttgataaaaacagtacaagtaaccaggtctgatgagaagtatactgcgattaagattgttatgaaaagcggaaaagaaaaatatctactaatttctaatacagatgcttctaaaaaaactacacataatttaaaaatcaatgataagacctttacttggattggcccttatcactttaattaa

SEQ ID NO: 19098 - protein, 110 aa, Unknown
  Obtained from environmental sample
  misc_feature (1)..(110): Xaa is any amino acid
MDRSDPDFNLRNDPAIILRKKNVKHTVYASVIEPHGSYNPVTESAKNAYSLIKTVQVTRSDEKYTAIKIVMKSGKEKYLLISNTDASKKTTHNLKINDKTFTWIGPYHFN

SEQ ID NO: 19099 - DNA, 399 bp, Unknown
  Obtained from environmental sample
  misc_feature (1)..(399): n is a, c, g, or t
atgacaaccgatatgaaagaaaaagggcttcatcccaataataaatttaataaaggatatgactttgatgatttaatcattaaaaatcctttgttaaaagagtttgttactaaaaataaatttgatgcaattacgattgatttttcaaatccaaatgctgtaaaagaattaaacaaagcattattgtttacctatgataaaatttctgcttgggagtttccagacgaaaatttatgtccgccaattcctggacgagtagattatatccatcatttaaatgatttgttaaaagatgagaaagacgtaactgttttagatatcggaactggagcaacgtgtatttatccgctgttaggaaatgcggtttatggttggaattttgtaggaacagacatcgnn

SEQ ID NO: 19100 - protein, 133 aa, Unknown
  Obtained from environmental sample
  DOMAIN (4)...(133): Protein of unknown function (DUF890)
  misc_feature (1)..(133): Xaa is any amino acid
MTTDMKEKGLHPNNKFNKGYDFDDLIIKNPLLKEFVTKNKFDAITIDFSNPNAVKELNKALLFTYDKISAWEFPDENLCPPIPGRVDYIHHLNDLLKDEKDVTVLDIGTGATCIYPLLGNAVYGWNFVGTDIX

SEQ ID NO: 19101 - DNA, 357 bp, Unknown
  Obtained from environmental sample
  misc_feature (1)..(357): n is a, c, g, or t
atggtaacagaagccacaaaaatagaagcagaaatacatggcgatgattgtgtcttcagatatttggacaagattattgtaaaaggcagaacacagcctgttaaaatatttgagatctccgatttacgctctgaggcgagccaagaattattcgactgtattggactctatgagcaaggaatagaggcttatatgaaccaaaactggaacaaggctattgagttgtttaataaatcccttcctctcgagcacaacaaaaataatccttcaaaaatattactcaatcgttgcaaactaatccttgaaaaccctcctaaaaaggattgggatggcgtttttgtgatgaagagtaaatag

SEQ ID NO: 19102 - protein, 118 aa, Unknown
  Obtained from environmental sample
  misc_feature (1)..(118): Xaa is any amino acid
MVTEATKIEAEIHGDDCVFRYLDKIIVKGRTQPVKIFEISDLRSEASQELFDCIGLYEQGIEAYMNQNWNKAIELFNKSLPLEHNKNNPSKILLNRCKLILENPPKKDWDGVFVMKSK

SEQ ID NO: 19103 - DNA, 582 bp, Unknown
  Obtained from environmental sample
  misc_feature (1)..(582): n is a, c, g, or t
ttgaggaaatatacgcctataataggtcttcttcacagagttattctagttgtatggatgagaacctgtttaaatatgtggatattcatcctgaaaaatagatttattccaaacggtgaacttgccgagtctgaaattccagcgtactgtatagattatgaaaaatctataaaaagaaatggtggcatagatattcagatattgggattagggctgaatggccatataggatttaatgagccaggttctaaaaaagaatctcttacccgaaaggtagagctaagtgatagtaccagagttgctgcaaaaaaatattttttaaaaaaagagttagttcctcgttatgcgatttcaatggggcttcaggtaatattagaagctcgagaaattatagttatggcgtggggcgaacaaaaagcagacatagttaaagaatgcatagaaggggaggtaagtagacgaatacctggatctttcttacaaactcattcaaatgttaaagttattcttgatgctgctgcagcgtcaaaactaaataaagaacaaatttctctagtagaaactaatttatccaaaacctaa

SEQ ID NO: 19104 - protein, 193 aa, Unknown
  Obtained from environmental sample
  DOMAIN (1)...(181): Glucosamine-6-phosphate isomerases/6-phosphogluconolactonase
  misc_feature (1)..(193): Xaa is any amino acid
MRKYTPIIGLLHRVILVVWMRTCLNMWIFILKNRFIPNGELAESEIPAYCIDYEKSIKRNGGIDIQILGLGLNGHIGFNEPGSKKESLTRKVELSDSTRVAAKKYFLKKELVPRYAISMGLQVILEAREIIVMAWGEQKADIVKECIEGEVSRRIPGSFLQTHSNVKVILDAAAASKLNKEQISLVETNLSKT

SEQ ID NO: 19105 - DNA, 588 bp, Unknown
  Obtained from environmental sample
  misc_feature (1)..(588): n is a, c, g, or t
atgcatattcccaagcatttcaaaattacagagcaaaaagagattcacgcgtttattaaaagtaacgccttcggccagctcatctccacggtcgacggccgccctttttcgacgcatctgccgttcatatttctcgaaaacgaaggcgtgttgcttggtcacttagggcgcatgaacgaacagttaaccagcttggatggccaagaggtgcttatcaccctgcaaggcccgcatgactatatctctccatcttggtacgccaagcccggcgtacccacgtggaattaccaagcggtacacatttacggaaaatgcctaactttcgacgaaccagagcgactcaaacatatcgttgaaaccctcactcgcacatacgagtctggctatgcagagccatggaagccggactacaaccccgcaatgcttaaggccattatcggcatagaaatcgttatttcagaaattcaatgccagtacaaattaagccaaaacagaggtaaagaagaccaacaacgcgtaattgctacactgaaaaccaaaggcaaacattcgctagcgacagcaatgggaaacgcactctctaaatga

SEQ ID NO: 19106 - protein, 195 aa, Unknown
  Obtained from environmental sample
  DOMAIN (1)...(155): Negative transcriptional regulator
  misc_feature (1)..(195): Xaa is any amino acid
MHIPKHFKITEQKEIHAFIKSNAFGQLISTVDGRPFSTHLPFIFLENEGVLLGHLGRMNEQLTSLDGQEVLITLQGPHDYISPSWYAKPGVPTWNYQAVHIYGKCLTFDEPERLKHIVETLTRTYESGYAEPWKPDYNPAMLKAIIGIEIVISEIQCQYKLSQNRGKEDQQRVIATLKTKGKHSLATAMGNALSK

SEQ ID NO: 19107 - DNA, 417 bp, Unknown
  Obtained from environmental sample
  misc_feature (1)..(417): n is a, c, g, or t
atgaaactccaagaaactttgttgaattccacggacattgaagagaccaaaaatggtcacagccatgaagaaattggcgaaatgcacgtaggaacctcttttgaaacccctttacgacccgacgcattcgaaaaggacgacgacctcaaaatcgaactgattgccaaacatttccgcgaaatcatgaccattctgggcctggacctcgaagacgacagtctgagcgggacccccaaccgcgtcgccaaaatgtatgtcaaagaaattttcagcggactgaacccggacaatgcgccggccatcaaactgtttgaaaacaagtacaagtacaatcagatgttggtggaaaagaacattcctttccattccaactgcgagcaccactttgtaccgatcgtgggctccgagccgatctga

SEQ ID NO: 19108 - protein, 138 aa, Unknown
  Obtained from environmental sample
  misc_feature (1)..(138): Xaa is any amino acid
MKLQETLLNSTDIEETKNGHSHEEIGEMHVGTSFETPLRPDAFEKDDDLKIELIAKHFREIMTILGLDLEDDSLSGTPNRVAKMYVKEIFSGLNPDNAPAIKLFENKYKYNQMLVEKNIPFHSNCEHHFVPIVGSEPI

SEQ ID NO: 19109 - DNA, 600 bp, Unknown
  Obtained from environmental sample
  misc_feature (1)..(600): n is a, c, g, or t
atgaaagcaaccaggaaatacattttctgcattggccttattgttcacatgagcttggtggtaagcggacaatctgtatttccattttctccgatagagcaagaaattttcacgcaagaacgatgtaaaaaactgatttccttctcgcaaacgacggccgactaccagaggcccaaccagaaaaaggcgatccgacgattccaacgaacggtcttttttgattcgcttgggaggccaataaggtccgtcgaggcagacagcaatcagtggaaaaacggcagctatgaaaaaacctggtcttatggggaggacggttgcattcagcttgcagaaaacgactcactatatcgaattcattgcaaagacggaatggtagattcgacgtttacttacctcagcacattcggtaagcccaaacgcctcaacaatgcaactctgattgaatgggagaatggcaaaagaaaatctgaaacaacgatcagcggcgctccgaaacatgtaggggacccatcgagggtagcctatacgcactatttttatgacgaggtggcaatctgtttcgcattcaaggtaaattctcgaccgatcttgatccactag

SEQ ID NO: 19110 - protein, 199 aa, Unknown
  Obtained from environmental sample
  misc_feature (1)..(199): Xaa is any amino acid
MKATRKYIFCIGLIVHMSLVVSGQSVFPFSPIEQEIFTQERCKKLISFSQTTADYQRPNQKKAIRRFQRTVFFDSLGRPIRSVEADSNQWKNGSYEKTWSYGEDGCIQLAENDSLYRIHCKDGMVDSTFTYLSTFGKPKRLNNATLIEWENGKRKSETTISGAPKHVGDPSRVAYTHYFYDEVAICFAFKVNSRPILIH

SEQ ID NO: 19111 - DNA, 411 bp, Unknown
  Obtained from environmental sample
  misc_feature (1)..(411): n is a, c, g, or t
ttgcaaatgcctggtttgaatttgttatttaaaaatccgaaatcaaaaacncagaacaataaaactgatttttcattagcattaacggaaccacttaatcatcagaaatatatgatggtacagcaagcaaaactattagattctgctttgtattggtatgctattcctccttttattatgaattttatattcattatagggttagaaaacccaactgattataattggactaatagtatagcagaaagcttattaccacttacttctaatttaaaaacaataacattaataggtttagtattgttttatgcatttactttttgggtaaataaaagagcattaaacaaggatgtaaatcctataataaagagcattgaaaaaatgcagaaacaaataaaaaaacaatcatga

SEQ ID NO: 19112 - protein, 136 aa, Unknown
  Obtained from environmental sample
  misc_feature (1)..(136): Xaa is any amino acid
MQMPGLNLLFKNPKSKTQNNKTDFSLALTEPLNHQKYMMVQQAKLLDSALYWYAIPPFIMNFIFIIGLENPTDYNWTNSIAESLLPLTSNLKTITLIGLVLFYAFTFWVNKRALNKDVNPIIKSIEKMQKQIKKQS

SEQ ID NO: 19113 - DNA, 471 bp, Unknown
  Obtained from environmental sample
  misc_feature (1)..(471): n is a, c, g, or t
atgggaaaacaaaacgatgatatattttttgaagaaattcttgaaaggaataagtataaaatatacaggatttgtagtatttatgctgtttctccaatagaaccacaagacctttttcaagaagttatttttgaaatttggaaatctcttaaaaacttcaaaggtaaatcatcgattgatacgtggatatacaaaattactgttaaggtttgtttgcgtaaaaaaatgaaatttgataaaagcaatagcaaaacagaccgatttgaatctattcattttatacccatagaaaaagaaattgacacttctgaacaagaaaaatttaaatatttaaaagaatgtatttcaacattaaatgaaatggacacttcacttatgtgtctttatttagatgatttatcctatagagacattgcagaaattacgggattatcagaaaatcatatcgcttgtaaaatggaagcgaattaa

SEQ ID NO: 19114 - protein, 156 aa, Unknown
  Obtained from environmental sample
  DOMAIN (13)...(78): Sigma-70 region 2
  misc_feature (1)..(156): Xaa is any amino acid
MGKQNDDIFFEEILERNKYKIYRICSIYAVSPIEPQDLFQEVIFEIWKSLKNFKGKSSIDTWIYKITVKVCLRKKMKFDKSNSKTDRFESIHFIPIEKEIDTSEQEKFKYLKECISTLNEMDTSLMCLYLDDLSYRDIAEITGLSENHIACKMEAN

SEQ ID NO: 19115 - DNA, 381 bp, Unknown
  Obtained from environmental sample
  misc_feature (1)..(381): n is a, c, g, or t
atgcagcaagacatttcttctagagaagatattcattttattatcacagaattttataaaaaattaatttctgattcagaaatgcttcccttttttgaggagatagtgcgacaaaatcatttagagaaacacatcaatattattacagatttttggcaagatattttgttgcaaacagattcttacaagaataatgttttacaaaagcatttagattttgataaaaaagttcgatttaagaaagaacatttcacgaaatggttgggctatttaacaactataattgacgcttcttttgaaggtcaggttgctcaaaacatgaaagacagagcaaattctattgtaatggtgttacaagtcaaatttaaactttacgattag

SEQ ID NO: 19116 - protein, 126 aa, Unknown
  Obtained from environmental sample
  misc_feature (1)..(126): Xaa is any amino acid
MQQDISSREDIHFIITEFYKKLISDSEMLPFFEEIVRQNHLEKHINIITDFWQDILLQTDSYKNNVLQKHLDFDKKVRFKKEHFTKWLGYLTTIIDASFEGQVAQNMKDRANSIVMVLQVKFKLYD

SEQ ID NO: 19117 - DNA, 615 bp, Unknown
  Obtained from environmental sample
  misc_feature (1)..(615): n is a, c, g, or t
gtgatactattttgcattgcgcaaaaatatgtatctttattgagcttatttaaattaagtattaaaatgtttacatcgccctttaaaaatattacagcaaaaaccgaaagaaaactaacatatagtcttttgtatcttttcataataagcgctgttgttttaaagtattttaatatttatttagacacggtttctgcaccttacggaattttctcttttgagttggcaggaaatctagataaatctatggaaatcatcaactcctggtctccattagcaaaaacatttgctggtttaaatttgggctatgattttcttttcttactaatttatacgttgtttatttcacttttaattcacaaagtaaacgagcgtttatgggttggtaaaaaattttataaaataggagaacttttaatttggtcaatgtttgttacagctatttttgatgctggtgaaaacgcagcgttgataaaactactaataggaagctacaaagaatattggtcatctactgcgtatatttttgcacttgcaaagtttattttgattggtgtttctgttttataccttatttacaacactgtgatattacttttcaagaaatcttcttaa

SEQ ID NO: 19118 - protein, 204 aa, Unknown
  Obtained from environmental sample
  misc_feature (1)..(204): Xaa is any amino acid
MILFCIAQKYVSLLSLFKLSIKMFTSPFKNITAKTERKLTYSLLYLFIISAVVLKYFNIYLDTVSAPYGIFSFELAGNLDKSMEIINSWSPLAKTFAGLNLGYDFLFLLIYTLFISLLIHKVNERLWVGKKFYKIGELLIWSMFVTAIFDAGENAALIKLLIGSYKEYWSSTAYIFALAKFILIGVSVLYLIYNTVILLFKKSS

SEQ ID NO: 19119 - DNA, 783 bp, Unknown
  Obtained from environmental sample
  misc_feature (1)..(783): n is a, c, g, or t
atgaagttgaataaacatttatttctgtccatgaaataccaacgaatagtcagcctagtaccaagtcttactcaactagttcttgatctgggccttggagatcgcctaattggtcgtacgcgattttgcattcatcctaaagttagagttaaagacattccaattattggaggtacaaagactccaaatattgaaagaattctcggaatgaagcccgattatatcatcgcaaatcacgaagaaaatcgaaaggatgatattgaaatccttcaaaaagaagtctccgttaacatcactgaaattaacaccattaatgatgccataaatacgatttgtgaactcggtggagactttgaactagctaaaccagcgcaaaaattagtcgataaaattttagttcttcttactgaaactaatgaaaacactcctgtttctgctgcttacttcatttggaaggatccttggatggttgccgctaaagaatcatatatcgatgctgtgctctctcattataaacttgaaaatatattctctgaccagcaacgatatccccaaatttctttagatgagttaagtaaaagatcaccccaagtagtcttactaagtagcgaaccttatccatttaagggaaagcatataaaagagattcaagaggcttgccctaattctcatatccaattaataaacggagagtggtttagctggtatggttcgggaatgctaaacgcatttacagagctgaataaatggcgaaagacaatttctattcattcagctccgtaa

SEQ ID NO: 19120 - protein, 260 aa, Unknown
  Obtained from environmental sample
  DOMAIN (13)...(260): Periplasmic binding protein
  misc_feature (1)..(260): Xaa is any amino acid
MKLNKHLFLSMKYQRIVSLVPSLTQLVLDLGLGDRLIGRTRFCIHPKVRVKDIPIIGGTKTPNIERILGMKPDYIIANHEENRKDDIEILQKEVSVNITEINTINDAINTICELGGDFELAKPAQKLVDKILVLLTETNENTPVSAAYFIWKDPWMVAAKESYIDAVLSHYKLENIFSDQQRYPQISLDELSKRSPQVVLLSSEPYPFKGKHIKEIQEACPNSHIQLINGEWFSWYGSGMLNAFTELNKWRKTISIHSAP

SEQ ID NO: 19121 - DNA, 666 bp, Unknown
  Obtained from environmental sample
  misc_feature (1)..(666): n is a, c, g, or t
atgaaaagaggattagtatcagtaattacccctgtttataacggcgaaatttttttagataggagtatcaaaagtgttttggctcagagctatacaaattgggaattaatacttattgacgatggctccgaggataattcgattcaggtaattaaaagttatgctgatgatgcaagaataaaactggtaaagaatgaaaataattttggtattcccacgacaagaaataaaggcatagcacaggctaaaggggaatatatagcattacttgatcaagatgatgagtggttacctgagaagcttgaaaagcaagtaaatgaatttgagaaattaaatcgaactttcggccttgtttactcgaacttggaggtgagaatagataatggaaaattatataaacagaaaatagatattaaaccggatttagataggcaaaagaatttggaattaatgttactaaagaacttaataagttctccaactgtattgataagggcggaagttttgcaagatgttggaaaatttgacacaacgattctttggggaggagacgattatgatctctggataagaattgccaagaaatataaattcttttttttagatgatgtgtcatgcattcggtatgagcatcaaaaaaattatagtgctgataaaaagagatga

SEQ ID NO: 19122 - protein, 221 aa, Unknown
  Obtained from environmental sample
  DOMAIN (7)...(173): Glycosyl transferase
  misc_feature (1)..(221): Xaa is any amino acid
MKRGLVSVITPVYNGEIFLDRSIKSVLAQSYTNWELILIDDGSEDNSIQVIKSYADDARIKLVKNENNFGIPTTRNKGIAQAKGEYIALLDQDDEWLPEKLEKQVNEFEKLNRTFGLVYSNLEVRIDNGKLYKQKIDIKPDLDRQKNLELMLLKNLISSPTVLIRAEVLQDVGKFDTTILWGGDDYDLWIRIAKKYKFFFLDDVSCIRYEHQKNYSADKKR

SEQ ID NO: 19123 - DNA, 522 bp, Unknown
  Obtained from environmental sample
  misc_feature (1)..(522): n is a, c, g, or t
atggacgatgatacagttctaaggtttaacgacccaagaagatttggttgtgtgctcgatagtgaagattacttgaatcacaagttaataaaaaatctgggtccagagcctttaaataatgaatttgatggcaaatatttaaagaaaaaatcaataaacaaaacccaagcgattaaaaattttattatggatggtcgtattgttgttggtgttggtaatatttatgcgagtgaatcattatttcttgcaggaattcatcccaacaaatcagcaggtaaggtttcgttgaaaaaatatactattctagcagaagtaataaaaaaggtactatttttagcgattcaagccggtgggactacattaaaggactttatcaatgcagaaggaaaacctggttatttttcacaagatttaaaagtatatggtagaaaaaatttgccctgtgttaattgcggtcaaaatatcttacaaaaaaccattggtcaacgcagcactttttattgtggatattgccaaaaataa

SEQ ID NO: 19124 - protein, 173 aa, Unknown
  Obtained from environmental sample
  DOMAIN (33)...(125): Formamidopyrimidine-DNA glycosylase H2TH domain
  misc_feature (1)..(173): Xaa is any amino acid
MDDDTVLRFNDPRRFGCVLDSEDYLNHKLIKNLGPEPLNNEFDGKYLKKKSINKTQAIKNFIMDGRIVVGVGNIYASESLFLAGIHPNKSAGKVSLKKYTILAEVIKKVLFLAIQAGGTTLKDFINAEGKPGYFSQDLKVYGRKNLPCVNCGQNILQKTIGQRSTFYCGYCQK

SEQ ID NO: 19125 - DNA, 417 bp, Unknown
  Obtained from environmental sample
  misc_feature (1)..(417): n is a, c, g, or t
atgatgatcgggaaatgcagattcaatgttataatgacaaaaagtaaacgaatcaaatccgtttcgtcaaccacgcaagattctcccacatttgaaacactccataggactttgctggacaatcgatcaagattcaattatctgagaaagaaacccttcgaaaacgagacacaatcgttcatattccaaaatgtcataccattactgcaatctcaagaaatattcattacgcaaatcatctcctcagaataccaggagcaattcacttttgaaagtgatgaagggtattgtatttgtggctttaactacgacgcgaaaggcttcatctcgactgtattagctattaaaaccaactcgaaagcactttgcgagaaggtgaaggatattgcattgactcttaaaaaaactcaaagctga

SEQ ID NO: 19126 - protein, 138 aa, Unknown
  Obtained from environmental sample
  misc_feature (1)..(138): Xaa is any amino acid
MMIGKCRFNVIMTKSKRIKSVSSTTQDSPTFETLHRTLLDNRSRFNYLRKKPFENETQSFIFQNVIPLLQSQEIFITQIISSEYQEQFTFESDEGYCICGFNYDAKGFISTVLAIKTNSKALCEKVKDIALTLKKTQS

SEQ ID NO: 19127 - DNA, 894 bp, Unknown
  Obtained from environmental sample
  misc_feature (1)..(894): n is a, c, g, or t
atggaattcttggctcagcggattagacgaattctcagcaccaatcgtatctttcgaatgaaaggcacaaccattaacttcagttttcgttataaaattatgaacaaaacttactatttaccattcccaatgaaaaaactttactctaccctggttctgatcctcactttttcgattttggtttcatcttgtggagaggcagaccccaatgccggttttcctttggacaagcaatactggaatccggatgattacacttccgtcattcacaagatcaactatgaaactccggaaggagcggaatacccccgatttgatgacccgacgacaagtcccatcatcaaaaagatgaccgaccatgagaattacaaagtgatcctggaggacaaagaacgtggcgtgaaaaacagaaatgagatttctgatttgttcatgaccaattacaaaaacatgtatacactttattcccggcaggatgttcaggacaagtttatctattcggaagaattggtcgccatagaacatttcggcttgggccttcagttgctttatttcggccttggaaatgaggctctgctggaggaggcagatgacccggaatccccccgcgtacagaacatcgtataccgaaacatcaatgccctaattgggaactacaaccagtacctggattatatggacgatgaaagtgctttgagcgatgaggcgattgattcctacgtcaaaggcatggacacctatttcactcgcctttacaaaaaatacccggatgccgattatgcccggaccatctcgaaggcgaccctgatgctcaaaaaggccaaatcagacaaagtcaaatctgcactgacccgtttgattaagttgtttcgccaccggagcggctgcacatag

SEQ ID NO: 19128 - protein, 297 aa, Unknown
  Obtained from environmental sample
  misc_feature (1)..(297): Xaa is any amino acid
MEFLAQRIRRILSTNRIFRMKGTTINFSFRYKIMNKTYYLPFPMKKLYSTLVLILTFSILVSSCGEADPNAGFPLDKQYWNPDDYTSVIHKINYETPEGAEYPRFDDPTTSPIIKKMTDHENYKVILEDKERGVKNRNEISDLFMTNYKNMYTLYSRQDVQDKFIYSEELVAIEHFGLGLQLLYFGLGNEALLEEADDPESPRVQNIVYRNINALIGNYNQYLDYMDDESALSDEAIDSYVKGMDTYFTRLYKKYPDADYARTISKATLMLKKAKSDKVKSALTRLIKLFRHRSGCT

SEQ ID NO: 19129 - DNA, 720 bp, Unknown
  Obtained from environmental sample
  misc_feature (1)..(720): n is a, c, g, or t
ttggttcgaaaaaatcaggaattgagagtgatttcgcttgattcatataaaaatagaatcattttagtgtcgcaaaagttcaaggagttcttcacggacttgaacaaataccattccgaagctctggttttggacctgatcattaatgtctacaaattcgcaaaaccgctgattcaaagccttatcaaggaagcggtagaaagcatcaaaaggattttgatcgaacagctcaaaagcctgaaacttacgcccatttcctgggaggaagctgaagccgtagttggttcgaagcaatcacccgctagcagagatgaagtaagtgcaaaggtaggactcaaacccaatcggcattatcaaaacttaggactggagcctggtgcagaccagaataccattaattccgcatgcaagtcactccaagaggaataccggattgaaattgaacgtacgagcaatccggaaatcaaagaatttttctccgaactgatagaaaaaaccaaaatggcgaagcaatactttgatgaaaacccgcctcgtaaaccggtggcaatagttgttgaatcgatagcggaacccaatcacaaaaatgttggctctccggggcagggaggaggttgtgtagaactcaaagcaaagatggaaggattgttgctgggggctcaatacatggataaagaccaaatcattgccgaaatgcaaaaactgattgataattactga

SEQ ID NO: 19130 - protein, 239 aa, Unknown
  Obtained from environmental sample
  misc_feature (1)..(239): Xaa is any amino acid
MVRKNQELRVISLDSYKNRIILVSQKFKEFFTDLNKYHSEALVLDLIINVYKFAKPLIQSLIKEAVESIKRILIEQLKSLKLTPISWEEAEAVVGSKQSPASRDEVSAKVGLKPNRHYQNLGLEPGADQNTINSACKSLQEEYRIEIERTSNPEIKEFFSELIEKTKMAKQYFDENPPRKPVAIVVESIAEPNHKNVGSPGQGGGCVELKAKMEGLLLGAQYMDKDQIIAEMQKLIDNY

SEQ ID NO: 19131 - DNA, 471 bp, Unknown
  Obtained from environmental sample
  misc_feature (1)..(471): n is a, c, g, or t
atgaagaagtttctactaattgaagacagcccaataatcgtcaagatcattaagcacttatgcaagaatgaccctgaacttcagtgcgacacagctgccacattcagcgaagcgaaagccatcattgctaaaaatggtgccgatcactatttagtcgctgtagttgacttaaacctgccagatgctcctgatggcgaagtcgtcgacttcactatcgaacaaaacattcccacgattgtcatgaccggtaattttgacgacaccgtccgacagaaaatgcaggaaaagaaaatcgtcgactacgtcacaaaagaaagccgttactcttatgagtatgtcatcaagcagattaaacggctcgacaaaaaccaaaacatcaaaattttggtagcagacgactcaaaaacatctcgcaactacgttaagggcctgctctctgtccagcagttaacaagtaatgactgccgatga

SEQ ID NO: 19132 - protein, 156 aa, Unknown
  Obtained from environmental sample
  DOMAIN (2)...(121): Response regulator receiver domain
  misc_feature (1)..(156): Xaa is any amino acid
MKKFLLIEDSPIIVKIIKHLCKNDPELQCDTAATFSEAKAIIAKNGADHYLVAVVDLNLPDAPDGEVVDFTIEQNIPTIVMTGNFDDTVRQKMQEKKIVDYVTKESRYSYEYVIKQIKRLDKNQNIKILVADDSKTSRNYVKGLLSVQQLTSNDCR

SEQ ID NO: 19133 - DNA, 477 bp, Unknown
  Obtained from environmental sample
  misc_feature (1)..(477): n is a, c, g, or t
atgcaaatcaaaaaaatggaaacaatcataaaatataatttgcctgtggaaggcatgacttgcgcaagttgcgtggcacgtgtagaaaaggcactaaataaaatagatggaattgataatgtttcagttaattatgcaaacgaaaaggtttcatttgaaattgatgaaagcttagatattgaaatagcaaagcaagcagttgataattttgggtacaaacttaaaatagaaaaactgaaagttaaatctgttgaagaaagtgaagaaaaccaaattgatgaacaatacgaaaaattaacgaaagatttacttttatccgctttgttttcacttccaattttcttaattagtatgactcgcgaatttgcatggttcacttctgtttggcctttggatgctgattacacaaataaaatattactaattctaacaacaccaataatttttatttcgggcaaacggttttacaaaatccna

SEQ ID NO: 19134 - protein, 159 aa, Unknown
  Obtained from environmental sample
  DOMAIN (13)...(76): Heavy-metal-associated domain
  misc_feature (1)..(159): Xaa is any amino acid
MQIKKMETIIKYNLPVEGMTCASCVARVEKALNKIDGIDNVSVNYANEKVSFEIDESLDIEIAKQAVDNFGYKLKIEKLKVKSVEESEENQIDEQYEKLTKDLLLSALFSLPIFLISMTREFAWFTSVWPLDADYTNKILLILTTPIIFISGKRFYKIX

SEQ ID NO: 19135 - DNA, 318 bp, Unknown
  Obtained from environmental sample
  misc_feature (1)..(318): n is a, c, g, or t
atggaaaatcaacaatcagaaacgcaactgtctcctaaaaaaggaatattgagaaggtttttaagatttccaggggtagtgaaatcggtggttattcttattgtcttggtattggctattctgatattaaccaatccatcgatgggtcaatttaaggagttcattccttccactattaacgataacaaaatcgtgtggaaaaaaatgaaattaagtaggaaaagaaactggcttttattctcaatctatgaatatcaatatgattttcattatgaaagagaatattgggcggttttcaataattttttcaaaaagtga

SEQ ID NO: 19136 - protein, 105 aa, Unknown
  Obtained from environmental sample
  misc_feature (1)..(105): Xaa is any amino acid
MENQQSETQLSPKKGILRRFLRFPGVVKSVVILIVLVLAILILTNPSMGQFKEFIPSTINDNKIVWKKMKLSRKRNWLLFSIYEYQYDFHYEREYWAVFNNFFKK

SEQ ID NO: 19137 - DNA, 726 bp, Unknown
  Obtained from environmental sample
  misc_feature (1)..(726): n is a, c, g, or t
atgcactctaaacaaaaaaaacctttctacattcgcacactaattaattcaagtttagtttttctaagtatccttattactctcttatttgttgagttttccttacgtatttttctcccccaagatagaatggttacttggcttgagatgcatgataaaggctttatgatgaaccaagtaaatggaacttcatttcaagaacttgattcaagagttgctaactatacctttactgagcaacgattaagagactcaaagaaaaaccgaacaaccgagcaaagaattttagctattggcgattcatttacttttggtttattgctggatgaagaaaacacttatatccacctccttaaccagaagcttttaaaatctgaaaatgattcaaccttcattctaaacggaggcgttggcggggctgggttagctgattggccactttggatagagacttttggacaaaacattaagcccgacaaaattatttattttttgaatgtacatgatatcgaccgctctttatcaaagaatttattcgtattgaaaaacgattcactcattcaatctaagcggtgggaaccccaacaattcatgttcagccttgggaaaaaagattggtatcgttggctccaagcacattctcatctcgccaatatcattgttaaggctttgtggaaaaatgtatatctcgacgatgtgacaaaaacttcgatcctaaaaaagtag

SEQ ID NO: 19138 - protein, 241 aa, Unknown
  Obtained from environmental sample
  misc_feature (1)..(241): Xaa is any amino acid
MHSKQKKPFYIRTLINSSLVFLSILITLLFVEFSLRIFLPQDRMVTWLEMHDKGFMMNQVNGTSFQELDSRVANYTFTEQRLRDSKKNRTTEQRILAIGDSFTFGLLLDEENTYIHLLNQKLLKSENDSTFILNGGVGGAGLADWPLWIETFGQNIKPDKIIYFLNVHDIDRSLSKNLFVLKNDSLIQSKRWEPQQFMFSLGKKDWYRWLQAHSHLANIIVKALWKNVYLDDVTKTSILKK

SEQ ID NO: 19139 - DNA, 681 bp, Unknown
  Obtained from environmental sample
  misc_feature (1)..(681): n is a, c, g, or t
gtggtgatactattttgtacacacacgaaggcgaacctattgttgcgaaaactcctggacagaaacgaatcgttatttcctcccgaaaaacacgacatcgttttttctattggtccagctggaacaggtaaaacatacacttctgtggctcttgctgttaaagctttaaaagaacgtcgagttaaaaagatcatacttgctcgccctgccgttgaagcaggtgaaaatctcggatttcttcctggcgacttaaaagaaaaaatagatccatatcttcgtccgctttatgatgcgctcgaagacatgattgaacctgataaattggaactctacttaaaaaagaatgtgattgaaatcgcacccttggcttacatgcgaggtagaactctcaataatgcttttgtaattctagatgaagcccaaaatgcaacgaattcgcaaatgaagatgtttctaacgcgtataggattccatagtagagctattattacaggcgatatcacccaaaccgatttaccaagaaaacttgaatctggattaatctctattcagtatattttgaaggacgtacaaggtatcgactttgtataccttcatgaagaagatgtggtgcgccataaactagttcgagatatcattaatgcttacgagaaatacgaagaaagtagagacaaaaaatag

SEQ ID NO: 19140 - protein, 226 aa, Unknown
  Obtained from environmental sample
  DOMAIN (13)...(217): PhoH-like protein
  misc_feature (1)..(226): Xaa is any amino acid
MVILFCTHTKANLLLRKLLDRNESLFPPEKHDIVFSIGPAGTGKTYTSVALAVKALKERRVKKIILARPAVEAGENLGFLPGDLKEKIDPYLRPLYDALEDMIEPDKLELYLKKNVIEIAPLAYMRGRTLNNAFVILDEAQNATNSQMKMFLTRIGFHSRAIITGDITQTDLPRKLESGLISIQYILKDVQGIDFVYLHEEDVVRHKLVRDIINAYEKYEESRDKK

SEQ ID NO: 19141 - DNA, 303 bp, Unknown
  Obtained from environmental sample
  misc_feature (1)..(303): n is a, c, g, or t
atgataaaaatttctatcattccttttgaagaaaaatttgccaagaatttttatgatttaaatgtagagtggctgcaaaaacacttctatgtagaaccttatgatgaaaaagttttgagcaatccaaaaacgcatatcattgataaaggcggttttattttttttgcaacttacaaaaatgaaattgtaggtactgttgcattaatcaacgagaaagaatgttttgaattgagtaaaatggcagttttaccaaaatatcacggacagagaattgacaacaaatcattctcggccgattcttga

SEQ ID NO: 19142 - protein, 100 aa, Unknown
  Obtained from environmental sample
  misc_feature (1)..(100): Xaa is any amino acid
MIKISIIPFEEKFAKNFYDLNVEWLQKHFYVEPYDEKVLSNPKTHIIDKGGFIFFATYKNEIVGTVALINEKECFELSKMAVLPKYHGQRIDNKSFSADS

SEQ ID NO: 19143 - DNA, 369 bp, Unknown
  Obtained from environmental sample
  misc_feature (1)..(369): n is a, c, g, or t
atgaaaaaaaaccaattatcattccttttattagtttttcttattagcaatactattcttgcccaagaagtaactgaagtacacaaagattcaataaacacgatactaaccaagtattacaatctcaacctaaaaatgtttcaagaaggttctacagttgaagatattgataacacattcaatctatttactgatgattttacttatacacattcaaaatttaatgggttttatacctgtgagagcttatataaaagtgctttaaggaacctaaatgaaggcaattacgatgggagagttacagattttaaaatagaaagtaaaataataggtttaaaagcggctgctgttcaaaaaagatttgcgtaa

SEQ ID NO: 19144 - protein, 122 aa, Unknown
  Obtained from environmental sample
  SIGNAL (1)...(18)
  misc_feature (1)..(122): Xaa is any amino acid
MKKNQLSFLLLVFLISNTILAQEVTEVHKDSINTILTKYYNLNLKMFQEGSTVEDIDNTFNLFTDDFTYTHSKFNGFYTCESLYKSALRNLNEGNYDGRVTDFKIESKIIGLKAAAVQKRFA

SEQ ID NO: 19145 - DNA, 678 bp, Unknown
  Obtained from environmental sample
  misc_feature (1)..(678): n is a, c, g, or t
atggaaccagcaatcgatgaaattaacgaatcgaaagcacgaaatatgttatacgcaatgggcgtaaatgaaaatgatgaaactagtgcaatctttgtttctaaaaataaagtagcagatgtatgttctaaatatattaaggagcaattggttttagttactgaaaacggaaaagttgttaagcaactaaaccgtaaagaatatatggctgaaaacaatatacaagaaccctatttgattgatgttaagaagctacaatcattagagaaagaaggcaaacaaagaaaacttcctttatttgttggagaaaaagaggggaacacattgtacatcgctccaattagaggaaaaggactttgggatgctatttggggatatgtagctatggacaaaaacatggttgtacaaggtgtttattttgatcataaaggagaaactccaggtttgggagcaaacattaaacaacgtttctttatggatgattttactggagaacaaatgatgcacaacgacgcatttaaaggaattcaagttgcaaaaggaaataacgatccaaaaaatatagataaaacggataatgaagttgatgctattgcaggagcaacgattactggtgatggagtttcagctatgatcaaatcagagttgaaaaatacgtaccattctttaacactttaa

SEQ ID NO: 19146 - protein, 225 aa, Unknown
  Obtained from environmental sample
  DOMAIN (112)...(219): FMN-binding domain
  misc_feature (1)..(225): Xaa is any amino acid
MEPAIDEINESKARNMLYAMGVNENDETSAIFVSKNKVADVCSKYIKEQLVLVTENGKVVKQLNRKEYMAENNIQEPYLIDVKKLQSLEKEGKQRKLPLFVGEKEGNTLYIAPIRGKGLWDAIWGYVAMDKNMVVQGVYFDHKGETPGLGANIKQRFFMDDFTGEQMMHNDAFKGIQVAKGNNDPKNIDKTDNEVDAIAGATITGDGVSAMIKSELKNTYHSLTL

SEQ ID NO: 19147 - DNA, 435 bp, Unknown
  Obtained from environmental sample
  misc_feature (1)..(435): n is a, c, g, or t
atgggcgcggttataggtggaatttatgcagcaggacattttcaagattataaaaactggattctgaagcttagcagaaaagatgtttccgatttaatggatttcacactcaccaaacaaggttttgtaaagggagataagatttttgctaagcataaagatttattaggaaccttgaacatcgaggattttgcaataccttttactgctgttgctaccgatatgaagaataccgacgacgttcacttcacaaaaggggatttatacaaagcattaagagcatcaggatccattccgggtttatatattccttcagtacaagatggacgtagtatgggtagatggtggagtattgaatcctcttccaataactttagtgaacaaacaagaagatgctattattgtagcagtggatctgaatgcgaaatccgataa

SEQ ID NO: 19148 - protein, 144 aa, Unknown
  Obtained from environmental sample
  DOMAIN (1)...(130): Patatin-like phospholipase
  misc_feature (1)..(144): Xaa is any amino acid
MGAVIGGIYAAGHFQDYKNWILKLSRKDVSDLMDFTLTKQGFVKGDKIFAKHKDLLGTLNIEDFAIPFTAVATDMKNTDDVHFTKGDLYKALRASGSIPGLYIPSVQDGRSMGRWWSIESSSNNFSEQTRRCYYCSSGSECEIR

SEQ ID NO: 19149 - DNA, 747 bp, Unknown
  Obtained from environmental sample
  misc_feature (1)..(747): n is a, c, g, or t
ttggtaaatgaaaggactaatgaaattgacgagcaaaatagaaagctcaatatttataaccaaaacttgaaagaacaaaaggaagctttagaaacggcactaaatgccctagaaaaaactcagtttaagttagttcaatcagaaaaaatggcagcattaggtgtgcttaccgctggggttgcccatgaaatcaataacccgatgaattacataaaatcgggagcagaaatcttaaaaatgatttcaaaaattgaaaataatgaagtgcttattaaagataaagacacctatgaacaggtgatggatggcattaatattggagtggagcgaatcgttaatatcactaagagtttaggctcctttagtagaaaggatgatagaatagattcgaaagtggatatcaataaggttcttaaagatagtgttactattctacatcacgagtataaagaacgtattcaaattctgttcaactttgaaaacgaacatttgtacgcatctggtaatgaaagtaaattataccaagtatttacgaatctgttgataaatgctatacactcaatagagcacgaaggtacgataaaaatagaaaccaaaacttcggaagataaagctctaattgttattacagatacggggcatggtattcctgaagaggtactgagtaaaatttacgatccttttttacaacaaaggaagcgggaaaggcactggcttagggctttctatagtctattatattattga

SEQ ID NO: 19150 - protein, 248 aa, Unknown
  Obtained from environmental sample
  DOMAIN (52)...(127): His Kinase A (phosphoacceptor) domain
  misc_feature (1)..(248): Xaa is any amino acid
MVNERTNEIDEQNRKLNIYNQNLKEQKEALETALNALEKTQFKLVQSEKMAALGVLTAGVAHEINNPMNYIKSGAEILKMISKIENNEVLIKDKDTYEQVMDGINIGVERIVNITKSLGSFSRKDDRIDSKVDINKVLKDSVTILHHEYKERIQILFNFENEHLYASGNESKLYQVFTNLLINAIHSIEHEGTIKIETKTSEDKALIVITDTGHGIPEEVLSKIYDPFLQQRKRERHWLRAFYSLLYY

SEQ ID NO: 19151 - DNA, 564 bp, Unknown
  Obtained from environmental sample
  misc_feature (1)..(564): n is a, c, g, or t
ttgataattcgccccacggtagtatttggtcctcataatttcggaaatttatttaatctgacaagaaatattaacagaggtgtgaattttcatataggtgacaagtcggtaataaagtctgttgcttatgtagagaatttagttgaagctactcattttctaattcagaatatgaagagcaaatgtgaaatttataactatgttgatgagcctcaattaacgaattttgaaatttccaatcagataagtactgttttagggagaggtaaaagctttagaattccatacccaatagctttgtttctaggctcaattttcgatgtcgcaagtaaattctttggtaaagaatttatggtttcggtgaagagggtaaaaaagttttgtacacccactcactttgaggcaaacaaagttttggaagctggcttcaaaccacgttttacaactaggagtgggttggaaaaaacaacgaattggtttgttgagagtagagacgtttgggaaaaagaatatgagttgcttaaagcactgtttaagtccaattatgatataactattgaatga

SEQ ID NO: 19152 - protein, 187 aa, Unknown
  Obtained from environmental sample
  misc_feature (1)..(187): Xaa is any amino acid
MIIRPTVVFGPHNFGNLFNLTRNINRGVNFHIGDKSVIKSVAYVENLVEATHFLIQNMKSKCEIYNYVDEPQLTNFEISNQISTVLGRGKSFRIPYPIALFLGSIFDVASKFFGKEFMVSVKRVKKFCTPTHFEANKVLEAGFKPRFTTRSGLEKTTNWFVESRDVWEKEYELLKALFKSNYDITIE

SEQ ID NO: 19153 - DNA, 354 bp, Unknown
  Obtained from environmental sample
  misc_feature (1)..(354): n is a, c, g, or t
atgaacaccgcagaaaaaccaaataaattcattcctgccctaggttatagttggcttactagcttttatgatctgaccattaagataaccatgcctgagaaaaaattcaggacacgccttataaatttgcttgaacctaagaaaaaggaaattattttggaatttggtttcggaactggtcaaaacctgattttggctcaccaatacaactcagcggcaagttaccggggactcgatattgacccaaaagtgaaaagtattgcagaacgaaagctaggggaactgaacaaaaggattaccctcgacttatataacggggggcaattcccctacccagattcgtcatttgacant

SEQ ID NO: 19154 - protein, 118 aa, Unknown
  Obtained from environmental sample
  misc_feature (1)..(118): Xaa is any amino acid
MNTAEKPNKFIPALGYSWLTSFYDLTIKITMPEKKFRTRLINLLEPKKKEIILEFGFGTGQNLILAHQYNSAASYRGLDIDPKVKSIAERKLGELNKRITLDLYNGGQFPYPDSSFDX

SEQ ID NO: 19155 - DNA, 780 bp, Unknown
  Obtained from environmental sample
  misc_feature (1)..(780): n is a, c, g, or t
gtgataaaatttataggaatgaaaaaaagaatgaatatacgtttgctaattattttagcagttctaactgttttgtcatgcgaagataaatcaacttctaaaacaaattcaaattctcaattacaacatcctaatttaatattatcagttaaaggggttgaaaaaataaaaaaaagcttaggctcaataccaatttttgacaaaactttagcagaaacaaaaaagcaagttgatgcagaaattgcattaggaattcaagttccgatgccaaaagatatggctggcggatatacacatacacagcacaaaaaaaactatgctacgatgcaaaaagcgggtgtgttatttcagattttaggagatgaaaagtatgccgtttttattaagaaaatgctgtatgaatatgcaaagttgtacccaacttttgatagacatccacaaacaagatcttatgcaagaggtaagtttttttggcaatgtttaaacgattcaaattggttggtatatacaagtcaagcgtatgattgcatttacgattggttatcaaaagatgaacaaaattatttaaatgcaaacttatttaaaccctatgcagattttttatccgtagaaacacctcagttttttaatagaattcacaatcatagtacttggggaaatgttgctgttggtatgattgggttagtgatgaatgatgacgagcttgttaatagaagcttatatggattaaaaatagatactattcacgaagatgccagagataatgatggtggtttataa

SEQ ID NO: 19156 - protein, 259 aa, Unknown
  Obtained from environmental sample
  misc_feature (1)..(259): Xaa is any amino acid
MIKFIGMKKRMNIRLLIILAVLTVLSCEDKSTSKTNSNSQLQHPNLILSVKGVEKIKKSLGSIPIFDKTLAETKKQVDAEIALGIQVPMPKDMAGGYTHTQHKKNYATMQKAGVLFQILGDEKYAVFIKKMLYEYAKLYPTFDRHPQTRSYARGKFFWQCLNDSNWLVYTSQAYDCIYDWLSKDEQNYLNANLFKPYADFLSVETPQFFNRIHNHSTWGNVAVGMIGLVMNDDELVNRSLYGLKIDTIHEDARDNDGGL

SEQ ID NO: 19157 - DNA, 567 bp, Unknown
  Obtained from environmental sample
  misc_feature (1)..(567): n is a, c, g, or t
atgtctaacacatttaatgaaattgacattcataaaaacaatattgaagtcttaaaaaaatcgtttgtaagtccaatttctacaacgggttttgaaacatacgattacgttttacacgatagtatcaccgtgaataataaaaaaacatacgccatttattttttcccaagaagaaatggcgatttggcttttgaaggattcttttgggtggcagataaaaatttttctatcacaaagattaaaatgaaagtccataaagagatcaatcttaactttgtgagaaggttgtctttcgaaaaggaatttacaataaaagatgatagtatttatcttcccaaaaaagatgtatatactggtgatttcacacttacagataagaatgatgataataaaggactgactataaaaaagacaagctcttattctgactatctttttgatcaaaaattagcagacaatttttactcagaaaaaattatccgctataaaccagaacagtttcatcaaaataaaatttattgggatagtgttagtaaatctacagagaaacaaacacttatgagctga

SEQ ID NO: 19158 - protein, 188 aa, Unknown
  Obtained from environmental sample
  misc_feature (1)..(188): Xaa is any amino acid
MSNTFNEIDIHKNNIEVLKKSFVSPISTTGFETYDYVLHDSITVNNKKTYAIYFFPRRNGDLAFEGFFWVADKNFSITKIKMKVHKEINLNFVRRLSFEKEFTIKDDSIYLPKKDVYTGDFTLTDKNDDNKGLTIKKTSSYSDYLFDQKLADNFYSEKIIRYKPEQFHQNKIYWDSVSKSTEKQTLMS

SEQ ID NO: 19159 - DNA, 513 bp, Unknown
  Obtained from environmental sample
  misc_feature (1)..(513): n is a, c, g, or t
gtgaacggtgtggtgnctggcaaatataaccttactgggtctgcgtcgatttccgccgcgcggatgaagtttncggggttttccgacagctatatctcggttgaaatcatcccgtttaccaccaaagataagatggaccgttttgacggaatggacagcattaaccagtccgacgtgaaagtggcgacaactttaggcacttcgtttgaaaaaatgacgcgggactggttccccgatgcagacatcaaagttgttgaggcaccagcgcgcggctatcaagaggtaatctcggggcgggcagatgtgttcatcacttccaacatcgaaggttcgacgcttgagggtaaattcccgattgcccgcgttaaaaacgtgactgcgccctccagcacgccgattgccatgttgatgccgcaaggggatcaaatctggatcaattacgtgaacaactggatcaagctgaaaaaaggcgaaggttttttcgaagcgacgcgggtgaaatgggggctgtaa

SEQ ID NO: 19160 - protein, 170 aa, Unknown
  Obtained from environmental sample
  misc_feature (1)..(170): Xaa is any amino acid
MNGVVXGKYNLTGSASISAARMKFXGFSDSYISVEIIPFTTKDKMDRFDGMDSINQSDVKVATTLGTSFEKMTRDWFPDADIKVVEAPARGYQEVISGRADVFITSNIEGSTLEGKFPIARVKNVTAPSSTPIAMLMPQGDQIWINYVNNWIKLKKGEGFFEATRVKWGL

SEQ ID NO: 19161 - DNA, 447 bp, Unknown
  Obtained from environmental sample
  misc_feature (1)..(447): n is a, c, g, or t
atgaaaaatattctcatattacaaatgcggccagaaaatgaaacttgcgacagcgagtatgaagccattttgaaagttggtaaaattgacagaaaacaggttgatcgaattcgagttgaacaacttgaaaattttgaaattgatatcagtaattatagtgctgtcattgcaggaggcagcccttttgatgttacttgtccagatcttaaaaagagtgcggtacaaaaacgcatagaatctttttttaatcatttatttgatcagattattagcactgatttcccatttctgggaatctgctcaggtaatggactcttggggaattactacggcaccaaaatttcggataaatatgctgaaggtataagcagtgtcaacctttcgataacaaaagaacgagaaaaagacgaattgctaatgggattgccaaaacagtttttgcattaa

SEQ ID NO: 19162 - protein, 148 aa, Unknown
  Obtained from environmental sample
  misc_feature (1)..(148): Xaa is any amino acid
MKNILILQMRPENETCDSEYEAILKVGKIDRKQVDRIRVEQLENFEIDISNYSAVIAGGSPFDVTCPDLKKSAVQKRIESFFNHLFDQIISTDFPFLGICSGNGLLGNYYGTKISDKYAEGISSVNLSITKEREKDELLMGLPKQFLH

SEQ ID NO: 19163 - DNA, 405 bp, Unknown
  Obtained from environmental sample
  misc_feature (1)..(405): n is a, c, g, or t
ttgttggggcatttacaatattggtgtcattcctatctggttttatggggcggggcctatattaaaacacccattgatctaacatccaataaaaaggcatttggggacaaacaggcctttaattcaaaaaccttgttattgactttgcccaagctaattctgcccttgggggtttatgccctgggccattatctaattagtccaaccgcgggctatatttttgttggtatggcgggggttatcggatttggatttagaaataaggtgtttgccatgattgagtccatttacaagaaggaaaagtataagacgcttgcggcctacaaacaaaataacataaataagcatgattacagtccaaaatttaacaaaaaaatacggggagtccatcgtgttaaatattga

SEQ ID NO: 19164 - protein, 134 aa, Unknown
  Obtained from environmental sample
  misc_feature (1)..(134): Xaa is any amino acid
MLGHLQYWCHSYLVLWGGAYIKTPIDLTSNKKAFGDKQAFNSKTLLLTLPKLILPLGVYALGHYLISPTAGYIFVGMAGVIGFGFRNKVFAMIESIYKKEKYKTLAAYKQNNINKHDYSPKFNKKIRGVHRVKY

SEQ ID NO: 19165 - DNA, 630 bp, Unknown
  Obtained from environmental sample
  misc_feature (1)..(630): n is a, c, g, or t
atgaaagagattcttcaatcacttcttaaagaagctggaattgaaccagcattaattgaagaaattcaagaagtaggagtgcctaaaaaagcagctacgggagaacttttaattacaccgggaagcacatcaatgtatatgccttttgtactagaaggtttattgagtgttgttcgtcaagatgataatggaaatgaaattctactctattatttggaaggaggggagacttgcgcaatgtcattagcttgttgtattgaaggaaaaaagaatgatttcaaagtaaccgcggaggaagattcaattttatggatggttccaatgaattacttagatcaatgggttcaaaaatataaatcgttcagaaaatatgtgtttagctcttatcaagtacgattcgatgaattacttgaaacgattgacagcataacttttctgaaattatatgaacgattatacaaatatttgttagataagaaacaagctacaaaatcatacgagataaacatgtctcacgagcaaattgctcaacatttaaatacctcccgagttgttatatcccgccttttaaaacaacttgaaaacgaagataagatcgaaatagagagaaacaagatttccattctttag

SEQ ID NO: 19166 - protein, 209 aa, Unknown
  Obtained from environmental sample
  DOMAIN (25)...(120): Cyclic nucleotide-binding domain
  misc_feature (1)..(209): Xaa is any amino acid
MKEILQSLLKEAGIEPALIEEIQEVGVPKKAATGELLITPGSTSMYMPFVLEGLLSVVRQDDNGNEILLYYLEGGETCAMSLACCIEGKKNDFKVTAEEDSILWMVPMNYLDQWVQKYKSFRKYVFSSYQVRFDELLETIDSITFLKLYERLYKYLLDKKQATKSYEINMSHEQIAQHLNTSRVVISRLLKQLENEDKIEIERNKISIL

SEQ ID NO: 19167 - DNA, 774 bp, Unknown
  Obtained from environmental sample
  misc_feature (1)..(774): n is a, c, g, or t
atggataagattagggacagggagattgaactggaccaaaaaatcgatgactggaaatacgatatatttaagcggaaagtcaaggagcctggtgtttccccatcagccattacacagtataaaaagacattggaactcattgcggagtatcccaatttctcttctttaaaacggaaaaaggactataatgcgattgttcccttgaccaggacggtcaataaaattgatcatgccttgagtttcattgaaagatttgtttacgggacttcagcacctaaggtgcagaaaaaagttattcctgccgaaacccctacaagcatcaaacgctttgcgcattgtgagtggtatgcttatttcctttattaccggaagtccaaactgaacaaggaaccaatgattgggcgcgcaaaggtaaatattgatgagaatcataaggtgactttcttgaatacgggtgtggatcaaagtgtaaactataagggggattatattgatttttccaaaatgaataatggaatcctcatgtttaatctggatggcatggaagaagaacaaggtcgtaacttacatattaaactgtttaatagaaaacccgatcaggtggtgtgtgttggcgggtatgaaacatacgagaacagtattccccaggggggagtcatcgtattccaaaaaattgacgacaccaatcggggactgcctgtgggtggcttttcctttttccacaagccagaggaatttgaaataccatacccgagcaaattcgcgagtttttag

SEQ ID NO: 19168 - protein, 257 aa, Unknown
  Obtained from environmental sample
  misc_feature (1)..(257): Xaa is any amino acid
MDKIRDREIELDQKIDDWKYDIFKRKVKEPGVSPSAITQYKKTLELIAEYPNFSSLKRKKDYNAIVPLTRTVNKIDHALSFIERFVYGTSAPKVQKKVIPAETPTSIKRFAHCEWYAYFLYYRKSKLNKEPMIGRAKVNIDENHKVTFLNTGVDQSVNYKGDYIDFSKMNNGILMFNLDGMEEEQGRNLHIKLFNRKPDQVVCVGGYETYENSIPQGGVIVFQKIDDTNRGLPVGGFSFFHKPEEFEIPYPSKFASF

SEQ ID NO: 19169 - DNA, 483 bp, Unknown
  Obtained from environmental sample
  misc_feature (1)..(483): n is a, c, g, or t
gtgagtatttttgcactccaatttgaaaacacaaaaatgaaacgtattagtcaatataaaaagttatttaatgttgaaggagctatcgatttaaaagagctaaaaactacctatagaggtttggttaaaaaatggcatccagataaatttttagaagaagataaaaaagaaattgcagaaattgaaagtactaaaattattgatgggtatcattttttagtaagcattgctccagaaacaaaagctgcaaatttagaagattacaaaactactattacagaatttcaagtagcagattggcatcataaaagtatgtcgttagaagttacttttaccgatggaaatacctacgaatactttggtgtgagtcgtattctttttggaaaatttgtaaatgcaaaatctatgaataactttgggcaaaggaatattttcaattcttttatttacagaaaatcaaagaaagcagctgtaatggcttaa

SEQ ID NO: 19170 - protein, 160 aa, Unknown
  Obtained from environmental sample
  DOMAIN (18)...(71): DnaJ domain
  misc_feature (1)..(160): Xaa is any amino acid
MSIFALQFENTKMKRISQYKKLFNVEGAIDLKELKTTYRGLVKKWHPDKFLEEDKKEIAEIESTKIIDGYHFLVSIAPETKAANLEDYKTTITEFQVADWHHKSMSLEVTFTDGNTYEYFGVSRILFGKFVNAKSMNNFGQRNIFNSFIYRKSKKAAVMA

SEQ ID NO: 19171 - DNA, 507 bp, Unknown
  Obtained from environmental sample
  misc_feature (1)..(507): n is a, c, g, or t
atgagttcgaagatccttaaagccttgatgcaactttttgcagttattgcaaaagttgaaaatcatgatcctaatgaaggtgatgcatcaataataaggaaacttctagaacgacaattaaaccgtactcttgttgaggaatatcttcaattatatttccaacatctggataaatttcgaaccagaaatatttctgcaagttctactaaggttctcagaatttgtattgagatcaacaaagagcaacaattaagtcagcgtgaacgtgtaattattgttatccgattattcgaatttctttattctacaggagggaaaataagcaaaattgaacttgagtttattgatcttgtagcgggagcatttaaagttgatcagaatgaatatttgggcattaaagaatttgtttctgatgacgtaataaatgcagataatccacttttattacatatacattcaggaagcaaaaaatttaaagatgccaaagagatactcgaccgatcttga

SEQ ID NO: 19172 - protein, 168 aa, Unknown
  Obtained from environmental sample
  misc_feature (1)..(168): Xaa is any amino acid
MSSKILKALMQLFAVIAKVENHDPNEGDASIIRKLLERQLNRTLVEEYLQLYFQHLDKFRTRNISASSTKVLRICIEINKEQQLSQRERVIIVIRLFEFLYSTGGKISKIELEFIDLVAGAFKVDQNEYLGIKEFVSDDVINADNPLLLHIHSGSKKFKDAKEILDRS

SEQ ID NO: 19173 - DNA, 723 bp, Unknown
  Obtained from environmental sample
  misc_feature (1)..(723): n is a, c, g, or t
gtgactggaagaatgcaaaccattggttttggaaatgtagaagatagagtaaatcaaagaagtatagaagaaacgaaacaatacaatatgtctacaagcattaatttagggaaaatgatgcctaaaaactggggcgttcagttgccaatgagctatagtattggtgaagaatttagagatccaaaatacgatccacaataccaagatgtaaaatttgctgaagcaaaacaagtaaatccaaatagtgctaattctcaagattatacgttgcgaaaaagcatcagttttaataatgttaagaaaaacagaaacccagcttctacaaaaaaaccaaaaccctacgatgtagaaaatttttctgtaacctatgctttttcagaagaatatcataaagattacaatatagaaaagtatttaaatcagaatttaagagcaggagcgagttataattttacatttcaaccaaagtttattgaaccctttaaaaaatcagaattttttgggaaaagtaaacattggcaaatcattagagacattaatattaatttattaccaaaatctatcggagtaaattctagaattacaagaaattttgtggaacaaaaatctagaaatttaatagcaggattaagtccgcaaccaacattaacactacgtaggtttatgtttgattgggattatacaataggtngtgatattacaaaatcgttgagtgtaacttga

SEQ ID NO: 19174 - protein, 240 aa, Unknown
  Obtained from environmental sample
  misc_feature (1)..(240): Xaa is any amino acid
MTGRMQTIGFGNVEDRVNQRSIEETKQYNMSTSINLGKMMPKNWGVQLPMSYSIGEEFRDPKYDPQYQDVKFAEAKQVNPNSANSQDYTLRKSISFNNVKKNRNPASTKKPKPYDVENFSVTYAFSEEYHKDYNIEKYLNQNLRAGASYNFTFQPKFIEPFKKSEFFGKSKHWQIIRDININLLPKSIGVNSRITRNFVEQKSRNLIAGLSPQPTLTLRRFMFDWDYTIGXDITKSLSVT

SEQ ID NO: 19175 - DNA, 555 bp, Unknown
  Obtained from environmental sample
  misc_feature (1)..(555): n is a, c, g, or t
atggtgactatgaagattgtaacaaaaaattgcgccatatactgcaggaaatcgaccgaagaaggtttggacatggatttcaatacgctccatgcccagcgtgaagcatgcgaagcttatgtcatcagccaacgtgccgagggctggaaaaccgttaaaacagaatataatgacggcggttattcaggtggaaatcttgaccgtcctgctatgaaaaaattgctcaccgatataaaagcaggaaaagtccaaactgttgttgtttataaaattgatcgcctgacacggtcattaatggacttttcaaagctggtcgagatttttgacgaatatggcgtgacctttgttagtgtgacacaaagctttaacactacgacatctatggggcggttaactctgaacgtactgctatcatttgcacaatttgaacgtgaagtttccgccgaacgcattcgtgacaaaatcgcagctagcaaaaagaaaggtatgtggatgggtggcagtccccccataggctatgaggttaacgacaaaaaactaatcatcaatccatga

SEQ ID NO: 19176 - protein, 184 aa, Unknown
  Obtained from environmental sample
  DOMAIN (11)...(164): Resolvase, N terminal domain
  misc_feature (1)..(184): Xaa is any amino acid
MVTMKIVTKNCAIYCRKSTEEGLDMDFNTLHAQREACEAYVISQRAEGWKTVKTEYNDGGYSGGNLDRPAMKKLLTDIKAGKVQTVVVYKIDRLTRSLMDFSKLVEIFDEYGVTFVSVTQSFNTTTSMGRLTLNVLLSFAQFEREVSAERIRDKIAASKKKGMWMGGSPPIGYEVNDKKLIINP

SEQ ID NO: 19177 - DNA, 756 bp, Unknown
  Obtained from environmental sample
  misc_feature (1)..(756): n is a, c, g, or t
atgagcaaatacgattcaacaaattcaattaacacgatttttcttgatattggaaactcagctataaaagcagctttcaaaaaagatggaaaatgggaaagagcgagtgataattttaagtccgttacatatctgatttcctggttgaataatcatacggattcaattggagaactggtagttgcaagtgtccgcaaagatcaatttgaacttcttcaaaatcaggttaatgatcaatccattatgaatatcaggattgaggacattcctttggagaagatggattataacacacctaagacattgggaatagaccgttaccttggctgtttaggtgcttttaaaaaagtaggaaaagcagttgttgttattgatgcaggtagtgcttgtacaatagatttaatgaatgatgaagggatttatcaaggaggggtaataatgcctggcttgcaaagtttgatgaatattttcaaaatttcggctccagaattaccaactattgaacctgaaattccatcaaaatggccagggaaaagcacctcagattcactgaaatggggtcaagtaggtttctttatagatggaattgaatcagcattgaatagatataaaaagcaatacggggattatgagctttttataactggaggagatgctgaaattatttcaaaattgatttcaacaaagccaaaaaaaagtgatttcctcatttataatggaatggaagcttttattaagcttagaagcttttcataa

SEQ ID NO: 19178 - protein, 251 aa, Unknown
  Obtained from environmental sample
  DOMAIN (12)...(202): Bordetella pertussis Bvg accessory factor family
  misc_feature (1)..(251): Xaa is any amino acid
MSKYDSTNSINTIFLDIGNSAIKAAFKKDGKWERASDNFKSVTYLISWLNNHTDSIGELVVASVRKDQFELLQNQVNDQSIMNIRIEDIPLEKMDYNTPKTLGIDRYLGCLGAFKKVGKAVVVIDAGSACTIDLMNDEGIYQGGVIMPGLQSLMNIFKISAPELPTIEPEIPSKWPGKSTSDSLKWGQVGFFIDGIESALNRYKKQYGDYELFITGGDAEIISKLISTKPKKSDFLIYNGMEAFIKLRSFS

SEQ ID NO: 19179 - DNA, 528 bp, Unknown
  Obtained from environmental sample
  misc_feature (1)..(528): n is a, c, g, or t
ttgggaacggacattaagcgaaagcaattcaaacctgctgactatagatcttttcgacagcgactgatgcagaaccttgacgtattccaacagctactcgctaaggaaggctttggaaaagggcccacttcttttggtgcagagttagaactctacatcatcgacaaagacggctcccctcttcccattaacgaacttatccatcaaaaaatggatgacccactactgacccttgagctaaatcgttttaatttagaatacaatttcacccctgttatccgcagtaaacaacctttttcacaaatggaaacgcaaatgcttaaggcattaaataccttaagctcggcagcggagaaactcgacgcaagagtgctacctattggtattttgcccacacttaaaacaaacgatttgggtaaagatgcaatcacggatatcacgcgctaccacgtgttagccaaagcactgcgggacaaacgcggagaaaactttcaaatacatattgaagcattgattgtcttgacttga

SEQ ID NO: 19180 - protein, 175 aa, Unknown
  Obtained from environmental sample
  misc_feature (1)..(175): Xaa is any amino acid
MGTDIKRKQFKPADYRSFRQRLMQNLDVFQQLLAKEGFGKGPTSFGAELELYIIDKDGSPLPINELIHQKMDDPLLTLELNRFNLEYNFTPVIRSKQPFSQMETQMLKALNTLSSAAEKLDARVLPIGILPTLKTNDLGKDAITDITRYHVLAKALRDKRGENFQIHIEALIVLT

SEQ ID NO: 19181 - DNA, 402 bp, Unknown
  Obtained from environmental sample
  misc_feature (1)..(402): n is a, c, g, or t
ttggtagacgaaatacactttatagaacggttacgaaatgctcaaactaaagaaaaagcctttagagagttagttgctacttataaagaacgcttgtattggcatattcgtaaaattgttatttctcatgatgatgcagatgatgtattgcaaaatacttttatcaaaatttttagaggcatcgataattttaaactagaaagtcaacttttttcttggatgtacagaatcgcaacaaacgaatctattagctttatcactaaaagagcaaaagaaaacaatgtcgatatttctgattatcancatagcttaacatctaatttagatagcgatcttcattttgatggagatcaaattcagtcatattacagaaagcataaaaagataccacaaaacacaana

SEQ ID NO: 19182 - protein, 134 aa, Unknown
  Obtained from environmental sample
  DOMAIN (24)...(92): Sigma-70 region 2
  misc_feature (1)..(134): Xaa is any amino acid
MVDEIHFIERLRNAQTKEKAFRELVATYKERLYWHIRKIVISHDDADDVLQNTFIKIFRGIDNFKLESQLFSWMYRIATNESISFITKRAKENNVDISDYXHSLTSNLDSDLHFDGDQIQSYYRKHKKIPQNTX

SEQ ID NO: 19183 - DNA, 711 bp, Unknown
  Obtained from environmental sample
  misc_feature (1)..(711): n is a, c, g, or t
ttgtatgtagatctgtttacgaattatcatgaacctgaaatcgcaaaatcagcggtgaaagtactcgagagtatgggctttgaggttttgattcctaagacagaggaattgggtcgtccacatttgtcaaagggatttctgaaagaggctaaaaatctagcccacaaagcgataatagagtggaaagattatgcaaacaatgaaataccaatagttggtttagaaccttctgagatattaacagcgaaagatgaatttctagacctttgtgataagagtgtacttgaagaggcgcaacaagtagcaaaatcctcttatacgtttgaagaatttttatcacttaatcaaaaccttatatcagcatcaatacaaaaagaaaaaattgtagttcatgagcattgtcatgcaaaggcattaagcaaaaaaggactttctagaaaagtgttagagcatgttggctatcaagttgatgtgttagactctggttgctgtgggatggctggtagttttggatatgaaaactctaaagtagatgtttcaatgaaaattgggaatcagcgtttatttccagctattaatgagacacctaacgaaagcaatatttgtgcttctggcttttcatgtagacaccaaatttatgatggaacaggtcgtaaagctttacatatttcagaattgatttggtccaaaatagaaaaaggcaaaacctag

SEQ ID NO: 19184 - protein, 236 aa, Unknown
  Obtained from environmental sample
  misc_feature (1)..(236): Xaa is any amino acid
MYVDLFTNYHEPEIAKSAVKVLESMGFEVLIPKTEELGRPHLSKGFLKEAKNLAHKAIIEWKDYANNEIPIVGLEPSEILTAKDEFLDLCDKSVLEEAQQVAKSSYTFEEFLSLNQNLISASIQKEKIVVHEHCHAKALSKKGLSRKVLEHVGYQVDVLDSGCCGMAGSFGYENSKVDVSMKIGNQRLFPAINETPNESNICASGFSCRHQIYDGTGRKALHISELIWSKIEKGKT

SEQ ID NO: 19185 - DNA, 612 bp, Unknown
  Obtained from environmental sample
  misc_feature (1)..(612): n is a, c, g, or t
atgattaatagaagacatattagagtcaaagtaatgcaatcggtttatgcaatgacaacttcaaaagccgatgatttagttaaagaagaaaaattcttaaaacacagcattcaaaaattgttagacttgtatgttttgcaattgcaaatgttggttgaagttcagaaattagctactcagcaaattgaactttcaaaaaagaaacatcttgccactaaagaagatttacaaccaaatacaaaattcatcaataataaagtaattgcagcaattgcaaatagtacttcaatttctgatcatatttctaatcagaaattagacaactggaaaaatgatgatgagtatgtaactattatttggcaaaaattgcaagcaagtgatttgtatagcaaatacatgagttctaaagacaactcttttaaagctgacaagaattttattcaagatttttttacagaaattattgcaccagatgataaattagcagaatattatgaagataaaacaattagctggttagatgatattccttttgtaaatacatggattttaagaactttaagtaaggtgaaagaaaataaaccattgcttttagaagtatttataagatga

SEQ ID NO: 19186 - protein, 203 aa, Unknown
  Obtained from environmental sample
  misc_feature (1)..(203): Xaa is any amino acid
MINRRHIRVKVMQSVYAMTTSKADDLVKEEKFLKHSIQKLLDLYVLQLQMLVEVQKLATQQIELSKKKHLATKEDLQPNTKFINNKVIAAIANSTSISDHISNQKLDNWKNDDEYVTIIWQKLQASDLYSKYMSSKDNSFKADKNFIQDFFTEIIAPDDKLAEYYEDKTISWLDDIPFVNTWILRTLSKVKENKPLLLEVFIR

SEQ ID NO: 19187 - DNA, 327 bp, Unknown
  Obtained from environmental sample
  misc_feature (1)..(327): n is a, c, g, or t
atgaccaataaattacttacgccaattaataaaaccatcaacggaaaaaagaccgcctgcactttatataaatcgatgtttttttctttgctatcatttgctaaagcatcaaaatttttgatgatagatttttcaattccgtacgatttcaccacattaattccagagaaaaactcttggttaaacgtcgttaattttgataaatattgttgcacaatcgtacttttttcgttgataattttactcaacacaaaaattgaaacagataaaataggaaaaggaattagtgtgtacatcgttaattttgcgtcgatactatacatttga

SEQ ID NO: 19188 - protein, 108 aa, Unknown
  Obtained from environmental sample
  misc_feature (1)..(108): Xaa is any amino acid
MTNKLLTPINKTINGKKTACTLYKSMFFSLLSFAKASKFLMIDFSIPYDFTTLIPEKNSWLNVVNFDKYCCTIVLFSLIILLNTKIETDKIGKGISVYIVNFASILYI

SEQ ID NO: 19189 - DNA, 549 bp, Unknown
  Obtained from environmental sample
  misc_feature (1)..(549): n is a, c, g, or t
ttgaaaaaaaatgggaaaaagaaaacgaggttgcgcgcaaaaactgtgatggtatttttgcgattgctgaaaaagaaccaaaacccacagaatataatgacgttgcaaaaagcgtggtgcaatatctgtgggaccttgaatcccacgcccgcaaaaaaccaaaacttccgaccgatgcgcaatgatctgttatttgcctacggcaccttgcaaaaagggtttagcaataaaattgctcaatatctgtcacagcacagccgtataattggcaccgggtatatgatcggcagactttatgaagtcagcgactaccccggcgccattcaaacagctgcacgtcatgaaaaactatatggttcaattttacagctctatgacacagcacgtcttattcccttgctggatcaatatgaagaatgtggaaaacatgatccacagccgactatgtaccaccgaaaaaaagtcaccgttttaccaaaccaaaggcaaaaaatggacgttgcgcctatatctacaattaagatgtcagcggcttttcacannnnnngg

SEQ ID NO: 19190 - protein, 183 aa, Unknown
  Obtained from environmental sample
  misc_feature (1)..(183): Xaa is any amino acid
MKKNGKKKTRLRAKTVMVFLRLLKKNQNPQNIMTLQKAWCNICGTLNPTPAKNQNFRPMRNDLLFAYGTLQKGFSNKIAQYLSQHSRIIGTGYMIGRLYEVSDYPGAIQTAARHEKLYGSILQLYDTARLIPLLDQYEECGKHDPQPTMYHRKKVTVLPNQRQKMDVAPISTIKMSAAFHXXX

SEQ ID NO: 19191 - DNA, 369 bp, Unknown
  Obtained from environmental sample
  misc_feature (1)..(369): n is a, c, g, or t
atgactagcaataagaaaatactaattgtagaggatgatatgatcatctctttagtcgtggagaacatggttaaagagcttgggtataaggttgttggtaaagctgtttctggtgaagaggcaataagaattgcaaaaaaagaaaaaccagacattttgttgatggatattcgattaaaaggggatatggatggaattgatgcggtagcaaaaatcaaagaaagtattgatcctaaagtcatctatttaacaggtaattctgatcgtcttaattttgaaagagctcaaggcactgattttgccgatctcattgtaaagccatttacgattggngatcttgataaatcattaaagttgctcatggagtaa

SEQ ID NO: 19192 - protein, 122 aa, Unknown
  Obtained from environmental sample
  DOMAIN (5)...(122): Response regulator receiver domain
  misc_feature (1)..(122): Xaa is any amino acid
MTSNKKILIVEDDMIISLVVENMVKELGYKVVGKAVSGEEAIRIAKKEKPDILLMDIRLKGDMDGIDAVAKIKESIDPKVIYLTGNSDRLNFERAQGTDFADLIVKPFTIGDLDKSLKLLME

SEQ ID NO: 19193 - DNA, 468 bp, Unknown
  Obtained from environmental sample
  misc_feature (1)..(468): n is a, c, g, or t
ttggctccttcaaagctggtgcgcaaatattgcagcggactacccctatccctgaaggaatacagtacaagttcggacccgatagctatcgggtttgagtacgaggctgaacctttttcatcaatcaaccattcaaaaaataccaaaaacatgaacaaataccaccaactccggcaagtgctggagaccgacggcgtgggcaaaatgaagtgcttcggccaatccatgctgcccatcctcaaaagcggctcactgctgacttttcacaaacaacccgaatacgaaatcggtgacatcgtcttttgcaaagtcaaaggccgattcatcgatgcccacaagatcgtgaagatgcatccgcaccgcggctacctcatcgcgaacaaccacggccatgaaaatggctggacccgaacgattttcggacgggccgtcaaagcagaattcaaacaagaaatcaaagaattatga

SEQ ID NO: 19194 - protein, 155 aa, Unknown
  Obtained from environmental sample
  misc_feature (1)..(155): Xaa is any amino acid
MAPSKLVRKYCSGLPLSLKEYSTSSDPIAIGFEYEAEPFSSINHSKNTKNMNKYHQLRQVLETDGVGKMKCFGQSMLPILKSGSLLTFHKQPEYEIGDIVFCKVKGRFIDAHKIVKMHPHRGYLIANNHGHENGWTRTIFGRAVKAEFKQEIKEL

SEQ ID NO: 19195 - DNA, 795 bp, Unknown
  Obtained from environmental sample
  misc_feature (1)..(795): n is a, c, g, or t
gtgaagataaagttagacggacgtaaagcagaggctgttcaattgagcacttcactggaaaactacataaagcttcaggctcagatcgataaaatgatgctggaagatgaagatattccgcagaaaatggatcttgagtgtcagctattaggtgagaaagtagatcgtgaaggtgggatagaagaaatggaggaaaagattgaaaagcttctaaacttgaatgaacgctatgagttgaagaaaaaacaattggttgcaacaaccatggcaaaggtgtgtacttcagaattattctttaatctcagctatgacgccgttgttgtggatgaagcttcgatggcaggtgttccgtacttattgttgatggcagcaaaaagtaaacaacatttggttattgcaggcgatcctatgcagcttccgcctattgcaataacgaatcacaaagaatcacgagcttttttggagcaagatattttcactttcgtttcaggagcagaatcaacggaagggttatttcaatggcacgatgagaatcctgatttcacctgtttttttgatactcaatatcgattgagatcagatttggcaggagtgattagttctattttctatgacggcagattgaaatccggcgcaaaaatcatggaacgaggcgtaaataaaaattcggtcgcattggtggattcctctaaatatggtccttatatcgaacaggacacaggaggacgaggattcaatccctcaaacgaagttcatctgaaaataattgagccaagtgttaaaaaagttctctaa

SEQ ID NO: 19196 - protein, 264 aa, Unknown
  Obtained from environmental sample
  misc_feature (1)..(264): Xaa is any amino acid
MKIKLDGRKAEAVQLSTSLENYIKLQAQIDKMMLEDEDIPQKMDLECQLLGEKVDREGGIEEMEEKIEKLLNLNERYELKKKQLVATTMAKVCTSELFFNLSYDAVVVDEASMAGVPYLLLMAAKSKQHLVIAGDPMQLPPIAITNHKESRAFLEQDIFTFVSGAESTEGLFQWHDENPDFTCFFDTQYRLRSDLAGVISSIFYDGRLKSGAKIMERGVNKNSVALVDSSKYGPYIEQDTGGRGFNPSNEVHLKIIEPSVKKVL

SEQ ID NO: 19197 - DNA, 684 bp, Unknown
  Obtained from environmental sample
  misc_feature (1)..(684): n is a, c, g, or t
gtggaaattgtagacgaaagccaacaactcaaaaataatagtgggaaaagaattaagttaattcgaagtatgattggattaactgcatctattttttcaaaaaaagtaggcgttacagaaagaacgatgaatagctgggaatgtggaagatcaggaggattgtcttcaaaaggtgctgaaaaaatagttggttacatcgaagaacatggcatttttatcaatgctgcatggttattatatggacttggaataccacctaaattgactggaagtgtttatggaaatattgcaaacacgttaaacaccggtactctagaaataggaaatttaagtgacacagaaaaaaacgacattcaatatatcttaggcaatcatcccaaattagttattttaaaaatttcagatgattctatggaaccattccttgaaaaaggcgatattgttgcaggagaacctcttaacaaaaagatgtttcaacaggctgtaaacaagatatgcattgtagagacaaaaaaaataggtcagatatgccgccttgtcacaaaaagcaataaaacgacatcatttaatctaaattatacgaataaaataagcgcttcaacaaatacgttaacagagcaaacagtcactaaattagctccaattgtttgggtcagaacgaaaaatatatctaagaaaacttaa

SEQ ID NO: 19198 - protein, 227 aa, Unknown
  Obtained from environmental sample
  misc_feature (1)..(227): Xaa is any amino acid
MEIVDESQQLKNNSGKRIKLIRSMIGLTASIFSKKVGVTERTMNSWECGRSGGLSSKGAEKIVGYIEEHGIFINAAWLLYGLGIPPKLTGSVYGNIANTLNTGTLEIGNLSDTEKNDIQYILGNHPKLVILKISDDSMEPFLEKGDIVAGEPLNKKMFQQAVNKICIVETKKIGQICRLVTKSNKTTSFNLNYTNKISASTNTLTEQTVTKLAPIVWVRTKNISKKT

SEQ ID NO: 19199 - DNA, 858 bp, Unknown
  Obtained from environmental sample
  misc_feature (1)..(858): n is a, c, g, or t
atgagtgtacgggtaatggatgtgctccgtcagctttctaataatgttgaagtttatagtattgatgaggcctttgctgagctttcaaccgatatttgcgatgatttaaatgaatacggtcaatttattaggcaaaccattttaaaatggactggtttacccgtatccgttggaattgctacaagtaagacattagcaaaagtagctaaccacatagccaagaaacgagcctcacataacggggttctaagcttggttggctctgatgaaatagactcaatacttcagggagtggatattcaaaaagtgtggggtattggccaaaaactaaccattcggcttaatagacatggaattaataccgcactagatttaaagaaaaccattgaaaataaaaaatgggttcgcaagcaaatgagtgttacaggtttacgtaccgtgcttgaactgaatggcatttcatgtatccacatgagtgaagttaaagaaattagaaagggtattttaacatctcgaatgtttggaaagcctctttatgaacttcgcgatatacaagaagcggtttcttcttttgtttctagagccgcagaaaaattacgggcgcaacactccgtagtctcagtacttagtgtaaccctaattggagaccgtttttccaacttaaaaagtaagtacaaatatagccttaattattctcttaaaatacctacagcccacacccctactttaatatatttagctaaagcactaactgaagcgctctacgaacacaatactaaatacaaaaaagctggaattatgtttacaggtattgttcctgatagcgagatacagatgatattctcgaccgattcttga

SEQ ID NO: 19200 - protein, 285 aa, Unknown
  Obtained from environmental sample
  DOMAIN (1)...(273): impB/mucB/samB family
  misc_feature (1)..(285): Xaa is any amino acid
MSVRVMDVLRQLSNNVEVYSIDEAFAELSTDICDDLNEYGQFIRQTILKWTGLPVSVGIATSKTLAKVANHIAKKRASHNGVLSLVGSDEIDSILQGVDIQKVWGIGQKLTIRLNRHGINTALDLKKTIENKKWVRKQMSVTGLRTVLELNGISCIHMSEVKEIRKGILTSRMFGKPLYELRDIQEAVSSFVSRAAEKLRAQHSVVSVLSVTLIGDRFSNLKSKYKYSLNYSLKIPTAHTPTLIYLAKALTEALYEHNTKYKKAGIMFTGIVPDSEIQMIFSTDS

SEQ ID NO: 19201 - DNA, 723 bp, Unknown
  Obtained from environmental sample
  misc_feature (1)..(723): n is a, c, g, or t
ttgcaggatattgagctaacttttgatatggaagtagacaatccaaatcctgtcacagtcgctctttcgcaatacgattatgatttacagttgaactcacagtctttggttaaaggcagtaaaccaacaaactcaagtgttgaagcctctggaaaaagcattgtacaaattcccgtttccttcggattcaaagatttatacaacatcgctagctcactaaaagatcaagacgaaactgattttgactttgcagcaaatgcagaaatcgatgttcctatacttggtaaaattaccatccctgtaaacaaaacagggaaattacctgttgttaaatttcctagtgttaatgttggtagtgttaaagtatcgaaattatcattcacaaaaattgatttagaagttcaaattgatatcgataacccgaactcttttgatctcaactttgataacttgaactacaattttgcattaaatggcattaaagcaatttctggaaaatcagagagtactattaatgttctcaagaaatctggttctaaacttacacttccaataagtctcaatttattcgagcttggtactgaagtaagaaaggcattagttgatggaaaaccattccagtacagtatcaccggaaatgcaaatgtaggctcttctctaccaatatttaaaacctcagcatttgattttgataaatccggagttgttgatatcttaaaataa

SEQ ID NO: 19202 - protein, 240 aa, Unknown
  Obtained from environmental sample
  DOMAIN (1)...(116): Late embryogenesis abundant protein
  misc_feature (1)..(240): Xaa is any amino acid
MQDIELTFDMEVDNPNPVTVALSQYDYDLQLNSQSLVKGSKPTNSSVEASGKSIVQIPVSFGFKDLYNIASSLKDQDETDFDFAANAEIDVPILGKITIPVNKTGKLPVVKFPSVNVGSVKVSKLSFTKIDLEVQIDIDNPNSFDLNFDNLNYNFALNGIKAISGKSESTINVLKKSGSKLTLPISLNLFELGTEVRKALVDGKPFQYSITGNANVGSSLPIFKTSAFDFDKSGVVDILK

SEQ ID NO: 19203 - DNA, 369 bp, Unknown
  Obtained from environmental sample
  misc_feature (1)..(369): n is a, c, g, or t
ttggaaagacaaaccgtgttattttctacacatattatgcaagaagtagaagcggtttgcgatcgcgttatcatcatcaaaaaaggagaaattgtagttgataaattattgaaagacgttcgttctaatcaacagcaagtgatagaagtaacgtttgattttaaactcgaagaacaatttattaaaaaattacccaacttggtttcttataaaaacaactatgatactacgtggtttttaacttttgattctgataaagatatgcgttctgtggtgtttgattttgcacaagaaaacggacttaaaatcttaggtttgaatacacaaaatcaaaatcttgaagcactttttagagaaagtactaattaa

SEQ ID NO: 19204 - protein, 122 aa, Unknown
  Obtained from environmental sample
  misc_feature (1)..(122): Xaa is any amino acid
MERQTVLFSTHIMQEVEAVCDRVIIIKKGEIVVDKLLKDVRSNQQQVIEVTFDFKLEEQFIKKLPNLVSYKNNYDTTWFLTFDSDKDMRSVVFDFAQENGLKILGLNTQNQNLEALFRESTN

SEQ ID NO: 19205 - DNA, 444 bp, Unknown
  Obtained from environmental sample
  misc_feature (1)..(444): n is a, c, g, or t
atgaaaatagcagtaactggcttaaataatgttgataatcctggaccaggtgttccagtaatcagaggcataaaagaatcaaaagagtttgacggagaaattgtaggtttaatgtacgatgctcttgaacctggtgcttatatgccggaagtggcgaagagcaattatttgattccatatccttctggtggattggatattttctttgaaagattatcgaaaattaatgaaatagaaaaaattgatgtaataattccaactttggatgcagaactatttgcatttgcaaagcttaaaccaaaacttgaatcaattggtattaaaactttggttccaaccattgatcaattaaccataagagggcaagatactcatttgatttttgcgaaaagaataatattactgcgcctaaaaatatctggctcatcagtacagactttataa

SEQ ID NO: 19206 - protein, 147 aa, Unknown
  Obtained from environmental sample
  misc_feature (1)..(147): Xaa is any amino acid
MKIAVTGLNNVDNPGPGVPVIRGIKESKEFDGEIVGLMYDALEPGAYMPEVAKSNYLIPYPSGGLDIFFERLSKINEIEKIDVIIPTLDAELFAFAKLKPKLESIGIKTLVPTIDQLTIRGQDTHLIFAKRIILLRLKISGSSVQTL

SEQ ID NO: 19207 - DNA, 465 bp, Unknown
  Obtained from environmental sample
  misc_feature (1)..(465): n is a, c, g, or t
gtgcaggaatatattagaggaagtgaatataatgtttgtgcacttggcgatggcgaaggagatacgnttgggccagttgcgatgaaaaaacttttcatcacagataaaggtaaagcctgggctggagtttcaattgaggataatgaaattattgatatttcaaaaaaaataataaaagaattgaattggttaggaggagcagaatttgaatttatgagggatgaagagactaataaaaattatcttcttgaaatcaatcctcgtttccctgcatgggtttacttggctgttgcatcaggacaaaaccttccgtacgccgcagtgcagcttgcgcttggcaaaaatgtaaaaccatttactacttatgaaaccggcaaaatattcctaagatattcatgggatttgattaccgatataaagcaatttgaagaaattacagttaaaggagttttgaaaaatggataa

SEQ ID NO: 19208 - protein, 154 aa, Unknown
  Obtained from environmental sample
  misc_feature (1)..(154): Xaa is any amino acid
MQEYIRGSEYNVCALGDGEGDTXGPVAMKKLFITDKGKAWAGVSIEDNEIIDISKKIIKELNWLGGAEFEFMRDEETNKNYLLEINPRFPAWVYLAVASGQNLPYAAVQLALGKNVKPFTTYETGKIFLRYSWDLITDIKQFEEITVKGVLKNG

SEQ ID NO: 19209 - DNA, 882 bp, Unknown
  Obtained from environmental sample
  misc_feature (1)..(882): n is a, c, g, or t
gtgagcatgattaatcaaaggaaaaaaaggtacagaagtcgattaactgtaaagaaaaaattagacaattctgttcgtgtaatttctattacaagagatatagtgaatttagaagaaacttttgtaaaatctagtgttgttctaaaagacggaaaaaaatacggtgtaattaatctcccaaaattttacatcgattttagtgataaaaactttagagattctgcaaaagatatggaaaaagaaattgcaaatcttaaaaaagaaaatgtagaagggttgcttatcgatttaagaaataatggcggtggatctttaaaaactgcaattgaaattgctggattatttatcagcgaaggccccgttgtacaggtaaaatacagaggagaaaatgcaagagttcagaatgatcaagatcctaaaatacaatggaatggacctttagttattttagtgaatgaattgtctgcttctgcttcagaaatttttgcagcagcaatgcaagattataacagagctgttattattggaagcaatcaaacctacggaaaaggaacagttcagaatattttaccaatcaataaattttatccagattataaagaagatttaggcttcttaaaaatgaccattcaaaaattttatagagtgaatggcggttctacacaaatagaaggcgtgtattctgatattgcaatgccagacagatatagttatatgaaatttggcgaaagagatttagaaggcgcattggcttgggataaagttccaaaagcaacatattctccaacaaattcttacgagaattttagcgatgttgtccatgacagcaaagaaagaatcatgcaaaatccaagttttacgttgattaatgattatgcctaa

SEQ ID NO: 19210 - protein, 293 aa, Unknown
  Obtained from environmental sample
  DOMAIN (53)...(232): Peptidase family S41
  misc_feature (1)..(293): Xaa is any amino acid
MSMINQRKKRYRSRLTVKKKLDNSVRVISITRDIVNLEETFVKSSVVLKDGKKYGVINLPKFYIDFSDKNFRDSAKDMEKEIANLKKENVEGLLIDLRNNGGGSLKTAIEIAGLFISEGPVVQVKYRGENARVQNDQDPKIQWNGPLVILVNELSASASEIFAAAMQDYNRAVIIGSNQTYGKGTVQNILPINKFYPDYKEDLGFLKMTIQKFYRVNGGSTQIEGVYSDIAMPDRYSYMKFGERDLEGALAWDKVPKATYSPTNSYENFSDVVHDSKERIMQNPSFTLINDYA

SEQ ID NO: 19211 - DNA, 681 bp, Unknown
  Obtained from environmental sample
  misc_feature (1)..(681): n is a, c, g, or t
atgttcaacaaaaaacaagcaattaccctgttttctgggttgcttttttgctttacttctttgcaaatttcggcacaaaccgattatagcaattacagcaaattctctcaacgacttaaaacattacaaagtcaaaatgcatcagacagtaaattagaaacacttacaactactgttggtggatataaaatttgggcattgactttatcgaaaggaaacgccaaaaacaaaccagcaattgctattgttagcggcgttgatggttctcttattttgggtccagaaatggctcttcaaattgcagaaaatattttaaaaaatcatgctgatgtattagagaaaactaccttttacatttttccaaacatgagtccgaatgccacagaaaactatttttcatcagtaaaacattacaaaaatggtaatgcaaaaagcactgatgatgatagagatggcgaatttaacgaagatccttttgacgatttaaataaagatggcttaattaccatgatgcgtgtagaagatatcactggagattatatcaagctaaaagaagacgaaagaatacttgtgaaagctgataaaaatgaaggtgaaataggtaaatacaaattgctaactgaaggaatagataacgataaagacggacaatttaatgaagacngtaaagtgtattcttaa

SEQ ID NO: 19212 - protein, 226 aa, Unknown
  Obtained from environmental sample
  SIGNAL (1)...(19)
  DOMAIN (35)...(174): Zinc carboxypeptidase
  misc_feature (1)..(226): Xaa is any amino acid
MFNKKQAITLFSGLLFCFTSLQISAQTDYSNYSKFSQRLKTLQSQNASDSKLETLTTTVGGYKIWALTLSKGNAKNKPAIAIVSGVDGSLILGPEMALQIAENILKNHADVLEKTTFYIFPNMSPNATENYFSSVKHYKNGNAKSTDDDRDGEFNEDPFDDLNKDGLITMMRVEDITGDYIKLKEDERILVKADKNEGEIGKYKLLTEGIDNDKDGQFNEDXKVYS

SEQ ID NO: 19213 - DNA, 627 bp, Unknown
  Obtained from environmental sample
  misc_feature (1)..(627): n is a, c, g, or t
atgcgtccgcgcttgccctggggancgcacatccctgccttcaaaaaggatccttcgcccattttgcccatcctccaccgattgtaccaggacgaatccgactatgtgcggctcagcgtttccaacaacctcaatgacatttgcaaggacaatcccgaggtggccttgaaactggctgcccaatggtccggaaaatcgaaggaagcggacaaagtggtcaagcacggcctccgtaccctgctcaaaaaaggcgatccccgcgctttggccatgatcggactggatggaaaccacgggctcgaaatgcgcgacttcgagattcatactcctttcgtccgcctgggagaaagtgccgaattcagcttcaccatgaccaatcccaccaaaacgagccaaaagtttcgcctggaatacggggtcgactaccaaaaagcaaacggcaccctgtcacgcaaggttttcaagatcagcgaaggagaaatcggagccggggaggagaaggaagtacagcggaaacagcactttcgtcccatcaccaccagagcttaccataccggacaacaccgaatcgccgtcatcatcaacggagaagaagtcgccatcggagatttaaaattggaattgtaa

SEQ ID NO: 19214 - protein, 208 aa, Unknown
  Obtained from environmental sample
  misc_feature (1)..(208): Xaa is any amino acid
MRPRLPWGXHIPAFKKDPSPILPILHRLYQDESDYVRLSVSNNLNDICKDNPEVALKLAAQWSGKSKEADKVVKHGLRTLLKKGDPRALAMIGLDGNHGLEMRDFEIHTPFVRLGESAEFSFTMTNPTKTSQKFRLEYGVDYQKANGTLSRKVFKISEGEIGAGEEKEVQRKQHFRPITTRAYHTGQHRIAVIINGEEVAIGDLKLEL

SEQ ID NO: 19215 - DNA, 831 bp, Unknown
  Obtained from environmental sample
  misc_feature (1)..(831): n is a, c, g, or t
atgagtaaaggaaacattaatgtatcggtagaaaatatttttccgttaattaaaaaattcttgtattctgatcacgaaatatttttacgtgagttaatttctaacggaacagacgcaactacaaaattaaaacacttaattgctatcggcgaagccaaagtagaattaggtgatgctaaaattgaaattagcatcgataaagacaaaaaaacgcttaccattaaagatcatggaattggaatgacggctgatgaagttgaaaaatacatcaaccaaattgcgttttctggtgctgaagagtttttagagaaatacaaagacgacaacaacgatacaggtgtaattggtcacttcggattaggtttctattctgcatttatggttgcagaaaaagtagaaattattaccaaatcttttaaagacgagccagctgctcattggacctgtgatggttcgccagaatacaccattgaagcgcacgacaaaacggaaagaggaacagaaattgtgttgcacattgcagaagattctttagactttttagaagattctaaaattggtggattgctaaacaagtacaatcgttttaatcaaattccaattaaattcgcgaacaaaaaagaaaacgatccaanctttacaccaaaaaccaccaaagacacagacggtaaagaaactactgaaccgcacaaacaaattgacgttgattatatccttcaccatacaaaaccagcgtggaccaaaaaccgcggattagaagatgagattttaacattcctccgaaattgctccatgcctttgaagaaccttttccccctctttaatgnnncn

SEQ ID NO: 19216 - protein, 277 aa, Unknown
  Obtained from environmental sample
  DOMAIN (24)...(176): Histidine kinase-, DNA gyrase B-, and HSP90-like ATPase
  misc_feature (1)..(277): Xaa is any amino acid
MSKGNINVSVENIFPLIKKFLYSDHEIFLRELISNGTDATTKLKHLIAIGEAKVELGDAKIEISIDKDKKTLTIKDHGIGMTADEVEKYINQIAFSGAEEFLEKYKDDNNDTGVIGHFGLGFYSAFMVAEKVEIITKSFKDEPAAHWTCDGSPEYTIEAHDKTERGTEIVLHIAEDSLDFLEDSKIGGLLNKYNRFNQIPIKFANKKENDPXFTPKTTKDTDGKETTEPHKQIDVDYILHHTKPAWTKNRGLEDEILTFLRNCSMPLKNLFPLFNXX

SEQ ID NO: 19217 - DNA, 417 bp, Unknown
  Obtained from environmental sample
  misc_feature (1)..(417): n is a, c, g, or t
atgaatataacgaaacaatttcttgatgatttaacctattcttttttaggctgttgcattaatgttcataaagaattaggtcctggcttattagaaagtatttatcatcaatgtttaattgaagaattaaaatacgaaaagatttctttttcatcagaattaaatattccagtttcttatagaaacattaaagttgatgctaatttaagagcagatttactgattgaaaactgtttagttgcagaattaaaatctgttcaagaattaaaacctatttttaaagctcaattattaacttacatgcatttactaaaagctccaaaaggtgttatcgttaattttaattgtttgaatatatttaaagaagggcaaaaaacttttgtgaataatttttttaatgaactaccaataaaataa

SEQ ID NO: 19218 - protein, 138 aa, Unknown
  Obtained from environmental sample
  misc_feature (1)..(138): Xaa is any amino acid
MNITKQFLDDLTYSFLGCCINVHKELGPGLLESIYHQCLIEELKYEKISFSSELNIPVSYRNIKVDANLRADLLIENCLVAELKSVQELKPIFKAQLLTYMHLLKAPKGVIVNFNCLNIFKEGQKTFVNNFFNELPIK

SEQ ID NO: 19219 - DNA, 486 bp, Unknown
  Obtained from environmental sample
  misc_feature (1)..(486): n is a, c, g, or t
ttgttactttatctgttgctctgcttttgtttcaatgacctttatcaaaacgttgtcccattatctgtggctatgtatccgctcttaatgtattcgtcacttattttgtttttttctacaattctaattgtgattattagttacttatttagtcagcgcgtaattcaacaagtaaaaactaatggtaaaaacagatatatacttaatataaaggatgaaaaatcattaaatgaagaaaaaaaagcgctgaatattgtttggttttttaatctcgctggcggtatttgttttattttagctgtattagttctaagcgtttatacaataattaaccttaacgaggtgcaaataatgagcggtaacaataaagaatctcaaataccacaggaagaaaaaagaggggcgccagtccctagcagctctcaatatgataagccggctaaggatgatcagaatagtgattcaagtaaaaagagtgatgattaa

SEQ ID NO: 19220 - protein, 161 aa, Unknown
  Obtained from environmental sample
  misc_feature (1)..(161): Xaa is any amino acid
MLLYLLLCFCFNDLYQNVVPLSVAMYPLLMYSSLILFFSTILIVIISYLFSQRVIQQVKTNGKNRYILNIKDEKSLNEEKKALNIVWFFNLAGGICFILAVLVLSVYTIINLNEVQIMSGNNKESQIPQEEKRGAPVPSSSQYDKPAKDDQNSDSSKKSDD

SEQ ID NO: 19221 - DNA, 333 bp, Unknown
  Obtained from environmental sample
  misc_feature (1)..(333): n is a, c, g, or t
ttgaaaactttgaccatgttatggaaatcaaatcaaatcgattgggttcccattaaaaaaatagactctgaaaaaaaatttcaagttcggaattctgatttggacatgaatcatcatgtaaacaatacaaaatacttagaatggatgattgagacaattcctgaaaacatgaacaaaaaaatatctgaagtggatatcatatttcttcgtgaaggcctttaccaagacaaaattcgttctatagcagagttgaatgaagagcatacatcccaccatcaacttatcaatcaagatggtgagactatcgcattggcaacttttagctttgtttaa

SEQ ID NO: 19222 - protein, 110 aa, Unknown
  Obtained from environmental sample
  misc_feature (1)..(110): Xaa is any amino acid
MKTLTMLWKSNQIDWVPIKKIDSEKKFQVRNSDLDMNHHVNNTKYLEWMIETIPENMNKKISEVDIIFLREGLYQDKIRSIAELNEEHTSHHQLINQDGETIALATFSFV

SEQ ID NO: 19223 - DNA, 477 bp, Unknown
  Obtained from environmental sample
  misc_feature (1)..(477): n is a, c, g, or t
atgattaaaaaaatcttttttatcatttttgtgtgtataggtttttcaatctatgcgcaaactggttctacagattttaggtctaagaattttacgttgttaaaagacacgattcagatagattctgtaagtatcaattcacaattatttaaagtatttactcaagacaaaacgctaattccgtcctcagaatatcaagtagattttgtaaaagcattacttataattgatgctcagaaatatgaattcataacgatagaatattttcggtttcctgattttatcaccaaagtatatcaaaaatatgatgataaaatcattgttccaaacaccaacaacacacagcaattatacagtttaacaaccaataaaaatcaacaacaaaaagaactctttaataacttagaaacttctggtaatattacaagaggattaacaattggaaacaatcaaaactcggttgtaactcttctttag

SEQ ID NO: 19224 - protein, 158 aa, Unknown
  Obtained from environmental sample
  misc_feature (1)..(158): Xaa is any amino acid
MIKKIFFIIFVCIGFSIYAQTGSTDFRSKNFTLLKDTIQIDSVSINSQLFKVFTQDKTLIPSSEYQVDFVKALLIIDAQKYEFITIEYFRFPDFITKVYQKYDDKIIVPNTNNTQQLYSLTTNKNQQQKELFNNLETSGNITRGLTIGNNQNSVVTLL

SEQ ID NO: 19225 - DNA, 714 bp, Unknown
  Obtained from environmental sample
  misc_feature (1)..(714): n is a, c, g, or t
ttgaaaaaaaatcgtaaacctaatgataacattatatttattgatgcaagtggtgaagatcattatttaaaaactggaaaattgaacacattacgtgatgaagacattgagttaattgttgatacctacaaaaaaagggtaacaaataagcactatagtaaggcagtaaaccttgatgaagtagcaaataataattacaaccttaatgttgccagatatgcagacagttccaatgcagctaaagaagttgaagctttaatagaacaatatggagactatgattatttaagactagaaaaagttattagaaacattaaatctataaataaaaatactgacctcagtaacagatcaaatgttttatactttcctagacaatcaaccctaaagattaaatcaaaatctgaaatcgagcaaatcaaacctaatagtaaatccaattattacgaaatagagttagatgaaaatattgtattaagtgagttcattacctacttttttgaatctgatttaggtcaaaatctaatcaagacaaaatcatcaggtatcacaatccaatcaattacaaaggatgatttactcaacacaatgaaaattcctgttccttctttatcaacacaaaaccaagttatttctgcttaccaattaatgaaccgagtaaaggaatctattagtgcagtccaaaaagaactttctctgagtccaactacttga

SEQ ID NO: 19226 - protein, 237 aa, Unknown
  Obtained from environmental sample
  misc_feature (1)..(237): Xaa is any amino acid
MKKNRKPNDNIIFIDASGEDHYLKTGKLNTLRDEDIELIVDTYKKRVTNKHYSKAVNLDEVANNNYNLNVARYADSSNAAKEVEALIEQYGDYDYLRLEKVIRNIKSINKNTDLSNRSNVLYFPRQSTLKIKSKSEIEQIKPNSKSNYYEIELDENIVLSEFITYFFESDLGQNLIKTKSSGITIQSITKDDLLNTMKIPVPSLSTQNQVISAYQLMNRVKESISAVQKELSLSPTT

SEQ ID NO: 19227 - DNA, 561 bp, Unknown
  Obtained from environmental sample
  misc_feature (1)..(561): n is a, c, g, or t
ttgttgtttttatcgttaatattaaggatgctaaaaatcggtggtcgttgtgcagtgattgttcctgatggtgttttatttggtgcttccaatgcacacaaaagtttaagacggcaaatagttgaggaacaaaagctagaagcagttatttctatacctggtggcgtgtttaaaccttatgctggagtgagtacagcgatattaatcttcaccaaaaccaataacggtggtacagacaatgtctggttttatgatatgcaagccgatggatatagcttggatgataaacgcactgaaatcaaagccagtgatatacccgatattttaaatcgctatcaaaatttatcagaagaagctcaaagaaaacgaaccgaacaaagttttatggtacctttcaatgaaatcaaagataataattgggagttaagcaacaaaatctacaaagaaatagtttatgaagaaattgaatatgctccaccagttgaaattattcaggaaattgaaaatctggataagaaaagaaacgaggctttgaaggttttgaaagagatgttgggatga

SEQ ID NO: 19228 - protein, 186 aa, Unknown
  Obtained from environmental sample
  DOMAIN (1)...(141): N-6 DNA Methylase
  misc_feature (1)..(186): Xaa is any amino acid
MLFLSLILRMLKIGGRCAVIVPDGVLFGASNAHKSLRRQIVEEQKLEAVISIPGGVFKPYAGVSTAILIFTKTNNGGTDNVWFYDMQADGYSLDDKRTEIKASDIPDILNRYQNLSEEAQRKRTEQSFMVPFNEIKDNNWELSNKIYKEIVYEEIEYAPPVEIIQEIENLDKKRNEALKVLKEMLG

SEQ ID NO: 19229 - DNA, 690 bp, Unknown
  Obtained from environmental sample
  misc_feature (1)..(690): n is a, c, g, or t
gtggtttttggattgttagaaagcggagtgaatgtgcttctttcaaaacgagaattgcacatgtacgacaaaaagtatcctgatatcaatgattgggttcttttaggcgatttagtcctaaaaagcgagcagcttgacgtgtcggccgaccgagtattccgagattacacaacacttagcagtgtgtataagaaacaatttcgcacatttggcaacccagaacgcgtaaaagatgagaaggatttgttgtggttaagaagcaaaggaatagacacacggatattctctgttatctactacttcctcattcccagttcaaaaatcaaagtaaacgataatgaaatgagttggtttcccatcaaccaactccctcaactaggatttgatcatgagctagtcatcaaacgatctttcaacgatcttcagagaaaagtacttaatgagccagctatctttgagtttttggaagacaagtttaccctcaacgaattgcactttgcctacgagtcggttcttggaatcgaaattgataatcgaaatttcagaaaaaaggctctgaacaaatcatatatcattccaatcgatgaaaaaaaggtgactggaaactcaaaaaaaccatcgaacctttacatgttcagtaaagatatttatgacaaaatcgcccctcagaatcatatcataaacatttaa

SEQ ID NO: 19230 - protein, 229 aa, Unknown
  Obtained from environmental sample
  misc_feature (1)..(229): Xaa is any amino acid
MVFGLLESGVNVLLSKRELHMYDKKYPDINDWVLLGDLVLKSEQLDVSADRVFRDYTTLSSVYKKQFRTFGNPERVKDEKDLLWLRSKGIDTRIFSVIYYFLIPSSKIKVNDNEMSWFPINQLPQLGFDHELVIKRSFNDLQRKVLNEPAIFEFLEDKFTLNELHFAYESVLGIEIDNRNFRKKALNKSYIIPIDEKKVTGNSKKPSNLYMFSKDIYDKIAPQNHIINI

SEQ ID NO: 19231 - DNA, 612 bp, Unknown
  Obtained from environmental sample
  misc_feature (1)..(612): n is a, c, g, or t
atgatatggttgactttaaaaagattcatttctaaaaagagcctttctaattgttattttcttacaaataataccagagacttttacgatgattcaggtatagatttacacccaacattaaaaaatgacattcctgatctaaaactatttaagtcatcaaaagagttaatccttaccgttgataacctcaatataatattagaaaaggatgagttagaaatgtggagttatttattagtccaagaagatgatattaaaaatattttattgaatgatattaatgtagaattttcaagtaaaatagaatttgagataaaacacaaatatgaagggaaactctttcacagcaacattatagacgaagtaaaaacggggtttatagacgatattgttataaagagtaaggattttaaggttgttcataactttagtttattcagttgtcaatttgagttattgatgcctacactatttagtaattatgaagaactaattgaagacttcatatctaatgaatacctagtaaaagtaaatggtaaagtagattttacagttcgacgtaacgaaaaagcccaatttatcagcattgatgacttggaactaaaagtatag

SEQ ID NO: 19232 - protein, 203 aa, Unknown
  Obtained from environmental sample
  misc_feature (1)..(203): Xaa is any amino acid
MIWLTLKRFISKKSLSNCYFLTNNTRDFYDDSGIDLHPTLKNDIPDLKLFKSSKELILTVDNLNIILEKDELEMWSYLLVQEDDIKNILLNDINVEFSSKIEFEIKHKYEGKLFHSNIIDEVKTGFIDDIVIKSKDFKVVHNFSLFSCQFELLMPTLFSNYEELIEDFISNEYLVKVNGKVDFTVRRNEKAQFISIDDLELKV

SEQ ID NO: 19233 - DNA, 504 bp, Unknown
  Obtained from environmental sample
  misc_feature (1)..(504): n is a, c, g, or t
gtgggatattcctcagttccccttttaaaagtatatgccaaggttaatgataaatacctaatgtttaaaatgtcagaacatggtggactgtggatagatataaaggctattgatgatatgtcttcaagatttctgacctataaaaagcttctttttggtaatagagatgaattgccatccgaagtggttaaaatggcaaactttgctaccattggagttaacttaacggatatttgtctgaattttaggaaaggaccttctacaaacgatgacaaaatagattgtataaatggcaatagctggagtaataagcaatgggtccattttaagatacttgagcacaaggataaatgggcaaaggtagaggctacgtatacaatatatggagaggatgatactggaggagactgttcatttacagagattaagaaagagactggttgggtaaaagctttaggtgatgatggttatcctaatatttggttttcagttactgcttattaa

SEQ ID NO: 19234 - protein, 167 aa, Unknown
  Obtained from environmental sample
  misc_feature (1)..(167): Xaa is any amino acid
MGYSSVPLLKVYAKVNDKYLMFKMSEHGGLWIDIKAIDDMSSRFLTYKKLLFGNRDELPSEVVKMANFATIGVNLTDICLNFRKGPSTNDDKIDCINGNSWSNKQWVHFKILEHKDKWAKVEATYTIYGEDDTGGDCSFTEIKKETGWVKALGDDGYPNIWFSVTAY

SEQ ID NO: 19235 - DNA, 843 bp, Unknown
  Obtained from environmental sample
  misc_feature (1)..(843): n is a, c, g, or t
gtgcgcaatgaggaggaacgtatcgaatccattttgacagatttactggaactggattatccagattatgaagtggtgcttgtcgatgatttttcagaagatcacacccttcttaaagtagcgcaactggccaaaaaatatccacggctaaagtttacatccatcagccaggaaaccaacttttcagagaaaattgcgattaacttgtctttgaaggcagcatcattcgatcgcattgtttttttaagtcccgaaagtcagtcagttgattcagcatttttgaagaagttggatgacaacgccggcgattcaaatttgatgatatgctacattaactttgcgccccaaaaaagctggcgtaacaagctttgccgaatcgaacggctgacagctttcgtttattcagccgctttttcgatggccggactaccggtgttttacgaagatcgaaatgtgcttttccagaagtctatctactttgatcaatctggattccgcggaaaaatgaacgatcattttgcgaatctcgaattgattttcaacgatcggtttaaaaagaaaatccatgtgtcgattgatccggacacctttatttacgagcaaggtgggattcaacgcggcgttttttttgatcttctgaaaaagagaatacggttaacccagcacttgggattctggaaacgactggtttatttcatgggtgatctatccaaatccttgtttttcggcaccttggtctggatgttggtcactgaacctaaaaactgggtgtctgtagttgttcctgccatacttgttctggtgatgcaattttttattcttaaaagtgtggtcgctcatttn

SEQ ID NO: 19236 - protein, 281 aa, Unknown
  Obtained from environmental sample
  misc_feature (1)..(281): Xaa is any amino acid
MRNEEERIESILTDLLELDYPDYEVVLVDDFSEDHTLLKVAQLAKKYPRLKFTSISQETNFSEKIAINLSLKAASFDRIVFLSPESQSVDSAFLKKLDDNAGDSNLMICYINFAPQKSWRNKLCRIERLTAFVYSAAFSMAGLPVFYEDRNVLFQKSIYFDQSGFRGKMNDHFANLELIFNDRFKKKIHVSIDPDTFIYEQGGIQRGVFFDLLKKRIRLTQHLGFWKRLVYFMGDLSKSLFFGTLVWMLVTEPKNWVSVVVPAILVLVMQFFILKSVVAHX

SEQ ID NO: 19237 - DNA, 636 bp, Unknown
  Obtained from environmental sample
  misc_feature (1)..(636): n is a, c, g, or t
atggaaatcatcaataaatattttccggatttaacgggccggcagcaggaacagctggctcaacttggtcctctgtaccgcgaatggaatgaaaaaattaatgtcatttcacgaaaagacattgatcagctttacgaacgtcacgttcttcattcgttgtccatagcgaagtacattcggtttgcaccgggcacttcgattatggatgttggcacaggaggtgggtttcccggtattccgctggctatattatttcctgaaacaagctttttactggttgattccattgcaaaaaaaataagggtggttgaaggaatcagcgaaagtttaggactgacgaatgttagcgcgcggcaaaaccgcgccgagaaagtagatggtcaatttgattttgtggtgagccgtgcggtaacagcattccctaagtttgtggcgttgatccggaaaaagatcagcagtaggcagaagaatacgttaggaaacggtattctatacctaaaaggcggtgatttttctgacgagttggaaccctttaagaaacaggtgcaggtttatcctttgagtcagcagtttgaagaggaatttttcgaaaccaagaagctgattcatttgccgctaaaaaagcttctaaaataa

SEQ ID NO: 19238 - protein, 211 aa, Unknown
  Obtained from environmental sample
  DOMAIN (15)...(202): Glucose inhibited division protein
  misc_feature (1)..(211): Xaa is any amino acid
MEIINKYFPDLTGRQQEQLAQLGPLYREWNEKINVISRKDIDQLYERHVLHSLSIAKYIRFAPGTSIMDVGTGGGFPGIPLAILFPETSFLLVDSIAKKIRVVEGISESLGLTNVSARQNRAEKVDGQFDFVVSRAVTAFPKFVALIRKKISSRQKNTLGNGILYLKGGDFSDELEPFKKQVQVYPLSQQFEEEFFETKKLIHLPLKKLLK

SEQ ID NO: 19239 - DNA, 456 bp, Unknown
  Obtained from environmental sample
  misc_feature (1)..(456): n is a, c, g, or t
atgtgcaaatggtatgtttcccttgaaaaatttgaggatgcatgcaagactgccgatctcctggctgaagctgaccctgagagtaaataccccaagaactttaaaaggcaacactgtgtggatgataaaatcgccgaggatctgaaatcgtgcgttttggtcgaaattgtttcgagttcggaatccaaagaaatagaagtcaaagaagtgggagagttagagggttgctatttgggaggatccaatatagtttccgcaaaagaaatccaagttgggcaattggtttcactggcccaatgtttagaaaatatgaagatgggcgaggcggtatacagaatcaccaagatcagcaggtcaaatatcagcctggagccatggtattggtcaattcttatcaatgacgagccagcagaatgtagttttattcccggagataactggattgttgaatggtga

SEQ ID NO: 19240 - protein, 151 aa, Unknown
  Obtained from environmental sample
  misc_feature (1)..(151): Xaa is any amino acid
MCKWYVSLEKFEDACKTADLLAEADPESKYPKNFKRQHCVDDKIAEDLKSCVLVEIVSSSESKEIEVKEVGELEGCYLGGSNIVSAKEIQVGQLVSLAQCLENMKMGEAVYRITKISRSNISLEPWYWSILINDEPAECSFIPGDNWIVEW

SEQ ID NO: 19241 - DNA, 621 bp, Unknown
  Obtained from environmental sample
  misc_feature (1)..(621): n is a, c, g, or t
ttgggtaaaattaatgtggttaaattatcacgtcattcagatcatcataacaacggaagcaaacacttatcaaatgttaaaatcgttgccagaaagtccacaaatgccaacaggttatccaggaatggtcatcttagcattagtgcctccattgtggttttcggtgatgcatacaaaactaaaagaacaataggatttatgaatattccgcaaatagtacaagagcaaaaaacatattttgcttcgcaacaaaccaaagacatttccaacagaaaaaaacttttaaaaaggttactttcagaagttactaaaagagaaaaagacattgtaaatgcgctgtatttagattttaaaaaatcggaatacgaaagtgtaatgacagaaacttccattgtaatttctgaactcaaaagaaccattaaaaacatcaatgcttgggcaaaaccacaaagcgtgatgcctgcatttttaaactttccgtcttctagtagaatctacaaagaaccttacggaactattttaataattgctccttggaattatccgtatcaactcgcattagttccacttattggtgcaattgctgcaggaaatactgtggttgtaaaccatcagaattaa

SEQ ID NO: 19242 - protein, 206 aa, Unknown
  Obtained from environmental sample
  misc_feature (1)..(206): Xaa is any amino acid
MGKINVVKLSRHSDHHNNGSKHLSNVKIVARKSTNANRLSRNGHLSISASIVVFGDAYKTKRTIGFMNIPQIVQEQKTYFASQQTKDISNRKKLLKRLLSEVTKREKDIVNALYLDFKKSEYESVMTETSIVISELKRTIKNINAWAKPQSVMPAFLNFPSSSRIYKEPYGTILIIAPWNYPYQLALVPLIGAIAAGNTVVVNHQN

SEQ ID NO: 19243 - DNA, 558 bp, Unknown
  Obtained from environmental sample
  misc_feature (1)..(558): n is a, c, g, or t
atgggaacaacaaaacgtatatgtgagctttatgcacaaaactctaatggaaacggtactgatatagttgctgtaaggtttggtaatgtattgggaagtagtggtagcgttattcctaagtttaagtctcaaatcgagaatggccaaaatattactgtaacgcatccagatatcacaagatactttatgcttattcctgaagcttgtgagcttgtacttcaagctggagctataggtacgggtggtgagatatttattcttgatatgggtgaacctattaaaataattgatttagccaaaaagatgatagaactaagtgattctaaagatatagagatagagtttactggacttcgtccaggagaaaaactttatgaagaattgcttatagacgatgcagattgtaaaacagagtatgaatctataactgtcgcagcaccaacaaagtatgatatagctaagctaaacaaagatattgaagaattaatcaataataataataagctagaaaaactcaaagagatagtacctgaatttaatcatcaaaaaaacatatga

SEQ ID NO: 19244 - protein, 185 aa, Unknown
  Obtained from environmental sample
  DOMAIN (1)...(178): Polysaccharide biosynthesis protein
  misc_feature (1)..(185): Xaa is any amino acid
MGTTKRICELYAQNSNGNGTDIVAVRFGNVLGSSGSVIPKFKSQIENGQNITVTHPDITRYFMLIPEACELVLQAGAIGTGGEIFILDMGEPIKIIDLAKKMIELSDSKDIEIEFTGLRPGEKLYEELLIDDADCKTEYESITVAAPTKYDIAKLNKDIEELINNNNKLEKLKEIVPEFNHQKNI

SEQ ID NO: 19245 - DNA, 486 bp, Unknown
  Obtained from environmental sample
  misc_feature (1)..(486): n is a, c, g, or t
atgtctgaattactgctcaaagcacaaggaatttataaaagctacgacgacgaaaacggcggtcccgcacttcaagtattagaagatgtttctcttgaagttaagaaaggaactatcacttctattgttgggtcaagcggtagtggaaaaagtacgttacttcatattttgggtggcttagacaagccaaataaaggatctgtgctgtggaaggataaagatatcagtgctatgaagcctgacgccttggctgaattcagaaacaaaaacatcggctttgtatttcaatttcatcatttgcttcctgaattcactgccttagaaaatattgcgatgccttgcgctaattgctggtgtatctatcaaagatgcctcagaacgagcattagatctaatgaagcgatttggagtagcagacagaaggtttcatcgccttatcaactctcaggtggagaacaaaacgcgtgtctatgtcacaggcgctga

SEQ ID NO: 19246 - protein, 161 aa, Unknown
  Obtained from environmental sample
  DOMAIN (37)...(160): ABC transporter
  misc_feature (1)..(161): Xaa is any amino acid
MSELLLKAQGIYKSYDDENGGPALQVLEDVSLEVKKGTITSIVGSSGSGKSTLLHILGGLDKPNKGSVLWKDKDISAMKPDALAEFRNKNIGFVFQFHHLLPEFTALENIAMPCANCWCIYQRCLRTSIRSNEAIWSSRQKVSSPYQLSGGEQNACLCHRR

SEQ ID NO: 19247 - DNA, 585 bp, Unknown
  Obtained from environmental sample
  misc_feature (1)..(585): n is a, c, g, or t
atggttcaatctgaaaagtatcgaaagagattatttttattgactggcacacattttcgggaaaaaggtggaatgttttgcatcaccccacgtaaagagcggaatatcgaagtgttaagtcagctgaaaatccctcttatttttggaattgagcaggctctccaaggaacctcaatggagtatgtggatgatgctggccacattggctttgcctttgaaacaggaacacatggtacaaaggttgccgaagataatgcctatgcagggcttcttatcttgttagtaagttctggccttatttcagctaaaaagttgcatgactttgatctgtactatgattatttgatggggaaagtggagcaataccctcacaaagtagaatatgtgtataagcatattattgaagaaggagataattttgtgatgttgccaggattcaagaattttgattccatcaaaaaaggcgatttattggctaatgatagaaacggtgagattcgttctttatccgatggctatgtgttgatgccactctatcaaaaacaaggcaatgatggtttttttattgtaagagattgtgaatag

SEQ ID NO: 19248 - protein, 194 aa, Unknown
  Obtained from environmental sample
  misc_feature (1)..(194): Xaa is any amino acid
MVQSEKYRKRLFLLTGTHFREKGGMFCITPRKERNIEVLSQLKIPLIFGIEQALQGTSMEYVDDAGHIGFAFETGTHGTKVAEDNAYAGLLILLVSSGLISAKKLHDFDLYYDYLMGKVEQYPHKVEYVYKHIIEEGDNFVMLPGFKNFDSIKKGDLLANDRNGEIRSLSDGYVLMPLYQKQGNDGFFIVRDCE

SEQ ID NO: 19249 - DNA, 621 bp, Unknown
  Obtained from environmental sample
  misc_feature (1)..(621): n is a, c, g, or t
ttgaaggaaatgctcatccatgattatcaattcaaagaagatcaggtgacgtttctacccaattgtaaaaaggatgaatttttgaatcaattggagaagattttgcccagtaaatcgaccagccaaacgcgattgttgatttgggttataagtcatggcaccgtagacaaaaccatcgagttttcggatgcgccagttcaagcggatgatatctggaaccgacttgggaagaaaaaaggtgatggcagctattcctttgaatgcaaacagatactttttgtaatcgatgcctgttacagtggtgcgatgatcaaggatggccaggaggaatacaatccaagccgaagtgtttgtgatgcggttgaagcaggatctcgaattgttgttacctctacttcatttgaaactacccgggagagtcagtttacccgtgaatttctcaagcaactaaccatcaattcaaagccctatcttaccattgataagctctttgacgagtcaagaaaggagtttttgaaaagcaattcaggaaacaccaatcccagactgacgatttttgacgatgtaaatcatcaggacaaaggatcctatttattcattaagaaaaagttcttcaaatga

SEQ ID NO: 19250 - protein, 206 aa, Unknown
  Obtained from environmental sample
  misc_feature (1)..(206): Xaa is any amino acid
MKEMLIHDYQFKEDQVTFLPNCKKDEFLNQLEKILPSKSTSQTRLLIWVISHGTVDKTIEFSDAPVQADDIWNRLGKKKGDGSYSFECKQILFVIDACYSGAMIKDGQEEYNPSRSVCDAVEAGSRIVVTSTSFETTRESQFTREFLKQLTINSKPYLTIDKLFDESRKEFLKSNSGNTNPRLTIFDDVNHQDKGSYLFIKKKFFK

SEQ ID NO: 19251 - DNA, 360 bp, Unknown
  Obtained from environmental sample
  misc_feature (1)..(360): n is a, c, g, or t
atgtacattctagattttgttgacttagaaggttactgggaaactgttgctgatatcattaagccacaaggtcacattgtatcgattacagaaagcagtaaaccgctgaacttaaatctcttgaaaggcaagagcgttactttttcatgggaattgatgtatacacggtcaatgttcaacaccgaggatatggtgaaacaacatgagattctaaatcaaattgctgacttattggatgcaggtaccatcaaaacatcgctaacaactacacttaatggatttagtgttgagaacctcaaaaaggctcacgaaatgcaagaatccggcaaaacaattggtaaaaccgtaatacaatattaa

SEQ ID NO: 19252 - protein, 119 aa, Unknown
  Obtained from environmental sample
  misc_feature (1)..(119): Xaa is any amino acid
MYILDFVDLEGYWETVADIIKPQGHIVSITESSKPLNLNLLKGKSVTFSWELMYTRSMFNTEDMVKQHEILNQIADLLDAGTIKTSLTTTLNGFSVENLKKAHEMQESGKTIGKTVIQY

SEQ ID NO: 19253 - DNA, 1023 bp, Unknown
  Obtained from environmental sample
  misc_feature (1)..(1023): n is a, c, g, or t
ttgggttctaatagcttatctgggatgggtgtgttgccaattaatcacggaaatcagccgaatatgcaggcttcctatttattcaattattcgggaaaaccttggctaacccaatattggtcacgagagataatggataaatattatggaacaacaccagaaaatggttggttaggagacgaggaccagggacaaatgggtgcttggtttgtgatgagcgccttaggactatttcagatggatggtggcgcctccgaaaatccaatctatgagataggaagtccactctttgataaagttaccatccacttagacgaaaaatattatcccggtggtaaatttgtaattaatgccaaaggaacgtctaaaaagaatagatacatccaatctgcaaaattgaacggcaagaaatggaaccaaccttggttttatcacgcagatcttgcaaaaggtggtgttcttgaactcaatatgggtagcaaaccaaacaaaaaatggggtagtaaaccagagcaagccccaccatctctaagtagcatgttaagccaagatgagattgatgagattatggcatatgatagacaggcagaggaattggaagaatggaatagagccgttaaagcttattactatcataaaaaggagcattttgagcttttgccgaatactccaaactctatattatttttgggtgatagtattaccgataatgcggaatgggtagagttatttgggaataatcctcgagttaaaaatagaggaattggcggcgacgatactgacggtgttttagggagactaaaagaagtaaccgaatctcagccaaataagatattcattatgattggtacgaatgatttggcatacggaaagtctaaagaatatgtattgaaaatttatcgtgagattctggagagaatcaagtcagactctccaacactaaagtattcgtacaaagtgtgctgccccgtaatgaagctatacatccacacgatcggatgctgctataaaattcatcaataa

SEQ ID NO: 19254 - protein, 340 aa, Unknown
  Obtained from environmental sample
  misc_feature (1)..(340): Xaa is any amino acid
MGSNSLSGMGVLPINHGNQPNMQASYLFNYSGKPWLTQYWSREIMDKYYGTTPENGWLGDEDQGQMGAWFVMSALGLFQMDGGASENPIYEIGSPLFDKVTIHLDEKYYPGGKFVINAKGTSKKNRYIQSAKLNGKKWNQPWFYHADLAKGGVLELNMGSKPNKKWGSKPEQAPPSLSSMLSQDEIDEIMAYDRQAEELEEWNRAVKAYYYHKKEHFELLPNTPNSILFLGDSITDNAEWVELFGNNPRVKNRGIGGDDTDGVLGRLKEVTESQPNKIFIMIGTNDLAYGKSKEYVLKIYREILERIKSDSPTLKYSYKVCCPVMKLYIHTIGCCYKIHQ

SEQ ID NO: 19255 - DNA, 402 bp, Unknown
  Obtained from environmental sample
  misc_feature (1)..(402): n is a, c, g, or t
atgattcttcaagattacagaaaaacaagagaaaaggattttaaaagtataattgattcgttaaaagaagaatcaatttatgcttccgataagtctctgttatgttttggtgattcattagaattgttaaaatcaataccagataaaagtatatcactaatattaatagacccaccttatcacagtaccaagaaaaaaaatattaagaatgataccgctttcagttcggatgatgattttctaaattggattgaagagttttcggaacaatgggttaggattttgaaaccaaatggttcattatacttattctgttcttctaaaatgtctgcaaggttagaagttcttttaaccaaacgttttaacatcttatctcacgttgtgtggtcaaaaccnaaatga

SEQ ID NO: 19256 - protein, 133 aa, Unknown
  Obtained from environmental sample
  misc_feature (1)..(133): Xaa is any amino acid
MILQDYRKTREKDFKSIIDSLKEESIYASDKSLLCFGDSLELLKSIPDKSISLILIDPPYHSTKKKNIKNDTAFSSDDDFLNWIEEFSEQWVRILKPNGSLYLFCSSKMSARLEVLLTKRFNILSHVVWSKPK

SEQ ID NO: 19257 - DNA, 420 bp, Unknown
  Obtained from environmental sample
  misc_feature (1)..(420): n is a, c, g, or t
atgaaacaaaaatttaggtcgaattgtccaattagttcagcactagacttaataggggataagtggtcattattaattattagagatatgatgttctctggaaaggaaacatatagtgaatttagcaactcgaatgaaaaaattgctacgaatatcctttcaaacagactatcaatgcttgaagaattgggaataattgataaagggaaaaaagaggggaataaaaaaaccaatatttatagcctctcgcaaagaggaaaagaattacttcccataattttggaaattgctcaatggagcgacaataatttgaatgatcacctgaaagatggagcaaaaccatttgtcaataaattcaaatcagataaagtaggatttgttcaaaacatgtatgcattatttgaaaagcgagaagggtga

SEQ ID NO: 19258 - protein, 139 aa, Unknown
  Obtained from environmental sample
  DOMAIN (17)...(108): Transcriptional regulator
  misc_feature (1)..(139): Xaa is any amino acid
MKQKFRSNCPISSALDLIGDKWSLLIIRDMMFSGKETYSEFSNSNEKIATNILSNRLSMLEELGIIDKGKKEGNKKTNIYSLSQRGKELLPIILEIAQWSDNNLNDHLKDGAKPFVNKFKSDKVGFVQNMYALFEKREG

SEQ ID NO: 19259 - DNA, 1005 bp, Unknown
  Obtained from environmental sample
  misc_feature (1)..(1005): n is a, c, g, or t
ttgcatgatatttatagcattgaagatcttaaacaactgattcatgaccttaagcaacttcacccaaatggtagagtgagtgtaaaattggtttcaggagttaatattggaacaattgccgtgggggttgcaaaagctggcgctgatacgattcaggtttcagggggtgaaggtggaaccggagctgcgtctttaagctcaatgaaacacgcagggctaccttgggaaattggattacttgaagtgcatcaatcattgatagaaaatgatcttcgtgatcatgttttgctaagaactgatggaggactatcaagtggaaaggatatcgtattagcgtctattcttggagctgaggaatttgatttcggtaagttgttactgattgcggaaggctgtgtaatggcaagaatatgtgagaaaaatacttgtccaacagggattgctactcatgatccaaagttcaaagcaaagtataaagggaacaaagatcatattattgatacccttacctatcttgcagaagatgttcgaagagagctagctaaaattggtgtagaatctttgccgaatattatggggaatacagcgttgcttacaattaatgagatacatcagccactaataaataaattggggctcgatcttggtttctttacaggtgcacctgaatatcataaagaagaggatttggaatcactttcagatccagtgagtgcattaaactcaaacattgttcatgacctaaaagacaaaatcgagaaaaatgagccaatagaagaagaatatgaaatcataaatacggatcgttctgctttagctactctatttggacttttagcggagaaagaaagcaaagaccgattagcatccatcaaaaataaaaagacaagtgttaaaccctatactcaaaaaattgatttaccatttagaggaagccccagccaaagttttggggttttttcaaaccaaaggagtttacttcagaccttatgggtgaacaaatga

SEQ ID NO: 19260 - protein, 334 aa, Unknown
  Obtained from environmental sample
  DOMAIN (1)...(186): Conserved region in glutamate synthase
  misc_feature (1)..(334): Xaa is any amino acid
MHDIYSIEDLKQLIHDLKQLHPNGRVSVKLVSGVNIGTIAVGVAKAGADTIQVSGGEGGTGAASLSSMKHAGLPWEIGLLEVHQSLIENDLRDHVLLRTDGGLSSGKDIVLASILGAEEFDFGKLLLIAEGCVMARICEKNTCPTGIATHDPKFKAKYKGNKDHIIDTLTYLAEDVRRELAKIGVESLPNIMGNTALLTINEIHQPLINKLGLDLGFFTGAPEYHKEEDLESLSDPVSALNSNIVHDLKDKIEKNEPIEEEYEIINTDRSALATLFGLLAEKESKDRLASIKNKKTSVKPYTQKIDLPFRGSPSQSFGVFSNQRSLLQTLWVNK

SEQ ID NO: 19261 - DNA, 474 bp, Unknown
  Obtained from environmental sample
  misc_feature (1)..(474): n is a, c, g, or t
atgccaacagctcctggatgtcaagttatagcaaccatttatgataaagatgtaaaagtagatgaatttcacgcttttgcctttgcagcttgggatccacacaccacacaaaaagagagtcgaacttgtattgactgccacttcaatccacaaacattaggacttggagctggaattttagatataaaagataacaatgtcacttttaatccccactatcaaagtaaagaagatggacttcctattaactatccaatcgatgccctaatttcaaaagagggaaaacagtttcaaagcttttcaagaaaagatgcaagaggttttaataaaaaagaggtaaataaaataatagaagcatataagtgtatcatctgccataataaatgggatgatacaatctataaagattttcaaaaaagtaaaaaacttttttatgataaaaaaacttcttgtagtaaagaggtattaaaatga

SEQ ID NO: 19262 - protein, 157 aa, Unknown
  Obtained from environmental sample
  misc_feature (1)..(157): Xaa is any amino acid
MPTAPGCQVIATIYDKDVKVDEFHAFAFAAWDPHTTQKESRTCIDCHFNPQTLGLGAGILDIKDNNVTFNPHYQSKEDGLPINYPIDALISKEGKQFQSFSRKDARGFNKKEVNKIIEAYKCIICHNKWDDTIYKDFQKSKKLFYDKKTSCSKEVLK

SEQ ID NO: 19263 - DNA, 324 bp, Unknown
  Obtained from environmental sample
  misc_feature (1)..(324): n is a, c, g, or t
ttgcttgtctggtgctcgttcagcaacaaactcgcgatgattaatcagaatatttttttctgtgcacaaagcttcgaaatctcggacagtgcagaagtgaatgtttggcgtgtcataccattggtaggtgagctgtttggtaacgggcatacggccatgaataaaaagggatgttcttgctcgccaattaccaaaattagggaacgtcacaatacatttttctccaatgcgaagcatttcttccaatacaagatgtggatagcgcattacttggagtgcttgtgtcataacgacagtatcaaagctgttgtctggaaattgtga

SEQ ID NO: 19264 - protein, 107 aa, Unknown
  Obtained from environmental sample
  misc_feature (1)..(107): Xaa is any amino acid
MLVWCSFSNKLAMINQNIFFCAQSFEISDSAEVNVWRVIPLVGELFGNGHTAMNKKGCSCSPITKIRERHNTFFSNAKHFFQYKMWIAHYLECLCHNDSIKAVVWKL

SEQ ID NO: 19265 - DNA, 459 bp, Unknown
  Obtained from environmental sample
  misc_feature (1)..(459): n is a, c, g, or t
atgaaaaaaacaattctagttttaatttgcctttttagtatatcggcactttttgcgcaaagtccatctcaagcagcaacgtatgctgtttctggtaaagtaattgacaaagacaccaaacaacctttagaatatgctactgttgttctaaaaaacttaaaaagcaacaaattaagtggtggaattactgatggaaaaggtgaattttacattaaaattgctggcggtacgtatgatataagtgttgagtttatttcttttaaaacaattcgttttaataatagaactattgataaaaacatcaatcttggaaccgtaattttatctgaagatggccaagtgcttgatgaagtaaacatcattccagaaaaatctaccgtagatattcgtttagataaaaaaatatataacgttggtaaagacatgaccgttaaaggaggaaatgttgccgatgtttag

SEQ ID NO: 19266 - protein, 152 aa, Unknown
  Obtained from environmental sample
  SIGNAL (1)...(19)
  misc_feature (1)..(152): Xaa is any amino acid
MKKTILVLICLFSISALFAQSPSQAATYAVSGKVIDKDTKQPLEYATVVLKNLKSNKLSGGITDGKGEFYIKIAGGTYDISVEFISFKTIRFNNRTIDKNINLGTVILSEDGQVLDEVNIIPEKSTVDIRLDKKIYNVGKDMTVKGGNVADV

SEQ ID NO: 19267 - DNA, 426 bp, Unknown
  Obtained from environmental sample
  misc_feature (1)..(426): n is a, c, g, or t
atgattacacaagaacaagtaaaaaatatttctgatagaatttctaagcttcaacagtatttaaatattgagcaaaagctgatagaaattaccaatgaagaagaaaaaacaatgtcgccagatttttggaataatccaaaagaagcggaagcgtttatgaaagaactccgaatcaaaaaaaaatgggtaaacgattataacaccgttgttggtttattagaagacgttcaagtattgttagatttttacaaagaagacgaagtttctgaacaagaagttgttgcgcaattcacaaaaacagaagaagtattagaagccatagaattcagaaatatgctttctgacgaaggcgataatttaagtgctgttatccaaattactgctggagcaggcggacaaaaaattgcgactggccagaaatgctga

SEQ ID NO: 19268 - protein, 141 aa, Unknown
  Obtained from environmental sample
  misc_feature (1)..(141): Xaa is any amino acid
MITQEQVKNISDRISKLQQYLNIEQKLIEITNEEEKTMSPDFWNNPKEAEAFMKELRIKKKWVNDYNTVVGLLEDVQVLLDFYKEDEVSEQEVVAQFTKTEEVLEAIEFRNMLSDEGDNLSAVIQITAGAGGQKIATGQKC

SEQ ID NO: 19269 - DNA, 321 bp, Unknown
  Obtained from environmental sample
  misc_feature (1)..(321): n is a, c, g, or t
atgaatactatcacttcaaagttggacgcagaacacaaagaatggctggataaaattcgctcatgggaaagtgagttgggcgaaatggaatctgaaaatggcaaaatagtggctcgtacagaaagcaaggatgctcaaaagaaagtagagcatttccaaaatcagattttgattcagaaacagcaacttgatcagatgaagcacaacatcaagatttatggcggggaccttgaaaaggggcagaccgagttgagcgaatacaatgagtattacaataatttccgcaacgaattcaaaacgtttacggcacagtataactga

SEQ ID NO: 19270 - protein, 106 aa, Unknown
  Obtained from environmental sample
  misc_feature (1)..(106): Xaa is any amino acid
MNTITSKLDAEHKEWLDKIRSWESELGEMESENGKIVARTESKDAQKKVEHFQNQILIQKQQLDQMKHNIKIYGGDLEKGQTELSEYNEYYNNFRNEFKTFTAQYN

SEQ ID NO: 19271 - DNA, 471 bp, Unknown
  Obtained from environmental sample
  misc_feature (1)..(471): n is a, c, g, or t
atgacagtttctattccaattgcaaatcgagtagctataaaatatgttgtaaatggagacactgtttctataataagcaatggcagagtacaaaaaatagatcaaaaagaaaagcaaagagttttaagtgaagcggttatttttccagaattagaatatggtcaaaaaggctatcaaacagctcttttggggatgcaaatgacgaatggtcaacagttgtatgtagtacaagtaacatcaccgagtggcgaaattagtaaagagtattatgatgttgcttctggtttaaaaacaaagcaagaagttcttggagataaaagtgttttaattactgaatattcaaattacaaattggtaaacggaataaaaattccatacacacaaacgtctaatagttttggacaaagtattgagatgaaattgaaggaggttaaagtaaatggaggaattgatgattcagattttaaatga

SEQ ID NO: 19272 - protein, 156 aa, Unknown
  Obtained from environmental sample
  misc_feature (1)..(156): Xaa is any amino acid
MTVSIPIANRVAIKYVVNGDTVSIISNGRVQKIDQKEKQRVLSEAVIFPELEYGQKGYQTALLGMQMTNGQQLYVVQVTSPSGEISKEYYDVASGLKTKQEVLGDKSVLITEYSNYKLVNGIKIPYTQTSNSFGQSIEMKLKEVKVNGGIDDSDFK

SEQ ID NO: 19273 - DNA, 444 bp, Unknown
  Obtained from environmental sample
  misc_feature (1)..(444): n is a, c, g, or t
atggaatatgaacctcttattggtttgtctgattgcaactcatacagaattggaaacgataataaatggttacctcccgtaaaaatgacttgggaatttaagtacatcatgaatggcatggcagttcaagatcaaactttaaaagaagatggcattcactctggaagtattcggcaatttaatgccgatagcagtgcttggtatgttcactattacaccacagcaagtgcaagctcaagcctgaaaacttggactgggggcaaaaccaacgataaaatcattttgtacagcgatcaaaaagcaccaaatggtatggacggtttatataaaatcagcttttatgatatctctacagaaggatttaactggattggtgaatgggttaaccaagatgaatccattatcttccccacttggaagattgagtgtaaaaaaagagtataa

SEQ ID NO: 19274 - protein, 147 aa, Unknown
  Obtained from environmental sample
  misc_feature (1)..(147): Xaa is any amino acid
MEYEPLIGLSDCNSYRIGNDNKWLPPVKMTWEFKYIMNGMAVQDQTLKEDGIHSGSIRQFNADSSAWYVHYYTTASASSSLKTWTGGKTNDKIILYSDQKAPNGMDGLYKISFYDISTEGFNWIGEWVNQDESIIFPTWKIECKKRV

SEQ ID NO: 19275 - DNA, 648 bp, Unknown
  Obtained from environmental sample
  misc_feature (1)..(648): n is a, c, g, or t
atggcgactaagaagcaaaaatattatgtggtttgggctggcagaaaaaaaggtgttttttcttcttgggacgattgtaaaaaacaaatagatggttttgagggtgcacaatacaaagcttttactgataaaaaagaagcacaattagcatacaataaaaactacttttcttacaaaggaaaggacaccaaaaaacccacgttaacggaatcggaaaagaaaaaatatggttctccaatcttagaaagtatttctgtggacgctgcgtgtagtgggaatccagggaaaatggagtatcgtggagttctcactcacaacaaacaacaaattttcatcaaaggccctttcgaaaaaggcaccaataatattggcgaatttttagcgctcgttcacggattggctttgttaaaaagtaaaaagaaagaagacatccctgtgtattctgattctaaaattgccatgagttggattaaaaaaaagcaatgcagaaccaatttgatttttgatgcttctaacaaagatttattagagttgattaaacgtgccgaaaaatggcttcatgaaaactcgtttaaaaatcccattttaaaatgggaaacaaaagcttggggaagaattcctgcagattttggaagaaaagtactttaa

SEQ ID NO: 19276 - protein, 215 aa, Unknown
  Obtained from environmental sample
  DOMAIN (82)...(196): RNase H
  misc_feature (1)..(215): Xaa is any amino acid
MATKKQKYYVVWAGRKKGVFSSWDDCKKQIDGFEGAQYKAFTDKKEAQLAYNKNYFSYKGKDTKKPTLTESEKKKYGSPILESISVDAACSGNPGKMEYRGVLTHNKQQIFIKGPFEKGTNNIGEFLALVHGLALLKSKKKEDIPVYSDSKIAMSWIKKKQCRTNLIFDASNKDLLELIKRAEKWLHENSFKNPILKWETKAWGRIPADFGRKVL

SEQ ID NO: 19277 - DNA, 417 bp, Unknown
  Obtained from environmental sample
  misc_feature (1)..(417): n is a, c, g, or t
atgaaatttacaagttatttattcttcttattcttcatctttatgaattgcactgctcaaaagttactcgatttaaaagaagttacttatgaggccaatactagaggtaaaaacatggagcttaaaatcacagcagattcaataatttataaagataatcacaaaataaaaaaattaaaaacaacctctgatacttggaaagaaattacaaaaattgcttctaaaatagacatgcattctatagcgaattttaaccctccatctgaaaagagaatttcagataaagcgttacacgctacattaaaagttgatgtaaatgatgggctatatgtttcacaagtttttgatcatgggaatccaccaaaagaattaaaacgtcttattgatttactttttaaagtagcagaattcaagtaa

SEQ ID NO: 19278 - protein, 138 aa, Unknown
  Obtained from environmental sample
  SIGNAL (1)...(19)
  misc_feature (1)..(138): Xaa is any amino acid
MKFTSYLFFLFFIFMNCTAQKLLDLKEVTYEANTRGKNMELKITADSIIYKDNHKIKKLKTTSDTWKEITKIASKIDMHSIANFNPPSEKRISDKALHATLKVDVNDGLYVSQVFDHGNPPKELKRLIDLLFKVAEFK

SEQ ID NO: 19279 - DNA, 636 bp, Unknown
  Obtained from environmental sample
  misc_feature (1)..(636): n is a, c, g, or t
atgtcaaataatgtaaccatctttaaacaagttattacaaatgataatataccttttaggagaataaaaagtataaattctaataagttttcaaaaattaataaaaattgtaaattgtgtcataaagctttaatcaaaagtaatgaaccattattaagtaaagttaaagtatatgataatgaaaaatataataaaaaaaataattataaattaattaactgttatacccattcagaatgtatagataaatatttaatcaaatgttcttatgacaactgtaatcaatttttttttaaagatagtaaaaaaccccttttggctttaaatatgttaaaatgcgaactgtgttcaaccactatatgtttataccatagtattaatttattatactctaaaaaaaggtttgatgattgtagtaaatttttaaataaaacctataatatttgttattggtgcaatgaaaatttttataattatgtaatatatatattaaaaaagtataaatataatgataataaagaaatatgtttagacgtgattaaaataattgcgtcatattttcccaagcctgatgatgggtttatgtatataaatagtttaagaaattccgaaaaggattctgaaaaggattggtaa

SEQ ID NO: 19280 - protein, 211 aa, Unknown
  Obtained from environmental sample
  misc_feature (1)..(211): Xaa is any amino acid
MSNNVTIFKQVITNDNIPFRRIKSINSNKFSKINKNCKLCHKALIKSNEPLLSKVKVYDNEKYNKKNNYKLINCYTHSECIDKYLIKCSYDNCNQFFFKDSKKPLLALNMLKCELCSTTICLYHSINLLYSKKRFDDCSKFLNKTYNICYWCNENFYNYVIYILKKYKYNDNKEICLDVIKIIASYFPKPDDGFMYINSLRNSEKDSEKDW

SEQ ID NO: 19281 - DNA, 828 bp, Unknown
  Obtained from environmental sample
  misc_feature (1)..(828): n is a, c, g, or t
atggcagaaatggcaacaaaagaaaccgcagatgtagcaattaagtccatgaaaattgataaaaacatgttaaatatagaagttgaagtaaccaataaaacaggccattttttaccctctggagtgggttttagacgtgtgttcttagaattagtggttaaggatacaacaggcaaagaaatgtgggcctcaggtaaaacatcggatttaggtgttatagttaatggcttaacagataagccattaatcagtgaaaaaggaggcaaaggaaccacccagtttcaacctcattatcaaaccattacagctcaagatcaggtacaaatttatcaagaattaattaaagattcagatggtcatttaaccacatcttttttacgaagagtggatgaaattaaagacaatcgtttacgcggaaaaggttttgatccgaaattttacttaaaaaacaaatctccctatattcaaatgttaggagaattaaaaggccaggctgaaaaggatccctattattacgatccgaaattaacgggttcggatttaatcaactataagataaaacttgatgaaagcttaatgaaaaaggttggctcggtatcggttcgattgttcaatcaatccatacctcctgcttatcttcaagaccgctttagtgatgcacagattaaaggcggcgaaagtgatgacatcaaaaggttgttttatatgaccagtcatttgaatacttcttcaaataaaaaaagtgaaactaacccgattaaagattggaaagtactgttaactggagcttgtcaaactatcgatggaaaagcctgtaaatcattatga

SEQ ID NO: 19282 - protein, 275 aa, Unknown
  Obtained from environmental sample
  misc_feature (1)..(275): Xaa is any amino acid
MAEMATKETADVAIKSMKIDKNMLNIEVEVTNKTGHFLPSGVGFRRVFLELVVKDTTGKEMWASGKTSDLGVIVNGLTDKPLISEKGGKGTTQFQPHYQTITAQDQVQIYQELIKDSDGHLTTSFLRRVDEIKDNRLRGKGFDPKFYLKNKSPYIQMLGELKGQAEKDPYYYDPKLTGSDLINYKIKLDESLMKKVGSVSVRLFNQSIPPAYLQDRFSDAQIKGGESDDIKRLFYMTSHLNTSSNKKSETNPIKDWKVLLTGACQTIDGKACKSL

SEQ ID NO: 19283 - DNA, 888 bp, Unknown
  Obtained from environmental sample
  misc_feature (1)..(888): n is a, c, g, or t
atgacctaccaagaaacattaaattggatgttttctcaattgccaatgtatcaaagagaaggcaaaacagcattcaaaaaagacttaaccaatattttaacattttcaaaagtattagatttccctgagaagaaatttaagtctattcacgttggtggaacaaacggaaaaggctctacaagtcatatgattgcttcagttttacaagaagcgggttataaagttggattgtacacatcgccacatttaaagaattttacggagcgaatcagaatcaacggagaagaaatttctccagattttgttgttaattttattgaaagaaataaattgtttttagaaaaacaaaaactctctttttttgaaatgactgttggaatggcatttgattattttgcgatagaaaaagttgacattgcaattattgaagtcggtttaggcggaagattagattcgacaaacatcattacaccagaagtttctgtcatcacaaatattggattggaccacacacaatttttgggagagacacttcaagaaatagcctttgaaaaagcaggaattataaaaaataaaatccctgttatcattggggaaagacaaaaggaggttgaatctgttttcataaaaaaagcaacaaaaatgaattcagaaatcttttttgcatccgattttactcaagattttaaaactgatttattaggncattatcagttaaaaaatgtaaaaaacggcgttttagcaatacatcaattaactagctttatagtaaatgagcatcatattggaacagggtttttgaaaggtggaaaggataccaagctaaaaagacgatggcagattttacagagtcctccaaaaataattgggaatccgcacataataaag

SEQ ID NO: 19284 - protein, 296 aa, Unknown
  Obtained from environmental sample
  DOMAIN (12)...(256): Mur ligase family, catalytic domain
  misc_feature (1)..(296): Xaa is any amino acid
MTYQETLNWMFSQLPMYQREGKTAFKKDLTNILTFSKVLDFPEKKFKSIHVGGTNGKGSTSHMIASVLQEAGYKVGLYTSPHLKNFTERIRINGEEISPDFVVNFIERNKLFLEKQKLSFFEMTVGMAFDYFAIEKVDIAIIEVGLGGRLDSTNIITPEVSVITNIGLDHTQFLGETLQEIAFEKAGIIKNKIPVIIGERQKEVESVFIKKATKMNSEIFFASDFTQDFKTDLLGHYQLKNVKNGVLAIHQLTSFIVNEHHIGTGFLKGGKDTKLKRRWQILQSPPKIIGNPHIIK

SEQ ID NO: 19285 - DNA, 663 bp, Unknown
  Obtained from environmental sample
  misc_feature (1)..(663): n is a, c, g, or t
ttgaaaaagcagggatttataaaaaataaaatccctgttatcattggggaaagacaaaaggaggttgaatctgttttcataaaaaaagcaacaaaaatgaattcagaaatcttttttgcatccgattttactcaagattttaaaactgatttattaggcaattatcagttaaaaaatgtaaaaacggcagttttagcaatacatcaattaactagctttatagtaaatgagcatcatattgaaacagggtttttgaaggttgtaaagaatacaagcttaaaaggacgatggcagattttacaagagtctccaaaaattatttgtgatacggcacataataaagatggtttgttgttgacaatgaatcagcttaaaaaagaaaaatataacaacttacatattgttttaggagttgtttctgataagaaattagaggatgttttagatttgtttcctaaaaaggctcactattatttttgtcaacctaatattccacgagctttacatgttgatgaattggtaaggaaagcaagtgaatttgaattatatggagaaaaatataattctgtaaatgaggcatataattcagcaaaagggaaagcagaaaaaagagatataatctatattggagggagtacatttgtggttgctgagattttataa

SEQ ID NO: 19286 - protein, 220 aa, Unknown
  Obtained from environmental sample
  misc_feature (1)..(220): Xaa is any amino acid
MKKQGFIKNKIPVIIGERQKEVESVFIKKATKMNSEIFFASDFTQDFKTDLLGNYQLKNVKTAVLAIHQLTSFIVNEHHIETGFLKVVKNTSLKGRWQILQESPKIICDTAHNKDGLLLTMNQLKKEKYNNLHIVLGVVSDKKLEDVLDLFPKKAHYYFCQPNIPRALHVDELVRKASEFELYGEKYNSVNEAYNSAKGKAEKRDIIYIGGSTFVVAEIL

SEQ ID NO: 19287 - DNA, 636 bp, Unknown
  Obtained from environmental sample
  misc_feature (1)..(636): n is a, c, g, or t
atgatagaattgtttaggtataatcatcagatgtttaagtttaaaaattcttttcttaaaaaatactgcctagtcttaatattatttctaatttctcctaatgttttatccataaataatgtaataaaagtttccgacaattctgctgaagatattccacaatatgaaattaagcgatatcaaaaagatattgaccttacttttaaacagggaacgattaaaatcattaaccattatggcaatgtagtggtgaaaaacacaacacatcatacagttgggttatctgcagtagtacaagaaattggcagagaacctgcttttcatgaattaaaaataaagaaccataagaagaaattaattattgagatcaaatatcctaaatctgacttaaaaaaccataaaaagtctcagtcacactatccaattggcagagtagatttagttgcttttatccccattgattacaaaatcgatgtacaaactacttttggaaaaatagattttaaaagagtaaaaaataaaataaaatccaattcaacttctggccagattaacttatcctcacattatgatatggaagctcattcaattagtggtcaaaataaagcccttccaatggcaactctgtggggataa

SEQ ID NO: 19288 - protein, 211 aa, Unknown
  Obtained from environmental sample
  misc_feature (1)..(211): Xaa is any amino acid
MIELFRYNHQMFKFKNSFLKKYCLVLILFLISPNVLSINNVIKVSDNSAEDIPQYEIKRYQKDIDLTFKQGTIKIINHYGNVVVKNTTHHTVGLSAVVQEIGREPAFHELKIKNHKKKLIIEIKYPKSDLKNHKKSQSHYPIGRVDLVAFIPIDYKIDVQTTFGKIDFKRVKNKIKSNSTSGQINLSSHYDMEAHSISGQNKALPMATLWG

SEQ ID NO: 19289 - DNA, 660 bp, Unknown
  Obtained from environmental sample
  misc_feature (1)..(660): n is a, c, g, or t
ttggagttatttgaaaaaaaaatatataatatgagttttatagatatagaaaagagtaaaatattttcccctttggggaaattaaaaggggatttagttccagcaatcattcaagatgcaaccaccaaaaatgtattgatgctgggatatatgaaccaagaagcatttgctaaaacacaagaaacaaagttggttacctttttcagcagaactaaaaatcgcttgtggaccaaaggagaagaaagcggaaacgtattacatctggtagacattaaattagattgtgataaggatacattgctgatttctgtaaatccaactggaccaacctgtcataaaggttctgatacctgttggaatgaacccaatgaagaaaattttggatttatttctaaattagaaacaaccattgaaaatagaattaagaacgctgacacgaacaattcttatgttgcttcgctgtttagtgaaggcatcaataaagtagcgcaaaaggttggagaagaagccgtagaagtaattattgaagcaaaagacaacaatgatgatttgttcttaaatgaaagtgccgatttgctgtttcactatttattgttgttacaagcaaaagggtttcaattaaaagatgttgttggcgttttaaagggaagagagaaataa

SEQ ID NO: 19290 - protein, 219 aa, Unknown
  Obtained from environmental sample
  DOMAIN (130)...(219): Phosphoribosyl-ATP pyrophosphohydrolase
  misc_feature (1)..(219): Xaa is any amino acid
MELFEKKIYNMSFIDIEKSKIFSPLGKLKGDLVPAIIQDATTKNVLMLGYMNQEAFAKTQETKLVTFFSRTKNRLWTKGEESGNVLHLVDIKLDCDKDTLLISVNPTGPTCHKGSDTCWNEPNEENFGFISKLETTIENRIKNADTNNSYVASLFSEGINKVAQKVGEEAVEVIIEAKDNNDDLFLNESADLLFHYLLLLQAKGFQLKDVVGVLKGREK

SEQ ID NO: 19291 - DNA, 339 bp, Unknown
  Obtained from environmental sample
  misc_feature (1)..(339): n is a, c, g, or t
ttgggagatttactattaaatcctgatataattattcccaataaattaattattgatattaagtataaaataccaatttcaattaatgatattaaagctgaagatagacatcaactttatgtatatggtaataattttaatatccaaaatgtatgtatgctttatccaaaaaataaatataatgataaaaagaaaatttctttaggcagtaacaataagtctataaatttatatttaaaatttatagatttatttattgatcaagatatgaaatatttagaatatattaacgaacaaaaagaaaacttaattaaaataataggaattactaatgactga

SEQ ID NO: 19292 - protein, 112 aa, Unknown
  Obtained from environmental sample
  misc_feature (1)..(112): Xaa is any amino acid
MGDLLLNPDIIIPNKLIIDIKYKIPISINDIKAEDRHQLYVYGNNFNIQNVCMLYPKNKYNDKKKISLGSNNKSINLYLKFIDLFIDQDMKYLEYINEQKENLIKIIGITND

SEQ ID NO: 19293 - DNA, 522 bp, Unknown
  Obtained from environmental sample
  misc_feature (1)..(522): n is a, c, g, or t
atgactgatttagctgaagaattaaaaaaaaatggacttaataaagataaaatatgtttcgataaattaggacaaatagaattaaacttacatcaaaaagcaatagacaatttatcaagatcaaatatttctgtagataacttaaaagaattattaagtaatagtgaattaaagataagatttaatttagataatgaaaataaggaagaactaacaatacttatagaagagtatattttaaaatgttcaacaaaatatacaactcatttatttgtattttatgctggagcatctaatgaacaatttaaatcatcatgctcaatagataatatctttgaattatcgacaggaaatgcaagctctagaaatgacaaagataataaaagtttattaacaatatataattattttagaggtgtaaataataaaacagataaagtttcatctgctaaaaaaattgatattgtacaatattcaattaatacaaaaaatatattttgtatggtgcacaggggttggtaa

SEQ ID NO: 19294 - protein, 173 aa, Unknown
  Obtained from environmental sample
  misc_feature (1)..(173): Xaa is any amino acid
MTDLAEELKKNGLNKDKICFDKLGQIELNLHQKAIDNLSRSNISVDNLKELLSNSELKIRFNLDNENKEELTILIEEYILKCSTKYTTHLFVFYAGASNEQFKSSCSIDNIFELSTGNASSRNDKDNKSLLTIYNYFRGVNNKTDKVSSAKKIDIVQYSINTKNIFCMVHRGW

SEQ ID NO: 19295 - DNA, 465 bp, Unknown
  Obtained from environmental sample
  misc_feature (1)..(465): n is a, c, g, or t
atgtataaaccaccatatagtataacaagtaagatggtaaaccttatttcacaaataagtgaagagcttactaaaatagaatatagtaagatggatataaatactccactattaagaaaaaagaatcgtgttaaaactttggcaggaactcttgaaatagagggtaactttatgggtgaagagaaaattacagctattttagaaggaaaaaaagtattgggtacttatcaagagatacttgaagttgaaggtgccatcaatgcttacaaaaaatttgaaaactatagatatgatagtttagatgatttactaaaagcacataaaattttaatgaaagggattttaacaactgccggaagttttaggggtgtaaatgtaggagttggtagtaaagatggtgttagtcatgttgcaccgccttttagtatagttccaaatcttatgagtgagttgtttgattggtaa

SEQ ID NO: 19296 - protein, 154 aa, Unknown
  Obtained from environmental sample
  misc_feature (1)..(154): Xaa is any amino acid
MYKPPYSITSKMVNLISQISEELTKIEYSKMDINTPLLRKKNRVKTLAGTLEIEGNFMGEEKITAILEGKKVLGTYQEILEVEGAINAYKKFENYRYDSLDDLLKAHKILMKGILTTAGSFRGVNVGVGSKDGVSHVAPPFSIVPNLMSELFDW

SEQ ID NO: 19297 - DNA, 327 bp, Unknown
  Obtained from environmental sample
  misc_feature (1)..(327): n is a, c, g, or t
atgaactctactgataaatctattgcaactattgatatagcacttagaagaagatttacatttttaaagatgaaaccaaatattgatttagtttcagatatagcaaaagaattatttacaaaactaaatgaacatattacaaaagctataaatgaagattatcaattagggcatagctactttatgaagattaatagtgtagaagatttagagtttgtaaaaaaatataaaatacaacctttacttgaagagtatttttatggagatgaagataactatacaaaagcacttgatattttgaaagtaaatgttaagataaaagaatag

SEQ ID NO: 19298 - protein, 108 aa, Unknown
  Obtained from environmental sample
  misc_feature (1)..(108): Xaa is any amino acid
MNSTDKSIATIDIALRRRFTFLKMKPNIDLVSDIAKELFTKLNEHITKAINEDYQLGHSYFMKINSVEDLEFVKKYKIQPLLEEYFYGDEDNYTKALDILKVNVKIKE

SEQ ID NO: 19299 - DNA, 711 bp, Unknown
  Obtained from environmental sample
  misc_feature (1)..(711): n is a, c, g, or t
atgtacgctgatgttaacatgctttttggcgatatcgtaaaagttacaccaagctctaaagttgttggagatatggcgcaatatttagtgagcaacaacttaacggttcaagatgtgttagaaaaaggagattcaatttcctttccacaatctgtggtaagtttctttaaaggagatttaggtcagcctgttggtggttttccaaaagaacttcaaaagttgattttaaaagacgaaaaaccatatacagacagaccaaatgcgcacatggctcctttagatattgaagctgaatacaaagaatttaaaaaaatatttgagcaagatttaagcagaccaattaatttaaccgattttctgtcgtacaaattgtatccaaaagtttttacagattcgtataacaaacatttgaagtatgacaacctaatgaatttaccaaccaaaaatttcttttacggaatggaagttggcgaagaaattattgttgaattagacaaaggaaaaacattacttatcactttagactctgttggcgaaccaaatgaagatggttttgttacggtttattttaaagtaaacggtcaagggagatctgtacaaataaaagacgcatctattaaagttgataaagtagaacacataaaagctgataaatcaaatccaaaagaaattggagctccattacaaggaatgttatctacaatatggtaa

SEQ ID NO: 19300 - protein, 236 aa, Unknown
  Obtained from environmental sample
  DOMAIN (1)...(180): Conserved carboxylase domain
  misc_feature (1)..(236): Xaa is any amino acid
MYADVNMLFGDIVKVTPSSKVVGDMAQYLVSNNLTVQDVLEKGDSISFPQSVVSFFKGDLGQPVGGFPKELQKLILKDEKPYTDRPNAHMAPLDIEAEYKEFKKIFEQDLSRPINLTDFLSYKLYPKVFTDSYNKHLKYDNLMNLPTKNFFYGMEVGEEIIVELDKGKTLLITLDSVGEPNEDGFVTVYFKVNGQGRSVQIKDASIKVDKVEHIKADKSNPKEIGAPLQGMLSTIW

SEQ ID NO: 19301 - DNA, 930 bp, Unknown
  Obtained from environmental sample
  misc_feature (1)..(930): n is a, c, g, or t
atgagcgataaagaaaagaacactaccgaccttgtacactgttcgttctgtgggcgatcgagccttgaagtaaacagcatggttgctgggccagatgtttacgtgtgcgatcgatgcgtagaggatgcatcaagtattattaaaagcgaccttgcttcgcttagccagcgcaaagaacaatcgttcaaacctcttctcaagcctgttgaaatagttggtaaactcgatgagtacgtaatagggcaagatagggcaaaaaaaacgctcgctgttgcagtttataaccattacaaacgtattactcatgagaacaaagaactagatgatacgcagattgagaaaagtaacattatacttcttgggccaacaggaagtggtaaaactttactcgctcgcacgttagcaaaagttatcgacgtaccatttactattgctgacgctacggtgcttaccgaagctggttatgtcggagaagatgttgaaagtattttaagcaaccttctacaagccgcagattatgatgtggatcgagccaaacgtggaatagtatatatcgatgaagtagataaagttgctcgcaaaagtgacaatccatctattactcgtgatgtaagtggcgaaggcgtacagcaagctttgcttaaaatattggaaggtactgttgctaatattccaccaaaaggtggtagaaaacaccctgagcagagctttattcaattagataccacaaatattctgtttatctgtggaggcgctttttctgggctagaagagataatagctcgtagaaaatctacaagtgcaatggggtttaatcatgcagaacagattaaatttgataaaaataacgcagagatatttacctttgttgagcctgaagatttacagaaatttgggcttattcctgagctaaaaggtcgcctcccctaa

SEQ ID NO: 19302 - protein, 309 aa, Unknown
  Obtained from environmental sample
  DOMAIN (116)...(305): ATPase family associated with various cellular activities (AAA)
  misc_feature (1)..(309): Xaa is any amino acid
MSDKEKNTTDLVHCSFCGRSSLEVNSMVAGPDVYVCDRCVEDASSIIKSDLASLSQRKEQSFKPLLKPVEIVGKLDEYVIGQDRAKKTLAVAVYNHYKRITHENKELDDTQIEKSNIILLGPTGSGKTLLARTLAKVIDVPFTIADATVLTEAGYVGEDVESILSNLLQAADYDVDRAKRGIVYIDEVDKVARKSDNPSITRDVSGEGVQQALLKILEGTVANIPPKGGRKHPEQSFIQLDTTNILFICGGAFSGLEEIIARRKSTSAMGFNHAEQIKFDKNNAEIFTFVEPEDLQKFGLIPELKGRLP

SEQ ID NO: 19303 - DNA, 930 bp, Unknown
  Obtained from environmental sample
  misc_feature (1)..(930): n is a, c, g, or t
gtgaacaaggaaggtaagttcagtaataagatttggaacgcattccgattcttaaccatgaatatggaagaggatgttgaatatgaacctacaactgatattgatactgagaatttagtagaccgatggatgatgtctcgtattcatcaaacaatcaaagaagtagaagaagatttccaaaactataaactcaacgatgcacttaaaaaagtgtattcattgatttgggatgatttctgtgattggtatatcgaacttgctaaaccagccaactacggcgataaatttgacaaagaacgtcttaatgtagctctcggaatgtttgagcaattgatgaagttgctccatccgttcatgccatttatcagtgaagaaatttggcaacatattgatgaacgttcttcaaaagaagcactttgtatttcagattggccgaattatgatgccgataaagtatcagtagaagatgttgagctttttgaaagtatgcaggaaatggtttctgcattgagaaatatccgttcagaaatgggcgtttctccaaagcaagatattgaagttcttatcaaatcagtaaatgctgataagattgaagccaacgagtggattattaggaagcttcaagtaattaaatcattatttatatctacggatcttgaaaaaccaaaagcttgtgcttctgcattagttggtaacgatgaaatttacgttcagatgttcggcttggtggatgtggataaggaaatcgagcgtatcaaaaaagaaatggaacgtgtggaaggttttcttaaaagcgttaatggtaagctgaataattcaagttttgtggataacgcccctgatgcggttgttcaaaatgagagaaacaaaaagcgcgatggcgaagctaatcttgaaaaactaaaagaacagctgaaagattttcaatag

SEQ ID NO: 19304 - protein, 309 aa, Unknown
  Obtained from environmental sample
  misc_feature (1)..(309): Xaa is any amino acid
MNKEGKFSNKIWNAFRFLTMNMEEDVEYEPTTDIDTENLVDRWMMSRIHQTIKEVEEDFQNYKLNDALKKVYSLIWDDFCDWYIELAKPANYGDKFDKERLNVALGMFEQLMKLLHPFMPFISEEIWQHIDERSSKEALCISDWPNYDADKVSVEDVELFESMQEMVSALRNIRSEMGVSPKQDIEVLIKSVNADKIEANEWIIRKLQVIKSLFISTDLEKPKACASALVGNDEIYVQMFGLVDVDKEIERIKKEMERVEGFLKSVNGKLNNSSFVDNAPDAVVQNERNKKRDGEANLEKLKEQLKDFQ

SEQ ID NO: 19305 - DNA, 519 bp, Unknown
  Obtained from environmental sample
  misc_feature (1)..(519): n is a, c, g, or t
ttgaatgaacaaattcttatgctaacaaaacagcttgaaaatgcacaatctgaaaaagccagagctatttcaagagcacaaattactaaatctgggcatgtttatataatctcgaatattggttcttttggagaaaaagtttataaaattggaatgactagaagattagatccaatagatcgggtaaaagagttaggagatgcgtctgttccgttcagatttgatgtgcatgccattatttattccgataatgctcctgaattagaatcaaaactgcatcaagcatttgataaaagaagggttaatttagttaatcaaagaaaagaatactttaaagtttcacttgatgaaatagaatcaattgtaaatgaatcattttcttcagaaataacttttacaaaagcagcagaagcacaagaatatagagaaacattagctttattagatgaaatggaaagcaagattcatgatacagaagaatttgttagtcaaaaatatcccgataatttatttgaatag

SEQ ID NO: 19306 - protein, 172 aa, Unknown
  Obtained from environmental sample
  misc_feature (1)..(172): Xaa is any amino acid
MNEQILMLTKQLENAQSEKARAISRAQITKSGHVYIISNIGSFGEKVYKIGMTRRLDPIDRVKELGDASVPFRFDVHAIIYSDNAPELESKLHQAFDKRRVNLVNQRKEYFKVSLDEIESIVNESFSSEITFTKAAEAQEYRETLALLDEMESKIHDTEEFVSQKYPDNLFE

SEQ ID NO: 19307 - DNA, 432 bp, Unknown
  Obtained from environmental sample
  misc_feature (1)..(432): n is a, c, g, or t
ttgaaaaatggtaaatcagtaatcacaaatggttatgtatatcttaaaccgttggcaacagtatttttatggaaaaaagtaaaagttgcagctaaaaaaaacataaatcttaaagttcttagcgtgtctgttactaaaactattacgcaaattgcttttagctttgatgcttcaaataagatatttgttagcaatgcttgtaatgttaaagatgcctttttaacagatcaggacggtaagaaatataaatacaaaggaaattataatttaacctcaaaaaaatgggattgcatgaacggagggaaaagtttaatttatgcgaataaaactaaatttatagtttattttgaggcgttacctaaaaacacaaaaatgattaatatatctggttttgatatgataaaagcatttgaagtgacaaagaaaaaataa

SEQ ID NO: 19308 - protein, 143 aa, Unknown
  Obtained from environmental sample
  misc_feature (1)..(143): Xaa is any amino acid
MKNGKSVITNGYVYLKPLATVFLWKKVKVAAKKNINLKVLSVSVTKTITQIAFSFDASNKIFVSNACNVKDAFLTDQDGKKYKYKGNYNLTSKKWDCMNGGKSLIYANKTKFIVYFEALPKNTKMINISGFDMIKAFEVTKKK

SEQ ID NO: 19309 - DNA, 603 bp, Unknown
  Obtained from environmental sample
  misc_feature (1)..(603): n is a, c, g, or t
atgaatcaatggtttgaaaaaaaaggcaatttaaaagcgcctaatgatgcgtctattaacctggtccaatatcagggtaaggagtgtataagattctttttacgcgaggaggatttagttaacgataaatgtaagtgcgagattgtctgtcttgaccccaagccactagagttaaaagctgcttatgagtttgatttcaattttatcattcctgagatatgggatgatgcttgggatattatttggcagatacattcacctgataacggattctatccaaaccctccactatgcttacaggtagagggtgatacgattattttaaggaatgtagctaccgaaggtgagaagctggatttattcagagtacattatgagcctggtatcgaggtcaagattaagatacagactaagttgcactggaatgagaatggatgggttaaggcatgggttgatggtctacagcgtactgattatattggtgcaagtattcacagtgacgaggatggtaattacttacgcttcggtcaatactgtatgcagtggcctggtaagcagagtcgtttactatatgtgactgagtgccttgataagcggatatga

SEQ ID NO: 19310 - protein, 200 aa, Unknown
  Obtained from environmental sample
  misc_feature (1)..(200): Xaa is any amino acid
MNQWFEKKGNLKAPNDASINLVQYQGKECIRFFLREEDLVNDKCKCEIVCLDPKPLELKAAYEFDFNFIIPEIWDDAWDIIWQIHSPDNGFYPNPPLCLQVEGDTIILRNVATEGEKLDLFRVHYEPGIEVKIKIQTKLHWNENGWVKAWVDGLQRTDYIGASIHSDEDGNYLRFGQYCMQWPGKQSRLLYVTECLDKRI

SEQ ID NO: 19311 - DNA, 447 bp, Unknown
  Obtained from environmental sample
  misc_feature (1)..(447): n is a, c, g, or t
atgaaatactacctcatttcgggtgaagcctcgggcgatttgcatggctccaatctcattaaggagatacaaaagcaagacgctaatgcacagttccgttgctggggtggcgacctgattgaagccacaggcgcaacgctggtgaggcattaccgcgacttagcattcatgggttttgtggaagtgcttgccaacctgagaaccatccttaataacatcaatttctgcaagcaggatatactggactacgaacccgatgtagtaatttttgttgactacccaggctttaacctacgcattgcgccttttgtgaaaaagcttgacatcaaaaccgtttactacatatcaccacaagtgtgggcctggaaagaaagtcgcgtagaaaaaatcaagcagtccatcgacaagatgttggtgatactgcctttncaaaaagcctttctataa

SEQ ID NO: 19312 - protein, 148 aa, Unknown
  Obtained from environmental sample
  DOMAIN (3)...(148): Lipid-A-disaccharide synthetase
  misc_feature (1)..(148): Xaa is any amino acid
MKYYLISGEASGDLHGSNLIKEIQKQDANAQFRCWGGDLIEATGATLVRHYRDLAFMGFVEVLANLRTILNNINFCKQDILDYEPDVVIFVDYPGFNLRIAPFVKKLDIKTVYYISPQVWAWKESRVEKIKQSIDKMLVILPXQKAFL

SEQ ID NO: 19313 - DNA, 348 bp, Unknown
  Obtained from environmental sample
  misc_feature (1)..(348): n is a, c, g, or t
ttggtacagagaataactatttctttttccgctggcaaaactccaatcgtcttttttacattagaacacaatttcccagacacatttataaacattaaaataaaaaataagaatatctcccaaaaggatcaaaaaatacctgaaaactatcgtgaaatagttcttccttatgttcaagacgacataaagcttttggagttatcaaatcaaacaattttaacaaatgaaaaatcgatccaggctaaaattgtaaaaaatcagtatggtaaaaaaatatggcgacataagattaggaactgtgttcgttttctacatcgcttagcgaactatttagagttaaagcaataa

SEQ ID NO: 19314 - protein, 115 aa, Unknown
  Obtained from environmental sample
  misc_feature (1)..(115): Xaa is any amino acid
MVQRITISFSAGKTPIVFFTLEHNFPDTFINIKIKNKNISQKDQKIPENYREIVLPYVQDDIKLLELSNQTILTNEKSIQAKIVKNQYGKKIWRHKIRNCVRFLHRLANYLELKQ

SEQ ID NO: 19315 - DNA, 648 bp, Unknown
  Obtained from environmental sample
  misc_feature (1)..(648): n is a, c, g, or t
atgaagaaaaataaaataaaaaaaggacttgtattatcggtattatttttaggaccgttaattttttatattttcctttcattagggatttatcatcatgcaaacttaccaatacttacaaaaaaggtagaagatgtaaaaggagaggttacatttaaaaaacatttttctatagttagttttttaggaacagatattgacaaaaataaaggaggcctttttaatttaaacgaagttatttataaaagataccataaaagcctttattttcagtctgttttaattgctccaaaaggaacagaaacacaagtagaatctttaaaaaagaaactgagctcttattcaaatattgaaaattggaagtttgtttttttgaacgaaaatgagataaagtcaatttttaaaagttttgactctccctattctttaaacaatcagttaggttctgagtatgtgtttattgttgatagagaattgcgtttgcgaggaagaaaagatgatgaagataccgataacggaaggttgtacggttacgatatgaattctgtaagcgatcttaaaaataaaatgaagaaagacatagaaattatttattatcagcttaaaaaatcattagaaaaagagaaacgctttaaacgaaaaatataa

SEQ ID NO: 19316 - protein, 215 aa, Unknown
  Obtained from environmental sample
  misc_feature (1)..(215): Xaa is any amino acid
MKKNKIKKGLVLSVLFLGPLIFYIFLSLGIYHHANLPILTKKVEDVKGEVTFKKHFSIVSFLGTDIDKNKGGLFNLNEVIYKRYHKSLYFQSVLIAPKGTETQVESLKKKLSSYSNIENWKFVFLNENEIKSIFKSFDSPYSLNNQLGSEYVFIVDRELRLRGRKDDEDTDNGRLYGYDMNSVSDLKNKMKKDIEIIYYQLKKSLEKEKRFKRKI

SEQ ID NO: 19317 - DNA, 510 bp, Unknown
  Obtained from environmental sample
  misc_feature (1)..(510): n is a, c, g, or t
gtgaatattggatgtgcgggcctgcggcgggtgctggaattggccaatcagggcttgaaggtttgtctgaaacaatcgcccctggaacccggcaaggtcaaagccggcgactatgccaacctcctgcaaaagctcaccgccctgcccaatgtcaccggcgatttcaagcagctcatcgaccatccgccgttgattcagggcgacagcattcctgattattggtgtcgggtgagcaaggacggcacacactatttgttcctggctcagcgcctgtccaaggatttgaagtatccggtctattccgggcaatcaatcatggacaagtctgacttcatggatctgaatctctatatcaacggcaaaacaatcgctcaaaaatttgaattcaaaccttatcagtcattgctgctcaaaatcgatccggatggaaatgtggaggaaatggacatcacatttgtgccgaaaacgccgattgtgagggagcgggagaagcagcggatgtatttttga

SEQ ID NO: 19318 - protein, 169 aa, Unknown
  Obtained from environmental sample
  misc_feature (1)..(169): Xaa is any amino acid
MNIGCAGLRRVLELANQGLKVCLKQSPLEPGKVKAGDYANLLQKLTALPNVTGDFKQLIDHPPLIQGDSIPDYWCRVSKDGTHYLFLAQRLSKDLKYPVYSGQSIMDKSDFMDLNLYINGKTIAQKFEFKPYQSLLLKIDPDGNVEEMDITFVPKTPIVREREKQRMYF

SEQ ID NO: 19319 - DNA, 453 bp, Unknown
  Obtained from environmental sample
  misc_feature (1)..(453): n is a, c, g, or t
atgggtgttaatctggtttttaaaaatagcacctctatccaaaaattctacatgacagatggatcaggggaggcgaatatattcatgccttataactggaccagtgtagataagataggtttggtaataacgaacacgcaatttaatgaggggaacacatattcacttagagcgtcatcagatacacccgacagaatcgaattagcccaaaactatccgaacccatttagtgccaacacaacaataccgcttattttaaaaacagagagccgaataaagttagaagtctatgattatactgggcgatttatcactaaaatatttgaaggaacgttgttggcgggttcttatgagattccattcaaggcgcctaatttagcgagtggagtatatttttataagctaacaaaagggaaggaaaaaaagtttaagaaaatgactataatcaggtaa

SEQ ID NO: 19320 - protein, 150 aa, Unknown
  Obtained from environmental sample
  misc_feature (1)..(150): Xaa is any amino acid
MGVNLVFKNSTSIQKFYMTDGSGEANIFMPYNWTSVDKIGLVITNTQFNEGNTYSLRASSDTPDRIELAQNYPNPFSANTTIPLILKTESRIKLEVYDYTGRFITKIFEGTLLAGSYEIPFKAPNLASGVYFYKLTKGKEKKFKKMTIIR

SEQ ID NO: 19321 - DNA, 924 bp, Unknown
  Obtained from environmental sample
  misc_feature (1)..(924): n is a, c, g, or t
atgggtacggacctgaacaaatacttcgaagtgatgaacactcggggcgagcagttggagaagcacgagatattgaaggcgcggttgctggataagattcctgaaacggaacataaagtttatggccgaatatggaacgcttgtagccagatgaatcaatatatagagcggggattggagaaaaagggtggaaatgtaaacaaggaattgcgaaatgcaattgcgggatacgggggaatagccgattcggtaatcaatcaagtgaattccgatggccctgccaagggaaaagaagatacgcttgcatcgatcatcgatccggaattcgagattcagcccggaaaagaaacggaagacaataccgccgacgaaaaaatcagctctcctctgcgcttcgaagtattcttgctgcatgtattgaacctgtttgagccatccgcccgcattagtcaactggctaccaaatccctgctcacagcatttgaaaaatttgattttgggaagcccggcaaagtcagtggagaggatgcgaagaaagcgcaggataaggcccggaacttcatgcaacaactgcttcattaccgcatattgctggatcaatacattctcaaaagtgtcaccgccgacaatgaaactgcctggaaaatcaaggaatatcgcaggtatgaaaggaccgaaaaaacggatgttacctggagccgcgaggaacacctgaaaaaatctgtccgcatccaggccatgctgcatgccagcaccgttactgagcactggctcactccggccttggcctggctgaatggaaatattcctgtaaagggcgaagatggtgataagcgaatctgtagcttgttggaaagctgggacccatcattggccagcgtcaggctcattgatgaatccaagttgcaagatgtcccgcattga

SEQ ID NO: 19322 - protein, 307 aa, Unknown
  Obtained from environmental sample
  misc_feature (1)..(307): Xaa is any amino acid
MGTDLNKYFEVMNTRGEQLEKHEILKARLLDKIPETEHKVYGRIWNACSQMNQYIERGLEKKGGNVNKELRNAIAGYGGIADSVINQVNSDGPAKGKEDTLASIIDPEFEIQPGKETEDNTADEKISSPLRFEVFLLHVLNLFEPSARISQLATKSLLTAFEKFDFGKPGKVSGEDAKKAQDKARNFMQQLLHYRILLDQYILKSVTADNETAWKIKEYRRYERTEKTDVTWSREEHLKKSVRIQAMLHASTVTEHWLTPALAWLNGNIPVKGEDGDKRICSLLESWDPSLASVRLIDESKLQDVPH

SEQ ID NO: 19323 - DNA, 447 bp, Unknown
  Obtained from environmental sample
  misc_feature (1)..(447): n is a, c, g, or t
ttgataaaatatttgatcatagaaaaagataggtccaccattgatagaatcaattttgttttatcagaatacagcgattttctatgtgcaggtgtgattgataattatgatgatgcaatgaataagatcttgaaaggagtatctgatttagtatttatcaatactgataaagttcttgaacatccatttcatattattcaggaattgaatcaatttcaggaatgcaaccctgaatttatagcaatttcttcttccaaaaatgatgcatacaccgctcttaaaaatgggtttctggattttttactgatcccattgacagaattagatattagaaagtcggtattgaaatttcaaaaaaaaaggagagtgaggaaacttagtactatctgtataaaatcatacaagggattacccatttataaaaaacaagaacctcattttttttaa

SEQ ID NO: 19324 - protein, 148 aa, Unknown
  Obtained from environmental sample
  DOMAIN (2)...(122): Response regulator receiver domain
  misc_feature (1)..(148): Xaa is any amino acid
MIKYLIIEKDRSTIDRINFVLSEYSDFLCAGVIDNYDDAMNKILKGVSDLVFINTDKVLEHPFHIIQELNQFQECNPEFIAISSSKNDAYTALKNGFLDFLLIPLTELDIRKSVLKFQKKRRVRKLSTICIKSYKGLPIYKKQEPHFF

SEQ ID NO: 19325 - DNA, 720 bp, Unknown
  Obtained from environmental sample
  misc_feature (1)..(720): n is a, c, g, or t
ttgaacggaattcaaggttctgtctatgatttatacaccgttgttccgcaatttaaaggaaaatataaaattccgaaagtgtcgttttcttattttaatccatcagaaaaaaaatacaaaaccattacaactgaagacttgtttgtacatgttttagaaggaaaaaaggtagttagtacaacaaacaatgttattaaaaaagatgttgcaatcactggagctaattttagatacattcaaacaaaaagtgttttttcaccatcaaaaaaagaagatttctttacctccaatcttttttacatattgcttttgttaccgttaattgcaattccgattggaattgttatttacaatatttcatcaaaaagaaatagtgatcttgttggtgtaaaacaacgaaaagcagatcgattggctagaaaatatttatcagaagcaaaaaaacaattaggcaataaagataaattttatatcgctttagaaaaagcgttgcacaattatttaaaagctaaattacaaatagaaacggctgatatcagcagagataatatcatcgaaattttaaattctaaacagattgatggcgctacaattaacgcttttatagaagtattgaataattgtgatattgctcgttacacaccaataacagttgtaatgatgaatgatgattatgaaaaatcgataaaagtaataaccgcattagaccaaacattataa

SEQ ID NO: 19326 - protein, 239 aa, Unknown
  Obtained from environmental sample
  misc_feature (1)..(239): Xaa is any amino acid
MNGIQGSVYDLYTVVPQFKGKYKIPKVSFSYFNPSEKKYKTITTEDLFVHVLEGKKVVSTTNNVIKKDVAITGANFRYIQTKSVFSPSKKEDFFTSNLFYILLLLPLIAIPIGIVIYNISSKRNSDLVGVKQRKADRLARKYLSEAKKQLGNKDKFYIALEKALHNYLKAKLQIETADISRDNIIEILNSKQIDGATINAFIEVLNNCDIARYTPITVVMMNDDYEKSIKVITALDQTL

SEQ ID NO: 19327 - DNA, 510 bp, Unknown
  Obtained from environmental sample
  misc_feature (1)..(510): n is a, c, g, or t
gtggtggacccatattatcagaaagaatggggcagggacagctttgtcaacatagcccaggcactgtacgatgaattcgtctttcccaatcactttgccaagtccgagatgttgcgcaccctgctacatgtgttgttgctcaaagctgaaaggacaaaagaatttcagtccgtggagggagcccaaacccattggttggagatctttagcaagtttaggaatatgcttgaaaatgagtatgtaagctcaagaaattcaagagcttatgctgccgaattgttgatctcctacaagtttctaaatgatattgtaaagaagttgactggtaaaacggtcaaagctttcattgacgattttgtaacgattgaaatcaaacgctacctggtctccaccacactttccgtgaaggaaatcagttataagactggatttgaagagccggccaacatgataaaattcttcaagaagaatacgaacatcactccactcaaattcaggcaggcttcatag

SEQ ID NO: 19328 - protein, 169 aa, Unknown
  Obtained from environmental sample
  DOMAIN (123)...(167): Bacterial regulatory helix-turn-helix proteins, AraC family
  misc_feature (1)..(169): Xaa is any amino acid
MVDPYYQKEWGRDSFVNIAQALYDEFVFPNHFAKSEMLRTLLHVLLLKAERTKEFQSVEGAQTHWLEIFSKFRNMLENEYVSSRNSRAYAAELLISYKFLNDIVKKLTGKTVKAFIDDFVTIEIKRYLVSTTLSVKEISYKTGFEEPANMIKFFKKNTNITPLKFRQAS

SEQ ID NO: 19329 - DNA, 303 bp, Unknown
  Obtained from environmental sample
  misc_feature (1)..(303): n is a, c, g, or t
atggtgtggtatctaaccgtattttctgtgatcacccccaccgtaccagtcgtgatcagtgctgaggaaggtgcagtgccaaagtctacaacttcgggctgtggcgtatcgtcatccttcttacaggaagaaaaaaatgtgatcgccaaaattgctaagagtcctaaaaatgcctttgaaaatttcatcattttgtatttagtgattcaatacagcaaaggtatatctgccctatcgagccatcgctatcaaaatgatggaaaaaatggtaaaagtgtaaccagacctatgaagcctgcctga

SEQ ID NO: 19330 - protein, 100 aa, Unknown
  Obtained from environmental sample
  misc_feature (1)..(100): Xaa is any amino acid
MVWYLTVFSVITPTVPVVISAEEGAVPKSTTSGCGVSSSFLQEEKNVIAKIAKSPKNAFENFIILYLVIQYSKGISALSSHRYQNDGKNGKSVTRPMKPA

SEQ ID NO: 19331 - DNA, 603 bp, Unknown
  Obtained from environmental sample
  misc_feature (1)..(603): n is a, c, g, or t
ttgaattttcaacaaaatgagggcattcctttaaatcaaaatctagtgactattattggaggtcgcggagaaggaaaaagtatgcttacagactatttagctagtagcttcataggtcaagaacattcaaaagaaggggtttttaataaaaatggtgatgttaatttgtcatatcataaatccaaccagtcagaagatgatataatcaattttgacctaacagaagataagaaagcagtagagtttatctatataaatcaaggtcgcttaaaaactcttgtagagaaaaaagacaaacagtttcaacttgcaaactcgattcggaaacttgcaaaacttaaagagccagaatttgataaggaacttgataatcaagtatatagagctttagaaagatttcacgaattaaatcttttttttagcacaaaagatgaagctggcaatttaatttattcgattgcgtatttagagaatcaagaaaaagcaattaatgattttataagcaatatcacaacaagtgagaataaagacaaattagagaaatactctgaaaatcttaggaaaagaaacaatctttattctaagcaaaaagaggttaaatga

SEQ ID NO: 19332 - protein, 200 aa, Unknown
  Obtained from environmental sample
  misc_feature (1)..(200): Xaa is any amino acid
MNFQQNEGIPLNQNLVTIIGGRGEGKSMLTDYLASSFIGQEHSKEGVFNKNGDVNLSYHKSNQSEDDIINFDLTEDKKAVEFIYINQGRLKTLVEKKDKQFQLANSIRKLAKLKEPEFDKELDNQVYRALERFHELNLFFSTKDEAGNLIYSIAYLENQEKAINDFISNITTSENKDKLEKYSENLRKRNNLYSKQKEVK

SEQ ID NO: 19333 - DNA, 567 bp, Unknown
  Obtained from environmental sample
  misc_feature (1)..(567): n is a, c, g, or t
atgagtcttagaaaaaaattatctccagttcgaattaagaacaacttatttagaaaagaaattggtagtgcaccaggtacattaacacacattggtgaaaagaagcttgataaagtaatcatcgaaattcatgattatgataatgaccggcttgatattaaaaagattgaatccattgctgattgtaaaccttatgttcacactcctaatcctacctgggttcaagtgaaaggactacatgatattgaatatctaaaagagctttgggaggaattcgaattccatcctcttatacaagaagacatcttgaatactacccaacgacctaaaatagaaagttatggggaacagatattcatggttttgaagatgctttatattgaagatggcaaacttctactagaacaggtaagtgtggtttttactgagaaatttattttctcttttcaggaatcagaacgtaagatcttttttactatcaaagaaagactcgctataaacaacaccagaatgcgtaaaagtgttccagaatatatggcctatgcctctaagggaaattattattga

SEQ ID NO: 19334 - protein, 188 aa, Unknown
  Obtained from environmental sample
  misc_feature (1)..(188): Xaa is any amino acid
MSLRKKLSPVRIKNNLFRKEIGSAPGTLTHIGEKKLDKVIIEIHDYDNDRLDIKKIESIADCKPYVHTPNPTWVQVKGLHDIEYLKELWEEFEFHPLIQEDILNTTQRPKIESYGEQIFMVLKMLYIEDGKLLLEQVSVVFTEKFIFSFQESERKIFFTIKERLAINNTRMRKSVPEYMAYASKGNYY

SEQ ID NO: 19335 - DNA, 747 bp, Unknown
  Obtained from environmental sample
  misc_feature (1)..(747): n is a, c, g, or t
ttgataccatttaggatgaagaaagataatgtgattttaaaggtagaaaatgtatcaaagcaatatcgattgggcaccattggtacaggaaccataagtcacgatttaaatcgtttatttgccagaattagaggaaaagaagatccctatttaaaaattggagaaacaaatgatcgtgctaaaaaaggaaaaacagaatatgtttgggctttaaaagagattacttttgaagtaaaacgtggagaagttttaggaattattggtaaaaatggcgcaggaaaatccactttattaaagattttatcaaaagttaccggtccaacaactggttcaattaaatcaaaaggaaggattgcttctttattagaagttgggacagggtttcatccagaaatgactgggaaagaaaacatctttttaaacggtgctattttgggaatgaccaaaaaagaaattgaattaaaacttgatgaaattgtggatttttctggttgcgagcgttatattgatacgcctgtaaaacgctattctagcggaatgaaagtacgtttagcttttgctgttgccgcttttttagaaccagatattttagtggttgatgaagtattagcagttggagatgcagaatttcaaaagaaagccattggtaaaatgcaagacatttctaatactgatggaagaaccgtgctgtttgtgagtcataatatggcagcagttcaaagtttatgtacaagaggttggtactag

SEQ ID NO: 19336 - protein, 248 aa, Unknown
  Obtained from environmental sample
  DOMAIN (81)...(246): ABC transporter
  misc_feature (1)..(248): Xaa is any amino acid
MIPFRMKKDNVILKVENVSKQYRLGTIGTGTISHDLNRLFARIRGKEDPYLKIGETNDRAKKGKTEYVWALKEITFEVKRGEVLGIIGKNGAGKSTLLKILSKVTGPTTGSIKSKGRIASLLEVGTGFHPEMTGKENIFLNGAILGMTKKEIELKLDEIVDFSGCERYIDTPVKRYSSGMKVRLAFAVAAFLEPDILVVDEVLAVGDAEFQKKAIGKMQDISNTDGRTVLFVSHNMAAVQSLCTRGWY

SEQ ID NO: 19337 - DNA, 321 bp, Unknown
  Obtained from environmental sample
  misc_feature (1)..(321): n is a, c, g, or t
atgattattttctccaagggtaccaaaatatgggggtttaacctttttagttcttttggcgggcaattattaaatgtattatcgggcagtgtgtatcctgtagaattgattaaagagaaagcacctaaatattcttggatagtagaatataaccctatgacaatagttatcgaaaattttagaaaaatgttttttccgactatagaaacaagagttttacccttagatattttttatatgttattgatttcgtttgtggtctttactttaggtttacttatttttaacaaaacagaaaaaagttttattgataccatttag

SEQ ID NO: 19338 - protein, 106 aa, Unknown
  Obtained from environmental sample
  misc_feature (1)..(106): Xaa is any amino acid
MIIFSKGTKIWGFNLFSSFGGQLLNVLSGSVYPVELIKEKAPKYSWIVEYNPMTIVIENFRKMFFPTIETRVLPLDIFYMLLISFVVFTLGLLIFNKTEKSFIDTI

SEQ ID NO: 19339 - DNA, 561 bp, Unknown
  Obtained from environmental sample
  misc_feature (1)..(561): n is a, c, g, or t
atgcatagaaacgaagcatataacgaagcgctcaaccagtttgtaaaactatggggagatatggcctcagcttggggtatcaataaaaccatggcccaaatccatgctctactctatgcagaatctcatgctttagataccgatgccattatggacactctagacataagccgtggtaacgccaatatgaatctccatcgtttgatggaatgggagttggttcataaagaacaaaaatctggcgatcgcaaagattattacgttgccgaaaccgatgtttggaatattgtttctaccattattagggaacgccagcaacgtgaaattgaacctatccgcgctgagcttaaagaatgtataaaaaccttagaaaaaggtggtttaatagatcaagaaagcaaagaattcaaagagcgtatagaaaactataacgagtttcttgaaatgtttgaacgattcactgatgcgctactcccatacattaacaaaaagaatctcggatttctaaaacaacttattaagttggttgaggtgaaagagtctcttttaggaaaaaagtaa

SEQ ID NO: 19340 - protein, 186 aa, Unknown
  Obtained from environmental sample
  misc_feature (1)..(186): Xaa is any amino acid
MHRNEAYNEALNQFVKLWGDMASAWGINKTMAQIHALLYAESHALDTDAIMDTLDISRGNANMNLHRLMEWELVHKEQKSGDRKDYYVAETDVWNIVSTIIRERQQREIEPIRAELKECIKTLEKGGLIDQESKEFKERIENYNEFLEMFERFTDALLPYINKKNLGFLKQLIKLVEVKESLLGKK

SEQ ID NO: 19341 - DNA, 855 bp, Unknown
  Obtained from environmental sample
  misc_feature (1)..(855): n is a, c, g, or t
gtgtttagctgtaaagaaacactactcccggatttcctatataaactctttaaaacagagcggttcaataaaattataaaggaaagcacgacaggctcagttaggcaaaatttgacttttgatataatgaagatgttagatattcctttaccaccgctaacaattcaaaaagaactactgaataattattacgcaaaaactgaaaaagctgaaaaacaggaattggaagcaaagaaaaaagaacaagaaattaattcctatattcttgacattttagaggttactcttgaaaaaacaaatagagctaaaggaatttcatttaccaagttcagcttaatagacagatgggcagccgattatttattcaacttgaactcaattaaaggtatcaccgaaggtaagtatcccgttcaaaaagttagaaatatattgctctcataccaatacggtttatcatcaaaagcaagcgaagaacctataggaaccccaatgcttcgaatgaataatatcaataattcggagcttgatgttgatgacttaaaatatattcagattgaaaaagggcaaaaagaaaaagttttattaaataaaggtgatttaatatttaatagaacaaatagtaaagagcttgttggaaaaacggcagtttttgaattgaatgaagaattcacttttgcctcttacttgataaggttgaagataaacaccgaaaaagtaaatgttcactatctaaattatctttttaactctcctattgggagaattcaaatagatatgattagccgtcaagttttgggtcaggcaaatgtaaatgcccaagaagtgcaggacttcatttttcccattccaacataa

SEQ ID NO: 19342 - protein, 284 aa, Unknown
  Obtained from environmental sample
  misc_feature (1)..(284): Xaa is any amino acid
MFSCKETLLPDFLYKLFKTERFNKIIKESTTGSVRQNLTFDIMKMLDIPLPPLTIQKELLNNYYAKTEKAEKQELEAKKKEQEINSYILDILEVTLEKTNRAKGISFTKFSLIDRWAADYLFNLNSIKGITEGKYPVQKVRNILLSYQYGLSSKASEEPIGTPMLRMNNINNSELDVDDLKYIQIEKGQKEKVLLNKGDLIFNRTNSKELVGKTAVFELNEEFTFASYLIRLKINTEKVNVHYLNYLFNSPIGRIQIDMISRQVLGQANVNAQEVQDFIFPIPT

SEQ ID NO: 19343 - DNA, 396 bp, Unknown
  Obtained from environmental sample
  misc_feature (1)..(396): n is a, c, g, or t
gtgattacctatggtagcaatccgactgtgggttcattcaaattgagagaagtcgataacgcacccattttcgacccatttaacccggcgaatccccatattacgtcccccggaaagtctgtatcacttcccaaaaatgctatcgagcaaaaccttgtggaagaattttatcatacattcggcgaggcaaaaaaaatacgacgaggtgacattttgtctaaaacaactgctggtgatattagagcggcgggttttgatgtgatttatgcacctacccacaatagtctctggcaccttaggatcgttgaaaagactcgaacttttgacgaaattggaagagaatggctttcttcggcattcaaaaaagtcggaaaaatcaagaaatcaattgattag

SEQ ID NO: 19344 - protein, 131 aa, Unknown
  Obtained from environmental sample
  misc_feature (1)..(131): Xaa is any amino acid
MITYGSNPTVGSFKLREVDNAPIFDPFNPANPHITSPGKSVSLPKNAIEQNLVEEFYHTFGEAKKIRRGDILSKTTAGDIRAAGFDVIYAPTHNSLWHLRIVEKTRTFDEIGREWLSSAFKKVGKIKKSID

SEQ ID NO: 19345 - DNA, 699 bp, Unknown
  Obtained from environmental sample
  misc_feature (1)..(699): n is a, c, g, or t
atgtgtccggtgtcacgaggaaaaacgatccatctcatcctcgataaaatcgcggaagtggagttgatccacggcgtggaaaaagaggtgatttgtgtcaacgattgctccagcgacgactcaaaagctgccctggaagcctatatcgccgctcaccccggctacaacctgcaattgtacaaccacgaagtcaaccaaggcaaaggcgccgcgctccataccggcatcgccaaagccaagggtgaatacatcatcattcaggatgccgacctcgaatacgatccccacgagtggaaccgtctgctccgccccattctcgaagggcacgccgatgtcgtctacggctcgcgtttcaaaggcggctatccccaccgcatcctgttttactggcattcccgaggcaatcagttcctcaccaacttgtccaacatgtttaccaatctgaacctgtcagacatggaaacctgttacaaaatgttccgttccccgctgatcaaaagcctgaaactgaaggaaaaccgctttggttttgagcctgaagtgaccgccaaaatctcccgcctgcccaaagttcgcatctatgaagtaggcatctcctactacggccgcacctacgaagaaggcaaaaaaatcaactggaaagacggctttcgggcgatctactgcatcatgaaatacaatatttgggcccggaagtaa

SEQ ID NO: 19346 - protein, 232 aa, Unknown
  Obtained from environmental sample
  DOMAIN (1)...(169): Glycosyl transferase
  misc_feature (1)..(232): Xaa is any amino acid
MCPVSRGKTIHLILDKIAEVELIHGVEKEVICVNDCSSDDSKAALEAYIAAHPGYNLQLYNHEVNQGKGAALHTGIAKAKGEYIIIQDADLEYDPHEWNRLLRPILEGHADVVYGSRFKGGYPHRILFYWHSRGNQFLTNLSNMFTNLNLSDMETCYKMFRSPLIKSLKLKENRFGFEPEVTAKISRLPKVRIYEVGISYYGRTYEEGKKINWKDGFRAIYCIMKYNIWARK

SEQ ID NO: 19347 - DNA, 348 bp, Unknown
  Obtained from environmental sample
  misc_feature (1)..(348): n is a, c, g, or t
atgacaataatgactcggtttaaaaaaaagttaggttctttggacggtgaatggaatgagtttgtaattccagaaaatctttccgaccaagttaggctcaaggtcgaaagggaggccaaccttaaattaaaggatttcgtgatttttgtcatgaactcgatgcagagttggtatgggattcacttggaaggggttttggtttattcggatggaggttttcaattctgggcgtttaaagaatttcggacttggtctttaattaccgatgagaagaattcagctaataatttcaaggagtcgatactgcgtatcaatgtacttaccaatgatggggctactttttcgtag

SEQ ID NO: 19348 - protein, 115 aa, Unknown
  Obtained from environmental sample
  misc_feature (1)..(115): Xaa is any amino acid
MTIMTRFKKKLGSLDGEWNEFVIPENLSDQVRLKVEREANLKLKDFVIFVMNSMQSWYGIHLEGVLVYSDGGFQFWAFKEFRTWSLITDEKNSANNFKESILRINVLTNDGATFS

SEQ ID NO: 19349 - DNA, 441 bp, Unknown
  Obtained from environmental sample
  misc_feature (1)..(441): n is a, c, g, or t
atgctgattaatttgcagcgtattgtagtggacaatcaagaggaagcgaatcaaattgttaaggatttagaaaagggtgcttcgtttaaaacattggttaaaaagcacactattaataccgaagatttatttacagacggtgaactcggatatgagtctattaaatcttacggttttatgtctaccaagctagccgctttaaacgtcggtgatatttcggaagtgatacattatgaaacaggtaaatatcacatctacaaatgcttgggtatagaagaggctgaagggcagagttttgaagaagcccgcgaacaagtaaacaattttttgatttcaaaaaaactaaagagcttaagagcttcaacaatagaagatgttaagaaaaaacataatgctgttattgatactcagaagctgaaagaattaaccattcaaatttga

SEQ ID NO: 19350 - protein, 146 aa, Unknown
  Obtained from environmental sample
  DOMAIN (8)...(90): PPIC-type PPIASE domain
  misc_feature (1)..(146): Xaa is any amino acid
MLINLQRIVVDNQEEANQIVKDLEKGASFKTLVKKHTINTEDLFTDGELGYESIKSYGFMSTKLAALNVGDISEVIHYETGKYHIYKCLGIEEAEGQSFEEAREQVNNFLISKKLKSLRASTIEDVKKKHNAVIDTQKLKELTIQI

SEQ ID NO: 19351 - DNA, 435 bp, Unknown
  Obtained from environmental sample
  misc_feature (1)..(435): n is a, c, g, or t
atggacaatgatttggtagattttgcgatgaaagtacctgttaaacataaattggggattttagaaagtgaaattgaaaaaattgatgaaaatttagaaaaagaaaaaaaatcaatttcataccgtgattttgatgatggtaaaaatgtattaagaaaggccatgtcagattttatacctgaagctattgttaatagaaaaaagcaaggattctctgctcctgatgaaagttggtaccgtggagagaatgccgaatatgtgaaagagttgttattagcaaataatactgtaagtacaaaatatattaataaagaatacatcactaaaattgttgaggaacacattaataaaggggttaaccatcgtttgttaatttggtcttttatgaattttgaatggtggtgtagaatttttataaatggagaaactgtttaa

SEQ ID NO: 19352 - protein, 144 aa, Unknown
  Obtained from environmental sample
  misc_feature (1)..(144): Xaa is any amino acid
MDNDLVDFAMKVPVKHKLGILESEIEKIDENLEKEKKSISYRDFDDGKNVLRKAMSDFIPEAIVNRKKQGFSAPDESWYRGENAEYVKELLLANNTVSTKYINKEYITKIVEEHINKGVNHRLLIWSFMNFEWWCRIFINGETV

SEQ ID NO: 19353 - DNA, 549 bp, Unknown
  Obtained from environmental sample
  misc_feature (1)..(549): n is a, c, g, or t
atgtgtggaattgtaggtgtttttaatcttaataaagaaactgtttatagggatcagttaaaatctatggcagcaaaaattgctcatagaggtccagatggacagggtctttttattaaaaacaatattggtttagcacataaaagacttgctattttagatgtttcggaaaaaggttcgcaacctatgagttcaaaaaattctgaatggacgcttatttttaatggctgtatctataattttttagaactcaaacaagaattaaaagccaaaggacatacatttgtttctgagacagatacagaggtaatctgtgaaggtttagcatctgaagggccttctttttttgaaaaattgaatggtatgtttgccatagctgcatggaatgagaaaacccaagagctatttctaagtagagatcgttttggaataaaaccattgtattattggtttaatggaaaaacgctttgctttgcaagtgaaaataaagcaattattcaacataccgactataaaattgatgttgatttaggtgctttaaatgaataa

SEQ ID NO: 19354 - protein, 182 aa, Unknown
  Obtained from environmental sample
  DOMAIN (2)...(110): Glutamine amidotransferases class-II
  misc_feature (1)..(182): Xaa is any amino acid
MCGIVGVFNLNKETVYRDQLKSMAAKIAHRGPDGQGLFIKNNIGLAHKRLAILDVSEKGSQPMSSKNSEWTLIFNGCIYNFLELKQELKAKGHTFVSETDTEVICEGLASEGPSFFEKLNGMFAIAAWNEKTQELFLSRDRFGIKPLYYWFNGKTLCFASENKAIIQHTDYKIDVDLGALNE

SEQ ID NO: 19355 - DNA, 528 bp, Unknown
  Obtained from environmental sample
  misc_feature (1)..(528): n is a, c, g, or t
atgcgtaaagaagattgtttttatttaggcaaaatcgttagaaaacatagttttaaaggggaagtggttatcaagttagataccgacgaacctgaacagtaccaagaaatggaatcaatttttgtcgatttaggcaataatctgattccattttttattgaaaaaagtttacttcaaaaaggaaatcaattgcgtgttcagtttgaagatatgtacaccgaagaagaagcggatggtattttgaaagccgatgtatatttaccgttggatttgctgccaaaattatctggagataaattttattttcatgaagtaattggttttaaagcggttgatgtaaattacggattggttggaaccattgaaggaatcaacgataaaacagcgcaacctttatttgaaatcaagaacggggataaagaagtttttattccgatgattgatgattttatcaaaaaaattgatagagaaaataaagtaattgaagttgaaactcccaaaggattgattgaactttatttatcctaa

SEQ ID NO: 19356 - protein, 175 aa, Unknown
  Obtained from environmental sample
  DOMAIN (97)...(170): PRC-barrel domain
  misc_feature (1)..(175): Xaa is any amino acid
MRKEDCFYLGKIVRKHSFKGEVVIKLDTDEPEQYQEMESIFVDLGNNLIPFFIEKSLLQKGNQLRVQFEDMYTEEEADGILKADVYLPLDLLPKLSGDKFYFHEVIGFKAVDVNYGLVGTIEGINDKTAQPLFEIKNGDKEVFIPMIDDFIKKIDRENKVIEVETPKGLIELYLS

SEQ ID NO: 19357 - DNA, 789 bp, Unknown
  Obtained from environmental sample
  misc_feature (1)..(789): n is a, c, g, or t
atgtttattcaagaaggaacttacaaatacattccctatcataaattatttagaagaactgagtttttacaaataaacggaagcggaaaatttgaagcatacgcaaacagagattctttaaaatacagatctatttatggtttggaaaatattcctacaatgtacagaggaacgattagaaaagttggtttctctagagcttggaacatctttattcaattaggaatgaccgatgacacctacaccattgaagactcagaacacatgagttatcgtgattttgttaatttgtttttagcgtatagtccaacagattctgtagaattaaaattgcgctcgtatttaaaaattgatcaagatgatgtaatgtgggaaaaattaattgagctcgatatttttaatccaacaaaaataattggattgaaaaatgcaactccagctcaaattttacaaaaaatattaatggataaatggacgctgtctgaggatgataaagacatgattattatgcaccataaattcggtttcgaattaaatggtaaaaagcaacaaatagaaagtagcatggttactattggagaaaaccaaacctacactgcaatggcaaaaacggttggcttgcctgttgcaattgctgcattanaaatactaaacggagaaattaaaacgcctggtgttttaagacccatttctaaagaagtgtatgaacccattttaaaagaactagaaagtttcggtatttcttttacagaaaaagaagttcccttatttgggatacaatccagataa

SEQ ID NO: 19358 - protein, 262 aa, Unknown
  Obtained from environmental sample
  DOMAIN (1)...(251): Saccharopine dehydrogenase
  misc_feature (1)..(262): Xaa is any amino acid
MFIQEGTYKYIPYHKLFRRTEFLQINGSGKFEAYANRDSLKYRSIYGLENIPTMYRGTIRKVGFSRAWNIFIQLGMTDDTYTIEDSEHMSYRDFVNLFLAYSPTDSVELKLRSYLKIDQDDVMWEKLIELDIFNPTKIIGLKNATPAQILQKILMDKWTLSEDDKDMIIMHHKFGFELNGKKQQIESSMVTIGENQTYTAMAKTVGLPVAIAALXILNGEIKTPGVLRPISKEVYEPILKELESFGISFTEKEVPLFGIQSR

SEQ ID NO: 19359 - DNA, 669 bp, Unknown
  Obtained from environmental sample
  misc_feature (1)..(669): n is a, c, g, or t
ttgccagatcatcatctcattaatttcaatactaaaaagaacggaaccctttttgatatcaaactggaattcaccgatataaaaccgggctttacttggggtgatggtaaatttttgcttggtaatgatgatgaagcaggtttatacactcctatcccctttgcacgtctatctggttttgttgctttaaatggagacactgttaaagtttcaggaacggcatcaatgaaccaagtttatcaaacaaatataggcacaaaactctttcaggatagttttcgcttttattcccagaacgagggggaaataaatgccggttatttcctaatcccaaaaaacagccaggatgaagtggtcgggtatgcttatgaaatcaacgactcaaaaattgtattaaaaaaaccaatttctttagaaagactaaactcaaaaaagtttttaggggagaaaatatatagcaaaatcaaaatctgttatatagattacccttgtgagattattacagttaaagaaataaacgagaaaattgcaatgctagatgagcttggcggctttaaaaagatgctggcaaagagatttcttggtggagatattatcgagcttagaggcttagctctgattaataatattccagtattttatagcacaacgctctcgagccgattctga

SEQ ID NO: 19360 - protein, 222 aa, Unknown
  Obtained from environmental sample
  misc_feature (1)..(222): Xaa is any amino acid
MPDHHLINFNTKKNGTLFDIKLEFTDIKPGFTWGDGKFLLGNDDEAGLYTPIPFARLSGFVALNGDTVKVSGTASMNQVYQTNIGTKLFQDSFRFYSQNEGEINAGYFLIPKNSQDEVVGYAYEINDSKIVLKKPISLERLNSKKFLGEKIYSKIKICYIDYPCEIITVKEINEKIAMLDELGGFKKMLAKRFLGGDIIELRGLALINNIPVFYSTTLSSRF

SEQ ID NO: 19361 - DNA, 768 bp, Unknown
  Obtained from environmental sample
  misc_feature (1)..(768): n is a, c, g, or t
atgatcagatggctcagggagcggagcagtcggaatttcggaatggaacaggcaagcggaaactattttatcattttagattctgatgtcatcgttccgaaacaataccttacagaagttaaaaaagcattagaacaaaattttacagatgcttttggtggtccagatgctgcgcatcaaagttttacttctttgcaaaaagcaattaattattccatgactgctgtgttaacaacaggcggaattcgaggcaagaaaaatgctgttgggaaatttcaaccaagaagttttaatcttgggctgtcgcagacagcatttaataagaccaaaggttttgcagatttaaaagttggtgaagatattgatttaacctttcgcttatggaaaaacggatttgaaacccaattgattgaaaaagcatttgtatatcacaaacgcagaagtacaattcgacagttttttaagcaaacggttgcttttggtactgcaagaccacaattgaataaacggtatccagaaactgcaaaaataacgtattggtttccttctttatttattattggatttgatgtcagtgtaattgctgcattttttggctattggcaactcattactttttatggattttattttattttactattcttagattcgttgtttcaaaataaaaacttggtggttgcttttttaagcatcattacttcttttacgcagcatttagggtatggattggggtttttagaatcgaagtttttgaagaaagactaa

SEQ ID NO: 19362 - protein, 255 aa, Unknown
  Obtained from environmental sample
  misc_feature (1)..(255): Xaa is any amino acid
MIRWLRERSSRNFGMEQASGNYFIILDSDVIVPKQYLTEVKKALEQNFTDAFGGPDAAHQSFTSLQKAINYSMTAVLTTGGIRGKKNAVGKFQPRSFNLGLSQTAFNKTKGFADLKVGEDIDLTFRLWKNGFETQLIEKAFVYHKRRSTIRQFFKQTVAFGTARPQLNKRYPETAKITYWFPSLFIIGFDVSVIAAFFGYWQLITFYGFYFILLFLDSLFQNKNLVVAFLSIITSFTQHLGYGLGFLESKFLKKD

SEQ ID NO: 19363 - DNA, 429 bp, Unknown
  Obtained from environmental sample
  misc_feature (1)..(429): n is a, c, g, or t
ttgcttattggagttttgttgtttaccattttcatctatgcaaccgggcaaggttttttgatagattttaccaaagacaataatgtatttgtatatcttgtcccaaccattgccatgttgagctattttataagcaactacgtttttggcaaacaattaaaggacttaacaaaacttaactctttaaaaagcaaattgatgctctatctacaggcatgcgtggtaagatatgcttttatagagggtgcagcaatattgagtactattgcatttaggttgaataaccacattttttatctggttatttccttatttttaattctttatctttttaagcttaggcccaccaaggacaaggttataaacgagttgcaattaaaattaaaggaccaacagtttttccaacaagaaaacggggaaattaaataa

SEQ ID NO: 19364 - protein, 142 aa, Unknown
  Obtained from environmental sample
  misc_feature (1)..(142): Xaa is any amino acid
MLIGVLLFTIFIYATGQGFLIDFTKDNNVFVYLVPTIAMLSYFISNYVFGKQLKDLTKLNSLKSKLMLYLQACVVRYAFIEGAAILSTIAFRLNNHIFYLVISLFLILYLFKLRPTKDKVINELQLKLKDQQFFQQENGEIK

SEQ ID NO: 19365 - DNA, 426 bp, Unknown
  Obtained from environmental sample
  misc_feature (1)..(426): n is a, c, g, or t
gtgggctggggtgaacaatttcccaacatacaaattccaataaccaatattcagtttatggataagcaaaaatacaacttacagaatagattggttgagttttcgatttcaattattgaagtcgcagagaagttgccaaaaagttatgctggacaacattttttgaaacaattaattcgttcaggaacttctccggctttccaacaagccgaagcacaaagtgcagaatcaagaagggactttatacacaaactaaaaatcgggattaaagaactacgagaaacaaaggtaaatctcaccatcatttctaagaaattcttagtagacaattcaatagtggttgatactctaaatgaatgtgatgaattgatcgcaatattttactcaagtattagaaccgtcaataataaaattgtaaataagtaa

SEQ ID NO: 19366 - protein, 141 aa, Unknown
  Obtained from environmental sample
  misc_feature (1)..(141): Xaa is any amino acid
MGWGEQFPNIQIPITNIQFMDKQKYNLQNRLVEFSISIIEVAEKLPKSYAGQHFLKQLIRSGTSPAFQQAEAQSAESRRDFIHKLKIGIKELRETKVNLTIISKKFLVDNSIVVDTLNECDELIAIFYSSIRTVNNKIVNK

SEQ ID NO: 19367 - DNA, 864 bp, Unknown
  Obtained from environmental sample
  misc_feature (1)..(864): n is a, c, g, or t
atgggatatactttgatagtgatcagggtaaaaatcacgtcaaacagcacattatttacttttactgatagccatcaagagacagaatacattgaggaatttgaattaagtataaataaaattgaatttacctcagataccacccttaaattgttaccattagatcccactatacccatcatttatgatcaagactttggcagtttatcattcacttttgccttaaatgacatcaaaaatcataaagatattttatacagttacagaattgtaggccttacagacaagtggtcagaatacagtcaatcaacaaaagttaatatgagtaatttgacatcaaaccattactcttttgaagtacgcgcaaaaaataatttaaatcaaatattcaccacaaacccttatcaaataattataaatccaccttggtacttatcaaaattatccattgttttatgggttgtcttaggcgtattgtctctattactattattacactctattcttaaatggagagaacgcattcacgaagtacaaaagctggatctgcaaaaaattatcaattatcaaactcaagaactaaaagaagccaataaaaaacttgaaaaaatggccctttatgatggattaacagggttgtctaatcgactttatttagatgagttctgtaaaaatattttaacaacaaatgttaacaacatgagtgttttaatgttagatatggaccactttaaaaaatataatgataagtatgggcatttagccggtgatgaattattaaaaaaacttgcactgattttaacgcaatactttattcaggataatgaaaccgtcgtagcgagatatgactcgagccgattctga

SEQ ID NO: 19368 - protein, 287 aa, Unknown
  Obtained from environmental sample
  DOMAIN (201)...(286): GGDEF domain
  misc_feature (1)..(287): Xaa is any amino acid
MGYTLIVIRVKITSNSTLFTFTDSHQETEYIEEFELSINKIEFTSDTTLKLLPLDPTIPIIYDQDFGSLSFTFALNDIKNHKDILYSYRIVGLTDKWSEYSQSTKVNMSNLTSNHYSFEVRAKNNLNQIFTTNPYQIIINPPWYLSKLSIVLWVVLGVLSLLLLLHSILKWRERIHEVQKLDLQKIINYQTQELKEANKKLEKMALYDGLTGLSNRLYLDEFCKNILTTNVNNMSVLMLDMDHFKKYNDKYGHLAGDELLKKLALILTQYFIQDNETVVARYDSSRF

SEQ ID NO: 19369 - DNA, 726 bp, Unknown
  Obtained from environmental sample
  misc_feature (1)..(726): n is a, c, g, or t
atgaaaggctggacaattgcttacgataatgaagttgtggctcctgcagaattacccgtaactatggttgattttaaaattcaacaatatagatggactaaagggcgtggtcagattattaagaaacattttttcaatcttttaaaaatggatatgcctttcatggtgaaagttcatgccatttttgatttgctcaatgtttttataaatgttggtgtactgttattggctcttttaagcattcctcttgttctactgctgagagtaagcccagagttgaaattgttttttgctttccaatcgctagcattaataaacatagtgatcgctccatggttttcttggatcgtatttgataaatatgagtctaccgtacgaggaaaaatcaaagaaatgaagtcttcttttttcccttttttagtacttattcttggctttccattctttatggtagtctctctaattgatggatttatcaacaataaatcattctttcacagaacttcaaaatataacgctctggataaaaaggactcttggaaaaataaagtatattcaccaagtgagattcctgctattacttggtttgagggattgtttgcttttttattccttggagcacttttaatcgatattactctttttagtgtggcttttttacccttccatacattactaacgttagggtttggttctatatttattcaatccattagaaaatcttag

SEQ ID NO: 19370 - protein, 241 aa, Unknown
  Obtained from environmental sample
  misc_feature (1)..(241): Xaa is any amino acid
MKGWTIAYDNEVVAPAELPVTMVDFKIQQYRWTKGRGQIIKKHFFNLLKMDMPFMVKVHAIFDLLNVFINVGVLLLALLSIPLVLLLRVSPELKLFFAFQSLALINIVIAPWFSWIVFDKYESTVRGKIKEMKSSFFPFLVLILGFPFFMVVSLIDGFINNKSFFHRTSKYNALDKKDSWKNKVYSPSEIPAITWFEGLFAFLFLGALLIDITLFSVAFLPFHTLLTLGFGSIFIQSIRKS

SEQ ID NO: 19371 - DNA, 969 bp, Unknown
  Obtained from environmental sample
  misc_feature (1)..(969): n is a, c, g, or t
ttgtttggtgaggtatgcaacaagacgattcagcttaactacagtaaggacaagttaaggtttaattatgcttcagctagtttttataaaccagaggtcaatacttattcttataaactaagcggttttgatagcgaatggagtaactggacagtagagactaaaaaggattatacaaatattcccgaaggaacttattcattcatggttaagagtagaaacatttttaatcaagaaggaatacctgatagcttcgattttattgtaagaccgccttggtaccgaacatggtgggcatatgctttataccttatattattagtcggactattatatggaatttataagataaggctcaatcagattttaaaagtacaattagttaggaatagaatagcagacgatttgcatgacgatttatctggaactttaatcggaatcagtaattttgcaaaagcaattagtgcaaatcccgattcaaaaattcaactgagattcttaggattaatagaaaaaagtgctgatgaagctaaagaaaagataagtgatatcgtatggacgattaatcccattcatgatgattggttagattttttaactaaatgtagacgccatgcctcagatatccttgaggcacagaaaatcgattactccttagaaatggatgaaaatataccaggtgatttggatatggagctaagaaaaaacctgtggcttatcttcaaggaaattatgactaacattacaaaacattcaaaggctagttatgttcttgtaaggtttaaaactgaccatagaaaattatcaatacttattaaagataatggtaaaggttttgataaggagtcagtagttcaaggtaatggaatcagtagcatccagaggagagcagagaagataaacggagagatagagttcgtgagtgaagttgataaaaggacattttggaatatcgtaatcaatatttag

SEQ ID NO: 19372 - protein, 322 aa, Unknown
  Obtained from environmental sample
  DOMAIN (232)...(313): Histidine kinase-, DNA gyrase B-, and HSP90-like ATPase
  misc_feature (1)..(322): Xaa is any amino acid
MFGEVCNKTIQLNYSKDKLRFNYASASFYKPEVNTYSYKLSGFDSEWSNWTVETKKDYTNIPEGTYSFMVKSRNIFNQEGIPDSFDFIVRPPWYRTWWAYALYLILLVGLLYGIYKIRLNQILKVQLVRNRIADDLHDDLSGTLIGISNFAKAISANPDSKIQLRFLGLIEKSADEAKEKISDIVWTINPIHDDWLDFLTKCRRHASDILEAQKIDYSLEMDENIPGDLDMELRKNLWLIFKEIMTNITKHSKASYVLVRFKTDHRKLSILIKDNGKGFDKESVVQGNGISSIQRRAEKINGEIEFVSEVDKRTFWNIVINI

SEQ ID NO: 19373 - DNA, 675 bp, Unknown
  Obtained from environmental sample
  misc_feature (1)..(675): n is a, c, g, or t
ttgggaagcaaaaacaaattaaaacgttttcatgaaaacgaaacgttctctaatgttgttcagccaaaaagggaagaaatcttagaaggtttttctttaaaaggaaaatggaatactttttttaaaaacgataaacctattgttttagagctcggttgcggtaaaggtgaatacacaattgcacttgctcaaaaaaatcctaacaaaaattttattggaattgatattaaaggggctcgtttttggcgtggcgcaaaaactgctttagaagaaaatttaaccaatgttgggtttattagaacgcaaatagaattgataagcgaattgtttgcagaaaatgaagtggatgaaatttggattacttttccagatcctcagattaaatacaaacgcacaaaacatcgattgacaaactcagaatttttaaagaaataccattatattttaaaagaaaatggtgtcgtaaatttaaaaacagacagtgagtttatgcacggttacactttaggtttattgcatggcgaaggacatgaaattttagatgcaaatcacgatgtgtataaaaatacctattctccagaagaagtaattggcacacaaaccttttacgaaaaacaatatttagaaaaaggaaaaccaataacttttattaaatttagaattaattattcataa

SEQ ID NO: 19374 - protein, 224 aa, Unknown
  Obtained from environmental sample
  DOMAIN (28)...(222): Putative methyltransferase
  misc_feature (1)..(224): Xaa is any amino acid
MGSKNKLKRFHENETFSNVVQPKREEILEGFSLKGKWNTFFKNDKPIVLELGCGKGEYTIALAQKNPNKNFIGIDIKGARFWRGAKTALEENLTNVGFIRTQIELISELFAENEVDEIWITFPDPQIKYKRTKHRLTNSEFLKKYHYILKENGVVNLKTDSEFMHGYTLGLLHGEGHEILDANHDVYKNTYSPEEVIGTQTFYEKQYLEKGKPITFIKFRINYS

SEQ ID NO: 19375 - DNA, 786 bp, Unknown
  Obtained from environmental sample
  misc_feature (1)..(786): n is a, c, g, or t
atgatcaatcatattcttggacctgatgaaggttctattacaattaacggtcaggaagcaagcccaatcacccaaagaatgattggctacatgccagaagagcgcggactttataaaaagatgaaagttgaggaacaattactatacctcactcagcttaaaggaatgaaacccaaagccgctaaagaggccattcattattggcttgatcgatttgaagcttctgactgggcaaaaaaagaagttggcgaactctcaaaagggatgtcacagaaaatacagtttatagctactattgctcacgatcctgatatttatatatttgatgagccttttagtggtcttgatcctatcaatagtgacatgctgaaagatattatcattgaactgaagaataatggcaaaacgatcctattctcgactcatcgtatggaacaagtagagcaaatgtgtgatgacatctgtttgttcaataaaggaaaagctgttcttcaaggaaaacttcgcgaggtgaaagcttctttcggtaaaaacaccatcaatatagaattcgacggtgatggttccttcttagataaactagaaggagtacgtttgaacaatcgttctacaaattattccgagattcgagtgcttaatggacaaaacatgcaggatattttaaaacttgccatggaacatgccgaaattcataaatttgaacgtatcgaaccttctctcaacgagatctttatctcaacagtaggtgaagacaatctcaaagctcaacaaaaagaggaggcgtaa

SEQ ID NO: 19376 - protein, 261 aa, Unknown
  Obtained from environmental sample
  DOMAIN (1)...(160): ABC transporter
  misc_feature (1)..(261): Xaa is any amino acid
MINHILGPDEGSITINGQEASPITQRMIGYMPEERGLYKKMKVEEQLLYLTQLKGMKPKAAKEAIHYWLDRFEASDWAKKEVGELSKGMSQKIQFIATIAHDPDIYIFDEPFSGLDPINSDMLKDIIIELKNNGKTILFSTHRMEQVEQMCDDICLFNKGKAVLQGKLREVKASFGKNTINIEFDGDGSFLDKLEGVRLNNRSTNYSEIRVLNGQNMQDILKLAMEHAEIHKFERIEPSLNEIFISTVGEDNLKAQQKEEA

SEQ ID NO: 19377 - DNA, 618 bp, Unknown
  Obtained from environmental sample
  misc_feature (1)..(618): n is a, c, g, or t
gtgcccaatttccagaagaagtacgacgactccatgaaagatccgggctaccatttcaagatcgccgacatgaaaaaactggatgagtttgcccaggattttctcacgatctacaacaatgcctggggtggccacggcaatttcaaggtgatgaaactggagcaatctaaggcgatcgtcaaagcgctcaaaccgattctcgctccggaattggccatttttggctattacaaagacgaacccatcgcgttttttatcatgatcccggacatgaaccagattttcaagggatacaatggcaaattcggattggtacaaaagatcaaaacctggatcaagctcaaacgcaaaagcaccaccaaatgctatgggatcctttttggcatcgtgcgtaagcaacaaggcaaaggtgtggacggagggctgatcgtagctgcttcgaaatggctgcatccgcaaaatcactggggccacatggaaatgacctggatcggcgatttcaatcccaaaatgatgaatgtggccactggaatcggaggaaaagtctacaagacttactatacgatgcgctacttgtttgatagggagaaggaatttaaacggcacccgatcatttag

SEQ ID NO: 19378 - protein, 205 aa, Unknown
  Obtained from environmental sample
  misc_feature (1)..(205): Xaa is any amino acid
MPNFQKKYDDSMKDPGYHFKIADMKKLDEFAQDFLTIYNNAWGGHGNFKVMKLEQSKAIVKALKPILAPELAIFGYYKDEPIAFFIMIPDMNQIFKGYNGKFGLVQKIKTWIKLKRKSTTKCYGILFGIVRKQQGKGVDGGLIVAASKWLHPQNHWGHMEMTWIGDFNPKMMNVATGIGGKVYKTYYTMRYLFDREKEFKRHPII

SEQ ID NO: 19379 - DNA, 318 bp, Unknown
  Obtained from environmental sample
  misc_feature (1)..(318): n is a, c, g, or t
gtgatatatgcggcctcaaccttctctggccgcctcaccatggccgagaccatccaggaaatagtggaagcgaccaacaagctgacttctacccagggctcgttggaatccttcaaccaggcaaaaagagaggaaaatagcggtagccagagaaagaatgaggaaataagaaaaatccaaggcaatcggtatggttttttcacggggagcgtcatccttgaatttaagaaaatagtcacagattggtttgacaaaagctgctgcaaacggaaagcagaatctcctatctttgccccgtgcaaaagcaacgacggttag

SEQ ID NO: 19380 - protein, 105 aa, Unknown
  Obtained from environmental sample
  misc_feature (1)..(105): Xaa is any amino acid
MIYAASTFSGRLTMAETIQEIVEATNKLTSTQGSLESFNQAKREENSGSQRKNEEIRKIQGNRYGFFTGSVILEFKKIVTDWFDKSCCKRKAESPIFAPCKSNDG

SEQ ID NO: 19381 - DNA, 831 bp, Unknown
  Obtained from environmental sample
  misc_feature (1)..(831): n is a, c, g, or t
gtgtctcttaattacgagcagttatacccagagtacaacacgttagataattggaaaaatgtagaaaaaagcattttagacaaacccatacaattaaaattaattaaagatattgaagatccatattacaatcaattattttatcagcctgagtttggctacaattattatgatggagttacacttgggttaaaactgcacaacaaacctataatccctcgaaattttgtttttaaattagtaccctcttacgcaacaaaaagtcagtctgtaacgggttttgcttctataatgtacaatcagtatttcgaaaaatctaagattcgacaaattatttacggagtttcagcgagcaattttcattatgctccagaattatcttacggtatttttgccccatatattgctgctgtttttaaacgtcatagtttgcgtgatgttggcggaagcgccctaacctttaaatacgtgaatgtatacaaggaatctgcaccaaatacttctgttagagagcaagatgtgtacaatgttttaaatgtaaaatacctctattctaaaccaaatattattgaaggaatttcgtacaaaataaacaccgatatttcatcaaaatttacaaaattttctacagatatacgatatagaaaactaactgaaactaacagattattagattttagattttttggcggattctttttaaataataaaacctcaggaaactattttagctttggactagatcggccttcagattatttatttgagcaaaattattttgggagatcagaaagctcaggaatttttagcccaccagttatttataaatga

SEQ ID NO: 19382 - protein, 276 aa, Unknown
  Obtained from environmental sample
  misc_feature (1)..(276): Xaa is any amino acid
MSLNYEQLYPEYNTLDNWKNVEKSILDKPIQLKLIKDIEDPYYNQLFYQPEFGYNYYDGVTLGLKLHNKPIIPRNFVFKLVPSYATKSQSVTGFASIMYNQYFEKSKIRQIIYGVSASNFHYAPELSYGIFAPYIAAVFKRHSLRDVGGSALTFKYVNVYKESAPNTSVREQDVYNVLNVKYLYSKPNIIEGISYKINTDISSKFTKFSTDIRYRKLTETNRLLDFRFFGGFFLNNKTSGNYFSFGLDRPSDYLFEQNYFGRSESSGIFSPPVIYK

SEQ ID NO: 19383 - DNA, 459 bp, Unknown
  Obtained from environmental sample
  misc_feature (1)..(459): n is a, c, g, or t
atggtggtcactcagaaaggaatctcccacatggaacgcatcggaatggtgcccatggtcaacgaatacagtaaggtgatggccttcagcggcaagacccttttcaacggtgacaaccttggcctgcagacctattctgtggtgcgggtctttgaccacgtcaccaaagtcctttttgacttcctcaaccgccgggccttcgaaaactggaccacccgcaccgaaaaagatcttcggagccaggttgtgaaatacctggacagcatcaccggccccaaaagcctgattgagaagttcaagatcctgcacatcgaacaggatccgaaccagaaggaccagatcaacatcgacatccacctcaagccctatttcccagccaagagcttcgtcatcgaactccacggacggaaaggcgaggatgagattgtggattgggacagcaagtatacgcaagaataa

SEQ ID NO: 19384 - protein, 152 aa, Unknown
  Obtained from environmental sample
  misc_feature (1)..(152): Xaa is any amino acid
MVVTQKGISHMERIGMVPMVNEYSKVMAFSGKTLFNGDNLGLQTYSVVRVFDHVTKVLFDFLNRRAFENWTTRTEKDLRSQVVKYLDSITGPKSLIEKFKILHIEQDPNQKDQINIDIHLKPYFPAKSFVIELHGRKGEDEIVDWDSKYTQE

SEQ ID NO: 19385 - DNA, 381 bp, Unknown
  Obtained from environmental sample
  misc_feature (1)..(381): n is a, c, g, or t
atgaaaaagataataccctatatactcagctgcatgctattatcgctcgcagcatgctgggaagaaatccctcaagccgaaaagccacaaggattaataaagaaggaaaacctaaaactgctgatgattgacttatatatagccgaatcagcaaataacatgcgcctgctagagaaagataccgcattgcccaaataccctgtactctacaaaaacatactggataagcacaaggtaacacccaaagactacgaaaacagccttaagtactattccgaagaccctgaggaaataaacgccatttatgatgatgtactggaaaggctaactaaaatggaaagtgacctaggtggttcgtcgacaacccaagacgaaccctaa

SEQ ID NO: 19386 - protein, 126 aa, Unknown
  Obtained from environmental sample
  SIGNAL (1)...(18)
  misc_feature (1)..(126): Xaa is any amino acid
MKKIIPYILSCMLLSLAACWEEIPQAEKPQGLIKKENLKLLMIDLYIAESANNMRLLEKDTALPKYPVLYKNILDKHKVTPKDYENSLKYYSEDPEEINAIYDDVLERLTKMESDLGGSSTTQDEP

SEQ ID NO: 19387 - DNA, 453 bp, Unknown
  Obtained from environmental sample
  misc_feature (1)..(453): n is a, c, g, or t
atgactcgcattgagccgacgtggttaggggtgaatgaagtgggggaattatttttctatgataaacgctcaaaaaagctgataaagctaaatgaatcaggatcttttttagatgaaattccaatcccatcggaagtgaaagatatttcaggtttacagttgagagggaataaggttttcattctagataaaaaagtggatgtaattcatcagctttcggaaaatggtttttatgagagtttctatccagctgaaggagcccaaacattctggaaaagtaagaacggaatgtggatttcggtaggaaatactcttttcaaaagtggaatggaaagaaaggattatatcgaagtgaaggccgtaaaatccattaaagattttgtggttactgaagagctactatttgtgttaggtgaggataaattgatatctatcacgatcccaaaagaatag

SEQ ID NO: 19388 - protein, 150 aa, Unknown
  Obtained from environmental sample
  misc_feature (1)..(150): Xaa is any amino acid
MTRIEPTWLGVNEVGELFFYDKRSKKLIKLNESGSFLDEIPIPSEVKDISGLQLRGNKVFILDKKVDVIHQLSENGFYESFYPAEGAQTFWKSKNGMWISVGNTLFKSGMERKDYIEVKAVKSIKDFVVTEELLFVLGEDKLISITIPKE

SEQ ID NO: 19389 - DNA, 339 bp, Unknown
  Obtained from environmental sample
  misc_feature (1)..(339): n is a, c, g, or t
atggcaagggacagtaaaacaatcgcaacaatgcttttgatggcaaagggacggctgatggtccaaaatgccataatcaggaaggggatgttgatcaaaacaataagaatggacagggatacaccactcaattcggcggtaatcagggaaattccggttacgccgccatccaaaaaggaattgggcaacaaaaatgcatgcagtccaaaactcgcagacaaaatccctgtcaaggatcaaaaactactgcgtatcaaatggatgaattcaactgaaaaaaatctgcatttcctttttcagctgctttgggggaaaggcggttgccttttttttctttaa

SEQ ID NO: 19390 - protein, 112 aa, Unknown
  Obtained from environmental sample
  misc_feature (1)..(112): Xaa is any amino acid
MARDSKTIATMLLMAKGRLMVQNAIIRKGMLIKTIRMDRDTPLNSAVIREIPVTPPSKKELGNKNACSPKLADKIPVKDQKLLRIKWMNSTEKNLHFLFQLLWGKGGCLFFL

SEQ ID NO: 19391 - DNA, 690 bp, Unknown
  Obtained from environmental sample
  misc_feature (1)..(690): n is a, c, g, or t
atgaaatcatttcttaccattcttttttctctttttctaactggttcaatcaattcacaaacagcaacttacaatgctttattaaatacacatgtagatgataaaggaaatgtaaattacaaaacattaaacgttgacgaatcaaaattaactggatacattcgttatttagagaaaacaacgccacaaaaagattggtcagcaaataaaacaaaagctttttggataaacgcctacaatgcatacactttaaaaacaatccttgataagtatcctttaaaaagcatcaccaatattaaagaaaaaggaaaagatgcttggaatattccatttgcaaatgttggcggcgaagtgtacacattgaattatattgagcataaaattctacgtaaaaactataacgatcctagaattcatgttggtgtaaattgtgcttcactatcttgtccgcaattaggaaattttgcatttaccgaagataatattgaggaaaaactagaagatttaatgaaaatttttattaatgattctaatcgaaataaaatcactcanaagaagattcagctttcgaaaatatttgattggtataaagacgatttcacaaagaatggttctttgattgattatttaaacaagtattctacaattaaaatcaacaaaaaagcaaaagattcttttcttagaatatga

SEQ ID NO: 19392 - protein, 229 aa, Unknown
  Obtained from environmental sample
  SIGNAL (1)...(19)
  DOMAIN (48)...(174): Protein of unknown function, DUF547
  misc_feature (1)..(229): Xaa is any amino acid
MKSFLTILFSLFLTGSINSQTATYNALLNTHVDDKGNVNYKTLNVDESKLTGYIRYLEKTTPQKDWSANKTKAFWINAYNAYTLKTILDKYPLKSITNIKEKGKDAWNIPFANVGGEVYTLNYIEHKILRKNYNDPRIHVGVNCASLSCPQLGNFAFTEDNIEEKLEDLMKIFINDSNRNKITXKKIQLSKIFDWYKDDFTKNGSLIDYLNKYSTIKINKKAKDSFLRI

SEQ ID NO: 19393 - DNA, 597 bp, Unknown
  Obtained from environmental sample
  misc_feature (1)..(597): n is a, c, g, or t
ttgggatggattttggaaatgcttaaacaactaaagccttttctaatagattttcattttcggtcaatccgttccgtcaatacgtcagtttgtgaactagctacccaacttggcattgtgcttgctttagtctttatgaaattaaataaagaggtaagcgcgatggcagacttcacagaatttggaatagaagtagaaaaacatttatccaaactgggaaaagacattcagcagtttgtagagaaggtagtaccacttactaatgaggacaaagactttgctcctgattgtgatattgtggaaagtgaatcagagtttaaaattttgatcgacttgccaggattatcaaaaaaagaaattggtatttcgctaaaagataatgtgctcactattaaaggtgaacgagacatcatgctctcagatggcgaagagtttaaaaggcaagaaagaaaacgaggcgcttttgcccgttcttttgcattacctgaaaccgttaataaagctgaaatagacgctagctttagaaatggtgtgttagcggttgctatgccgaaatcggaaagcttgaaaaacactcaatctattccagttaaatag

SEQ ID NO: 19394 - protein, 198 aa, Unknown
  Obtained from environmental sample
  DOMAIN (98)...(198): Hsp20/alpha crystallin family
  misc_feature (1)..(198): Xaa is any amino acid
MGWILEMLKQLKPFLIDFHFRSIRSVNTSVCELATQLGIVLALVFMKLNKEVSAMADFTEFGIEVEKHLSKLGKDIQQFVEKVVPLTNEDKDFAPDCDIVESESEFKILIDLPGLSKKEIGISLKDNVLTIKGERDIMLSDGEEFKRQERKRGAFARSFALPETVNKAEIDASFRNGVLAVAMPKSESLKNTQSIPVK

SEQ ID NO: 19395 - DNA, 429 bp, Unknown
  Obtained from environmental sample
  misc_feature (1)..(429): n is a, c, g, or t
atgctggaagaattatcttacacttttaatcactctacaaaaggtaaaatcaacgtatcaactaacccgttaaaaccagctccttctgtacgagctaaatcagcaactcaaagcactcggtttacactcaaaataagtacggaagatattgagcttaatgtccctgaagaagtatttttgagtcagaattatccaaatccgtttaacccatctacaaccatccctttcggtatagacaaggatagcaatgtgaatcttgttatttacgacatcttaggacgaaaagtagccacattaatcgacgaacaacttactgcaggactatacaatccaaaattcattgcaagtcatcttgcaagtggagtgtatttctataggttgataacagattcaaaagtaattgttaagaaattcacacttatcaaataa

SEQ ID NO: 19396 - protein, 142 aa, Unknown
  Obtained from environmental sample
  misc_feature (1)..(142): Xaa is any amino acid
MLEELSYTFNHSTKGKINVSTNPLKPAPSVRAKSATQSTRFTLKISTEDIELNVPEEVFLSQNYPNPFNPSTTIPFGIDKDSNVNLVIYDILGRKVATLIDEQLTAGLYNPKFIASHLASGVYFYRLITDSKVIVKKFTLIK

SEQ ID NO: 19397 - DNA, 300 bp, Unknown
  Obtained from environmental sample
  misc_feature (1)..(300): n is a, c, g, or t
atgaaaaagaataatacaacagattttgaagaaatacttactaaaaagtatggtaagaaaggaagtgaagaaagagataaatatgactccgaatcactagctttccgattaggtgttatgttaaaagaagcaagaaatgaagctaaaatgactcaagaagaacttgctaataaagttggaacgaagaaaagctatatctcaagagtagaaagaggattaagtgatatacaactatcatcttattataaattgatagaaataggcttaggtaagaatcttaatatctcaatttcaaattaa

SEQ ID NO: 19398 - protein, 99 aa, Unknown
  Obtained from environmental sample
  DOMAIN (41)...(96): Helix-turn-helix
  misc_feature (1)..(99): Xaa is any amino acid
MKKNNTTDFEEILTKKYGKKGSEERDKYDSESLAFRLGVMLKEARNEAKMTQEELANKVGTKKSYISRVERGLSDIQLSSYYKLIEIGLGKNLNISISN

SEQ ID NO: 19399 - DNA, 300 bp, Unknown
  Obtained from environmental sample
  misc_feature (1)..(300): n is a, c, g, or t
atgatggctgagactacacacctcgatagaactatacgaacttcatcgggtggttttattgttgattcacctggactcaaagtgatgggactatgggaacttgataaaaaagacctgccattttactatcgtgagtttgatgcctatcaaggcgattgtaaattttcatcctgcatacatattcatgaaccaaaatgtgccgtcaaagatgccgtcgctgagggaattatttcgcagtatcgctatgacaattatattgcaatctataattcccttgataataaagaatttaacaaataa

SEQ ID NO: 19400 - protein, 99 aa, Unknown
  Obtained from environmental sample
  DOMAIN (1)...(90): Protein of unknown function, DUF258
  misc_feature (1)..(99): Xaa is any amino acid
MMAETTHLDRTIRTSSGGFIVDSPGLKVMGLWELDKKDLPFYYREFDAYQGDCKFSSCIHIHEPKCAVKDAVAEGIISQYRYDNYIAIYNSLDNKEFNK

SEQ ID NO: 19401 - DNA, 687 bp, Unknown
  Obtained from environmental sample
  misc_feature (1)..(687): n is a, c, g, or t
atgaataaattcaaacttgccatcgggctacataatcatcaaccagtcggaaatttcgactttgtctttgacgaatcacatcaaaaagcatataaaccatttgccgatttgcttgccaaatatcccgacattcgtatttctttgcatcagtcaggaattttatggaactggcaggaacaacacaaacctgaatatattaaacagatacaaaagttagttgcgtcagggcaaatcgaactgatgacaggtggctactatgaaccgattttagtttcgattccagaacgtgattcatacgggcagattgaaaaacttgatgactatatacaaaaacggtttgacgtaacgacacatggtggctggctcactgaacgaatatgggagccacatcttccgaaaattctcaatcaagccggggtcaaatttatcccagttgatgatacccattttatctacgcaggttttgatagcgaacaattgacgggtccatttgtgactgagtttgaggggaaagagctgacgcttttaccaatttcaaaaaagatgcgctatctgaattcatttggaactgttgatgaattgattgacgaactaaacagcttgccgaagaaaaacgaaacggaatggttgtctatgctgacgatggttgaaaaatttggtcatggccaaagacattcgagcatggct

SEQ ID NO: 19402 - protein, 229 aa, Unknown
  Obtained from environmental sample
  DOMAIN (7)...(229): Glycosyl hydrolase family 57
  misc_feature (1)..(229): Xaa is any amino acid
MNKFKLAIGLHNHQPVGNFDFVFDESHQKAYKPFADLLAKYPDIRISLHQSGILWNWQEQHKPEYIKQIQKLVASGQIELMTGGYYEPILVSIPERDSYGQIEKLDDYIQKRFDVTTHGGWLTERIWEPHLPKILNQAGVKFIPVDDTHFIYAGFDSEQLTGPFVTEFEGKELTLLPISKKMRYLNSFGTVDELIDELNSLPKKNETEWLSMLTMVEKFGHGQRHSSMA

SEQ ID NO: 19403 - DNA, 642 bp, Unknown
  Obtained from environmental sample
  misc_feature (1)..(642): n is a, c, g, or t
gtggctttcttcggtgctccacatccatttgacgatcatgctcttcgtgctgttatatcttctcacttcatgcaaaaagaacttgttcttttaagagaaaaatggagaaaagacgggtggcctgatatcgtttctaggatgaaganccgcatgggaatgaacacaggagaaatgattactgggaatatgggttcgggaagccgtttcaattatactatgatgggtgataatgtaaaccttgctgcaagatgtgaaagtggtgccaaaacttatggtgtttatacgatggtaacagaagccacaaaaatagaagcagaaatacatggcgatgattgtgtcttcagatatttggacaagattattgtaaaaggcagaacacagcctgttaaaatatttgagatctccgatttacgctctgaggcgagccaagaattattcgactgtattggactctatgagcaaggaatagaggcttatatgaaccaaaactggaacaaggctattgagttgtttaataaatcccttcctctcgagcacaacaaaaataatccttcaaaaatattactcaatcgttgcaaactaatccttgaaaaccctcctaaaaaggattgggatggcgtttttgtgatgaagagtaaatag

SEQ ID NO: 19404 - protein, 213 aa, Unknown
  Obtained from environmental sample
  misc_feature (1)..(213): Xaa is any amino acid
MAFFGAPHPFDDHALRAVISSHFMQKELVLLREKWRKDGWPDIVSRMKXRMGMNTGEMITGNMGSGSRFNYTMMGDNVNLAARCESGAKTYGVYTMVTEATKIEAEIHGDDCVFRYLDKIIVKGRTQPVKIFEISDLRSEASQELFDCIGLYEQGIEAYMNQNWNKAIELFNKSLPLEHNKNNPSKILLNRCKLILENPPKKDWDGVFVMKSK

SEQ ID NO: 19405 - DNA, 897 bp, Unknown
  Obtained from environmental sample
  misc_feature (1)..(897): n is a, c, g, or t
gtgattcaaaccgtttttaatgttgagattgataaagttcaggaattagaaagaggacatgcattaattattaagaaagatggaacgattgatgtaaaatcgatcttagaacaaaaaccaaaaaaagcgtgttcttttgagcgtatttatttttctagaggaagtgatgcgtctatttatgaggagcgtaaaaatttaggaaaattagtatttcctcaaatattagaatcgattgataacgacattacaaactccgttttttcttacattccaaacacagcagaaacttctttttatggaatgatagaagcagcggaagatgttttaaatcaacaaaaaacaaccaaaattttagctggcggcacaaagttatctgcagaaaaagttacagaaatactatcagaaagaccgcgttttgaaaaaattgccataaaagatgcaaaattaagaacctttattgcagatgataatagtagagatgatttagttgcgcatgtgtacgatgtaacttacggcgttgtaaaacctacagataatttggtaattattgatgatagtattgttagaggaacaacattaaagaaaagtattatcaaaattttagaccgattaaatcctaaaaaaattgtcgttgtttcttcggcgccacaaattcgctacccagattgttacggaattgacatggcaagaattaatgattttattgcttttaaagcagccttagaactgttaaaagacacccatcaataccatattgtagatgagggttatgcaaagtctattgcgcaaagaggaaagcccgatgctgaaataagtgatttttgtaaaagaaaatttatgcttccttttacgagaagaagaaaatttcttgaaaaaaaccggcaccaaatgttttaa

SEQ ID NO: 19406 - protein, 298 aa, Unknown
  Obtained from environmental sample
  misc_feature (1)..(298): Xaa is any amino acid
MIQTVFNVEIDKVQELERGHALIIKKDGTIDVKSILEQKPKKACSFERIYFSRGSDASIYEERKNLGKLVFPQILESIDNDITNSVFSYIPNTAETSFYGMIEAAEDVLNQQKTTKILAGGTKLSAEKVTEILSERPRFEKIAIKDAKLRTFIADDNSRDDLVAHVYDVTYGVVKPTDNLVIIDDSIVRGTTLKKSIIKILDRLNPKKIVVVSSAPQIRYPDCYGIDMARINDFIAFKAALELLKDTHQYHIVDEGYAKSIAQRGKPDAEISDFCKRKFMLPFTRRRKFLEKNRHQMF

SEQ ID NO: 19407 - DNA, 723 bp, Unknown
  Obtained from environmental sample
  misc_feature (1)..(723): n is a, c, g, or t
atgtcagattggctgagtgatgcttggattttagttgccgttttttctttgttgatgaatctattttatgccaaattaattgtgccgttatttaataaacaaactccgttagaagatggagaattaaaaagagcaattgaaaaatacgcaacgaaagtgggttttacacttaaaaatgtttttgtaatcgatggttctaaacgttctacaaaagcaaatgcgtatttctctggatttggttcacaaaaaagaattacgctgtacgacacgttgataaacgatttagaaattgatgaaattgttgctgttttggcgcacgaagttggtcattacaaacgcaaacacatcatctttaacttggtcgcttctaccctattaacagggtttacattgtggctattatcggtatttgtaagcttgcccatattttcagaagccttgcatatttctattccaagttttcatattggattgattgtctttggaattttatattcgcccatttcagaaattacaggtttgttaatgaacatcatttctagaaaatttgaatatcaagcagataattacgccaaagaaacatttgccgcaaaacctttaatcacttccttaaaaaaattatcgaaaaatagtttgagtaatttaacgccacataaagcgtatgtttttatgcattactcacatccaacgttattaaaacgagttcaaaacttaaataaataa

SEQ ID NO: 19408 - protein, 240 aa, Unknown
  Obtained from environmental sample
  DOMAIN (46)...(240): Peptidase family M48
  misc_feature (1)..(240): Xaa is any amino acid
MSDWLSDAWILVAVFSLLMNLFYAKLIVPLFNKQTPLEDGELKRAIEKYATKVGFTLKNVFVIDGSKRSTKANAYFSGFGSQKRITLYDTLINDLEIDEIVAVLAHEVGHYKRKHIIFNLVASTLLTGFTLWLLSVFVSLPIFSEALHISIPSFHIGLIVFGILYSPISEITGLLMNIISRKFEYQADNYAKETFAAKPLITSLKKLSKNSLSNLTPHKAYVFMHYSHPTLLKRVQNLNK

SEQ ID NO: 19409 - DNA, 822 bp, Unknown
  Obtained from environmental sample
  misc_feature (1)..(822): n is a, c, g, or t
atgagcgataaattttcggcagtgctatctgtctatgacaacgataatgaagatcattttaatattgctgtaaaaagtctattaaatcaaactttgcaacctagcgaaatagttatagttgtggatggtccagtatctgcaggtattgataaagttcttcaggaaatatcttccaatgaaatcgttaagataataaaattacctaaaaatgtaggaaggggtgctgctaggcacacagccatttctgctacagaaaatgatttagtagctataatggatgcggacgatatctgtgtagaagataggttcgaaaagcaagtaaaagcgatgaatacgtcagaagttgatattttaggcggttatattgaagagtttcggaatgaacctggtgatttaaagaaaactcgcccagtgcaggtttctcatgataagattatccaatttagcaagtggaagcaaccggttaatcatgttaccatgatgtttagaaaacatgtgtattttgaaattggtggttacaagccctacaagatgttggaagactttgatctcttccatcggttaattaaacatggtgcaaagtttcagaatattccagaaaatctggtatttgtacgcattcctgaaaattatatttctaagaggacaggggctagatatgctcgggaagaacggatgattcttagagaaatgtataaaagtggtcatatcaacttggttcagtttttatttaataccctagcgagatcattggtaagagcacttccttatagcttagtggataaaatttataataatattttaagaaagaaagatgggtag

SEQ ID NO: 19410 - protein, 273 aa, Unknown
  Obtained from environmental sample
  DOMAIN (6)...(168): Glycosyl transferase
  misc_feature (1)..(273): Xaa is any amino acid
MSDKFSAVLSVYDNDNEDHFNIAVKSLLNQTLQPSEIVIVVDGPVSAGIDKVLQEISSNEIVKIIKLPKNVGRGAARHTAISATENDLVAIMDADDICVEDRFEKQVKAMNTSEVDILGGYIEEFRNEPGDLKKTRPVQVSHDKIIQFSKWKQPVNHVTMMFRKHVYFEIGGYKPYKMLEDFDLFHRLIKHGAKFQNIPENLVFVRIPENYISKRTGARYAREERMILREMYKSGHINLVQFLFNTLARSLVRALPYSLVDKIYNNILRKKDG

SEQ ID NO: 19411 - DNA, 894 bp, Unknown
  Obtained from environmental sample
  misc_feature (1)..(894): n is a, c, g, or t
ttggcaatgcacagacgcaaagtaaaaggaaactttttaggatcttctaaatctggaaacatcgtttatattgcgccacaagctactttaaattacgatcgagaattacaaaatttaacctacgaagaacaacaagaggttaccaaaatactaaaaaaattagcggcagaaattaaaccttttgttccgttattacacttgtatttacagtatttaacacatttagatgccattgctgcaaaagcaatatatggcaaaagtttagatgcagttttaccaaaaataacttcagaaaagaaaatcgattttaaaaaagcataccatcctattctttggaaaaaaaatcaagagaaaaatatagaaaccgttccgcagtctatcattttaaatgaaaaacagcaaatcattgttatttctggtccaaatgctggtggaaaaagcatcacgctaaaaaccattggtttgttacaagtaatgttacaaagtggtttgttaattccggttgatgagcgaagcgaaacctacatttttaatacaattcttacagatattggagacaatcaatctatagaaaatcagttaagtacgtatagttatcgactaaaaaacatgcgtaattttttacgaaaatgtaataaaaacaccttgtttttaattgatgaatttggaactggttctgatcctgaattaggcggcgctttggcagaaattttcttggaagagttttacagtaaaaaagcattcggaattatcaccacacattattctaatttaaaagtgttggcaaacgaatttggaaaatgttaccaacgcaaatatgcagtttcacgaacgtactttagaacctttgtaataactgtatgttgggcaagcaggaagttcttttacgtttga

SEQ ID NO: 19412 - protein, 297 aa, Unknown
  Obtained from environmental sample
  DOMAIN (90)...(286): MutS domain V
  misc_feature (1)..(297): Xaa is any amino acid
MAMHRRKVKGNFLGSSKSGNIVYIAPQATLNYDRELQNLTYEEQQEVTKILKKLAAEIKPFVPLLHLYLQYLTHLDAIAAKAIYGKSLDAVLPKITSEKKIDFKKAYHPILWKKNQEKNIETVPQSIILNEKQQIIVISGPNAGGKSITLKTIGLLQVMLQSGLLIPVDERSETYIFNTILTDIGDNQSIENQLSTYSYRLKNMRNFLRKCNKNTLFLIDEFGTGSDPELGGALAEIFLEEFYSKKAFGIITTHYSNLKVLANEFGKCYQRKYAVSRTYFRTFVITVCWASRKFFYV

SEQ ID NO: 19413 - DNA, 717 bp, Unknown
  Obtained from environmental sample
  misc_feature (1)..(717): n is a, c, g, or t
atggctaaatctaaatttcattcaacttcttcaagcgtaaatgctttaaaatcaaagttaaagctattagggtttaaaattgatgaagttgctaaaggtcaaattttttctgcggttcctattacaacacctataagtgggtttgtagacgaagtgttggttaaccttggtgattatgtggcaccacaaaccaaaatgtttaccgttagtgataattctaaactacatgtagatttaattgtttatgaaaaagacattaacaaagtaaaattgggtcagaaaattttctttacagtagcttccaaacccaatgaaattcttaaagctaaagtgcattctattggtaaaacttttgaaaccaatccaaaagcattgcacattcatgcagatatgaataataaaaacggagatttactcccgggcatgtacgtggaaggaagaatagtacagggagaaaaaatgggttatgctgtgccagaagctgccattataaaagaaggtgagcaatcttttatttttattttagatgaagacgaagcaataaataagaataaaatgaaatttaagatgataccggtaaccgttggtattactgatttaggttttgttgaagtcaacctaccagctgaaatttcaaaaaaggtaaaagtggttacaaaaggagcatatatgctgtcatcagaaagaataaaaggagaattagaacatgatgattaa

SEQ ID NO: 19414 - protein, 238 aa, Unknown
  Obtained from environmental sample
  misc_feature (1)..(238): Xaa is any amino acid
MAKSKFHSTSSSVNALKSKLKLLGFKIDEVAKGQIFSAVPITTPISGFVDEVLVNLGDYVAPQTKMFTVSDNSKLHVDLIVYEKDINKVKLGQKIFFTVASKPNEILKAKVHSIGKTFETNPKALHIHADMNNKNGDLLPGMYVEGRIVQGEKMGYAVPEAAIIKEGEQSFIFILDEDEAINKNKMKFKMIPVTVGITDLGFVEVNLPAEISKKVKVVTKGAYMLSSERIKGELEHDD

SEQ ID NO: 19415 - DNA, 543 bp, Unknown
  Obtained from environmental sample
  misc_feature (1)..(543): n is a, c, g, or t
ttgtttgccgcttcaaatgccgggatttacttctttcagaaattcaagcaaaacaagcaggccaaagagatgcgggtcaagtttgacgataaagtcaaatcgaataccgaagccgtcaatatgctttccgcattgaagaacctggagatcgtggagattctcaccaaaaccctggtttggggagtgcggggcgaagtcatccggggcaacaaagagatcattgaccgtttcctcatcgaaatggcccaggaaaccaatgtggacctggtgatccttgaaggcatcgacggtgtgatttatctttccaccgacaaaaagtatgagaatcagaaggtcagtgatatcctcccttccgttccgatttctgtggattcccgcaagattttgaaaaatgaacctgatgaaattgtagtggctgctcccatcatgggagaggaactcaagttgggcgtgctttttctcgtttacaagccggatgctgcttctcaaaaactcatcaaggacgtttctgtcaacccatttgcagagaccgaagaaaagtaa

SEQ ID NO: 19416 - protein, 180 aa, Unknown
  Obtained from environmental sample
  misc_feature (1)..(180): Xaa is any amino acid
MFAASNAGIYFFQKFKQNKQAKEMRVKFDDKVKSNTEAVNMLSALKNLEIVEILTKTLVWGVRGEVIRGNKEIIDRFLIEMAQETNVDLVILEGIDGVIYLSTDKKYENQKVSDILPSVPISVDSRKILKNEPDEIVVAAPIMGEELKLGVLFLVYKPDAASQKLIKDVSVNPFAETEEK

SEQ ID NO: 19417 - DNA, 423 bp, Unknown
  Obtained from environmental sample
  misc_feature (1)..(423): n is a, c, g, or t
atgtttatcggtcattctggtgttggaaaatctaccttggtaaatgccattgaaccaactttagatttaaaaaccaaggaaatatcgaatcaacataaacaggggcaacacacaacaacttttgcggaaatgttcgatttaagttttaatgcctctattattgatacaccaggaattaaaggctttggtgttgtagatatggagaaagaagaagttgatagttattttccagagtttttagcagttaaaaacgattgtaaatttaacaattgtttgcacgtagaagaaccaaaatgtgctgtaaaagaagctgttgaaaacgaagaaatttctttttctcggtataaaagttacctgcaaattattgctggagaagaggaaaattatagaactgatttttgggaaaacgaagaagatatttaa

SEQ ID NO: 19418 - protein, 140 aa, Unknown
  Obtained from environmental sample
  DOMAIN (2)...(123): Protein of unknown function, DUF258
  misc_feature (1)..(140): Xaa is any amino acid
MFIGHSGVGKSTLVNAIEPTLDLKTKEISNQHKQGQHTTTFAEMFDLSFNASIIDTPGIKGFGVVDMEKEEVDSYFPEFLAVKNDCKFNNCLHVEEPKCAVKEAVENEEISFSRYKSYLQIIAGEEENYRTDFWENEEDI

SEQ ID NO: 19419 - DNA, 858 bp, Unknown
  Obtained from environmental sample
  misc_feature (1)..(858): n is a, c, g, or t
ttgatcggctcgagggatatatatcaacattggttgattagcaatattgagacaaagtatccaagaaaaataattgatcttggcataggaaatgcgtctttgtctattgcagcctattccaaatggaatacggcaaagtattatgcaacagaaattgagccttataaagctaaaaaactaagaaataaattatcatttttaaatgtagtaggttatgacacacttaatcctaatatttccaataggttaaaagtgaaatttggtctgatggatgttgcaatatgtaaccctccatatttcacaattaaatatgatacaaaatataataagctttttgagtcaattggctgtcaggaattttgtagtttaaaacggatatcatctgaaattgtctttcttgctcataacttgaagttattgaaaagaaatggagagcttgccataatagtttccgatagtttagtaacaggtaaagattatactacttttcgtaaggtaattcttagtaaatttttactacgacgtattattcaattacccgataatgtttttgataaaacagaagcaaggacacatattttgtttatttctaaatgcaagtcttccgttaaacaatgtgagatatttgcatcaaacaataatggtgaattaacagaaccaattgttgtttctacagataaattgtcagaaagaatggactttcaataccacaattataaactcaatgaactacttggtaataaaactcttaaagaaataggtgctattatcagtagagggaagttttcgtgccgagaattgtcagaatctaaactcttttatttcactcaactcattttaaggattatgatgaattga

SEQ ID NO: 19420 - protein, 285 aa, Unknown
  Obtained from environmental sample
  misc_feature (1)..(285): Xaa is any amino acid
MIGSRDIYQHWLISNIETKYPRKIIDLGIGNASLSIAAYSKWNTAKYYATEIEPYKAKKLRNKLSFLNVVGYDTLNPNISNRLKVKFGLMDVAICNPPYFTIKYDTKYNKLFESIGCQEFCSLKRISSEIVFLAHNLKLLKRNGELAIIVSDSLVTGKDYTTFRKVILSKFLLRRIIQLPDNVFDKTEARTHILFISKCKSSVKQCEIFASNNNGELTEPIVVSTDKLSERMDFQYHNYKLNELLGNKTLKEIGAIISRGKFSCRELSESKLFYFTQLILRIMMN

SEQ ID NO: 19421 - DNA, 345 bp, Unknown
  Obtained from environmental sample
  misc_feature (1)..(345): n is a, c, g, or t
atgcggaaacaccagctgctcatactcatcatcttgatgcttacttcagtgagtaacagttctgcgcaatattttaaggagtttgacacctacgttttgcaggatagccttatggctttgaatacagaatacatcactacgataaaactgccaccctcagaattcgatgttaatcaccccaatgatatacttgaatacttatctgaacacctttcaaaagacaaaggcaatgtagtaaggctgtacgatgttaaaaaagagaaagacggaaaactacatacaaaacctatgctgatatatacagcactaacaaagcagacaattcagaatattacacccccttga

SEQ ID NO: 19422 - protein, 114 aa, Unknown
  Obtained from environmental sample
  SIGNAL (1)...(20)
  misc_feature (1)..(114): Xaa is any amino acid
MRKHQLLILIILMLTSVSNSSAQYFKEFDTYVLQDSLMALNTEYITTIKLPPSEFDVNHPNDILEYLSEHLSKDKGNVVRLYDVKKEKDGKLHTKPMLIYTALTKQTIQNITPP

SEQ ID NO: 19423 - DNA, 813 bp, Unknown
  Obtained from environmental sample
  misc_feature (1)..(813): n is a, c, g, or t
ttgccaaaaacacatagattaagaagtgatggaacaggaatgttattaagagcacgagcaaaaatgttgattggattaggagcaaaaaccgtagtaaaagttattgataataaaagagaagaagattttcaaaataaaggatatgattttgctgtcaacaaaaaaagtagtgtggtaaatgatgaaatggttgaaagagaaaacaaaagagttagttataatgacattcaaataagacacgcaatggcttctgatattcttggaatatctagaaaagatttaaataaaatgtttgatgaggttaaaaaaggacatcaaataaaagggaaagttattcgtggtataaaagtaaaaattaatattgatgttataaaaggaaaagacagttctagaaatgtaattgccataataaaaggtagtgatgcaaagctgaaagaagaatatgttgttcttagcgcacattatgatcatataggaattaccgaaggaggtatttttaatggagcaaatgataatggctcaggaacagttggtttgttagagattgctagagcaatgatgaaagaaaaaccagcaagaacagtagtttttgtttggtttacaggagaagaaaaaggattgtggggttctaagtattttgttgcaaatccgccaattcctttagaaaaaattagtgctgcaattaatttagatgtaataagtggtacagatattagtaaagtaacagcaacaggaggagaaatgttaagctcaatcttaaaacaattaatttctgaagctagntcagggacaaatgaaagtaggattatatga

SEQ ID NO: 19424 - protein, 270 aa, Unknown
  Obtained from environmental sample
  DOMAIN (148)...(216): Peptidase family M20/M25/M40
  misc_feature (1)..(270): Xaa is any amino acid
MPKTHRLRSDGTGMLLRARAKMLIGLGAKTVVKVIDNKREEDFQNKGYDFAVNKKSSVVNDEMVERENKRVSYNDIQIRHAMASDILGISRKDLNKMFDEVKKGHQIKGKVIRGIKVKINIDVIKGKDSSRNVIAIIKGSDAKLKEEYVVLSAHYDHIGITEGGIFNGANDNGSGTVGLLEIARAMMKEKPARTVVFVWFTGEEKGLWGSKYFVANPPIPLEKISAAINLDVISGTDISKVTATGGEMLSSILKQLISEAXSGTNESRII

SEQ ID NO: 19425 - DNA, 429 bp, Unknown
  Obtained from environmental sample
  misc_feature (1)..(429): n is a, c, g, or t
atgtctaagattcgtaagaatcaaactgctgagcttattgttgatgctttaccaaaccaagcattcaagggccatgtagaacgaattagccctgttgttgaccccaccactggtacttttaaggcaactgtatatgtagatcaaaagaacacgacattgaaacctggtatgttcggaagaatcaaaatagtttatgatacacgtttaaacgcacagcttattccaaaagcagcagtcattaccgaggatcaaacccaaactgtattcgtgattaaagattcacttgcccacaaaagagaaataagaacgggttatataaacggcaaaaacattgaagtaatagatggtctattagacggagaatttgttgtaaccattggccaaggaagtttacaagacagcgcaaaagtaacggttgttaaaagctaa

SEQ ID NO: 19426 - protein, 142 aa, Unknown
  Obtained from environmental sample
  misc_feature (1)..(142): Xaa is any amino acid
MSKIRKNQTAELIVDALPNQAFKGHVERISPVVDPTTGTFKATVYVDQKNTTLKPGMFGRIKIVYDTRLNAQLIPKAAVITEDQTQTVFVIKDSLAHKREIRTGYINGKNIEVIDGLLDGEFVVTIGQGSLQDSAKVTVVKS

SEQ ID NO: 19427 - DNA, 558 bp, Unknown
  Obtained from environmental sample
  misc_feature (1)..(558): n is a, c, g, or t
atggccggggattttggttcgttcgggggcgattttttttgccttgtaaaacgaggcgaaagttgcaacctggacatcatttggcttgagcaaaaggaattacgggcgggatttatgcttctttcaatcaccgtttctagtgatgaaatttatgagagctttaattccattgatccaatcaaaacgttttggcatggacacagttatacgggcaatccgttgggatgtgcagcaggaattgcttcttggaaattgctaaaagaaaacgaatctgttttcaaaggaatggaagccattcacaccaaacatttagcaaaattagccgatcatccacgattagaaaagcttcgtgtaaaaggaaccattgccgcaatggacatcaaaaacgaagaagagggcggatatttgaattcggtggcaaagcgaatcaaaaaagaatgtgtggatcacggtttgttacttcgacctcttggaaatgtgttgtacctaatgccaccgtattgtgtaaccgaagatgagctgaatatgatttatgggaagattggggagttggtgtag

SEQ ID NO: 19428 - protein, 185 aa, Unknown
  Obtained from environmental sample
  misc_feature (1)..(185): Xaa is any amino acid
MAGDFGSFGGDFFCLVKRGESCNLDIIWLEQKELRAGFMLLSITVSSDEIYESFNSIDPIKTFWHGHSYTGNPLGCAAGIASWKLLKENESVFKGMEAIHTKHLAKLADHPRLEKLRVKGTIAAMDIKNEEEGGYLNSVAKRIKKECVDHGLLLRPLGNVLYLMPPYCVTEDELNMIYGKIGELV

SEQ ID NO: 19429 - DNA, 684 bp, Unknown
  Obtained from environmental sample
  misc_feature (1)..(684): n is a, c, g, or t
ttgaatagaaagggggtgggagatggttactcgatgataaaaactaggctagaccaaaatgaaatagacctgagggtcgcggaagatagtttagttcattttcaaaaaagatatggaattctagaagtcgaggaacaagccaagtctcaaataaaagctttagcggagctgaaatctgaaattgtaaaacttgaagttcaaatcggttatacaaaagaagttcttggttcaggtaataataaaattgaagatttagaagttcaaaaaaaacaatttgagaagaaatatagtgaacttttaattggaggtgttaacggtgatgagcctttcgatgtattccaatctatgcaggaactaccagatttgtttttagaatatctgagaaggtatcgagaggtaattgttcaagaagaaatatacaaagtgctttaccctcaatacgaacaacaaaaacttaattatgaggctgctaactctggattaagggtaatagatccagcagttttacctacgtataagtcggcgcctaagcgtgcttatataatattagttgcaatgttttttggcggatttttaggtgttttgattgtgctttttaaagagtggaaagaaagtcttcaagtgaataatccagatgagttaactagatttaacgaatttattaaagagctaaaaaggttctag

SEQ ID NO: 19430 - protein, 227 aa, Unknown
  Obtained from environmental sample
  misc_feature (1)..(227): Xaa is any amino acid
MNRKGVGDGYSMIKTRLDQNEIDLRVAEDSLVHFQKRYGILEVEEQAKSQIKALAELKSEIVKLEVQIGYTKEVLGSGNNKIEDLEVQKKQFEKKYSELLIGGVNGDEPFDVFQSMQELPDLFLEYLRRYREVIVQEEIYKVLYPQYEQQKLNYEAANSGLRVIDPAVLPTYKSAPKRAYIILVAMFFGGFLGVLIVLFKEWKESLQVNNPDELTRFNEFIKELKRF

SEQ ID NO: 19431 - DNA, 666 bp, Unknown
  Obtained from environmental sample
  misc_feature (1)..(666): n is a, c, g, or t
atgtttccaaagcaaattacacttttaattctatccattctcctttgcaccggttgttcgattttcaagcaacccagaaacccatacaagcccaaacttataaaagttaggggaggggagtttcttttcggtgattttttcgagggggaaaatacggatgcacttccattacacaaagtgaaagttaaggatttcaaaataagtccttatgaaatcacctacgaacagtttgactactactcaaaccttaaaggagaacctctcattgactctgaattattggagcgaggaaatagagcagcagcttacgtaacatgggatcaagcggttgaattttgcaaattttatggaatgcggctccccagcgaaatggagtgggaatatgctgcacggtccgaagggaaggctgaactttacgcaggaacctcaaatccagattctcttcaatactatggaataaccattttagatgatattcatgcttcagctcagattgngcttaaaaaaccaaatggaattggcttatacgatatgactggaaacgtatttgagtggattggtgagttttaccaattttacactatgccagaacagcttcacaataacgaacaagatgctgtaagagtttttaagggaagaagttttgcggaaaaaaaaattcactaa

SEQ ID NO: 19432 - protein, 221 aa, Unknown
  Obtained from environmental sample
  DOMAIN (29)...(221): Domain of unknown function (DUF323)
  misc_feature (1)..(221): Xaa is any amino acid
MFPKQITLLILSILLCTGCSIFKQPRNPYKPKLIKVRGGEFLFGDFFEGENTDALPLHKVKVKDFKISPYEITYEQFDYYSNLKGEPLIDSELLERGNRAAAYVTWDQAVEFCKFYGMRLPSEMEWEYAARSEGKAELYAGTSNPDSLQYYGITILDDIHASAQIXLKKPNGIGLYDMTGNVFEWIGEFYQFYTMPEQLHNNEQDAVRVFKGRSFAEKKIH

SEQ ID NO: 19433 - DNA, 981 bp, Unknown
  Obtained from environmental sample
  misc_feature (1)..(981): n is a, c, g, or t
ttgattcccaaagattcaattttaatggtatgcataggggggagtatcggtaaatgccatattgcagatcgtgacgtaagttgtaatcaacaaattaacacaataaatccaattgctggaattagcccgaattatatttatagcttattgagatcagattatttccaagaagcaattcttgaagcttcaacggggtcagcgacacccataattaataaaactaaatggggaaatatactagttagcttgcccccactcgccgaacaacaccgcattgttcagaaaattgaatccctatttgaagaagtagatgagttggaagcaaagctagataagcaaagcaaaatggacgcgcgattacaattggcagtgaatgcagaagttcagcaagctccagatagtgcagcctccaaaacagcatggaatttcatcaccaataattttgagacgctgtaccacactccagaagccatagacaacctcaaaaagaacattttgaacgaagctgttcgtggtcggcttgtcccccaagaccccaatgacgaacccgcctccgaactcctcaataggattattaaaaggaaagaatacttaatagaggagaagttattaaaaagggggcgttcgacagatcaacccaaaagaatttttaataaagattcagttccatcaacttgggttttctctaaatctgatgacgttttctttatcacaaagcttgcaggatttgaatacactaaatacataaacctcgaggaaaatggtgaggtaccagtaataagagctcanaatgtaaagccattacatctgaataaggaaaactttctttatattgataagctaatcagcgaagaattagataggtgtgctttaacaaagcaatgcttactcgtaacctttattggggccgggtattggagatgttttcaatttttaatgaaggatagaaaagttgccattttagcgccccaatgttgccca

SEQ ID NO: 19434 - protein, 327 aa, Unknown
  Obtained from environmental sample
  DOMAIN (1)...(101): Type I restriction modification DNA specificity domain
  misc_feature (1)..(327): Xaa is any amino acid
MIPKDSILMVCIGGSIGKCHIADRDVSCNQQINTINPIAGISPNYIYSLLRSDYFQEAILEASTGSATPIINKTKWGNILVSLPPLAEQHRIVQKIESLFEEVDELEAKLDKQSKMDARLQLAVNAEVQQAPDSAASKTAWNFITNNFETLYHTPEAIDNLKKNILNEAVRGRLVPQDPNDEPASELLNRIIKRKEYLIEEKLLKRGRSTDQPKRIFNKDSVPSTWVFSKSDDVFFITKLAGFEYTKYINLEENGEVPVIRAXNVKPLHLNKENFLYIDKLISEELDRCALTKQCLLVTFIGAGYWRCFQFLMKDRKVAILAPQCCP

SEQ ID NO: 19435 - DNA, 681 bp, Unknown
  Obtained from environmental sample
  misc_feature (1)..(681): n is a, c, g, or t
atggttacaaagaaaattcaaggagttgaagttccagagctcggttttggtacatttaaacttattggaaaggaatgcgagcaggctgtaaagcttgccctaaatgttgggtaccgacacatcgacaccgctcaagtatataaaaacgagcgcgaagttggcaacggtattaaacaagctcatataaagcgagatgagctttttgtaactaccaagatttggatgaataatttagcaccagaggaagtaattaaatcgactgagcgctctcttcaggagttagacttaccttatgttgacttattacttattcattggcctaatccagattatgatgtcgaaaaaactattgaagctatgctttcggttcgagatcaagggaaggcgttaaatattggtgtgagtaacttccccatgaagcatttgaaagaggttaatgaagaacttgcagctccaatattttgtaaccaagtggaataccacccattgttagggcaatttgatttgctggaatatgctgcagaacaggacttgctagtcaccgcttatagtccgttagcacagggtgaaattttcaagatacctctattaaaagatctagcagaaaagtatggaaaaaactccatctcagatagcactgcgctggttagtagaaccagagccagtggtggcaatacctaa

SEQ ID NO: 19436 - protein, 226 aa, Unknown
  Obtained from environmental sample
  DOMAIN (6)...(226): Aldo/keto reductase family
  misc_feature (1)..(226): Xaa is any amino acid
MVTKKIQGVEVPELGFGTFKLIGKECEQAVKLALNVGYRHIDTAQVYKNEREVGNGIKQAHIKRDELFVTTKIWMNNLAPEEVIKSTERSLQELDLPYVDLLLIHWPNPDYDVEKTIEAMLSVRDQGKALNIGVSNFPMKHLKEVNEELAAPIFCNQVEYHPLLGQFDLLEYAAEQDLLVTAYSPLAQGEIFKIPLLKDLAEKYGKNSISDSTALVSRTRASGGNT

SEQ ID NO: 19437 - DNA, 372 bp, Unknown
  Obtained from environmental sample
  misc_feature (1)..(372): n is a, c, g, or t
ttgcggaatacaatcttcattatcatacgtaattataagcgttgcctgttctggctgaagggtcgattttccaatccattcccgcaattcttgtccacaaccatcacctttgcatccccagggagtaataactacataaatgtgattttcctccatctcaaggccaaatccatcgagcaagtagctctcaagttgttgactcgctgctatttgaaaaagagcaacagcaaaaaacacaaaaaggatatattttctcatttttgtatggcattaaattcaggaataaattcaaccaaccgtattttcttcttgtcccgaattcgtaatgggagcaataaggaactgtcagttgtcattatatggtcaaaataa

SEQ ID NO: 19438 - protein, 123 aa, Unknown
  Obtained from environmental sample
  misc_feature (1)..(123): Xaa is any amino acid
MRNTIFIIIRNYKRCLFWLKGRFSNPFPQFLSTTITFASPGSNNYINVIFLHLKAKSIEQVALKLLTRCYLKKSNSKKHKKDIFSHFCMALNSGINSTNRIFFLSRIRNGSNKELSVVIIWSK

SEQ ID NO: 19439 - DNA, 747 bp, Unknown
  Obtained from environmental sample
  misc_feature (1)..(747): n is a, c, g, or t
atggccaatatgagccatgagatacgtacacctatgaatgcaatagtaggtatgacacggttgctcatggacaaagagcccagagatgatcagaaaaagtatatgaaagccatccagcaatcggcagataatctactggtcatcatcaacgacatacttgacttatctaaaattgaagccggcaagatagtcatagaagaaacagactttgtaatgacagagcttattggcagtgtgaaggatatactattgtttaaagctgaagaaaaaggacttgcctttaaggtatctattgataaaaacattccggtaagactgattggtgatcctacacgtatcaatcaggtgcttatcaatctggcaggaaatgcagttaagtttaccgaaagcggcagtgtatctgttgatgcatatatacacaaacaggaagacaataagtactggatacgttttgatgttacagatacaggtattggtatatcaccagactatgtaggaactatttttgagagctttacccaagcaggtacagacatagcacgtaagtttggtggcaccggattaggacttactatctccaaacagttggtaagcctgatgggtggagagataagtgtagaaagtgagctgggcaagggtacaaagttcactgtaattgttccgcttacagaatctgctaatcaagtagctgagacagaaacacctataatagacgattacaaaaagcaaaaactagctaaagcttaa

SEQ ID NO: 19440 - protein, 248 aa, Unknown
  Obtained from environmental sample
  DOMAIN (1)...(61): His Kinase A (phosphoacceptor) domain
  misc_feature (1)..(248): Xaa is any amino acid
MANMSHEIRTPMNAIVGMTRLLMDKEPRDDQKKYMKAIQQSADNLLVIINDILDLSKIEAGKIVIEETDFVMTELIGSVKDILLFKAEEKGLAFKVSIDKNIPVRLIGDPTRINQVLINLAGNAVKFTESGSVSVDAYIHKQEDNKYWIRFDVTDTGIGISPDYVGTIFESFTQAGTDIARKFGGTGLGLTISKQLVSLMGGEISVESELGKGTKFTVIVPLTESANQVAETETPIIDDYKKQKLAKA

SEQ ID NO: 19441 - DNA, 756 bp, Unknown
  Obtained from environmental sample
  misc_feature (1)..(756): n is a, c, g, or t
ttgacaagttaccctctgttatgtttagtctggtctactatcgttttttttagaaagtacttaatggctaaaaaagcccaaagcacacttaaaaatgcttatctatccttttttctattatctagcttagcaattgttgtctcttttagcgttgtttttgaagcgatggctttgattactcccatccaaaacatgattgttttcttcgttttcaatctgtttataatttcccttcttacaataaactttattaattatttagccgagaaaacaaccgtactcgttaagcttgttggattgtctctagtcctttttattaccgtaatcgggttgcaggggatgcttgttatccccgaatttgaaaaaggagcaagtgttcaaaatagccttctaacaaaagctgacttggagattgttcatagccaagccgagccctatgcttggtttttgatgggctccattgtaattatcatagctattttcccatttttctatagcaaaagtgtgctcagccctttaaaaacattacttgacggtgtagatgaagttaacaaaggcaatttgaaggtaacaatccctgttacaaatcaagatgagattggggctgtaacgaggcattttaatacgatgacaagcaatctcgaaaaagcgaattcttcgttaaaagattatgctgaacagctagaaaagaaagttaaggaccggacaaagcaattaaataagcaaaacatcgctctcgaactcgagccgatctga

SEQ ID NO: 19442 - protein, 251 aa, Unknown
  Obtained from environmental sample
  DOMAIN (147)...(216): HAMP domain
  misc_feature (1)..(251): Xaa is any amino acid
MTSYPLLCLVWSTIVFFRKYLMAKKAQSTLKNAYLSFFLLSSLAIVVSFSVVFEAMALITPIQNMIVFFVFNLFIISLLTINFINYLAEKTTVLVKLVGLSLVLFITVIGLQGMLVIPEFEKGASVQNSLLTKADLEIVHSQAEPYAWFLMGSIVIIIAIFPFFYSKSVLSPLKTLLDGVDEVNKGNLKVTIPVTNQDEIGAVTRHFNTMTSNLEKANSSLKDYAEQLEKKVKDRTKQLNKQNIALELEPI

SEQ ID NO: 19443 - DNA, 825 bp, Unknown
  Obtained from environmental sample
  misc_feature (1)..(825): n is a, c, g, or t
ttggtcattgctcgcatcctatctgaaaaaggatattccataactatttgttttgtagatggaacagagtctttaagcgaagacaccgaaaagaattttcagcttctgaaaaagcttaacggagatattcgttttatagagtggaatcctgatctgcgtttttcagaattcgattttattgtggatggaatgtttgggactggattaaattccgatgtccgtgcgccttataaagaagtaattcaatctgtcaataaaagtaacttgtctatcttctctttagacctaccatcaggtttacacgcagatacaggacaaattatgggcgctgccattaaagcagattttacccttacatttggtgcgctaaaaactggtttctatttaaatgatggttttgatcttacaggagatatcatcctttgcgagctccctttcccaaatcattttaaagaaaagtctgctgttttgattgatgaggattgggccttaaaatcagatttaaaaccaactctacgagctcataaatatgatggtggtgttctctatatcattgcaggttcagaaggactaacgggtgctgctatacttgcttcaaaaagtgcttgggctacaggaatcggagcagttattctaataaccccaaaaggattgcttcgtgtttatgaagaacagttgattcanatcattaagaaaccaatcggcacatatgaagatgtatttttctctgaagatcatcttgaggaagtgaagtctattctaaatgaaaaaacagggactcttcttattgggtccgggtattgnaagaaacccatctactattaa

SEQ ID NO: 19444 - protein, 274 aa, Unknown
  Obtained from environmental sample
  DOMAIN (1)...(126): YjeF-related protein N-terminus
  misc_feature (1)..(274): Xaa is any amino acid
MVIARILSEKGYSITICFVDGTESLSEDTEKNFQLLKKLNGDIRFIEWNPDLRFSEFDFIVDGMFGTGLNSDVRAPYKEVIQSVNKSNLSIFSLDLPSGLHADTGQIMGAAIKADFTLTFGALKTGFYLNDGFDLTGDIILCELPFPNHFKEKSAVLIDEDWALKSDLKPTLRAHKYDGGVLYIIAGSEGLTGAAILASKSAWATGIGAVILITPKGLLRVYEEQLIXIIKKPIGTYEDVFFSEDHLEEVKSILNEKTGTLLIGSGYXKKPIYY

SEQ ID NO: 19445 - DNA, 429 bp, Unknown
  Obtained from environmental sample
  misc_feature (1)..(429): n is a, c, g, or t
atgatggctggaatggatcatttttgtcgatttaggcataatctgattccattttttattgaaaaaagtttacttcaaaaaggaaatcaattgcgtgttcagtttgaagatatgtacaccgaagaagaagcggatggtattttgaaagccgatgtatatttaccgttggatttgctgccaaaattatctggagataaattttattttcatgaagtaattggttttaaagcggttgatgtaaattacggattggttggaaccattgaaggaatcaacgataaaacagcgcaacctttatttgaaatcaagaacggggataaagaagtttttattccgatgattgatgattttatcaaaaaaattgatagagaaaataaagtaattgaagttgaaactcccaaaggattgattgaactttatttatcctaa

SEQ ID NO: 19446 - protein, 142 aa, Unknown
  Obtained from environmental sample
  DOMAIN (64)...(137): PRC-barrel domain
  misc_feature (1)..(142): Xaa is any amino acid
MMAGMDHFCRFRHNLIPFFIEKSLLQKGNQLRVQFEDMYTEEEADGILKADVYLPLDLLPKLSGDKFYFHEVIGFKAVDVNYGLVGTIEGINDKTAQPLFEIKNGDKEVFIPMIDDFIKKIDRENKVIEVETPKGLIELYLS

SEQ ID NO: 19447 - DNA, 483 bp, Unknown
  Obtained from environmental sample
  misc_feature (1)..(483): n is a, c, g, or t
atgggattaggttctgctgtaaacagattaaaagaaagcaaagccaaaagcaaagtcattattttattgacagacggagtaaataattctggatttatcgacccaaagacagcaacagaattggcaaaagaactttctataaaagtatataccatcggaattggaacaaacggaatggcagattttcctgcatttaaagatccaagaacaggaaaattaattttcagaaaacaacaagtagagattgatgaagatttgttaaaatatattgcaaatcaaactgaaggagaatattttagagctacagacaatacagagttaaaagctatttacgacgaaattaacaagttagaaaaaacaaaaatagaagaatttaaatattataattatcaagaattgtatagaaatttagtgcttttagcattaggattattagtattagaatatctgttgaaaaaaacactgtttaaaagttttatttaa

SEQ ID NO: 19448 - protein, 160 aa, Unknown
  Obtained from environmental sample
  misc_feature (1)..(160): Xaa is any amino acid
MGLGSAVNRLKESKAKSKVIILLTDGVNNSGFIDPKTATELAKELSIKVYTIGIGTNGMADFPAFKDPRTGKLIFRKQQVEIDEDLLKYIANQTEGEYFRATDNTELKAIYDEINKLEKTKIEEFKYYNYQELYRNLVLLALGLLVLEYLLKKTLFKSFI

SEQ ID NO: 19449 - DNA, 381 bp, Unknown
  Obtained from environmental sample
  misc_feature (1)..(381): n is a, c, g, or t
atgtatcaaatagaagaaccaacatatttttattatttagcaattattcctgtaataattgtactatttctattggctttttggtggaaaaaaagaactcaaaaaagatttactgacagtcttttattagaaaaactagcgccaaacacctccacttttaaatctgttttaaaaatgatttttttaatcattggaattgggtttttagtgattttctttggtaaaaccctaaaatgggaaaccaagttaaaaaacggtaaaaaagagaaaggtgtaggaatgttgttttttgcgtttggatgttttccaaaaagtatgtttgaccggaaaaataattgccgcccaaacagggttaagaaaaaaagccaaaggcaaaattaa

SEQ ID NO: 19450 - protein, 126 aa, Unknown
  Obtained from environmental sample
  misc_feature (1)..(126): Xaa is any amino acid
MYQIEEPTYFYYLAIIPVIIVLFLLAFWWKKRTQKRFTDSLLLEKLAPNTSTFKSVLKMIFLIIGIGFLVIFFGKTLKWETKLKNGKKEKGVGMLFFAFGCFPKSMFDRKNNCRPNRVKKKSQRQN

SEQ ID NO: 19451 - DNA, 360 bp, Unknown
  Obtained from environmental sample
  misc_feature (1)..(360): n is a, c, g, or t
atgatgaatatgaaatcaatttttgtgtgttttttatttacaattattattggaataacaaatgtaaatggacaaacaaccacgagtaatgaggtgaaatctcttattaaaaagaagatagaatacaacaagaaaaatggctatgggtttagaattcagttagaaagcggacttgaaactgcaattaaaacgacgcaacgtaaatttagaatagagcgtccaacaattaaaacctatattttatttgaatctccagaatggaaagtacaagttggagattacaaaactagattggaagctgataaaattttaaatgaaattaaaaagaagtttccatcggcaattatagtccctaggtaa

SEQ ID NO: 19452 - protein, 119 aa, Unknown
  Obtained from environmental sample
  misc_feature (1)..(119): Xaa is any amino acid
MMNMKSIFVCFLFTIIIGITNVNGQTTTSNEVKSLIKKKIEYNKKNGYGFRIQLESGLETAIKTTQRKFRIERPTIKTYILFESPEWKVQVGDYKTRLEADKILNEIKKKFPSAIIVPR

SEQ ID NO: 19453 - DNA, 723 bp, Unknown
  Obtained from environmental sample
  misc_feature (1)..(723): n is a, c, g, or t
atgtactcatcggccactgacaacaaagtgtacaagaaactagatgtgttggttgatgttattgtgattaatggttctctgtataagctcgaatcttacgcatacggcatcgatacagaagtaattgaaaaatctgatattcaatctttagtccagaagtggaatggatttgcggttgatggaaaattatcgacaagcaaccccaatcaacctgaagtaaaacgccgggagttttcaactagaattcagtcagaagaccctattaagcagatttggagcagacttaagcaattcaagtcgaaggatattgcaaaaaagatagttggcgaaaggatgctagctaaaggcatctcggaaccggaggaggtaatagaaagtaaggcgataggactagcgtattgcattcagaatgcctgcgactattttgaggctgcgagtcaacaaatgctcaatcagagaattgttagcctgtactatgggggtattgcacttgcatcggcagaaatgctgtcttctcccactggccctcgttcgttaagggaggtcgaggatatgactaagtttggacacggtctatatacctttgattcgatctctgacaatgagtttgagggatttgttgtcggcgttctctcaaatggtttttacaaaagatgggtggaatttttagggcatgatgtatcgcaattccctcagaaaaacctcgcaaaccttaaagatgta

SEQ ID NO: 19454 - protein, 241 aa, Unknown
  Obtained from environmental sample
  misc_feature (1)..(241): Xaa is any amino acid
MYSSATDNKVYKKLDVLVDVIVINGSLYKLESYAYGIDTEVIEKSDIQSLVQKWNGFAVDGKLSTSNPNQPEVKRREFSTRIQSEDPIKQIWSRLKQFKSKDIAKKIVGERMLAKGISEPEEVIESKAIGLAYCIQNACDYFEAASQQMLNQRIVSLYYGGIALASAEMLSSPTGPRSLREVEDMTKFGHGLYTFDSISDNEFEGFVVGVLSNGFYKRWVEFLGHDVSQFPQKNLANLKDV

SEQ ID NO: 19455 - DNA, 372 bp, Unknown; identical to SEQ ID NO: 18091
  Obtained from environmental sample
  misc_feature (1)..(372): n is a, c, g, or t

SEQ ID NO: 19456 - protein, 123 aa, Unknown; identical to SEQ ID NO: 18092
  Obtained from environmental sample
  misc_feature (1)..(123): Xaa is any amino acid

SEQ ID NO: 19457 - DNA, 396 bp, Unknown
  Obtained from environmental sample
  misc_feature (1)..(396): n is a, c, g, or t
atgaataaacaaaaaatagatgagatttttcaaatctggaaaaaagaacataaaaattcccctataatagaattagattataagaataactacacaatgctcgttgcaattatactctccgcacaatcaacggatgtgggcgtaaacaaagcaactccggcactttttgaaatagtagatacaccagaaaaaatgaatagcctgggcgaagaaggacttaaaaagtatataagaacaatcggtctttttaactctaaagctcgcaatataattaaaatgtcagaacaactagttaaagagcataattctaaagttcctgatgattttgataagttaattaagcttggcggagtagggcgtaagacagctaatgttttcttaaatgtcgctttttga

SEQ ID NO: 19458 - protein, 131 aa, Unknown
  Obtained from environmental sample
  DOMAIN (35)...(127): HhH-GPD superfamily base excision DNA repair protein
  misc_feature (1)..(131): Xaa is any amino acid
MNKQKIDEIFQIWKKEHKNSPIIELDYKNNYTMLVAIILSAQSTDVGVNKATPALFEIVDTPEKMNSLGEEGLKKYIRTIGLFNSKARNIIKMSEQLVKEHNSKVPDDFDKLIKLGGVGRKTANVFLNVAF

SEQ ID NO: 19459 - DNA, 342 bp, Unknown
  Obtained from environmental sample
  misc_feature (1)..(342): n is a, c, g, or t
ttgatggctgagatatttttaatgtgtggttctgtctttttccacgtccataaagaatgccaaaccgaaacatctaatggcgcaggcatccagcctaaaaaagcaattaaaaaagttatttctatggttccgcttggtaaaatttgcgtaaaagtaaatgtttcttttgtgctaaatactgcaatagcgactgcaattacagtgcttatcgttaataaaatgataatatatttcattaaattatctagcaatttatattttccaataactagaattatcgtgctaatactaataattagtatcgaccataaaaccaaattatttgtaaaaccaaacagctga

SEQ ID NO: 19460 - protein, 113 aa, Unknown
  Obtained from environmental sample
  misc_feature (1)..(113): Xaa is any amino acid
MMAEIFLMCGSVFFHVHKECQTETSNGAGIQPKKAIKKVISMVPLGKICVKVNVSFVLNTAIATAITVLIVNKMIIYFIKLSSNLYFPITRIIVLILIISIDHKTKLFVKPNS

SEQ ID NO: 19461 - DNA, 330 bp, Unknown
  Obtained from environmental sample
  misc_feature (1)..(330): n is a, c, g, or t
ttgccttacggcggagcagttttaaaagtaaaaattcaaggaagtctgttgttaaaagtgttagaatatggaaaaaatgcagcaggaacaggagcttatttacaacgatataatgtagagaaaatgaacaataaatggttggtgaaatcaaagccaattaacccaaataagatttatacagtagctttttctgattatcttttaaaaggatttgacattccgtttttatcagataaaaacaaagaagtactttctatgtatcaaccaaaaccaaatgaaatttcttttgatattagaaatgctgtaattttatacttaaaatctttatag

SEQ ID NO: 19462 - protein, 109 aa, Unknown
  Obtained from environmental sample
  misc_feature (1)..(109): Xaa is any amino acid
MPYGGAVLKVKIQGSLLLKVLEYGKNAAGTGAYLQRYNVEKMNNKWLVKSKPINPNKIYTVAFSDYLLKGFDIPFLSDKNKEVLSMYQPKPNEISFDIRNAVILYLKSL

SEQ ID NO: 19463 - DNA, 456 bp, Unknown
  Obtained from environmental sample
  misc_feature (1)..(456): n is a, c, g, or t
atgtcgacagacgaactaaatatcaactatacacgcgaagcatttatgaatcccatcaatttgggaggattgcttatcgcaacacttacggcattctttatcagtgattttggtgacgcttcaagcgtgatgttaactacaatctttggtttagaattgatgtacttgggtatcgtaccaaaactgccgcgttttagaaagaaaacggaattaaagaaaattaaagagagacatgcttccagtaatgaaaaggacttgtttcaatcacttgattcagctagccaaaaacgatttttagtgctaaagcatcttgcaaagatggtgcaagaaaactttgaaaaacttccatatagttctcaagggttgctcgataacattggtaaaaaaattgaagaattattaggcaattatcttacacttttagatttgataaaacgatatgaaaggtgtatttga

SEQ ID NO: 19464 - protein, 151 aa, Unknown
  Obtained from environmental sample
  misc_feature (1)..(151): Xaa is any amino acid
MSTDELNINYTREAFMNPINLGGLLIATLTAFFISDFGDASSVMLTTIFGLELMYLGIVPKLPRFRKKTELKKIKERHASSNEKDLFQSLDSASQKRFLVLKHLAKMVQENFEKLPYSSQGLLDNIGKKIEELLGNYLTLLDLIKRYERCI

SEQ ID NO: 19465 - DNA, 723 bp, Unknown
  Obtained from environmental sample
  misc_feature (1)..(723): n is a, c, g, or t
ttgacccagaaatttgttttcaatagtatcagacgattctttttgtttttaagaaaaaacccttacaagtgggctgctaagattaacaaagaaattggagctcaaaacctaaacattcatttaggccaattcaatattgacgagcacaaactgactgaactgattcaaagtttagccaaagccgaaaagagagacagaaaaaaaattattcagtccttcaagattagaaagaatggtttatcctttcaatcatttctgaaaattctcctttatatctcaatttcaattgctttactcttactgtccttgacaggcattacggcttttatgactattatgatattaatgggaataggagctataactgcacgatggtattggggaagcacagagaagtctataattaggaaatatgcaggaataattacttggttcggtttgataaatatggtcttgtgtttagctactttgaaatcctacgactatgtttccgagaatgcaggaagaaaactatcacagcaaattgaccacttcataaaagtgcactcttcatatccaactgactttaaatcaattaaaaaaaatacagacttaaattttatagaagggatttttgcaaatagagttcaatacgaagtaactaacaacaactacgaattacggactatcaatttgttgaataaggaaaggatatatgacaaagacttggaagaatggaattaa

SEQ ID NO: 19466 - protein, 240 aa, Unknown
  Obtained from environmental sample
  misc_feature (1)..(240): Xaa is any amino acid
MTQKFVFNSIRRFFLFLRKNPYKWAAKINKEIGAQNLNIHLGQFNIDEHKLTELIQSLAKAEKRDRKKIIQSFKIRKNGLSFQSFLKILLYISISIALLLLSLTGITAFMTIMILMGIGAITARWYWGSTEKSIIRKYAGIITWFGLINMVLCLATLKSYDYVSENAGRKLSQQIDHFIKVHSSYPTDFKSIKKNTDLNFIEGIFANRVQYEVTNNNYELRTINLLNKERIYDKDLEEWN

SEQ ID NO: 19467 - DNA, 369 bp, Unknown
  Obtained from environmental sample
  misc_feature (1)..(369): n is a, c, g, or t
atgtctaattatttactgtctgttattctgcttgcatttattttggctagttgcagtaccgctccagagctaaagcgggatagcgtattcgaccctaatcctacagagcctaatggccaaataatattcccaaaagattatcaaataaggggtaatatcgagcgcttaagctttaagataaaacttaataaggcagccaaaggtgaagatataaatatagtactaaagagtaatcttgatggagtaatttatgaaacctcaaatgcactaaccgatactttagttatctataaaacagatttatctgatggtaatcacaaagttgatttaatcattaatggtgaaaaagtgtctgaaagtcaatcttag

SEQ ID NO: 19468 - protein, 122 aa, Unknown
  Obtained from environmental sample
  SIGNAL (1)...(20)
  misc_feature (1)..(122): Xaa is any amino acid
MSNYLLSVILLAFILASCSTAPELKRDSVFDPNPTEPNGQIIFPKDYQIRGNIERLSFKIKLNKAAKGEDINIVLKSNLDGVIYETSNALTDTLVIYKTDLSDGNHKVDLIINGEKVSESQS

SEQ ID NO: 19469 - DNA, 576 bp, Unknown
  Obtained from environmental sample
  misc_feature (1)..(576): n is a, c, g, or t
gtgactagcataacatctccaactctagtattaaacgagtccattattagtgctaacattaaattaatgaaagaaaaaacagcaagagttggtattgaattcagaccccattttaaaacacatcaatcaaaatatgtttctgaatcatttaagctgcaaggagttactggtattaccgtatcttcaattaagatggctgaatactttgctgaacatggctggaatgatatcactatagcatttccaattaatatacttgagatagataaactaaataagctaacctcgcatattaagcttaatgttctagttgtagatcaagaagtagtttcatacttagataaaaatttaaaaaatccgatttttgcatacatcgaattagatccaaattatggacgaagtggggtctctatggaaagtattcctgatatacagcgccttaaaaacaacatagactcttctccgattgtgaattatgccggattttatttacacgcaggccatacttataaatgcaaaggagccgatgaagttcgagtggtagcaaattctgtgttggataagatttcaatttaa

SEQ ID NO: 19470 - protein, 191 aa, Unknown
  Obtained from environmental sample
  misc_feature (1)..(191): Xaa is any amino acid
MTSITSPTLVLNESIISANIKLMKEKTARVGIEFRPHFKTHQSKYVSESFKLQGVTGITVSSIKMAEYFAEHGWNDITIAFPINILEIDKLNKLTSHIKLNVLVVDQEVVSYLDKNLKNPIFAYIELDPNYGRSGVSMESIPDIQRLKNNIDSSPIVNYAGFYLHAGHTYKCKGADEVRVVANSVLDKISI

SEQ ID NO: 19471 - DNA, 429 bp, Unknown
  Obtained from environmental sample
  misc_feature (1)..(429): n is a, c, g, or t
ttgtctgacaattacatgaaatactgcctacaggtagtgaaaaatgccaagataatggctcaggaatttgttgaccgtggctataaggtgatatcagacggtacggataaccactccatgctgattgatatgcgctcaaaaaaccttactggtaaggtggccgaagaagccttggtgaaagcacacattacccttaacaagaacatggtgccttttgacgaccaatcgcctttcgttacttcaggcataagggtgggcacgcctgccattaccactagggggcttaaggaaaaacaaatccctaaaatagtggacttgatggataaggtgctgatgaaccacgaggatgaaaagacaattaagaaagtgagaaaagaggtgaacgaaatgatgaatgcctaccctcttttcgagaaacaaccgaagtaa

SEQ ID NO: 19472 - protein, 142 aa, Unknown
  Obtained from environmental sample
  DOMAIN (1)...(107): Serine hydroxymethyltransferase
  misc_feature (1)..(142): Xaa is any amino acid
MSDNYMKYCLQVVKNAKIMAQEFVDRGYKVISDGTDNHSMLIDMRSKNLTGKVAEEALVKAHITLNKNMVPFDDQSPFVTSGIRVGTPAITTRGLKEKQIPKIVDLMDKVLMNHEDEKTIKKVRKEVNEMMNAYPLFEKQPK

SEQ ID NO: 19473 - DNA, 639 bp, Unknown
  Obtained from environmental sample
  misc_feature (1)..(639): n is a, c, g, or t
ttggtcgataattcgtccacagatgtgttaaaagagcattttaatcaagaagagatcgtatatctttttactggaaaaaatttgggttttggaaaagcacataacttggtgatttcaaaattaaaatcagaatttcatttaattttaaatccagatgtcacttttaattcgcaggttttacccaatttaatacacgaattaaagcaccaagaaacggttgctatgatttctcctcaagttgaatacccaaacggggaattacaatatacttgtagaaaaaacccaacacttttagaacttgtttttcgtaggttaaaaattaaaaaagagtttacacaacaacaagaatatagaaatttagacttgtcaaaacccttttacccagagtttattcacgggtgttttatggtttttaaaacccaagagtttaaaaaaattaaaggatttgacgagcggtattttctgtatctagaagatgctgatatttgtagaaaagtgattttgaatcaaaagaaaattttatattttccttcagaaaaaattacgcatctccatcaaaaagcatcagcaaaaagactaaaattattttatcatcatataatttctgcaataaaatatactaaaaaatggcaaatttga

SEQ ID NO: 19474 - protein, 212 aa, Unknown
  Obtained from environmental sample
  misc_feature (1)..(212): Xaa is any amino acid
MVDNSSTDVLKEHFNQEEIVYLFTGKNLGFGKAHNLVISKLKSEFHLILNPDVTFNSQVLPNLIHELKHQETVAMISPQVEYPNGELQYTCRKNPTLLELVFRRLKIKKEFTQQQEYRNLDLSKPFYPEFIHGCFMVFKTQEFKKIKGFDERYFLYLEDADICRKVILNQKKILYFPSEKITHLHQKASAKRLKLFYHHIISAIKYTKKWQI

SEQ ID NO: 19475 - DNA, 432 bp, Unknown
  Obtained from environmental sample
  misc_feature (1)..(432): n is a, c, g, or t
atgaagattcgattttacctttccgcactgtttgcttgccttctgtttgcctcctcggtcaatgcccaggcggttttgaaattgaatggcagctccgaacaaacagatgatctcactctgatcgagtttgaaaaggaaacctatgatcttggcaccctcaccgctggtgaagtcgccaaaagtacttttgtcttcaaaaacattggcgatggcgatttggtgatcgaaaacgttaagccttcctgcgcctgtaccacgcttgaatttcccgacgaaccgattaaaccaggcgaaaccggcaccatctatgccgaaatcgacacggaagacaaggaaggcgaacaaatcaaatacttcaccgtgatttacaacggcaatcctccggtagagcgggtcaagctcatcttcaccgttgaaccggaagggaagtaa

SEQ ID NO: 19476 - protein, 143 aa, Unknown
  Obtained from environmental sample
  SIGNAL (1)...(19)
  DOMAIN (62)...(106): Protein of unknown function (DUF1573)
  misc_feature (1)..(143): Xaa is any amino acid
MKIRFYLSALFACLLFASSVNAQAVLKLNGSSEQTDDLTLIEFEKETYDLGTLTAGEVAKSTFVFKNIGDGDLVIENVKPSCACTTLEFPDEPIKPGETGTIYAEIDTEDKEGEQIKYFTVIYNGNPPVERVKLIFTVEPEGK

SEQ ID NO: 19477 - DNA, 657 bp, Unknown
  Obtained from environmental sample
  misc_feature (1)..(657): n is a, c, g, or t
ttgttaattcccaaccaagcgtatacttcttttattttaaaaaatggtaaagaagagtttgtttctaaagacttgaatctaaccggtgattacgatattagctttgtaacaagtataatggggagtgaggagggtgagtatgaattaaaagtgggtaaatggaaagacattcccaatgatatgatgattgtaattgaagatttagtagccgagaaggtatacgagttagatgataaatgggaaatgaaatttgagtattcgaataatttagttggagacaaggaatctttttatagaaaagatgatttaatccagcctcaaaaagagaatcgttttgtactcagattgatgtcaaaatcgaacaatattgaggatgagaatgttgatactcctcaagagctaacattgaatcaaaattatccaaatccttttaatcctcttactacaatatccttttatatcccagagccaacagaggttaaattatcggtttttaatatagtggggcagcctgttgcattacttattcatgagagcttaaccaggggagagcatcagattgattgggatgcttctgaaatgcctagtggtatgtatatttatcaactagaggttggtacaaagataatgactcgaaagatgaccctagtaaaatag

SEQ ID NO: 19478 - protein, 218 aa, Unknown
  Obtained from environmental sample
  misc_feature (1)..(218): Xaa is any amino acid
MLIPNQAYTSFILKNGKEEFVSKDLNLTGDYDISFVTSIMGSEEGEYELKVGKWKDIPNDMMIVIEDLVAEKVYELDDKWEMKFEYSNNLVGDKESFYRKDDLIQPQKENRFVLRLMSKSNNIEDENVDTPQELTLNQNYPNPFNPLTTISFYIPEPTEVKLSVFNIVGQPVALLIHESLTRGEHQIDWDASEMPSGMYIYQLEVGTKIMTRKMTLVK

SEQ ID NO: 19479 - DNA, 855 bp, Unknown
  Obtained from environmental sample
  misc_feature (1)..(855): n is a, c, g, or t
atgaagccttcaaattcggcttgggaacgattgagcgctcaattagatagtgctcaagaaaagaagcgtaaaaattggtttttatatgttggttatgccgcatcagttttactagtagtgtcagtagctttttttataaatacggatgatggtattgaaccgatgattccagaaaaagtggttacatcgccaattattgataccacgaaatttgtaaaaccaaccattgagaatacaattaaaacggaaactgtaattgtaaaaacggataaagtagaagagaaacaacaaacaaaaaaatcaactattacaaagagaaaacctcaaattaaacaagcaaaaattattgaggaaaatccgattgtaattgctgataatacaaacgatattaagaaagaaacaaagaatccgttacaacaaaacagaatcatgattgatagcaattcgttgttgaaatctgtagatcaaaccgaaacgaaagttacaaaaacaaccatttcaattccgaagaaaacaaagaagtttcttcagaaaagtgctataaaaatcaatagtgatgcattgttgtatgcggttacaaatccggataaagacatcaatgaatattataaaaaatacaatattgatagaaacgatgtgttgaaaaacattcagaaagaattgaataaaacaaacttaaaaattgatgctgctactttattaacaagcgttgaaaagacaattgatgaagaaacccttaaaaagagttttatgcaagttgtaaaaggtaaaataacaggattagcagaagctattgctaacagaaataatttaagaatactttttcaaaacagattaaaaaacttccccatttaa

SEQ ID NO: 19480 - protein, 284 aa, Unknown
  Obtained from environmental sample
  misc_feature (1)..(284): Xaa is any amino acid
MKPSNSAWERLSAQLDSAQEKKRKNWFLYVGYAASVLLVVSVAFFINTDDGIEPMIPEKVVTSPIIDTTKFVKPTIENTIKTETVIVKTDKVEEKQQTKKSTITKRKPQIKQAKIIEENPIVIADNTNDIKKETKNPLQQNRIMIDSNSLLKSVDQTETKVTKTTISIPKKTKKFLQKSAIKINSDALLYAVTNPDKDINEYYKKYNIDRNDVLKNIQKELNKTNLKIDAATLLTSVEKTIDEETLKKSFMQVVKGKITGLAEAIANRNNLRILFQNRLKNFPI

SEQ ID NO: 19481 - DNA, 576 bp, Unknown
  Obtained from environmental sample
  misc_feature (1)..(576): n is a, c, g, or t
ttgaggggcggaattggaaaggaatttgaaaaaggaggaaacggagtttttgcaagccatttgttttcctttcagggtgaaaaagggaaacccaaaaagaagttttgtaaaaagaaagtaaacgatttgataccggtttttcgaaatttttattttcgggaagattatgtaaattctattacagaacgtttgaatttatacaataaattgggcaacttaaaaacagaagaggaattggtgattttgaaaactgaaatcacggatcggtttggagaaattccgattcaagtagtagatttattagacagtgttcgcatcaaatggttggcaaaaaaattggggttagaaaaaatcatcttgaagaaaaaacgcatgattggctattatgtttctgatcaacaaagtgctttttatcaaacagaagattttacaaacatgttaaaatatgttcaacaaaaccctaaaagttgtgtgatgaaagaaaaagaaaccaaaaatggtttgcgtttattaattacctttattcatatagatactgtaggtaaagcattgtctattcttcaaaaaattaaataa

SEQ ID NO: 19482 - protein, 191 aa, Unknown
  Obtained from environmental sample
  DOMAIN (54)...(159): TRCF domain
  misc_feature (1)..(191): Xaa is any amino acid
MRGGIGKEFEKGGNGVFASHLFSFQGEKGKPKKKFCKKKVNDLIPVFRNFYFREDYVNSITERLNLYNKLGNLKTEEELVILKTEITDRFGEIPIQVVDLLDSVRIKWLAKKLGLEKIILKKKRMIGYYVSDQQSAFYQTEDFTNMLKYVQQNPKSCVMKEKETKNGLRLLITFIHIDTVGKALSILQKIK

SEQ ID NO: 19483 - DNA, 984 bp, Unknown
  Obtained from environmental sample
  misc_feature (1)..(984): n is a, c, g, or t
ttgatgggttggcggacctttctaatggaaaaaggaaaggggggttgcccggccggttttgagaaaaataggggtttttctttcttttttaaggtaaacccgtggaaggaatcactttcttcaagatttgtatcaaagccagtattatttccggccacatatggaagatgcaaaaaaattaccccattattaccccggtacagctttattgaaagtaaaaaacagaacaggcagatcctgatcgttgaagatatggaaaccaatcgtttaacggcaaaagcgctgatcggcaagctgggatataggacagacgaggcgaaaaacgggctggaagctgtccagaaacataaagacaaccagtatgatctgattttgatggattgccagatgcccgtgatggatgggcttgaagcaacccgccagataagacagaatgagaaagcattcaaaatagtgcatgttccgattattgccatgaccgggaatgcatttgaaagtgatcagaaaaaatgttttgaggccggaatggatgattttatttcaaaaccggttgaacctgatattttatcacaaaagatccgttcaaatttgacggataatttgagttatacaaaagaagactatcctgaaaaatcagaagatgaggcagaactgccggacatgtgttttaataaagataaattatttgatagatttggaggagatgaggagcttattgaagttgtgttggatgctttttttgaagaagcaccggaactgatagcgaagatcgggcatacaatcgatgaaaacgatatcgaaggtgtaaggttaaattcccatgcactgaaaggatctgcggcaaacgtgaatgcagatttattgaaaaaggctgttttagatatggaaacccaggcaaagatacaaaattttgattcatttgcctcaaattttgaaattattcaaaatgaatacagcaaatttatcagggaagcaaagttatga

SEQ ID NO: 19484 - protein, 327 aa, Unknown
  Obtained from environmental sample
  DOMAIN (241)...(324): Hpt domain
  misc_feature (1)..(327): Xaa is any amino acid
MMGWRTFLMEKGKGGCPAGFEKNRGFSFFFKVNPWKESLSSRFVSKPVLFPATYGRCKKITPLLPRYSFIESKKQNRQILIVEDMETNRLTAKALIGKLGYRTDEAKNGLEAVQKHKDNQYDLILMDCQMPVMDGLEATRQIRQNEKAFKIVHVPIIAMTGNAFESDQKKCFEAGMDDFISKPVEPDILSQKIRSNLTDNLSYTKEDYPEKSEDEAELPDMCFNKDKLFDRFGGDEELIEVVLDAFFEEAPELIAKIGHTIDENDIEGVRLNSHALKGSAANVNADLLKKAVLDMETQAKIQNFDSFASNFEIIQNEYSKFIREAKL

SEQ ID NO: 19485 - DNA, 855 bp, Unknown
  Obtained from environmental sample
  misc_feature (1)..(855): n is a, c, g, or t
atggtctcggtggtcctaccaatgggtacggacctgaacaaatacttcgaagtgatgaacactcggggcgagcagttggagaagcacgagatattgaaggcgcggttgctggataagattcctgaaacggaacataaagtttatggccgaatatggaacgcttgtagccagatgaatcaatatatagagcggggattggagaaaaagggtggaaatgtaaacaaggaattgcgaaatgcaattgcgggatacgggggaatagccgattcggtaatcaatcaagtgaattccgatggccctgccaagggaaaagaagatacgcttgcatcgatcatcgatccggaattcgagattcagcccggaaaagaaacggaagacaataccgccgacgaaaaaatcagctctcctctgcgcttcgaagtattcttgctgcatgtattgaacctgtttgagccatccgcccgcattagtcaactggctaccaaatccctgctcacagcatttgaaaaatttgattttgggaagcccggcaaagtcagtggagaggatgcgaagaaagcgcaggataaggcccggaacttcatgcaacaactgcttcattaccgcatattgctggatcaatacattctcaaaagtgtcaccgccgacaatgaaactgcctggaaaatcaaggaatatcgcaggtatgaaaggaccgaaaaaacggatgttacctggagccgcgaggaacacctgaaaaaatctgtccgcatccaggccatgctgcatgccagcaccgttactgagcactggctcactccggccttggcctggctgaaggaaatattcctgttaaggggcgaaaatggggattaa

SEQ ID NO: 19486 - protein, 284 aa, Unknown
  Obtained from environmental sample
  misc_feature (1)..(284): Xaa is any amino acid
MVSVVLPMGTDLNKYFEVMNTRGEQLEKHEILKARLLDKIPETEHKVYGRIWNACSQMNQYIERGLEKKGGNVNKELRNAIAGYGGIADSVINQVNSDGPAKGKEDTLASIIDPEFEIQPGKETEDNTADEKISSPLRFEVFLLHVLNLFEPSARISQLATKSLLTAFEKFDFGKPGKVSGEDAKKAQDKARNFMQQLLHYRILLDQYILKSVTADNETAWKIKEYRRYERTEKTDVTWSREEHLKKSVRIQAMLHASTVTEHWLTPALAWLKEIFLLRGENGD

SEQ ID NO: 19487 - DNA, 900 bp, Unknown
  Obtained from environmental sample
  misc_feature (1)..(900): n is a, c, g, or t
ttggaagtttatttttgggaaaaattaaccaagggatttttttattttcagaaacttttaacaaaagaaaaccagttttggtgtacgatcaaaatcgtgtgttttggggaattagtagcgacaaaaatagtgagtgcttttttaaaagaatcaggtgttaaaaatacttggcttgatagtagagaaattattaaaacagattctaattttagaaatgccgcagtaaattgggatgaaacgctattcaattgtcagaaactaaatcagcaagaattatatattacacaaggctttattggtcaagatttaaaaggaaacaccactactttaggaagagaaggttctgattttacagcaggaattttagcctattgtttagatgcagaaagtgtaactatctggaaagatgttgatggtattttaaatgcagatccaagagtttttgaaaaaacaattttactgaaacaaatttcgtatcaagaagcaattgaaatggctttttatggcgcatctgtaattcacccaaaaactataaaacctttagaaaataaaagaattccattatatgttcgttcatttaaaaatttaaaaaatttaggaacaaaagttggcaaagacgttcaattagtgccagaaacgagttgttttattgttaagaaaaatcaaatattggtgtcaatttcagcaaaagatttttcttttatggttgaaaaaaacctgagttatatttttgatttattggatcaatataaaataaaagtaaatttaatccagaattcggcaattagtttttctgtatgtattgaggataattattctaattttacagctttttataacgagttacaaccaaattttacagtaaagttaacgaaaatgtacccctcgagccgaatctga

SEQ ID NO: 19488 - protein, 299 aa, Unknown
  Obtained from environmental sample
  DOMAIN (9)...(192): Amino acid kinase family
  misc_feature (1)..(299): Xaa is any amino acid
MEVYFWEKLTKGFFYFQKLLTKENQFWCTIKIVCFGELVATKIVSAFLKESGVKNTWLDSREIIKTDSNFRNAAVNWDETLFNCQKLNQQELYITQGFIGQDLKGNTTTLGREGSDFTAGILAYCLDAESVTIWKDVDGILNADPRVFEKTILLKQISYQEAIEMAFYGASVIHPKTIKPLENKRIPLYVRSFKNLKNLGTKVGKDVQLVPETSCFIVKKNQILVSISAKDFSFMVEKNLSYIFDLLDQYKIKVNLIQNSAISFSVCIEDNYSNFTAFYNELQPNFTVKLTKMYPSSRI

SEQ ID NO: 19489 - DNA, 846 bp, Unknown
  Obtained from environmental sample
  misc_feature (1)..(846): n is a, c, g, or t
ttggattatgtgggagcatttgatgctacaaaagttatagttgtgatgggttcaggagcgagtgctgttgatgaaactatcgaacatcttacaaaagatggagaaaaagttggtatgataaaagtaagactagttcttcccttttgtgtagaaagttttatagactccttaccaaaaacactacaagctatagcagttctagatagaacaaaagaatcaggaagcacaggagaaccactctaccacgatgtagttacagcactttttgaatcacaagaaaaactaccatttcctatgccaaaaatcataggtgggcgatatggtatctcttcaaaagaatttacaccaagtatgataaaaactatttttgatgaattaggaaaatcacttcctaaaaatcactttacaataggaatcaatgatgatgttaccaatacaagtttagaatatgataaaaatcttattatgaaaaacagtgaccaatatgaggctgtattttatggacttggaagtgatgggacagtaggtgcaaataaaaactctataaaaattatagggatggaaacagagaattatgcacaaggatattttgtctatgattcaaaaaaatctggttctatgacaacttcccatttacgatttggggcaaaacctattaaatcaagttatctgattcaaaaagcagatttcgtaggtgtacatcaagcggtctttttagaaaagttggatctattagagattgctaaagatggagctacatttttactcaatactccatattcaaaagagaagatttgggatagattaccaaaagctacacaaaaacaaattgtaaataaaaactaa

SEQ ID NO: 19490 - protein, 281 aa, Unknown
  Obtained from environmental sample
  DOMAIN (170)...(281): Pyruvate ferredoxin/flavodoxin oxidoreductase
  misc_feature (1)..(281): Xaa is any amino acid
MDYVGAFDATKVIVVMGSGASAVDETIEHLTKDGEKVGMIKVRLVLPFCVESFIDSLPKTLQAIAVLDRTKESGSTGEPLYHDVVTALFESQEKLPFPMPKIIGGRYGISSKEFTPSMIKTIFDELGKSLPKNHFTIGINDDVTNTSLEYDKNLIMKNSDQYEAVFYGLGSDGTVGANKNSIKIIGMETENYAQGYFVYDSKKSGSMTTSHLRFGAKPIKSSYLIQKADFVGVHQAVFLEKLDLLEIAKDGATFLLNTPYSKEKIWDRLPKATQKQIVNKN

SEQ ID NO: 19491 - DNA, 657 bp, Unknown
  Obtained from environmental sample
  misc_feature (1)..(657): n is a, c, g, or t
gtgtacaaatgggaaaatcatctcttctccaacacaaatacacaaaactttgctgtgaaaaaatatataaaagaaacatataatatccccttagctattgacaatgatttaaattgtgcagctttggctgaacataatgctttacaagtaagttctctagcagttttttatataggaacaggttttggcagtgcctttattgataataatagattaatcaaaggtgcaaataataaaagcggagagataggacatatcccttttaaaaaatccccttttaaatgtggctgtggtagagaggactgtttagaactctatgtgagtggaaatgctattgaaaattggtgtgattattttaatatcgaatcaaaatacagaagattagatttattagaatcttttgatgactataaagcaaaaattattatagaaaatttttatcatggtttagaatatgcatttcattcaagcctaaatctctttgattttaataatttggttttaggtggaagtgttggaaaaaatgaaaatatcaaaagttttttagaagaacaattcactaaaagtgctttccaaagagaaagtttaaatattactctttcacaactacaagagggttctcttcaaggctcaaaacttctatatacaaaaaactaa

SEQ ID NO: 19492 - protein, 218 aa, Unknown
  Obtained from environmental sample
  DOMAIN (1)...(112): ROK family
  misc_feature (1)..(218): Xaa is any amino acid
MYKWENHLFSNTNTQNFAVKKYIKETYNIPLAIDNDLNCAALAEHNALQVSSLAVFYIGTGFGSAFIDNNRLIKGANNKSGEIGHIPFKKSPFKCGCGREDCLELYVSGNAIENWCDYFNIESKYRRLDLLESFDDYKAKIIIENFYHGLEYAFHSSLNLFDFNNLVLGGSVGKNENIKSFLEEQFTKSAFQRESLNITLSQLQEGSLQGSKLLYTKN

SEQ ID NO: 19493 - DNA, 375 bp, Unknown
  Obtained from environmental sample
  misc_feature (1)..(375): n is a, c, g, or t
atgattcgctctgaattcggtttatctaggctttttaatggtggaactaaagagcaagcagattacgacccaatagtaatgaaagaaactattaagaaaactctcttgaatcgagagactaaagttttggcgccgccaatcatccaacccacttcaggtgaaaagacgaaagacgatttaatagctaaattcaaaaccatcagagaacatttactcgccaatattcagacaatggataagcaagcaatctgtttgaaatatccgcacccactcttcggttatcttactaggactgattgggtttatagtagtatttatcattgccagcgtcatataatgcaagtaaatgatattttaactcaaattaataagtag

SEQ ID NO: 19494 - protein, 124 aa, Unknown
  Obtained from environmental sample
  misc_feature (1)..(124): Xaa is any amino acid
MIRSEFGLSRLFNGGTKEQADYDPIVMKETIKKTLLNRETKVLAPPIIQPTSGEKTKDDLIAKFKTIREHLLANIQTMDKQAICLKYPHPLFGYLTRTDWVYSSIYHCQRHIMQVNDILTQINK

SEQ ID NO: 19495 - DNA, 591 bp, Unknown
  Obtained from environmental sample
  misc_feature (1)..(591): n is a, c, g, or t
atgatggctcagaatctctcctttactttaaggaatttaaattccaggcattaccagatatttccagaaataatccgttgtgaaaatgactttgagatgatattaaaaataaaacagaaatctaatagagatcagattacagggttgtgttggctggataaaaaaaatgacaaatggatttggctggacaataataaaattgataactctcttatttcagcatcaacaggcggaggatcttttgttggtgttaccgattatgatccgcccattgttgttaaattaaatattattgatcaaaaaacatatattgatgaaaatttcaaagtaagcttctttcttaatgattcactttcggggataagtgatgaccgcagtattttagttcgcgttgacaacgaatggttgcttccggaatatgattatgaatcgggtaagcttgtcgctattcctcaaaagaaattaaagcaagggaaacaccatttggccattgaagttacagatagagccgggaataaatttgaacagtatctgaattttgctattatggagaaaaaagtcagaaactggaacaaacctaaggggcagtaa

SEQ ID NO: 19496 - protein, 196 aa, Unknown
  Obtained from environmental sample
  misc_feature (1)..(196): Xaa is any amino acid
MMAQNLSFTLRNLNSRHYQIFPEIIRCENDFEMILKIKQKSNRDQITGLCWLDKKNDKWIWLDNNKIDNSLISASTGGGSFVGVTDYDPPIVVKLNIIDQKTYIDENFKVSFFLNDSLSGISDDRSILVRVDNEWLLPEYDYESGKLVAIPQKKLKQGKHHLAIEVTDRAGNKFEQYLNFAIMEKKVRNWNKPKGQ

SEQ ID NO: 19497 - DNA, 726 bp, Unknown
  Obtained from environmental sample
  misc_feature (1)..(726): n is a, c, g, or t
gtggaaacgcggtatgcgggagcgagtgggcaaatggtgacggtggggtatgagtttccggagtattaccgccgacttgacagcagatgcgcattcttatggccccggatcacccttaacgacaaatacacagtttattaccctaaatacaacctttacccggctgaatgggaattgctggattcttccgcagcagatttgacctttttcattccttctgcgctttatgacgatgaaggaaaggcaaatgtggaaatgagctgtaaatgtacgcgtgggaggacgaggctgggttatgagaaggtggagttgaaacaggaaaaaaaggagaaggtgaaggtggagattgtggtggaaaagatggtgaggaaggagaaaatatctaaaacctaccccaatatgccactgaatctcaagatattgattggaggaatcatttacaaagtttctccaatttccaataagcctcctaaaaatcctcctgtttggtgttggaataaagaccttacaatgagcttggaaatattagaacaagattcaatcaatattcgagcggtaaatgaagcaaccgtcgaccatgaaatacaatactatacagcttcttttttccttccgattggtcagacaagcagcgaaaaggagaaaaggaaacttaaatttattagacaatccgaagtaatcaagaaaacctatttcctttttctgaagcctagtttcaaattttag

SEQ ID NO: 19498 - protein, 241 aa, Unknown
  Obtained from environmental sample
  misc_feature (1)..(241): Xaa is any amino acid
METRYAGASGQMVTVGYEFPEYYRRLDSRCAFLWPRITLNDKYTVYYPKYNLYPAEWELLDSSAADLTFFIPSALYDDEGKANVEMSCKCTRGRTRLGYEKVELKQEKKEKVKVEIVVEKMVRKEKISKTYPNMPLNLKILIGGIIYKVSPISNKPPKNPPVWCWNKDLTMSLEILEQDSINIRAVNEATVDHEIQYYTASFFLPIGQTSSEKEKRKLKFIRQSEVIKKTYFLFLKPSFKF

SEQ ID NO: 19499 - DNA, 462 bp, Unknown
  Obtained from environmental sample
  misc_feature (1)..(462): n is a, c, g, or t
atgtcaaaagatttacaagatataatttacaataacgaacgagaagttcaacaattggtaaatgaatataaaagaatcgaaaatgaggttctagctaaattaaacacgattggaaaagaattagataaattcaatccagttgtagattctggaattgaaataagtaaaagcggattatttaattgggaaggttatagagtttataaatattccgtttcaaaaaacgagaataaaatttgggtgcagtttgtaaaagaagaaatacatttatactcaaattactatttacaagaagggacagattcgattattaatgaagttttaaatgatttaggaataaataaacacgttaaaatcaatcataaattaagtaaaacagaattagtaaatatctttctaagtcaagtaaagattgctaatgatagtttgaaaatttatgctgaacgaattgggattgaataa

SEQ ID NO: 19500 - protein, 153 aa, Unknown
  Obtained from environmental sample
  misc_feature (1)..(153): Xaa is any amino acid
MSKDLQDIIYNNEREVQQLVNEYKRIENEVLAKLNTIGKELDKFNPVVDSGIEISKSGLFNWEGYRVYKYSVSKNENKIWVQFVKEEIHLYSNYYLQEGTDSIINEVLNDLGINKHVKINHKLSKTELVNIFLSQVKIANDSLKIYAERIGIE

SEQ ID NO: 19501 - DNA, 441 bp, Unknown
  Obtained from environmental sample
  misc_feature (1)..(441): n is a, c, g, or t
atgagtgattcccctaaaaaaataattggcagattagaatatattgatttaccagaatggcgagttcaagatattgaagcaaaaattgatacgggagcgtattcatctagtttacactgccatcaaattgaattacttaagaaaaacagtgtagatatagttcgatttaatttacttgacccagatcaccccgcgtataatgagaaactttttgaattgcctgttcacgatgtaagagaagtaaagagctctaatggactctcagagaaaagagtctttataaaaacaacactcttaatgtttaataaaatttataaaattgaactttctcttgcagatcgctcagaaatgaaatatccgctacttattggtagaaaatttatcaataaaaaatttcttgtagatgtttccaaaactaatctgtctaataaaaaaatatga

SEQ ID NO: 19502 - protein, 146 aa, Unknown
  Obtained from environmental sample
  DOMAIN (8)...(145): Protein of unknown function (DUF785)
  misc_feature (1)..(146): Xaa is any amino acid
MSDSPKKIIGRLEYIDLPEWRVQDIEAKIDTGAYSSSLHCHQIELLKKNSVDIVRFNLLDPDHPAYNEKLFELPVHDVREVKSSNGLSEKRVFIKTTLLMFNKIYKIELSLADRSEMKYPLLIGRKFINKKFLVDVSKTNLSNKKI

SEQ ID NO: 19503 - DNA, 345 bp, Unknown
  Obtained from environmental sample
  misc_feature (1)..(345): n is a, c, g, or t
gtgactagcataacatctccaactctagtattaaacgagtccattattagtgctaacattaaattaatgaaagaaaaaacagcaagagttggtattgaattcagaccccattttaaaacacatcaatcaaaatatgtttctgaatcatttaagctgcaaggagttactggtattaccgtatcttcaattaagatggctgaatactttgctgaacatggctggaatgatatcactatagcatttccaattaatatacttgagatagataaactaaataagctaacctcgcatattaagcttaatgttctagttgtagatcaagaagtagtttcatacttaggataa

SEQ ID NO: 19504 - protein, 114 aa, Unknown
  Obtained from environmental sample
  misc_feature (1)..(114): Xaa is any amino acid
MTSITSPTLVLNESIISANIKLMKEKTARVGIEFRPHFKTHQSKYVSESFKLQGVTGITVSSIKMAEYFAEHGWNDITIAFPINILEIDKLNKLTSHIKLNVLVVDQEVVSYLG

SEQ ID NO: 19505 - DNA, 495 bp, Unknown
  Obtained from environmental sample
  misc_feature (1)..(495): n is a, c, g, or t
ttggggtatttgaaacggggggaaatggttagtggttgtttaaaacgaaattaccttattgggatgaaaatgaaacctnccaatttggaaaagcgcaaaatttctcctctcaaaaccatcagcatcaacgctactcttgctgagataaaagcaatatttattaagcctgataatgtgcttcaatttcaatctattttggaaaaaggactgccgttgaaatctgattggagaaataccactaatgttaattaccattatcctaaagccggaaaaataacctcctcttatgctgatgatttatttggaaactattacattcaaaacgattacgacaaccattatttcactgagaagtttttggtgttgggaaatgaagaaaccaatgtgaccgaactaaaaataatgtgtggtccttttgtggaagattttgaagctcaaaagcaattgttggacaattgggcgaagcaattaaaagcattgagcgaaaaaggttaa

SEQ ID NO: 19506 - protein, 164 aa, Unknown
  Obtained from environmental sample
  misc_feature (1)..(164): Xaa is any amino acid
MGYLKRGEMVSGCLKRNYLIGMKMKPXNLEKRKISPLKTISINATLAEIKAIFIKPDNVLQFQSILEKGLPLKSDWRNTTNVNYHYPKAGKITSSYADDLFGNYYIQNDYDNHYFTEKFLVLGNEETNVTELKIMCGPFVEDFEAQKQLLDNWAKQLKALSEKG

SEQ ID NO: 19507 - DNA, 459 bp, Unknown
  Obtained from environmental sample
  misc_feature (1)..(459): n is a, c, g, or t
ttgattgtttatgtgttttactttacagtgatcgaaaatgaacaaccaaaggtaaaggcaacaaccggatgggaaatttggatcattttactcattttagttgcagtaggtggatggatgctattcttaatcaaaaagaaacgtcgcccaaagcagagcggggatgtcgtaaatattggcctatttcagtttgatcaaaaaggcatgcgattgaacctaaaagcccaatccattgagttgtcgagtaaagaaactgatttgctctacttactgttcaccaacgaaaacaaaaccttggaacgtgaatacatcctcaatgtagtgtggggagacgaaggcgattatgtgggcagaacattggatgtgtttatctctaagctgcgtaagaaattggaagccgactccaatgtgaagattatcaatgttagaggagtcggctaccgttttgtagtcagttag

SEQ ID NO: 19508 - protein, 152 aa, Unknown
  Obtained from environmental sample
  DOMAIN (75)...(149): Transcriptional regulatory protein, C terminal
  misc_feature (1)..(152): Xaa is any amino acid
MIVYVFYFTVIENEQPKVKATTGWEIWIILLILVAVGGWMLFLIKKKRRPKQSGDVVNIGLFQFDQKGMRLNLKAQSIELSSKETDLLYLLFTNENKTLEREYILNVVWGDEGDYVGRTLDVFISKLRKKLEADSNVKIINVRGVGYRFVVS

SEQ ID NO: 19509 - DNA, 867 bp, Unknown
  Obtained from environmental sample
  misc_feature (1)..(867): n is a, c, g, or t
atgaaattatatcctttaaaatttacaccaatccttaaagacaaaatctggggtggagagaaactcggatctgtactagataaaccaattggtgattctaagaaatgtggagaatcatgggagatttcaggagtagaagaaaatatttctatagtatcagaaggcgaattaaagggaaataacctcattgaactgattgatgagttcaaaggggaattgatcggcgaaactgtttataaaagattcggtactaaatttcctttacttattaagtttattgatgcgaatgatgatctaagtattcaagtacaccccgatgatgagttagctatgaagcgccacaattcgtttggaaaaacagaaatgtggtatgtggttgatgctgaaaaagacgcgactttaatttcagggtttaacaaaccaactagtaaagaagaatatctggaagcttttggagaaggaaatctaactgatattcttaaccaagaagatgttgataatgatgatgtcttctttttgccttcagggagagttcacaccattgggaaaggacttctgatagcagaaatacaacaaacttctgatatcacgtacagaatctatgactttgatcgcgtagacgctgatggaaacaggagagagcttcatgttgaagaagcggtcgatgctattgattataattgttacaacgagtacaaaacgatttatgatcgatcttcgagcgatacggaaattggaaatagtgaatattttataacccatcgacttttagtaaatgatccgatagagagagattattcaaagtttgattcgtgcatcattttaatgtgttggaaggggaaggttgctcactcgagccgatcctga

SEQ ID NO: 19510 - protein, 288 aa, Unknown
  Obtained from environmental sample
  DOMAIN (6)...(287): Phosphomannose isomerase type I
  misc_feature (1)..(288): Xaa is any amino acid
MKLYPLKFTPILKDKIWGGEKLGSVLDKPIGDSKKCGESWEISGVEENISIVSEGELKGNNLIELIDEFKGELIGETVYKRFGTKFPLLIKFIDANDDLSIQVHPDDELAMKRHNSFGKTEMWYVVDAEKDATLISGFNKPTSKEEYLEAFGEGNLTDILNQEDVDNDDVFFLPSGRVHTIGKGLLIAEIQQTSDITYRIYDFDRVDADGNRRELHVEEAVDAIDYNCYNEYKTIYDRSSSDTEIGNSEYFITHRLLVNDPIERDYSKFDSCIILMCWKGKVAHSSRS

SEQ ID NO: 19511 - DNA, 537 bp, Unknown
  Obtained from environmental sample
  misc_feature (1)..(537): n is a, c, g, or t
ttggaaaaacatactcccggaaacgtaaagggaattgctgatttagaaagtaaatgtgtagaactaggcgggatattggctgattttaatgaaggtgaaattggacctggtcactgtgacggtggggaagaagaggaagaagaagaagaagaagaagaagaggacgaagaagaggacgaagccgaaatacaacctgttgatgaggaacttgtaaaagttaaaatgtttcccaacccagccagcacgtacagtaaaattgcatttacaccaaaacaaaatggtaatactcgagttgaaatgtataatatgaatgggcaaaaagttgcagtattatataataaaaaaacacagagaaatgtgccaattacaattgaatataatactgatagatttaagaaagggttatattttgtaattattagaaacggcagcgatgttttcaaagaaaaaatatctatttttaaattaattccctcctttaacatactaattaatagagattgcctatttggcaatctcttttttttggtagtataa

SEQ ID NO: 19512 - protein, 178 aa, Unknown
  Obtained from environmental sample
  misc_feature (1)..(178): Xaa is any amino acid
MEKHTPGNVKGIADLESKCVELGGILADFNEGEIGPGHCDGGEEEEEEEEEEEEDEEEDEAEIQPVDEELVKVKMFPNPASTYSKIAFTPKQNGNTRVEMYNMNGQKVAVLYNKKTQRNVPITIEYNTDRFKKGLYFVIIRNGSDVFKEKISIFKLIPSFNILINRDCLFGNLFFLVV

SEQ ID NO: 19513 - DNA, 339 bp, Unknown
  Obtained from environmental sample
  misc_feature (1)..(339): n is a, c, g, or t
ttgctttttctatcttgggtcttaacttttcgcataaacctagtaatattaaacaccacctcattaaatatgaaagaaataaaatatgaaaatagaatagttgcttatatagatatcttgggttttaaagatattgtaaatgaatcagtgaacgatttatcgaaactctcactgatacacgatattttgacatttttaaaaacgaaagagagtccggatgaatggagtcttaaactaattgaaatcgaagaagacgctcaaaaaaagggtgttgaaaaatttgatgtatcaaaaaacattgcatgtacatgcttttcggatacgctcgagccgatctga

SEQ ID NO: 19514 - protein, 112 aa, Unknown
  Obtained from environmental sample
  misc_feature (1)..(112): Xaa is any amino acid
MLFLSWVLTFRINLVILNTTSLNMKEIKYENRIVAYIDILGFKDIVNESVNDLSKLSLIHDILTFLKTKESPDEWSLKLIEIEEDAQKKGVEKFDVSKNIACTCFSDTLEPI

SEQ ID NO: 19515 - DNA, 834 bp, Unknown
  Obtained from environmental sample
  misc_feature (1)..(834): n is a, c, g, or t
atgatattccagatgctgtacgcaggttgtatcaggcaggcncttttttcagatgtccaaattctgattaaagaaaaaagtggaagtgagattagcttaattattagagttaaagaacaacctaggattattgagtataaattagaaggcatcaaaagatcacaacgtagagatttaaaagacttgattgtgttgcttcctggtgttgcaataactgagtcgaataaagcccaagcaataaacactattaagcggttttatagagaaaaaggtttttggtatacagaggtcagcactagtgtagtacctgataaaaagctagacaacagagctcgtctaatctttgatattaagccaggaaaaagattagaagttaaagacttagaaattagtggaaatgaagaattttcagatagaaagctaaaaaagaaacttaaacctttaaaagaggataagtggattaaattctttagtaaaaaggttttcaaaaaagatgattttgaagaaggaaaagaaaacgttttagctttttatcgcaagaatggattttcagatgtacgtattattagcgattcggtatatgtgtacaattatgttaaagatttagaaggtattggtgtaaaactagtacttgaagaaggccctcagtataaagttagaaatgtttcttgggaaggaaatacagtatacaccgatgatcagcttagtaggtcgcttggctttgaaaaaggtgatgtttttaacgaagaaaaatatgatgctaacataactttcaataaaactagctcggatatcaattctctgtatcagaatattggctatttatttttttag

SEQ ID NO: 19516 - protein, 277 aa, Unknown
  Obtained from environmental sample
  DOMAIN (156)...(219): Surface antigen variable number repeat
  misc_feature (1)..(277): Xaa is any amino acid
MIFQMLYAGCIRQALFSDVQILIKEKSGSEISLIIRVKEQPRIIEYKLEGIKRSQRRDLKDLIVLLPGVAITESNKAQAINTIKRFYREKGFWYTEVSTSVVPDKKLDNRARLIFDIKPGKRLEVKDLEISGNEEFSDRKLKKKLKPLKEDKWIKFFSKKVFKKDDFEEGKENVLAFYRKNGFSDVRIISDSVYVYNYVKDLEGIGVKLVLEEGPQYKVRNVSWEGNTVYTDDQLSRSLGFEKGDVFNEEKYDANITFNKTSSDINSLYQNIGYLFF

SEQ ID NO: 19517 - DNA, 651 bp, Unknown
  Obtained from environmental sample
  misc_feature (1)..(651): n is a, c, g, or t
atgctttatgaagctatttcaaatcttacagaacctcatctaatgcaagaatatataaatggtaaagaatatggaatattttattatagataccccaatgaagagaacgggcacttgttttcaattacaaaaaaggagaaaatttgtgtaattggggatggaagtcacactttagagcaactcattctaaaagatcaaagggccgtttgtatggctgaaattcactttgataaacatattgatgctttatactctgtacctgctaaaggagaaaaggttcaacttgtagagctaggcacacattctagaggagccttatttttggatggaagtgaacttatttcttctgaactcacaaaaataatcgataaaataagtaagagttttgaaggcttttattttggcaggtatgacattaaagtacaaaatgaatctgatttaaaatccggacttaatgtgaaagtaatagagatcaacggagtaacatcagaatcaacaaatatctatgaccccaaaaacagctacttctttgctataaaaacattaatgaaacaatggagaattgctttcgaaattggtgctattaattatcataatggagcaactattccttctttaagtcatatgatcaatttgatattaagaaagtga

SEQ ID NO: 19518 - protein, 216 aa, Unknown
  Obtained from environmental sample
  misc_feature (1)..(216): Xaa is any amino acid
MLYEAISNLTEPHLMQEYINGKEYGIFYYRYPNEENGHLFSITKKEKICVIGDGSHTLEQLILKDQRAVCMAEIHFDKHIDALYSVPAKGEKVQLVELGTHSRGALFLDGSELISSELTKIIDKISKSFEGFYFGRYDIKVQNESDLKSGLNVKVIEINGVTSESTNIYDPKNSYFFAIKTLMKQWRIAFEIGAINYHNGATIPSLSHMINLILRK

SEQ ID NO: 19519 - DNA, 738 bp, Unknown
  Obtained from environmental sample
  misc_feature (1)..(738): n is a, c, g, or t
gtggactataatcgacttttgcttgtacgtataagcaagagagaggcgggattgctaggagagggagatgaaaaggctcaagggatattgggattttatttcaaaacaaaaagcaatgaattgactagtattaacaaaaccagatatcttctgttgttgaggtcacccatcagtcgttttattgacgatcatcacgaaactaatgagtttcgtgatttggaactcaattatatcaaaaagaaagcagcgttgcttaccggacatggcagcgacatgatgataaatctatgtaggaatggaaaagcggaatctaagccaaaattcaaaaagttgatagagacacttctgatggttcagcacctgttaatagaccaccgcggaataagtgcactgggccttgatggaagggtgaaagtaaacctcgcagagcactcgaccaatattttaaaagatgtacatttcaatttcaatgagaaaattgactctttgtacttcgataagctaaatgaaatggctacggaactttttgcttccgaatatgtagaacaacccgttcatcttaagctgaataaacctatattgaatccagaaaaatcgttttgtttttcatctgatatactgaacctgatctttttcgagctaatcgtaaatgcaaaaaagaatcgatgggtctttctcgatggtgaaaagatttctgctaatgagaatacctacgaccaaaacgaagttactaattaa

SEQ ID NO: 19520 - protein, 245 aa, Unknown
  Obtained from environmental sample
  misc_feature (1)..(245): Xaa is any amino acid
MDYNRLLLVRISKREAGLLGEGDEKAQGILGFYFKTKSNELTSINKTRYLLLLRSPISRFIDDHHETNEFRDLELNYIKKKAALLTGHGSDMMINLCRNGKAESKPKFKKLIETLLMVQHLLIDHRGISALGLDGRVKVNLAEHSTNILKDVHFNFNEKIDSLYFDKLNEMATELFASEYVEQPVHLKLNKPILNPEKSFCFSSDILNLIFFELIVNAKKNRWVFLDGEKISANENTYDQNEVTN

SEQ ID NO: 19521 - DNA, 321 bp, Unknown
  Obtained from environmental sample
  misc_feature (1)..(321): n is a, c, g, or t
gtgccgcagttcatccagaatcccatctgcaaaaaactcaagccagtcagaaaaatctatatcttccaccaaatcataatagtctccttccagcccaacagttttaaaataacgtgtaatattacggttgtaataattttcaaaactgaatatctcanagaagtccagaccggtttctccaaggattgcggtagtgagaaggcgtgtagttcggccattgccgtcaatgaaagggtgaataatcacgcattgccggtggaatatgcccgccagggtaaacgaatcaatttttcctgtattgtcattaatgaactgcagtaa

SEQ ID NO: 19522 - protein, 106 aa, Unknown
  Obtained from environmental sample
  misc_feature (1)..(106): Xaa is any amino acid
MPQFIQNPICKKLKPVRKIYIFHQIIIVSFQPNSFKITCNITVVIIFKTEYLXEVQTGFSKDCGSEKACSSAIAVNERVNNHALPVEYARQGKRINFSCIVINELQ

SEQ ID NO: 19523 - DNA, 969 bp, Unknown
  Obtained from environmental sample
  misc_feature (1)..(969): n is a, c, g, or t
ttggttccaacaaatcaattactcagacctgcagggtttcaaatacaatttcacggaagacctgttgatctggcattaagtccggatggaaaatggatggcggttctcaataaaaattatctggaattaatacatgtaaatgataggacgatttttcaaagattggagattaaaaaaggaggatcctacattggagtgactttttcagaagatggaagaaagatctatgtgagccagtcaagaaatcatatttttatagcagaaatgaatgacaacaatattttaaactggatagatgaaataaaatttcctgaagctaaagttggaggacatccagttcctggaggaattgttttagataaaaaggatgacaaactttacactactttaaatagaagtaattctttggcaatagtacagttatccgataaatcgataaaagaaatacctgtaggtattgctccatatgaattagtacttttctcttcgaaaaaagcttatgtgagcaattggggtggcagaattccaaaaaagggtgagataacttataaaacttctggtagtgatattctagttgatcaaaaaacgggtattgccaaaagcggaaccgtatcagttgttgacctttctaaaggaatggaaattaaaagtattgaagtaggattgcatccgggtgatatggttctaagtccagataaaaaacagctttatgttacctgtgctaatagcgatatagtttctgtaattgatacggaaacagataaagttgtaaaagaaatatcagttcatttcactcagggattgccatttggaagtgctcccnatgcattggaaatatcaaaagatgggaaaatactatatatagcctatgggacagaaaatgctgtttgtgtaatagatttgaaaaatgacaataaattacttggttttaatcccaccaggctggtaccccagggctggttcttttag

SEQ ID NO: 19524 - protein, 322 aa, Unknown
  Obtained from environmental sample
  misc_feature (1)..(322): Xaa is any amino acid
MVPTNQLLRPAGFQIQFHGRPVDLALSPDGKWMAVLNKNYLELIHVNDRTIFQRLEIKKGGSYIGVTFSEDGRKIYVSQSRNHIFIAEMNDNNILNWIDEIKFPEAKVGGHPVPGGIVLDKKDDKLYTTLNRSNSLAIVQLSDKSIKEIPVGIAPYELVLFSSKKAYVSNWGGRIPKKGEITYKTSGSDILVDQKTGIAKSGTVSVVDLSKGMEIKSIEVGLHPGDMVLSPDKKQLYVTCANSDIVSVIDTETDKVVKEISVHFTQGLPFGSAPXALEISKDGKILYIAYGTENAVCVIDLKNDNKLLGFNPTRLVPQGWFF

SEQ ID NO: 19525 - DNA, 498 bp, Unknown
  Obtained from environmental sample
  misc_feature (1)..(498): n is a, c, g, or t
atgaaaattctaaagagagtcttactactacttatttctattgttttaatactaatcgtctataattatccgaagttaaacatcattgctggatatgctgcaaaaaacatgaattcatctgtgtttttagccgggcgaacactgcaatttacagacagcaccgacaatcatttttctccaataaacttagcttctgataaaattaatgaatcagaaaaaacagcaagctcttctgtttttgggttgttaaccagaatagcaatttatagagaaggcttaggaagtgttttaattacggatgattttgatacaacaaaaaaagtacaaactcctaaaagaacaaaaccagataatttaactgcgtttccgtttggaaatgccgaacaaaaagattcggttttaacaaatgtaaattacaataaactaaacgaaactgtcggaaatctatttacaaaccatacgcaaacgagagctgtggtagtgattcataaaaactaa

SEQ ID NO: 19526 - protein, 165 aa, Unknown
  Obtained from environmental sample
  misc_feature (1)..(165): Xaa is any amino acid
MKILKRVLLLLISIVLILIVYNYPKLNIIAGYAAKNMNSSVFLAGRTLQFTDSTDNHFSPINLASDKINESEKTASSSVFGLLTRIAIYREGLGSVLITDDFDTTKKVQTPKRTKPDNLTAFPFGNAEQKDSVLTNVNYNKLNETVGNLFTNHTQTRAVVVIHKN

SEQ ID NO: 19527 - DNA, 756 bp, Unknown
  Obtained from environmental sample
  misc_feature (1)..(756): n is a, c, g, or t
atgaaaaaaatattattacttttaccattaattagcattctgtcatatgcaaaagttaatcaaaaaactgtagaaaactttatcgttaatactgccaaaaataataacttaaatgagcaatctattcgaacaattatctcacaagctaaacgtcaacaaagcattattgatgccatgaatcgacctgcagaaaagaaaaaacaatggcatgaatacagaaatattttcctcaaacaaaaacgcattgatggtggagttgaattttggaataagcaccaagctactttagaaaaagtcagtaaagactctggtgtgccaattgaaattattgtcgccattattggtgttgaaaccaattatggaggcaacatgggcagttatcgtgttattgatgctttatacacattggcttttgactacccaaaaagatcaccattttttaccaaagaattagaaaaatttttagttttaactgaaaaagaaaaaatctctgccactgaaacaaaaggctcttatgctggtgccatgggatatggtcaatttatgcccagttcctatctcatgtattctttagattatgacaacgatggcagccgtgatttattggataatattgatgatgccatcgcctcagttgccaattattttaaagcccatggttggaaaaaagatgaagttgttgtaattcaagctcaaacagataagaattttaaaaagctaaaaaaacaagaactcaaaccatcactgacgggttaa

SEQ ID NO: 19528 - protein, 251 aa, Unknown
  Obtained from environmental sample
  SIGNAL (1)...(17)
  misc_feature (1)..(251): Xaa is any amino acid
MKKILLLLPLISILSYAKVNQKTVENFIVNTAKNNNLNEQSIRTIISQAKRQQSIIDAMNRPAEKKKQWHEYRNIFLKQKRIDGGVEFWNKHQATLEKVSKDSGVPIEIIVAIIGVETNYGGNMGSYRVIDALYTLAFDYPKRSPFFTKELEKFLVLTEKEKISATETKGSYAGAMGYGQFMPSSYLMYSLDYDNDGSRDLLDNIDDAIASVANYFKAHGWKKDEVVVIQAQTDKNFKKLKKQELKPSLTG

SEQ ID NO: 19529 - DNA, 843 bp, Unknown
  Obtained from environmental sample
  misc_feature (1)..(843): n is a, c, g, or t
ttggtatctaaatacaaagcatcccttgatagacaattcaaaattatagactatctagtacatcaaaatatagaaaaactagtatgtttatcaagtgtagatggatgtagaatagcatttggtataggaatacctatagtaaacttttatgacataccactttctgaccataaggaaaatttcaaaaaagctatacctcaagcaaggttaacaataccaatagcaactaaaatgtttaaaccctttgtagtaccaaatgatgttattagaagatttggtcttgatgaggaacaaatctttgactataattttattgatcctcttatttggttaaataactttaagtatgatgaggattatgtgaaagaatctttagcttcttataatattaattatacaaaaaaaacaattgtaataagagaagaagagtataagtcaagttatgtagataagaaataccctttcctttatgaagctttagaggagcttcataatacacttaatgcgaatataattattatcccaagatatgaaagtgcttatctaaaaaaagagtttccttttgcaattattttagaagagaaaataaaaatacaacacctgttaaaatatgcagacctttttattggtggtggaggtactcttaatacggaagcttgtttcttagggacacctactatctctacgagaagttttatttgtcactatgacaaatggcaaatagataatgaacttatggtttgggtacaaaataaaattgaattactagagaaagcccaaatattactcagtaaaaaaatagatgtagatattttaaaaacaatgtcagtagatgtagattaa

SEQ ID NO: 19530 - protein, 280 aa, Unknown
  Obtained from environmental sample
  DOMAIN (9)...(278): Protein of unknown function (DUF354)
  misc_feature (1)..(280): Xaa is any amino acid
MVSKYKASLDRQFKIIDYLVHQNIEKLVCLSSVDGCRIAFGIGIPIVNFYDIPLSDHKENFKKAIPQARLTIPIATKMFKPFVVPNDVIRRFGLDEEQIFDYNFIDPLIWLNNFKYDEDYVKESLASYNINYTKKTIVIREEEYKSSYVDKKYPFLYEALEELHNTLNANIIIIPRYESAYLKKEFPFAIILEEKIKIQHLLKYADLFIGGGGTLNTEACFLGTPTISTRSFICHYDKWQIDNELMVWVQNKIELLEKAQILLSKKIDVDILKTMSVDVD

SEQ ID NO: 19531 - DNA, 510 bp, Unknown
  Obtained from environmental sample
  misc_feature (1)..(510): n is a, c, g, or t
atgaaaaaagtatttgtatatggagattttaatattcttcatcctggacatctaagactactgaaatttgcaaaagagagtggagattatttaatagtaggtttaaatagtgataaaataaattataaaggaataagccaagatattagacttgagtcaattcaggctacaagttatgtagatgaatcatttattttggatgagccatcgttggattatatttctaagtataagccagatattgtagttaaaggaaaagaacatgaaaataaagataatccagaactcgaaatcatcaataattatgggggaaagttactttttagttcgggagagattgcattttcatcaattgatcttttaaaagaggagtttttaaatacgaactacaaagtaaatcacaatcaaaagtatttcaatagacataattttgatttgatagatctaaaaagaatcgtagaaaaatttgcaaaactccatgttttgattatagggggatactattgttga

SEQ ID NO: 19532 - protein, 169 aa, Unknown
  Obtained from environmental sample
  DOMAIN (5)...(123): Cytidylyltransferase
  misc_feature (1)..(169): Xaa is any amino acid
MKKVFVYGDFNILHPGHLRLLKFAKESGDYLIVGLNSDKINYKGISQDIRLESIQATSYVDESFILDEPSLDYISKYKPDIVVKGKEHENKDNPELEIINNYGGKLLFSSGEIAFSSIDLLKEEFLNTNYKVNHNQKYFNRHNFDLIDLKRIVEKFAKLHVLIIGGYYC

SEQ ID NO: 19533 - DNA, 336 bp, Unknown
  Obtained from environmental sample
  misc_feature (1)..(336): n is a, c, g, or t
gtgttatcaaataaaataacactaaaatcaagtacagatagaacgtcaaagttttttaataatttaggtgtgattaaaatagatgttaagaaaaaggataatgaaacctttgtcaaagtgaattcagggaaaactttttattttaatggaaaatcaattaacttatctaattattccgttaaagttagcaagaaaaaggtttctcttgttgaagatgataaatataaaattgcattaaagaataataaagcatatttaattacaccaaattataaaggtttttatgaaaatgcagatttaaaaacacttcaaaataagaaaacatttatttgctaa

SEQ ID NO: 19534 - protein, 111 aa, Unknown
  Obtained from environmental sample
  misc_feature (1)..(111): Xaa is any amino acid
MLSNKITLKSSTDRTSKFFNNLGVIKIDVKKKDNETFVKVNSGKTFYFNGKSINLSNYSVKVSKKKVSLVEDDKYKIALKNNKAYLITPNYKGFYENADLKTLQNKKTFIC

SEQ ID NO: 19535 - DNA, 837 bp, Unknown
  Obtained from environmental sample
  misc_feature (1)..(837): n is a, c, g, or t
atgaagtctattaaaaaattatttatttttatttttctaataattttagttgtttatttaattccaacttctccttctgatttttttcaggcctaccaaaaaaatgataaagcatctcaaagtttaaaaaagtttcaattaaaaacaaccagtaaaatcactattgatggtgttagttgggaatattacgctggaggaaaagggagcaaaactattctttttttacatggcatgggtgggtcttatgatttatggtggcaacaaataagtgctttcgaaaaggattacaaagtgattacttataccctacccgaacaaataaactcactcgaaaagacttccaaaggaattcttgaaattttaaaccaagaaaaagtaaataaattttatgtagttggcacctccatgggtggatatattacacaatatttagtgaccctaattccaaaccgaattgaaaaagcagtttttggtaatacttttccgccaaatgatcttatcctaaaagaaaacctaagtaaaagtaaaataattccattattacctgaaattttattctcaaaattaggagaaaaaaaattaaataatgagattattccatctgctaaaaattctgaattattaaaagcatttttaactagcctaccttctaataaaaaattatttataaatagatatagtgttgttattgataaatttactgctacacccgataaatacgaaacaaaaaggattcctaaattaattattgaatcggataacgaccctttaatacaacctgaattaagaaaaaaaataaaagacctttatcctgatgcggaagtattactttcataa

SEQ ID NO: 19536 - protein, 278 aa, Unknown
  Obtained from environmental sample
  SIGNAL (1)...(20)
  misc_feature (1)..(278): Xaa is any amino acid
MKSIKKLFIFIFLIILVVYLIPTSPSDFFQAYQKNDKASQSLKKFQLKTTSKITIDGVSWEYYAGGKGSKTILFLHGMGGSYDLWWQQISAFEKDYKVITYTLPEQINSLEKTSKGILEILNQEKVNKFYVVGTSMGGYITQYLVTLIPNRIEKAVFGNTFPPNDLILKENLSKSKIIPLLPEILFSKLGEKKLNNEIIPSAKNSELLKAFLTSLPSNKKLFINRYSVVIDKFTATPDKYETKRIPKLIIESDNDPLIQPELRKKIKDLYPDAEVLLS

SEQ ID NO: 19537 - DNA, 399 bp, Unknown
  Obtained from environmental sample
  misc_feature (1)..(399): n is a, c, g, or t
atggtaatggcagtagtagtattatttgtgtcttgtgaacaatatgattcagaattccatattccaagtgtagaaaatgacaccacaaatattaattttaaaaatcaaaaaaatcaagatattgagtttacagttaaagagcatattaaattggtcaagcagttgtctaatttgtataaaaagcaagataaacatatctatcacctgaaagatttggggcaaaaaaactataagaacaaaaaacaatttaaagatttcttgaaaaagaaccagtttaaaaatgttgataagattgttattctttcagaaagaatcagtaataatattagtaattatttgtcaacaaataatttacataaaaagacagatgaacaagaagcggtaactataatttactaa

SEQ ID NO: 19538 - protein, 132 aa, Unknown
  Obtained from environmental sample
  misc_feature (1)..(132): Xaa is any amino acid
MVMAVVVLFVSCEQYDSEFHIPSVENDTTNINFKNQKNQDIEFTVKEHIKLVKQLSNLYKKQDKHIYHLKDLGQKNYKNKKQFKDFLKKNQFKNVDKIVILSERISNNISNYLSTNNLHKKTDEQEAVTIIY

SEQ ID NO: 19539 - DNA, 612 bp, Unknown
  Obtained from environmental sample
  misc_feature (1)..(612): n is a, c, g, or t
atgaatagttccctgatcttcggaatcggtcaaaagcagattgaagttgaatcagctaaaatagctcagaatgtagtaggggatgatatttctgttcgtcaagagaagaaacgagacaaggtaaataactacgcagttgaaaacccttggtataggagcattgttaaagatattgacctttcaagtgttccttacaacgcttcagaggatgaaatagaaaaccgtttaatgaaagaaaagattaaacaggattcaaaaatcaagactaaggtacgaaaacttctcaaagatggtagtgcaaaagatttacaggaaaatgtaacagaaatagccgatcaaatttccgtatcaagtaaaaacgatttgtgtcgctacatagctttcaggcgtcatatcttagagatgtttagcaaaagtttagagtatgatgttgatggaaagtacgaaacagaaggcgcagtacatgatataatttttccccggaagggtgatacagattccacaccatttgatgatcacaatctttggatgattgatgaacggttgagcttcactaactacgttgcttcagacataccattagatggcgggaatacggagcgaccagattaa

SEQ ID NO: 19540 - protein, 203 aa, Unknown
  Obtained from environmental sample
  misc_feature (1)..(203): Xaa is any amino acid
MNSSLIFGIGQKQIEVESAKIAQNVVGDDISVRQEKKRDKVNNYAVENPWYRSIVKDIDLSSVPYNASEDEIENRLMKEKIKQDSKIKTKVRKLLKDGSAKDLQENVTEIADQISVSSKNDLCRYIAFRRHILEMFSKSLEYDVDGKYETEGAVHDIIFPRKGDTDSTPFDDHNLWMIDERLSFTNYVASDIPLDGGNTERPD

SEQ ID NO: 19541 - DNA, 441 bp, Unknown
  Obtained from environmental sample
  misc_feature (1)..(441): n is a, c, g, or t
ttgaatcgacaaattttcattggcgtcattagcacaatggaagctttcctttctgatgcatttatcaatttgacatatgacaatagcacatattttcgtaattttgttgagacgcatcctgaatttaagaaacggaaatttgaactaaaagatatattttatgaatcagaaaatatcaaagaaactgcaaagataatcatgcttgatacaatttatcataatttacctacagtcaaacaaatgtatcaagatacttttaaaatacaaattccaagcataaagaaagtatatgagtatgtccgtatgcgtcatgatttagtccatagaaatggaaaaaccaaagaaggtagccaagtaaacacggatgatgcaacaattgctagcttgatacatgaaatcaatgttttcattcatgaaattattaatgaattaaatatataa

SEQ ID NO: 19542 - protein, 146 aa, Unknown
  Obtained from environmental sample
  misc_feature (1)..(146): Xaa is any amino acid
MNRQIFIGVISTMEAFLSDAFINLTYDNSTYFRNFVETHPEFKKRKFELKDIFYESENIKETAKIIMLDTIYHNLPTVKQMYQDTFKIQIPSIKKVYEYVRMRHDLVHRNGKTKEGSQVNTDDATIASLIHEINVFIHEIINELNI

SEQ ID NO: 19543 - DNA, 498 bp, Unknown
  Obtained from environmental sample
  misc_feature (1)..(498): n is a, c, g, or t
atgacggacattttattcttactaaaggtgcctccaccggttcatggctctactatgatgaataaaatagtagctgattctaaggagattggtagtgcctattcaaaagcttaccatcttgaaagtatttctaagaatgttgacgatataggtaaggtctcgtttagaaaattatctttgattataggaaactacaattctttatttaagaatcttagaaggtacagaccaaaattagtatactttgcgatatctccaaaaggactagcattttataaagactttataagtatccttattgtgaaaatgtttggctccaaaattgtctatcattttcatgtgaaaggtcttaatcaggaagcagataaatcttttattaggtcatttttatacaagttttcatttaaaaaccaatttggtatagtattatcggagtctttaaagagtgagtataaaccaatgggctttaagaagctttttattgtcccaaatggatga

SEQ ID NO: 19544 - protein, 165 aa, Unknown
  Obtained from environmental sample
  misc_feature (1)..(165): Xaa is any amino acid
MTDILFLLKVPPPVHGSTMMNKIVADSKEIGSAYSKAYHLESISKNVDDIGKVSFRKLSLIIGNYNSLFKNLRRYRPKLVYFAISPKGLAFYKDFISILIVKMFGSKIVYHFHVKGLNQEADKSFIRSFLYKFSFKNQFGIVLSESLKSEYKPMGFKKLFIVPNG

SEQ ID NO: 19545 - DNA, 972 bp, Unknown
  Obtained from environmental sample
  misc_feature (1)..(972): n is a, c, g, or t
ttggaaaaaaagaaatttacgcagtttggggaatctcatggacctggatcgacttttaattggcaaggtttaatggctgctttagaagataaagtaatagatacatctacagttgttgatacagaaatggaatttttaatgctgcacggaagtaaaatagaagattctcatcgtggaggtttcggaaaaatatctgctgctagagttcttgaggtttcatctaatgtcggaatcgtaaagctgattagaaaatattacgatgagactcctatgaaatttatcaacaaaatgagatcatttggtttagataaaaaactaggattacaaattcaaggagaaggaacaccatttattccgtatccaggaaatacaagaaatccttggaataaaatttctttagaatggatggcttggggatacggtgtttctcttacacctttacaaatgttaacattttacaatgctgttgcaaacaatggcgaaatggtaaagccacggtttatcaaagaattgcgagtacaaaataaaacggagaaagtctttaaaaaggtaattataaaagaaaaaattgcgagtcaagaaacgataaataaagttagaaaagtattggaaaatgttgtgataaaaggaacagcagaacatatttattctccaaatttttctatggctggtaaaaccggaactgcaaaaaaatgggtagatacttatactgataaagaaggaaaaaggataaaaggccattattctagtcaattatatgttgcttcatttgcaggtttttttcctgcggataaccctaaatattcttgcattgttgtaattcacgaacccaacaaaaagaaaggatattacggagcaattgttgccgctccagtttttaaagaaatcgctcaaaaaatatatacaactacgccaattaatgtgcaacaagtaactgatcaaccaacaatactggatactcagccaatctga

SEQ ID NO: 19546 - protein, 323 aa, Unknown
  Obtained from environmental sample
  DOMAIN (1)...(298): Penicillin binding protein transpeptidase domain
  misc_feature (1)..(323): Xaa is any amino acid
MEKKKFTQFGESHGPGSTFNWQGLMAALEDKVIDTSTVVDTEMEFLMLHGSKIEDSHRGGFGKISAARVLEVSSNVGIVKLIRKYYDETPMKFINKMRSFGLDKKLGLQIQGEGTPFIPYPGNTRNPWNKISLEWMAWGYGVSLTPLQMLTFYNAVANNGEMVKPRFIKELRVQNKTEKVFKKVIIKEKIASQETINKVRKVLENVVIKGTAEHIYSPNFSMAGKTGTAKKWVDTYTDKEGKRIKGHYSSQLYVASFAGFFPADNPKYSCIVVIHEPNKKKGYYGAIVAAPVFKEIAQKIYTTTPINVQQVTDQPTILDTQPI

SEQ ID NO: 19547 - DNA, 999 bp, Unknown
  Obtained from environmental sample
  misc_feature (1)..(999): n is a, c, g, or t
ttgtttaccgggccgttgtatttcttatataaaattatttctacaatcaatttggcagaagcattacaagaacaatttcctgcggatcattttgtgcccatttattggatggcaacagaagatcatgattttgatgaaatcaattattttaatttcaacaataaaaaaatccaatggaaaagaaatgatggtggcgccgttggtcatttttctactgatggattgaaagaagtttttgagcaattttcagcagcattaggaaccactagaaatgctgattttttaagagatttattttcaaaaggatatttagagcacaatactttaacggaagctacacgttatattgccaatcaattattcgcaaaatatggtttggtaattgttgatggagacgatccgcaattaaagcaattatttgctccatttgttgcgcaagaactacaaaatcaagtttcttataaggccgttacaaacacgataaaagaattagaaaaaaactataaagtacaagtaaatcctagagaaatcaacttgttttatttgagtgaagattctagagaacgcattgtttttgaaaacggaatttacaaagtaaacaatacaaaaatcactttttctaaagaagaaattctagaagaactaaaagaaaaaccacaattattttctccaaatgtcatcatgcgacctttatatcaggaagttattttgccaaatctagcgtatattggtggaggtggagaattggcgtattggttacaattaaaagagtattttaatactgtttctgttccttttccggttttagtgttgcgaaattctgttcaagtgatttctagtaaacaacagaaaaaaatagataatttaagtatttcaacagtagaaattgtttttaagaaagaggattttatgaaggttgaaaatcatgtaaactcagacatcgaatttaatttttttaaatgcaaaaccctggttagaccaacggttttatattgttag

SEQ ID NO: 19548 - protein, 332 aa, Unknown
  Obtained from environmental sample
  misc_feature (1)..(332): Xaa is any amino acid
MFTGPLYFLYKIISTINLAEALQEQFPADHFVPIYWMATEDHDFDEINYFNFNNKKIQWKRNDGGAVGHFSTDGLKEVFEQFSAALGTTRNADFLRDLFSKGYLEHNTLTEATRYIANQLFAKYGLVIVDGDDPQLKQLFAPFVAQELQNQVSYKAVTNTIKELEKNYKVQVNPREINLFYLSEDSRERIVFENGIYKVNNTKITFSKEEILEELKEKPQLFSPNVIMRPLYQEVILPNLAYIGGGGELAYWLQLKEYFNTVSVPFPVLVLRNSVQVISSKQQKKIDNLSISTVEIVFKKEDFMKVENHVNSDIEFNFFKCKTLVRPTVLYC

SEQ ID NO: 19549 - DNA, 816 bp, Unknown
  Obtained from environmental sample
  misc_feature (1)..(816): n is a, c, g, or t
atgtcaacttcgtatgagtttgataatgtggatgtaaagcgatatccgcgttattttaatacgccaaatcaagaaatgttatgcaagaaaattgcagctttagaaaaaactgagaacgctttgattttcggatctggaatggcagctgttagtacaactttgttggcttttttacacaaaggagatcatattgttttgcaacaaaccttgtatggcggaacgtataattttgtggtagaagaatttgataaattcggaattgaatattcgtttacaaaggatttatccatcgaatcttttcaaaaagaaatcaaagaaaacaccaaagtgttgtacatagaaactccatctaacccgttgttaaccattacagacatgcaattggttgcagatttagcaaagaaaaatgacattgtaacaatgattgacaatacgtttgcatcgccaataaatcaaactccaattgatttcggaattgatattatgctgcattctgcaacaaaatatatgggcgggcattcagatattttggcaggcgcagttgctgcatcaaatgaacatattgataaaatttggaacatcgcaaaaaacttaggcggaagtttgagtgattttaccgtttggatgttagagcgtagtttaaaaacgatgagtctacgtgtaaaacgtcaaagtaaaaatgcgttgaaaatggccaaatatttagctacaaataaaaatgtatctagagtttattatccaggattaaaagggcatccaaattataaattggcaaaaaaaacaatgaaaaaattttggagggatgttgtcttttga

SEQ ID NO: 19550 - protein, 271 aa, Unknown
  Obtained from environmental sample
  DOMAIN (2)...(270): Cys/Met metabolism PLP-dependent enzyme
  misc_feature (1)..(271): Xaa is any amino acid
MSTSYEFDNVDVKRYPRYFNTPNQEMLCKKIAALEKTENALIFGSGMAAVSTTLLAFLHKGDHIVLQQTLYGGTYNFVVEEFDKFGIEYSFTKDLSIESFQKEIKENTKVLYIETPSNPLLTITDMQLVADLAKKNDIVTMIDNTFASPINQTPIDFGIDIMLHSATKYMGGHSDILAGAVAASNEHIDKIWNIAKNLGGSLSDFTVWMLERSLKTMSLRVKRQSKNALKMAKYLATNKNVSRVYYPGLKGHPNYKLAKKTMKKFWRDVVF

SEQ ID NO: 19551 - DNA, 912 bp, Unknown
  Obtained from environmental sample
  misc_feature (1)..(912): n is a, c, g, or t
ttgaaaataaaatggaattcgcttaacctgcctcattgtttagaaaaaattgtaccttcaataatcatttttgcaatattatacacgctgctcgcaaacataaaatggtattgtttctggatttttattgtgggtaaagaaattgatttgtggagttcactaacctattgggaccctattcttctaactgggttacgattaatgtctatttggattttggcatatcatttataccactattaccaaaataaaattgaaactacccagcaaaacgctgagcttttagtaattgcaaaacaagcacaacttgataatttatcagcacaattaaatccacattttttatttaattcgctaaactctataaagtctttagtgattgaaaacccaagtgttgctagaagagctattgatttattatctgatttattacgttcatcattgtacgaaaaaaacaaaggtttaattagtattaaagacgaattggctttggtaaaagattatattgaactagaaaaaatgcgttttgaagaacgattaacaattaatattactgttgataaaactttagagaagttaaaaatcccaaccctgagtatacaattattggtagaaaatgccatcaaacacggaatcgataaaattattgaaggtggtttgattacagtaaacataacaacgaaggaaaatcagctttacatagaagttaaaaatccagggaaattagctgtaaataaatcctcaaaaggagttggtttaagaaatttaaaagaacgcttagcaattcaatataaaaacaacacctcttttaacttaataaagttagatcaaaatacagttaaggctaccataattttaccaattacaggcgatgaaaacattaaaacagtaattatagatgatgaacgttag

SEQ ID NO: 19552 - protein, 303 aa, Unknown
  Obtained from environmental sample
  DOMAIN (102)...(185): Histidine kinase
  misc_feature (1)..(303): Xaa is any amino acid
MKIKWNSLNLPHCLEKIVPSIIIFAILYTLLANIKWYCFWIFIVGKEIDLWSSLTYWDPILLTGLRLMSIWILAYHLYHYYQNKIETTQQNAELLVIAKQAQLDNLSAQLNPHFLFNSLNSIKSLVIENPSVARRAIDLLSDLLRSSLYEKNKGLISIKDELALVKDYIELEKMRFEERLTINITVDKTLEKLKIPTLSIQLLVENAIKHGIDKIIEGGLITVNITTKENQLYIEVKNPGKLAVNKSSKGVGLRNLKERLAIQYKNNTSFNLIKLDQNTVKATIILPITGDENIKTVIIDDER

SEQ ID NO: 19553 - DNA, 747 bp, Unknown
  Obtained from environmental sample
  misc_feature (1)..(747): n is a, c, g, or t
atgatcgaggaaaaagcgctcaatccgggcgaagaatccttcaacaaagcggtcatgtacggtgctgacaccaaagccggcaaattgctgggtgagttgcgcagctttcccatgatggccagccgccgattggtaattctcaaagaagctcagaagtttgacaaaaatgaatggaccaaacttcagccttatctggacaatccttccgaaaccaccgtatttgtcatgacttttaagggcaaggacctcgatcagcggaccaagcccttcaaagcaatggaaaaaaacggggtggtattcaagtccaaaccgatttatgaaaaccaggccggacgctggatgcaggattatgccggtggcaaaggattcaagctggctcccgaagcccttcccatcctgactgcttatctgggcgccaatctcggattgatcgaaagtgaactggaaaaaatcttcatttacctcaacggagacaccagccaaaccatcactccggcggtcgtttatgagatgatcaacatcgacaaagactacaatgtcttcgaattgatgaattctttgggcgttcgggaccattccaagagccatttcattgtcaaccagatgatgcgaaatgtcaaagacaatccgcccgtactcatcgtattccagctttttcagtttttttcgcgaattttaagggtccaatccaagaaattgaagacggatgctgaaattgcaaaggagttgggaatccctaatttttag

SEQ ID NO: 19554 - protein, 248 aa, Unknown
  Obtained from environmental sample
  misc_feature (1)..(248): Xaa is any amino acid
MIEEKALNPGEESFNKAVMYGADTKAGKLLGELRSFPMMASRRLVILKEAQKFDKNEWTKLQPYLDNPSETTVFVMTFKGKDLDQRTKPFKAMEKNGVVFKSKPIYENQAGRWMQDYAGGKGFKLAPEALPILTAYLGANLGLIESELEKIFIYLNGDTSQTITPAVVYEMINIDKDYNVFELMNSLGVRDHSKSHFIVNQMMRNVKDNPPVLIVFQLFQFFSRILRVQSKKLKTDAEIAKELGIPNF

SEQ ID NO: 19555 - DNA, 897 bp, Unknown
  Obtained from environmental sample
  misc_feature (1)..(897): n is a, c, g, or t
atggaaataaatcgacaaggaaaaacaatttcaatccctttaaaaagagaaaaaatagaaataaatccggttccgttttacaaaaaaatagatggtgaaaccgtttatattgttttaacaaggtttaatgaaaaagcagcatccgaagtaaaaaaagcctttgaaactttaaagcaagaaggcatcaaaagcttgattttagatttgcgttcaaatcctggaggattattaggagaagctgtaaatatttctaacttttttttaccaaaaggaactacaattaccaccacaaaagcaaaagtaaaaaaatggagcaatacgtatttgtctagaaataatccgttagatttagagattccgatagtagttttaattaacggaagttctgcatctgcatcagaaattgtaactggcgccttgcaagattatgacagagcagttgtgatgggaaagcgctcttttggaaaaggtttggtgcagcgttttagagctttgagttatggaacgcaattaaaagtaaccatttctaaatattatacaccaagcggacggtgtattcaagaattagattatgcaaatagagatttaaaaacaggaaaagttccgaagttttcggatgctggagttaatgagtttagaactcaaaacggaagagtagtttttgatggtggcggaattaatccagatattattaccgaaaacgaaatggtaacagaagaaacgaaaatactattaaattctagagccttatttaattttgcaatccattttaaaaataaaaacaacaggattacttctgcaaaagagtttaggtttacgaatactgattttaaacaatttcaatcgtttttaaaaacgggatacaacgtttcaaacaaaagaagaaacatcctttaa

SEQ ID NO: 19556 - protein, 298 aa, Unknown
  Obtained from environmental sample
  DOMAIN (33)...(193): Peptidase family S41
  misc_feature (1)..(298): Xaa is any amino acid
MEINRQGKTISIPLKREKIEINPVPFYKKIDGETVYIVLTRFNEKAASEVKKAFETLKQEGIKSLILDLRSNPGGLLGEAVNISNFFLPKGTTITTTKAKVKKWSNTYLSRNNPLDLEIPIVVLINGSSASASEIVTGALQDYDRAVVMGKRSFGKGLVQRFRALSYGTQLKVTISKYYTPSGRCIQELDYANRDLKTGKVPKFSDAGVNEFRTQNGRVVFDGGGINPDIITENEMVTEETKILLNSRALFNFAIHFKNKNNRITSAKEFRFTNTDFKQFQSFLKTGYNVSNKRRNIL

SEQ ID NO: 19557 - DNA, 390 bp, Unknown
  Obtained from environmental sample
  misc_feature (1)..(390): n is a, c, g, or t
atgaaatttgaagcacgtatttctgaagaaccaatagaagttgaaatttctgaaaaagaacacacttttaaatcaggcaaactggaagggtcgtatgagtttgttacccaaaatggaagaaagttacttcgtatcggaacaaaattgtataaaattgataatgtaaattatgacggctctaatattgagttttccatagatggaaactggtttaccgtatctgtaaaagatgaacaagagttattgcttgatcggcttgggttcaagacaggaaatgcagtagctgaaggttcccttaaatctccaatgcctggtaagattctggatattttggtgtccgaaggtgatgaagttacaaaaggtcagccagtggtgatttggaagctatga

SEQ ID NO: 19558 - protein, 129 aa, Unknown
  Obtained from environmental sample
  misc_feature (1)..(129): Xaa is any amino acid
MKFEARISEEPIEVEISEKEHTFKSGKLEGSYEFVTQNGRKLLRIGTKLYKIDNVNYDGSNIEFSIDGNWFTVSVKDEQELLLDRLGFKTGNAVAEGSLKSPMPGKILDILVSEGDEVTKGQPVVIWKL

SEQ ID NO: 19559 - DNA, 315 bp, Unknown
  Obtained from environmental sample
  misc_feature (1)..(315): n is a, c, g, or t
atgtgtgttggatgttcaacttccaaagttctatcttctttgcctatgagaaaacttactaaatctgaacgagctgtaattgaacgattgatctttcctgaatcttttgatgtaattatggaagaaacggagatgcaattcggagaacttcgagacgatcttataaatttagtaaactacagatatgtggaagtagtgaatagtgaagaggacaaagacagcaaaatgttgttttatgatagtgataacattaaagcgttttcgtttagagcaactaaaattggacttaaaagtttaaatcaatctgttatatga

SEQ ID NO: 19560 - protein, 104 aa, Unknown
  Obtained from environmental sample
  misc_feature (1)..(104): Xaa is any amino acid
MCVGCSTSKVLSSLPMRKLTKSERAVIERLIFPESFDVIMEETEMQFGELRDDLINLVNYRYVEVVNSEEDKDSKMLFYDSDNIKAFSFRATKIGLKSLNQSVI

SEQ ID NO: 19561 - DNA, 408 bp, Unknown
  Obtained from environmental sample
  misc_feature (1)..(408): n is a, c, g, or t
gtgatactaagaactgttgctcaagataaaaaagtagcagaattagacagggatttacaaaactctttagaacgttggaaaggcatgtgtaaaagcattgcaaacacaaataccccaacaaaaatattgagcgagttaaacagagcatcttctattttaagagatgtaatgaatgattcttttacaaacattgttacaaatgacgagactttagttgtagaaattaaagattatttacaagaaatttatcccgaaaaggtaaatattgtaaatctacacaaatcaaaaactccaatatttgagaagtatggcgtagagcgtcaaataaaaacttcttttggtaaaacagtatctatgagtaaaggtgcgtatttggtaattgaacataccgaagcattgcacgtgtag

SEQ ID NO: 19562 - protein, 135 aa, Unknown
  Obtained from environmental sample
  misc_feature (1)..(135): Xaa is any amino acid
MILRTVAQDKKVAELDRDLQNSLERWKGMCKSIANTNTPTKILSELNRASSILRDVMNDSFTNIVTNDETLVVEIKDYLQEIYPEKVNIVNLHKSKTPIFEKYGVERQIKTSFGKTVSMSKGAYLVIEHTEALHV

SEQ ID NO: 19563 - DNA, 645 bp, Unknown
  Obtained from environmental sample
  misc_feature (1)..(645): n is a, c, g, or t
atgaagaattcaattgcattcctttttttatccttattaatctttacaggttgtaaatcagaaaaaacagttccaaaaaaaccaaaattagtcatcggaattgtaattgaccaaatgcggtacgattatttaattcgattttcagataaatatggcgaagatggttttaaaagaattataaaagatggattctctttagaaaacgccaattataattacattccgacgtatacagctgtaggacacacttcaatatatacaggtacaacaccagaaaaccatggaattataggaaataactggtatgataaatatgcaaaaaaatacatttactgtgtagatgatgacaattactcttcagttggtgttacttctaacggtggaaaaaaatctccgcacagaatgcaaaccacaacgattacagatcaattacgattggcgcaaaatatgcacggaaaaacaattagtattgccattaaagacagatctgctgtgttgcctggcggacatactgcaaacggagcatattggttagaaggaaaaaatgaagggaaatggattaccagttcttattatatgaacgaattaccaaaatgggtaacaaaatttaatacttctggggaaagctgcggcatacatgtctaa

SEQ ID NO: 19564 - protein, 214 aa, Unknown
  Obtained from environmental sample
  SIGNAL (1)...(20)
  DOMAIN (29)...(212): Type I phosphodiesterase / nucleotide pyrophosphatase
  misc_feature (1)..(214): Xaa is any amino acid
MKNSIAFLFLSLLIFTGCKSEKTVPKKPKLVIGIVIDQMRYDYLIRFSDKYGEDGFKRIIKDGFSLENANYNYIPTYTAVGHTSIYTGTTPENHGIIGNNWYDKYAKKYIYCVDDDNYSSVGVTSNGGKKSPHRMQTTTITDQLRLAQNMHGKTISIAIKDRSAVLPGGHTANGAYWLEGKNEGKWITSSYYMNELPKWVTKFNTSGESCGIHV

SEQ ID NO: 19565 - DNA, 384 bp, Unknown
  Obtained from environmental sample
  misc_feature (1)..(384): n is a, c, g, or t
atgtgtcatactcacnttgatctcattctgtgtacactatatctttngcacgtgtcatatacccactatnctgtactatantanctnacgttagacatcgtgtcnctcntatcagacatctanatctncancatctcctacantntcatgatactcgnactctatcgcactgcatacatgatcgancgcntcgtcgtctcattagactcngatactagctcatctgtacgatnactctcgangctctgtccatcgtacacactgctacacgatgtcgtcgcactatactacactgctgcgcctaccnatcgtctcgctcgntcatatntacactatgatatctccatacgatcactactgatacgtccnactctnaccatctaa

SEQ ID NO: 19566 - protein, 127 aa, Unknown
  Obtained from environmental sample
  misc_feature (1)..(127): Xaa is any amino acid
MCHTHXDLILCTLYLXHVSYTHYXVLXXLTLDIVSLXSDIXIXXISYXXMILXLYRTAYMIXRXVVSLDSDTSSSVRXLSXLCPSYTLLHDVVALYYTAAPTXRLARSYXHYDISIRSLLIRPTLTI

SEQ ID NO: 19567 - DNA, 801 bp, Unknown
  Obtained from environmental sample
  misc_feature (1)..(801): n is a, c, g, or t
atgaagcatgctttggatggaaatagggaagagagagacattcgaataaagaaactacataaaggaaaagtaacaatcccatttgagcttattaacaacttaattgtggtacctgttaagcttaataattctgacgaactcaaatttatattagatacaggcgctggtcaaactgtaattactgaattaggctcggatcagagtttcaatattaggtatcagagtaatattaagataagtggtctaggtgttacgggatctatagaggcgttactctctaatggaaacgagattttcatggatggcatagaaggagaagctcacacggtggtttttattttagaaggcagattcaatttgtcatattatatgggtactcagattaatggacttttaggatatgatatctttgagaatttcattgttgaagttgactacgagagaaaaagattatatttgcacgatccagatgtttttgaaaaagaatatcaccgcaaaaagaatgataaatcgtggacctacataccggcgtatatttttaagaacaagctatatatagacgttgatattacacaaaatgataactctacgattaaagcgaggcttctagttgactccggcgcaagtagctctgtttttttatacccaaacgaaagaaaggaagtaattattcctacaaacgctattgaatcatatttaggaactgggttaagtggtgaaatacatggcttaataggtcgtgtaaagaagttgaaaattggagaaactgaaattaataatccccattattgcgtatcctaa

SEQ ID NO: 19568 - protein, 266 aa, Unknown
  Obtained from environmental sample
  misc_feature (1)..(266): Xaa is any amino acid
MKHALDGNREERDIRIKKLHKGKVTIPFELINNLIVVPVKLNNSDELKFILDTGAGQTVITELGSDQSFNIRYQSNIKISGLGVTGSIEALLSNGNEIFMDGIEGEAHTVVFILEGRFNLSYYMGTQINGLLGYDIFENFIVEVDYERKRLYLHDPDVFEKEYHRKKNDKSWTYIPAYIFKNKLYIDVDITQNDNSTIKARLLVDSGASSSVFLYPNERKEVIIPTNAIESYLGTGLSGEIHGLIGRVKKLKIGETEINNPHYCVS

SEQ ID NO: 19569 - DNA, 504 bp, Unknown
  Obtained from environmental sample
  misc_feature (1)..(504): n is a, c, g, or t
atgattaacttaaatgagaaacaggttcgagagaaattaaaaaacattgaagcttttgttttggaccaagacggaactttatacttagaatatgagtcattcccttggacaatagattttttaaaaggtttggatcaaagaggaattagttacttgtttttgagtaataactcttcaaaatcgtgcaacgagcatattgaaaaattgtccgagttgggtatttccgcaaaacccgagcagattttaagttcttcagaatccacaatagagtatcttaaatcactcaaagattctgaggatatttatttattggccacaccaaaagttgagcaagattatcgtgatgctggatttaacattgatgcagcaaaaccaaattatgtagtattagcttacgatttaacttttacattcgacaaattggataaagcttcgcgtcttgttcgtaatggcattccattcattgctacacacgaagacaataatttggatgattgctcctaa

SEQ ID NO: 19570 - protein, 167 aa, Unknown
  Obtained from environmental sample
  misc_feature (1)..(167): Xaa is any amino acid
MINLNEKQVREKLKNIEAFVLDQDGTLYLEYESFPWTIDFLKGLDQRGISYLFLSNNSSKSCNEHIEKLSELGISAKPEQILSSSESTIEYLKSLKDSEDIYLLATPKVEQDYRDAGFNIDAAKPNYVVLAYDLTFTFDKLDKASRLVRNGIPFIATHEDNNLDDCS

SEQ ID NO: 19571 - DNA, 339 bp, Unknown
  Obtained from environmental sample
  misc_feature (1)..(339): n is a, c, g, or t
atgagttccaaattaccaatatcacccgcatgccatatttcatcggcctccctggcatattttagaattttctcgtccatatgtccgtgggtatcggaaagaaggagtatttttttcatgcgtttaattctttttgatttcttgcctaaaaagcaatcaaataatctggataaacctaaggggccaacaatcgtcctttacagctgtaaacataaggtatttggacaaatggacatagtaatactttatgtcaatattgtattaaaacatttcagccatctgtttttctccattagaacaagtatctttgccaactacaaaactaaatttttcatttga

SEQ ID NO: 19572 - protein, 112 aa, Unknown
  Obtained from environmental sample
  misc_feature (1)..(112): Xaa is any amino acid
MSSKLPISPACHISSASLAYFRIFSSICPWVSERRSIFFMRLILFDFLPKKQSNNLDKPKGPTIVLYSCKHKVFGQMDIVILYVNIVLKHFSHLFFSIRTSIFANYKTKFFI

SEQ ID NO: 19573 - DNA, 336 bp, Unknown
  Obtained from environmental sample
  misc_feature (1)..(336): n is a, c, g, or t
ttgcttgagaaaggatttaaaaaatcggaaaatccagatatgttggtgagtatttttaccaagtcaagaaaaacaattgaagtagattctagagataattatccaagttattattggtatccatcatattattatggaagagacagacttcgtgtaaccaaacaaacagaaggaactttgtttattgatttgattgatgtgaaaaataagaaattgttatggcaaggaattggttcaggagctttaggagcaaaaacaggagcgaagaaggtagagagaattcaagcatttgtaaaagaaattatgagtaagtatccgccaaataaaaagaagtaa

SEQ ID NO: 19574 - protein, 111 aa, Unknown
  Obtained from environmental sample
  misc_feature (1)..(111): Xaa is any amino acid
MLEKGFKKSENPDMLVSIFTKSRKTIEVDSRDNYPSYYWYPSYYYGRDRLRVTKQTEGTLFIDLIDVKNKKLLWQGIGSGALGAKTGAKKVERIQAFVKEIMSKYPPNKKK

SEQ ID NO: 19575 - DNA, 741 bp, Unknown
  Obtained from environmental sample
  misc_feature (1)..(741): n is a, c, g, or t
ttggcactgattaattcaatgttttctagtcactggtacaattatgaattctctaattcaataccccaagaaacatcctatcctctaattcatgcaaaaaatccagaaaaaaatgtatttttagaaacggaatcaaataaacagccaactggcattgcattaaacctttcagattcacaaccatcaacaaaaaagtcttttaattggatgattttcttcaaattagtttggatgatagggtttattctattcacttttaagtggatttatcaaattaaaaatatttacctaataaaaaaacaagcacgaatcatgaaagcttcaaataataaatttaagatttactggagccaattatcggaagttccgtttttgtttgtaggtaaatttattttcataattattccagaacatatgcagcaatggccaaaagaaaacataaaacacattattaaacatgaaaaatgtcactatcaccgtaaagatcattgggtattatggatttctgtactaacaaaaagtgtgttttggtttcatccatttattcacatattagccaaaaagcagcaacatttaattgaattagcttgtgatcagcaattattagccagtggtgctgacccgatttcatatgccgaaacactattatcctgtgtatataattgcgaacaggatcgaccggttgttgccatggcaaataaacccagtcaaattaaaatacggataagttctctactttaa

SEQ ID NO: 19576 - protein, 246 aa, Unknown
  Obtained from environmental sample
  DOMAIN (123)...(216): BlaR1 peptidase M56
  misc_feature (1)..(246): Xaa is any amino acid
MALINSMFSSHWYNYEFSNSIPQETSYPLIHAKNPEKNVFLETESNKQPTGIALNLSDSQPSTKKSFNWMIFFKLVWMIGFILFTFKWIYQIKNIYLIKKQARIMKASNNKFKIYWSQLSEVPFLFVGKFIFIIIPEHMQQWPKENIKHIIKHEKCHYHRKDHWVLWISVLTKSVFWFHPFIHILAKKQQHLIELACDQQLLASGADPISYAETLLSCVYNCEQDRPVVAMANKPSQIKIRISSLL

SEQ ID NO: 19577 - DNA, 549 bp, Unknown
  Obtained from environmental sample
  misc_feature (1)..(549): n is a, c, g, or t
atgaaacatctagaaggtatcatgaaataccttcctgaacaattaaatgaaatcaaaaaccaaaacagcacagaactaaaaacaacaataaaaaatattcgggatttttattctgccgttgggatgtcaattaatgatttaaataaaatgttcgaagaacaaccagaatttcacgaaatgatggcaaaaacttggttcaatgatactgtaggtgttgaatatgcagaatcaattctacttaatctatcaaatgatgaatacaaattaattttagaggaaggcattgatttaattcaaaacagagattcttcaataagaaaatataaccctaaagtaatcacagacaatatccctaaacaattggattttattaaaattaaagcgataagagtttatgaagattactgcgaaatatttctttacaaaggcataggaggaatgaaaagcattggttattctgttcaaaaagatgatcaaggtcaatggacattgtaccatttcaactttttaaagaattgggataaaactttaattgatttaaaagattga

SEQ ID NO: 19578 - protein, 182 aa, Unknown
  Obtained from environmental sample
  misc_feature (1)..(182): Xaa is any amino acid
MKHLEGIMKYLPEQLNEIKNQNSTELKTTIKNIRDFYSAVGMSINDLNKMFEEQPEFHEMMAKTWFNDTVGVEYAESILLNLSNDEYKLILEEGIDLIQNRDSSIRKYNPKVITDNIPKQLDFIKIKAIRVYEDYCEIFLYKGIGGMKSIGYSVQKDDQGQWTLYHFNFLKNWDKTLIDLKD

SEQ ID NO: 19579 - DNA, 801 bp, Unknown
  Obtained from environmental sample
  misc_feature (1)..(801): n is a, c, g, or t
ttgacccagattgccgccccgaatgatatcattgcaataacttattttaacgatgcttttcaaattttgaatctgacaaaattagatgtggaagcattgattaattcttcagttctaaatccatttcaggatttaatcaaggcaattaatactattgaaaatgaagttgcattcgaacttttggcattgttacgaaaaatagcgagtgctggtcctattccttcgatggtagacgccgacacttccgttggacgaactcttgaaaccgcgctcggtatagacatcaattcctctaagaaaccagactacaaaggaattgagctaaagtcattcagaagtaacagaacaaatagaaagaatctttttgctcaagttccagactggacatcaagcaaattcaaaagttcagcagaaattcttgacactttcggatatgcccgtggtaatgattttaaactttattgtacagtttcagcaataactagaaattcacaaggcttgacgctaagagttgacgataaaattaagcatttggttgaaaactcaaataatccggaaattggagattttgttgtttggactttggacaaacttcacagtcggctaaaagaaaagcataaagagacattttgggttgaagccgaaagcacgaaaataaacgatcgtgaacattttcaatataagctagtggaacacactaaaaaacctattacatctcaatttgatttattgattgaccaagggattataactcttgaccacctaataaaaaagaaactccgaagggaaaaagttggttga

SEQ ID NO: 19580 - protein, 266 aa, Unknown
  Obtained from environmental sample
  misc_feature (1)..(266): Xaa is any amino acid
MTQIAAPNDIIAITYFNDAFQILNLTKLDVEALINSSVLNPFQDLIKAINTIENEVAFELLALLRKIASAGPIPSMVDADTSVGRTLETALGIDINSSKKPDYKGIELKSFRSNRTNRKNLFAQVPDWTSSKFKSSAEILDTFGYARGNDFKLYCTVSAITRNSQGLTLRVDDKIKHLVENSNNPEIGDFVVWTLDKLHSRLKEKHKETFWVEAESTKINDREHFQYKLVEHTKKPITSQFDLLIDQGIITLDHLIKKKLRREKVG

SEQ ID NO: 19581 - DNA, 372 bp, Unknown; identical to SEQ ID NO: 18091
  Obtained from environmental sample
  misc_feature (1)..(372): n is a, c, g, or t

SEQ ID NO: 19582 - protein, 123 aa, Unknown; identical to SEQ ID NO: 18092
  Obtained from environmental sample
  misc_feature (1)..(123): Xaa is any amino acid

SEQ ID NO: 19583 - DNA, 525 bp, Unknown
  Obtained from environmental sample
  misc_feature (1)..(525): n is a, c, g, or t
atgctagaaatggcattggtagaaaacatccaacggaaaaatttagaccctattgaagttgcactttcttatcaacgtttaattgatgaaataaaattaacgcaagaacaattaagtgtgcgagttggtaaaaaaagatccaccgtaaccaactatttacgattgttaaaattagatccaattattcaaaccggaatgcgagatgggtttatttctatgggacacggaagagctttaatcaatgttgattcttctgaaaatcaattgaatatttacaccaaagttgtcaaagataaattgtctgtaagacaaactgaagaattggttaaaaatgtaaaagaaggaaatactgctgcaaaatcaaaaaagaaaactcctggttttgtaaaagaatctttatcagaattgaattcttttttcggcagtaaagttgatgtaaatgtaacggcaaaagggaaaggaaaaatatcaatttcttttaaatcagaagaagattttaaccgaataaaaaacttattaaagtag

SEQ ID NO: 19584 - protein, 174 aa, Unknown
  Obtained from environmental sample
  misc_feature (1)..(174): Xaa is any amino acid
MLEMALVENIQRKNLDPIEVALSYQRLIDEIKLTQEQLSVRVGKKRSTVTNYLRLLKLDPIIQTGMRDGFISMGHGRALINVDSSENQLNIYTKVVKDKLSVRQTEELVKNVKEGNTAAKSKKKTPGFVKESLSELNSFFGSKVDVNVTAKGKGKISISFKSEEDFNRIKNLLK

SEQ ID NO: 19585 - DNA, 564 bp, Unknown
  Obtained from environmental sample
  misc_feature (1)..(564): n is a, c, g, or t
ttgatggctcggtatccatcattaactattgttgctgcagcaattgctattttaacaaaagaatatattgttgattttatcagcggaatttatctaagtttttccaacactttcgaaattggcgattatgtaaagattgatcatctaaaaggaaaaatagtagaaattagcatgttaaaagtaaaagttttgaatgatgatgacgatatcgttatcattccaaactctaaagtacactacaacgaaattatcaactataccaaaagagatgctaggtttatgacggtagattttcaaattgctttaaaatatattgatactcttgagcaacttgaaaaagaaattatttcatcactaagaagttttagtcaatatattgagccaaaaacatataatttaaaggtggtagaaatgaaagttgattacttagatcttaaatttcagtacactttaaaactcgttgatatggatatgcaacgaaaaataagaaagaaaacaattagagaagtttttaattttatttctagtaaaaaagaacttcctatcgcaaatccatcattataa

SEQ ID NO: 19586 - protein, 187 aa, Unknown
  Obtained from environmental sample
  DOMAIN (1)...(183): Mechanosensitive ion channel
  misc_feature (1)..(187): Xaa is any amino acid
MMARYPSLTIVAAAIAILTKEYIVDFISGIYLSFSNTFEIGDYVKIDHLKGKIVEISMLKVKVLNDDDDIVIIPNSKVHYNEIINYTKRDARFMTVDFQIALKYIDTLEQLEKEIISSLRSFSQYIEPKTYNLKVVEMKVDYLDLKFQYTLKLVDMDMQRKIRKKTIREVFNFISSKKELPIANPSL

SEQ ID NO: 19587 - DNA, 414 bp, Unknown
  Obtained from environmental sample
  misc_feature (1)..(414): n is a, c, g, or t
atgggagaaaataaacatattgaagaaatagatgcttttgcaaaaaagtatgtaaaagagattccgatagaaacaccttctttaggttttactgcaaatttaatgaagtctatagtccaattagaatctgtaaaaagcaatatagcttacaaaccgttaatttctaaaaaaggatggtttgttgttgcattagcaattgtagcagttttactaattcctttcagttcttctaaaaaggaagtctttatgttgccaaaattagatttttattttctaaataaattggatttttctaacgcgattgaaagtctgagtgtttcgaatacaacctttacagttgctataattttcggaatttttatggcaattcaattaatttatttaaaagggtatttcgaaaaaagactgcattaa

SEQ ID NO: 19588 - protein, 137 aa, Unknown
  Obtained from environmental sample
  misc_feature (1)..(137): Xaa is any amino acid
MGENKHIEEIDAFAKKYVKEIPIETPSLGFTANLMKSIVQLESVKSNIAYKPLISKKGWFVVALAIVAVLLIPFSSSKKEVFMLPKLDFYFLNKLDFSNAIESLSVSNTTFTVAIIFGIFMAIQLIYLKGYFEKRLH

SEQ ID NO: 19589 - DNA, 441 bp, Unknown
  Obtained from environmental sample
  misc_feature (1)..(441): n is a, c, g, or t
ttgaatattgccattttagaggaaactattgaaccattacttattgcaatcgtaaatacgccttctaaagagagcataaaaaaattggaagttcaagaacatgtagttggagtttaccgaacaacatttgaaagcgagcgcaggatgttagagaataaattgatagatcctaatttaactgcatcacaaaagaaagcaataaggcagttattatcgatgccggcagaagattatgtgatagaattcgattattcaattgatgtgaataaagctaaaaagttaatgggtgaattcagagatatagcctataaaattgttcggaattcttttcgaacagttacactacaagcagagccaggaaacgaaccattattaatggataacgttgaacaacttccctttgtggtaagcactgcaatgattgggacggttaagaattaa

SEQ ID NO: 19590 - protein, 146 aa, Unknown
  Obtained from environmental sample
  misc_feature (1)..(146): Xaa is any amino acid
MNIAILEETIEPLLIAIVNTPSKESIKKLEVQEHVVGVYRTTFESERRMLENKLIDPNLTASQKKAIRQLLSMPAEDYVIEFDYSIDVNKAKKLMGEFRDIAYKIVRNSFRTVTLQAEPGNEPLLMDNVEQLPFVVSTAMIGTVKN

SEQ ID NO: 19591 - DNA, 411 bp, Unknown
  Obtained from environmental sample
  misc_feature (1)..(411): n is a, c, g, or t
atggcaggatattcaggaactccattacaaaaaaaacttggtataaagccgaattataaagttcttctggtaaatccacctgagcattatatcgaactgttaggtgaactcccagatagtgtagagatcataaattccagttacaattatccgattgacttcattcatgtcttttgcaaaacagaagaagagctccataatttttttcctcctctcaaaaacaaactcgatagaaacggcttgatctgggtttcttggataaagaaagcctccaaaaactatgaatctacattccttgatagtgaagttcgaaacctgggcttgaatatcgggttggttgacgtaaaggtttgcgccgttgatgaagattggagcggattaaagtttgtgtacagggttgaggatagatga

SEQ ID NO: 19592 - protein, 136 aa, Unknown
  Obtained from environmental sample
  misc_feature (1)..(136): Xaa is any amino acid
MAGYSGTPLQKKLGIKPNYKVLLVNPPEHYIELLGELPDSVEIINSSYNYPIDFIHVFCKTEEELHNFFPPLKNKLDRNGLIWVSWIKKASKNYESTFLDSEVRNLGLNIGLVDVKVCAVDEDWSGLKFVYRVEDR

SEQ ID NO: 19593 - DNA, 513 bp, Unknown
  Obtained from environmental sample
  misc_feature (1)..(513): n is a, c, g, or t
atgaaaaaaacagttttagaaaaaggaaaagcatgggctcatgatttagaaatcattgaggaacttatcaaggatgggtttatccatgtaacagggctctccacgaagaaaagtgggtgtgatcctgaaacgatttatgcaagccagcatgattacgattttatcaaggggataggatccatagatagtaataatggtatgactgccgtcatcacccctaaagggttttatttcttgaaatacggaaaagaaaatcctgagatgcataatgaagtagatttcaagattacaaaggatcacaatgtgggtgtgtattgctcaaatggagacagtatattttcacgggctctttttacaagagtcgccgatccattggctgaagagtatggagatcccttttaccgaacagtggtaaaaaagatgaatatgaaacccgatcacattgcgatccgggttttttccggtttataccccttcccccacaaaatttttgctcaacaaaaaaaaaaagct

SEQ ID NO: 19594 - protein, 171 aa, Unknown
  Obtained from environmental sample
  misc_feature (1)..(171): Xaa is any amino acid
MKKTVLEKGKAWAHDLEIIEELIKDGFIHVTGLSTKKSGCDPETIYASQHDYDFIKGIGSIDSNNGMTAVITPKGFYFLKYGKENPEMHNEVDFKITKDHNVGVYCSNGDSIFSRALFTRVADPLAEEYGDPFYRTVVKKMNMKPDHIAIRVFSGLYPFPHKIFAQQKKKA

SEQ ID NO: 19595 - DNA, 846 bp, Unknown
  Obtained from environmental sample
  misc_feature (1)..(846): n is a, c, g, or t
ttggcgttggaggagccatgccttctgtgtttttatatcacgcattcaagcaggaatgaacatggaaatgtaaatccgcctttgttagaagtatatgatgatatcccgaagatttatttagacngagtagaagatgttattttagaccgaagagaagatgcaacagaacgtntgttagattttgctgaaacagttaaaggatcaaaagttgaaaaaggattggatttatcttggagagaaaatccgttacaagacagaattacacacgctttggtaaaaggtattgatgcttttattattgaagatattgaacaagcaaggcaagaagcagaaaagccaattgaagtgattgaaggtcatttaatgattggaatgaatgtggttggagatttgtttggcgcaggaaaaatgtttttaccgcaagtagtaaaatctgctcgtgttatgaaaaaagcagttggttacttaaatccgtttatagaagcagaaaaaacagaaaaacaagaacctgttggtaaaatattgatggcaactgtaaaaggcgatgtgcatgatattggaaaaaatattgtcagtgttgtgctggcgtgtaacaattatgaaattattgatttaggtgtgatggttccgccagaaaaaattattgaaacagcaattaaagaacgtgttgatgctattggtttatcaggattaattacgccatcgttagatgaaatggtgtatttggcaaaagaaatgcaacgtcaaaattttgaattaccgttgctaattggaggagcaacaacatccaaagcacacacagctgttaaaattgatacacaatataaaaatgcagtggttcagtaa

SEQ ID NO: 19596 - protein, 281 aa, Unknown
  Obtained from environmental sample
  DOMAIN (172)...(281): B12 binding domain
  misc_feature (1)..(281): Xaa is any amino acid
MALEEPCLLCFYITHSSRNEHGNVNPPLLEVYDDIPKIYLDXVEDVILDRREDATERXLDFAETVKGSKVEKGLDLSWRENPLQDRITHALVKGIDAFIIEDIEQARQEAEKPIEVIEGHLMIGMNVVGDLFGAGKMFLPQVVKSARVMKKAVGYLNPFIEAEKTEKQEPVGKILMATVKGDVHDIGKNIVSVVLACNNYEIIDLGVMVPPEKIIETAIKERVDAIGLSGLITPSLDEMVYLAKEMQRQNFELPLLIGGATTSKAHTAVKIDTQYKNAVVQ

SEQ ID NO: 19597 - DNA, 321 bp, Unknown
  Obtained from environmental sample
  misc_feature (1)..(321): n is a, c, g, or t
gtggagcgcatctccccccattacaagctttttcactcttccaacttctatccattgcacctctggcggcaaggtttcctggctatctgggccaaaatcaagattgacaattttttgaaaatcgaacaaatcagacccgctgtcgccagtcaacgaccaaaagaaacgaatacgatcttcattggaaaaactatcaaatcgaatttctgttgtcggtgctgtggttggaacatgattggtttccttgaatttgctgataagcctcttggatacgttgtcagcaattcttttagtttctgctgcggtatgtacgattcgtaa

SEQ ID NO: 19598 - protein, 106 aa, Unknown
  Obtained from environmental sample
  misc_feature (1)..(106): Xaa is any amino acid
MERISPHYKLFHSSNFYPLHLWRQGFLAIWAKIKIDNFLKIEQIRPAVASQRPKETNTIFIGKTIKSNFCCRCCGWNMIGFLEFADKPLGYVVSNSFSFCCGMYDS

SEQ ID NO: 19599 - DNA, 489 bp, Unknown
  Obtained from environmental sample
  misc_feature (1)..(489): n is a, c, g, or t
atgctattaaaaacaaaaaaaatgagtacaaaaatactcaatataatttatatgagtctattactggttaatgcctggagtaatttatcgtttgcaaatgaactcacaccagtaatctatgaaacccctaaatctttgataacttataaaatggacacaaaacaagacgccatttttttgttatcttcagatgactttaaaaaagaattaattaacttagctaagcttatagattctgtagataaaaaagaaatacttgaacgtgaaaacattgcattgagttcttttttaggacaattcagtaaatgcattgccataattgatcagaacaaatacccattaaaattttatcattattccttgtatgcgaatagtcattctcaatctttatccaatgctggctctctagataataatattgaaaaaacactgaaaaaatcactgttatctctatcaaatgaaacgctacataaaataagttatccatga

SEQ ID NO: 19600 - protein, 162 aa, Unknown
  Obtained from environmental sample
  misc_feature (1)..(162): Xaa is any amino acid
MLLKTKKMSTKILNIIYMSLLLVNAWSNLSFANELTPVIYETPKSLITYKMDTKQDAIFLLSSDDFKKELINLAKLIDSVDKKEILERENIALSSFLGQFSKCIAIIDQNKYPLKFYHYSLYANSHSQSLSNAGSLDNNIEKTLKKSLLSLSNETLHKISYP

SEQ ID NO: 19601 - DNA, 321 bp, Unknown
  Obtained from environmental sample
  misc_feature (1)..(321): n is a, c, g, or t
atggggaagtctttttcttatcattattacattggacgtgcaagttatgcccctgatatgagtaagcgtcaactactgacaccaaacgaaaaatcccctgttccaatagtcaatagcaaaatgactgctaaactcatcgaaaaaggcagccgtttagttatcgttctcaatgttaataaaaactcaggtgcccaagtcaatcttggaacaggtcaagatgtcagcgatgaaacaatcgctgatgcaggcgaaccactggaaataaaatggtttagtgatagccaaataaacataccattaaaaaaatgggtaatacaataa

SEQ ID NO: 19602 - protein, 106 aa, Unknown
  Obtained from environmental sample
  misc_feature (1)..(106): Xaa is any amino acid
MGKSFSYHYYIGRASYAPDMSKRQLLTPNEKSPVPIVNSKMTAKLIEKGSRLVIVLNVNKNSGAQVNLGTGQDVSDETIADAGEPLEIKWFSDSQINIPLKKWVIQ

SEQ ID NO: 19603 - DNA, 942 bp, Unknown
  Obtained from environmental sample
  misc_feature (1)..(942): n is a, c, g, or t
ttgattatcgccggtcgtttttctgattgcacagatgtcgaaaccggaaatcaagtaaaacttacaagcggctcattacctttggccttaagagcaagtggttcttttcctacgttgttagatccgatagaggttgatgataaattattggttgacggcggaattgcaaacaattttccggttgatgaaatgaaaaaaacaggggtcgatattattattggtgttgatgtacaatcggaattatttaaaaaagaaaaaattaaaacagtattagatgtattaggtcaaatttctaattatcagatttataaaagaaacgcagaacaggttgctaaaacagatgtgtatattcatccagatatttatgattattctgtagtttcttttgataaacctgtagaaatattatctaaaggagtacaaataggtaaaaaattcgccaaaacattcgacagcattgcaaaacttcaacctctaaaaataaaacgaattgacttggttaataaagaccctgaatttgttgttcataaagtagaaattaaagggaacaataattatacaagagcttatatattaggaaaattaaaactgcaagaaggggataaaataaactataaagagttggcaactaagattagttatttatcggcaacagataattttaagatgatcaattttcatgttaaaaatacacctgaaggaaaaaagattcaattaaaaatcaaagaaaagaagctaaatgcaagtttaagactaggagtacattacgatttggtatacaaatcgggcgttttaatcaacttaaacaaaaagaattttttatctaaaaacgatgctgtttctttagacatagtcgttggagacaaaccaagatttaattttgcactactttgtaggaccaccggattttattatagtttatgggctttagttcctaggtaa

SEQ ID NO: 19604 - protein, 313 aa, Unknown
  Obtained from environmental sample
  misc_feature (1)..(313): Xaa is any amino acid
MIIAGRFSDCTDVETGNQVKLTSGSLPLALRASGSFPTLLDPIEVDDKLLVDGGIANNFPVDEMKKTGVDIIIGVDVQSELFKKEKIKTVLDVLGQISNYQIYKRNAEQVAKTDVYIHPDIYDYSVVSFDKPVEILSKGVQIGKKFAKTFDSIAKLQPLKIKRIDLVNKDPEFVVHKVEIKGNNNYTRAYILGKLKLQEGDKINYKELATKISYLSATDNFKMINFHVKNTPEGKKIQLKIKEKKLNASLRLGVHYDLVYKSGVLINLNKKNFLSKNDAVSLDIVVGDKPRFNFALLCRTTGFYYSLWALVPR

SEQ ID NO: 19605 - DNA, 441 bp, Unknown
  Obtained from environmental sample
  misc_feature (1)..(441): n is a, c, g, or t
gtggttgattttattgatatgcaaagtgcagaaaatagacaaaaactctatcagtacatgaaagatgaaatgtcttttgatagaacaaagcacaaaattttaccaccaagtaaatttggtttggtacaaatcactcgtcaaagagtaagaccagaattagaaattaaaacaagagagccaaatccgaatataaacggagaagttgaagctccaattgttttaattgataagatcgaaattgagttagaaagaattatatctagcggaaaaaactacaaaaagattacgcttaatgcgcatccgtttgtagccgcgtaccttacaaaaggtgtttcttctatccgttttaaatggtttattaaatacaaaaagtggatcgatatattacctagagatgcttaccaatacttacaatataaattttataaaaaaagtaagtaa

SEQ ID NO: 19606 - protein, 146 aa, Unknown
  Obtained from environmental sample
  misc_feature (1)..(146): Xaa is any amino acid
MVDFIDMQSAENRQKLYQYMKDEMSFDRTKHKILPPSKFGLVQITRQRVRPELEIKTREPNPNINGEVEAPIVLIDKIEIELERIISSGKNYKKITLNAHPFVAAYLTKGVSSIRFKWFIKYKKWIDILPRDAYQYLQYKFYKKSK

SEQ ID NO: 19607 - DNA, 366 bp, Unknown
  Obtained from environmental sample
  misc_feature (1)..(366): n is a, c, g, or t
atgaaaagagctcaaactatattattcagacttattcttccttttatattattgttggctgcctgcagttcatctccagaggagtttacaccatccaatgaacaattgagtatctaccctgactatacttcaattaccatccctccgaatatagctcctctgaatttcaggatcaataatgaaggagaggcatttattattaaaatagtcaatactaaaggcaactctatcaagctaagtacccatacaggaaaagttctcattccagaatcaaaatggaaaaaactactggaagaagacaaaggaggcaccctgacttatgaagtctatcgaaaattagcagataattccctgggagaaatatga

SEQ ID NO: 19608 - protein, 121 aa, Unknown
  Obtained from environmental sample
  misc_feature (1)..(121): Xaa is any amino acid
MKRAQTILFRLILPFILLLAACSSSPEEFTPSNEQLSIYPDYTSITIPPNIAPLNFRINNEGEAFIIKIVNTKGNSIKLSTHTGKVLIPESKWKKLLEEDKGGTLTYEVYRKLADNSLGEI

SEQ ID NO: 19609 - DNA, 1035 bp, Unknown
  Obtained from environmental sample
  misc_feature (1)..(1035): n is a, c, g, or t
ttgatagtggatctaaagtttgacagccaaaataatcagtatgtaacaatggttaatggtatcggagtaaaaattaactcttcttttgaaaaattaaacccttttaaggatcaagaatcaattcgtttgaaatcctttctccaagacaatgaaggtaactattggataggtacagaaggggatggtctttttcgttttagaaaaaagaccatttctatgattgataaaaatgatggtttacaaaatgagaaaatgctttcaattactaatcttagtgatggaaagatattgatggccacaaattgtgatggaatttatgaattggaggacgggaaagtaaagttgtcaacaatacatgactacatagatacaggttgttattggtcagtatttcaagattcaaaagatagaatatgggtaggtggtgaaaatccttatatgacagaatccttagataaacctggaaagttctttggtaaagaggatggctatgacggatattcagttgtcgcaattacagaagactcaaaaaacagaatatgggtagctacaacaactggaatttatatttatgatggcacatctttcacagaaaatttaactgaaaaagatggattgtattacagagatgcaagaatactttacgaagacacttcaggcaaaatgtggattggaacgaatggagggttaaatacctacaaagacaaggaaatacagaagattagtttagctattaagtatgaatcagaaataacaactcaaccacatgttagagctattcatgaagatgaaaatggaatattttggataggaacttatggtgatggtttattcagaattaagaatggagagtcttttcattttaatactagcaatggcttgtatgaatatgtagtatctcacatcattgaagatgaagatggctactttttggagggaagtaatcgtgggattcatcgaactagaaaagagagccttcataaatttgcggatgggggaaatagattgggggaaatttcttttttccaaccataa

SEQ ID NO: 19610 - protein, 344 aa, Unknown
  Obtained from environmental sample
  misc_feature (1)..(344): Xaa is any amino acid
MIVDLKFDSQNNQYVTMVNGIGVKINSSFEKLNPFKDQESIRLKSFLQDNEGNYWIGTEGDGLFRFRKKTISMIDKNDGLQNEKMLSITNLSDGKILMATNCDGIYELEDGKVKLSTIHDYIDTGCYWSVFQDSKDRIWVGGENPYMTESLDKPGKFFGKEDGYDGYSVVAITEDSKNRIWVATTTGIYIYDGTSFTENLTEKDGLYYRDARILYEDTSGKMWIGTNGGLNTYKDKEIQKISLAIKYESEITTQPHVRAIHEDENGIFWIGTYGDGLFRIKNGESFHFNTSNGLYEYVVSHIIEDEDGYFLEGSNRGIHRTRKESLHKFADGGNRLGEISFFQP

SEQ ID NO: 19611 - DNA, 492 bp, Unknown
  Obtained from environmental sample
  misc_feature (1)..(492): n is a, c, g, or t
ttgatatcgaaaagccgggataccacggggtttgaagtgcttcaaaaagttcataaagagtcaacttcaattgatatcatttttttgaccatgtttaaagatgaatcgatgttcaataatgctatgaatattggcgtaaaaggatatgtattaaaagaaaatacggtatcagagatagttcaatgtgtaaaagccgtactatcaggggaatactatntgagtcccgccatttcgcaatacctgattcgcagaaacaatggtttaatgaatgaagcttctgataaacatggtattaatttgcttactgactcagaaaagaaaattctaaaactggtctccgatatgaaaacaaaccaggagatagcaaaacagttaagcataagcagcaaaacagttaagaatcatcgtaacaacatttgtaataaattgggtttaacaggaactcatgcacttcttaaatatgccattcaaaacgaatccagttttgaataa

SEQ ID NO: 19612 - protein, 163 aa, Unknown
  Obtained from environmental sample
  DOMAIN (98)...(155): Bacterial regulatory proteins, luxR family
  misc_feature (1)..(163): Xaa is any amino acid
MISKSRDTTGFEVLQKVHKESTSIDIIFLTMFKDESMFNNAMNIGVKGYVLKENTVSEIVQCVKAVLSGEYYXSPAISQYLIRRNNGLMNEASDKHGINLLTDSEKKILKLVSDMKTNQEIAKQLSISSKTVKNHRNNICNKLGLTGTHALLKYAIQNESSFE

SEQ ID NO: 19613 - DNA, 306 bp, Unknown
  Obtained from environmental sample
  misc_feature (1)..(306): n is a, c, g, or t
atgatggtttgtctatctgatttcgggttgctggatacatccaaaaaaatcatttcattttctatgcttgatctcacggcaaattatctggcccacgaaatgcacttcaagggaatcaaggatacggatattttgatatcaaaagattggaagctttttggaatgagtccccatgatgttgcccggcggttggagcgcatttccttcaagggccattttgtttttcaatattccggggaaatactgaatatcgactggaaataccaaaacatggaggaattcgcaaatggaagttctggattctaa

SEQ ID NO: 19614 - protein, 101 aa, Unknown
  Obtained from environmental sample
  misc_feature (1)..(101): Xaa is any amino acid
MMVCLSDFGLLDTSKKIISFSMLDLTANYLAHEMHFKGIKDTDILISKDWKLFGMSPHDVARRLERISFKGHFVFQYSGEILNIDWKYQNMEEFANGSSGF

SEQ ID NO: 19615 - DNA, 813 bp, Unknown
  Obtained from environmental sample
  misc_feature (1)..(813): n is a, c, g, or t
ttgtaccaatgtgcccttccgtccttctctctgaaacactgctttaggtcgcaaaaaaagatcaaagatgttgcggttgaattccagcgctcaagattctcggaaaaatatgagattgattctctttcagatcagattgaaatttcctttgcaaaagaaggttacctgaattacatgctgcttcgggatggagatccagcgatctccatattcaacattgtccaacagaatgccgagcggctggccgttcaccccaatgacattactgtgctgggattcacgattgccgaattgcgacgatttgaaatctactatcggtatatgacgggggagcaaacgaataccatgtttgagaccgaggaagtggttcggaagctacaaatggacaagattagcaaaagcacggtcattgacaagggattgctccttttcagagatatgaagtcgtatgagaaggaaaagaagagaggtatccttgccgcaatgacggtgatggacgagttgtacgaaaaatacggtcagccggccttccttgccaaatttgaacagctgtgttctcagcaaaatgtaaacctccatgcctatgaaacctggaaggcaaattattggacggaggccagggagaacctgaacctcaagggcatcaagagtgagatcaaaaagatcagagacaacaaaaaattcaacttctggtacaaccgtggatcattngaagtttcgaccatccatagtttcaaaggctgggaagcccacaccctctttctcattctggagcccgtttatgacggtggagaatttccatttttcatttga

SEQ ID NO: 19616 - protein, 270 aa, Unknown
  Obtained from environmental sample
  misc_feature (1)..(270): Xaa is any amino acid
MYQCALPSFSLKHCFRSQKKIKDVAVEFQRSRFSEKYEIDSLSDQIEISFAKEGYLNYMLLRDGDPAISIFNIVQQNAERLAVHPNDITVLGFTIAELRRFEIYYRYMTGEQTNTMFETEEVVRKLQMDKISKSTVIDKGLLLFRDMKSYEKEKKRGILAAMTVMDELYEKYGQPAFLAKFEQLCSQQNVNLHAYETWKANYWTEARENLNLKGIKSEIKKIRDNKKFNFWYNRGSXEVSTIHSFKGWEAHTLFLILEPVYDGGEFPFFI

SEQ ID NO: 19617 - DNA, 360 bp, Unknown
  Obtained from environmental sample
  misc_feature (1)..(360): n is a, c, g, or t
atggagaaagataaagtcctggaaaaactgaaatcgttggctcagcttcaacacattgacacgaagctggacaagattctcaccctacgcggctcgctgcctgacgaagtggccgacctggagttcgaaattcaaacgaaggaaggaaccaaggagcgtgtagaggcagacatcaaggaacttgaagcggaaatttcgaagaagaaatccaatatcaaggaattccagtcttcgattgagaaatacgaagcgcagctcaacagcgtgaaaaacaaccgtgaattcgaagctctgcaaaaagagatcgaatatgcccggttggaaatcctcacttccgacaagaaaatccgttccttttga

SEQ ID NO: 19618 - protein, 119 aa, Unknown
  Obtained from environmental sample
  misc_feature (1)..(119): Xaa is any amino acid
MEKDKVLEKLKSLAQLQHIDTKLDKILTLRGSLPDEVADLEFEIQTKEGTKERVEADIKELEAEISKKKSNIKEFQSSIEKYEAQLNSVKNNREFEALQKEIEYARLEILTSDKKIRSF

SEQ ID NO: 19619 - DNA, 546 bp, Unknown
  Obtained from environmental sample
  misc_feature (1)..(546): n is a, c, g, or t
ttgttaaatatcatctgtaaatactccttgttacgcatattattcacatttatttatgttacttcattgtcggcatttgccactgattatgaaaaagttggcgaacctgtcactgaagtctatgattcatttgcacataaaggagccaatcaaaattggtggatggcccaggctaaaaacggtttaatttataacggtactggcacgggcttaaatgagtgggatggtgaacaatggtcaatttatagaacaccacaaaaatcacgcattcgcagtctttccatttggaaagatgacaatatttatattggtacaaccaatgacattggctattattatgccaataaatcaggcagtttaacctataaatccttattaaacgattggacttttgaagaaaaacagttcggtgaagtgtggtcggttgcctccaacaataatggtgtattatttctatctaataaaatatttacttcctttggaaatggcccgttctataaagtaaaaatgaaaactcaatgtaggttccgcaccaaagttttttag

SEQ ID NO: 19620 - protein, 181 aa, Unknown
  Obtained from environmental sample
  misc_feature (1)..(181): Xaa is any amino acid
MLNIICKYSLLRILFTFIYVTSLSAFATDYEKVGEPVTEVYDSFAHKGANQNWWMAQAKNGLIYNGTGTGLNEWDGEQWSIYRTPQKSRIRSLSIWKDDNIYIGTTNDIGYYYANKSGSLTYKSLLNDWTFEEKQFGEVWSVASNNNGVLFLSNKIFTSFGNGPFYKVKMKTQCRFRTKVF

SEQ ID NO: 19621 - DNA, 780 bp, Unknown
  Obtained from environmental sample
  misc_feature (1)..(780): n is a, c, g, or t
gtgaaaatttatagtgctaatgttgatcgtttaaaaaacattccaaaacaagctgttattaatattcgtaaaataactgatttaaataataaaagtgaaatctatggtggtcttggacctgtaatactgcccacattaacgcaggaaaacaattcaattagaattaactttgctctagctgataatagcattgccaatgctattggttccaatgacgtgctttacaggcaccgtttattaggcagtggaaatcaaaactttaccgaatggggtgatgaaaaccgtaaagattttacattgttacaaggcaatgattaccaatttgaagtagaggcaaaagatgcctggggaagaataagcaaaaccagttttaaatacagtgtattgcccccttggtatttgagtaatttggcatggactgcgtattcatttatcgccctctttttattatttatcagttcatggttcactcaaaagtggcgaacaaaacagttgaaacttaaaaacttagagttggaacaagttgttcaagaaagaactgcagatgttctagaaaaagccaatgcattaaaacaacaacaagaaattaaagaccgattttttagtaatgtatcacatgagtttcggacaccattaacactaacaattgctccactacaggcgtttttggatgacaacaaagaactggataattctttactacacccgattaaaacagccttaagaaattctaaaaaaatgctgtcattagtgagtcaagttttagacatcaaccgatag

SEQ ID NO: 19622 - protein, 259 aa, Unknown
  Obtained from environmental sample
  DOMAIN (196)...(258): His Kinase A (phosphoacceptor) domain
  misc_feature (1)..(259): Xaa is any amino acid
MKIYSANVDRLKNIPKQAVINIRKITDLNNKSEIYGGLGPVILPTLTQENNSIRINFALADNSIANAIGSNDVLYRHRLLGSGNQNFTEWGDENRKDFTLLQGNDYQFEVEAKDAWGRISKTSFKYSVLPPWYLSNLAWTAYSFIALFLLFISSWFTQKWRTKQLKLKNLELEQVVQERTADVLEKANALKQQQEIKDRFFSNVSHEFRTPLTLTIAPLQAFLDDNKELDNSLLHPIKTALRNSKKMLSLVSQVLDINR

SEQ ID NO: 19623 - DNA, 471 bp, Unknown
  Obtained from environmental sample
  misc_feature (1)..(471): n is a, c, g, or t
gtggcgaataacttttctagagtccaatgggaatatgacataaaaaatgaaaaatactccagaaaaaaagtaaacaataaattcttgccagaatacaattgggtttggtctaatcaaggtgccattaatatgcatttgccagaaaactggggatacattcatttttctgataataatcctacagaacaaatagaattcaaacatcaaacagatgtgttaacagaacaagtcacgtatgcgttgtttagaaacattgcttttaaaaagttaacctatttaaaaaaagaaaaaactggatttcaaattcagtttgaacctataaaaataaataaagaaactatcaatgcctcctttttaaaaacccacacaggttttactttgcaaacacaaaacacacaaaaaaacatcctatattcaatcagtgaaaacggattaattcatcgtaaaaaaatcaataacactaaaaaataa

SEQ ID NO: 19624 - protein, 156 aa, Unknown
  Obtained from environmental sample
  misc_feature (1)..(156): Xaa is any amino acid
MANNFSRVQWEYDIKNEKYSRKKVNNKFLPEYNWVWSNQGAINMHLPENWGYIHFSDNNPTEQIEFKHQTDVLTEQVTYALFRNIAFKKLTYLKKEKTGFQIQFEPIKINKETINASFLKTHTGFTLQTQNTQKNILYSISENGLIHRKKINNTKK

SEQ ID NO: 19625 - DNA, 945 bp, Unknown
  Obtained from environmental sample
  misc_feature (1)..(945): n is a, c, g, or t
ttgttctatttagtattaaatcctgcgaaagcaatttcgacagcattttataatattcaaaaaggaaatgcatctgctgaaagaattttaaatgttttagaaactgaaaatactattgttgataagccaaatgctatagaaaaaatcaattttgaaaataacattagttttgaaaacatttcatttaaatataaagatgaatatgttttaaaaaaattctcattaaatattcctaaagggaaaacagttgcactagttggacaatcaggtagtggtaaatctactttagccaatttaattactcgtttttatgatgtaaacaaaggagtaattaaaattgacaatgttgatataaaagatatcaaacaaaaatctttacgtggattaatgggaattgttactcaagattcaattttatttaatgatactgttaagaacaatattagtttaggagttgaacaagcaactgatgaagaagtaaaagaagcttcaacaatttcaaatgctcatgaatttataaaagacttgcctttaaaatatgaaaccaatattggagatagtggtaatacgctttctggtggacaaaaacagcgattgagtattgctagagctgttcttaaaaatcctccaattatgattttagatgaagcaacatcagctttagatactgaaagcgaacaattggttcaaaaggcattggaaaaaatgatggaaaacagaacatctttagttattgcacatagattgtctacgattcaaaaagctgatttaatagtagtaatgaaaaaaggtgaaattgttgaaacagnaaaacatcaggaattactcgataaaaaagagaatatttcaaactgttactatgcaaacattataaaaaaaaagagggaaattaaaattcctcctttttttttaatttttcaaaccctattccttctgcccttttga

SEQ ID NO: 19626 - protein, 314 aa, Unknown
  Obtained from environmental sample
  DOMAIN (80)...(264): ABC transporter
  misc_feature (1)..(314): Xaa is any amino acid
MFYLVLNPAKAISTAFYNIQKGNASAERILNVLETENTIVDKPNAIEKINFENNISFENISFKYKDEYVLKKFSLNIPKGKTVALVGQSGSGKSTLANLITRFYDVNKGVIKIDNVDIKDIKQKSLRGLMGIVTQDSILFNDTVKNNISLGVEQATDEEVKEASTISNAHEFIKDLPLKYETNIGDSGNTLSGGQKQRLSIARAVLKNPPIMILDEATSALDTESEQLVQKALEKMMENRTSLVIAHRLSTIQKADLIVVMKKGEIVETXKHQELLDKKENISNCYYANIIKKKREIKIPPFFLIFQTLFLLPF

SEQ ID NO: 19627 - DNA, 855 bp, Unknown
  Obtained from environmental sample
  misc_feature (1)..(855): n is a, c, g, or t
atggctcggatacgaagattgtattattgttgctccaactcgagttttgattatcgtattttaaaaacagaatacaaacgtttaggatatcaatttaaaagagacacattgtgtacggttgaattaagtagaaaaataattccagacaaaccttcgtacagtttaggtaaattatgtaaatcactcggaataccaatgaatgatagacatagagcttctggtgatgcactcgcgaccattcaactttttaaattattgttaaataaagatgttgacaaaacaatactaaaaagtaccattaaacattttgattctaagaaggttgcagaaaaactagctggtttagtagaagtaattcccacaattatgggcgtttattatttgcataaagatgatggagaaattatttttatgggcaaaggaagtaacataaaaaaagatcttacaaatcagtttgtaaaaacgacaaaacgagcacttaaagttcaagaaaaaacagcttcgataagttacgaatctactgggaatatgttgcttaccagcttaaaatattttttagaattagatgtaaacaaacccaaatacaatttaaagagtaaaaaaagaatgctatcagaaagctttaatagcgacaatatgttgttgactgataaaggaagaactatggatgagcgttctataattgtaattgaaaataacgaggttttaggatattgttttaccaatttggcttttcaagaaagtcaaatgagcattttaaaagaaatgcttactcctattttaaataaagagttggctaaaaccatcataaaaaatattttaaaaataaatcgttttaaaaatataagattctag

SEQ ID NO: 19628 - protein, 284 aa, Unknown
  Obtained from environmental sample
  misc_feature (1)..(284): Xaa is any amino acid
MARIRRLYYCCSNSSFDYRILKTEYKRLGYQFKRDTLCTVELSRKIIPDKPSYSLGKLCKSLGIPMNDRHRASGDALATIQLFKLLLNKDVDKTILKSTIKHFDSKKVAEKLAGLVEVIPTIMGVYYLHKDDGEIIFMGKGSNIKKDLTNQFVKTTKRALKVQEKTASISYESTGNMLLTSLKYFLELDVNKPKYNLKSKKRMLSESFNSDNMLLTDKGRTMDERSIIVIENNEVLGYCFTNLAFQESQMSILKEMLTPILNKELAKTIIKNILKINRFKNIRF

SEQ ID NO: 19629 - DNA, 366 bp, Unknown
  Obtained from environmental sample
  misc_feature (1)..(366): n is a, c, g, or t
ttgaatacttctggtgagattagaatccacatagaaggaaaagcgaataaagacgcttacgaaagagctttagatgtttttaatgaattaaaaatgcatcaaacagaacaaagaaatggtgtgttgatttatgtggcaacagaagatcaaaaatttgtaatttgtggtgatgaagggattaataatgtggttgctgatgatttttgggattctacaagagatgtaattgctgaacattttaaaaaggggaattttaaaaatggaattgtagcaggaattttaagtgctggaattcaattgaaacagttttttccttggcaaactgatgatgaaaacgaattgtctaacgaaatttctaaaggatga

SEQ ID NO: 19630 - protein, 121 aa, Unknown
  Obtained from environmental sample
  DOMAIN (2)...(103): Domain of unknown function (DUF477)
  misc_feature (1)..(121): Xaa is any amino acid
MNTSGEIRIHIEGKANKDAYERALDVFNELKMHQTEQRNGVLIYVATEDQKFVICGDEGINNVVADDFWDSTRDVIAEHFKKGNFKNGIVAGILSAGIQLKQFFPWQTDDENELSNEISKG

SEQ ID NO: 19631 - DNA, 852 bp, Unknown
  Obtained from environmental sample
  misc_feature (1)..(852): n is a, c, g, or t
ttgaacactattttaaacaaaggcattagagcaaaagtttctttaaagaaatttaataacggaggtaaagattttgattacggaactatttttattcctgtacagaatcagaaattaaatgcggttgacttatatacctttttagaaaaagtagctaaaaacagtcatgtgcatgtgtacggaacaagaactggtttaaatgaaggggtggatttaggttctaataacttcagtaatataagtccaaagaaaatagcaatgttagttggagacggaatttctagttctgatgctggagaaatttggcatttattcgatacacgttttgatattaaaataacaaaactagacatgtcttatgtgggtagaacagatttgagtaaatactctacattaattgtaccaagtagccgtggtgttgataaaggaacagaagcgaaccttaaaacatgggttagaaatggtggcgttttaataggatatagaagtgctgcaagatggttggcttcaaagaagtttatcaacgtagaatttgaaaaagcagcacctcctacaaatcctgttacgttcgaaaatagaggattgcgttctggagcacaagtaattggtggtgccattttcaacacaaagttagatgtttcgcatccaattaactttggttacaaaaacgatgaattgccaatgtttagaaatacaaccatctttataaaaccaaacaaaacgaattataaacatccaattcagtatactaaaaatccgttattggcaggttatatttctaagcaaaaacttaaaagtattagcagggtcaggttccttttcaagtacaaagaatgggtagaggtagggtga

SEQ ID NO: 19632 - protein, 283 aa, Unknown
  Obtained from environmental sample
  misc_feature (1)..(283): Xaa is any amino acid
MNTILNKGIRAKVSLKKFNNGGKDFDYGTIFIPVQNQKLNAVDLYTFLEKVAKNSHVHVYGTRTGLNEGVDLGSNNFSNISPKKIAMLVGDGISSSDAGEIWHLFDTRFDIKITKLDMSYVGRTDLSKYSTLIVPSSRGVDKGTEANLKTWVRNGGVLIGYRSAARWLASKKFINVEFEKAAPPTNPVTFENRGLRSGAQVIGGAIFNTKLDVSHPINFGYKNDELPMFRNTTIFIKPNKTNYKHPIQYTKNPLLAGYISKQKLKSISRVRFLFKYKEWVEVG

SEQ ID NO: 19633 - DNA, 330 bp, Unknown
  Obtained from environmental sample
  misc_feature (1)..(330): n is a, c, g, or t
atgagtacagataaacactcgtcgcgaggacgacaatcaggaaacaacagtggttttcaagggaagaaaaaagagtataaaaaaataaaaactgctccaaaagcaaatccggaagacggaattcgattgaacaaatacatttctaactcaggagtttcttcgagaagagaagcagataagttgattgcttctggaaatgttactgtagatggtgtggtgatcacagaaatgggatttaaagtaaaaccaggaagtgaagttcgttttgatggatcgtcaattactccagaagaaaaaaaatacattttattaaacaaaccaaaaaattaa

SEQ ID NO: 19634 - protein, 109 aa, Unknown
  Obtained from environmental sample
  DOMAIN (41)...(87): S4 domain
  misc_feature (1)..(109): Xaa is any amino acid
MSTDKHSSRGRQSGNNSGFQGKKKEYKKIKTAPKANPEDGIRLNKYISNSGVSSRREADKLIASGNVTVDGVVITEMGFKVKPGSEVRFDGSSITPEEKKYILLNKPKN

SEQ ID NO: 19635 - DNA, 696 bp, Unknown
  Obtained from environmental sample
  misc_feature (1)..(696): n is a, c, g, or t
atgtgtttgttaaatttagaaaaagaattaaatccaaatttatcatcagcatttatcaatcaaaaagcatcttttttagcgcgattaggttcaggaagcgcaagcagaagtgtagaaggcccgttggttgtttggggaaatcatccaaaaattaaaggaagttcagatttgtttggtgtacaatttccatataaagtgcattcggttttcgaaaattatcaagatgcaattttattagttgataaaggagaaaaaccagtttctagcacagttggacacaatttaatgcacaaacatcggtatgccgaacagcgttttgtgcaagcaaatgaaaatcttacaaagctttctgaaatacttcaaaatggagatgtagatgcatttataaacattgtagaaagtgaagcattaaccttacatgcaatgatgttaacaagcaatccgtattttattttaatgaaaccaaatacgttgaaaatcatcaataaaatttggaaatttagagaagaaactcaaagtaaaatctgttttacgttggatgcaggagcaaatgtacatgtgttgtatccagagaaagaaaaagaaaaagtgaatcattttatacaagaaattttggctaattattgccaaaaaaagcaatatatttttgatgctgtaggatttggtgcaaaaaaagttgtaaattacaatcactaa

SEQ ID NO: 19636 - protein, 231 aa, Unknown
  Obtained from environmental sample
  misc_feature (1)..(231): Xaa is any amino acid
MCLLNLEKELNPNLSSAFINQKASFLARLGSGSASRSVEGPLVVWGNHPKIKGSSDLFGVQFPYKVHSVFENYQDAILLVDKGEKPVSSTVGHNLMHKHRYAEQRFVQANENLTKLSEILQNGDVDAFINIVESEALTLHAMMLTSNPYFILMKPNTLKIINKIWKFREETQSKICFTLDAGANVHVLYPEKEKEKVNHFIQEILANYCQKKQYIFDAVGFGAKKVVNYNH

SEQ ID NO: 19637 - DNA, 939 bp, Unknown
  Obtained from environmental sample
  misc_feature (1)..(939): n is a, c, g, or t
atgcaaacaaaacaaatcgaaacagcggttagtgaagttcaatttactagtgacaaagattgtgatattagtgcggtgtatcaaaatggtttgttgaatatttctgttggggaaagagtaggagaaggtgactacgatgggaaattacgattcttatttgaaaatatgcctgttgaaattccggtaattattgaagtttccaatggaaaaacaggcgaaaatagaatcaagaatggcgattttgaacatggacgctcatactggtttggccccaaagagaaaagtaaatttaatatttcaaatggtatcggtgttaacaagtctgccggtttgaaattgactggtaaagtattttgtgggcagtcagtggtgacaataaaggttagaaatggtgaagattatggtatctactatgacatcatgggcacaggctcagtaggtgttgcgtaccagattctaaatgctgataaaaaggtgatctatccacccatgctcaaggctgagacgttggcagcaaaaggaaatccgaaccaatggcggcgtataaaccaagtgctgcatattagtagacccggtgcatgttatatgcggttctttatgttatcgaattatgcagagaaaaatcctgaggctgaaatttatgtagataatttttctcttgttcgtctggatggtcgtatgacgatggctaaagttctttggcagggaactttcagcaagcctaaaagcaacataaatattgacggagatattaacgattggcaagacgtcatcccgatggtagtttacaccaaagatagagtcgactggccacgggaaaaaagtcgtgttccatggaatagtcctgctgacctaagtgcccaatgcagagtgatgaaggacaatgaaaatctttatttttcctttgaaattacgatgaaaaagtttacaggggactga

SEQ ID NO: 19638 - protein, 312 aa, Unknown
  Obtained from environmental sample
  DOMAIN (73)...(223): Carbohydrate binding domain
  misc_feature (1)..(312): Xaa is any amino acid
MQTKQIETAVSEVQFTSDKDCDISAVYQNGLLNISVGERVGEGDYDGKLRFLFENMPVEIPVIIEVSNGKTGENRIKNGDFEHGRSYWFGPKEKSKFNISNGIGVNKSAGLKLTGKVFCGQSVVTIKVRNGEDYGIYYDIMGTGSVGVAYQILNADKKVIYPPMLKAETLAAKGNPNQWRRINQVLHISRPGACYMRFFMLSNYAEKNPEAEIYVDNFSLVRLDGRMTMAKVLWQGTFSKPKSNINIDGDINDWQDVIPMVVYTKDRVDWPREKSRVPWNSPADLSAQCRVMKDNENLYFSFEITMKKFTGD

SEQ ID NO: 19639 - DNA, 936 bp, Unknown
  Obtained from environmental sample
  misc_feature (1)..(936): n is a, c, g, or t
atgatggctgggcttcagaggcacattagggttaaagttatgcaatgtatttatgcattgacacaatcgaaggatgattctcttgaaaaacaagagaaatttttgaaagtaagcatagagaacatgtacactctttacctgttaatgctgagtctttttatagagttacatgaaagggcggagaatcagattagcctttcctccaaaaaatatctaaaaaacaatacagattcctatcccaacaaggaaaaattcctaagaaataaacttttgcttcaaattgcgggaaacaagacgttaaaagatgaattatccaaaagaaaattgaacaactggtatttgaacgaagaatacatcaggataatttacaatgaggttatggaaagtgagatatatgccaaatatatgtccaatgctgatagtacttatgaggaggacaaaaggcttataatcgatttgttccgagagatcattgcgcccaatgaaaagatttacgattattttgaagatgacaaattaacatgggtagatgatatacccattgtaaacacctttctcttaaagcagtttaaaaaagtaaaggaaagtactgtcccttcttattttttaccgcctctttttaaggatgaggatgatatggtatacgccaataggctattgacgaaaactttgctgaacaattccaaattggaacaagagatcgaaggtaaaacacctaattgggacaaggatcgaattgcagatattgatgccatacttttgaaaatggcaatttgcgaactactcaattttccctctataccggaacgggttactataaacgagtttttagaaattgcaaaggaatactccactcctcagagtagcatattcattaatggaatattggataagctggtgagagaatataaggaggatgggaaactaaaaaagtag

SEQ ID NO: 19640 - protein, 311 aa, Unknown
  Obtained from environmental sample
  DOMAIN (181)...(303): NusB family
  misc_feature (1)..(311): Xaa is any amino acid
MMAGLQRHIRVKVMQCIYALTQSKDDSLEKQEKFLKVSIENMYTLYLLMLSLFIELHERAENQISLSSKKYLKNNTDSYPNKEKFLRNKLLLQIAGNKTLKDELSKRKLNNWYLNEEYIRIIYNEVMESEIYAKYMSNADSTYEEDKRLIIDLFREIIAPNEKIYDYFEDDKLTWVDDIPIVNTFLLKQFKKVKESTVPSYFLPPLFKDEDDMVYANRLLTKTLLNNSKLEQEIEGKTPNWDKDRIADIDAILLKMAICELLNFPSIPERVTINEFLEIAKEYSTPQSSIFINGILDKLVREYKEDGKLKK

SEQ ID NO: 19641 - DNA, 723 bp, Unknown
  Obtained from environmental sample
  misc_feature (1)..(723): n is a, c, g, or t
atgcctatatttttaatagttagtttgttattaattttctattatatcaatcgccaacctgtcaaagaacttttaattaacgatatttcttatcaaacactcaaagatcttggagaatctgaagcgccaaagttattcgcattattagatgaaaaatatacaaaattagatttattatacgaagataaaatacaaatagctttcttaaaaggattaggctattacaaacaaggagattacacaaatagtgtacaacagttaaaacaagccattgaaatttcagaaaaaaatcaaaacattttagcctctgctgatgcacatactttattagctgatatttatgtttatcaatctaaatacgatgagaaatggcaacatttaaatgctgctgaaaaaatatacacacaactatcaaatacccaaggattagataatgtgatggtgtcacgaggacgctactatattgcgattgatgattttgataaatcttttcaggtgtttaatcaattattaaaacaagcaaaggaaaataataacataccaacccaagttgctgttttatataacacatcacatttgtaccaacttttaaataagttcgataaggccaaaaatgatcttaaccaaatgttagagttatccttaagcattggtgacggtgaaaatctagcaaaagcatacagttcactgtctaatattaacaaattgcaaggccatttatga

SEQ ID NO: 19642 - protein, 240 aa, Unknown
  Obtained from environmental sample
  misc_feature (1)..(240): Xaa is any amino acid
MPIFLIVSLLLIFYYINRQPVKELLINDISYQTLKDLGESEAPKLFALLDEKYTKLDLLYEDKIQIAFLKGLGYYKQGDYTNSVQQLKQAIEISEKNQNILASADAHTLLADIYVYQSKYDEKWQHLNAAEKIYTQLSNTQGLDNVMVSRGRYYIAIDDFDKSFQVFNQLLKQAKENNNIPTQVAVLYNTSHLYQLLNKFDKAKNDLNQMLELSLSIGDGENLAKAYSSLSNINKLQGHL

SEQ ID NO: 19643 - DNA, 357 bp, Unknown
  Obtained from environmental sample
  misc_feature (1)..(357): n is a, c, g, or t
atgacaaaaattacttctttaaaagaaaaatggaatttgttagttgagaatttatcaacgcaatttgctgatggagatcccttagatatcgatgcaattatttatttaattggcattcaagaattaggacaaggacaccgaaaatttaagaaagacgaaaaaataaacttaatgcatattgccatttgcaaattgttagaaccttatggttattacgaatttgagttttttgataatgatggctggccacattacaaaaccacaaatcaattgccaaatttaaaacctggcgaacaatcagtattgatgaaagaagccattgtttcgtattttgaggggttagatttttttaagtaa

SEQ ID NO: 19644 - protein, 118 aa, Unknown
  Obtained from environmental sample
  misc_feature (1)..(118): Xaa is any amino acid
MTKITSLKEKWNLLVENLSTQFADGDPLDIDAIIYLIGIQELGQGHRKFKKDEKINLMHIAICKLLEPYGYYEFEFFDNDGWPHYKTTNQLPNLKPGEQSVLMKEAIVSYFEGLDFFK

SEQ ID NO: 19645 - DNA, 1101 bp, Unknown
  Obtained from environmental sample
  misc_feature (1)..(1101): n is a, c, g, or t
ttgcaaaacccactgagatttcagtgggttttcattttccaatacatcatctttctttatattcgttcaataaatattattatgaaaataaagatcaaaaaatatgtacttccgttaaaacatactttcagtatttccagggaatcccatgattttcaagattctatgatcgttgccctggaactggatggtaaaacgggctatggggaggcaacatccaatccctactataaaataaccttcgaaaccatgcaggcggagattgaaaaggtcaggaaggcaatagaagatttcaattttattacaccagaggccttccatgcgttcttggtatccaaaaacttgagcaattttgctatttgtgcattggatcttgccgccaacgatctgtatggaaaaatactgggcaaaccattatatgaaatatggaatacggacaacagcagttatcccatcaccaattataccattggactggataccattgagaaaatggtggacaagatgaaagaaatgccctggcctatatataaaattaaactgggcaccgataatgatgtcgagataataagggaattgcgcaaacataccgatgccattttcagagtagatgccaattgtgcatggacggcggaggaaaccattgccaacgcccccttattgaaggatttgggcgttgagtttttggaacaaccacttaaagcggatgattggacaggaatggaagcggtgatgcaccaaagcgttcttcctgtaatagccgatgaaagctgcatagtggaaagtgatgttgagaaatgtgcgcttcattttaatggaattcacataaaattaacaaaatgtggtggccttaccccggcaaggcgaatgatcaaaagggcccaggaattgaatctacaggtaatggtggggctgtatgaccgaaatccacagttgggaatttcgggtcattgccccaacttaatttcctcaattggaataatgtggaaatggaccggcttcttgttttttgaaaaaagaaaattggccgacgggttgattctttcgggaaaaggggaaaagtattctttccttcttatggagggagacggaaaacctttt

SEQ ID NO: 19646 - protein, 367 aa, Unknown
  Obtained from environmental sample
  DOMAIN (148)...(356): Mandelate racemase / muconate lactonizing enzyme, C-terminal domain
  misc_feature (1)..(367): Xaa is any amino acid
MQNPLRFQWVFIFQYIIFLYIRSINIIMKIKIKKYVLPLKHTFSISRESHDFQDSMIVALELDGKTGYGEATSNPYYKITFETMQAEIEKVRKAIEDFNFITPEAFHAFLVSKNLSNFAICALDLAANDLYGKILGKPLYEIWNTDNSSYPITNYTIGLDTIEKMVDKMKEMPWPIYKIKLGTDNDVEIIRELRKHTDAIFRVDANCAWTAEETIANAPLLKDLGVEFLEQPLKADDWTGMEAVMHQSVLPVIADESCIVESDVEKCALHFNGIHIKLTKCGGLTPARRMIKRAQELNLQVMVGLYDRNPQLGISGHCPNLISSIGIMWKWTGFLFFEKRKLADGLILSGKGEKYSFLLMEGDGKPF

SEQ ID NO: 19647 - DNA, 384 bp, Unknown
  Obtained from environmental sample
  misc_feature (1)..(384): n is a, c, g, or t
atgaaattaaaaatgaccataaacaaaataaagtctataaacaatttaactattgaattacctgtagacaaagggctttatgctattacaggtcaaaatggtgctgggaaaagtacagtttccacttgcgcatctagtgtgttttttaatatgactatgaaagactattttggaaaaaccgaaagagacgcatttatagaatttgattacgatgggaacactaagaaatatttaaaaaattctattggtaaatggtttagccaaaagaatggatatataagtttaaaaggcttttatgaaggaagtttaatatttggaaatagatttagaaatacaaattattctaaccttagaaaacttgatagaattgatgaatctttataa

SEQ ID NO: 19648 - protein, 127 aa, Unknown
  Obtained from environmental sample
  misc_feature (1)..(127): Xaa is any amino acid
MKLKMTINKIKSINNLTIELPVDKGLYAITGQNGAGKSTVSTCASSVFFNMTMKDYFGKTERDAFIEFDYDGNTKKYLKNSIGKWFSQKNGYISLKGFYEGSLIFGNRFRNTNYSNLRKLDRIDESL

SEQ ID NO: 19649 - DNA, 561 bp, Unknown
  Obtained from environmental sample
  misc_feature (1)..(561): n is a, c, g, or t
atggcattaacttactttattaaacctgaagtgctcaatgaagaatacattgaggaagaccaagatttgccacagatacaaaaggacttagctaaagtttatgaactcatcgaaaaatctagatttaattcggcaattaaatgtctagatgccgtgataaaaaagcatggtaatcaattcgaatggcagttattgcaatttaaactgcttaaaaatcagaagaaccctgcttataaagaatccataattaaattgattaccatggatagacttaagccacatgaaactgataagttgataaaggtttggcagagtattggtgatgagcactcagaaataaattcaaatgatttgtataagttcggctggaacttatctaataacacacattatgaaacggctgaaagaatttttgcacagttgtatcacgaaaaagacaaacaccctaatttaggtatgtatgctaaaaagttatcagtaatttttggaaaattgaaaaataacgataaaaaacaacaatatgaactagtttcaactgaattaattcaggagttgaaataa

SEQ ID NO: 19650 - protein, 186 aa, Unknown
  Obtained from environmental sample
  misc_feature (1)..(186): Xaa is any amino acid
MALTYFIKPEVLNEEYIEEDQDLPQIQKDLAKVYELIEKSRFNSAIKCLDAVIKKHGNQFEWQLLQFKLLKNQKNPAYKESIIKLITMDRLKPHETDKLIKVWQSIGDEHSEINSNDLYKFGWNLSNNTHYETAERIFAQLYHEKDKHPNLGMYAKKLSVIFGKLKNNDKKQQYELVSTELIQELK

SEQ ID NO: 19651 - DNA, 336 bp, Unknown
  Obtained from environmental sample
  misc_feature (1)..(336): n is a, c, g, or t
atgggctgtgccgataaagttgtagctaaagagagtgccgaagaagctctagagtatcttaaatctatgacagatggagaatatcctaagccagatttaatcttcttggatatcaacatgccaagaatgaatggctgggagttccttgaagaatatgaaaagctagaactctctcaaaaagcatcaattgttttaatcatgcttagcacatcgctgaaccctgatgatgaaaagaaagcgatagacaatccactaattaacgattttgtaaacaagcctcttattaaagataatttaagagaaattattgagaagaattttctagaccgtttgtaa

SEQ ID NO: 19652 - protein, 111 aa, Unknown
  Obtained from environmental sample
  DOMAIN (5)...(110): Response regulator receiver domain
  misc_feature (1)..(111): Xaa is any amino acid
MGCADKVVAKESAEEALEYLKSMTDGEYPKPDLIFLDINMPRMNGWEFLEEYEKLELSQKASIVLIMLSTSLNPDDEKKAIDNPLINDFVNKPLIKDNLREIIEKNFLDRL

SEQ ID NO: 19653 - DNA, 429 bp, Unknown
  Obtained from environmental sample
  misc_feature (1)..(429): n is a, c, g, or t
ttgatcggctcgagagctatcgaaacaacagntagggttatatanggaggtcaaaaagagaatcctacttatgaagaagtaaactcaggtaaaacaggccatgctggagcagtaaaagttatatatgatattaggtcaacttcttatgaagaattatgcaaatatttttttgaaatacacgacccaacacaagtaaatagacaaggtccagatataggaaaacaataccgttcaggtatattttatttatcaatagaacaaaaaaagatagctaatcaaataaagagaaaattagaaaacaaaggtttaaatgtaactacagaaatcaccagagcgaatatattttggatagcccgtgaatttcaccaacaatattatgcaaaaaaaggcacgaaaccttattggcataaatataccaaacgattttaa

SEQ ID NO: 19654 - protein, 142 aa, Unknown
  Obtained from environmental sample
  DOMAIN (4)...(139): Peptide methionine sulfoxide reductase
  misc_feature (1)..(142): Xaa is any amino acid
MIGSRAIETTXRVIXGGQKENPTYEEVNSGKTGHAGAVKVIYDIRSTSYEELCKYFFEIHDPTQVNRQGPDIGKQYRSGIFYLSIEQKKIANQIKRKLENKGLNVTTEITRANIFWIAREFHQQYYAKKGTKPYWHKYTKRF

SEQ ID NO: 19655 - DNA, 909 bp, Unknown
  Obtained from environmental sample
  misc_feature (1)..(909): n is a, c, g, or t
ttgtcaaacccgatattcatcggttcgaaatgncaagagagaagaaaacaaaaagcaatgagtaaaaaaggtagagttcttgtagcaatgagcggcggtgtagattcatcggttgcggcagtcatgcttagagaacaagtttacgaagtaatcggaattacgatgaaaacctgggattatcaccgaagtggtggtgataacggaaaagaaacgggttgttgtacggtagagtcaatgaacgatgctcgtcacatcgccgtaaaccatggttttaagcatttcattgttgatattagagaagagttcggcgattgggtaattgatcgctttgtgggcgattatatggatggacgaacaccaaatccatgtgtgctttgcaatacgcatatcaagtgggctgcgttacttaaaagagcagataacttaggatgtgatttcatcgcaacaggacattatgcgaaagtccgcgaggaaaataatcgctatgtattgtcaagaggattagatcctaaaaaagatcaatcttatgcattatggggtgttgctcaaaaacatttagaaagaacaatttttcctttaggaggatattcaaaaccagagattcggcaaattgctgaagatcatggattgttgaatgtggctaataaaccggattcatatgaaatttgttttgtcccggacgacgattatcgaagatttttaaaagacaaagttccgggcctcgaggagaaaatgaaaggcggaaaattcgttgataaaaatgggaatattttaggcgaacatgaagggtatccgttttacactatcggacaaagaagaggtttaaatttaccaatgggtgttcccgtttatgtaaccgacatcaatgccgttacaaatacaatcactatggtgaaaaagaagatttga

SEQ ID NO: 19656 - protein, 302 aa, Unknown
  Obtained from environmental sample
  DOMAIN (24)...(302): tRNA methyl transferase
  misc_feature (1)..(302): Xaa is any amino acid
MSNPIFIGSKXQERRKQKAMSKKGRVLVAMSGGVDSSVAAVMLREQVYEVIGITMKTWDYHRSGGDNGKETGCCTVESMNDARHIAVNHGFKHFIVDIREEFGDWVIDRFVGDYMDGRTPNPCVLCNTHIKWAALLKRADNLGCDFIATGHYAKVREENNRYVLSRGLDPKKDQSYALWGVAQKHLERTIFPLGGYSKPEIRQIAEDHGLLNVANKPDSYEICFVPDDDYRRFLKDKVPGLEEKMKGGKFVDKNGNILGEHEGYPFYTIGQRRGLNLPMGVPVYVTDINAVTNTITMVKKKI

SEQ ID NO: 19657 - DNA, 495 bp, Unknown
  Obtained from environmental sample
  misc_feature (1)..(495): n is a, c, g, or t
atgattgcgaaaaaaataaccctacttatcctttttgttttcaatcagtatgtgatagcgcaaagcggtctttgggaaaagctgaaagaggaagatcaggtgttttcggaatttaccttggattatgagtaccgtgaaccagggctaagttttgatcctgatcagggaatcaaaatatcacgaagcaaaatcacagtatcgcaaaatgcgacagccttgaaaatggtcaattccttcagtcaggaaccaacctataaaaatcctgggtacagggactatagagaatatgactacaatcctgacggcgacctcataatttggcgaacgctggctaaacatgcgatttctaacctcaaagaaaacctctcggttctggaattgcaatcatgtaatatttctgaaattagaaaagtaacgaagttgccctccaggtatcgcaagacgcattttgatttaggcagcattgataatatctatgaatggagctccgtttaa

SEQ ID NO: 19658 - protein, 164 aa, Unknown
  Obtained from environmental sample
  SIGNAL (1)...(20)
  misc_feature (1)..(164): Xaa is any amino acid
MIAKKITLLILFVFNQYVIAQSGLWEKLKEEDQVFSEFTLDYEYREPGLSFDPDQGIKISRSKITVSQNATALKMVNSFSQEPTYKNPGYRDYREYDYNPDGDLIIWRTLAKHAISNLKENLSVLELQSCNISEIRKVTKLPSRYRKTHFDLGSIDNIYEWSSV

SEQ ID NO: 19659 - DNA, 669 bp, Unknown
  Obtained from environmental sample
  misc_feature (1)..(669): n is a, c, g, or t
gtggacaagcagaaaaaaattgaccagttggttgcctccaacaagatttccaaaaaccaggccgaacagctgcgcggcaaggtggagcagttggaatactacatcaagaaataccaaactgaaatcacggaactgcgtgccgaattggatgctaccaaggaggtcaatgagcaacttaccgcagaggttggcaatatcaagggcgaagttcgtgacctgcgccgcgccaaagagacggtggacttcaagctggaaacggctgccatactgaacgcccacaccttcaactattaccgtttgaaaggaagcggcaaagccattcaggaaaccagcttccgcagaggacaaatggacgaattccgttcctgtttccaactcaaccagaatctcgctgcaaccgccggtccccgcgacctgtatatccagatcaaagatccttccggtaaggtgatcaaagatgaagccggtggaaagagtggctattttacttacgaggaccaggacatcgcctataccctcaaaaagaccatcgattacgaccgcactaccaaggaagtctgtttcgactttatcaagcctgaaagttacgattacgaaaaaggcaatcactctgtggtcatctattgcgaaggctacgacattggtaaaggtaaatttgaagtcaaatag

SEQ ID NO: 19660 - protein, 222 aa, Unknown
  Obtained from environmental sample
  misc_feature (1)..(222): Xaa is any amino acid
MDKQKKIDQLVASNKISKNQAEQLRGKVEQLEYYIKKYQTEITELRAELDATKEVNEQLTAEVGNIKGEVRDLRRAKETVDFKLETAAILNAHTFNYYRLKGSGKAIQETSFRRGQMDEFRSCFQLNQNLAATAGPRDLYIQIKDPSGKVIKDEAGGKSGYFTYEDQDIAYTLKKTIDYDRTTKEVCFDFIKPESYDYEKGNHSVVIYCEGYDIGKGKFEVK

SEQ ID NO: 19661 - DNA, 363 bp, Unknown
  Obtained from environmental sample
  misc_feature (1)..(363): n is a, c, g, or t
atggatagagttctaatcgatacagacgttcttctagatttcttctttgatagaaaaccatttgcagaatattcggcccaaattttaaatctttgtacagaaaaagaaataaaaggatttacaactccagtaattatctcaaacgtatactatttgcttagaaaaacagccaaacatgcatttgtagttgaaaaaataaaacaacttcttacttttattgatgtgataaaaatggataaaaccactgtaatacatgcgctgaattctgaatttaaagattttgaagatgcgctacaaaatttttcggcaatagaaaatggacagattaaaattattctgatcagaaatataaaagattattaa

SEQ ID NO: 19662 - protein, 120 aa, Unknown
  Obtained from environmental sample
  misc_feature (1)..(120): Xaa is any amino acid
MDRVLIDTDVLLDFFFDRKPFAEYSAQILNLCTEKEIKGFTTPVIISNVYYLLRKTAKHAFVVEKIKQLLTFIDVIKMDKTTVIHALNSEFKDFEDALQNFSAIENGQIKIILIRNIKDY

SEQ ID NO: 19663 - DNA, 729 bp, Unknown
  Obtained from environmental sample
  misc_feature (1)..(729): n is a, c, g, or t
ttgtttgacggttcctgtgcgttagaggacattttaacatatttatgtgattttgtcctatggatttcctgtctaactttacaaaaagcaacaattatgataagggtagtaatatatgaggataatccccaatttcgcgaagggcttaccatgttgatcaatggtagtgatgggttttccgttttggcgtcttacaagaattgtaacaatgttgccgaagaggtaaaaaaatggtcgccagacgtcattttgatggatatcaatatgcccggaaccgacggcctggaaggattaaaaaaaattagggaagtgaacgccgaggtcaaggtattgatgcttaccgtctttgacgacaacaaaaatgttttcgaggcgctaaggaacggggccaatggttatttgctaaaaaagacccctcctgccaaattattggaatatattcaggatgccaccttgggcggagctcccatgacttcctccatcgccacccaagtgctaaaaatgttccaggttataccgcagaccaagaaccaggactattgcttaagtgaaagggaaacagaggtactacaacttctagtagatggctatagctataaaatgattgcttcggaactttttatagctattgatacagtccgatcacacatcaaaaaaatttacgaaaaactgcatgtaaatagtaagagcgaagccgttgccaaggcatttaaggataaattgctataa

SEQ ID NO: 19664 - protein, 242 aa, Unknown
  Obtained from environmental sample
  DOMAIN (179)...(236): Bacterial regulatory proteins, luxR family
  misc_feature (1)..(242): Xaa is any amino acid
MFDGSCALEDILTYLCDFVLWISCLTLQKATIMIRVVIYEDNPQFREGLTMLINGSDGFSVLASYKNCNNVAEEVKKWSPDVILMDINMPGTDGLEGLKKIREVNAEVKVLMLTVFDDNKNVFEALRNGANGYLLKKTPPAKLLEYIQDATLGGAPMTSSIATQVLKMFQVIPQTKNQDYCLSERETEVLQLLVDGYSYKMIASELFIAIDTVRSHIKKIYEKLHVNSKSEAVAKAFKDKLL

SEQ ID NO: 19665 - DNA, 918 bp, Unknown
  Obtained from environmental sample
  misc_feature (1)..(918): n is a, c, g, or t
gtgagtatacgagttataaaccttcacccgcagcactcaaatatacgcggaactctgcctgcggttatgggccgctgttttgtcgagcatgaagttaaagatgagattatcttcaaagagatcgataccaagcttgataccattcattttcttcctggggctgacctgggtgtgcttgttcatcgaggaactatcgaagtcaatgaagacgatgcgcgagatataaaaaagattattgttagtcatgaaaacgtgtctgacgaaaagcgttcacctgatcattacagggaccagctggaaaaacgcacaaatactgaagtgtcataccagtatctcctggatacgaaaccgctaatcccgactggatataaatgcggctttaagattatccaggaaaatagcgagcactcagaaaatgtgctgatgaaagaaaaccttaaaacattcacagatgggaaaaagacagaggctgaaaaacagcagtctgaagctcttttgcaacagctggatgacttcaaaaaaaatggcgcagataccagtgctatagaagctgagctaaaaaaggttaaagaactgtctaaggcagcaactgaagacacgcctgaaagtaagagaataaaagatgcagtcaataagatatcgccggatttaaatggtccatcatccgagtttgatatttcaaaggtcgatctaaaagctatcgatcaactaaaggctgttgttaaggaaatcgaggatgaaaagaagcaggattctattcaaaacttaaaagaccagatcaatgaagcaaggaagagtggttttgataaagaagccgataaacttcagtatctccttgatagtcttttactaccccctgtcttaccacgtgtcgataaggcaagcttgctaacccaggttgaagacaggccggactga

SEQ ID NO: 19666 - protein, 305 aa, Unknown
  Obtained from environmental sample
  misc_feature (1)..(305): Xaa is any amino acid
MSIRVINLHPQHSNIRGTLPAVMGRCFVEHEVKDEIIFKEIDTKLDTIHFLPGADLGVLVHRGTIEVNEDDARDIKKIIVSHENVSDEKRSPDHYRDQLEKRTNTEVSYQYLLDTKPLIPTGYKCGFKIIQENSEHSENVLMKENLKTFTDGKKTEAEKQQSEALLQQLDDFKKNGADTSAIEAELKKVKELSKAATEDTPESKRIKDAVNKISPDLNGPSSEFDISKVDLKAIDQLKAVVKEIEDEKKQDSIQNLKDQINEARKSGFDKEADKLQYLLDSLLLPPVLPRVDKASLLTQVEDRPD

SEQ ID NO: 19667 - DNA, 303 bp, Unknown
  Obtained from environmental sample
  misc_feature (1)..(303): n is a, c, g, or t
atgaagctagggcgttcttattttccaaaaattgagtcttttaatttcgatgacaccaataaaactgaaatcattcaaaatataaaaagcgactttagagaagccttagaaggaatttcaaaattacctgataattctagattgggtgtttatgtggcttacaaatattacctaacactacttaaaaaattatccactcttgaagttaaaaatatcatagcacatcgagtaagaatatcgaactttcagaagatgtacattcttaaaaaatcactcattcgatacaatttaaatgttctttaa

SEQ ID NO: 19668 - protein, 100 aa, Unknown
  Obtained from environmental sample
  misc_feature (1)..(100): Xaa is any amino acid
MKLGRSYFPKIESFNFDDTNKTEIIQNIKSDFREALEGISKLPDNSRLGVYVAYKYYLTLLKKLSTLEVKNIIAHRVRISNFQKMYILKKSLIRYNLNVL

SEQ ID NO: 19669 - DNA, 624 bp, Unknown
  Obtained from environmental sample
  misc_feature (1)..(624): n is a, c, g, or t
gtgccgcaggtgatattcttggagcagagcaaagcaggttttatcaacgacattggctttgatttatacactaaaattttaaacgatgctgtccgagagctaaaagaatctgaatttagctacatgtttgaaggcatagaagctgaaatcgatctccccgaaacactcgttgaatttgatgaatcagcccttcttcctacaaactatgtgaacgataatgtggaaagattgaatctttaccgcaaattatctcaagctaaaacggaaaaagaaattattgaatgggaggatgaaattgtggatagattcggtcctgcccctaaagaagcaaagtatttaattgaggcgagtaaaattaagctttacgcttctcaatgtatgtttaccaaggtaaccatccgttccaaaagaatgtgggcggtttgcccaaaaccagaatcaaaaattggaactcatttttacgatagcggaaagttccaagcaattatggaaggtcttggcaaactccgcgctgacaaatatcagctggttcaaaaaaatgatattatgcgtttcgcaattcaagatattgatgacatctttgcggtaactccatttttaaagcaattactaaacacccattga

SEQ ID NO: 19670 - protein, 207 aa, Unknown
  Obtained from environmental sample
  DOMAIN (58)...(169): TRCF domain
  misc_feature (1)..(207): Xaa is any amino acid
MPQVIFLEQSKAGFINDIGFDLYTKILNDAVRELKESEFSYMFEGIEAEIDLPETLVEFDESALLPTNYVNDNVERLNLYRKLSQAKTEKEIIEWEDEIVDRFGPAPKEAKYLIEASKIKLYASQCMFTKVTIRSKRMWAVCPKPESKIGTHFYDSGKFQAIMEGLGKLRADKYQLVQKNDIMRFAIQDIDDIFAVTPFLKQLLNTH

SEQ ID NO: 19671 - DNA, 918 bp, Unknown
  Obtained from environmental sample
  misc_feature (1)..(918): n is a, c, g, or t
ttggacacaaagaaggaattaaatgactcgctggggattgctagaagtttaaataatatcagagagatctatcaacagcaaagaaatacatcncaagccaaaaaatatttccaggaatcgttggagtatatgcttgctttatcttttaaagaaggtttagccgctgtatataacaatctcggagaggtttataaactggaagggaatataaatagagcgattgagtttcatacgttttcactggagatagaaaaggaatttgataacaagccgggaataggattaagctatttgaatatcgcttctctgttcagaattattgatcaacctaaggtggctattgacaactatcttgaaagcatcaaatattttaaagctgtaaatgatttgggcggattgcaaaaagcgtataatgatctggctacagcgtatgcagaaacggaaaattttaaagaatcactcgtttattttcaattgcatgcagatataaaagatacgctgatttcgattgagacaaaccgccagattgctcagcttcaaacagagtatgaatcagaaaagcaaaaacaagagatcgacttgcttaatgagacgtctgcattacaattagcgcaactggatcaagaaaaaagcacacgacggttactttttgtaattctttcactgttgataatcatcgctataattctatatatgagcgatcgctctaaaagaaaaatcaatcaaattcttataaataaaaataaagagatagaggaagcagcggcgttaaaggttcagtttttatcggttatgagtcatgaaatacgaacacctatgaacgctgttgtgggtatgactaatcttcttttagatgagaacccaagagaagatcaaaaaatatatctagacaccctttcatttcgtccaaaaacctga

SEQ ID NO: 19672 - protein, 305 aa, Unknown
  Obtained from environmental sample
  DOMAIN (54)...(87): TPR Domain
  misc_feature (1)..(305): Xaa is any amino acid
MDTKKELNDSLGIARSLNNIREIYQQQRNTSQAKKYFQESLEYMLALSFKEGLAAVYNNLGEVYKLEGNINRAIEFHTFSLEIEKEFDNKPGIGLSYLNIASLFRIIDQPKVAIDNYLESIKYFKAVNDLGGLQKAYNDLATAYAETENFKESLVYFQLHADIKDTLISIETNRQIAQLQTEYESEKQKQEIDLLNETSALQLAQLDQEKSTRRLLFVILSLLIIIAIILYMSDRSKRKINQILINKNKEIEEAAALKVQFLSVMSHEIRTPMNAVVGMTNLLLDENPREDQKIYLDTLSFRPKT

SEQ ID NO: 19673 - DNA, 636 bp, Unknown
  Obtained from environmental sample
  misc_feature (1)..(636): n is a, c, g, or t
ttgaaaaaaaccatttttgaacacttacatattgaatatcaacctggagaaaaaagattttggaccggtagaaaatctaatcctgatattggcaatcaatactggcatcaagaaattgaattattagacattaaaaacatcgccacaaaaaaaacagacatcgctttgttaggttatgtttgtgatgaaggtgttcgtagaaatttaggcagaattggcgctagtcaaggaccaactgctttaagagaacgactggcaaaattacccattcatttcgatacaaaaaaagttgctgattatggaaatatcatttgtgttaataaaaatatggaagcttgtcaaacacaattagcaaatactattgaatcatttcttttaaataacatttttccaattataattggcggtggacatgatatgtcttatggacattttaaaggaatttacaaagcaattaataaaagctcaaaaaagaaaatcggaattattaattttgatgcacattttgatttacgtaccgttgaaaaaaaatctaattcaggtacaccttttaatcaaataattagtgaatttgaaaatgtaacttatttttctattggaattcaacgacaatctaacaccaaagaattgttttga

SEQ ID NO: 19674 - protein, 211 aa, Unknown
  Obtained from environmental sample
  misc_feature (1)..(211): Xaa is any amino acid
MKKTIFEHLHIEYQPGEKRFWTGRKSNPDIGNQYWHQEIELLDIKNIATKKTDIALLGYVCDEGVRRNLGRIGASQGPTALRERLAKLPIHFDTKKVADYGNIICVNKNMEACQTQLANTIESFLLNNIFPIIIGGGHDMSYGHFKGIYKAINKSSKKKIGIINFDAHFDLRTVEKKSNSGTPFNQIISEFENVTYFSIGIQRQSNTKELF

SEQ ID NO: 19675 - DNA, 558 bp, Unknown
  Obtained from environmental sample
  misc_feature (1)..(558): n is a, c, g, or t
gtgagcacttctaaatcaacatcattcttatacaaactattaagtttactttcagtcattagaggttacaatattttagtgctaatattagcgcaatatttagctgcaatatttatattttccccaaaaaaatcgttgcactttgttttattagattatcaattattattgattgtattagcgtctgtttgtgtggtttcttcagggtatatcatcaataatttttacgatgtaaaagcagatattatcaacagaccaattaaaacaagtttagataatgtggtgagtcagaaaataaaattacaaatttattttttgcttaatttcttaggctttctctttggttgttttatttcttggaaagcagcgttgttttttgcagtgtatatntttgccatttggttgtattcacataaattaaaaaagcatccttttattggattaatttctgcagcagttttaacaattctgccatttttcgccatttttgtgtattatggaaatttctcaaaaaaatatttgtacacgcttcgntcttgttttttggggtggtggtaa

SEQ ID NO: 19676 - protein, 185 aa, Unknown
  Obtained from environmental sample
  misc_feature (1)..(185): Xaa is any amino acid
MSTSKSTSFLYKLLSLLSVIRGYNILVLILAQYLAAIFIFSPKKSLHFVLLDYQLLLIVLASVCVVSSGYIINNFYDVKADIINRPIKTSLDNVVSQKIKLQIYFLLNFLGFLFGCFISWKAALFFAVYXFAIWLYSHKLKKHPFIGLISAAVLTILPFFAIFVYYGNFSKKYLYTLRSCFLGWW

SEQ ID NO: 19677 - DNA, 783 bp, Unknown
  Obtained from environmental sample
  misc_feature (1)..(783): n is a, c, g, or t
atgtacgaagttattctctactacttttttaatacgattgaaaaccctgagcagtttgcaaaaacgcataaacagttttgcaaagaactcggtataaaaggtcggatctatatttcctccgaaggaataaacggaaccgctgctggcaccaaacagcagatggatgaatacaaagctgcgataagatctatcccaggatttgaaaaaaccgaattcaagaccgatgaatcggattacatcccgttttctaagctgatatgcaaagtacgcgaagaaattgtttctcttcatgtagacgatgttgatcccaagcatgggggaaatcacttgttgccttctgaatggagaaaagtgatggaaaccaacgatgattatgtgatgatcgatgtacgcaataactacgaatctaagattggacactttaaaggtgcgttgaaaccaaatctcgaaaatttttatgattttccgcaatggctagatgaagctgaaatccccaaagacaaaaaagtactgatgtactgcacaggtggaattcgttgtgagaaattttctgtgctgatgaaagaaaaaggttgggatgacgtaaaccagttacacggtggtattttacgctacgccaaagaagaagaaggaaaatactttgaaggaaaatgctttgtattcgatgatcgcctcgtcgttcccgtaaatccgaaagatctggcaccaatctcagcatgtgaaatcactggaaaacccgccgatacctacgtgaactgcgccaacatgctcgagccgatctga

SEQ ID NO: 19678 - protein, 260 aa, Unknown
  Obtained from environmental sample
  DOMAIN (111)...(208): Rhodanese-like domain
  misc_feature (1)..(260): Xaa is any amino acid
MYEVILYYFFNTIENPEQFAKTHKQFCKELGIKGRIYISSEGINGTAAGTKQQMDEYKAAIRSIPGFEKTEFKTDESDYIPFSKLICKVREEIVSLHVDDVDPKHGGNHLLPSEWRKVMETNDDYVMIDVRNNYESKIGHFKGALKPNLENFYDFPQWLDEAEIPKDKKVLMYCTGGIRCEKFSVLMKEKGWDDVNQLHGGILRYAKEEEGKYFEGKCFVFDDRLVVPVNPKDLAPISACEITGKPADTYVNCANMLEPI

SEQ ID NO: 19679 - DNA, 651 bp, Unknown
  Obtained from environmental sample
  misc_feature (1)..(651): n is a, c, g, or t
atgaataacagccaatccatagaaaattacttaaaagtgatttttaaccaagccatcgcttctgatgatgtcaataccacaagtattgcncaagctctggaagtcagccttccatcagttaatagtatggtcaaaaaattggcaggaatgggcttattggagtacgaaaaatacaagcctctcaagattactgctaaggggagaaagatggccgccatgatcatcaggaagcacaggcttacagaaatgtatctggtggaaaagatgggttttggttgggaagaagtacatgagatagcagagcagttggaacatatccaatcaacagccttttttgataggatggatgaaattttaggttaccctgagagagatcctcatggatcccctataccaacaagtagtggtgaaattgccacacaaaaattcaggttgctttctgattgtcagcctgaggagttggtaacattaaaggcattaagcaagacttcagatgaatttttaaaataccttaacagcaaaggcttggcattaggagtggaggtggagattttggaagtggagccttatgacaaaaacatgacggtatcttacggcggacataaagaagttttatcagccttggtatgttccaaacttttggtaagttaa

SEQ ID NO: 19680 - protein, 216 aa, Unknown
  Obtained from environmental sample
  DOMAIN (4)...(62): Iron dependent repressor, N-terminal DNA binding domain
  misc_feature (1)..(216): Xaa is any amino acid
MNNSQSIENYLKVIFNQAIASDDVNTTSIAQALEVSLPSVNSMVKKLAGMGLLEYEKYKPLKITAKGRKMAAMIIRKHRLTEMYLVEKMGFGWEEVHEIAEQLEHIQSTAFFDRMDEILGYPERDPHGSPIPTSSGEIATQKFRLLSDCQPEELVTLKALSKTSDEFLKYLNSKGLALGVEVEILEVEPYDKNMTVSYGGHKEVLSALVCSKLLVS

SEQ ID NO: 19681 - DNA, 372 bp, Unknown
  Obtained from environmental sample
  misc_feature (1)..(372): n is a, c, g, or t
gtggaacaggatggcgaacaaaaagatcttttcaatataaaaagtagagctatgatgccattaattgatgcagcaagattacttatcttgaataataaaataaaaggcatcaacaacacctctgaacgttatgaaaaattagcagaaatagatcctaataataaagaactatatgaatcttgttcgtatgcgtttaaggcgctcttaaaatttaaaacaaaacaaggcatcttgcataataattctggaaaatttatcgagttgaaaacattaaccaaagaagaacaattaaaactgcggcgctgctttaaacctatacacgaaattcaagaaagcctgaaattacgttttgacttaaaaaactttatataa

SEQ ID NO: 19682 - protein, 123 aa, Unknown
  Obtained from environmental sample
  misc_feature (1)..(123): Xaa is any amino acid
MEQDGEQKDLFNIKSRAMMPLIDAARLLILNNKIKGINNTSERYEKLAEIDPNNKELYESCSYAFKALLKFKTKQGILHNNSGKFIELKTLTKEEQLKLRRCFKPIHEIQESLKLRFDLKNFI

SEQ ID NO: 19683 - DNA, 666 bp, Unknown
  Obtained from environmental sample
  misc_feature (1)..(666): n is a, c, g, or t
atgaagttatcttggttcaataaaaagacacctacgcatccggatttttggaacgactatcttgattgttttaaagacactaaaaaaggtgatatccagaatacacgttttattgctttagatactgaaactactggttttaatatcaaagaagatcgggttttatccattggagctgtttcctttattgaaaaaaaaatccaagtaaacaatagcctagagctctatttagaacaagatgtttttaaacctgaaaccgttgaaatacacgggttaatgaaaaaaggtttactagaaaaggttactgaattagaagccataaaactatttttgtcctatataaaaaatgctgttttaatagctcatcatgctcattttgataaaaatatgattaatgaaatgcttttaagacatggtttgaatgaactaaaaaacgaatttatagacactggcattttgtataaaaaatcgaagcacattatttatcagagtacactaaaacccatctccttagacgacttatcaaaagaactaaatgttccttttatagatcgtcatactgctactggagatgctcctataacagccccttgttttcttaaaaatcttagctcgtttagaataaccccaacccctttaaatgggacttttttattaaacaaatag

SEQ ID NO: 19684 - protein, 221 aa, Unknown
  Obtained from environmental sample
  DOMAIN (14)...(201): CAF1 family ribonuclease
  misc_feature (1)..(221): Xaa is any amino acid
MKLSWFNKKTPTHPDFWNDYLDCFKDTKKGDIQNTRFIALDTETTGFNIKEDRVLSIGAVSFIEKKIQVNNSLELYLEQDVFKPETVEIHGLMKKGLLEKVTELEAIKLFLSYIKNAVLIAHHAHFDKNMINEMLLRHGLNELKNEFIDTGILYKKSKHIIYQSTLKPISLDDLSKELNVPFIDRHTATGDAPITAPCFLKNLSSFRITPTPLNGTFLLNK

SEQ ID NO: 19685 - DNA, 315 bp, Unknown
  Obtained from environmental sample
  misc_feature (1)..(315): n is a, c, g, or t
ttgccttttctaaagatattttgcaaggctaaaacaaccatccattgcctaattatttttttatccaataaatatttaatcatcatcattaataattttgttaataaggcgaaaataaaccaaatggcaattaagccaaaaaatatttgcaggctttgtttgacattattaatttcagaatacaataaaaccaaggtggcaataccagccataagtaaccatacccaaggcgttttacttaagctttgtttaacttcgtgtttatgcaaaacagccactggcttgatttctttaatgctttttaatgacaaatga

SEQ ID NO: 19686 - protein, 104 aa, Unknown
  Obtained from environmental sample
  misc_feature (1)..(104): Xaa is any amino acid
MPFLKIFCKAKTTIHCLIIFLSNKYLIIIINNFVNKAKINQMAIKPKNICRLCLTLLISEYNKTKVAIPAISNHTQGVLLKLCLTSCLCKTATGLISLMLFNDK

SEQ ID NO: 19687 - DNA, 333 bp, Unknown
  Obtained from environmental sample
  misc_feature (1)..(333): n is a, c, g, or t
atggactacaaaaaaaccgactcagctcacagcactattactagaaatgtgattgatatggccaaagatactggcaatatctatgagagcgtttctatcattggcaaaagagccaaccaaatatcaatggagattaaagaagagttggatggtaaactacaagagtttgctacccacactgataaccttgaagagatttttgagaatagggagcaaattgagatttcaaaatattatgagagtcttcctaagcctgtagccattgccatcaatgagtttaataatggtgatatctactttaggaacccaaccaaagaagaaggcgcattttaa

SEQ ID NO: 19688 - protein, 110 aa, Unknown
  Obtained from environmental sample
  DOMAIN (23)...(101): RNA polymerase Rpb6
  misc_feature (1)..(110): Xaa is any amino acid
MDYKKTDSAHSTITRNVIDMAKDTGNIYESVSIIGKRANQISMEIKEELDGKLQEFATHTDNLEEIFENREQIEISKYYESLPKPVAIAINEFNNGDIYFRNPTKEEGAF

SEQ ID NO: 19689 - DNA, 573 bp, Unknown
  Obtained from environmental sample
  misc_feature (1)..(573): n is a, c, g, or t
atggtaagtggtaaaggaacaaacggaacttcaattactttggacactgattccaaagaaaaattttcgaatttagaagaaacatattttagaaaattacaactttctaaaccagcaagatattggcacaaaaaatcaacgaaatattatacagatgctaataaaatgaaaaggattttgttgtgggtagttggtctttcatcacttttccttgccctaattttaaccatttccccgaaatggatttttgaaacagtattttcggaaaatagagctgcaattattagatggtcactcgtttttataacacttatatcacttatagcatttacggttagagcaattacaaaagttatgtttagttcatttcacttggctagggatgcagaagaaagacatactttaactttcttctatttgtccttgcttgccgagaaagattccacaattaatgatgaagatagaaaattgattttacaatcactatttagtagagccgaaacgggtttattaaaagatgattcaggtccaacaatgccgaatgattttattggaaaaattatgaataaataa

SEQ ID NO: 19690 - protein, 190 aa, Unknown
  Obtained from environmental sample
  misc_feature (1)..(190): Xaa is any amino acid
MVSGKGTNGTSITLDTDSKEKFSNLEETYFRKLQLSKPARYWHKKSTKYYTDANKMKRILLWVVGLSSLFLALILTISPKWIFETVFSENRAAIIRWSLVFITLISLIAFTVRAITKVMFSSFHLARDAEERHTLTFFYLSLLAEKDSTINDEDRKLILQSLFSRAETGLLKDDSGPTMPNDFIGKIMNK

SEQ ID NO: 19691 - DNA, 645 bp, Unknown
  Obtained from environmental sample
  misc_feature (1)..(645): n is a, c, g, or t
ttgaagtttttggatggacatgatatctataatgaaaatttattatacctgataaaacaaacaaactataggaaagtcagagagcgttgtctattaagttttaactttgatataaaggcttcctcttccatagatataggtttctcaattttagaaaatacaggttcaggtcatagcagtcttttttctctaattgaagaggacaatctttttgaaaaagttagtgattccgttgcctatgaagtgttgtcaaaaattgctgccaaagattttgataagatttataagattacaaaaaatctggatgctaagtatttaagaggaatgcttaacaatatcgaagtaaatgctgagacatttccttttatagtaagatttgtagttaaaaaagagtatgacgttgaaaaaaatctggatgcgacttctgatttggcaatactgacagaattcattaataatccaatgcatagtaataatattggtaatatcaatcaattgttgaaaaatagatattactcttttcaactaactttatataaatacatcgtatcagaatataagacccagaagatatcaaagaatgatgcggtgtggttgcttagagaaataaaaggagtacaattgagtgctttgctttttcaatag

SEQ ID NO: 19692 - protein, 214 aa, Unknown
  Obtained from environmental sample
  misc_feature (1)..(214): Xaa is any amino acid
MKFLDGHDIYNENLLYLIKQTNYRKVRERCLLSFNFDIKASSSIDIGFSILENTGSGHSSLFSLIEEDNLFEKVSDSVAYEVLSKIAAKDFDKIYKITKNLDAKYLRGMLNNIEVNAETFPFIVRFVVKKEYDVEKNLDATSDLAILTEFINNPMHSNNIGNINQLLKNRYYSFQLTLYKYIVSEYKTQKISKNDAVWLLREIKGVQLSALLFQ

SEQ ID NO: 19693 - DNA, 555 bp, Unknown
  Obtained from environmental sample
  misc_feature (1)..(555): n is a, c, g, or t
ttgattatggctcggagcacaatgagtgccatgattataaaagctcatgttagcgaaggtgttaaaatggcagaagaacacggtcttcctaaaacaattataaacttcattgagtctcatcacggtacctcggtaattagatatttttatgaaaaagctaaagaggatgacaacttaaaagagatgctgaatgaagagcaattccgatatgaaggtccacttccgtcaactaaagaaacgggaatattattattagccgatgggattgaagctgcttctcgtgccatgaaaaaccctaattataacaaactcgaaaaccttgttaataaaatggtggatgatcgtgttgctgaaggacagctgagcaaatgtccgctgacgttcagagacttaagcgtgatcaaagaaacttttatcaatattttggtaggtgtttatcatggccgtattgaatatcctgaagagaaaaaagaaagcgagtccaacaaggacagttcctctagtcaacaacaaccagaacacaaatttgaccaacaggaagaaaagaataactaa

SEQ ID NO: 19694 - protein, 184 aa, Unknown
  Obtained from environmental sample
  misc_feature (1)..(184): Xaa is any amino acid
MIMARSTMSAMIIKAHVSEGVKMAEEHGLPKTIINFIESHHGTSVIRYFYEKAKEDDNLKEMLNEEQFRYEGPLPSTKETGILLLADGIEAASRAMKNPNYNKLENLVNKMVDDRVAEGQLSKCPLTFRDLSVIKETFINILVGVYHGRIEYPEEKKESESNKDSSSSQQQPEHKFDQQEEKNN

SEQ ID NO: 19695 - DNA, 393 bp, Unknown
  Obtained from environmental sample
  misc_feature (1)..(393): n is a, c, g, or t
gtgatggaaaaatttaagcgagaagttgatctttacctccaattcataaagctagaaaaaggtctttctccgaattctatcgcatcttacaaaaatgacattgctcgttacatagattttctaattttcaataagaaaatatccgatttatctggggttacgcttactcatattgaagactttctggactatctgattgactctgaatgtttatctactagttcgttggcgagaaatatttcaagtattcggggatttcatgaattcgcaacggttgagggtttctcgaaggcaaatcctgcagaattgatcgaacttcctaaaaagcacaaagctttccgaggttttggacgtagtggaagtggatgctttgcttttcttccccgatattga

SEQ ID NO: 19696 - protein, 130 aa, Unknown
  Obtained from environmental sample
  DOMAIN (9)...(95): Phage integrase, N-terminal SAM-like domain
  misc_feature (1)..(130): Xaa is any amino acid
MMEKFKREVDLYLQFIKLEKGLSPNSIASYKNDIARYIDFLIFNKKISDLSGVTLTHIEDFLDYLIDSECLSTSSLARNISSIRGFHEFATVEGFSKANPAELIELPKKHKAFRGFGRSGSGCFAFLPRY

SEQ ID NO: 19697 - DNA, 360 bp, Unknown
  Obtained from environmental sample
  misc_feature (1)..(360): n is a, c, g, or t
gtgtacacattgaattatattgagcataaaattctacgtaaaaactataacgatcctagaattcatgttggtgtaaattgtgcttcactatcttgtccgcaattaggaaattttgcatttaccgaagataatattgaggaaaaactagaagatttaatgaaaatttttattaatgattctaatcgaaataaaatcactcaaaagaagattcagctttcgaaaatatttgattggtataaagacgatttcacaaagaatggttctttgattgattatttaaacaagtattctacaattaaaatcaacaaaaaagcaaagattcgtttcttagaatatgattggaatctgaacgggaagtag

SEQ ID NO: 19698 - protein, 119 aa, Unknown
  Obtained from environmental sample
  misc_feature (1)..(119): Xaa is any amino acid
MYTLNYIEHKILRKNYNDPRIHVGVNCASLSCPQLGNFAFTEDNIEEKLEDLMKIFINDSNRNKITQKKIQLSKIFDWYKDDFTKNGSLIDYLNKYSTIKINKKAKIRFLEYDWNLNGK

SEQ ID NO: 19699 - DNA, 933 bp, Unknown
  Obtained from environmental sample
  misc_feature (1)..(933): n is a, c, g, or t
ttgttaaatgtggaaggaaacggaggtgtacaaagtgctggaatacttacctcggatggaaagttgttgtttcccaatcaagatggtgttgtgtatacccgaccagaatggtttttgacagataacgagggcacactcgtaagcccaatatttgaatccataaactataaagggagcagtcagcttttgtttggacgagagcacctaacattgccaaaaaatgtcagagatattcaagtgaaggttaccattcctacttttatagaagctcaaaaaatgaagcttgagtatagaattgatgaggtaagtgaacagtggcaaaaggcaggtacagaccgcttggcaatatttacaaatttaccagctggtgaacatacattacgtgtgcgaggaaggttagatggaggaagtaaatattcagtaagtaccatggtaataaaagtacctgcttttttctacgaaaccgtatggtttatagtgttaatggcagtagtatttattatctgccttgggtggggaatagagctgattcttaaacgagctaagaatacagaaacaaaactcaataatattgtaaccgaaagaaccaaagaacttgtactcgaaaaggaaaaaacagagcaagctttataccgaatccaaaagcttgataaagcaaaatctcagttttttaccaatttcactcacgaattaagaacacctctttcactaattctgaatcctattgaagatgtacttacaagcgaagaaatatttcacacaaaaagcgaaaatagagattccttagctcttgtaaaacggaatgccattcggttaaaagacttagtaaatcagctactggatatatctaaacttaatgcangagaactgaaactcnaattcgagctttgtaatattgntagtatcactaaacaagttgctacgcagttttga

SEQ ID NO: 19700 - protein, 310 aa, Unknown
  Obtained from environmental sample
  DOMAIN (95)...(133): Two component regulator three Y motif
  misc_feature (1)..(310): Xaa is any amino acid
MLNVEGNGGVQSAGILTSDGKLLFPNQDGVVYTRPEWFLTDNEGTLVSPIFESINYKGSSQLLFGREHLTLPKNVRDIQVKVTIPTFIEAQKMKLEYRIDEVSEQWQKAGTDRLAIFTNLPAGEHTLRVRGRLDGGSKYSVSTMVIKVPAFFYETVWFIVLMAVVFIICLGWGIELILKRAKNTETKLNNIVTERTKELVLEKEKTEQALYRIQKLDKAKSQFFTNFTHELRTPLSLILNPIEDVLTSEEIFHTKSENRDSLALVKRNAIRLKDLVNQLLDISKLNAXELKLXFELCNIXSITKQVATQF

SEQ ID NO: 19701 - DNA, 471 bp, Unknown
  Obtained from environmental sample
  misc_feature (1)..(471): n is a, c, g, or t
ttgatccggatggattacaaaggcctaaatagactacagaaagtcaaggaactgaacgctaaccccaactgggtaaatcgcgatctctacagaatgctgtatatggaggatctctatatcacggcctatgaaaggattaagagcgcccctgggaacatgaccaaagggtcggatgatactactcttgatggtttttctatgacaaccattaagaacatcatctgtaaaatgaaagaccaaagtttcgacttcacacggtccaaaaggattaaaatccccaaggccaatgggaaagagagacctctgggtattccatcacctaaggataaggtggttcaagaggttatccgcatgatactcgaatgtatctacgatgggataatcctactttcttggacacctcacatggtttcagaaacggaaggggaacgcacagctgcttgcaacaagttcgtggatggcacggagtga

SEQ ID NO: 19702 - protein, 156 aa, Unknown
  Obtained from environmental sample
  misc_feature (1)..(156): Xaa is any amino acid
MIRMDYKGLNRLQKVKELNANPNWVNRDLYRMLYMEDLYITAYERIKSAPGNMTKGSDDTTLDGFSMTTIKNIICKMKDQSFDFTRSKRIKIPKANGKERPLGIPSPKDKVVQEVIRMILECIYDGIILLSWTPHMVSETEGERTAACNKFVDGTE

SEQ ID NO: 19703 - DNA, 765 bp, Unknown
  Obtained from environmental sample
  misc_feature (1)..(765): n is a, c, g, or t
atgggatttaagcatgagaggaattttttttcaccagttcaaagcctcgttcgacatgtgtgttctggatatttacctctatataagggttataaaatatcaaaaaaattactgcggtcaatgnagggttctgaactgaaacaggataaacttacaaaactaaaaagctcaagaatttccaaacctattcatagatataataggtatactggtgaatatgagtttgaatttggatttttatatgaaacggataatggcattggtccacttggggcactactttcaaaaacaatgctttcttgtaatcagaaatctaaaactgtaaccggtattatagaatattacccatacatctttggttataatatttccggaagccaaaaatggatttctaaaattgatgattttgaaagtattcagtccattgaaacgcgcccagacgcaggcagcccaactagaccatcacttaaacgctatagtaatacaaatatttttaatagatatttaccgatgcgctctgcctcaggtgagtttttatttgttcaaacggtgttcagtttgcctcaaagagactccgcgggaaagacaaaattacgcctaccagaccatcccacaagaactttactattagacacttatactggcgaactgagtcgactatcatacgaaaagcttatagggacgttaaacaataatatttttgtagaagttgaaaactcaaacgacaatacagctatactttcaatctacagcgccactgaataa

SEQ ID NO: 19704 - protein, 254 aa, Unknown
  Obtained from environmental sample
  misc_feature (1)..(254): Xaa is any amino acid
MGFKHERNFFSPVQSLVRHVCSGYLPLYKGYKISKKLLRSMXGSELKQDKLTKLKSSRISKPIHRYNRYTGEYEFEFGFLYETDNGIGPLGALLSKTMLSCNQKSKTVTGIIEYYPYIFGYNISGSQKWISKIDDFESIQSIETRPDAGSPTRPSLKRYSNTNIFNRYLPMRSASGEFLFVQTVFSLPQRDSAGKTKLRLPDHPTRTLLLDTYTGELSRLSYEKLIGTLNNNIFVEVENSNDNTAILSIYSATE

SEQ ID NO: 19705 - DNA, 453 bp, Unknown
  Obtained from environmental sample
  misc_feature (1)..(453): n is a, c, g, or t
atgccaggacacatatcaatgggattgcatgtggtagtatcatttgacaaggtgcttattattaaattatccatccttcttatagtgggaataagcgggtttttacaagggtgtaaaacaactcctgaaaaagtaatttatcatcctaaccctgaattcttaccaaaaaataatgaggttactcatagagttagtttgggtaactttgatagcctgaagccattacccattaccttgacaaaaacaggagaaataaaggccaaggaaaagacacttgatgagtattttttttatcaaatacctccaaaaaaaatagagacagacttaggaggaaacgtgtatgtattacaaaaccataccaattctataaatgtgtttaatcaaaccggggaaattcctatacaagatttggtagaaaagggaaatgggacctggagaaatttaggtcaataa

SEQ ID NO: 19706 - protein, 150 aa, Unknown
  Obtained from environmental sample
  misc_feature (1)..(150): Xaa is any amino acid
MPGHISMGLHVVVSFDKVLIIKLSILLIVGISGFLQGCKTTPEKVIYHPNPEFLPKNNEVTHRVSLGNFDSLKPLPITLTKTGEIKAKEKTLDEYFFYQIPPKKIETDLGGNVYVLQNHTNSINVFNQTGEIPIQDLVEKGNGTWRNLGQ

SEQ ID NO: 19707 - DNA, 795 bp, Unknown
  Obtained from environmental sample
  misc_feature (1)..(795): n is a, c, g, or t
atgatgtcaaataataatatgaaaattagtaaatgtctttttccggcagccggttatgggacaagattcttaccagctacaaaagcaattccaaaagagatgttgccagtactcactaaaccacttcttcaatacggtgtagaagaagctgttgaagcaggtatggatactatggcgattgtaacaggaagaggtaaaagagctatagaagatcactttgatagatcttatgaacttgaacatcaaattgatggaacatcaaaagagaatttgatgacggagattagaactatagtaaataactatacttttagttatacaagacaagtcgagatgaaaggtttaggtcatgctatccttaccggaaaaacactaataggcgatgagccttttgcagttatactagcagatgatttatgtgacaatcatggagaatcagtactatctcaaatgactaaactatatgaaaaatatcctgattcttgtatagtagcaattgaagagattcctaaagaacaaacaaataaatatggtgtaatatctggtgttgaaatagaagagaacctttttaaagtagataatatggtagaaaaaccagaaccaaaggatgcaccttctaatttggctatcataggtagatatatcttgattccagagatatttgatattatagaaactactaagcctggtaaagctggagagatacagataacagatgctctaatgactttggcaaaacaaggaaaagttttagcatataaatttagcggtaaaagatttctcgagccgatctga

SEQ ID NO: 19708 - protein, 264 aa, Unknown
  Obtained from environmental sample
  DOMAIN (11)...(264): Nucleotidyl transferase
  misc_feature (1)..(264): Xaa is any amino acid
MMSNNNMKISKCLFPAAGYGTRFLPATKAIPKEMLPVLTKPLLQYGVEEAVEAGMDTMAIVTGRGKRAIEDHFDRSYELEHQIDGTSKENLMTEIRTIVNNYTFSYTRQVEMKGLGHAILTGKTLIGDEPFAVILADDLCDNHGESVLSQMTKLYEKYPDSCIVAIEEIPKEQTNKYGVISGVEIEENLFKVDNMVEKPEPKDAPSNLAIIGRYILIPEIFDIIETTKPGKAGEIQITDALMTLAKQGKVLAYKFSGKRFLEPI

SEQ ID NO: 19709 - DNA, 444 bp, Unknown
  Obtained from environmental sample
  misc_feature (1)..(444): n is a, c, g, or t
atggaaaacgacacaattaaaataattgatgagttatttaagtcatacaattatactcttgcacctaaatctaactctgatgttagaatttatacgctcagatatggcatgtatcacgccgcagaaattttggtattaaatgaaaactttaatccaaaagaaattaaagctgaatactctgacttaggatatgccacggaaataaaaactcacaaggatatcgaaaatatagaagaatatcttttcgaaggcttcttcataaaaacaccattagggaatgaattaaaaagcagatacaatcaatttgtaaataagcaactcaaaaatttacccgatgaaagtaaatatgaatatataaaaagttcatacgagttacaccaccaagacgaaaatggggctctaatgaacacgcaaattttgatggttgaatgttccgagccataa

SEQ ID NO: 19710 - protein, 147 aa, Unknown
  Obtained from environmental sample
  misc_feature (1)..(147): Xaa is any amino acid
MENDTIKIIDELFKSYNYTLAPKSNSDVRIYTLRYGMYHAAEILVLNENFNPKEIKAEYSDLGYATEIKTHKDIENIEEYLFEGFFIKTPLGNELKSRYNQFVNKQLKNLPDESKYEYIKSSYELHHQDENGALMNTQILMVECSEP

SEQ ID NO: 19711 - DNA, 822 bp, Unknown
  Obtained from environmental sample
  misc_feature (1)..(822): n is a, c, g, or t
atgattctcaaggacaaggacgacaagttaattagaatttattttctaatctgtaaaaatttcaaagaattacattattactgtgaacgatttagcaacaacagtaaaccagagttgactgatcaggagattatgacaatttacctttacgttatgcatcatcaagggcatactaaaataaagcacatccacagatttgcaatggactatctaattccatggtttccaaagcttggaagctataaagcctttaataatcgtcttaatagattaggcggggcatttaccagacttgttgaaatactggtaacagattatcagccagatgattgcatattagatcaaagcctgctggactctatgccaattattacctgctcaggtaaacgttcaggcaaagtggccagagagataacaaacaagggttactgctcaactaaagggatgtattactatggtcttaaactgcatttattagggtttcgacgtattggcaaattaccccatccggagcaaatattattcactccggcttcagttaatgatttgaccgtttttaaagaagcatggtctgaaattgagcacagaacattttttggagataaaatctactttgtaaagcaaatcaatgaacatatgatggaaaatcagaattcagaaatgcttgctcccgtgaaaggagtaaaaggaatgcatgaattgataaagcaaagaataaaagccgctgacgatttatactcaactgccgtctcgcgtgtcaggcaaccgattgaggccatgttcaactggttgatgaaaaaactatatcctgagccgatctga

SEQ ID NO: 19712 - protein, 273 aa, Unknown
  Obtained from environmental sample
  misc_feature (1)..(273): Xaa is any amino acid
MILKDKDDKLIRIYFLICKNFKELHYYCERFSNNSKPELTDQEIMTIYLYVMHHQGHTKIKHIHRFAMDYLIPWFPKLGSYKAFNNRLNRLGGAFTRLVEILVTDYQPDDCILDQSLLDSMPIITCSGKRSGKVAREITNKGYCSTKGMYYYGLKLHLLGFRRIGKLPHPEQILFTPASVNDLTVFKEAWSEIEHRTFFGDKIYFVKQINEHMMENQNSEMLAPVKGVKGMHELIKQRIKAADDLYSTAVSRVRQPIEAMFNWLMKKLYPEPI

SEQ ID NO: 19713 - DNA, 711 bp, Unknown
  Obtained from environmental sample
  misc_feature (1)..(711): n is a, c, g, or t
atgctcgatgataaggataatgccacgttaggaattggacatacaagatgggctacacatggagagcctaatgatataaactctcatccacatacaagcaattctggaaaattagctttagtgcataacgggattatagaaaactataattctttgaaaaaagtactagaaggaaaggggcatactttttattcagaaaccgatacagaggttttagctaaacttatagaagatatttacaacaaccatcctgaggattttaaaaaatctgttcaactagcactagcacaggtagaaggaacgtatggagttgctgttattcattcagatttgcccgatcaaatgattgttgcgagaaaaggttcgccactattgataggtgtgggggatggagagatgcttattgcatcggatgcttccgcggttgctgaatatactgatcaagtagtatatcttgatgatggtgaaatggcggtcattaagaaagatggatataaagttcttacacttgatgatgatgcgttagtaaaagaagtacatgagttggcggtgagtttggaggagattgaaaagggtgggtatgactacttcatgcttaaagaaattttcgagcaaccaaaggcaatttcagattgcttaagaggacggtttgatcctaaaaaaggaactataacattaggccgaaatcaaagatgttatgggagcaaatag

SEQ ID NO: 19714 - protein, 236 aa, Unknown
  Obtained from environmental sample
  DOMAIN (1)...(78): Glutamine amidotransferases class-II
  misc_feature (1)..(236): Xaa is any amino acid
MLDDKDNATLGIGHTRWATHGEPNDINSHPHTSNSGKLALVHNGIIENYNSLKKVLEGKGHTFYSETDTEVLAKLIEDIYNNHPEDFKKSVQLALAQVEGTYGVAVIHSDLPDQMIVARKGSPLLIGVGDGEMLIASDASAVAEYTDQVVYLDDGEMAVIKKDGYKVLTLDDDALVKEVHELAVSLEEIEKGGYDYFMLKEIFEQPKAISDCLRGRFDPKKGTITLGRNQRCYGSK

SEQ ID NO: 19715 - DNA, 351 bp, Unknown
  Obtained from environmental sample
  misc_feature (1)..(351): n is a, c, g, or t
atgaattcaaaaattgatctttcctatttagaggaagttactggtggaaatacggatataattaaagagatgttagagctgtttttgagtgaaactcctcaacaaattcagctgatacaagaaaaatgcaaactaaaagaatggcagggtgttagtgcggaagctcataaattaaaacccacctttctatatgtaggattacaagagtcgaacgaaaagctaactaaaattgaacacggcgctcgaaataatcaaaacctagatgagttaatagaactaataaattcggttgaaagagaatttaatagcacaaagcctgaggttaaggctttaattttaaagtttagctag

SEQ ID NO: 19716 - protein, 116 aa, Unknown
  Obtained from environmental sample
  DOMAIN (23)...(100): Hpt domain
  misc_feature (1)..(116): Xaa is any amino acid
MNSKIDLSYLEEVTGGNTDIIKEMLELFLSETPQQIQLIQEKCKLKEWQGVSAEAHKLKPTFLYVGLQESNEKLTKIEHGARNNQNLDELIELINSVEREFNSTKPEVKALILKFS

SEQ ID NO: 19717 - DNA, 318 bp, Unknown; identical to SEQ ID NO: 19135
  Obtained from environmental sample
  misc_feature (1)..(318): n is a, c, g, or t

SEQ ID NO: 19718 - protein, 105 aa, Unknown; identical to SEQ ID NO: 19136
  Obtained from environmental sample
  misc_feature (1)..(105): Xaa is any amino acid

SEQ ID NO: 19719 - DNA, 486 bp, Unknown
  Obtained from environmental sample
  misc_feature (1)..(486): n is a, c, g, or t
ttgaaaatgaagtcttttaaggtcattaacgtaattattgcttccattatcttagcgggatgcactagcgtgcccataaccttaaactattctccaagcagcacaatgagtgttaacggtagcttggaggttgatagttttaaatatttaccgagcgaaaataatagtattatcaaatcaaatcagataagaaacactggcatgggtgatgtcatccttgataagaacgttaacgaatattttgaagctgctctgcttgtagaatcaaggtttgttggtattaagataaaccaatcacctaacaaagtttctggagaaataactgaatttttaattgacgatttaggttacagcatcgactggacgttagaggttaaatacataattactcaacaatcagggaatgagtgttacaacaaaacccataaaatagaaaaaaaatcagacaaatttgttaatgcatttgcaacccttaatgaagtatga

SEQ ID NO: 19720 - protein, 161 aa, Unknown
  Obtained from environmental sample
  misc_feature (1)..(161): Xaa is any amino acid
MKMKSFKVINVIIASIILAGCTSVPITLNYSPSSTMSVNGSLEVDSFKYLPSENNSIIKSNQIRNTGMGDVILDKNVNEYFEAALLVESRFVGIKINQSPNKVSGEITEFLIDDLGYSIDWTLEVKYIITQQSGNECYNKTHKIEKKSDKFVNAFATLNEV

SEQ ID NO: 19721 - DNA, 483 bp, Unknown
  Obtained from environmental sample
  misc_feature (1)..(483): n is a, c, g, or t
gtgtccgcacaaaaaataatcgcttacccaagcaaccatttcaaacgcggatccatcttaaggataacgaaatcaaatacactcgctaaaactattttgattatgaattctaactcgcacactaaatcgctttctcaaaacatccggaagttcatcatcatcagcatgatgatgtttgtaagcttctccgccgttctggctggacccggaaataccactcgccaaaaaagcaagctggccaatcgggtgaaaaaaatgattgaaaacgtcaatccggccaatgccactccccttagtggtgaagcggtagttttcttcaccgtggacaacaaaggtcagattcaggtaaaaggtgttttcggaaccaatgacgatctcattgatcatgttgaaactgcccttgacggtgaactgatcaaagtcgaccacctcgacccggaacaagaatatcaggtgcgcctcaaataccaggatctgcgctga

SEQ ID NO: 19722 - protein, 160 aa, Unknown
  Obtained from environmental sample
  misc_feature (1)..(160): Xaa is any amino acid
MSAQKIIAYPSNHFKRGSILRITKSNTLAKTILIMNSNSHTKSLSQNIRKFIIISMMMFVSFSAVLAGPGNTTRQKSKLANRVKKMIENVNPANATPLSGEAVVFFTVDNKGQIQVKGVFGTNDDLIDHVETALDGELIKVDHLDPEQEYQVRLKYQDLR

SEQ ID NO: 19723 - DNA, 564 bp, Unknown
  Obtained from environmental sample
  misc_feature (1)..(564): n is a, c, g, or t
gtgacaatatcttttacgggcacgaccctgatcaaaaccatgcaaggtgcggccaaaaccgtgaaggaagaaggaggcggaatggtatttgcctaccacgtttcggatccggaacgctacggcgtagtcgaatttgacaagaacggtgatgtcctcagcattgaagaaaagccggaaaatccgcgttcttcatatgccgttccgggcatctatttttatggcaatgaagttgtagacatctgcaaaaacctcaaaccctctccccggggcgaacttgaaatcaccgacgtcaacaaaattttcctgagcgaaaagaagctcaaagtggccattctcagccgcggcaccgcctggctagatacgggcacccacgattctctcctcgacgccggacaatacgtgcacatcatcgaaaagcggcagggcctcaaaatcggctgcatcgaagaagtggcctggcgcatgggcttcatcaacagcgaccaattgcggaaagttgcccaaccgctgttgaagagcggatatggagagtatttgttggatttgttgaaggaagggaaatag

SEQ ID NO: 19724 - protein, 187 aa, Unknown
  Obtained from environmental sample
  DOMAIN (1)...(137): Nucleotidyl transferase
  misc_feature (1)..(187): Xaa is any amino acid
MTISFTGTTLIKTMQGAAKTVKEEGGGMVFAYHVSDPERYGVVEFDKNGDVLSIEEKPENPRSSYAVPGIYFYGNEVVDICKNLKPSPRGELEITDVNKIFLSEKKLKVAILSRGTAWLDTGTHDSLLDAGQYVHIIEKRQGLKIGCIEEVAWRMGFINSDQLRKVAQPLLKSGYGEYLLDLLKEGK

SEQ ID NO: 19725 - DNA, 816 bp, Unknown
  Obtained from environmental sample
  misc_feature (1)..(816): n is a, c, g, or t
ttgagacatcagaaaggagtttttgttgaaaatcaaattattaatgataaatttacccgactattacaggcatcaaaaatgacaaaaccaaaaattttacttatttatactggaggaaccattggaatggtaaaagattatgaaaccaatgcgttaaaagcatttaatttcgaacaacttttagatcgagttccagaattagttcagttaaattgtaccattgatacctattcctttaaagaaccaatcgattcttctaatatgaacacagaatattatgtaactatcgcagaagtgatagaagataagtattctaaatttgacggatttgttgtgttaacgggttctgatacgatggcgtacacatcatcagcaattagttttatgctagaaaatttagcgaagccaataatttttacaggatcacaattgccaattggtcatttaagaacagatgcaaaagagaacctaattacctctatagaaattgcgtgtaccagaaaaggtgatcaaccagtaatttctgaagtgtgtttgtattttgaatataaattatacagagcaaatagaactacaaaagttaatgcagagcaatttgaagcgtttgcgtctttaaattatccgcctttggcagaaagtggtgtgcatttgcattttaattatgagttacttttaaaatcaagaacaaaagacgctcatcttattgttcgtaaaaggttgaatgataacatcgttgtattaaaattatttccaggtattagagaggaagtcgtaaaaagcattactgaaattagaaatataaaaggcattgtctag

SEQ ID NO: 19726 - protein, 271 aa, Unknown
  Obtained from environmental sample
  DOMAIN (36)...(266): Asparaginase
  misc_feature (1)..(271): Xaa is any amino acid
MRHQKGVFVENQIINDKFTRLLQASKMTKPKILLIYTGGTIGMVKDYETNALKAFNFEQLLDRVPELVQLNCTIDTYSFKEPIDSSNMNTEYYVTIAEVIEDKYSKFDGFVVLTGSDTMAYTSSAISFMLENLAKPIIFTGSQLPIGHLRTDAKENLITSIEIACTRKGDQPVISEVCLYFEYKLYRANRTTKVNAEQFEAFASLNYPPLAESGVHLHFNYELLLKSRTKDAHLIVRKRLNDNIVVLKLFPGIREEVVKSITEIRNIKGIV

SEQ ID NO: 19727 - DNA, 471 bp, Unknown
  Obtained from environmental sample
  misc_feature (1)..(471): n is a, c, g, or t
ttgttattgacatcggttttgcatccagatttgggagcaatcaaaaaagcaattgaaaccaataaacaacgttctgtaacaattagttctgttaaagattttaaagggaaattggcagattatcaattggttatcttgtatcagccaacggtacaatttgaaactgttttcaattccattcaaaaagaaaaagcaaattattttataattacaggtttaaataccaattggaatttcttaaacgaaatgcaatcgaattactataaaaatgcgaccaatcaatcagaagaatttggcgcaatttttaataacggatttttaacgtttggacaaaaagagattggttttgaatctttttcgcctttagagaatgcttttggaagcattaatatgacatcaaaatttgatgcgttgttatttcaaaatattgcaggatttaaaacacaaacgccttttattggccacttttga

SEQ ID NO: 19728 - protein, 156 aa, Unknown
  Obtained from environmental sample
  misc_feature (1)..(156): Xaa is any amino acid
MLLTSVLHPDLGAIKKAIETNKQRSVTISSVKDFKGKLADYQLVILYQPTVQFETVFNSIQKEKANYFIITGLNTNWNFLNEMQSNYYKNATNQSEEFGAIFNNGFLTFGQKEIGFESFSPLENAFGSINMTSKFDALLFQNIAGFKTQTPFIGHF

SEQ ID NO: 19729 - DNA, 663 bp, Unknown
  Obtained from environmental sample
  misc_feature (1)..(663): n is a, c, g, or t
atgagattggaggtgtgtaaaaaggcaggtgggagtgtaaaagaaactaaaaagacaaattggatcctttatttaagaaaagggaccgggctttcgaaaaagccggaaaaacttcttgagatggtaaggggaaagtccctgccacaaaaaccgattgatattcttaaaaacgtatatgcgtttgagtttctgcatctcccggaacgtgattttattgaagagtctgaacttgaaagggcattgcttgaccaactggaagcattcattctggaattgggaaatggattttgctttgaggccagacagaagcgaatcctgattgggcctgaatattattggattgatatggttttctatcatcgggttttgaaatgccacgtccttatcgatctaaaagtggaagaattctcccattcgaatgttggccagctgaatacttacctgaattactacaggaaaaatatcgttttggaggatgataatccgcccattggaatcttgatggtgaccgataaaaatgattctttggtggaatatgccactgctgggatggacgaaaatctgtttgtgaagaaatacctggtcaaccttccttcgattcaagaattgaatgcgattattcaaaaggaactagaccagagattcacggggaatttaaaatga

SEQ ID NO: 19730 - protein, 220 aa, Unknown
  Obtained from environmental sample
  DOMAIN (2)...(210): Protein of unknown function (DUF1016)
  misc_feature (1)..(220): Xaa is any amino acid
MRLEVCKKAGGSVKETKKTNWILYLRKGTGLSKKPEKLLEMVRGKSLPQKPIDILKNVYAFEFLHLPERDFIEESELERALLDQLEAFILELGNGFCFEARQKRILIGPEYYWIDMVFYHRVLKCHVLIDLKVEEFSHSNVGQLNTYLNYYRKNIVLEDDNPPIGILMVTDKNDSLVEYATAGMDENLFVKKYLVNLPSIQELNAIIQKELDQRFTGNLK

SEQ ID NO: 19731 - DNA, 642 bp, Unknown
  Obtained from environmental sample
  misc_feature (1)..(642): n is a, c, g, or t
ttgggtttatggctcggattgattcatgaaatgctcacgtctggaatgatggcaaagcactttttacagcaaaaaattacaagtggaaaaatagcttatctagggacagaaagttcagcagactatatcttacaatcgggtttagagcatatcgcggtaaaagatgtagatttgaataatctcgatgagatttcggcatgtgtgttcttagacgacgaaggctttgattggaatacagacatcaataaagtggtgaacttgcttagaaagaagaatatgcccgttattttggctaattcggattacttctaccctgtttcaagtaacgacattgcaattgcaaccggtggcgttgcaaaactagttgagaacatgctcggaaaaaagtttattcattttggtaaacccgattctcagatgttcatgtacgcctatgagcagttaactaaagatatattcatcaacaaaaatgacattttaatggtgggtgatacattacatactgatatattagggggaaataaatttggtgtaaaaaccatgttggttctttcgggaaatactcgagaggacaattacgaagcacaaatcagatcgacaggtattatacctgactatgtctgtaaatccattatggaatga

SEQ ID NO: 19732 - protein, 213 aa, Unknown
  Obtained from environmental sample
  misc_feature (1)..(213): Xaa is any amino acid
MGLWLGLIHEMLTSGMMAKHFLQQKITSGKIAYLGTESSADYILQSGLEHIAVKDVDLNNLDEISACVFLDDEGFDWNTDINKVVNLLRKKNMPVILANSDYFYPVSSNDIAIATGGVAKLVENMLGKKFIHFGKPDSQMFMYAYEQLTKDIFINKNDILMVGDTLHTDILGGNKFGVKTMLVLSGNTREDNYEAQIRSTGIIPDYVCKSIME

SEQ ID NO: 19733 - DNA, 630 bp, Unknown
  Obtained from environmental sample
  misc_feature (1)..(630): n is a, c, g, or t
atgaatattacaattataggttcgggatatgtaggtttggtttcaggaacttgttttgcagaaatgggaaataccgttgtttgtgtagacaacgatcaagataaaattaataaacttaataaaggagttgttccaatttatgaacctggattaaaagaattaattcagagtaattcaacaaaaacattgtttttttcaacagaaataaaaaaagctataaaaaaaaaggatattatttttatagctgttggaacaccaatgtctgatgatggaagtgcagacttatcctctgtgtataatgttgcagaacttatagggagaaatatagattctcaaactatcgtggtaacaaaatcaactgtacctgttggtacaacttgtagaattgagaaaattattcagtctgaattaatgaaaagaaacgttgatgtaaaattccacatggcttctaatccagagtttttaaaggaaggtgctgctattgaggattttatgaagccagatagagtggtcattggggcggatgtagagtttgtctttcaaaaaatgaaagagttgtatgctccattcttcagaacacatgatcgctttatcaccatggatattcgttctgcctcgagccgattctga

SEQ ID NO: 19734 - protein, 209 aa, Unknown
  Obtained from environmental sample
  SIGNAL (1)...(20)
  DOMAIN (1)...(192): UDP-glucose/GDP-mannose dehydrogenase family, NAD binding domain
  misc_feature (1)..(209): Xaa is any amino acid
MNITIIGSGYVGLVSGTCFAEMGNTVVCVDNDQDKINKLNKGVVPIYEPGLKELIQSNSTKTLFFSTEIKKAIKKKDIIFIAVGTPMSDDGSADLSSVYNVAELIGRNIDSQTIVVTKSTVPVGTTCRIEKIIQSELMKRNVDVKFHMASNPEFLKEGAAIEDFMKPDRVVIGADVEFVFQKMKELYAPFFRTHDRFITMDIRSASSRF

SEQ ID NO: 19735 - DNA, 864 bp, Unknown
  Obtained from environmental sample
  misc_feature (1)..(864): n is a, c, g, or t
ttgtcttgctgtgcgcatgaggaggaacgtatcgaatccattttgacagatttactggaactggattatccagattatgaagtggtgcttgtcgatgatttttcagaagatcacacccttcttaaagtagcgcaactggccaaaaaatatccacggctaaagtttacatccatcagccaggaaaccaacttttcagagaaaattgcgattaacttgtctttgaaggcagcatcattcgatcgcattgtttttttaagtcccgaaagtcagtcagttgattcagcatttttgaagaagttggatgacaacgccggcgattcaaatttgatgatatgctacattaactttgcgccccaaaaaagctggcgtaacaagctttgccgaatcgaacggctgacagctttcgtttattcagccgctttttcgatggccggactaccggtgttttacgaagatcgaaatgtgcttttccagaagtctatctactttgatcaatctggattccgcggaaaaatgaacgatcattttgcgaatctcgaattgattttcaacgatcggtttaaaaagaaaatccatgtgtcgattgatccggacacctttatttacgagcaaggtgggattcaacgcggcgttttttttgatcttctgaaaaagagaatacggttaacccagcacttgggattctggaaacgactggtttatttcatgggtgatctatccaaatccttgtttttcggcaccttggtctggatgttggtcactgaacctaaaaaacgggtgtttgttgttgttcctgccatacttgttctggtgatgcaattttttattcttaaaagtggggtccgctcatttgaagggaagtaa

SEQ ID NO: 19736 - protein, 287 aa, Unknown
  Obtained from environmental sample
  DOMAIN (1)...(163): Glycosyl transferase
  misc_feature (1)..(287): Xaa is any amino acid
MSCCAHEEERIESILTDLLELDYPDYEVVLVDDFSEDHTLLKVAQLAKKYPRLKFTSISQETNFSEKIAINLSLKAASFDRIVFLSPESQSVDSAFLKKLDDNAGDSNLMICYINFAPQKSWRNKLCRIERLTAFVYSAAFSMAGLPVFYEDRNVLFQKSIYFDQSGFRGKMNDHFANLELIFNDRFKKKIHVSIDPDTFIYEQGGIQRGVFFDLLKKRIRLTQHLGFWKRLVYFMGDLSKSLFFGTLVWMLVTEPKKRVFVVVPAILVLVMQFFILKSGVRSFEGK

SEQ ID NO: 19737 - DNA, 636 bp, Unknown; identical to SEQ ID NO: 19237
  Obtained from environmental sample
  misc_feature (1)..(636): n is a, c, g, or t

SEQ ID NO: 19738 - protein, 211 aa, Unknown; identical to SEQ ID NO: 19238
  Obtained from environmental sample
  DOMAIN (15)...(202): Glucose inhibited division protein
  misc_feature (1)..(211): Xaa is any amino acid

SEQ ID NO: 19739 - DNA, 834 bp, Unknown
  Obtained from environmental sample
  misc_feature (1)..(834): n is a, c, g, or t
atgcactattattttgctaaaaaaacaagtgaagtaactcactgtgaattagatgcaaacttatcaacaattgttaacaacaattatcaacaattaaaaattgatgaaattcaactaatttctggagacggaattgcttatttaagaaatacttcaaaaaaatacgattggatttatattgatccttcaaggcgagattcagtagataaaaaagtttttttgttaaaagactgtttaccaaacgttcctgagaatttaaccttattcttttcaaaatcaaataacattctgataaagaattctccgattttagacatttcaaaaacgatagatgaattagattttgtaaaagaaattcacgttgttgctgttgcaaatgaagtaaaagaattgctctttgtattggaaaaagactacaaagaaagcattcgaattaaaacaatcaattacagtaaaaatattattcaaatatttgattttcaatatattaaaaacaatatatcagaatattctgaacccaaaaaatacatatatgagcccaatgctgccattttaaaatcaggcgggtttcacgaaataagccttcaattaaatctagaaaaattacatccacattctcatttatatacttcagataatttaattgaattcccaggaagaacttttttggttgaaaatagttgccagtacaataaaaaagaaattaaaaaatatttaaaagaaaataaggcaaatataacgactagaaattttccagaaactgttgcacaaatcagaaaaaaaacaaaaattaaagaccgcgggttctcagtatttattttttacaacctttaa

SEQ ID NO: 19740 - protein, 277 aa, Unknown
  Obtained from environmental sample
  misc_feature (1)..(277): Xaa is any amino acid
MHYYFAKKTSEVTHCELDANLSTIVNNNYQQLKIDEIQLISGDGIAYLRNTSKKYDWIYIDPSRRDSVDKKVFLLKDCLPNVPENLTLFFSKSNNILIKNSPILDISKTIDELDFVKEIHVVAVANEVKELLFVLEKDYKESIRIKTINYSKNIIQIFDFQYIKNNISEYSEPKKYIYEPNAAILKSGGFHEISLQLNLEKLHPHSHLYTSDNLIEFPGRTFLVENSCQYNKKEIKKYLKENKANITTRNFPETVAQIRKKTKIKDRGFSVFIFYNL

SEQ ID NO: 19741 - DNA, 684 bp, Unknown
  Obtained from environmental sample
  misc_feature (1)..(684): n is a, c, g, or t
atgcgatgcacaccaagaaatatagttgctaatactccaggcctaaataaatttgtttgggatttaagttacccagaagtaaccagactaaatggagttcaaattctttggtcaggtaatacaaacgggccttctgcaattcctggttcttatactgtaaaaatgtatataggggacaaaatgattggagagcgtaagttcgaaattataaaagacccaagacttactgaagtttcacaggctgactttgaagctcagttccaattagttcaaacagtaaaagctaagttagatactactcataaaacgattaaccgcattagagaagtaagaaaggaaatcaacgaattattggcggaagctaagaatgataaagatctccaagaaagagccaaattgatgttggaagcaatgtcagaaatcgaaaatgagttggttcaaactaaagctgaatctggacaagatgtacttaacttccagattaagcttaataataaactagcttctcttgctaatactattgaaacaggtcacggtagaccaactaaacaacagtatgaagtatatgaagatctagctgctcgtgttgacgtacaattcaaacgcttacaagctgtttgggatggagaatatgaaactatgatccaagagttcgaaagtaaaggcggaaagattcaaaattag

SEQ ID NO: 19742 - protein, 227 aa, Unknown
  Obtained from environmental sample
  misc_feature (1)..(227): Xaa is any amino acid
MRCTPRNIVANTPGLNKFVWDLSYPEVTRLNGVQILWSGNTNGPSAIPGSYTVKMYIGDKMIGERKFEIIKDPRLTEVSQADFEAQFQLVQTVKAKLDTTHKTINRIREVRKEINELLAEAKNDKDLQERAKLMLEAMSEIENELVQTKAESGQDVLNFQIKLNNKLASLANTIETGHGRPTKQQYEVYEDLAARVDVQFKRLQAVWDGEYETMIQEFESKGGKIQN

SEQ ID NO: 19743 - DNA, 501 bp, Unknown
  Obtained from environmental sample
  misc_feature (1)..(501): n is a, c, g, or t
ttgtgtatatcaataaaacacaccaatccagttttgattggagtttcgtttggtggaatgatagttcaagaaatgagtaaatatgtacaccctcaaaaggtgattttaatttctagtattaaaaacaattctgaaaaacccaagcgaattctttttctacagaaaactaaattttacaagttatttccaacttatagaatatcaaaaattgaagatttttcaacttttagttttaataaatcattcaaaaaaaaattagagctttataataagtatttggctgtaagagatgaaaaatatctaaattgggcaattcataatgttgtaaattggaaaagagaaaacagcataaataacatttttcatatccacggaagtgatgatgaaatatttccaattaaacatataaagaatagtattattattgaaggcggaacacatgctatgatcattactaaagcaaaaaaaataaatataattcttgaaaaaattattacataa

SEQ ID NO: 19744 - protein, 166 aa, Unknown
  Obtained from environmental sample
  misc_feature (1)..(166): Xaa is any amino acid
MCISIKHTNPVLIGVSFGGMIVQEMSKYVHPQKVILISSIKNNSEKPKRILFLQKTKFYKLFPTYRISKIEDFSTFSFNKSFKKKLELYNKYLAVRDEKYLNWAIHNVVNWKRENSINNIFHIHGSDDEIFPIKHIKNSIIIEGGTHAMIITKAKKINIILEKIIT

SEQ ID NO: 19745 - DNA, 399 bp, Unknown
  Obtained from environmental sample
  misc_feature (1)..(399): n is a, c, g, or t
ttgaactattttcatatggcgaagtcctttctggaaagcgcgaacagtataccaaatagtgcatttgtagttcgatcatacagaacattgtggttagtcataaaattaacagaaatggaaataaacagcatgacactaaaaagtctgactgaagaatccttaatttgtactagtctatacaacagatatccccagaaaaatataaataggcaaaaaggtatgatgccagcttcgcccataatcaataaatatgtattatggataccctcatctctactaggaaggcaactcgaaaagaccctaaccccatcctgcgaccggtctctccttatccactctacaccaactcgaaaaatctcaaagcgttccgagggttgtctccattacaaatcgccctga

SEQ ID NO: 19746 - protein, 132 aa, Unknown
  Obtained from environmental sample
  misc_feature (1)..(132): Xaa is any amino acid
MNYFHMAKSFLESANSIPNSAFVVRSYRTLWLVIKLTEMEINSMTLKSLTEESLICTSLYNRYPQKNINRQKGMMPASPIINKYVLWIPSSLLGRQLEKTLTPSCDRSLLIHSTPTRKISKRSEGCLHYKSP

SEQ ID NO: 19747 - DNA, 666 bp, Unknown
  Obtained from environmental sample
  misc_feature (1)..(666): n is a, c, g, or t
ttgacatctcaatttataaatacaatttataacgaaatttttgattcatatcccaatattgaagtcaaagaacacatcaataaattaattgaacttgattattattatccttacaacactacttttttttgcatcacaaatactgctagtcaaaattttgaatttataagtaaaaatttttctgcttgtaccggtttatcaaaagagaaaatgatggaaggaggcatgaattatttttggtcgttatttcataaagatgatatacatccgtggttagattgtttaaaagagctcatgaattttacgatgaccgaattaacggacgagcagcgaaaaagaatgagttatacttggaattacagaataaaaaatgcaaaaggagattatgtaacgattattcagaatacaactccaattcagtttgacgatcaaaataaaccgatgattggcttggcgcattacaccgttttagaatgcgatttaaatatggatatttgtgcttgtgcaaagtatttaaacgataaaaatgaatacgaaacgttgttttataaaaatgtttcgaacactaatttgttagatgttattagcaacagagaaagagatattatccgcttattaattacaaaaaaatcgagcaaaggaaattgcagaaaatttacacattag

SEQ ID NO: 19748 - protein, 221 aa, Unknown
  Obtained from environmental sample
  misc_feature (1)..(221): Xaa is any amino acid
MTSQFINTIYNEIFDSYPNIEVKEHINKLIELDYYYPYNTTFFCITNTASQNFEFISKNFSACTGLSKEKMMEGGMNYFWSLFHKDDIHPWLDCLKELMNFTMTELTDEQRKRMSYTWNYRIKNAKGDYVTIIQNTTPIQFDDQNKPMIGLAHYTVLECDLNMDICACAKYLNDKNEYETLFYKNVSNTNLLDVISNRERDIIRLLITKKSSKGNCRKFTH

SEQ ID NO: 19749 - DNA, 675 bp, Unknown
  Obtained from environmental sample
  misc_feature (1)..(675): n is a, c, g, or t
atggaagcgatacatatcaatgattttaacaatcataaaataaatgaaacagaagtgataaagcgtatactgggtggcgaaaaagaactgtacgaaattttggtaagacgaaacaatcaaaaattgtatcgcgcaattcgcagttatttaaaagcagaagccgaaattgaagatatcatgcaaaatagttacctaaaagcttttactaaattatatcaatttaaattagaatcctctttttctacttggcttattcgcatcggaatcaatgaatctctagctcggttaaaagaaaaaggaaaattatatcatttaaaccaacaatcagacaatttaaaaagcactattattttagaaattccagataacaaacaattaaatccgcaggacaaaatgatacggaatgaagcaaaacaattactagaaaacgctatcgataatttggatttaaagtacaaagcggtttatattttaagagaagtcgaagaaatgagtcttaaagaaattgctgttgctttagatttaaccgttgccaatgtaaaaatacgtttacatcgttcaaaagaaatgcttaaagataaactgtatgaagttacaaatgataaaaatatttttgaatttggttttagcagatgcgatagcattactgaaaatgtaatgaaattaatcatctaa

SEQ ID NO: 19750 - protein, 224 aa, Unknown
  Obtained from environmental sample
  DOMAIN (144)...(193): Sigma-70, region 4
  misc_feature (1)..(224): Xaa is any amino acid
MEAIHINDFNNHKINETEVIKRILGGEKELYEILVRRNNQKLYRAIRSYLKAEAEIEDIMQNSYLKAFTKLYQFKLESSFSTWLIRIGINESLARLKEKGKLYHLNQQSDNLKSTIILEIPDNKQLNPQDKMIRNEAKQLLENAIDNLDLKYKAVYILREVEEMSLKEIAVALDLTVANVKIRLHRSKEMLKDKLYEVTNDKNIFEFGFSRCDSITENVMKLII

SEQ ID NO: 19751 - DNA, 498 bp, Unknown
  Obtained from environmental sample
  misc_feature (1)..(498): n is a, c, g, or t
atggaaaattatttcaatacattatcattaagagaacaactggcacaattaggtaaatgtgattttatggatgcctcagaatttacaaatggcgtaagtgctttaaaagggaaaaagattgtcattataggttgtggcgcacaaggtttaaaccaaggtttaaatatgcgagattctggtttagatgtttctttcactttaagagaaagtgctataaaagagcgaagacaatcttttaaaaatgcaaatgaaaacaaatttaaggttggaacttataaagaaatgataccaaccgcagatttggttataaacctcacgcctgataaacaacataccgatgtggtaagtaaaataatgcctttaatgaaaaaaggagcagctttatcttattctcacggtttcaatattgtagaagaaggaatgaaaataagggaagatttaacagtaataatgatggctccaaaatcgcctggttcggaattaagagaagaaatataa

SEQ ID NO: 19752 - protein, 165 aa, Unknown
  Obtained from environmental sample
  misc_feature (1)..(165): Xaa is any amino acid
MENYFNTLSLREQLAQLGKCDFMDASEFTNGVSALKGKKIVIIGCGAQGLNQGLNMRDSGLDVSFTLRESAIKERRQSFKNANENKFKVGTYKEMIPTADLVINLTPDKQHTDVVSKIMPLMKKGAALSYSHGFNIVEEGMKIREDLTVIMMAPKSPGSELREEI

SEQ ID NO: 19753 - DNA, 705 bp, Unknown
  Obtained from environmental sample
  misc_feature (1)..(705): n is a, c, g, or t
atgtcttttgtacatccttttcncgatataaaagtaatagaagggcaagcaaccattgctttagaaatattagcacaaagcaaaacacctgtagattatttgtttttgcctgttggtggtggtggtttggctgctggtgtttccagtatatttaaagaactttctcccaacacaaaaattataggtgttgaaccaaaaggcgcagcttcaatgtctgtttcaataactaatggatttaacacaaaaatagaaaacatagataaatttactgatggcgcatctgtccaaaaagtaggtgatttaaactttgaaatttgtaaagaaaatttagacgaaatggtaaccgttcacgaaggaaaagtgtgccaaactattttagatttgtacaataaaaacgctattgtggttgaacctgctggtgcgttaaccacagcagttttagaccagttttctactgaaataaaaggtaaaaatgtagtttgtttaattagtggctcaaataatgacattactcgaacagaagaaataaaagagcgtgctttgcttcattctggacacaaacattatttcatcataaaatttccgcaaagagcaggtgctttactagagtttttaaatgatattttaggtccaaatgatgatattacccattttgaatataccaaaaaacacaacagaaattcaggtccagccattgttggttag

SEQ ID NO: 19754 - protein, 234 aa, Unknown
  Obtained from environmental sample
  DOMAIN (1)...(166): Pyridoxal-phosphate dependent enzyme
  misc_feature (1)..(234): Xaa is any amino acid
MSFVHPFXDIKVIEGQATIALEILAQSKTPVDYLFLPVGGGGLAAGVSSIFKELSPNTKIIGVEPKGAASMSVSITNGFNTKIENIDKFTDGASVQKVGDLNFEICKENLDEMVTVHEGKVCQTILDLYNKNAIVVEPAGALTTAVLDQFSTEIKGKNVVCLISGSNNDITRTEEIKERALLHSGHKHYFIIKFPQRAGALLEFLNDILGPNDDITHFEYTKKHNRNSGPAIVG

SEQ ID NO: 19755 - DNA, 459 bp, Unknown
  Obtained from environmental sample
  misc_feature (1)..(459): n is a, c, g, or t
ttggaattagtaaggaaaatagtagatattaatattggctttgaagttttcaaagatcaaatctactttcaacaaggagataaattattcaagtgtaatactgaaagtgaaaaggtaaaccctatttgtgaaattgaacataatttttcgggaatctcgaaaactcaaaacggtttagtattagtttcagctaaaggttttcaagttttatcaaacgaaaatatacttagtgaatttattgaaatagaaggaggtataggtgattacaaaataaaagaatcaaaatccttaatcataactgaaaaaataaatggcacttggaaacaaagcctaattgacccaattgcaaattcagtacgttggtcgtcgaatgaaaaagaaagaataatatactccgagggtggctactatgtcattaacaatcaaaatatttataaaaaggatgcagacagggattga

SEQ ID NO: 19756 - protein, 152 aa, Unknown
  Obtained from environmental sample
  misc_feature (1)..(152): Xaa is any amino acid
MELVRKIVDINIGFEVFKDQIYFQQGDKLFKCNTESEKVNPICEIEHNFSGISKTQNGLVLVSAKGFQVLSNENILSEFIEIEGGIGDYKIKESKSLIITEKINGTWKQSLIDPIANSVRWSSNEKERIIYSEGGYYVINNQNIYKKDADRD

SEQ ID NO: 19757 - DNA, 633 bp, Unknown
  Obtained from environmental sample
  misc_feature (1)..(633): n is a, c, g, or t
gtggttattggaattttaattgcgctacaaatcaataattggaatagtaacagaatagaaaaagaatcagactcacaattgattggagcattaattaatgatttaaaattaaaaaatgaagagcttatttctgatttagaatacggtaaatcactaattaaaaatactgataacatcattgaattttgggcaaaaacaaaaagaattgacactctaaatcttaaatactcaatcaatagacttggagacgacagaggatttcttaatgaaaaatcacaagtattagaaggtctaacaaattctggcttatggaaacgattaccagatagtttaactagggaaattgatgatgtttatagatttaaacttggagcagttaaaacatcatttgaaaaaacaactgaatatgcgtcacattacaaactaaattttcttgtaccaaatggactcgcagacacaaaattaaatacattcgaaatccattctatagttactgaaaaaaatatagaatttatttcaagtttagaagtatttagaggtggaatttatctcttaaattatagatttgaagacgcctcgaaaggaataattaaattaacagaaaatttaaacaattatcaatctgaattataa

SEQ ID NO: 19758 - protein, 210 aa, Unknown
  Obtained from environmental sample
  misc_feature (1)..(210): Xaa is any amino acid
MVIGILIALQINNWNSNRIEKESDSQLIGALINDLKLKNEELISDLEYGKSLIKNTDNIIEFWAKTKRIDTLNLKYSINRLGDDRGFLNEKSQVLEGLTNSGLWKRLPDSLTREIDDVYRFKLGAVKTSFEKTTEYASHYKLNFLVPNGLADTKLNTFEIHSIVTEKNIEFISSLEVFRGGIYLLNYRFEDASKGIIKLTENLNNYQSEL

SEQ ID NO: 19759 - DNA, 672 bp, Unknown
  Obtained from environmental sample
  misc_feature (1)..(672): n is a, c, g, or t
ttgcccacttggtttgaagtcagaattaatgaaaaaggttacttaggacgccgtgaaggatatgattttattgtggcaactaatggtcaaactgaattcaaagattacaatgagttactcagtggaggttattttttctatgattcatcaagaaaattacctgataatttgaatcgtactgacataactgaaattggcgtgccgttaactcggatttgtaatgaaaattatactgatccaagactcaggcaaatctttaaaaacattatttatgttggagcattggcctttttgtttgatatggactttagtgtttttgaagattcaattgcctctcagtttgcaaaaaaagctaaattaatcgaacccaatataaaagcattaaaactgggttatgattacgcgaaagaacattatcaaggcgtctgtggtttaaaaattgaaagacgtgatttagtaaaaaataaaatcatgatggaaggcaatgatgccactggattaggagcagtatttgcaggagcaacaattgcagggtggtatccgattacaccatcaacttctgtcattgaagctttcgagaaatattgccgaaaatttagagtcgataaagaaacgggaaaaacaaatttgctattgttcaggccgaagacgaattggcggccattggcatag

SEQ ID NO: 19760 - protein, 223 aa, Unknown
  Obtained from environmental sample
  misc_feature (1)..(223): Xaa is any amino acid
MPTWFEVRINEKGYLGRREGYDFIVATNGQTEFKDYNELLSGGYFFYDSSRKLPDNLNRTDITEIGVPLTRICNENYTDPRLRQIFKNIIYVGALAFLFDMDFSVFEDSIASQFAKKAKLIEPNIKALKLGYDYAKEHYQGVCGLKIERRDLVKNKIMMEGNDATGLGAVFAGATIAGWYPITPSTSVIEAFEKYCRKFRVDKETGKTNLLLFRPKTNWRPLA

SEQ ID NO: 19761 - DNA, 546 bp, Unknown
  Obtained from environmental sample
  misc_feature (1)..(546): n is a, c, g, or t
atgtcagagttcaaagaagtttctttaggttttgctgaatttgtttctcaacttattcaagaaacctttgatgcaatcctttcttctcaaaattatcaacttgagaaatatgctgaattagaaagtagattaaacttacctcacaatattttcgttgataattttataggaagtgaacaagttgaagccaaaaaagtagaattttttggctttaaaattgaaaagcaaatgattgttgatgacaaccttaatagttttatttcagagaattttaattcaacagaaaatcttgttttcaataaaaaattaactagttctggatttgattctataacatattacatagaaaatttacttgtagagagtcaaaaaaatattataaatacactaatcaataaatctagcgtttccagtttagttgntggattctggagagatttcagcaaagctagagttatcaaacctgtatttggaagaaagcaccaatactggaaaaaaaggaggtatcaagcactaaatttaatgtcaataaagaagaatccttga

SEQ ID NO: 19762 - protein, 181 aa, Unknown
  Obtained from environmental sample
  misc_feature (1)..(181): Xaa is any amino acid
MSEFKEVSLGFAEFVSQLIQETFDAILSSQNYQLEKYAELESRLNLPHNIFVDNFIGSEQVEAKKVEFFGFKIEKQMIVDDNLNSFISENFNSTENLVFNKKLTSSGFDSITYYIENLLVESQKNIINTLINKSSVSSLVXGFWRDFSKARVIKPVFGRKHQYWKKRRYQALNLMSIKKNP

SEQ ID NO: 19763 - DNA, 816 bp, Unknown
  Obtained from environmental sample
  misc_feature (1)..(816): n is a, c, g, or t
atgcctgaatggcttgatcagtataagcgagtcttaaacggggaagaaatatcagcatctaaagacaaaatggttagggatgatggttcagttcagtggatgaggaggaagctgattccatggtatatcgaacccggagaaataggaggtatgattatgtttaattcagatattacttcggaggtttcatacactgaaaaacttgaaaaagaggttcaaaacagaacaaaacaattggaaatagcaattaatgaactggaatcttttagctattccatttctcatgatctaagagctccattaagatcaataaatggattctcagatattttaatagaagattattcagaagctttggatgataatggaaatagattattgaatattgttagagacagcgcatcgaaaatgggacggttgatagatgatatactacatttttcacgactgggcaaaaaatctatcgagttcagatcgatgaatatgagccttatttttaaatctgtgattgacgatttaaatttctcgtacgtggggaaagaaccgtcagtaatgataagcgatttacatagtgcgatgggcgatccggcgcttattaagcaggtagttgtaaatttaattacaaatgcttacaaatattctgcaaataaagataaaatttcagttattgtacacagtaaaatccaaaatgacttggtactgtattctgtgaaagataatggggtaggctttgatactaaataccacgataaattatttggggtattccaaagattacattcagatgctgaattgaaggtaccccagccaatctga

SEQ ID NO: 19764 - protein, 271 aa, Unknown
  Obtained from environmental sample
  DOMAIN (194)...(270): Histidine kinase-, DNA gyrase B-, and HSP90-like ATPase
  misc_feature (1)..(271): Xaa is any amino acid
MPEWLDQYKRVLNGEEISASKDKMVRDDGSVQWMRRKLIPWYIEPGEIGGMIMFNSDITSEVSYTEKLEKEVQNRTKQLEIAINELESFSYSISHDLRAPLRSINGFSDILIEDYSEALDDNGNRLLNIVRDSASKMGRLIDDILHFSRLGKKSIEFRSMNMSLIFKSVIDDLNFSYVGKEPSVMISDLHSAMGDPALIKQVVVNLITNAYKYSANKDKISVIVHSKIQNDLVLYSVKDNGVGFDTKYHDKLFGVFQRLHSDAELKVPQPI

SEQ ID NO: 19765 - DNA, 585 bp, Unknown
  Obtained from environmental sample
  misc_feature (1)..(585): n is a, c, g, or t
ttgataggatatttgatagaagaattgaaacgtttggatactgatggaaatataaacctgatgattgtttctgaccatggaatgatcgaagtacttcctgagaaaagagtcgtattagatgattatatcaatgtaaataatattgaagtgatttcgtattcaccggcactcatgtttaatgtgaaagaggatggaaacgaagcagaaatttattcagcgttaaaagcagatcaaaatcattataaagtgtattcaaaagctgatatcccggagcgctatcatcttaaaaataatatcagaactccagatttcctgatggttgctgatgaaggatatacaataaatatgaaggagtattttgattctagaggtgatgattatccacgtggcggcgctcatggttttgataattcaaatacaaaaatggatgcactttttgtagcttatggcccagcattcaaacaaggagcaaaattggatcgtatcgaaaatgttcatctttatgaagttatggcaaaaattttaaatattaagccagcaccaaacgatggaaatttcagtttagttaaagaaatgcttaaataa

SEQ ID NO: 19766 - protein, 194 aa, Unknown
  Obtained from environmental sample
  misc_feature (1)..(194): Xaa is any amino acid
MIGYLIEELKRLDTDGNINLMIVSDHGMIEVLPEKRVVLDDYINVNNIEVISYSPALMFNVKEDGNEAEIYSALKADQNHYKVYSKADIPERYHLKNNIRTPDFLMVADEGYTINMKEYFDSRGDDYPRGGAHGFDNSNTKMDALFVAYGPAFKQGAKLDRIENVHLYEVMAKILNIKPAPNDGNFSLVKEMLK

SEQ ID NO: 19767 - DNA, 612 bp, Unknown
  Obtained from environmental sample
  misc_feature (1)..(612): n is a, c, g, or t
gtgtggtgtatttctaataagttagagactattatcacaagaagaaatggtaaagtttctataatgggtaattgtataggaagaggttctcgtttagcagatgggaaacctaattttatcattctggactatggaggtaatacttcacgatttggattctatgatgatgatagagaatggtctttagaaaatgaccttactaacttcaagaaggaatcttcaatgacgaagatatgtcctgtatgttcagcagtagttccaatgaatactattacttgcagatgtggacatgtatggactaaacaaagacgtgagcaaatgacagaagaaatagtcatagacttaatgcctttgaatggttttgctgttcaagaatatgctcaaggtaaatcttttgaggagttagaaataatccaagagattaaagactacaagaagtattggattaaacaccaattacagagtaaagaggatttgaaaatgttcggtgaatatatgggttataaaaaaggatggtatgattttgctgttaaagattttaaacctatgactattgaacaacgtaaaatagattatgataactatattgctcgtaggcaacgtggttactaa

SEQ ID NO: 19768 - protein, 203 aa, Unknown
  Obtained from environmental sample
  misc_feature (1)..(203): Xaa is any amino acid
MWCISNKLETIITRRNGKVSIMGNCIGRGSRLADGKPNFIILDYGGNTSRFGFYDDDREWSLENDLTNFKKESSMTKICPVCSAVVPMNTITCRCGHVWTKQRREQMTEEIVIDLMPLNGFAVQEYAQGKSFEELEIIQEIKDYKKYWIKHQLQSKEDLKMFGEYMGYKKGWYDFAVKDFKPMTIEQRKIDYDNYIARRQRGY

SEQ ID NO: 19769 - DNA, 783 bp, Unknown
  Obtained from environmental sample
  misc_feature (1)..(783): n is a, c, g, or t
atgtattctttattaaaaattaatttcgttttgaaactaaaactaatctttgcattttttcttttattatttgtgaatcggatttgcgcgcaaacaaattcgattcgaattaatgcagttttagatgcaaaaaatgatgtattaaaaattcagcaagaacttgtttaccacaacaattctaaccaatctttaagcgaaatatatcttcttaattgggcaaatagttttaaagataaaaacacgccgctaacaaaaagattgattgaagattatgataaatcactctattttgcaaaagagaatgagcgtggttttagcaagattttaaacctatcagtaaactataaaccgacaccatttacttcggataaaaatactgaagacattttaaagatcgatttagccgaagcgttaaatcctgcagattctattgtcatcagtgcttcgtttactgttaaaattccagatgctaaatttacaggttacggaaaaacaaaaacggggtatcatttacgttattggtatttaacgcctgttgtttttactacggattggcaattaatgagcaatttaaatatcgatgatttatttatagatattaccaattatgacatccacttaaaagttgccgaaaacacttttgtgacgagtaatttatcgcaaaaaaaagaatcaaattcggtttatactttgtcgggaaaaaacaaaacggatgtcataataagtattgataaaaaaaataatttcacggtttataaaaccgaaaatattgatgtattctga

SEQ ID NO: 19770 - protein, 260 aa, Unknown
  Obtained from environmental sample
  misc_feature (1)..(260): Xaa is any amino acid
MYSLLKINFVLKLKLIFAFFLLLFVNRICAQTNSIRINAVLDAKNDVLKIQQELVYHNNSNQSLSEIYLLNWANSFKDKNTPLTKRLIEDYDKSLYFAKENERGFSKILNLSVNYKPTPFTSDKNTEDILKIDLAEALNPADSIVISASFTVKIPDAKFTGYGKTKTGYHLRYWYLTPVVFTTDWQLMSNLNIDDLFIDITNYDIHLKVAENTFVTSNLSQKKESNSVYTLSGKNKTDVIISIDKKNNFTVYKTENIDVF

SEQ ID NO: 19771 - DNA, 756 bp, Unknown
  Obtained from environmental sample
  misc_feature (1)..(756): n is a, c, g, or t
atggacgaagtttcgtgttctacatgtaacggaaatcgtcttaaaaaagaagccttgtattttaaaattttagataaaaatattagcgatttggcgaagatggacatcacagaattggcaaattggtttgacaaactcgataaaaaaatctctaaaaggcaattaacaattgctgaagaaattttaaaagaaattagaactcgaattcagtttttactagatgttggtttagattatttaaacttagacagaacttcaaaatcgctgtctggcggagaagcgcaacgtatcagattggcaacacaaattggttctcaactagttggcgtgttgtatattttagacgaaccgagcattggtttacatcaaagagacaatcaaaaattaattgattctttaataaaattacgagatattggcaattcggtgctggttgtagaacatgataaagacatgattgaagccgcagattttgtgtttgatattggccctggagctggaagacatggcggagaaattgtaagcgaaggaacgtttgaagaattaaaaaaacacgatacgttaactgcggattatatcacaggtaaaaaagtaattgctgttcctaaaaaaagaagaaaaggaaacggaaaaaaaattcaattaaaaggagcgacaggaaataatttaaaaaatgtttcagtagattttcctttaggaaaaatgatttgcgttactggagtttctggaaagcggaaaatcaaccttgataaatga

SEQ ID NO: 19772 - protein, 251 aa, Unknown
  Obtained from environmental sample
  DOMAIN (16)...(165): ABC transporter
  misc_feature (1)..(251): Xaa is any amino acid
MDEVSCSTCNGNRLKKEALYFKILDKNISDLAKMDITELANWFDKLDKKISKRQLTIAEEILKEIRTRIQFLLDVGLDYLNLDRTSKSLSGGEAQRIRLATQIGSQLVGVLYILDEPSIGLHQRDNQKLIDSLIKLRDIGNSVLVVEHDKDMIEAADFVFDIGPGAGRHGGEIVSEGTFEELKKHDTLTADYITGKKVIAVPKKRRKGNGKKIQLKGATGNNLKNVSVDFPLGKMICVTGVSGKRKINLDK

SEQ ID NO: 19773 - DNA, 651 bp, Unknown
  Obtained from environmental sample
  misc_feature (1)..(651): n is a, c, g, or t
atgcccgttatagtatgcttcggcccaggtccgaaattcaaaggcgggatttcgaattataatacttcattagctaagaacttggataaagatccaaataatgacgtacatattgtttcttggacaaatcaatatccttctatcattcctagggagtttgtggacaaatcaagtcgctcagatttcatggaaggaaccaatatcaaaattgagtatatcaccaattacaataacccattaagctggcgtaaaactgcaaaatttattaaatcacttaacccagataaagtgattttccaatgggcgatttctattcaaggtttgccaatgggatcaatcgctaaatggttgaagcgaaattctgatgctgaaatcatttttgatcttcattttgtagttcaaaaagaaggtagttctgtagatgaacgatttactaaaatgggaatcaagtatgcggatacctatatcgctcatgcctataaaacagtgaacgaactaaaggcgttattacctagaanagagttctcagttaatngaaccggtaagcgatccactaatacagctacaactgtttataaattatttcatccagtgtacgatctctatcaacctgatgcacaatttgatgttgagaagtttaaacagaactag

SEQ ID NO: 19774 - protein, 216 aa, Unknown
  Obtained from environmental sample
  misc_feature (1)..(216): Xaa is any amino acid
MPVIVCFGPGPKFKGGISNYNTSLAKNLDKDPNNDVHIVSWTNQYPSIIPREFVDKSSRSDFMEGTNIKIEYITNYNNPLSWRKTAKFIKSLNPDKVIFQWAISIQGLPMGSIAKWLKRNSDAEIIFDLHFVVQKEGSSVDERFTKMGIKYADTYIAHAYKTVNELKALLPRXEFSVNXTGKRSTNTATTVYKLFHPVYDLYQPDAQFDVEKFKQN

SEQ ID NO: 19775 - DNA, 780 bp, Unknown
  Obtained from environmental sample
  misc_feature (1)..(780): n is a, c, g, or t
atgggagttgaacaggtgtatatggattatttccaacgcgccagagaatatgaaactattaaaaaaagtggaaaagactttagaaaggatattgaaatggaaaccatagttgaaattcttaataaaaaaagatttatcacttgccattcttatgttcaaagtgagatcaatatgttgatgaaagttgccgataaatttgatttcacaataaatacttttacacatattttagaaggttataaagttgccgataaaatgaaagcacatggtgttggtggatcaacatttgctgattggtgggcttataaatatgaagttaatgatgcaataccttataatgcagctattatgaataaacttggaattgttacagcaatcaattctgatgatagagaaatgataagacgattaaatcaagaagctgctaaaacggttaaatacggtggagttagtgaagaagatgcttggaaaatggtaaccttaaatccggcaaaattattacaaattgatgatcgagttggtagtattaaagtgggtaaagaagcagatgtagttttatggagcgatcatcctttatcgatcaaggctaaagccgaaaaaacactaattgaaggcgttgtttatttcgatatagaaaaagatatagcaatgcgaaaagccatcaaaaaagaacgtaatcaattgattcatatgatgcttcaagatcacaatcacgggaaaccaagaaaaatcctacaaggaaacagatcacgaatgccttgtgatactgtggaattctat

SEQ ID NO: 19776 - protein, 260 aa, Unknown
  Obtained from environmental sample
  misc_feature (1)..(260): Xaa is any amino acid
MGVEQVYMDYFQRAREYETIKKSGKDFRKDIEMETIVEILNKKRFITCHSYVQSEINMLMKVADKFDFTINTFTHILEGYKVADKMKAHGVGGSTFADWWAYKYEVNDAIPYNAAIMNKLGIVTAINSDDREMIRRLNQEAAKTVKYGGVSEEDAWKMVTLNPAKLLQIDDRVGSIKVGKEADVVLWSDHPLSIKAKAEKTLIEGVVYFDIEKDIAMRKAIKKERNQLIHMMLQDHNHGKPRKILQGNRSRMPCDTVEFY

SEQ ID NO: 19777 - DNA, 675 bp, Unknown
  Obtained from environmental sample
  misc_feature (1)..(675): n is a, c, g, or t
gtgggtactgtctatttcaatgttaatgaattaaatttcttttcagaaattggtttaaaacttgcaaactctgtagaaataacaagtccaaacgatgaaattttatttgatgagccacatcccgaatttgaacagcaagcgtttttacacgcaatggcaaaatcacaaagaagcaatccttttgttcgtgtcctaaacgataatattccactaatcttattgctacaagtaattcaaaagttaaataatgataaagaatttaatgatgcaggaatatctcgattagagttgcctttaattttatattggcaagataatgactctgaaagtctttatcaacgtattaaaaaattaagaaaaaaacacggatatagtccaagttgggaagttatcaccgacatctgtcgtaatgaaattatggctggagatgatattaagcgagaagacaaatctataatgaacgaatatcctgatgaatttattcgtaaaatgcgactaacaggagttatatctctgcgtggtggtggtagatttattgatattaacagaaatgaacaagcaaaagttgattatattcttaaagagtattcggcttacaaaaaatattcaacagaaaaagaatattttacgtatatgtcaacaacggacaaatgttttaataagtttaaaaactaa

SEQ ID NO: 19778 - protein, 224 aa, Unknown
  Obtained from environmental sample
  misc_feature (1)..(224): Xaa is any amino acid
MGTVYFNVNELNFFSEIGLKLANSVEITSPNDEILFDEPHPEFEQQAFLHAMAKSQRSNPFVRVLNDNIPLILLLQVIQKLNNDKEFNDAGISRLELPLILYWQDNDSESLYQRIKKLRKKHGYSPSWEVITDICRNEIMAGDDIKREDKSIMNEYPDEFIRKMRLTGVISLRGGGRFIDINRNEQAKVDYILKEYSAYKKYSTEKEYFTYMSTTDKCFNKFKN

SEQ ID NO: 19779 - DNA, 384 bp, Unknown
  Obtained from environmental sample
  misc_feature (1)..(384): n is a, c, g, or t
gtgcaaggaaaattgtctaaattcatggcagttaaaaaagtcaacccaccccttatcatggtcaaaaacctcacctttttactgatttttattgttgcagttagtttttcgggatgtagtacggggatagacagcaccgccgccgccaatcgacactatgagtcgttctataattcaatgagacatgctgcggaaaaaaccgattggttcaacgacgaccgggaggatcagattctgcgcaacatttacgaccaaatgctaaaacgtgaccaaaccaataccctcctcaaaatcgaaattgaggaatcgaaaaagcgaaccgaagagatctgtgcgtntctggaccagcagtccaataacttaaaaacctttcggggcatatga

SEQ ID NO: 19780 - protein, 127 aa, Unknown
  Obtained from environmental sample
  misc_feature (1)..(127): Xaa is any amino acid
MQGKLSKFMAVKKVNPPLIMVKNLTFLLIFIVAVSFSGCSTGIDSTAAANRHYESFYNSMRHAAEKTDWFNDDREDQILRNIYDQMLKRDQTNTLLKIEIEESKKRTEEICAXLDQQSNNLKTFRGI

SEQ ID NO: 19781 - DNA, 798 bp, Unknown
  Obtained from environmental sample
  misc_feature (1)..(798): n is a, c, g, or t
atgatcaactatttcaattatgattatgaaaatccaaccggaaaacatcccttttcagtaaataccgaagttggagtagcaccctggaatccgaaacacagattagttcaaattggaattcaagggcgacatatagaagctaatgatcttccaccaagcaatctcgtttttctacttgatgtctctggttcaatgagtgctcatgataaactccccttacttaaaaaaggattcaaacttcttactaatcagctcagagaagaagattatgtgtcaatcgtggtgtatgctggaaattcaggattggtgcttcctccaacttctggttcagataaagaaacaatactggaagcacttaataaacttaatgccagtggttctacagctggtgcggcgggaatcaaacaagcataccaagtagctaaagagcatttcagagaaaacggaaataatcgtgtgatccttgccactgatggtgattttaatgtgggcgtttcaagcaacaacgaattgactaaactgataaaaaagaaacgagacgaaggaatttttctttctgtactaggcttcggttctggtaatttgaaagattctaaaatggaacagatcgctgataacggaaatgggaattattactacatcgataatttattagaagctaagaaagtactcgtttcagaaatgggaggaacactccacactattgcaaaggatgtcaagattcaggttgaattcaatcctcaaaatgtaaaagcataccgtttgattggatatgaaaaccgaatacttgctgattga

SEQ ID NO: 19782 - protein, 265 aa, Unknown
  Obtained from environmental sample
  DOMAIN (54)...(228): von Willebrand factor type A domain
  misc_feature (1)..(265): Xaa is any amino acid
MINYFNYDYENPTGKHPFSVNTEVGVAPWNPKHRLVQIGIQGRHIEANDLPPSNLVFLLDVSGSMSAHDKLPLLKKGFKLLTNQLREEDYVSIVVYAGNSGLVLPPTSGSDKETILEALNKLNASGSTAGAAGIKQAYQVAKEHFRENGNNRVILATDGDFNVGVSSNNELTKLIKKKRDEGIFLSVLGFGSGNLKDSKMEQIADNGNGNYYYIDNLLEAKKVLVSEMGGTLHTIAKDVKIQVEFNPQNVKAYRLIGYENRILAD

SEQ ID NO: 19783 - DNA, 411 bp, Unknown
  Obtained from environmental sample
  misc_feature (1)..(411): n is a, c, g, or t
atggaagacaaaattgtttatataacaggagctggtttttctcgaccattaggtcttcctttaatgaatgatttttatgaaaaatctaaagatttacatatatcaaataaagaaaggtatggatactttaacgaggtttttgatacaataagagagcttcaaataatcaaaagttattacaaatctgatttatttaatatagaagaaattctttcgataattgagatgtggaaggaaattggaggaaaagatcttaaagaatcagtagatgattatatatcagatactatatcaggttatactggaaaaatacctaatatagatgaagatgagctatttaatatagtaaatctgtgtactagagaagattcatattggtttaaatatataatctttatgctaagttttnat

SEQ ID NO: 19784 - protein, 137 aa, Unknown
  Obtained from environmental sample
  misc_feature (1)..(137): Xaa is any amino acid
MEDKIVYITGAGFSRPLGLPLMNDFYEKSKDLHISNKERYGYFNEVFDTIRELQIIKSYYKSDLFNIEEILSIIEMWKEIGGKDLKESVDDYISDTISGYTGKIPNIDEDELFNIVNLCTREDSYWFKYIIFMLSFX

SEQ ID NO: 19785 - DNA, 501 bp, Unknown
  Obtained from environmental sample
  misc_feature (1)..(501): n is a, c, g, or t
atgagaaccttgtcctttttgattgtcactttcagcgtactcatttcaggatgcgccgccaccttcaacggggcctatcaacaggtaaccatcaagggcgaatccaaggcaaaaatgaaggtcaacggggaggacgtaagcaatgaagacggcatcgttcgtttgaagcgcaatgggcaattccagcaaatcaccttttcacggaagggctacaaagacgccaatgtagcgatttctcaaaccagtatgtcccccctgtatgtgatctcatgggtaccttttggggtgttgttttttcctccgctgctcgatcctttttccgcgaaagcttacaattacccgaaggaattcaagtacgatgaaggaatgtacgagcttcccaaaaaggatgtcgccggcatggacatcatgctcagcaaggtgggccttgacttgaaagcagagaagattcagttccggttttaccccaggtacaaatacttatccgggatatccatggan

SEQ ID NO: 19786 - protein, 167 aa, Unknown
  Obtained from environmental sample
  SIGNAL (1)...(19)
  misc_feature (1)..(167): Xaa is any amino acid
MRTLSFLIVTFSVLISGCAATFNGAYQQVTIKGESKAKMKVNGEDVSNEDGIVRLKRNGQFQQITFSRKGYKDANVAISQTSMSPLYVISWVPFGVLFFPPLLDPFSAKAYNYPKEFKYDEGMYELPKKDVAGMDIMLSKVGLDLKAEKIQFRFYPRYKYLSGISMX

SEQ ID NO: 19787 - DNA, 609 bp, Unknown
  Obtained from environmental sample
  misc_feature (1)..(609): n is a, c, g, or t
ttgctacaagtaattcaaaagttaaataatgataaagaatttaatgatgcaggaatatctcgattagagttgcctttaattttatattggcaagataatgactctgaaagtctttatcaacgtattaaaaaattaagaaaaaaacacggatatagtccaagttgggaagttatcaccgacatctgtcgtaatgaaattatggctggagatgatattaagcgagaagacaaatctataatgaacgaatatcctgatgaatttattcgtaaaatgcgactaacaggagttatatctctgcgtggtggtggtagatttattgatattaacagaaatgaacaagcaaaagttgattatattcttaaagagtattcggcttacaaaaaatattcaacagaaaaagaatattttaagtatatgtcaacaacggacaatgttttaataagtttaaaaactaaacctttagatataactgaaaatgataaattacttgaacaatgggtaaatcattatacttgggaaattataaaatccgaatttaaaggtttagctgttagaaaaaattctacagacccaattctgaaatttttaactcatccaatcaagacttga

SEQ ID NO: 19788 - protein, 202 aa, Unknown
  Obtained from environmental sample
  misc_feature (1)..(202): Xaa is any amino acid
MLQVIQKLNNDKEFNDAGISRLELPLILYWQDNDSESLYQRIKKLRKKHGYSPSWEVITDICRNEIMAGDDIKREDKSIMNEYPDEFIRKMRLTGVISLRGGGRFIDINRNEQAKVDYILKEYSAYKKYSTEKEYFKYMSTTDNVLISLKTKPLDITENDKLLEQWVNHYTWEIIKSEFKGLAVRKNSTDPILKFLTHPIKT

SEQ ID NO: 19789 - DNA, 870 bp, Unknown
  Obtained from environmental sample
  misc_feature (1)..(870): n is a, c, g, or t
ttgaaaaaagaatacaggcgaacacacacaacgccagatccaatcacgatcaattcgtatttaaatgataggaaacatgaaggtgttgattattgttttatggaagtgagttcgcatggaattcatcaaaaaaggacacacggattgcattttgaaggcggaattttcacgaatctttctcacgatcatttagattatcacaattcgtttgcagcatatagagatgttaaaaaagcattttttgattcgttgccaaaatcggcttttgcacttgtaaatattgatgataaaaacggaacagtaatgttgcaaaataccaaagcaacaaaaagaacatatgcgttaaaaaccattgcagattttaaaggaaaagtgctagaaaaaagtatgtctggaactttattaacggtaaatggaacagaaatttggtctaaacttatcggaacatttaatgcatacaatttattagcaattattggaacggcagaattatgcggtttagaaaaactagaaattttaagattaacaagtgaattagaaagtgtaagtggtcgttttcaatacacaatttctaaaaccggaattaccgcaattgtagattatgcacacacgccagatgcgttaaaaaatgtgttagaaaccattgctgatattaaaacgggtaaagaaaaagtaatcacagttgttggttgtggcggcgatagagataaaacaaaaagaccaaaaatggcaagaattgcttcgcagttaagcaatcaagcaattttcacatctgataatccaagaacagaaaatgcgcaaacgattattgatgaaatggaagattggagtaagcgcagaaaatattgcaaatcatctcgaggtagctga

SEQ ID NO: 19790 - protein, 289 aa, Unknown
  Obtained from environmental sample
  DOMAIN (1)...(173): Mur ligase family, catalytic domain
  misc_feature (1)..(289): Xaa is any amino acid
MKKEYRRTHTTPDPITINSYLNDRKHEGVDYCFMEVSSHGIHQKRTHGLHFEGGIFTNLSHDHLDYHNSFAAYRDVKKAFFDSLPKSAFALVNIDDKNGTVMLQNTKATKRTYALKTIADFKGKVLEKSMSGTLLTVNGTEIWSKLIGTFNAYNLLAIIGTAELCGLEKLEILRLTSELESVSGRFQYTISKTGITAIVDYAHTPDALKNVLETIADIKTGKEKVITVVGCGGDRDKTKRPKMARIASQLSNQAIFTSDNPRTENAQTIIDEMEDWSKRRKYCKSSRGS

SEQ ID NO: 19791 - DNA, 735 bp, Unknown
  Obtained from environmental sample
  misc_feature (1)..(735): n is a, c, g, or t
atgaaatttatcaacaaaatgagatcatttggtttagataaaaaactaggattacaaattcaaggagaaggaacaccatttattccgtatccaggaaatacaagaaatccttggaataaaatttctttagaatggatggcttggggatacggtgtttctcttacacctttacaaatgttaacattttacaatgctgttgcaaacaatggcgaaatggtaaagccacggtttatcaaagaattgcgagtacaaaataaaacggagaaagtctttaaaaaggtaattataaaagaaaaaattgcgagtcaagaaacgataaataaagttagaaaagtattggaaaatgttgtgataaaaggaacagcagaacatatttattctccaaatttttctatggctggtaaaaccggaactgcaaaaaaatgggtagatacttatactgataaagaaggaaaaaggataaaaggccattattctagtcaattatatgttgcttcatttgcaggtttttttcctgcggataaccctaaatattcttgcattgttgtaattcacgaacccaacaaaaagacaggatattacggagcaattgttgccgctccagtttttaaagaaatcgctccaaaaatatattacattacgccaattaatgtgcaacaagtaatgatcaaacaacattactggattagattcacagtatcaggagtactattaaaacgttacaaaggaacgnna

SEQ ID NO: 19792 - protein, 245 aa, Unknown
  Obtained from environmental sample
  DOMAIN (1)...(208): Penicillin binding protein transpeptidase domain
  misc_feature (1)..(245): Xaa is any amino acid
MKFINKMRSFGLDKKLGLQIQGEGTPFIPYPGNTRNPWNKISLEWMAWGYGVSLTPLQMLTFYNAVANNGEMVKPRFIKELRVQNKTEKVFKKVIIKEKIASQETINKVRKVLENVVIKGTAEHIYSPNFSMAGKTGTAKKWVDTYTDKEGKRIKGHYSSQLYVASFAGFFPADNPKYSCIVVIHEPNKKTGYYGAIVAAPVFKEIAPKIYYITPINVQQVMIKQHYWIRFTVSGVLLKRYKGTX

SEQ ID NO: 19793 - DNA, 813 bp, Unknown
  Obtained from environmental sample
  misc_feature (1)..(813): n is a, c, g, or t
ttgattcggtcgagttgggaggtgagcatccagccgaatcacgcggagtcgcaaagccatcttgcccacactttgtccctggaaaatccactccatgatcaagtggtaaaacaatccgggaagcatcaccagcgccaccaagccattttccggaagataaacgatcatattcagaaccgcgatcgccagcaacacgtatcctactatgatcacaaagtcgatcagccaggccaggatacgatcaaaaacagtagcgagttcatactcgatatctatgtgctgggtggtggtgattttgatttttgtcacggcaaaaagctttggtctgcaaaaagtttattatttttcacaaaatcatttcgcaaatcgaagataatgagagaaactgctttcctcaaacaaaacgaaaaaaagtggaaagaatttgagactttgctccgggcccgtaaatctacggtttctccggataagatcgcggatttgttcatcgaactcaccgacgacctggcctatgcgcgcacccattacccggaaagcaacactgtcaaatacctcaacggactcgccgggcaggtccatctggccctggtaaaaaacaaaaagcccaagaaaaacggnctctgggccttctggaaatacgaactgccgctgatcatggcagaatctcaccgcaagctcttttattcctttctcatttttatgattgccattggaatcggagtgatttccaccatttacgacgaaaacttcctcagactcatcctttccgacgaatatgtagaaatgaccctgggcaaaatcaaaagcgggnnn

SEQ ID NO: 19794 - protein, 271 aa, Unknown
  Obtained from environmental sample
  misc_feature (1)..(271): Xaa is any amino acid
MIRSSWEVSIQPNHAESQSHLAHTLSLENPLHDQVVKQSGKHHQRHQAIFRKINDHIQNRDRQQHVSYYDHKVDQPGQDTIKNSSEFILDIYVLGGGDFDFCHGKKLWSAKSLLFFTKSFRKSKIMRETAFLKQNEKKWKEFETLLRARKSTVSPDKIADLFIELTDDLAYARTHYPESNTVKYLNGLAGQVHLALVKNKKPKKNGLWAFWKYELPLIMAESHRKLFYSFLIFMIAIGIGVISTIYDENFLRLILSDEYVEMTLGKIKSGX

SEQ ID NO: 19795 - DNA, 405 bp, Unknown
  Obtained from environmental sample
  misc_feature (1)..(405): n is a, c, g, or t
ttggtagcatctcttcatgatggctttattggtgcaattgacattccactggtcaattacagagctcatactgatatatttaagagaatcccctcgggatatatggggaaatggaaaaagaatgttcagcctaaagacactaattactacaagattaaaaaacaacgcatagattgtctgtgccaatacatgtatgacaatagagaggcgatacattataagcactttttaaatcgtataccttcgatgaaaaagcacgtatcttctcttctcaagcatcgaacaaataagtcaattggattactatttatattaaaagagtttataacacttcgctattttcgatattcttttgttaataaattatcaatgccaggttttattgttgactacatatctagttag

SEQ ID NO: 19796 - protein, 134 aa, Unknown
  Obtained from environmental sample
  misc_feature (1)..(134): Xaa is any amino acid
MVASLHDGFIGAIDIPLVNYRAHTDIFKRIPSGYMGKWKKNVQPKDTNYYKIKKQRIDCLCQYMYDNREAIHYKHFLNRIPSMKKHVSSLLKHRTNKSIGLLFILKEFITLRYFRYSFVNKLSMPGFIVDYISS

SEQ ID NO: 19797 - DNA, 525 bp, Unknown
  Obtained from environmental sample
  misc_feature (1)..(525): n is a, c, g, or t
ttgaaaacggctttattcatcctgttctgtaccttggggcagatgtccctcgcgcaatcaaccagcccaatgaaactgccgttcaaagacatccagggcaaatggttcatcaacctgtccaatttccccatgtggctgaagggaaacaaaacgcatccagaattcaactacagcattcaggatcggaagggcaaaaccgtgctgctggacgaagtgtattttgagaaaaggggcaaacgaaagagcattacgggatttgacacctcattgaatgagaaaaactcaaaatttgtctggcggggaaatgggattttgggaattctgaaaagcaaatgggagattgtgcattttgatctgcaggaagaatggatggtcatctacttcgaaaaaacactcttcactcctgagggatacgatgtggtctcgcggaagaaaaacctgtccccggaaatccgaaagcatatcgaaaaaatcctgaaaagcttaaatccaaagccggaactcaccgaaatctcccagaattga

SEQ ID NO: 19798 - protein, 174 aa, Unknown
  Obtained from environmental sample
  SIGNAL (1)...(18)
  misc_feature (1)..(174): Xaa is any amino acid
MKTALFILFCTLGQMSLAQSTSPMKLPFKDIQGKWFINLSNFPMWLKGNKTHPEFNYSIQDRKGKTVLLDEVYFEKRGKRKSITGFDTSLNEKNSKFVWRGNGILGILKSKWEIVHFDLQEEWMVIYFEKTLFTPEGYDVVSRKKNLSPEIRKHIEKILKSLNPKPELTEISQN

SEQ ID NO: 19799 - DNA, 414 bp, Unknown
  Obtained from environmental sample
  misc_feature (1)..(414): n is a, c, g, or t
atgcaacccacccaatcatttgttcttattgaggacgacgaggtagatattttgtcagtaaaaagggctttcaaggagcttgatatccctaaccccttggtgataaccaaaaatgggcaggaggcacttgattacattgaaaacacccaagaccccctacctgcacttattcttcttgaccttaacatgcctaagatgaatggtattgaatttctacaatacattaaggcaagggctaaactaaaagctattccagttgttatattaactacttcatcaaactatgtagacattaacaaaagctttgaaaattatgctgctggttacatagtgaagccaatggatttcactaattttaaagaagtgattcgcaaagtgtatgagtactggactagttgtgaattaccaagataa

SEQ ID NO: 19800 - protein, 137 aa, Unknown
  Obtained from environmental sample
  DOMAIN (5)...(131): Response regulator receiver domain
  misc_feature (1)..(137): Xaa is any amino acid
MQPTQSFVLIEDDEVDILSVKRAFKELDIPNPLVITKNGQEALDYIENTQDPLPALILLDLNMPKMNGIEFLQYIKARAKLKAIPVVILTTSSNYVDINKSFENYAAGYIVKPMDFTNFKEVIRKVYEYWTSCELPR

SEQ ID NO: 19801 - DNA, 792 bp, Unknown
  Obtained from environmental sample
  misc_feature (1)..(792): n is a, c, g, or t
ttgataaaaaatagaatttatcgagatccatacgatactctagatggtaaaagatcgaaagtagttgatcaactcgatctcgtgtatttcgctaaatgcgcttattgtgagcggatatgcaaagcggatgtcgagcactaccggccgaaaaaagcggtgaaagaagattccactcatgagggctattattggctgtgttatgagtggagcaatcttattccttcatgtatcacttgtaaccgcgaaggggccaagcacaataaattctcaatcgctggcacccgcgtagcagcaccgccctttttacctgatggcacccttgatttttcgttgatgaaagccaattgtgcaattctcaaaaatgaaatcccagacttattacaccctgaggttgatcctccagatgacttttttgagtttgaggccgaccctgccggcgagggaatcagaattaaggggaaggatgcaggtaaccgaggtgaaaaaactatcgatatttgcaagctgaaccgtaaggaactgaaactcatgcgtcaaaaacatatcgttgatgactttacggaaactgttcattgcatttttcaacaacacaccttcaatcagcgcagtaaacgtgaattgaacagcggtattcacgatgcgttacacgcactccatcgaaaaagttcaaatgaaacctttgatttcacttttctaagaaaatctgtcatcgaagaacaagataactttaagaagatcgtgattcccttcttggacaaaggtgtccacacggtgaccttggaccgcatttga

SEQ ID NO: 19802 - protein, 263 aa, Unknown
  Obtained from environmental sample
  misc_feature (1)..(263): Xaa is any amino acid
MIKNRIYRDPYDTLDGKRSKVVDQLDLVYFAKCAYCERICKADVEHYRPKKAVKEDSTHEGYYWLCYEWSNLIPSCITCNREGAKHNKFSIAGTRVAAPPFLPDGTLDFSLMKANCAILKNEIPDLLHPEVDPPDDFFEFEADPAGEGIRIKGKDAGNRGEKTIDICKLNRKELKLMRQKHIVDDFTETVHCIFQQHTFNQRSKRELNSGIHDALHALHRKSSNETFDFTFLRKSVIEEQDNFKKIVIPFLDKGVHTVTLDRI

SEQ ID NO: 19803 - DNA, 588 bp, Unknown
  Obtained from environmental sample
  misc_feature (1)..(588): n is a, c, g, or t
atgataagagatttctcaaaggataaaatcaggaactacttagctagtgttcacaatctcgttcctgatgaaggaccaagtaaggctgcaaattttgacctaattataaaatataacaggctaagaaaaacccttattgagaaacaaagcctcttaaataagagaaagtctgaagaaactcttcttgagcaggaaatccatattaagaaagaaaaatttgaagattgggcatcaacagttccagatctcctcttaaagcatgtagtaaatggggatgatattcccaaaatcggagcaaataatttaaactctcttttgtattctttaaagaatgctcaagggctcatcggtaaagtaatattctcaatattcaaaaagaataaagttcaagaaaaactctctatgattgatggtgatttaccactttggatacaaaataaattatcgcatgatgcaccacttatctcattaacagtacccttcagaatttcagcactattttatgtacatgaattacaaaaattactcttaaatatcgattcggtcaatgatcaacataatgactggcaantaaaaattccttactaa

SEQ ID NO: 19804 - protein, 195 aa, Unknown
  Obtained from environmental sample
  misc_feature (1)..(195): Xaa is any amino acid
MIRDFSKDKIRNYLASVHNLVPDEGPSKAANFDLIIKYNRLRKTLIEKQSLLNKRKSEETLLEQEIHIKKEKFEDWASTVPDLLLKHVVNGDDIPKIGANNLNSLLYSLKNAQGLIGKVIFSIFKKNKVQEKLSMIDGDLPLWIQNKLSHDAPLISLTVPFRISALFYVHELQKLLLNIDSVNDQHNDWQXKIPY

SEQ ID NO: 19805 - DNA, 579 bp, Unknown
  Obtained from environmental sample
  misc_feature (1)..(579): n is a, c, g, or t
ttggtaactgatagcgaagaacctcatatcaaagctgtaagtaataactctgcttctggttggaagtataaagtggatattgaccctaaagaatacccaatcattgaatggaagtggaaagttgatggcgttcttgaaaatggagatatgactgaaaaagatggagatgattatccggctagaatttacatcacttatgaatatagtagaaaagatcttcctcttggagaacgcattaaatatggaagcatgaaaacattcactgatttcgatatcccattacgatctatgaactatgtatgggcaaataaaacagatacaggaactgttcaggaaaatgttttcaccaattgggtaaatatggttgtaatagaatctggcgatagaaaagcaggagaatggataacatccactgcaaatgtatacgactcttataaagatgcatttgatgaagaacctaaaaatattacaggtgttgcaattatgacagattctgataattctaaaggatcagcaacagcttattacggagatattgtgttcaagaaagctgtaaaaaaggcttctaaagacaactaa

SEQ ID NO: 19806 - protein, 192 aa, Unknown
  Obtained from environmental sample
  misc_feature (1)..(192): Xaa is any amino acid
MVTDSEEPHIKAVSNNSASGWKYKVDIDPKEYPIIEWKWKVDGVLENGDMTEKDGDDYPARIYITYEYSRKDLPLGERIKYGSMKTFTDFDIPLRSMNYVWANKTDTGTVQENVFTNWVNMVVIESGDRKAGEWITSTANVYDSYKDAFDEEPKNITGVAIMTDSDNSKGSATAYYGDIVFKKAVKKASKDN

SEQ ID NO: 19807 - DNA, 978 bp, Unknown
  Obtained from environmental sample
  misc_feature (1)..(978): n is a, c, g, or t
gtgcatnatcgtttgcatcaaaatagagaaataactcagcaaaattttaatgctatttttaaacatttttgggtaatcaataacaacaatcatatttacaccaccttaggaaatggtttgtcaaacgagaatttcttaacaatagacaaacaagaattagacaatggttcttttaacaatttttcgtctaacggatttggaaatactgtaaattttaaaatgaatgatttttttgtaggattgcattataaatttagaacaggcatttttacggttaaacaaggtgtagaattacacaattacaattggaatgttcatcagcaaacaacattttcaaaatcgaaatggattgcattacccgattttttagcaaaaattgagtttaacaaatctaaaagtatcagaattcgttataatttaaaaaccaatttttctgacgcatcaaaattggcgaatcaattttacttacaatcgtataactctgtttttaaaggaaatacgaacttagaaaacgaattatatcacaatgcaaacatcttttataatcgttttagtttgtatagaggtttaatgataagcgtaaatgtaaactacactaaaaaaataaaagggtttacaaatgtggtagtttttgatgaaacaaatccagatccaacacaaagaaccaatcaatttttaaccacgcaattaattagcaatccttcagaaaattggatgtttagaggttttttacaaaaaaccataaaaaagctaaaatatagtttcgaaggaagcgcanatttatctaaatatgtgcagaatattaataatcaaattcaaacaaacaaaagcaatagttatactacaggtattggtgtagaaactttatttgatgattttccaaacatagaaatgggatataaaagcactattggaaattacacttctggtgcttctagttcaaaatttatacgttccaaaaccgtatctaaatattga

SEQ ID NO: 19808 - protein, 325 aa, Unknown
  Obtained from environmental sample
  misc_feature (1)..(325): Xaa is any amino acid
MHXRLHQNREITQQNFNAIFKHFWVINNNNHIYTTLGNGLSNENFLTIDKQELDNGSFNNFSSNGFGNTVNFKMNDFFVGLHYKFRTGIFTVKQGVELHNYNWNVHQQTTFSKSKWIALPDFLAKIEFNKSKSIRIRYNLKTNFSDASKLANQFYLQSYNSVFKGNTNLENELYHNANIFYNRFSLYRGLMISVNVNYTKKIKGFTNVVVFDETNPDPTQRTNQFLTTQLISNPSENWMFRGFLQKTIKKLKYSFEGSAXLSKYVQNINNQIQTNKSNSYTTGIGVETLFDDFPNIEMGYKSTIGNYTSGASSSKFIRSKTVSKY

SEQ ID NO: 19809 - DNA, 540 bp, Unknown
  Obtained from environmental sample
  misc_feature (1)..(540): n is a, c, g, or t
atgattaaattaatttatatgaacaaaatttttaaactatccatattctttgttctgtttatttttattaatccatctgccctttttggacaaaagatcgatttgagtcaggctaaaataatcagcttggagaaaaaggatccactggtcttaaatgccattaccattttgcaggaggaaataagtaaaaggaccaacattatacttactaaagggaacaaatttccgaagcaaacccaaaggactatagttattggactcgaaaatggacttgataaatttccattggaatacaggcagttcttggctactatgccagaattaaaagcggaaggttataaaatagcagtagttcccaaaaaaaatgtagtcctcgtggtggggaacgattccaggggggtgctttatggagttggaaaacttttaaggaaattggaaatgtcccagggggaaattttgctacccaatgatctgatattgcttccagtccggcctttcccatancgggtcaccaattgggtaccctcgaccgattcttga

SEQ ID NO: 19810 - protein, 179 aa, Unknown
  Obtained from environmental sample
  misc_feature (1)..(179): Xaa is any amino acid
MIKLIYMNKIFKLSIFFVLFIFINPSALFGQKIDLSQAKIISLEKKDPLVLNAITILQEEISKRTNIILTKGNKFPKQTQRTIVIGLENGLDKFPLEYRQFLATMPELKAEGYKIAVVPKKNVVLVVGNDSRGVLYGVGKLLRKLEMSQGEILLPNDLILLPVRPFPXRVTNWVPSTDS

SEQ ID NO: 19811 - DNA, 474 bp, Unknown
  Obtained from environmental sample
  misc_feature (1)..(474): n is a, c, g, or t
atgagtagagttgtaataacaggaatgggaatttactcttgcataggtaaaaaccttgatgaagtaaaaaaatctttacaagaaggaaaatctggagtcatttacgataaagatagggaaacatttggttttcgctcttgtctaacaggaatggtagaaccattatctcttaaaaaggaacttcaccgaagacaacgtataagtatgggagaagaatctgaatatgcttatgtcgctaccattgaagcattaaaaaatgctaagatggatcaagagtatattgatagcaatgaagttggaattatctacggaaatgatagtacttcaaagtctgttatagaatcagtagataaaattagggagaaaaaagatactactttggtgggttctggggctattttcaaggctatgaactcaactgtaacaatgaacttgtcaaccatttttaaactaacaggagtaatttcactataa

SEQ ID NO: 19812 - protein, 157 aa, Unknown
  Obtained from environmental sample
  misc_feature (1)..(157): Xaa is any amino acid
MSRVVITGMGIYSCIGKNLDEVKKSLQEGKSGVIYDKDRETFGFRSCLTGMVEPLSLKKELHRRQRISMGEESEYAYVATIEALKNAKMDQEYIDSNEVGIIYGNDSTSKSVIESVDKIREKKDTTLVGSGAIFKAMNSTVTMNLSTIFKLTGVISL

SEQ ID NO: 19813 - DNA, 906 bp, Unknown
  Obtained from environmental sample
  misc_feature (1)..(906): n is a, c, g, or t
atgatnccgatgtgtaagcacagttattttgctcaagagctagctttaattgttgaaaaagatcaagcagggtatattaataaatctggcgaaatagtaatccagccaaaatttaaaaatgcaggaagtttttctgaaggctatgctgctgcttcagataatgggaaagtctggggaataatcaacacaaaaggtgattgggtaattcagccagaatacgataaaattaaaaagtttaattcaggttttgtaattgctcttaaagacgatcgatggaggtatattgatgcttctaataaagaattagaaacaccagttaccgaaaaagttttcgattttaatgatggaattgctttttatagagttgaaaagaaaattggccttataggaacagatggaaaagtggtattagaaccaacttacgatgtaatgaagccttttgtaaagggttatgctaaagttagaaataacgaaaaatggggaatgattgataaaacaggaaaagtgattatcaatttgaattacgatggtattggtgattatagcaaaaaaggaatttgggctaaaaaaggagaaacatttggagtgatttctaatggtgagtttaatgaaaactctgaaatcaataaaataaatgacttcaggtttggacaattattaacttatgctcgtaaggataagctttggggatttgtgaatgctaaagcagaatgggttattcagccaaaatatcaaaaagtgaaggcttttagaaatggtttggcacctgcaatggaatcaaaatttcgcggttatattactgaaaaacgagagatgctaattcctgaatcttataaagatgctgaggtctttgctgaagaatggattacacgcttgttaaagacaagaaatcatggggtttcataa

SEQ ID NO: 19814 - protein, 301 aa, Unknown
  Obtained from environmental sample
  DOMAIN (228)...(244): KWG Leptospira
  misc_feature (1)..(301): Xaa is any amino acid
MXPMCKHSYFAQELALIVEKDQAGYINKSGEIVIQPKFKNAGSFSEGYAAASDNGKVWGIINTKGDWVIQPEYDKIKKFNSGFVIALKDDRWRYIDASNKELETPVTEKVFDFNDGIAFYRVEKKIGLIGTDGKVVLEPTYDVMKPFVKGYAKVRNNEKWGMIDKTGKVIINLNYDGIGDYSKKGIWAKKGETFGVISNGEFNENSEINKINDFRFGQLLTYARKDKLWGFVNAKAEWVIQPKYQKVKAFRNGLAPAMESKFRGYITEKREMLIPESYKDAEVFAEEWITRLLKTRNHGVS

SEQ ID NO: 19815 - DNA, 633 bp, Unknown
  Obtained from environmental sample
  misc_feature (1)..(633): n is a, c, g, or t
atggaaaaagaaagtttcgaaaacgaagatgttgccgagattatgaatcatcattatatcaacataaaagttgatagagaagaaagaccagacatcgatcaaatttacatgaatgctgttcaattaatgacaggcgctggcggttggcctttaaattgtattgctttgccagacggaagaccagtttggggcggaacgtattttaaaaaagaagaatggtctaatattttacatcaaataggagatttatatcaaaaaaatcctaaaaaagtggttgaatacgccgaaaaactcactgaaggaattcaacaatctgggctgataacaatcaataaagaaaaagcacttttcacaaaagaatatgtaaatgaaactgtaaaaaaatggagtatttattttgatgaagatttaggcggactaaataaagctccaaaatttccgatgccaaataactatcattttttactaagacatgcgtatcaaaacaacgataaaccgttactgaaatatgtaaacaccacacttacaaaaatggcgtatggcggaatttttgatcaaattggtggtggattttctagatattctgttgatacaaaatggcatattccacatttcgagaaatgctttatataa

SEQ ID NO: 19816 - protein, 210 aa, Unknown
  Obtained from environmental sample
  misc_feature (1)..(210): Xaa is any amino acid
MEKESFENEDVAEIMNHHYINIKVDREERPDIDQIYMNAVQLMTGAGGWPLNCIALPDGRPVWGGTYFKKEEWSNILHQIGDLYQKNPKKVVEYAEKLTEGIQQSGLITINKEKALFTKEYVNETVKKWSIYFDEDLGGLNKAPKFPMPNNYHFLLRHAYQNNDKPLLKYVNTTLTKMAYGGIFDQIGGGFSRYSVDTKWHIPHFEKCFI

SEQ ID NO: 19817 - DNA, 741 bp, Unknown
  Obtained from environmental sample
  misc_feature (1)..(741): n is a, c, g, or t
atgacttacttcgtagtaggcgctacaggttttattggctcgcattttttgaaaaaactttttgagcgtaaaggcaaaatttatgtcttggtaagatctggctcaaagaaaaaattaaatactttactcgaaaaaataaatgcaccaaaaaatagagttattgctgttacaggcgatttaagtaaagctaatttaggagtaagtaaaaaattcaaagatgaaatgaatggaaaaattaaacacttttttcatttagctgctatttacgatatgaaagccaaaatggcagaacaagaaattgccaacattgatggaaccagaaatgccatcggcttagcggacacaataaatgccaaatgtttccatcatgtttcatctattgcagctgccggtctgtataacggtgtctttagagaagacatgtttgatgaagccacagggctagaacatccgtatttcaaaaccaaacatgaatcggaaggagtagtcagaagagaatccaaagtgccttttcaaatttatcgcccaggaatggttctcggacactcaaaaacaggtgaaattgataaaatagatggaccttactatttctttaagcttattcaaaaaatgcgccgaatgattcctcgttggatgccaactttaggattagaaggcggccgcatgaacatggttccagtggattatgtcgttgatgcgatggattacattgctcataacaaaggcttacccgacagtggg

SEQ ID NO: 19818 - protein, 247 aa, Unknown
  Obtained from environmental sample
  misc_feature (1)..(247): Xaa is any amino acid
MTYFVVGATGFIGSHFLKKLFERKGKIYVLVRSGSKKKLNTLLEKINAPKNRVIAVTGDLSKANLGVSKKFKDEMNGKIKHFFHLAAIYDMKAKMAEQEIANIDGTRNAIGLADTINAKCFHHVSSIAAAGLYNGVFREDMFDEATGLEHPYFKTKHESEGVVRRESKVPFQIYRPGMVLGHSKTGEIDKIDGPYYFFKLIQKMRRMIPRWMPTLGLEGGRMNMVPVDYVVDAMDYIAHNKGLPDSG

SEQ ID NO: 19819 - DNA, 768 bp, Unknown
  Obtained from environmental sample
  misc_feature (1)..(768): n is a, c, g, or t
atgtcggaatatgttgctttaaaagtattagaacatcaacacggaaaagaaaaaatgcgaacctttgtaaaagatgctttagataaatacttattgcaaagaaccttagaaagaaaacgcgaaaatgcgttgatgtataatgacggacaagggtatattcgatatcaaaaaggttctctggttttttatgcattgagcgattatattggcgaagaaaagttaaacggagctttaaaaaagtatgttgaaaaagtgaaatttcaagatcctccttatacaacttccatacaaatggtagattatataaataaagtaacgccagattctttaaaatacgtaattaaagatatgtttaaaacgattacattgtatagaaatagggttttagacgcaaaaactactgagttagaaaatggaaaataccaagtagaaattgagtttgaagtttctaaatatagaaatgatgaaaaaggaaaacggtattatggagaaaaagtaggagatacattgtcttacaaaactgctgatatgaaaaaaccaatattatcggttcctttagcagattatatagatatcggtgtttttactgaagaagagttggatggtgaaaagaaagaaaaagaactttatttaaagaaatacaagattacgaaaatcaataataagctgatacttattgtagataaaaagccgacagaggttggagtagatccgtacaataaattaattgacatcaactctaacgataatcgaatgaaagtaaattga

SEQ ID NO: 19820 - protein, 255 aa, Unknown
  Obtained from environmental sample
  misc_feature (1)..(255): Xaa is any amino acid
MSEYVALKVLEHQHGKEKMRTFVKDALDKYLLQRTLERKRENALMYNDGQGYIRYQKGSLVFYALSDYIGEEKLNGALKKYVEKVKFQDPPYTTSIQMVDYINKVTPDSLKYVIKDMFKTITLYRNRVLDAKTTELENGKYQVEIEFEVSKYRNDEKGKRYYGEKVGDTLSYKTADMKKPILSVPLADYIDIGVFTEEELDGEKKEKELYLKKYKITKINNKLILIVDKKPTEVGVDPYNKLIDINSNDNRMKVN

SEQ ID NO: 19821 - DNA, 936 bp, Unknown
  Obtained from environmental sample
  misc_feature (1)..(936): n is a, c, g, or t
ttgaagacgattttgcgtgatgttttaaagaagtgggagaacatgctcgacaaattagaaacggcaaaacctccttctctccttcaccgtgatttagatatgacagggagtttaattcgcgatctttttgcaaaaaactatgaccgcgtacttattgacgatcctaaaatgtatcgtgagattaagtcttatgttggccaaattgcacccaatatgttgcctaacgttcagcaatacaaaggcaaagaacatattttcgaccatgttaatatctctgaggatgtaaattctattttcagccctcgtgttcgcatgaaatctggcggctatcttatttttgagcaaacggaagcaatgtatgttgtggatgtgaactctggcccttatgctgcaaaagctcgtcaagaggacaactctcttaaaacaaatttagacgctgctagagaaatagctaagcaattacgtttgcgtgatattggcggtataattgtagttgattttattgacttaaaagaagataaaaatcgcaagaagatttatgatgaattaaagaaagagttcagaaaagaccctgcgaaaacaaatatgctgggcatgagcgattttggcttagtccaaattactcgccaacgtattcgcccaagtgtagttaactctgtttcaaaagtttgcccaatgtgtggcggctctggtaatgtggtaagccaagataccattgtaacagatatcgaaagctggttaagccgctttaagcacaactctgcttaccgtgcaatcgaactttatgtgaatccttatctaaaatccatgatttcaaaaggattatttagtaagcgatggaaatggatgcttaagtaccatctcaaaattactctcattagcgacgaaactgtttctcttaacgaattaaagtcacactgctcgagccgattctga

SEQ ID NO: 19822 - protein, 311 aa, Unknown
  Obtained from environmental sample
  misc_feature (1)..(311): Xaa is any amino acid
MKTILRDVLKKWENMLDKLETAKPPSLLHRDLDMTGSLIRDLFAKNYDRVLIDDPKMYREIKSYVGQIAPNMLPNVQQYKGKEHIFDHVNISEDVNSIFSPRVRMKSGGYLIFEQTEAMYVVDVNSGPYAAKARQEDNSLKTNLDAAREIAKQLRLRDIGGIIVVDFIDLKEDKNRKKIYDELKKEFRKDPAKTNMLGMSDFGLVQITRQRIRPSVVNSVSKVCPMCGGSGNVVSQDTIVTDIESWLSRFKHNSAYRAIELYVNPYLKSMISKGLFSKRWKWMLKYHLKITLISDETVSLNELKSHCSSRF

SEQ ID NO: 19823 - DNA, 450 bp, Unknown
  Obtained from environmental sample
  misc_feature (1)..(450): n is a, c, g, or t
gtggccggactccttggcgtcaaacgcgacacaaaaaacatcgaccgcaagaagcgcaagggcaaagacgtagacttttttgactggatcggtcaggaaatcggtctggctatgattccgatcaancaatccggcaccaaacagtcctatgtggccatgttccattcgccggacaaagccaatgcccagcacgacctggatgccattgaaaagaagctaaaaaaccgttctccggtgcgttttgacgaatacgaatacacggggcggacggtgaaatacctgatgctcaacggatttttcaagctgtttattggcaagttgtacgagaagttcgacaagcccaagtatgcgattctggatgattttgtgatcttcagcaacgataccaccgcgcttcaccgcatgatccatgtcgcggacggacgcctggtcaaactgcccatggannnn

SEQ ID NO: 19824 - protein, 150 aa, Unknown
  Obtained from environmental sample
  misc_feature (1)..(150): Xaa is any amino acid
MAGLLGVKRDTKNIDRKKRKGKDVDFFDWIGQEIGLAMIPIXQSGTKQSYVAMFHSPDKANAQHDLDAIEKKLKNRSPVRFDEYEYTGRTVKYLMLNGFFKLFIGKLYEKFDKPKYAILDDFVIFSNDTTALHRMIHVADGRLVKLPMXX

SEQ ID NO: 19825 - DNA, 315 bp, Unknown
  Obtained from environmental sample
  misc_feature (1)..(315): n is a, c, g, or t
atgaagattgcgataatgcaagcttatttctttccgtatataggctattttcaacttatcaattcagcagacgtatttattatttatgaatatgtaggctttaggaaaggttcttgggtaacacggaatagaattttagataagggtaagaatgaacccacttacatcaacctttcagtttcaaaaaagagtattggagaaatagtatctacagtgaatttagctcataaaaaagagcgagttgaagctatagataaccttatatatttcaattataaaaagcctcattttatcgatgaatatacccaattttaa

SEQ ID NO: 19826 - protein, 104 aa, Unknown
  Obtained from environmental sample
  misc_feature (1)..(104): Xaa is any amino acid
MKIAIMQAYFFPYIGYFQLINSADVFIIYEYVGFRKGSWVTRNRILDKGKNEPTYINLSVSKKSIGEIVSTVNLAHKKERVEAIDNLIYFNYKKPHFIDEYTQF

SEQ ID NO: 19827 - DNA, 696 bp, Unknown
  Obtained from environmental sample
  misc_feature (1)..(696): n is a, c, g, or t
atggatccgaaggaagaggaattaattagagagaaattagatcaaaaaacgtggaatgaaataaaatcaaacgactcttgggcgatttttaaaatcatgtctgaattcgttacaggatatgaaaaattaagtaaaattggcccctgtgtttcaatctttggttctgcgagaacaaaaccagaagataaatattataaattagctgaagaagtagcctacaaacttacacaaaacggttatggtgtaattactggcggcggaccacgaattatggaagctggtaataaaggtgcgcacagaggaaaaggaacttcggttggattaaacattgaattgccttttgagcagcactttaatccgtggatagacagcgataaaaacttagagtttgattatttctttgttcgtaaagtaatgtttgtaaaatattctcaaggatttattgtaatgcctggaggttttggtacaatggatgaattgtttgaagcaattaccttaattcaaactaaaaaaattggncgttttcctatcgttttagttggtaaagatttttggagcggattgttagattggattanaaaaacgttaattgcagaaggaaatattactgcagaagattcaaattcatttagaattgttgatactgctgatgaagcgatagatccacttaataagttttatgcaaatacagtctaa

SEQ ID NO: 19828 - protein, 231 aa, Unknown
  Obtained from environmental sample
  DOMAIN (91)...(226): Possible lysine decarboxylase
  misc_feature (1)..(231): Xaa is any amino acid
MDPKEEELIREKLDQKTWNEIKSNDSWAIFKIMSEFVTGYEKLSKIGPCVSIFGSARTKPEDKYYKLAEEVAYKLTQNGYGVITGGGPRIMEAGNKGAHRGKGTSVGLNIELPFEQHFNPWIDSDKNLEFDYFFVRKVMFVKYSQGFIVMPGGFGTMDELFEAITLIQTKKIGRFPIVLVGKDFWSGLLDWIXKTLIAEGNITAEDSNSFRIVDTADEAIDPLNKFYANTV

SEQ ID NO: 19829 - DNA, 651 bp, Unknown
  Obtained from environmental sample
  misc_feature (1)..(651): n is a, c, g, or t
gtggtcgagagtggcctggtttcggcaagggcacaaatagtaagtagaggtgatggtggccgaaatagaagatatataatagacgaatcatatagttccttccataacctgaagaaaatgaaaaacaaaataaagagcctaatcatggcttatgcgaaaatttacaatggttttgaggaacttcaatctggaaataattctcccttaacgagtggcgatcaaaaaacaggggtaatagctgagtattatgcaaaatgttacttagaatctaaaattgaagtaactgcagaatatgctaaaccaggatcaccttatgatttatactatgcaacaaaatctggaaaaatcaacaaaatccaagtaaagggagtctccgcatattcaaaaagtagaacaattgccccattacatttggggaaaaccgatgggaatcctcctttggatgagttatatttaatagatttagatagtgattttcttccaatagccttttacgtaaatacatacgaccaaataatcagtaaagttgaagatccaaataggaaaaagatagctggatcaaaattgaaagatctcgtaaatggaacaactaatgggtcgagtttccatgattcttctgagaataagataagtgaattgaaaaaagcataa

SEQ ID NO: 19830 - protein, 216 aa, Unknown
  Obtained from environmental sample
  misc_feature (1)..(216): Xaa is any amino acid
MVESGLVSARAQIVSRGDGGRNRRYIIDESYSSFHNLKKMKNKIKSLIMAYAKIYNGFEELQSGNNSPLTSGDQKTGVIAEYYAKCYLESKIEVTAEYAKPGSPYDLYYATKSGKINKIQVKGVSAYSKSRTIAPLHLGKTDGNPPLDELYLIDLDSDFLPIAFYVNTYDQIISKVEDPNRKKIAGSKLKDLVNGTTNGSSFHDSSENKISELKKA

SEQ ID NO: 19831 - DNA, 471 bp, Unknown
  Obtained from environmental sample
  misc_feature (1)..(471): n is a, c, g, or t
ttgtttcttggtaatataggggaaactaaacttgtggatatggaaactaaagtgggaatccttaataaggtggtcatgattgatgacaacgattttactaatgagttgcatagtagggtggctaattctgtaaatctagcaaatgaggtcagctgtttcaataacgccaaagatgcattggctgagcttgagaaaattactgaaaagtacgattttcctgagttgatactggccgacatacacatgcctgggatggacggccatgagttctcagagaaaatacaaaacatgtcaggttttaatcccaatagaactgttttggcatttctcacatcttcaaaagatatagtggatgtgataaaggcagatgagaatgaggtggagctatactactggaaacccttaaataaagacttgttgaggaaagtgttgaagacgttttgtattctcgaccgattcttgatccactag

SEQ ID NO: 19832 - protein, 156 aa, Unknown
  Obtained from environmental sample
  DOMAIN (22)...(152): Response regulator receiver domain
  misc_feature (1)..(156): Xaa is any amino acid
MFLGNIGETKLVDMETKVGILNKVVMIDDNDFTNELHSRVANSVNLANEVSCFNNAKDALAELEKITEKYDFPELILADIHMPGMDGHEFSEKIQNMSGFNPNRTVLAFLTSSKDIVDVIKADENEVELYYWKPLNKDLLRKVLKTFCILDRFLIH

SEQ ID NO: 19833 - DNA, 576 bp, Unknown
  Obtained from environmental sample
  misc_feature (1)..(576): n is a, c, g, or t
atgtcacgcgtatttaaagagatagaatatggcagtgccgatatcacaattgtattgagaaccccttattccgaagccgtcgcggtgccagtcaccaacttaagcctctctttgcgcgccatcatctggccgcgcaaaggaatttccataaaaaacacagaagacttatccggtttgcgactttccatgcccatcggcatgaagatggggaaagaatttacgagcatccaaaaaaacctaaacatcatgccaaccattgactacccaaaaagtctgcaaatgtttcgggcaaatcgcatcgatgcaatcattggcacagaacaaagcctactctacaatgccataaaaagtggaatgaacccttatgaagagtttggcatcccttatgaaatttcccgatatatcgtctgggtgcatgcctctaaaaaattcattgcacatgaaggcctagaaaaattgcaaagtgtggcacaaagcctaaaggatgatggcacatttgcaagcatcttaaaaaaatataactacccaatcccaacaacggggcccataccaaaaaatcttcccaatatccgctaa

SEQ ID NO: 19834 - protein, 191 aa, Unknown
  Obtained from environmental sample
  misc_feature (1)..(191): Xaa is any amino acid
MSRVFKEIEYGSADITIVLRTPYSEAVAVPVTNLSLSLRAIIWPRKGISIKNTEDLSGLRLSMPIGMKMGKEFTSIQKNLNIMPTIDYPKSLQMFRANRIDAIIGTEQSLLYNAIKSGMNPYEEFGIPYEISRYIVWVHASKKFIAHEGLEKLQSVAQSLKDDGTFASILKKYNYPIPTTGPIPKNLPNIR

SEQ ID NO: 19835 - DNA, 822 bp, Unknown
  Obtained from environmental sample
  misc_feature (1)..(822): n is a, c, g, or t
atgactgatgcgtctaatatttctttgattgataaatatattgactacctattaaaaagagagcaaataaggcaaaacattaaactctcaactgagactcaacttcgaatattcagaaaactcatgcggtttatgactgagtttaatattacagcagagtctaaagaaactattaaagacttaattaaagcatacaatgttaaaatacttcaaaatagcattaaggaatatatatcagaagaaaaaccatctatggaagacttagttgaaacactttcaaatcatgtttttttagatcgaaaacctaatggagatatcggctttgtaaatgactttatatttggtttgctagttggtgaaaatctaatttcaaaaaagtatcatcaatattatccgaatatagagaaacttcttcctcaagactttgcctcaaaatcagttcaatcttttaaaattcaaaacgaagaaagacgtttaaaactttggaatgaatttaatacaaaaccatttgagtttgaaccgagattcttttttaatcttgattactattatttaggtgaatttaaaagaaaatatgacaacctatatatagatgacatagaaataaacgatgtttggtttcctaattcttcaccatttaaggattgtgtattttcaaatgttacatttaatagctgtactttcagaataagtgaattctatgcttgtacttttcttaatggttccttttataagtgtaatatagaatcttgtaacgggaaaaatttcaatgactttgctgttttcgcctgcacttcanacaaggatttcttgcaaagttaa

SEQ ID NO: 19836 - protein, 273 aa, Unknown
  Obtained from environmental sample
  misc_feature (1)..(273): Xaa is any amino acid
MTDASNISLIDKYIDYLLKREQIRQNIKLSTETQLRIFRKLMRFMTEFNITAESKETIKDLIKAYNVKILQNSIKEYISEEKPSMEDLVETLSNHVFLDRKPNGDIGFVNDFIFGLLVGENLISKKYHQYYPNIEKLLPQDFASKSVQSFKIQNEERRLKLWNEFNTKPFEFEPRFFFNLDYYYLGEFKRKYDNLYIDDIEINDVWFPNSSPFKDCVFSNVTFNSCTFRISEFYACTFLNGSFYKCNIESCNGKNFNDFAVFACTSXKDFLQS

SEQ ID NO: 19837 - DNA, 795 bp, Unknown
  Obtained from environmental sample
  misc_feature (1)..(795): n is a, c, g, or t
atgatcacattagaacaaatattgatttcacaatcacaaatgctgaaaggccaaaaagtaaaactggtgcgccataaagacagccgtgttcaatatcgtgatattattaaggatcgcgatgctttgcttgcatatcaatgtgagcagcccaaagatgtctttaaaggctgtgattatattatttcgtttattggcttggagagaaaacgctccatttttattggcgtgtttaaggttaacgacaccacagttaaaaacggacaatatcattatgacttagaacccgtgactgcatttaatgatttggtggatcgtcttgttatcgattggggtaagaatgccattgcctggcatcaatggtatgacaagcagtcaaaagaagtgattgagattttgcctcgcggctatatcggcaattttccaggattgttggattttgttcttgagtatgatgaactgcactctcttatcaacaacccagaagccaaccatgactggcgacagcacctgtcatcggtgaatggcatttacatgattttagatagcagcactggtatgcaatatatcggctcggctaatggtaaaaacggcatttggcaacgctggtccgattatgctgccaatggtcacggcggtaataaagagctaatctccttgcaaaagaaaaattcccaccatcatcggaactttaaattctctgttttgcaaagcttgcccagcaacatcacacagcgtgaattgtcgcgattgaaaacctgtataaaaaaaaactggggtcaaaggtacatggactga

SEQ ID NO: 19838 - protein, 264 aa, Unknown
  Obtained from environmental sample
  misc_feature (1)..(264): Xaa is any amino acid
MITLEQILISQSQMLKGQKVKLVRHKDSRVQYRDIIKDRDALLAYQCEQPKDVFKGCDYIISFIGLERKRSIFIGVFKVNDTTVKNGQYHYDLEPVTAFNDLVDRLVIDWGKNAIAWHQWYDKQSKEVIEILPRGYIGNFPGLLDFVLEYDELHSLINNPEANHDWRQHLSSVNGIYMILDSSTGMQYIGSANGKNGIWQRWSDYAANGHGGNKELISLQKKNSHHHRNFKFSVLQSLPSNITQRELSRLKTCIKKNWGQRYMD

SEQ ID NO: 19839 - DNA, 498 bp, Unknown
  Obtained from environmental sample
  misc_feature (1)..(498): n is a, c, g, or t
gtgaccgaaattgaagtaaatgatgtaactgaaattgttgcagacgcaactaacgttgttgaaaaaagatatgttttagaagattttacaactgaaccaactatcggaaaaagttcttnattacatcaacaaaaagaaaccgttgttgaagaagatgaagagttaacatttactgtgaaaacaaaaaaagtaaaagaaattgaagatattgaaactatctcagaagaaatttctccattaagtatcaccatttcagaattagaaaagacagcagaattacgtcgtcaaaaaatgaaaggattcaattataaatttgcagatcaagtgcataaaaacattgacgaaattgaaaagcaaccagcttacaaaagaatgggtgtagatttagatgaagtaaattctgatttaagtaaatctaaaactacattaagtacagatgcaaatgatgatgtacaattgcgatcaaataactcgtttttacacgataatgtagattaa

SEQ ID NO: 19840 - protein, 165 aa, Unknown
  Obtained from environmental sample
  misc_feature (1)..(165): Xaa is any amino acid
MTEIEVNDVTEIVADATNVVEKRYVLEDFTTEPTIGKSSXLHQQKETVVEEDEELTFTVKTKKVKEIEDIETISEEISPLSITISELEKTAELRRQKMKGFNYKFADQVHKNIDEIEKQPAYKRMGVDLDEVNSDLSKSKTTLSTDANDDVQLRSNNSFLHDNVD

SEQ ID NO: 19841 - DNA, 786 bp, Unknown
  Obtained from environmental sample
  misc_feature (1)..(786): n is a, c, g, or t
ttgctgctacagaatcagaaattagatgcggttgacttatatacctttttagaaaaagtagctaaaaacagtcatgtgcatgtgtacggaacaagaactggtttaaatgaaggggtggatttaggttctaataacttcagtaatataagtccaaagaaaatagcaatgttagttggagacggaatttctagttctgatgctggagaaatttggcatttattcgatacacgtttggatattaaaataacaaaactagacatgtcttatgtgggtagaacagatttgagtaaatactctacattaattgtaccaagtagccgtggtgttgataaaggaacagaagcgaaccttaaaacatgggttagaaatggtggcgttttaataggatatagaagtgctgcaagatggttggcttcaaagaagtttatcaacgtagaatttgaaaaagcagcacctcctacaaatcctgttacgttcgaaaatagaggattgcgttctggagcacaagtaattggtggtgccattttcaacacaaagttagatgtttcgcatccaattaactttggttacaaaaacgatgaattgccaatgtttagaaatacaaccatctttataaaaccaaacaaaacgaattataacaatccaattcagtatactaaaaatccgttattggcaggttatatttctaagcaaaacttaaaagtattagcaggttcagttccttttcaagtacaaagaatgggtagaggtagggtgattgtttttacagacaacaccaaactttag

SEQ ID NO: 19842 - protein, 261 aa, Unknown
  Obtained from environmental sample
  misc_feature (1)..(261): Xaa is any amino acid
MLLQNQKLDAVDLYTFLEKVAKNSHVHVYGTRTGLNEGVDLGSNNFSNISPKKIAMLVGDGISSSDAGEIWHLFDTRLDIKITKLDMSYVGRTDLSKYSTLIVPSSRGVDKGTEANLKTWVRNGGVLIGYRSAARWLASKKFINVEFEKAAPPTNPVTFENRGLRSGAQVIGGAIFNTKLDVSHPINFGYKNDELPMFRNTTIFIKPNKTNYNNPIQYTKNPLLAGYISKQNLKVLAGSVPFQVQRMGRGRVIVFTDNTKL

SEQ ID NO: 19843 - DNA, 711 bp, Unknown
  Obtained from environmental sample
  misc_feature (1)..(711): n is a, c, g, or t
ttgggaatgccccaagtagtggattttggaatcgctacatttgaatcaattgaaggttctaatgataaccatttatcagaattaatttttacgcccgattatgcttctcctggacaaattttaaatcaaagcatcactcctaattgtgatgttttttcattaactgcacttttactagaattattgacccaaccaaaaccattacctgaatacagtggtagtgaaattaaacaagaaaattaccacaaccatattagtcaggttttaaaaggttcagacttatccacagacttaaaatgtatcattaaaaaaggcttgcaatttaatccattgaacaggtaccaatccatgcttggattatctgatgatttacaggcttatctcaacaagactcctgtatcttccagaaaaaaatctaaactttattttatttcgaaatacattgctcgtaatcctggtttttcattggcaatactcgcctttacgatttctgccattattggcgtaattactaccatacaaccaaaaaacaaagctctatttgaagcatttaaagcgcaacaaatcaccgattttcttattgattccattcaagctaatgatccagatatcaataaaggcaaggaagtcacagtcaaagaattgttattaaatgccaaaatcaacatgcaagagacaacattacaggataaaacttatcttctgctttag

SEQ ID NO: 19844 - protein, 236 aa, Unknown
  Obtained from environmental sample
  misc_feature (1)..(236): Xaa is any amino acid
MGMPQVVDFGIATFESIEGSNDNHLSELIFTPDYASPGQILNQSITPNCDVFSLTALLLELLTQPKPLPEYSGSEIKQENYHNHISQVLKGSDLSTDLKCIIKKGLQFNPLNRYQSMLGLSDDLQAYLNKTPVSSRKKSKLYFISKYIARNPGFSLAILAFTISAIIGVITTIQPKNKALFEAFKAQQITDFLIDSIQANDPDINKGKEVTVKELLLNAKINMQETTLQDKTYLLL

SEQ ID NO: 19845 - DNA, 594 bp, Unknown
  Obtained from environmental sample
  misc_feature (1)..(594): n is a, c, g, or t
atgccgataaaatcgatagaatatgtatctaaagcgatcaaggtattagaagataattatgaggtattaccgccaatttatgggtggcactcatataatctagccaaagacatagcacgaacaggagattctgaaaaagcaattttaaaacttaaaaaaacctatgagttttatactaaacaaaccaatggctatgaaagacaattattaagaatccaaatgaatattgtcaaacaacacattgtcttaaatcaatataacttggcaaaaaaagaatttgataaattggaaataattggtctagaaaatttgcctcccaattacttagatcaaagtcaattattactactaaaggccctcttgtcttttcaatttgattcactagaagaaataaaaattaagacaacacagttctatgattacagtaaaaatcactttggacctgaaagtgaagataaagatgaagtgttagaagcatactggtattacttacaagccaaactttttcaaaaacaaaacaaaactgaattgtttttaaatgcaataactaaaacagaaaatattatagacaaataccctgaagattatattggn

SEQ ID NO: 19846 - protein, 198 aa, Unknown
  Obtained from environmental sample
  misc_feature (1)..(198): Xaa is any amino acid
MPIKSIEYVSKAIKVLEDNYEVLPPIYGWHSYNLAKDIARTGDSEKAILKLKKTYEFYTKQTNGYERQLLRIQMNIVKQHIVLNQYNLAKKEFDKLEIIGLENLPPNYLDQSQLLLLKALLSFQFDSLEEIKIKTTQFYDYSKNHFGPESEDKDEVLEAYWYYLQAKLFQKQNKTELFLNAITKTENIIDKYPEDYIG

SEQ ID NO: 19847 - DNA, 324 bp, Unknown
  Obtained from environmental sample
  misc_feature (1)..(324): n is a, c, g, or t
ttgaactcggctcagtatgctgagaagttttgtgctgctgtaattattcctgattggaagaacatggaaaaacgttttgaacggttcggatacgtccttcctggagagaataaaatagaaagtgagcatgtactttctagaattcaaaaagagatagacaaagttaataagaaacttcctcactgggagaaagtaaaaaaatttgtattactggaagaacctttttcaattgaaaaaggggagcttactgcgaaaatgagcataaagagagcaggcgtgatgaagaatcataaagaattaattgaaagtatttatcaagactaa

SEQ ID NO: 19848 - protein, 107 aa, Unknown
  Obtained from environmental sample
  misc_feature (1)..(107): Xaa is any amino acid
MNSAQYAEKFCAAVIIPDWKNMEKRFERFGYVLPGENKIESEHVLSRIQKEIDKVNKKLPHWEKVKKFVLLEEPFSIEKGELTAKMSIKRAGVMKNHKELIESIYQD

SEQ ID NO: 19849 - DNA, 585 bp, Unknown
  Obtained from environmental sample
  misc_feature (1)..(585): n is a, c, g, or t
atgaccaaatcggacaataaaaacccattatttagtagtcagcgagaaaaatcaggggcgagaacctttgataaatatttgtatcagtacaattgggcattatacagaatcataagtgagcatgatgaaaaaagtgaatatgctgtatttatagaatatcatgaagatgtagttgtttgtaactcactcgactcaggaaaagcaacctttgaatttaatcaagtaaaagctactgcaactaaattctcaacttaccaattagtacataaaaaaaagaatgggagttctgtgctaggtaaattaattcaaagtgtcaatgcaaaaccttttgccgatagaatatctgaattaaaccttattagcactaatgatttcaaccttcaattagagaccgagggtgtcgatttaagagttattcggaaagaagacttatcgaaaaagcaactcacagaactagaagaagcattaaaaaaggaaattgcaataactgaattaccttcttcattgaaatttatcatatctgagctttcagatagtagctatcacaaaattattatctggggaaatatcaagtttgatcaatag

SEQ ID NO: 19850 - protein, 194 aa, Unknown
  Obtained from environmental sample
  misc_feature (1)..(194): Xaa is any amino acid
MTKSDNKNPLFSSQREKSGARTFDKYLYQYNWALYRIISEHDEKSEYAVFIEYHEDVVVCNSLDSGKATFEFNQVKATATKFSTYQLVHKKKNGSSVLGKLIQSVNAKPFADRISELNLISTNDFNLQLETEGVDLRVIRKEDLSKKQLTELEEALKKEIAITELPSSLKFIISELSDSSYHKIIIWGNIKFDQ

SEQ ID NO: 19851 - DNA, 681 bp, Unknown
  Obtained from environmental sample
  misc_feature (1)..(681): n is a, c, g, or t
atgaagttggattacaatacattaactaatgtatacaaatcacacaataagtatcttggaggcaaatctattcaattagaaaacttcaatattaaaaagcaactgactgaccttttttgtcctggtccaaatttttattttataatagattctcctacgcttactatagattttgtgagtgattctattcaagaaattttagggataaaacctaaaaatttagagttagcaaacttcttagaaattttacacccaggagatgtacaattttttgtaaaatgcgaagatttaatagcttattttttaacaaaaattgttaagcctaataaaataacaagctataaaataaattattgtttaagattaaaaaccaaagacaatagttataagttgtttttattgcaaatcattacactaaaggtagatgaaaaaggttctttattaaaggtttttgactcctttacaaatattaaccacttaacctctttaaataattataaattatcattttttgggttggatggagaattgtcttaccccgaaatagatgtttttaaagaaaatccttttgacgattatgttccgtttaatataaatgcagagggacatccttttacaaaaagagaatttgagattattaattttttagtaaaaggttttagcacaaaaagatatttctaa

SEQ ID NO: 19852 - protein, 226 aa, Unknown
  Obtained from environmental sample
  misc_feature (1)..(226): Xaa is any amino acid
MKLDYNTLTNVYKSHNKYLGGKSIQLENFNIKKQLTDLFCPGPNFYFIIDSPTLTIDFVSDSIQEILGIKPKNLELANFLEILHPGDVQFFVKCEDLIAYFLTKIVKPNKITSYKINYCLRLKTKDNSYKLFLLQIITLKVDEKGSLLKVFDSFTNINHLTSLNNYKLSFFGLDGELSYPEIDVFKENPFDDYVPFNINAEGHPFTKREFEIINFLVKGFSTKRYF

SEQ ID NO: 19853 - DNA, 522 bp, Unknown
  Obtained from environmental sample
  misc_feature (1)..(522): n is a, c, g, or t
ttgaggaatttggctggatttgtcatctcccaattggcaacgttgaattgggcagtgaaatcaatctcgcataaacagtatcaggagcaatatatcttgaaaacgaatgatgatcgggaaatgcagattcaatcttattatgacaaaagtaaacgaatcaaatccgtttcgtcaaccacgcaagattctcccacatttgaaacactccataggactttgctggacaatcgatcaagattcaattatctgagaaagaaacccttcgaaaacgaaacacaatcgttcatattccaaaatgtcataccattactgcaatctcaagaaatattcattacgcaaatcatctcctcagaataccaggagcaattcacttttgaaagtgatgaagggtattgtatttgtggctttaactacgacgcgaaaggcttcatctcgactgtattagctattaaaaccaactcgaaagcactttgcgagaaggtgaaggatattgcattgactcttaaaaaaactcaaagctga

SEQ ID NO: 19854 - protein, 173 aa, Unknown
  Obtained from environmental sample
  misc_feature (1)..(173): Xaa is any amino acid
MRNLAGFVISQLATLNWAVKSISHKQYQEQYILKTNDDREMQIQSYYDKSKRIKSVSSTTQDSPTFETLHRTLLDNRSRFNYLRKKPFENETQSFIFQNVIPLLQSQEIFITQIISSEYQEQFTFESDEGYCICGFNYDAKGFISTVLAIKTNSKALCEKVKDIALTLKKTQS

SEQ ID NO: 19855 - DNA, 552 bp, Unknown
  Obtained from environmental sample
  misc_feature (1)..(552): n is a, c, g, or t
ttggagttcttcttttatatcattcatcattttatcttattaagttctcgactgcgctcgaacaaacattataaatctaacgcttgttttaaatcgtttataatatcatttacatgttctaatccgacagaaattcgaaccaaatcgtcggtaattccgacttctaatctatcttcaattaataatttactatgtgttgtactcgcaggatgtgtaactatggttcttgtatctcctagatttgctgataatgaacaaagcgcaacggcatttaaaaaacttctccctttttcaattcctccttgtacttcaaaagcaataatatttccacctaaaagcatttgtttttttgcaattttatactgcggatgcgattttaaaaaaggatattttaccagatttacttttggatgcgtctctaaaaattcggcaactttcaacgcattttcgcaatgtttttctactcttaccgctaaggtttctaaactttttgacaaaacccacgcattaaaaggagacattgccggacccgtatttcttgaaaacaaataa

SEQ ID NO: 19856 - protein, 183 aa, Unknown
  Obtained from environmental sample
  misc_feature (1)..(183): Xaa is any amino acid
MEFFFYIIHHFILLSSRLRSNKHYKSNACFKSFIISFTCSNPTEIRTKSSVIPTSNLSSINNLLCVVLAGCVTMVLVSPRFADNEQSATAFKKLLPFSIPPCTSKAIIFPPKSICFFAILYCGCDFKKGYFTRFTFGCVSKNSATFNAFSQCFSTLTAKVSKLFDKTHALKGDIAGPVFLENK

SEQ ID NO: 19857 - DNA, 459 bp, Unknown
  Obtained from environmental sample
  misc_feature (1)..(459): n is a, c, g, or t
atggaaaaaatattagttactggagcaactggagaattaggaagtacagttattgaaacgtttcttaaaaatacgaaagctgaaaatatttcggtcctcacaagaaaagaagaaagaaaaaccgaattcgaacaaaaaggattaaaagcttttattggccaatatagtgatgttgaatcgcttggaaaagcgatggagaacgtagataccgttttgctaatttcttcaggagaccatggcgatagaatgcaagaacataaaaacgttattgatacagcaaaaaagaaaggtgttcaaaacattgcttacacaagccgttccttaaaagacaaagacacgttagtaaataaactaatgacagaacatttcctaaccgaagactatattaaagaaagtggattgaaatatatcatttttagaaatgctttgtatatgctcgaccgattcttgatccactag

SEQ ID NO: 19858 - protein, 152 aa, Unknown
  Obtained from environmental sample
  misc_feature (1)..(152): Xaa is any amino acid
MEKILVTGATGELGSTVIETFLKNTKAENISVLTRKEERKTEFEQKGLKAFIGQYSDVESLGKAMENVDTVLLISSGDHGDRMQEHKNVIDTAKKKGVQNIAYTSRSLKDKDTLVNKLMTEHFLTEDYIKESGLKYIIFRNALYMLDRFLIH

SEQ ID NO: 19859 - DNA, 693 bp, Unknown
  Obtained from environmental sample
  misc_feature (1)..(693): n is a, c, g, or t
ttgcttgagaaatcatatagaccgaaatccagttcaggtatcttaggactagggaaagcgataaatgaacaaaatatcgacaaagttttcgaagtaattaatgagtttgagcagattgacattcaacatccttctgtagaactgttagaagtcctaatagagaactatgctaaggaaattatgtcaggcgataatggctctcaatttttatgctcaaatctaaaaggaattttagggactagggaattaaatgcacgaatagaaaaagaactgaaaattaaacttagaatttcttctagtgatgaatggtatacaggaagaaggattctaataactaaaaatgatttttctacgggtttaaagaatggtgaaattggcacatgttataaaaatagtaagaatgaattttgcataagttttgattcttctaatcaggtgttggtttcgcagctacaaaattatgaattagcgtatgcattaacagttcataaaagccaaggttcagaatttagacatgtgtttttatttcttccagaaaagataaatcctgttcttacaaaagaattattgtatacagctgtaacaagggcaaaagaaagtactcttgtagtaggaaatagggggttaatttcggaagtagtactcaagaaaatcaaaagagctagttctattccttccaaaattactaaataa

SEQ ID NO: 19860 - protein, 230 aa, Unknown
  Obtained from environmental sample
  misc_feature (1)..(230): Xaa is any amino acid
MLEKSYRPKSSSGILGLGKAINEQNIDKVFEVINEFEQIDIQHPSVELLEVLIENYAKEIMSGDNGSQFLCSNLKGILGTRELNARIEKELKIKLRISSSDEWYTGRRILITKNDFSTGLKNGEIGTCYKNSKNEFCISFDSSNQVLVSQLQNYELAYALTVHKSQGSEFRHVFLFLPEKINPVLTKELLYTAVTRAKESTLVVGNRGLISEVVLKKIKRASSIPSKITK

SEQ ID NO: 19861 - DNA, 564 bp, Unknown
  Obtained from environmental sample
  misc_feature (1)..(564): n is a, c, g, or t
ttgtgcttaatattgcattgggctaatatcaaatttaaagactatcgatttccgttttctgaatttgttgaagttcgaaaaagcacaccttttggacaggttccatgtatgcaaatcggcaatgaaaccatcactcaaacaaatgcattaattcgtcattttggtaaaaaagcaggattgtatcctcatgatgattatatcgctttattatgcggtgaagtcatgaatatcatagaagatgcgacgaacaaagtcgttgcaacctttgggctagaaggcgatgcgttacaaaaagctcgtaagaaattcgcatcaggtcctttaacgatgtatttaaaatggttagaaaatagaatgcaaaaacgaggcggaactttttataatggggaaaaaataagcatggcagattttaaaatatttgtgtggaccaaaggattatgcgctggacatttagatcacataccaactaatttggttaaaaatgatgctccaatggttttcaaacatttgaatcacatgtcaaatttagaacaaataaaggattattacccatctagaaaataa

SEQ ID NO: 19862 - protein, 187 aa, Unknown
  Obtained from environmental sample
  misc_feature (1)..(187): Xaa is any amino acid
MCLILHWANIKFKDYRFPFSEFVEVRKSTPFGQVPCMQIGNETITQTNALIRHFGKKAGLYPHDDYIALLCGEVMNIIEDATNKVVATFGLEGDALQKARKKFASGPLTMYLKWLENRMQKRGGTFYNGEKISMADFKIFVWTKGLCAGHLDHIPTNLVKNDAPMVFKHLNHMSNLEQIKDYYPSRK

SEQ ID NO: 19863 - DNA, 576 bp, Unknown
  Obtained from environmental sample
  misc_feature (1)..(576): n is a, c, g, or t
atgcctgtttccaagaccaacataccacacccggacctcgaaagcgttctcgttacccaatctcaaatcaaaagccgcatcaaaaaactcgggaaacagatcaaggaaatctacggcgacgaagagatcacgatcatttcaatcatcaacggcgccatcatgtttacggccgatctgatgagagagatcgacaatcccgtgcgtttggactgcatccggatctccagttatcgcgataaaacgaaatcaaacggcacgcctaaactgatccacagcctgacgctcgatatcaccaaacgaaacgtcctgctcattgacgatattctcgataccggaaaaaccttggcgatggtctctggaatgatccgcaaactcaatcctgccagtctgaccgtctgtgtgcttctcgataaaaaggggcgtcgggaagtcgaattcgatgccgatctcgtgggtttcaatattcccgataaatttgtcgtcggatacggcctcgatttcgcggagcgataccgtaatttaccgagcatcggggtgctgaaatcacacctgcaaaatccgcccgagtgggcctga

SEQ ID NO: 19864 - protein, 191 aa, Unknown
  Obtained from environmental sample
  DOMAIN (12)...(156): Phosphoribosyl transferase domain
  misc_feature (1)..(191): Xaa is any amino acid
MPVSKTNIPHPDLESVLVTQSQIKSRIKKLGKQIKEIYGDEEITIISIINGAIMFTADLMREIDNPVRLDCIRISSYRDKTKSNGTPKLIHSLTLDITKRNVLLIDDILDTGKTLAMVSGMIRKLNPASLTVCVLLDKKGRREVEFDADLVGFNIPDKFVVGYGLDFAERYRNLPSIGVLKSHLQNPPEWA

SEQ ID NO: 19865 - DNA, 618 bp, Unknown
  Obtained from environmental sample
  misc_feature (1)..(618): n is a, c, g, or t
atggaagaaactaagatcgtatatatcgacgatgatctacaagaagatgatcctattattgtccttctcaaggaaaaatatggtgatcagaatgtcatcgtaaaaaggaaatctactgaaggacttagggttgtcttagaattacttcctagtaaggtaattgtcttgttggacctagatttagggcatgggcaaccctctggagcaaaagtattcgaagaaattcggaatgaaacttccttggtgtatgtaatcttcgttactgccaaacaatttgactccattcctgcggaagatttgatccatttcatcaacaatgatgcgctcgccatcgtaaataataccgaggatttgcaagtaattttagaccttgttgacaaggcatatcataggctcgacaccaggatagattgtattcttgaacaatggattgcgaagcgaccgcgcgctgagcaagaacagccttatttaatgaccaaaggagggaacacatacaccctcaaggatgtcatgaatgaaatacgtaaagaaaccgatctgggaaaaaggttgaaaaaaggaattttgcaactcgcaattgaaatgctaacgaacgattctgagaaaattgatgattga

SEQ ID NO: 19866 - protein, 205 aa, Unknown
  Obtained from environmental sample
  misc_feature (1)..(205): Xaa is any amino acid
MEETKIVYIDDDLQEDDPIIVLLKEKYGDQNVIVKRKSTEGLRVVLELLPSKVIVLLDLDLGHGQPSGAKVFEEIRNETSLVYVIFVTAKQFDSIPAEDLIHFINNDALAIVNNTEDLQVILDLVDKAYHRLDTRIDCILEQWIAKRPRAEQEQPYLMTKGGNTYTLKDVMNEIRKETDLGKRLKKGILQLAIEMLTNDSEKIDD

SEQ ID NO: 19867 - DNA, 411 bp, Unknown
  Obtained from environmental sample
  misc_feature (1)..(411): n is a, c, g, or t
atgatacaagatattattttgttatcggatagggattttggaaaaattatttattctaaatataaggacaagggtggtatttataaaataattgcggttcgagatggtaagcgtattctaatcaatagatttttgggggtagatgaaagtggagtcctttatattggcaaagcaacctcatttaaggatagggtagttggtttgaagaaatccatatctccagagtacagaggttcatcacatatttgtggtaggcgatacaaggctaatcctaatatagcaaaacagtttccttttgaaattttacatattgaattgatgcagtcggattgtcccgaggagcttgagagagaaatgcttaatgagtatacttctgtttatggtgaagtgccgccattaaatgcagtttga

SEQ ID NO: 19868 - protein, 136 aa, Unknown
  Obtained from environmental sample
  misc_feature (1)..(136): Xaa is any amino acid
MIQDIILLSDRDFGKIIYSKYKDKGGIYKIIAVRDGKRILINRFLGVDESGVLYIGKATSFKDRVVGLKKSISPEYRGSSHICGRRYKANPNIAKQFPFEILHIELMQSDCPEELEREMLNEYTSVYGEVPPLNAV

SEQ ID NO: 19869 - DNA, 558 bp, Unknown
  Obtained from environmental sample
  misc_feature (1)..(558): n is a, c, g, or t
atgggaatggtatttcagggtagcgcgctattcgattccatgaccgttcagggaaatgttatgtttcccttgggcatgttcaccaaacaatcaaaatcggaaatgcaggatcgggtagattttgtacttaaacgtgtaaacctagttgatgcacataataaatttccatcggaaatatcgggaggaatgcaaaagcgggttgccattgccagggctattgtaatgaatccaaaatacttattttgtgatgaacccaattcgggactggatccaaaaactgctatcctaatagacaatcttatacatgaaattacccaggaatacgatattactacggtaatcaatacccatgacatgaattctgttatggaaattggcgaaaagataattttcctcaaaaatggattaaaggaatgggaaggcagtaataaggaaatttttaaaacggataatgaagccgtaaccgacttcgtctattcctccgaattatttaaaaaagtgcggcaaatgtatattgaggacggaataactcgttcttncctgactgaatctgactga

SEQ ID NO: 19870 - protein, 185 aa, Unknown
  Obtained from environmental sample
  DOMAIN (1)...(135): ABC transporter
  misc_feature (1)..(185): Xaa is any amino acid
MGMVFQGSALFDSMTVQGNVMFPLGMFTKQSKSEMQDRVDFVLKRVNLVDAHNKFPSEISGGMQKRVAIARAIVMNPKYLFCDEPNSGLDPKTAILIDNLIHEITQEYDITTVINTHDMNSVMEIGEKIIFLKNGLKEWEGSNKEIFKTDNEAVTDFVYSSELFKKVRQMYIEDGITRSXLTESD

SEQ ID NO: 19871 - DNA, 657 bp, Unknown
  Obtained from environmental sample
  misc_feature (1)..(657): n is a, c, g, or t
atgattacagttttaaatccaggaatatatagttctattcaagatttaggaagatcgggttttgcacatattggcgttcctgtttctggagttatggattcttattctgctaaaattggaaatcaattattgcataataatatagaagaagctgtcatcgaaattacttttggtggttgtaaattcaggtttgaaaaagagttgaaggtatgtttaactggtgcaaattttagtccaaaaattgatgataaggatgcgcaaatgaatacagttgtagaagtcaaaaaaggtgcagttttgtctttcggtaaaaaaacatttggagttcgaacctatttgagtgtgcaaggcggaatttcatcagaagttgttcttaatagtaaaagtttttacaaaggaattacagagggttttgttcttaaaaaagaagatcaaataaaaataaattcaacgaagtcagaaaataaaaacacgttatcacaaattaaaattagccaacatcattttaatacgaatagcattaaatgtctaaagggaccagaatctgatttgctaacaaatacgcaacaagagcaattaatgcgaacacaatttttaatttcccctgattatcatagagtacggtatcgattagaacaattgtctaaaaatgaataa

SEQ ID NO: 19872 - protein, 218 aa, Unknown
  Obtained from environmental sample
  DOMAIN (23)...(218): Allophanate hydrolase subunit 2
  misc_feature (1)..(218): Xaa is any amino acid
MITVLNPGIYSSIQDLGRSGFAHIGVPVSGVMDSYSAKIGNQLLHNNIEEAVIEITFGGCKFRFEKELKVCLTGANFSPKIDDKDAQMNTVVEVKKGAVLSFGKKTFGVRTYLSVQGGISSEVVLNSKSFYKGITEGFVLKKEDQIKINSTKSENKNTLSQIKISQHHFNTNSIKCLKGPESDLLTNTQQEQLMRTQFLISPDYHRVRYRLEQLSKNE

SEQ ID NO: 19873 - DNA, 633 bp, Unknown
  Obtained from environmental sample
  misc_feature (1)..(633): n is a, c, g, or t
ttgaatcggctcagggactatcgaaagaaatttgaagaacatagcctaaaggcatacctacgtaatgcggagcggatccatttaccttacgaaaaatctccaaaggattatatccaactcttcaacgccaagggattttattttgagcaaagagatgatgaaatttatatcatctccatatactctaaacatggggtcagtagtccgttaggatcaaaaaaccaggcatatcttaagtcgatcaagaattttgatacggtgttgaacaatcaatccaaaaccatatccaacattatggacaagggtaagggagagctcaaaaacttatggctttcttatttaatcgaaaaaggattatacaggaaagctgcttttatgatggtctatgataaaacacttccaaatttggataaggaaataattgaatgccatttggaaaaaggaatgcgggaacggttacttgaagtatccaaacaaaagttgaattcacagcaggcaactatgttgcgtaggagtgcctttgccttcaattctcttttaggaggtaaccattataaggaggaagaagtatttaatgggtttaaggacgagcttacggattattccaaacgaaatggaattcacctttcctga

SEQ ID NO: 19874 - protein, 210 aa, Unknown
  Obtained from environmental sample
  misc_feature (1)..(210): Xaa is any amino acid
MNRLRDYRKKFEEHSLKAYLRNAERIHLPYEKSPKDYIQLFNAKGFYFEQRDDEIYIISIYSKHGVSSPLGSKNQAYLKSIKNFDTVLNNQSKTISNIMDKGKGELKNLWLSYLIEKGLYRKAAFMMVYDKTLPNLDKEIIECHLEKGMRERLLEVSKQKLNSQQATMLRRSAFAFNSLLGGNHYKEEEVFNGFKDELTDYSKRNGIHLS

SEQ ID NO: 19875 - DNA, 588 bp, Unknown
  Obtained from environmental sample
  misc_feature (1)..(588): n is a, c, g, or t
gtgctgttgggggccaataagctagaggtgaggctaatcttgcacaaactgccacggaaaatcgcggacgggattcgcaggaagatgaaaagtgacaaacaaaagaaatgcaaaggtatgtctgcgggaaggttggccttttgcgatgtgaatgcatacatcaccaacctcagtccagagcagttgcccggtcacaagattcgcgaggtctatagcctgcgatggcaggtagaaatcatgttcaaaacctggaaatccggcctggacatggacaaagtgcgagctattggtcccctgcaattccaatgcatgttcctgagaaagctgataaaaatgctgctctgctttaaaatattctggagctcaaagctgcagatttggaaccaaaagcgaatcgaaatcagcgagagcaaagggatgaaatatatcggcagtttgatatcggaaatcaaggaatggcttgttgggaggaaagccaagagcaaaaatctactgaataaaattgcgaatacaatgagtaaaacatgcatcaaacaagccaaaaagggcgatttaagtcctctggaaactatacaatgttatgcttaa

SEQ ID NO: 19876 - protein, 195 aa, Unknown
  Obtained from environmental sample
  misc_feature (1)..(195): Xaa is any amino acid
MLLGANKLEVRLILHKLPRKIADGIRRKMKSDKQKKCKGMSAGRLAFCDVNAYITNLSPEQLPGHKIREVYSLRWQVEIMFKTWKSGLDMDKVRAIGPLQFQCMFLRKLIKMLLCFKIFWSSKLQIWNQKRIEISESKGMKYIGSLISEIKEWLVGRKAKSKNLLNKIANTMSKTCIKQAKKGDLSPLETIQCYA

SEQ ID NO: 19877 - DNA, 522 bp, Unknown
  Obtained from environmental sample
  misc_feature (1)..(522): n is a, c, g, or t
ttgggtacgtacataattccattccctcatgatcacaaatctacgtttacttgtacaagttgtggagttataaaaaagcactcaaaagagtggcacggatattatcaaggttttttaacgatagcttgtggatattgtggtagtaatattgttcacgctaccaaaccagtcaaaaaaattacaaaaaccgctcaaataaaatgtgaagcttgtaagaaagaaaaagaatatcaattaaaatggtatcgatatcgaaaagacaaatctatcgacccttattttggattagatttatggcttcaaattaattttaaaaaccattttttatgggtgtataatttagagcatttaaaatatttaaaagaatatgtcactgctaaattaagagaagataatgataggcataagtattctatgattacaaaccttccacaatggattaaatctgctaaaaatcgtgaaggtcttttaaaaaaactgaatacactagaaaaggaaattaaaaaaataaatatggcttaa

SEQ ID NO: 19878 - protein, 173 aa, Unknown
  Obtained from environmental sample
  misc_feature (1)..(173): Xaa is any amino acid
MGTYIIPFPHDHKSTFTCTSCGVIKKHSKEWHGYYQGFLTIACGYCGSNIVHATKPVKKITKTAQIKCEACKKEKEYQLKWYRYRKDKSIDPYFGLDLWLQINFKNHFLWVYNLEHLKYLKEYVTAKLREDNDRHKYSMITNLPQWIKSAKNREGLLKKLNTLEKEIKKINMA

SEQ ID NO: 19879 - DNA, 861 bp, Unknown
  Obtained from environmental sample
  misc_feature (1)..(861): n is a, c, g, or t
gtggccaccaatgatgggttggccctttttgatggagataggttttttgtatataacacttccaactctccaaaaatgcagagtaatcgaattaaatggataggaaatgggaatgcaaatgagctatggtttctagatatcagtgaaaacttgtatcggttaaaaaatggagaagtaacttggtttcaagaagaagaaaaaaacaaagaccttaaggttcaaaaagtagattggtttgctgatggccgcgtaataattacatcaaataaaggatttctaattcaagatgagaatggagggtggaagacagagggtgaagcagagcttccaattctaaacagctttgtgttagatggcaaaacaatttcattctttaataatagcgggtttcagaatttagataacggcattgtaactcagcagattagcacagaagatttactacttaaacaggatgcagcgtttaacgtaattcctactaaagacggaacgacttggtttttaggaaataagagtgaattgctacgcatagataaaagcaataaccaaactctatacgaatacaaagatctaggtgagtttagattttgggattttaaagaactgaatagcaacgaactaattattagcacaaaaaaaggctatttgatttttaataggcaaacagaatccttcaaaaagacttcgtatgaatcggaggtagaaccatactttgaggataatgcatgggttgctgtaaatgataggttaataactaaagttggtgggactgtatttataaacggtgcaaaggttttagaatcggataaacccattccctttttaacggcgagtaaagaagtgaaatttggtagcaactaa

SEQ ID NO: 19880 - protein, 286 aa, Unknown
  Obtained from environmental sample
  misc_feature (1)..(286): Xaa is any amino acid
MATNDGLALFDGDRFFVYNTSNSPKMQSNRIKWIGNGNANELWFLDISENLYRLKNGEVTWFQEEEKNKDLKVQKVDWFADGRVIITSNKGFLIQDENGGWKTEGEAELPILNSFVLDGKTISFFNNSGFQNLDNGIVTQQISTEDLLLKQDAAFNVIPTKDGTTWFLGNKSELLRIDKSNNQTLYEYKDLGEFRFWDFKELNSNELIISTKKGYLIFNRQTESFKKTSYESEVEPYFEDNAWVAVNDRLITKVGGTVFINGAKVLESDKPIPFLTASKEVKFGSN

SEQ ID NO: 19881 - DNA, 864 bp, Unknown
  Obtained from environmental sample
  misc_feature (1)..(864): n is a, c, g, or t
ttgagaaatgctggcagtaaccaatatggcaaacgcaccacaaccatgttgtttgaaaagtgtttgcacaaatacgtgatcaccgatgccatccgtgatgaaaatgtcttgaagttttctatcgagtatttcaacacctttaaacaaaaagacaacatcatcgatatcaaagtcgaggacattgatgaagaagaggcttttactgacccaaaacatttgaatctggttacggattacattattgctcatcacaagcgcaagacgcataaccgtgagtttactgctatcttatgtgtgtcaagtatcgatgtattgattcagtattatcagttattgcaagctaaaaaagagcagggggatcataatctaagagtggcgactattttttcatacaaagccaatgaagaggacaaagaagcacaaggctttgtagaggatattgaggatgaagagttattaaaagtggccgagccaggcaatatttatgaaatcaataataagcataagcacagcagagatcatttagaaagttttataggcgattacaaccaacagttcaataccaattttaccaccaaagatacgcagtctttttacaattattacaatgacattgccaaacgggtcaaagaccgacaagtcgatatcttgttggtggtgaatatgtttttaaccggttttgatagcaaacacctcaataccctatatgtggataaaaacctcaagtaccacggcttgattcaggcttattcacgcaccaatcgcatcttanacgaggtcaagtcccaaggtaacatcgtatgctttagaaacctcaaagccgccaccgatgatgccatccgtttgttttcagcttggatataa

SEQ ID NO: 19882 - protein, 287 aa, Unknown
  Obtained from environmental sample
  misc_feature (1)..(287): Xaa is any amino acid
MRNAGSNQYGKRTTTMLFEKCLHKYVITDAIRDENVLKFSIEYFNTFKQKDNIIDIKVEDIDEEEAFTDPKHLNLVTDYIIAHHKRKTHNREFTAILCVSSIDVLIQYYQLLQAKKEQGDHNLRVATIFSYKANEEDKEAQGFVEDIEDEELLKVAEPGNIYEINNKHKHSRDHLESFIGDYNQQFNTNFTTKDTQSFYNYYNDIAKRVKDRQVDILLVVNMFLTGFDSKHLNTLYVDKNLKYHGLIQAYSRTNRILXEVKSQGNIVCFRNLKAATDDAIRLFSAWI

SEQ ID NO: 19883 - DNA, 735 bp, Unknown
  Obtained from environmental sample
  misc_feature (1)..(735): n is a, c, g, or t
atgattgatagcttgagctttgtaaataaccattggttttggcatgttgtattaacagcactattcttgtggcttgtttttgcatggaaagaatggcgacaagtcaacaagtctaaactatacttaaagttagttctggcactcattgccctttcttctttggcctttattattctaaaacccatggttgtttctaaattggaaacttttgaaatggtactgcttacaaaaggataccgtgtagaaaaacttgatagtctcaaaaaagaacataaaaaaattcaggttgaaaattataaagccaatacatcatttataaattcgaataaaaaaccctcatcaatttacgttctaggagaaggtattgcaccttatgatttttatcagttcgatagtttaaacgtaacttttttagggtatagcacaccatcggggattgtgaaattaaactatgatcaaaaacaaacagtagggaattcaataacagtacaaggtttgtacgctgcgccaaaaagaggcaccaaacttattttagaaagcgctgcagaaacaagtttagactctgtagtgttttcaaacgattcttcccaaatttttaacctatctacgcaactaaatgtcattggcgactatgaatattatttagctgaaaaagattcgttagatcgtgttattgcatcaaatccaattggtattcgcgttgttccagagcgtacattgagcatattattgtga

SEQ ID NO: 19884 - protein, 244 aa, Unknown
  Obtained from environmental sample
  misc_feature (1)..(244): Xaa is any amino acid
MIDSLSFVNNHWFWHVVLTALFLWLVFAWKEWRQVNKSKLYLKLVLALIALSSLAFIILKPMVVSKLETFEMVLLTKGYRVEKLDSLKKEHKKIQVENYKANTSFINSNKKPSSIYVLGEGIAPYDFYQFDSLNVTFLGYSTPSGIVKLNYDQKQTVGNSITVQGLYAAPKRGTKLILESAAETSLDSVVFSNDSSQIFNLSTQLNVIGDYEYYLAEKDSLDRVIASNPIGIRVVPERTLSILL

SEQ ID NO: 19885 - DNA, 450 bp, Unknown
  Obtained from environmental sample
  misc_feature (1)..(450): n is a, c, g, or t
atgaaaaaaacgaacttgtatctctttgtaaactcacaaatattattttggagaagaaataagtgcatgaaacgactaaagaaaattttaaaaattgtaagtgcaattatagttgttttatttcttgttttgtacttcttatttgtcaatttttctttaccaaaatcgaatgaagaagttcttgaagaatttgcagaaagcttttataaacccatattaacaacaaatacatacaaaggatttgagtacagagttgtatcgatgcaaaaagaaattgatacttctaaaacaataattgtctttgttcacggagcgccaggatctttattagattttaaaaaatatttggcagattctttgctaaatacaaaagcaaatatgatttcttacgatagaattgggtacaattttaaggataaaaatacccgttcaaaaatcaatctcttttga

SEQ ID NO: 19886 - protein, 149 aa, Unknown
  Obtained from environmental sample
  misc_feature (1)..(149): Xaa is any amino acid
MKKTNLYLFVNSQILFWRRNKCMKRLKKILKIVSAIIVVLFLVLYFLFVNFSLPKSNEEVLEEFAESFYKPILTTNTYKGFEYRVVSMQKEIDTSKTIIVFVHGAPGSLLDFKKYLADSLLNTKANMISYDRIGYNFKDKNTRSKINLF

SEQ ID NO: 19887 - DNA, 438 bp, Unknown
  Obtained from environmental sample
  misc_feature (1)..(438): n is a, c, g, or t
ttgtttggccatggaggaatagtagacctaggaacaaattctatcaatgaatttaatcaaacagtacattcttatatacatgacccaatgtttttagatattatgcaagactaccctgacagtactaaatatgatcctcaagaatggagaaaaatgaataattttttgtacaatgaaaatagtccattttggtatcgtggttatgttaattacgacactttagggccacagttaaatgccatgttgaaaaagtatcaatcaaaaattcatattgtagcgcatactccattagagactattacacaaagatataaaggtaaactgctaacaactgatcttaatgatgcagcaacacaattgttattacttgttcgtgataagaaaaaatattctaaatttattattgatagttcgggaattgtttcagaattaaagtga

SEQ ID NO: 19888 - protein, 145 aa, Unknown
  Obtained from environmental sample
  misc_feature (1)..(145): Xaa is any amino acid
MFGHGGIVDLGTNSINEFNQTVHSYIHDPMFLDIMQDYPDSTKYDPQEWRKMNNFLYNENSPFWYRGYVNYDTLGPQLNAMLKKYQSKIHIVAHTPLETITQRYKGKLLTTDLNDAATQLLLLVRDKKKYSKFIIDSSGIVSELK

SEQ ID NO: 19889 - DNA, 507 bp, Unknown
  Obtained from environmental sample
  misc_feature (1)..(507): n is a, c, g, or t
atgagagtttttaaagaagaacaacgatttacacaaagttggcttattgttttaatagcaattagtatgcttgtgccaatttttataattattaaagagttttctaaagaaaatacaacaatgagtacgaacgaatttcttttttcgattattttaatgcctctgtgtattctgcctattttcttctttaaattaaaaacaagagtcgacgaaatgggaattcattttcaatttttcccgtttcatttctctccaaaaacaattgcttggtcagcattaaaatctgcgaacaccagaaaatattatgcaatcacagaatatggtggctggggattaaaaactagctttctatctagaaaaaagaaagggatcgcttatactgtttctggagatttaggtttgcaactcgaattacaaaatggaccgaacattttaattggaacacaacttttaaacgaagtaaattccgttttaaaaaccgtacgaagaccaaataaataccaatga

SEQ ID NO: 19890 - protein, 168 aa, Unknown
  Obtained from environmental sample
  misc_feature (1)..(168): Xaa is any amino acid
MRVFKEEQRFTQSWLIVLIAISMLVPIFIIIKEFSKENTTMSTNEFLFSIILMPLCILPIFFFKLKTRVDEMGIHFQFFPFHFSPKTIAWSALKSANTRKYYAITEYGGWGLKTSFLSRKKKGIAYTVSGDLGLQLELQNGPNILIGTQLLNEVNSVLKTVRRPNKYQ

SEQ ID NO: 19891 - DNA, 531 bp, Unknown
  Obtained from environmental sample
  misc_feature (1)..(531): n is a, c, g, or t
atgaaaaagattatttactacgtagcaagttctcttgacggatatatagctggaaagaatgacgatataagtcaattcatacttcaagggaaaggagttgagaaatatcaacaggatctttcaacgtttgaaacggtcatcatgggtaggagaacctatgaatttggtttccaatatggacttcagccaggtcaacccgcctacccaaatatggaacactatatttttactgattcaatgaacattaaggatttagcaaacactgttcatattgagaaaaaatccatccaaagagtgctcgaaatcaaagaaagctctactacagacatttacttgtgtggtggcggtgactttgctggatggcttttagacaatggactgattgatcaactcaaattgaaattgaatcccattattcttggggaaggcattagattatttggaaattccaaatcgactcaaaaatggaagttagttgatacagaatcttttgacgatggtcttcaaattctgacgtatgaaaaggaatag

SEQ ID NO: 19892 - protein, 176 aa, Unknown
  Obtained from environmental sample
  DOMAIN (2)...(170): RibD C-terminal domain
  misc_feature (1)..(176): Xaa is any amino acid
MKKIIYYVASSLDGYIAGKNDDISQFILQGKGVEKYQQDLSTFETVIMGRRTYEFGFQYGLQPGQPAYPNMEHYIFTDSMNIKDLANTVHIEKKSIQRVLEIKESSTTDIYLCGGGDFAGWLLDNGLIDQLKLKLNPIILGEGIRLFGNSKSTQKWKLVDTESFDDGLQILTYEKE

SEQ ID NO: 19893 - DNA, 636 bp, Unknown
  Obtained from environmental sample
  misc_feature (1)..(636): n is a, c, g, or t
ttgcccacttggtttgaagtcagaattaatgaaaaaggttacttaggacgccgtgaaggatatgattttattgtggcaactaatggtcaaactgaattcaaagattacaatgagttactcagtggaggttattttttctatgattcatcaagaaaattacctgataatttgaatcgtactgacataactgaaattggcgtgccgttaactcggatttgtaatgaaaattatactgatccaagactcaggcaaatctttaaaaacattatttatgttggagcattggcctttttgtttgatatggactttagtgtttttgaagattcaattgcctctcagtttgcaaaaaaagctaaattaatcgaacccaatataaaagcattaaaactgggttatgattacgcgaaagaacattatcaaggcgtctgtggtttaaaaattgaaagacgtgatttagtaaaaaataaaatcatgatggaaggcaatgatgccactggattaggagcagtatttgcaggagcaacaattgcagggtggtatccgattacaccatcaacttctgtcattgaagctttcgagaaatattgccgaaaatttagagtcgataaagaaacgggtaaaaacaaatttgctaaa

SEQ ID NO: 19894 - protein, 212 aa, Unknown
  Obtained from environmental sample
  misc_feature (1)..(212): Xaa is any amino acid
MPTWFEVRINEKGYLGRREGYDFIVATNGQTEFKDYNELLSGGYFFYDSSRKLPDNLNRTDITEIGVPLTRICNENYTDPRLRQIFKNIIYVGALAFLFDMDFSVFEDSIASQFAKKAKLIEPNIKALKLGYDYAKEHYQGVCGLKIERRDLVKNKIMMEGNDATGLGAVFAGATIAGWYPITPSTSVIEAFEKYCRKFRVDKETGKNKFAK

SEQ ID NO: 19895 - DNA, 528 bp, Unknown
  Obtained from environmental sample
  misc_feature (1)..(528): n is a, c, g, or t
ttgattgatatcggaagtaaaatagaatttatgccgcttattataaatggcgcaattaaaattttaagagaagatgaaaaaggagatgaattagtgttgtattttattgaacaaggagacacttgcgccatgacaattacatgttgtttaggacaatcaaaaagtaaaattagagctgttgcagaagtagaaacggaattgataatgattcctgttcagaaaattagcgaatggatgaacacgtatcaaacttggcaaaattttatcttacaaagctatcatgaacgaatgcaagaattactagaggcgattgatacgattgcttttttaaatatggacaaacgtctgctaaaatatttaaaagacaaagcgatgataaataaaaatgaagtaattcaggttacacataaagaaatcgcaaatgacttgtacacctctagagttgtgatttctcgtttgttaaaatccttagaaataaaagggaaaatacaattaaacagaaatcaaataaaggttttaaacctttaa

SEQ ID NO: 19896 - protein, 175 aa, Unknown
  Obtained from environmental sample
  DOMAIN (132)...(163): Bacterial regulatory proteins, crp family
  misc_feature (1)..(175): Xaa is any amino acid
MIDIGSKIEFMPLIINGAIKILREDEKGDELVLYFIEQGDTCAMTITCCLGQSKSKIRAVAEVETELIMIPVQKISEWMNTYQTWQNFILQSYHERMQELLEAIDTIAFLNMDKRLLKYLKDKAMINKNEVIQVTHKEIANDLYTSRVVISRLLKSLEIKGKIQLNRNQIKVLNL

SEQ ID NO: 19897 - DNA, 864 bp, Unknown
  Obtained from environmental sample
  misc_feature (1)..(864): n is a, c, g, or t
ttgatgaattattgtgaagctaaatcattgcctccatacaacgatgatgatgtttttctaattgtttatacttcaggtacaactggtaagccaaaaggtgtaatgctaacatttggtaatatggaatcgaacatacttggtacaactaaatatgtagaaatttataatgaaaattccaaaactttagttttacttccgctgcatcacattcttcctttaggtggaacagttttaatacctctttatgcaggaggcacaattgttttttcgccatccttgcagtctgaagatgtaatggcaacacttcagaatcataaaattaatataattgtttcagttccacgatttttctcattaatccgaaaaggaattaaagaaaaaattaatgataataaaatagcatcactattatttaagatagctgaaaagcgaaaatcaagaaagttttcaaaaaagatattcaaaaaagtacatgataaaatgggcggtgctattgaaacatttgtctgtggtggtgcgaagctagatgaagatgtagctcgagattttcaaactcttggctttgaagtattagagggattcggattaacggaaacttctccaatgattactttcactaggcctggacgagtaaaaattggttcacctggagaagtatttccaggaatggaagtgaaatttgaggatggagaaattctaactcgcggaccaaacttgatgaaaggatattataataaggaagcagaaacaagagaagctattgttgatggatggtttcacacaggagatttagggcatcttgatgacgagggatttcactttgtaaccgggagaaagaacgaatcattgttctttcaatggtaa

SEQ ID NO: 19898 - protein, 287 aa, Unknown
  Obtained from environmental sample
  DOMAIN (1)...(284): AMP-binding enzyme
  misc_feature (1)..(287): Xaa is any amino acid
MMNYCEAKSLPPYNDDDVFLIVYTSGTTGKPKGVMLTFGNMESNILGTTKYVEIYNENSKTLVLLPLHHILPLGGTVLIPLYAGGTIVFSPSLQSEDVMATLQNHKINIIVSVPRFFSLIRKGIKEKINDNKIASLLFKIAEKRKSRKFSKKIFKKVHDKMGGAIETFVCGGAKLDEDVARDFQTLGFEVLEGFGLTETSPMITFTRPGRVKIGSPGEVFPGMEVKFEDGEILTRGPNLMKGYYNKEAETREAIVDGWFHTGDLGHLDDEGFHFVTGRKNESLFFQW

SEQ ID NO: 19899 - DNA, 429 bp, Unknown
  Obtained from environmental sample
  misc_feature (1)..(429): n is a, c, g, or t
atgaaaaaaacatatttttatgcaaaaaagaaacatgtcggaaataagttcctcaatttcttagcaaataaagacaatattattgttgttgatataaataaagatttaaaaaaatcacttcaaaaaatgggtgcagttctgaaaagtggaaaaaatatgataatatttccagagggaacacgttcggaaaatggagaattgggtgattacaaaaaaacatttgcaattttaagtagtgaattaaatgtgccagttgttcctgtagcaattggaggcgcttataaagctcttccaaaaggtagtttcatcccaagaccatttaaaaagatttgtgtaaaatttttagagccaatagatccctctggatattcatacgattcacttaccaatgaggtttataataaagtttcggatgaacttgagtgctaa

SEQ ID NO: 19900 - protein, 142 aa, Unknown
  Obtained from environmental sample
  misc_feature (1)..(142): Xaa is any amino acid
MKKTYFYAKKKHVGNKFLNFLANKDNIIVVDINKDLKKSLQKMGAVLKSGKNMIIFPEGTRSENGELGDYKKTFAILSSELNVPVVPVAIGGAYKALPKGSFIPRPFKKICVKFLEPIDPSGYSYDSLTNEVYNKVSDELEC

SEQ ID NO: 19901 - DNA, 588 bp, Unknown
  Obtained from environmental sample
  misc_feature (1)..(588): n is a, c, g, or t
ttgaaagctgaatttcaaaaattaaataaagacattaatcctttagttttaattcagttacctaatgatgatagtaaattaaaagattcaggtcaaaaaactaaagaagaaattgtgcttgaatatctctcaaaaaagaaaatagatgtagaacgaaaagtagctttatggtttgatggcaaacagaaaaatatggacttcattactcataatgaaagtgatgtagattttatgttatttaaacaagcggcaggtacaggttgggattgtccaagagcacatatattagtaatgttcagagaaataaattcagcttctttttatacgcaaacaattggtagaattttaaggatgccagagccaaattcaaaagacgattataaaaataatccaaatttgagaacaggctatttatttacaaattacaagcgtaatgatatagaaataccagatcaaaccacaaacaacaaacccttcatatatacttcaaaaagaaaagatgatattcaaaatattgaaggattatattcagattttgtgtctagaatagattatggtgatttaggtcacgcagttaagttcaaatga

SEQ ID NO: 19902 - protein, 195 aa, Unknown
  Obtained from environmental sample
  misc_feature (1)..(195): Xaa is any amino acid
MKAEFQKLNKDINPLVLIQLPNDDSKLKDSGQKTKEEIVLEYLSKKKIDVERKVALWFDGKQKNMDFITHNESDVDFMLFKQAAGTGWDCPRAHILVMFREINSASFYTQTIGRILRMPEPNSKDDYKNNPNLRTGYLFTNYKRNDIEIPDQTTNNKPFIYTSKRKDDIQNIEGLYSDFVSRIDYGDLGHAVKFK

SEQ ID NO: 19903 - DNA, 426 bp, Unknown
  Obtained from environmental sample
  misc_feature (1)..(426): n is a, c, g, or t
gtggaacccgtggattacctggtaaaacccttggatgggaccggttcatcaaaagcaacagacaggcctgttgaacggtgcaagcttatcacagattcttccgctgacgagaaggagttatttatgatggtcaagtcggagtataacctgatccgtgtgaatttcagcgacatcctgtacattgaggcttaccgggagtatgtcagaatctttcttgaaaagggggatgtactcacgttggataccatgaagaatatggagcttgttcttcccgcggcaggattcagacgcatacataaatcatttattatatcttttgacaagctcacttcgattcaggggaatcaggtagagatcgcaggaaagaaattgccgataggccgcagttataaagcagcattgatgaaggctctaaactcagattaa

SEQ ID NO: 19904 - protein, 141 aa, Unknown
  Obtained from environmental sample
  DOMAIN (48)...(139): LytTr DNA-binding domain
  misc_feature (1)..(141): Xaa is any amino acid
MEPVDYLVKPLDGTGSSKATDRPVERCKLITDSSADEKELFMMVKSEYNLIRVNFSDILYIEAYREYVRIFLEKGDVLTLDTMKNMELVLPAAGFRRIHKSFIISFDKLTSIQGNQVEIAGKKLPIGRSYKAALMKALNSD

SEQ ID NO: 19905 - DNA, 318 bp, Unknown
  Obtained from environmental sample
  misc_feature (1)..(318): n is a, c, g, or t
atgttcaaaccgggcaagcgtatatatatttccgtatggacccacggcaatggaattcacataggttggcctgcctccatcttcataaaaaacagggccatgatcgatgtattttttctccgggatatcaaaggttatcagatgaaggttttccaatccttttgctgcacccatggcaatatgttcctttccttttacccgttgaccatcaatgtatatgggtcccccggtgagataatatatggtacgaccatccggtccaagctgaaatcccaaatagccataactgaattgatcaaacatcccacttttttttga

SEQ ID NO: 19906 - protein, 105 aa, Unknown
  Obtained from environmental sample
  misc_feature (1)..(105): Xaa is any amino acid
MFKPGKRIYISVWTHGNGIHIGWPASIFIKNRAMIDVFFLRDIKGYQMKVFQSFCCTHGNMFLSFYPLTINVYGSPGEIIYGTTIRSKLKSQIAITELIKHPTFF

SEQ ID NO: 19907 - DNA, 660 bp, Unknown
  Obtained from environmental sample
  misc_feature (1)..(660): n is a, c, g, or t
atgtatgttgataggccagagttggaaaaatatttgcttcgttcagtaaagaaaaatatgcattcgatactttgtggtgagagtggaaatgggaaatcctggttatataaaaaacttctaacaaaaaataaggtcccattcgtagtcgcaaattgcgctaatgcctctaggattaattccctcacagatgaaatacgtaatgcaataataggaagtggctattcagtaaaaacctcctacactgaaacaaagaaggcaacagcaaatgctggcatagccacaggcgcgctcgcacattcaggcaattacgatttgagtgatgaagagccactgttgcaagcatttaaagtgtttgaaaaaaaagaaggtaacatcaagaaaatactggtaattgataatttggaaagtattttcactaaaccaatgataatggatgagcttgcagatatcgttattctgctagatgacgaaaggtatgcaaaatataatgttaatttgctaattgtcggagttccaaatggagtattggattatttcagaaaaactaaaaatagtgaatccgtttcaaatagaattgaagaggtagaaaaagtaggcgggcttgataaagaccaggttgaaaatattattcagaagggatttagcaactcaaaattannt

SEQ ID NO: 19908 - protein, 220 aa, Unknown
  Obtained from environmental sample
  misc_feature (1)..(220): Xaa is any amino acid
MYVDRPELEKYLLRSVKKNMHSILCGESGNGKSWLYKKLLTKNKVPFVVANCANASRINSLTDEIRNAIIGSGYSVKTSYTETKKATANAGIATGALAHSGNYDLSDEEPLLQAFKVFEKKEGNIKKILVIDNLESIFTKPMIMDELADIVILLDDERYAKYNVNLLIVGVPNGVLDYFRKTKNSESVSNRIEEVEKVGGLDKDQVENIIQKGFSNSKLX

SEQ ID NO: 19909 - DNA, 612 bp, Unknown
  Obtained from environmental sample
  misc_feature (1)..(612): n is a, c, g, or t
gtgacccaattaacgaatacaatgtctttaaaatcatttgcaaattatgattctacgataaaaggttcaccttttattcaaaaagattatgaagtagcaaagatttctaaatttggtaatagaacgttttctataaaatacaatgctcatagagattttatggaagtattaaatgacggaaaaattcaatcctttctacctgataaaaaatacccttatgaaatttttttcttaaagaccaataaaacctacaaagcttttcattataaaaagaaaaaagaagattcttatggtttttttaatgttacgacaaagaataccttttgcaatctactgattaaacaagaaataatattaacaaaagctagcaaaccaaaaactggttacaacgaatattctcccgcaaaatttaaaagacaaaaagatactttctttattaacttcactaaaaatgatcttgccattaagcttcctaaaaagaaaaaagctttttttaaaatcttttcatcacattcacaaagaattcaaaaatatgttaaaaaagaaaaactaaacataaagaaagaacatgatttagctcaaattattactttttataacaccctattataa

SEQ ID NO: 19910 - protein, 203 aa, Unknown
  Obtained from environmental sample
  misc_feature (1)..(203): Xaa is any amino acid
MTQLTNTMSLKSFANYDSTIKGSPFIQKDYEVAKISKFGNRTFSIKYNAHRDFMEVLNDGKIQSFLPDKKYPYEIFFLKTNKTYKAFHYKKKKEDSYGFFNVTTKNTFCNLLIKQEIILTKASKPKTGYNEYSPAKFKRQKDTFFINFTKNDLAIKLPKKKKAFFKIFSSHSQRIQKYVKKEKLNIKKEHDLAQIITFYNTLL

SEQ ID NO: 19911 - DNA, 315 bp, Unknown
  Obtained from environmental sample
  misc_feature (1)..(315): n is a, c, g, or t
atgatctttaaaatatttgatttgacaaatgttcctgccgaactagagcatcgccttaaagccctgttaaaaagcaagaatatccacttccacgttaaatctaacgataaaaactccagtcgatatatttacgttaagaataaaatgcaatcggttaaggcaaaaaagcttattcaggagtttgaacaggaatggagagaaaaggccagaagccacgaagtatccagcattcccccgaaggataaacgtatcaagcagttaatttttttgatcgcagtcgttttcgccttctttatgtttagcatttttctctaa

SEQ ID NO: 19912 - protein, 104 aa, Unknown
  Obtained from environmental sample
  misc_feature (1)..(104): Xaa is any amino acid
MIFKIFDLTNVPAELEHRLKALLKSKNIHFHVKSNDKNSSRYIYVKNKMQSVKAKKLIQEFEQEWREKARSHEVSSIPPKDKRIKQLIFLIAVVFAFFMFSIFL

SEQ ID NO: 19913 - DNA, 903 bp, Unknown
  Obtained from environmental sample
  misc_feature (1)..(903): n is a, c, g, or t
atgccaggcggcgagaaagacggtgcttactatcctgaaatcaaggcgaagagcgtgaattacaaatggctcaccaaaaaagatgaaatcgagctggaaaccatgaatacaggggaaccaattgccctgtttgaaggcgaaggtatatttgaaggaaaactggtcatcaccaaaaaaggactcattggctctggtaaattgaccatgggcaatatcacggtggaaagtgacgagattcttttcaaggaaaaagaattcgaggccaaaacgggaacctttgccgtcatggacaaatctgacccgaccaagcagttgtacaaagctgaaaatgtagaggtcaaatacgatgttgacggacaccactcaaccttccaggcgaatgaaatcggagtagccaattcttcattcccacaacaaaactaccgcacgtcgctgtcgaaaggtacgtacgacaaaaagaccaacgacatcttgctcgaacgcgtttctccgaaacaaaaccagaattacttctactctacggacaagttgcaggacagcctggcctactacgccaatgctgcgcattatgattttgacaaaaaagaaattgagatcgaaggcgtgccttatatctacgtcgcggatgccaaaatcacccctgataccggaaaagtaacggtcaagccagacggattcctgcaaaagctggaagacgcggtcatcgaagccaatctggaaacgaagtaccacaagatgtatgatggcaacgtggagatcacttcttccaaacggtacaaaggcagcggtaagtacgaatacattccgattgccgggaacgaacaggtcatcaacatgaccgacttcatgtccgcgagatcatggccgtgccaaagtaacttacggaaagaaggttactcatga

SEQ ID NO: 19914 - protein, 300 aa, Unknown
  Obtained from environmental sample
  misc_feature (1)..(300): Xaa is any amino acid
MPGGEKDGAYYPEIKAKSVNYKWLTKKDEIELETMNTGEPIALFEGEGIFEGKLVITKKGLIGSGKLTMGNITVESDEILFKEKEFEAKTGTFAVMDKSDPTKQLYKAENVEVKYDVDGHHSTFQANEIGVANSSFPQQNYRTSLSKGTYDKKTNDILLERVSPKQNQNYFYSTDKLQDSLAYYANAAHYDFDKKEIEIEGVPYIYVADAKITPDTGKVTVKPDGFLQKLEDAVIEANLETKYHKMYDGNVEITSSKRYKGSGKYEYIPIAGNEQVINMTDFMSARSWPCQSNLRKEGYS

SEQ ID NO: 19915 - DNA, 426 bp, Unknown
  Obtained from environmental sample
  misc_feature (1)..(426): n is a, c, g, or t
atgaaaaaactactcatcttactctttttatttaactctaacttatttgccaaaactttggaatttgggaaaaatgaattacttaatattgcaagtaaaggaaatcaattaaacgctgatgaaggctatttatacttttcattaaaaaattatgacttaatacggaatttttatattaaacccgaaggatctggaaaggacatccgatttagctcagttgatagaggatttcatagggctttaatcaagttaaaagctggcacttatacttggaacaatcttaattacaaagttcgtgcaccgggagcatcaagagaacaatccatctcatttgattatgaaaaacacgattactcatttaaagttgaagccggagtactaattatcctggacatggtcactcttcatgtctcgaccgattcttga

SEQ ID NO: 19916 - protein, 141 aa, Unknown
  Obtained from environmental sample
  SIGNAL (1)...(17)
  misc_feature (1)..(141): Xaa is any amino acid
MKKLLILLFLFNSNLFAKTLEFGKNELLNIASKGNQLNADEGYLYFSLKNYDLIRNFYIKPEGSGKDIRFSSVDRGFHRALIKLKAGTYTWNNLNYKVRAPGASREQSISFDYEKHDYSFKVEAGVLIILDMVTLHVSTDS

SEQ ID NO: 19917 - DNA, 726 bp, Unknown
  Obtained from environmental sample
  misc_feature (1)..(726): n is a, c, g, or t
atgcgtaaaatgataatttattcaagccaaatatataggcaattattttttcttactgctttattcctttgttgtacagagcctgataatgctaaagttactagtagtgtcataagtttaaaccccaaatctacaaccgatatcggactcaaaggtttaattaaggactggcacttcttagagcttaagattaaaaataatttcatcggtacagccgacaaggtcattatcggtaaagacaatatttatatactagacatatataggtcaatgtctctgtttatttttgataaaaaaggcaatcatttaaatactatcaaccgacctggccgaggtcccggtgaatttctttcaccagtcgactttgaaataactgatgaaactcaagaaataattatttatgaccaagctggattaaaattaattttctatgatcaagatggaaattttaaacttgagaaaacccttaatcttaatcctgatagattcggtcatataaaagataaatatatatttttgttgggtaattttgatgaaaataatgggaacaaaaagctagttgtaacagatagtacatttaaagttttggaaagctttgtagaaatgagaagtgaactcattggtttacattttgacataccgacacatattacacaaaacaaatccacattcttagttacaattccattcgacaatactctttataggttaaatagtgaattntaa

SEQ ID NO: 19918 - protein, 241 aa, Unknown
  Obtained from environmental sample
  misc_feature (1)..(241): Xaa is any amino acid
MRKMIIYSSQIYRQLFFLTALFLCCTEPDNAKVTSSVISLNPKSTTDIGLKGLIKDWHFLELKIKNNFIGTADKVIIGKDNIYILDIYRSMSLFIFDKKGNHLNTINRPGRGPGEFLSPVDFEITDETQEIIIYDQAGLKLIFYDQDGNFKLEKTLNLNPDRFGHIKDKYIFLLGNFDENNGNKKLVVTDSTFKVLESFVEMRSELIGLHFDIPTHITQNKSTFLVTIPFDNTLYRLNSEX

SEQ ID NO: 19919 - DNA, 327 bp, Unknown
  Obtained from environmental sample
  misc_feature (1)..(327): n is a, c, g, or t
atgagaatctcagtcttcttttatatttctttatttataatttctagtactaagttttcaggagaaaaatctcattctttaagtaagaatttggtgagaactgatagcatcagaactgatatcaatcttattgttgaagaaaaaacggtaattcagtttgataaatcactagaatacactcaaactcagcgtccatatttgagccatctattaaatgcccctttggaatttaagacgaacaccttaaagaaaaaaaaagtacttcttaagatcgccactaacccgttaaaaccaagtagtttaatcgtgacatttcccttacaatag

SEQ ID NO: 19920 - protein, 108 aa, Unknown
  Obtained from environmental sample
  SIGNAL (1)...(20)
  misc_feature (1)..(108): Xaa is any amino acid
MRISVFFYISLFIISSTKFSGEKSHSLSKNLVRTDSIRTDINLIVEEKTVIQFDKSLEYTQTQRPYLSHLLNAPLEFKTNTLKKKKVLLKIATNPLKPSSLIVTFPLQ

SEQ ID NO: 19921 - DNA, 837 bp, Unknown
  Obtained from environmental sample
  misc_feature (1)..(837): n is a, c, g, or t
gtggaggtatgtacccgaaatgatattgttggtattcaaacgcaactaaagaacagagatttaaccacttcaaaaacaaataaaatgtatggaatgccttttaatgaagaaaatggaggtgctcatcattttagtcgatttattgaatcagaattgattccttatattgaagacaaataccctgtgactaattttagaaccttaattggtcattcatatggtgggttatttaccatttacacactgattaatcatcctcagatgttttctaattatattgccatcgacccaagtcttgattgggataatcagaaattactgattgagtcacgagaaaaattctcaaaaaataactataaaagaaaatccttattcatgtctttaggtggtcaattgcatatgaaaaattcaaaaattaccattgataatattatggaggacacctcagactacaccttgtttgctcgttctaatatcatgttttcaaatttaataaaacaaaagaataatggattggcttttgattggaagttttatccccgagatatacatggcaccattccatttccttccataatggatggtttgattgctgtttttaattggtatcaaatggaaaatactgataaaataaactcctttgatactcctaaagatgagctatatggtattgtaaagtatagagaaaagaaactcaaagagcattttgggtatacaatgcctccttatccagaagaacttttaatcatgtcaggttatatgaatatggacctgattcaanctaaaaaagttaaaatgtatttggagctcactattgagtactatcctaaagtgngn

SEQ ID NO: 19922 - protein, 279 aa, Unknown
  Obtained from environmental sample
  misc_feature (1)..(279): Xaa is any amino acid
MEVCTRNDIVGIQTQLKNRDLTTSKTNKMYGMPFNEENGGAHHFSRFIESELIPYIEDKYPVTNFRTLIGHSYGGLFTIYTLINHPQMFSNYIAIDPSLDWDNQKLLIESREKFSKNNYKRKSLFMSLGGQLHMKNSKITIDNIMEDTSDYTLFARSNIMFSNLIKQKNNGLAFDWKFYPRDIHGTIPFPSIMDGLIAVFNWYQMENTDKINSFDTPKDELYGIVKYREKKLKEHFGYTMPPYPEELLIMSGYMNMDLIQXKKVKMYLELTIEYYPKVX

SEQ ID NO: 19923 - DNA, 741 bp, Unknown
  Obtained from environmental sample
  misc_feature (1)..(741): n is a, c, g, or t
atgaagattaagcacactaataatcacgaatctatagaattgcctttacagatttctgtgagctttgaaaaggtgtttttgatgtataaaaaatattcaaaagacgaatataaagaacatccttttcatttagctgcaaaaaacatggtgactgaaattgaaaaaactccagcgttaattgatgggttctctgattctactttatttgatactcataaaaaaaatattgatttattattaaatccactttttccagagccacttttattgaacgaaattaaatcagcaaccataccatttacttttacttcttttaaatttacaactcggttcgaaaatatcataaaaaatgcaggagctgatttcgaaattaagattcgaaatttcgaagacgatttattatacatttacgcttgtaccatgattttaggctcagtctataaatacccgatagatttaaaaagacctttctttttcgacattccagatgtaactactggaaacatgaaacattatagagctgcatttaataacgattttggagaagttattcctactaaaaacgcgcctaaaataacagaagaagactacatcattttaataaataattttgacaatatcgctgtttggaaagaaaaatttccaccaaacagctacatctancagggttttggaattatgaatttgtttgatgttacaacagatgaattatctctaatattagaacaaacttataaataa

SEQ ID NO: 19924 - protein, 246 aa, Unknown
  Obtained from environmental sample
  misc_feature (1)..(246): Xaa is any amino acid
MKIKHTNNHESIELPLQISVSFEKVFLMYKKYSKDEYKEHPFHLAAKNMVTEIEKTPALIDGFSDSTLFDTHKKNIDLLLNPLFPEPLLLNEIKSATIPFTFTSFKFTTRFENIIKNAGADFEIKIRNFEDDLLYIYACTMILGSVYKYPIDLKRPFFFDIPDVTTGNMKHYRAAFNNDFGEVIPTKNAPKITEEDYIILINNFDNIAVWKEKFPPNSYIXQGFGIMNLFDVTTDELSLILEQTYK

SEQ ID NO: 19925 - DNA, 705 bp, Unknown
  Obtained from environmental sample
  misc_feature (1)..(705): n is a, c, g, or t
atgaacattattgaatactacagacaggatgtaattgaaagttgttttaaaacaaagtcttttaaaaatgcctgggtagtttgggaaaagatcataatacaaaaacttgggaaagattataactggaatgatgttcttaatctaggggaaggtttgggggaaatatttttcacgacaagaggagatgtagaagaagggcttagtgttgctcaagctaatagtaaggcttcgacttcaggaacagcttgggaatgtttggtaacctggtatctgaatctaatttttatcaatagccgggctgtagtatttaagaaaacgggagacgttccatcgccattaacagatggactaaaggttcttcacaacaataccgctacaaactcagaatctgatcttattgtagttgtttttcctaatcgacctcattttacagctgatttattacaagttccattgaccgataatagatcaaaaccatatgtgtcggatggcaataagtccgttggtttgtataaacaaggcactcctaataaaagagccattgataaatatgcggctaaagtgtgcgaagaatactttagtaagtttgagatgggcgtaattcaatgtaagactaattggaatgaaaactcccaaataccaatgctttgggatatcgtttatcgcctttggaaaaaatatcgatcgagatattccaaattttag

SEQ ID NO: 19926 - protein, 234 aa, Unknown
  Obtained from environmental sample
  misc_feature (1)..(234): Xaa is any amino acid
MNIIEYYRQDVIESCFKTKSFKNAWVVWEKIIIQKLGKDYNWNDVLNLGEGLGEIFFTTRGDVEEGLSVAQANSKASTSGTAWECLVTWYLNLIFINSRAVVFKKTGDVPSPLTDGLKVLHNNTATNSESDLIVVVFPNRPHFTADLLQVPLTDNRSKPYVSDGNKSVGLYKQGTPNKRAIDKYAAKVCEEYFSKFEMGVIQCKTNWNENSQIPMLWDIVYRLWKKYRSRYSKF

SEQ ID NO: 19927 - DNA, 402 bp, Unknown
  Obtained from environmental sample
  misc_feature (1)..(402): n is a, c, g, or t
ttgatcaagtggaataggatggccaaactttctaaaaatcatagaatagagtttagagccaattattttggaaacccaggagagactaatgaganacaagttttggcatttgcaaagtatacttttacttttggtgtaccactgaaaaaagtaataaagcaaggtggtttaataggaaatgttttttctttagacaccaaaataaatacccaagggattaaaattattgctgcgggtaaaacagtattaacggataagaatggaaactttgaattaaataatttagcgttaggtaaaaattatattttggtagatcaatctacactaggaaatggagttattactgcagctaaaattccttatgaagttattgttaaagataataaacacagcagaaattag

SEQ ID NO: 19928 - protein, 133 aa, Unknown
  Obtained from environmental sample
  misc_feature (1)..(133): Xaa is any amino acid
MIKWNRMAKLSKNHRIEFRANYFGNPGETNEXQVLAFAKYTFTFGVPLKKVIKQGGLIGNVFSLDTKINTQGIKIIAAGKTVLTDKNGNFELNNLALGKNYILVDQSTLGNGVITAAKIPYEVIVKDNKHSRN

SEQ ID NO: 19929 - DNA, 618 bp, Unknown
  Obtained from environmental sample
  misc_feature (1)..(618): n is a, c, g, or t
ttgtattatatgaaagatattgatccagatgttattagaagattatttataatattattgaaagatattgatgaggaaaataaatcaatattgtttatgtcaaataaatttgaacaagatatattagaaggtgttggatttaaaaaatatgcaaactttaaaaaagcagtccataaaggggcagcagttgcttttaatttctctaatgctacatcaaaaagtataagtaatgcaaactacataccaacagtaacaaaacttgatacggatacttttaaagagaatagagtagagtatattttacacatagttgcaaagcagtcttcacttatgctctcaacacaatttggataccaacactcttatgcactgagtaaagatattattaaaatatcaccatggattatggtagatgaagcattcacagatgccgaaaaacttattagaggagtattgtaccaccgtggtttaaaaaccattgtctcttttataccagctgaggtaaaagagatagtggaactttacaaatcttataagtttgaatttgttgaggattttggtttgttgtatataaataaaaaaccaactttcaatcttgattcaatctatggattttaa

SEQ ID NO: 19930 - protein, 205 aa, Unknown
  Obtained from environmental sample
  misc_feature (1)..(205): Xaa is any amino acid
MYYMKDIDPDVIRRLFIILLKDIDEENKSILFMSNKFEQDILEGVGFKKYANFKKAVHKGAAVAFNFSNATSKSISNANYIPTVTKLDTDTFKENRVEYILHIVAKQSSLMLSTQFGYQHSYALSKDIIKISPWIMVDEAFTDAEKLIRGVLYHRGLKTIVSFIPAEVKEIVELYKSYKFEFVEDFGLLYINKKPTFNLDSIYGF

SEQ ID NO: 19931 - DNA, 516 bp, Unknown
  Obtained from environmental sample
  misc_feature (1)..(516): n is a, c, g, or t
atggaaaaaaataatagggtaggctatactaggccttattcgttcaatcttagtttagccatgaaactaacgacaatccttttaattctttcaatctttaccgtacaggccaattcctacgcgcaaaaaaccaaggtaactttagacctgcgacaggtggaaatgcataaggtatttgaggaaatagaatcgcttacagaattcaaatttttatatgacaatacaaaaattgatgcggcgaaacttgtttctataaaggcaaacaacaaaccagtatccgaagttctcaataatttgttcaacggcacttcaatctattatttggttagacagaagcaaattgttcttaaagttcaaaaacccatactcccatctttaattaaagaagagggtgaattattgttgaaaaaaattagtacaaacatcgttctggaacataatgatgataaggcagtctgccaagagcatgggtggaaaggacaattaggcgtaacgcgatttgaggtatttcgataa

SEQ ID NO: 19932 - protein, 171 aa, Unknown
  Obtained from environmental sample
  misc_feature (1)..(171): Xaa is any amino acid
MEKNNRVGYTRPYSFNLSLAMKLTTILLILSIFTVQANSYAQKTKVTLDLRQVEMHKVFEEIESLTEFKFLYDNTKIDAAKLVSIKANNKPVSEVLNNLFNGTSIYYLVRQKQIVLKVQKPILPSLIKEEGELLLKKISTNIVLEHNDDKAVCQEHGWKGQLGVTRFEVFR

SEQ ID NO: 19933 - DNA, 555 bp, Unknown
  Obtained from environmental sample
  misc_feature (1)..(555): n is a, c, g, or t
ttgtttttcaagagcatcattcagatagccttgatggagggccaacccgatcttgcgcaaaagtacattgaggacctggccgaaaacaaagtctggtacgattacgaaggccagaaggagatgatcaagcagttcatgcaggccaagatcagcctggctttgaagaactatgaggaagcactgtcagatttgaattatttgtcgattcattccaagctgaatgacctcaacctggaaatcgattttcgcaccatgaagttgcagctgcactatttgcttcagcaatgggaacccggcatcagcgccatggatgcatttcgcatgtatgtcagcaacaactcagaattgctcactgaaaattccatagccatcttgaattggcgattgcgctggtttcggcgattgtatcgtctcggctcctcagaagtaaaatccaagtctcccaaagtcaaacccaaagcaattcaaaaactcatagacgaactgaaagccgatccgcgctaccgtttgaaagattggtttttggagcagttgcgggtattgagttgcgggtaa

SEQ ID NO: 19934 - protein, 184 aa, Unknown
  Obtained from environmental sample
  misc_feature (1)..(184): Xaa is any amino acid
MFFKSIIQIALMEGQPDLAQKYIEDLAENKVWYDYEGQKEMIKQFMQAKISLALKNYEEALSDLNYLSIHSKLNDLNLEIDFRTMKLQLHYLLQQWEPGISAMDAFRMYVSNNSELLTENSIAILNWRLRWFRRLYRLGSSEVKSKSPKVKPKAIQKLIDELKADPRYRLKDWFLEQLRVLSCG

SEQ ID NO: 19935 - DNA, 789 bp, Unknown
  Obtained from environmental sample
  misc_feature (1)..(789): n is a, c, g, or t
gtggatttaatacttgatgctgaaaatatgttttctagtacttggtctagtaatttaaaatctagttacagtgaaaaccaagttgtgcttgatgaactattagtagataaactttattattcttaccttgacagtggctttaatttagccagaaataatgcatgcatacagaactacaaatcttcttttgctgcctatcgattaagctcagctgaacatttacaaaagtttttacgtattaactattctaaagagttacctagtgcattaataaattcttatcaaagattattagctcctgatactgagtacagcaccattatcactctcgatgaaagaaaatatttgagcgatgtatatcatacttctcaattaaatttatttgaaaactctatggttgaaatttctaccagcaaaaatgaatatattcccattaacttaaaagaaattgattacacaaaaatagatactgatcagttaattgcagaaaatattaaaaaagaaattcaagaagaactagaccaaaaaaagactaaactaaaaaatccttctattccaaaaaccagagttgtaagaactggtagcagtgatttgcgtatcattgccataagtaatatcagcagtgccattaataaacgggttagaataaaaaccctcagaggaaggcctatagttggcataattaaaagcatcaataatgatttaatcacactaaattccagctttaaaactggtaaatcaaccatcaccattcctgttgatatggtttcatcggttgagctattatag

SEQ ID NO: 19936 - protein, 262 aa, Unknown
  Obtained from environmental sample
  misc_feature (1)..(262): Xaa is any amino acid
MDLILDAENMFSSTWSSNLKSSYSENQVVLDELLVDKLYYSYLDSGFNLARNNACIQNYKSSFAAYRLSSAEHLQKFLRINYSKELPSALINSYQRLLAPDTEYSTIITLDERKYLSDVYHTSQLNLFENSMVEISTSKNEYIPINLKEIDYTKIDTDQLIAENIKKEIQEELDQKKTKLKNPSIPKTRVVRTGSSDLRIIAISNISSAINKRVRIKTLRGRPIVGIIKSINNDLITLNSSFKTGKSTITIPVDMVSSVELL

SEQ ID NO: 19937 - DNA, 750 bp, Unknown
  Obtained from environmental sample
  misc_feature (1)..(750): n is a, c, g, or t
atgaaaattaaaactgctttttttactgtattttttacttttctttttattggatgcacttcaaacgagtcaaaaaaaacgaatcaattaaataacgtttctactgcagataacattaaaattgatgaagttcaattgttaaacaatataaaaatattagcaagcgattctttagaaggaagaggtttttctaagccaggtaattataaagcgcagcaattaattgccaatgaatttaaaaggttacaattggaaacagctttagatagtggttatattcaaaaatttacaactacttataaaggcgtaagaagacaacgaatgtttcctgtaaaaggaaaagaaaaaaacgatgcaaacgttcctgacacaactgttgttggcggaaatgttgtaagtatgattaaaggaaaatcggacaaaataattgttattacaggacatcatgatcatttgggaattagaaacggaaaaatatataatggcgcagatgatgatgcttctggtactgctgcagtaattgcaattgcagattattttaaagataaaacaccaaatcacactttggtttttgcaactgttgatgctgaagaagctggaatgcacggctcggcttatttggtaaaaaactttcctttaggaaaagacaacatcgttttacatattaatatggatatgatttcgcacaacgaacaaaacaaattgtatgcgtgtggtttgtatcattatccgcagttaaaaaacctttaa

SEQ ID NO: 19938 - protein, 249 aa, Unknown
  Obtained from environmental sample
  DOMAIN (141)...(209): Peptidase family M20/M25/M40
  misc_feature (1)..(249): Xaa is any amino acid
MKIKTAFFTVFFTFLFIGCTSNESKKTNQLNNVSTADNIKIDEVQLLNNIKILASDSLEGRGFSKPGNYKAQQLIANEFKRLQLETALDSGYIQKFTTTYKGVRRQRMFPVKGKEKNDANVPDTTVVGGNVVSMIKGKSDKIIVITGHHDHLGIRNGKIYNGADDDASGTAAVIAIADYFKDKTPNHTLVFATVDAEEAGMHGSAYLVKNFPLGKDNIVLHINMDMISHNEQNKLYACGLYHYPQLKNL

SEQ ID NO: 19939 - DNA, 699 bp, Unknown
  Obtained from environmental sample
  misc_feature (1)..(699): n is a, c, g, or t
atgatcgcacagcacctgatcggcagcatcgatgaagacggatacctgagacggcctctgccggccatcatcaacgacatgacctttcgctacaaccttcgcccttcgattgaggacatggaggcggtgctaaagcagattcatacatttgatccggccggagtcggcgctcgtgacttgcgagaatgccttctactgcaattgcagcgcaaagacgcgacggagaacatcaccctggccattcggatcctgacagattacttcgatgagttcaccaaaaagcacttttccaagctcaaatctgcactgggagttaccgaggaaaagctgaaagatgtctaccaggaaatcacccggctcaatcccaagcccggcggcgcccccagcaatgccaaacacgaatacatcattcctgatttcaccctgatcgtcaccaacggtgagattgaaatcaaactgaacagctccaacgcaccggatttgcgggtcagcggcagctatatcaagatgtacgatcagtacaaaacgcagcagaaaaagcaaaagtcgcccaaaaccaaggagactctggactttgtcaagcagcgcattgaatcggcacagtggttcatcgatgccatccgccagcgccaattcactttgctcaataccatgatggccatcgccgagcgccaaaaggagtttttcctctctgccgnn

SEQ ID NO: 19940 - protein, 233 aa, Unknown
  Obtained from environmental sample
  DOMAIN (1)...(168): Sigma-54 factor, core binding domain
  misc_feature (1)..(233): Xaa is any amino acid
MIAQHLIGSIDEDGYLRRPLPAIINDMTFRYNLRPSIEDMEAVLKQIHTFDPAGVGARDLRECLLLQLQRKDATENITLAIRILTDYFDEFTKKHFSKLKSALGVTEEKLKDVYQEITRLNPKPGGAPSNAKHEYIIPDFTLIVTNGEIEIKLNSSNAPDLRVSGSYIKMYDQYKTQQKKQKSPKTKETLDFVKQRIESAQWFIDAIRQRQFTLLNTMMAIAERQKEFFLSAX

SEQ ID NO: 19941 - DNA, 492 bp, Unknown
  Obtained from environmental sample
  misc_feature (1)..(492): n is a, c, g, or t
atgaatgaaaatgatattctggttccatcagaagtgacctcttcggagaaacaattaatggaatctccagaaattgaaacgattgccaaaactgtaatcgaaaagaataagctcgaatttggtccgacagaaattggatattttttagtttatccaaatatatcaaagcagaaagctgccaaatgtatgaaagcaacacgagaagttaagtactactcgggtaatgactatctgatagaagtgtctggtgagctttgggatatgcttgataatgacacaaaggaaatggtaatctatcatgagttacttcatatagatccttcttttaagtctaaaactcaagaatggaagatgaatttgaagcgtcctgacttctctgattactacactataaatgacaagtacggaaacgaatggtataaaacggtgcaagcaacagcttcgtcgttatacgatttagacccacgccaagaaagcaaagtttctctttag

SEQ ID NO: 19942 - protein, 163 aa, Unknown
  Obtained from environmental sample
  misc_feature (1)..(163): Xaa is any amino acid
MNENDILVPSEVTSSEKQLMESPEIETIAKTVIEKNKLEFGPTEIGYFLVYPNISKQKAAKCMKATREVKYYSGNDYLIEVSGELWDMLDNDTKEMVIYHELLHIDPSFKSKTQEWKMNLKRPDFSDYYTINDKYGNEWYKTVQATASSLYDLDPRQESKVSL

SEQ ID NO: 19943 - DNA, 513 bp, Unknown
  Obtained from environmental sample
  misc_feature (1)..(513): n is a, c, g, or t
atgtgtacattatttgaacgttacaaaacggatggtgtagagtacaacatgtatattggtggttctttgaccgacaaaaaagcatttgacaatttgtatttatacaatttgcgtttatggcaattacaaaccatgtttgagctagaaaatattgcttttaaagcgcgtgaagaaatgaatcacgatttaagagttgcttctttaattttagtgcacagcaatccgttatctattaaatttagaatggatgaaaaacaatttgatgtggatggtgcttacaacatcagatatgaaattatcaaaaaaagaattgataaagcgcatataaaaaacactactgagcggctaactgttcctggcaaaatagccattgtttattctcaagacagcgatgcgagagagtatttaaaatacatccgttttttacaatcaaaaaaatattttggtgcattagaaaaattagaaatcgaagatttacagggcatctctggattnaaaagctttacgtgttga

SEQ ID NO: 19944 - protein, 170 aa, Unknown
  Obtained from environmental sample
  misc_feature (1)..(170): Xaa is any amino acid
MCTLFERYKTDGVEYNMYIGGSLTDKKAFDNLYLYNLRLWQLQTMFELENIAFKAREEMNHDLRVASLILVHSNPLSIKFRMDEKQFDVDGAYNIRYEIIKKRIDKAHIKNTTERLTVPGKIAIVYSQDSDAREYLKYIRFLQSKKYFGALEKLEIEDLQGISGXKSFTC

SEQ ID NO: 19945 - DNA, 612 bp, Unknown
  Obtained from environmental sample
  misc_feature (1)..(612): n is a, c, g, or t
ttgttgccatccatcatccaatggttacaaaatggtccacatgncggtcaattctctttaaaacaacaattatgtcctacagaaggaagcattcctataccaattcttggaacgtttttagatctgataagaaaaacaagtggaatcagtaatacagacatccaaaataaacggtatttagaatttaaaaatagaattgtaacactgtctcaagaaaacgaaaaagtaattttagttgctgggcacgaacatacattacaatatataaaacaagataatttacctcaaatcattagcggttctggttctaaaacttcagcaacaagaaatgttggtaaaggattattttcttatggagcgccaggttttgctaaactagatgttttaaaagatggttcttctcgagttacatttattgcttcagaaaaaaatgagatcgtttatcaaacacaagtactaaaaccagacagtcctaaaattgattttacttttactaaaaatcaaaatccatatacttctgcatcaatttatacagaaaaagaagtttcaaaaggaaaattctatacagctgtttggggaaacgttacagaaaatattacggcacaaaaataa

SEQ ID NO: 19946 - protein, 203 aa, Unknown
  Obtained from environmental sample
  misc_feature (1)..(203): Xaa is any amino acid
MLPSIIQWLQNGPHXGQFSLKQQLCPTEGSIPIPILGTFLDLIRKTSGISNTDIQNKRYLEFKNRIVTLSQENEKVILVAGHEHTLQYIKQDNLPQIISGSGSKTSATRNVGKGLFSYGAPGFAKLDVLKDGSSRVTFIASEKNEIVYQTQVLKPDSPKIDFTFTKNQNPYTSASIYTEKEVSKGKFYTAVWGNVTENITAQK

SEQ ID NO: 19947 - DNA, 336 bp, Unknown
  Obtained from environmental sample
  misc_feature (1)..(336): n is a, c, g, or t
atgaaattaggtgatcgattagacggtcatattgtgcaaggtcatgtagatgaaacaggagtttgctcaactattttagaacaaaacggaagcaccatttttacttttaaatacaactcaaaaagcaataacttaaccattgaaaaaggttcaataactataaacggagttagtttaacggttgtaaactctaaagattatgagtttagtgttgcaatcattccttttacaaaagagcatactacttttcatcaattgaaaataggagacaaggtaaacttagagtttgatgtgcttggaaaatatgttgtgaaactaaatgctttaagaaactaa

SEQ ID NO: 19948 - protein, 111 aa, Unknown
  Obtained from environmental sample
  DOMAIN (13)...(97): Lumazine binding domain
  misc_feature (1)..(111): Xaa is any amino acid
MKLGDRLDGHIVQGHVDETGVCSTILEQNGSTIFTFKYNSKSNNLTIEKGSITINGVSLTVVNSKDYEFSVAIIPFTKEHTTFHQLKIGDKVNLEFDVLGKYVVKLNALRN

SEQ ID NO: 19949 - DNA, 396 bp, Unknown
  Obtained from environmental sample
  misc_feature (1)..(396): n is a, c, g, or t
ttggggtttacaaacgacggaacgcacttaatcaaatctgacggaactgataaaatttggtttttagatccaataacattaaaagaaaagaaatcgattcaagtatatacaaacaagtattcgctaaaagaattgaacgaaatagaatacatcaatggaaaaatttacgcaaataaatggcaacaaaattctattgtaattattgatgctaaaaccggaattgtggaaggtgttgctaatttatctggattgaaaaaagaaattgaaaaaacacaaaccctagccaatcaagacgaagttttaaacggaattgcctacgacaaagaaactggaagaatttttattacgggaaaacattggggaaaactttttgaaatcaaattagtaaaacaataa

SEQ ID NO: 19950 - protein, 131 aa, Unknown
  Obtained from environmental sample
  DOMAIN (1)...(131): Glutamine cyclotransferase
  misc_feature (1)..(131): Xaa is any amino acid
MGFTNDGTHLIKSDGTDKIWFLDPITLKEKKSIQVYTNKYSLKELNEIEYINGKIYANKWQQNSIVIIDAKTGIVEGVANLSGLKKEIEKTQTLANQDEVLNGIAYDKETGRIFITGKHWGKLFEIKLVKQ

SEQ ID NO: 19951 - DNA, 546 bp, Unknown
  Obtained from environmental sample
  misc_feature (1)..(546): n is a, c, g, or t
atgtggaatctggagcagatcggtggattaacagtacgtatggcccaaattggtgtccagctcaactggtctcaaagaaaatccagtggacaaatagctgttgtaccgttacatggtgtcaaggacggggcaatggaaatcctcaaaccgagcctgaaaaaagaaccagtggagctcactatcgacattcagcccgacaacctggaagtacgtgccaatcatgtgctcctgcaacaggttttggtcaatcttgtttccaatgccatgcaggcaatagagggacagaagtcgaaaaagattctgcttgaaggtcacgcattggaggagaaagtcgtgatcgcggtccatgataacgggccgggagtttcggcagaacacctgcatgatatttttgaacctttttttacctccaaaaaaccaggacatggattgggactgggcttaacgataagtgatagaatcgtcagaaattttgggggaaaaatcatttgtgttcagttcaaagaaggggctcggttcgagtttaacctggataaaatagtgtga

SEQ ID NO: 19952 - protein, 181 aa, Unknown
  Obtained from environmental sample
  DOMAIN (72)...(180): Histidine kinase-, DNA gyrase B-, and HSP90-like ATPase
  misc_feature (1)..(181): Xaa is any amino acid
MWNLEQIGGLTVRMAQIGVQLNWSQRKSSGQIAVVPLHGVKDGAMEILKPSLKKEPVELTIDIQPDNLEVRANHVLLQQVLVNLVSNAMQAIEGQKSKKILLEGHALEEKVVIAVHDNGPGVSAEHLHDIFEPFFTSKKPGHGLGLGLTISDRIVRNFGGKIICVQFKEGARFEFNLDKIV

SEQ ID NO: 19953 - DNA, 360 bp, Unknown
  Obtained from environmental sample
  misc_feature (1)..(360): n is a, c, g, or t
atgaagaaatttctgctgctatttgttttgcctttgcttgcgatttccggttttgcccaggaagagaaggccgataccccccgggatctgatttgtgaaatgacgaaaatcaacatccccaaagttgccgacctcaagtcttattgttcccgaatccaggcgctttacccaagtgcgcaaaccatcgccaggtaccccatcaagaagaagctctattacaacaaattgagtggcgtactcaagcgcggcacaacctgggacaaattgaccccacagcagcgcagcagcctttgcgaatctactttcggctatatcaccacttatttgggtacgaaccgggaggaaaatcaaccagcctga

SEQ ID NO: 19954 - protein, 119 aa, Unknown
  Obtained from environmental sample
  SIGNAL (1)...(19)
  misc_feature (1)..(119): Xaa is any amino acid
MKKFLLLFVLPLLAISGFAQEEKADTPRDLICEMTKINIPKVADLKSYCSRIQALYPSAQTIARYPIKKKLYYNKLSGVLKRGTTWDKLTPQQRSSLCESTFGYITTYLGTNREENQPA

SEQ ID NO: 19955 - DNA, 312 bp, Unknown
  Obtained from environmental sample
  misc_feature (1)..(312): n is a, c, g, or t
ttgaaccttaaacttagcgagttgacgaagtctgtcaaaggttttagaagtcgttggcatatactcagcagttccgaaaacagtttgcattcgatttttgaaactatttggttctatcgatgcgtgaagttcctgtgcctcgtacacgagtttgcctacttttccatctccaagaaaatatgcaagcttcttcataacttctccaacaagctgagcattgccaacaatgccattattaccataggtaggggccggagttccggcaaaatggcgggaatgaatcattttagaaaatttcaaaagaagctttga

SEQ ID NO: 19956 - protein, 103 aa, Unknown
  Obtained from environmental sample
  misc_feature (1)..(103): Xaa is any amino acid
MNLKLSELTKSVKGFRSRWHILSSSENSLHSIFETIWFYRCVKFLCLVHEFAYFSISKKICKLLHNFSNKLSIANNAIITIGRGRSSGKMAGMNHFRKFQKKL

SEQ ID NO: 19957 - DNA, 405 bp, Unknown
  Obtained from environmental sample
  misc_feature (1)..(405): n is a, c, g, or t
atgcttaaagaaaaactagcgaactacaacattatattggcttctaaatcacccagaagacagcaatttttaaaagacttagaccttccgtttaccattgaattaaaggaagttgaagaaatatatccacccaaattacaaggtgcagaaattactgattatttagcagatttaaaatcgaaaccctttaccaacttaaaagaaaatgatgtgttaattacttcggataccattgtttggttaaacggtaaagcattgggaaaaccaaaagataaagcaggtgcttttaagatgttaagagctttatctggtaagaaacacgaggtaattacatcggtaagtattaaaggaattagctttcaaacgatttttaatgatacaactgatgtatattttaaagagtaa

SEQ ID NO: 19958 - protein, 134 aa, Unknown
  Obtained from environmental sample
  DOMAIN (9)...(134): Maf-like protein
  misc_feature (1)..(134): Xaa is any amino acid
MLKEKLANYNIILASKSPRRQQFLKDLDLPFTIELKEVEEIYPPKLQGAEITDYLADLKSKPFTNLKENDVLITSDTIVWLNGKALGKPKDKAGAFKMLRALSGKKHEVITSVSIKGISFQTIFNDTTDVYFKE

SEQ ID NO: 19959 - DNA, 582 bp, Unknown
  Obtained from environmental sample
  misc_feature (1)..(582): n is a, c, g, or t
atgagattcataatcatagattacggagcaggaaatatcaaaagcattcagtttgcctttaaacggcttggtgttgatgctattttatcaaataatatcgaggagataagagctgcagataaagtgatattccctggagttggagaagcaagttctgcgatgaacatgttgaaaaaaagcggattggacaccataattccgaccttgaaacaacctgttttaggaatctgtttaggcatgcaattgatgtgtattgcaacagaagaaggaaacaccaaaggattgggaatttttaacacgacagtaaaacgtttttcatcaaaagtaaaagttccgcaaatgggttggaataccatttctgatttgaaatcggatgtatttacaggaattaaagaaaacgaatttatgtatttggtgcatagtttttacgcagaaaattgcaaagaaactattgcaactacgaattacgacatcgcatatgctgctgctttgcaaaaagataacttttatggagtgcaatttcatcccgagaaaagcggtgtaataggagaacaaattttgaagaatttcatagaattataa

SEQ ID NO: 19960 - protein, 193 aa, Unknown
  Obtained from environmental sample
  DOMAIN (4)...(193): Glutamine amidotransferase class-I
  misc_feature (1)..(193): Xaa is any amino acid
MRFIIIDYGAGNIKSIQFAFKRLGVDAILSNNIEEIRAADKVIFPGVGEASSAMNMLKKSGLDTIIPTLKQPVLGICLGMQLMCIATEEGNTKGLGIFNTTVKRFSSKVKVPQMGWNTISDLKSDVFTGIKENEFMYLVHSFYAENCKETIATTNYDIAYAAALQKDNFYGVQFHPEKSGVIGEQILKNFIEL

SEQ ID NO: 19961 - DNA, 606 bp, Unknown
  Obtained from environmental sample
  misc_feature (1)..(606): n is a, c, g, or t
ttgtttttatgctcaccaaacaatccaacaggaaatagtttttctgttgctgcaattgaagaattgttattaaagttcaacggtttggtagtgattgacgaagcctatatcgatttttctgaacaagaaagttggttaaataaattagaaaaattcccaaatttagtcatcacacaaaccttgtcgaaagcgtatggaatggcaggaattcggttgggagtttgttatgcatccaaagaaattattagcgtgttgaactccataaaaccgccttataacgtaaacgaattatcgcaacaaaaagcaatcagtagattgttagattttgatgccgttcaaaatgaaattatacaaattaaaaacgaaagagttcaacttgaaaaagaattaaaatctattgattttattgagaaaatatatccatcagatgcaaattttgtattgatacaagtagatgatgctaccaaaagatatcagcaattaattagcaacggaattgtaattcgaaatagagccaaagatcctttgtgtgaaaattgtttgcgaattactgttgggactgcatcagaaaataaagaattgataaccatatttaaacagttataa

SEQ ID NO: 19962 - protein, 201 aa, Unknown
  Obtained from environmental sample
  misc_feature (1)..(201): Xaa is any amino acid
MFLCSPNNPTGNSFSVAAIEELLLKFNGLVVIDEAYIDFSEQESWLNKLEKFPNLVITQTLSKAYGMAGIRLGVCYASKEIISVLNSIKPPYNVNELSQQKAISRLLDFDAVQNEIIQIKNERVQLEKELKSIDFIEKIYPSDANFVLIQVDDATKRYQQLISNGIVIRNRAKDPLCENCLRITVGTASENKELITIFKQL

SEQ ID NO: 19963 - DNA, 753 bp, Unknown
  Obtained from environmental sample
  misc_feature (1)..(753): n is a, c, g, or t
atgataaaattttttagaaaaatcagacaacgactgctgcttgaaaataagctaagcaaatacctactttacgcaattggagaaattcttcttgtggtcataggtattttgattgcattgcagataaacaaccaaaatgacttgcgcaaggaacggctaaaggaaatccactatctcgagaatatcaagacagacctcaatatcaatctacttgagatggataggtaccttgatatcagaactgaaagtatcgaagatgcaaaaagaataattgaacattttgaaggtaagccaataactgattattccgcttttaatgctgacggtgtccagatttataattggcaaaaattctggcaaaacaacaacaccttccaggaactcgtcaattcaggcaacctcgccctgatatcaaatgacgccataaagaagtcgttattcgacattgagtcaatttataagaaaatgaaaagtgaagaagaccactatcgctttgataccgaaaaacttctttacgagcctttatatgaactcatggatcttaatcccatggttaacaattttgaatttcatgcaagcaatggaagttcaggtaaagacgtgaccctgtctgctgagtactttgacgatttcctgaaaagtacgaagctaaaaaaaggctttgtaatgaccgtattgcgcttgcagagagaatgtaaatcaggttcaggaccttgttggatacagaactttcgggcgacttctggtgctcnn

SEQ ID NO: 19964 - protein, 251 aa, Unknown
  Obtained from environmental sample
  misc_feature (1)..(251): Xaa is any amino acid
MIKFFRKIRQRLLLENKLSKYLLYAIGEILLVVIGILIALQINNQNDLRKERLKEIHYLENIKTDLNINLLEMDRYLDIRTESIEDAKRIIEHFEGKPITDYSAFNADGVQIYNWQKFWQNNNTFQELVNSGNLALISNDAIKKSLFDIESIYKKMKSEEDHYRFDTEKLLYEPLYELMDLNPMVNNFEFHASNGSSGKDVTLSAEYFDDFLKSTKLKKGFVMTVLRLQRECKSGSGPCWIQNFRATSGAX

SEQ ID NO: 19965 - DNA, 345 bp, Unknown
  Obtained from environmental sample
  misc_feature (1)..(345): n is a, c, g, or t
ttgaatgatattaatgtagaattttcaagtaaaatagaatttgagataaaacacaaatatgaagggaaactctttcgcagcaacattatagacgaagtaaaaacggggtttatagacgatattgttataaagagtaaggattttaaggttgttcataactttagtttattcagttgtcaatttgagttattgatgcctacactatttagtaattatgaagaactaattgaagacttcatatctaatgaatacctagtaaaagtaaatggtaaagtagattttacagttcgacgtaacgaaaaagcccaatttatcagcattgatgacttggaactaaaagtatag

SEQ ID NO: 19966 - protein, 114 aa, Unknown
  Obtained from environmental sample
  misc_feature (1)..(114): Xaa is any amino acid
MNDINVEFSSKIEFEIKHKYEGKLFRSNIIDEVKTGFIDDIVIKSKDFKVVHNFSLFSCQFELLMPTLFSNYEELIEDFISNEYLVKVNGKVDFTVRRNEKAQFISIDDLELKV

SEQ ID NO: 19967 - DNA, 552 bp, Unknown
  Obtained from environmental sample
  misc_feature (1)..(552): n is a, c, g, or t
gtgtatcaagagtctatcgataatattgtgggtattttatatgcaaaagacttgttggaacatttagataaaaccaaatttaaatggcaagatttattgcgcgaacccttttttgtgccagaaaataaaaagttagacgatttattaagtgagtttcaagacaagaaaaatcatttggcaattgtggttgatgaatacggaggaacaagcggaattgtaaccttagaagatgttattgaagaaattgttggagatataaatgacgaatttgatgaggatgatttagcgtattctaaattagatgccaacaattatgtgtttgatggaaaaacgaccattaaagacttttgtaaagttttaaatgttgatgatgaagctgtttttgaagaagaaaaaggagagtctgaaactttagcaggatttattttagagatttctggaaaatttccaaaaaaaggagagaaaataaacttccataacttttcgtttacagttgaggcgcttgataaaaggcgaattaaacaagttaaagtaaccagattacatgcgtaa

SEQ ID NO: 19968 - protein, 183 aa, Unknown
  Obtained from environmental sample
  DOMAIN (30)...(83): CBS domain
  misc_feature (1)..(183): Xaa is any amino acid
MYQESIDNIVGILYAKDLLEHLDKTKFKWQDLLREPFFVPENKKLDDLLSEFQDKKNHLAIVVDEYGGTSGIVTLEDVIEEIVGDINDEFDEDDLAYSKLDANNYVFDGKTTIKDFCKVLNVDDEAVFEEEKGESETLAGFILEISGKFPKKGEKINFHNFSFTVEALDKRRIKQVKVTRLHA

SEQ ID NO: 19969 - DNA, 468 bp, Unknown
  Obtained from environmental sample
  misc_feature (1)..(468): n is a, c, g, or t
gtgattcaggncggaacagatagtgtgaataaaatgcgtgatttagtggcatcgaaaaaaatggatttgcacattgcccaaccaattgaattacatggtaaagacggtatgttggaggctgtgacgctcaaatcaaaagaaaaaggtgaatatcaggtcgcatgtgacacattgttaccgttctatggtttaacgatgaaattgggccctgttgaacattttggtattagttttgaaaataatttaatccctgttgatacagaaaaatttgaaacaaatgtgccgggtatttttgcgattggcgatattaattattatccaggaaagctgaaattaattctatccggttttcacgaaggcgcattgatggcgcaacaggcatttcgatatatttatccagataaaaagttgcggttccaatacacaacttctagctcaaatttgcaggaaaagcttggcgtttcttga

SEQ ID NO: 19970 - protein, 155 aa, Unknown
  Obtained from environmental sample
  misc_feature (1)..(155): Xaa is any amino acid
MIQXGTDSVNKMRDLVASKKMDLHIAQPIELHGKDGMLEAVTLKSKEKGEYQVACDTLLPFYGLTMKLGPVEHFGISFENNLIPVDTEKFETNVPGIFAIGDINYYPGKLKLILSGFHEGALMAQQAFRYIYPDKKLRFQYTTSSSNLQEKLGVS

SEQ ID NO: 19971 - DNA, 435 bp, Unknown
  Obtained from environmental sample
  misc_feature (1)..(435): n is a, c, g, or t
ttgacgttagagcgtaaaattatatcaagttttttactgctgactatattacttgtgggtataggtctaatttgggaattttattataccgaaattaataataagcagttcttagagagtaaaaatgctacaacggttgtagattatgctaatcaaatggaagttggtttatatcaaacgatgatatatctaaacctgatgcatgagacgagatccaatcgtgataatattgaagatatccgtgacattccccttacagcgcaatcaaaaaaagggtttgagaatggaataaaagcattctatttaaatagccaaaaactacaggtaataattgcagataaaccaatgttacttgaagagatttatgaactaaaaaagcgagttttactatacgaaagtttgtcaaaggattggcttgagatggggacgaattag

SEQ ID NO: 19972 - protein, 144 aa, Unknown
  Obtained from environmental sample
  misc_feature (1)..(144): Xaa is any amino acid
MTLERKIISSFLLLTILLVGIGLIWEFYYTEINNKQFLESKNATTVVDYANQMEVGLYQTMIYLNLMHETRSNRDNIEDIRDIPLTAQSKKGFENGIKAFYLNSQKLQVIIADKPMLLEEIYELKKRVLLYESLSKDWLEMGTN

SEQ ID NO: 19973 - DNA, 321 bp, Unknown
  Obtained from environmental sample
  misc_feature (1)..(321): n is a, c, g, or t
ttgatttcccctttacaaggtctttttgtgatagacggctcaaaacggtctagcaaatcgaacgctttttttacgggttttggaaagaataaacgtgttgctctttatgatacgctcattgaaaatcatactaacgaagaacttgtggccgtgttagctcatgaaattgggcattacaaaaagaagcacattataaaagggatgataaccagcattctgcatacaggagttctattctatttactttcaattttcttgaatgtagaaggattattcgatggctttttatattggagagtatgtcggtttatgcaggtttaa

SEQ ID NO: 19974 - protein, 106 aa, Unknown
  Obtained from environmental sample
  DOMAIN (2)...(105): Peptidase family M48
  misc_feature (1)..(106): Xaa is any amino acid
MISPLQGLFVIDGSKRSSKSNAFFTGFGKNKRVALYDTLIENHTNEELVAVLAHEIGHYKKKHIIKGMITSILHTGVLFYLLSIFLNVEGLFDGFLYWRVCRFMQV

SEQ ID NO: 19975 - DNA, 522 bp, Unknown
  Obtained from environmental sample
  misc_feature (1)..(522): n is a, c, g, or t
atgaaaaatatacttgttccgatcggttcttcagaaaactcaataaacaccttgcagtacgccattgattttgcttgtgagattgatgcaaatgtctttgtacttagagcatataatgtgcaaccaaaagcaggaacaattataaatattgatggaatcttagagcgcgaatctaatttgtatatgcgttctataattaatgctgcaaatagaaaaggaaaagatattcaattaattactgcgaaaggaaatgtgttagattctatagcatctgtagaaaaagaaattggagtggatttaattgtaatgggaccaaaaagcaactctataaaagaagaagtttttttaggaagtacttcaggtagcgttgtaaaacaatctaatattcctgttttaattgttccagaggcgtatgtttttaaaccatttaactctgttttaacagcgtttaaaacgggtattgtaaacacaaaagatgttttaaaacctttacaatttataaaggataattcaatcccgtga

SEQ ID NO: 19976 - protein, 173 aa, Unknown
  Obtained from environmental sample
  DOMAIN (1)...(135): Universal stress protein family
  misc_feature (1)..(173): Xaa is any amino acid
MKNILVPIGSSENSINTLQYAIDFACEIDANVFVLRAYNVQPKAGTIINIDGILERESNLYMRSIINAANRKGKDIQLITAKGNVLDSIASVEKEIGVDLIVMGPKSNSIKEEVFLGSTSGSVVKQSNIPVLIVPEAYVFKPFNSVLTAFKTGIVNTKDVLKPLQFIKDNSIP

SEQ ID NO: 19977 - DNA, 519 bp, Unknown
  Obtained from environmental sample
  misc_feature (1)..(519): n is a, c, g, or t
atgagccgcacagctaagatgaatatgattatgcacggtgacgggcatggaggtgttcaccacaatgacggtttactcaatgtgaatgggattttcgaaaatcgatttgatctcattttaaccaatcctccatttggtgcacgaatcgaaaagtcactcaaaattacagaagctgacaagtataaagaccctgcacgtattgaagaatacaaggaaaggtatggttctgcctacgaaaaggctttgaaacaaataaacgggaacattgacaaatccttattgagtttatataaaactggttcaatgagcacactcaccgaagtagtgttcatcgaaaggtgcttgaaccttttgaagccaggtggaagaatgggaattgtacttccagaaggtgttttgaacaatacaaacctccaaaaggtacgcgattttgtggaaagcaaagccaagatcatattcatcacatcaattccgcaagatttttgttgcttcggtgctaccgttaacctattactctga

SEQ ID NO: 19978 - protein, 172 aa, Unknown
  Obtained from environmental sample
  misc_feature (1)..(172): Xaa is any amino acid
MSRTAKMNMIMHGDGHGGVHHNDGLLNVNGIFENRFDLILTNPPFGARIEKSLKITEADKYKDPARIEEYKERYGSAYEKALKQINGNIDKSLLSLYKTGSMSTLTEVVFIERCLNLLKPGGRMGIVLPEGVLNNTNLQKVRDFVESKAKIIFITSIPQDFCCFGATVNLLL

SEQ ID NO: 19979 - DNA, 642 bp, Unknown
  Obtained from environmental sample
  misc_feature (1)..(642): n is a, c, g, or t
ttgaaagaaggtttgatgagcttacttgggatggttacaaatgaaacaggggttccgtatgatatttccgggatgtctatagggactgttcattctatttgtcaggattttttagtggatcatgaccgacgtttctctgaggaacacgagcgaagcagacctccattgctcatggattcactggagcaatacttcaaagtgtatcgtagaagttattggcgagagttattagaggcaggaggatatttaaccactgataatatcgaaatcgatgagaaaaatgcccaagaagaattaaatcttttctttgctgggtttagttcgtattcaaggcattatgcagccaagagtattattgatgtattcaaccgattttctgaggaaagtttagatccaaataaagtcatttccgaagataaggtacttcagaaagtcctgaagatgtacaaatactatacggatagccaacaaaaaggaaaaatccatacagttgacttttccttacttcagcaaaaggctttcaataagattaaaaatttcgaaggttcgaaaagagtctttagatctattatcatagatgaataccaagatacgaattcaatccaagagaagatatatcttgagctagctagtcaatgttaa

SEQ ID NO: 19980 - protein, 213 aa, Unknown
  Obtained from environmental sample
  misc_feature (1)..(213): Xaa is any amino acid
MKEGLMSLLGMVTNETGVPYDISGMSIGTVHSICQDFLVDHDRRFSEEHERSRPPLLMDSLEQYFKVYRRSYWRELLEAGGYLTTDNIEIDEKNAQEELNLFFAGFSSYSRHYAAKSIIDVFNRFSEESLDPNKVISEDKVLQKVLKMYKYYTDSQQKGKIHTVDFSLLQQKAFNKIKNFEGSKRVFRSIIIDEYQDTNSIQEKIYLELASQC

SEQ ID NO: 19981 - DNA, 645 bp, Unknown
  Obtained from environmental sample
  misc_feature (1)..(645): n is a, c, g, or t
atgagttgggctaaatttgtagaaactaacatcatgaaaccattaggaatgcaacgatcggcaggtgtgtatcaacatttaaaagacaaaagcaatgtggcttttccacattcagtagaaaatggcaaactaaatcaacttgaacattatattaaaaatgatgaatctttaggagctgctggcggaatttatacaagtgtaaacgatttgagtaaatggctaatcatgcatttgaacaatgggaaatacggcaacgattttagcaaaacaatgatttctaaaaaaagccatgacgaactttggaaaccacacaccaatattggatttaatgtaaacccaaaacctccatataaaacacattttaatgcttacggattgggttggcgaatcagtgacaaaggaggctatctaacgattgaacacactggcggcttaccaggaatgctttcacgaacaattttaattccagagttaaatgtgggaatcgttgtattgacaaacacagctccaggaggaaatagtttttggacaattcctaatgaaattatggatgggtatttaggagttaaaaaaacagattggatttctttaatggaaaaaaatcttcaaagaaatgcaactcaaagtgatgcagcagcaaaagct

SEQ ID NO: 19982 - protein, 215 aa, Unknown
  Obtained from environmental sample
  misc_feature (1)..(215): Xaa is any amino acid
MSWAKFVETNIMKPLGMQRSAGVYQHLKDKSNVAFPHSVENGKLNQLEHYIKNDESLGAAGGIYTSVNDLSKWLIMHLNNGKYGNDFSKTMISKKSHDELWKPHTNIGFNVNPKPPYKTHFNAYGLGWRISDKGGYLTIEHTGGLPGMLSRTILIPELNVGIVVLTNTAPGGNSFWTIPNEIMDGYLGVKKTDWISLMEKNLQRNATQSDAAAKA

SEQ ID NO: 19983 - DNA, 675 bp, Unknown
  Obtained from environmental sample
  misc_feature (1)..(675): n is a, c, g, or t
ttgtacgaaagcaaggttttggttggtgcgactgtagaaaggaaaagaaatacacaactcacaaatcagcaacaaatagtgcattttaccattaattataacgccaacgaaatcagaaatccttcgcaagaaattaaaactgttgtcttacaaaacaacatctgggaaacagcgatttctaatttaaaaccgcagtttttcagaaacaatcaattggtgtatcaatactataataaacctagcttttatagcggaaatgaatatctgaattttgataataaacaaataagaaatagcacggttcaaattgcacgtgtagaaaaaaaagacatttatcacgcatatttatatccgcaagaacccagaaaactaaacccttacacgtattttccagacataaacggacagtttgtcatcagaactacagaaggaaacaatccgtttacagaagccgattatgcgatggttcatttttcgttagacgcggatgaaatccccacaaaagaagtttatgtgtacggagcttttaatgattttaaaacaactccagaaaacaaaatgaactttaattctgaaacaaaaaagtatgaagcctctatcttgcttaaacaaggattttacaattacacgtttgcaacaaaagacagacatacgagtataattcgcacgaaataa

SEQ ID NO: 19984 - protein, 224 aa, Unknown
  Obtained from environmental sample
  misc_feature (1)..(224): Xaa is any amino acid
MYESKVLVGATVERKRNTQLTNQQQIVHFTINYNANEIRNPSQEIKTVVLQNNIWETAISNLKPQFFRNNQLVYQYYNKPSFYSGNEYLNFDNKQIRNSTVQIARVEKKDIYHAYLYPQEPRKLNPYTYFPDINGQFVIRTTEGNNPFTEADYAMVHFSLDADEIPTKEVYVYGAFNDFKTTPENKMNFNSETKKYEASILLKQGFYNYTFATKDRHTSIIRTK

SEQ ID NO: 19985 - DNA, 300 bp, Unknown
  Obtained from environmental sample
  misc_feature (1)..(300): n is a, c, g, or t
ttggtttgggacggaacacaacaacatttttcgaaattaaaaaaggaacctaaaatttggtcttcatcaacgttatatacacaacaagaaaaagaattgcgaaaagtttggtttgctgattggttggcaaatcaaaaggaaattacccaagaagaaattttaaaatttcatcacaattctgaaattggaactccagagaattcgattaaaatgaaacgtagctatgtagaaacggtgagcattacttcagttaaaaaaagtgctgaaaatattaccttgaactacgaaaaaatcagttaa

SEQ ID NO: 19986 - protein, 99 aa, Unknown
  Obtained from environmental sample
  misc_feature (1)..(99): Xaa is any amino acid
MVWDGTQQHFSKLKKEPKIWSSSTLYTQQEKELRKVWFADWLANQKEITQEEILKFHHNSEIGTPENSIKMKRSYVETVSITSVKKSAENITLNYEKIS

SEQ ID NO: 19987 - DNA, 333 bp, Unknown
  Obtained from environmental sample
  misc_feature (1)..(333): n is a, c, g, or t
ttgcctcaacaattcgatattattgtttcaaatccgccgtacgttcgtgaattagaaaaagcagaaatacacccaaatgttttagaaaacgaacctcatttagctctgtttgttgaagataacaatccattgcttttttataaaaaaatagctgaattagcaataaaccatttgaccagaaatggtgttttgttttttgaaatcaatcagtatttaggaaaagaaactgttgaaatgcttacagaaaaaggttttataacggaattaaaaaaagatgttttcggaaataacagaatgacaaaatctacaaaaacagactctaataaaggctaa

SEQ ID NO: 19988 - protein, 110 aa, Unknown
  Obtained from environmental sample
  misc_feature (1)..(110): Xaa is any amino acid
MPQQFDIIVSNPPYVRELEKAEIHPNVLENEPHLALFVEDNNPLLFYKKIAELAINHLTRNGVLFFEINQYLGKETVEMLTEKGFITELKKDVFGNNRMTKSTKTDSNKG

SEQ ID NO: 19989 - DNA, 426 bp, Unknown
  Obtained from environmental sample
  misc_feature (1)..(426): n is a, c, g, or t
atgataggcattgataggtttaaagcagttattgaagaatttgattacgatattggagataaagtattaatagaactagcaaaagttatccatggcaatataaaagattttgacattgtttctcgtcttacgggggatgagtttttactagcaatagtgaatcctagttctatagcaaatgtagaaaaaacagcacaaaaaattattaatgattttgcaaaagttgaagttatagtaaatccagaaacaggacaaatactacaaaaaacaatttgtattgggatctcattatttccatatgattccaatgatatcaatcaagttttaaaaaatgcagataattttttaaatgaggcaaaaaacaagggtagatctcaatatgctttttataaaaaagaggaagaaagtagcatcgatttattttaa

SEQ ID NO: 19990 - protein, 141 aa, Unknown
  Obtained from environmental sample
  DOMAIN (1)...(126): GGDEF domain
  misc_feature (1)..(141): Xaa is any amino acid
MIGIDRFKAVIEEFDYDIGDKVLIELAKVIHGNIKDFDIVSRLTGDEFLLAIVNPSSIANVEKTAQKIINDFAKVEVIVNPETGQILQKTICIGISLFPYDSNDINQVLKNADNFLNEAKNKGRSQYAFYKKEEESSIDLF

SEQ ID NO: 19991 - DNA, 594 bp, Unknown
  Obtained from environmental sample
  misc_feature (1)..(594): n is a, c, g, or t
atgcagtttgttcaaaaagagtataatgtaacagttgagattaaaaagtcaaaatttattacatatcttttcccttatgaaaaatttaacgatgttatggaaaaacttaaaaatgaacatcccaaagcaagacattttgtttatgcttatagatatctcaatgaatttgaacaaattgttgaaaatagtagtgatgatggagaaccaaaagggacaagcggtaagccatctttagctgtaatggcaggaatggatattatcaatagtggtgttattgttgtacgttattttggcggcattaagttgggaactggaggactggttcgtgcttacggtgatgccgttaatgaggtgcttaatagtgcaactttagtagagtataaaaagcttattgaaaaaaaactaatttttgagtatagttacctatcaaaagttgagtatttattagagaagtatgatattatcatagtaaaaaaagtatttgaaatagatgtgatattctttattcaagcttctaaagaacagcttgaaaaattaaaactagagttggatagaaaatgtataatagaggaaactaaatttgataaaaaatga

SEQ ID NO: 19992 - protein, 197 aa, Unknown
  Obtained from environmental sample
  DOMAIN (14)...(120): Uncharacterized protein family UPF0029
  misc_feature (1)..(197): Xaa is any amino acid
MQFVQKEYNVTVEIKKSKFITYLFPYEKFNDVMEKLKNEHPKARHFVYAYRYLNEFEQIVENSSDDGEPKGTSGKPSLAVMAGMDIINSGVIVVRYFGGIKLGTGGLVRAYGDAVNEVLNSATLVEYKKLIEKKLIFEYSYLSKVEYLLEKYDIIIVKKVFEIDVIFFIQASKEQLEKLKLELDRKCIIEETKFDKK

SEQ ID NO: 19993 - DNA, 705 bp, Unknown
  Obtained from environmental sample
  misc_feature (1)..(705): n is a, c, g, or t
atgcgtacaacattgaaaagaattgcttttttatttttttttagctttttgattttttcttgtaaaaaagaaaaatatgtcgttacaaaaattaccgcaaataagattgctattgattctagcttaacttctgatagtgatatcacaaaaacaattgctccgtttaaagagaaaatgattcaagaaataaacaccaaaatatcgtatactccaaaagacattgttagaacagatggcgatttagaaagtagtttaggaaatttaatagcagatttatcttacgaaagagcaaatccaatttttaataaagaaacaggaaaaaatatcgattttgcgatgtttaattatggtggaatcagagccggaattcccaaaggaaacatcaccaataaacatgcttttgaattgatgccttttgacaatatgtttgttattgttgaattatctggcaatcaaatggaagaacttatcaactatttaatcacaaataaaacggcgcatccattatcaaaacaagtacaattaacgattacaaaaaacggttacgatttttatatcaaccataaaaaattcgacaaaaagaaagatccttatgtgttaccaacagattatttacaaactggtggcgatagtatgaacttttttaaaaagccaaaaattatcataacaccgattataacatgcgtgatgccattggtacactaa

SEQ ID NO: 19994 - protein, 234 aa, Unknown
  Obtained from environmental sample
  SIGNAL (1)...(20)
  DOMAIN (66)...(217): 5'-nucleotidase, C-terminal domain
  misc_feature (1)..(234): Xaa is any amino acid
MRTTLKRIAFLFFFSFLIFSCKKEKYVVTKITANKIAIDSSLTSDSDITKTIAPFKEKMIQEINTKISYTPKDIVRTDGDLESSLGNLIADLSYERANPIFNKETGKNIDFAMFNYGGIRAGIPKGNITNKHAFELMPFDNMFVIVELSGNQMEELINYLITNKTAHPLSKQVQLTITKNGYDFYINHKKFDKKKDPYVLPTDYLQTGGDSMNFFKKPKIIITPIITCVMPLVH

SEQ ID NO: 19995 - DNA, 645 bp, Unknown
  Obtained from environmental sample
  misc_feature (1)..(645): n is a, c, g, or t
gtgaaatactctcatagtatgataatgacaccgctttcaataaatgaacacgttgaacgcctcctcaatgcgatgcacttagatgcagagccatactatgtggatgttgttcccgaagatggagttcccccgaacgattgttttccttcagtaatgaagaaggtcgagaaagatgagggatcaatgattttggggtggcagatatgggaaagaccttttttgattgaagcagaatttcatgcgatctggaattctaaagaagggaaaaaagtcgatataaccccaaaagatttgccgggtataaataggatcttgtttgcccaagaccaaggtcaaaaatatgaagggaagcaggtgaacaatttctgcttgaatatatccgggaatcaacttgtggataattacattgaggttcggaatgctcactttcgtttgatgaacaaaggagaaagagcgacgcaatttccagttaggctcacccccttcgaattccagataacgaaagctctgaaaattttggaaggtgaaattttgaatttgttaaattctggtggtaatcgaaatagtttatgcttttgtagcagtggaaaaaaattcaaatactgtcatgggatgaacataaatagcatgttgatgtccatttga

SEQ ID NO: 19996 - protein, 214 aa, Unknown
  Obtained from environmental sample
  DOMAIN (187)...(207): SEC-C motif
  misc_feature (1)..(214): Xaa is any amino acid
MKYSHSMIMTPLSINEHVERLLNAMHLDAEPYYVDVVPEDGVPPNDCFPSVMKKVEKDEGSMILGWQIWERPFLIEAEFHAIWNSKEGKKVDITPKDLPGINRILFAQDQGQKYEGKQVNNFCLNISGNQLVDNYIEVRNAHFRLMNKGERATQFPVRLTPFEFQITKALKILEGEILNLLNSGGNRNSLCFCSSGKKFKYCHGMNINSMLMSI

SEQ ID NO: 19997 - DNA, 417 bp, Unknown
  Obtained from environmental sample
  misc_feature (1)..(417): n is a, c, g, or t
ttgtctgctttggtttttaaagttgagcacgataaatcattgggtaaaatgtgttatatccgagtttttaaaggcaatattaaacctcgagatgaattaaatcaattaattaaaaatggtttaaaacatcaaaaagttgggcaaatcaaaaccattataaatggtaagtatgtcgacaaagaaataatttctgcaggagatattggtgttgtttcgggtttaagccaagctcaagtcggagatgtttttggtgaaattgaaaacaatttgataaattatagtctatcgacaccgatgttaaccgttcaagtcaaacctaaaaatccttctgaaattatgcaactagttaaagcgttaaatgaattatcagatgaggatcctttgttagatttacaatgtacccgtattggattctga

SEQ ID NO: 19998 - protein, 138 aa, Unknown
  Obtained from environmental sample
  DOMAIN (15)...(84): Elongation factor Tu domain 2
  misc_feature (1)..(138): Xaa is any amino acid
MSALVFKVEHDKSLGKMCYIRVFKGNIKPRDELNQLIKNGLKHQKVGQIKTIINGKYVDKEIISAGDIGVVSGLSQAQVGDVFGEIENNLINYSLSTPMLTVQVKPKNPSEIMQLVKALNELSDEDPLLDLQCTRIGF

SEQ ID NO: 19999 - DNA, 708 bp, Unknown
  Obtained from environmental sample
  misc_feature (1)..(708): n is a, c, g, or t
gtgcagtttgcatggtcgtacaaaaccaactacataaatgcggtgtgtaatgtgtaccaccaaatgggcagttggggcgaagtggtatcaggctttgaataccaaaaagcaataaagaatggtgtgcctggcaataaggtaatattcaacgggcctgacaaaaccattgaggagttgaaaatggctatcgagaacaactccttgattcacattgaccacttggatgagttatacaccatcattgagcttaccgaggaaataaagaaacgcccaagggttgccatccgcgtgaacatggatacaggcatttaccccatgtgggacaggtttggcttcaactatgagaacggagccgcctgggatgctatcaacaaaattatacttactgacaagatggacttggtgggcttgcactgccacataggtacatttatgctggcacccagtgcttacggcattgcggcagccaagctgtcacaactggcattgagcatcaagaagaaatacgacagaaagatacaatacattgatatgggcggtggttttgcttctaaaaacacactcaaagggtcttacctacaaggcgtagacgcttctcccacctttgacgagtttgccgagggccataaccaccgccatattaaacgcgggatttgtggaagacgaactacccctactgatactggaaacaggccgtgccttgattga

SEQ ID NO: 20000 - protein, 235 aa, Unknown
  Obtained from environmental sample
  DOMAIN (2)...(221): Pyridoxal-dependent decarboxylase, pyridoxal binding domain
  misc_feature (1)..(235): Xaa is any amino acid
MQFAWSYKTNYINAVCNVYHQMGSWGEVVSGFEYQKAIKNGVPGNKVIFNGPDKTIEELKMAIENNSLIHIDHLDELYTIIELTEEIKKRPRVAIRVNMDTGIYPMWDRFGFNYENGAAWDAINKIILTDKMDLVGLHCHIGTFMLAPSAYGIAAAKLSQLALSIKKKYDRKIQYIDMGGGFASKNTLKGSYLQGVDASPTFDEFAEGHNHRHIKRGICGRRTTPTDTGNRPCLD

SEQ ID NO: 20001 - DNA, 489 bp, Unknown
  Obtained from environmental sample
  misc_feature (1)..(489): n is a, c, g, or t
ttgaaaaaaataatctttcttttagtaaccctcattatttttaattcttgcaaagaagataaaccagaaaatattgaggaaatccaaacaatacttcaaccaaaaataatctatgagtttggttataaactaaacgattataaggtaattaatgatacaattaaaaaaggcgaaagttttggagtaatcttagacagacatcatgtagattacccaatcatcaataaaatagcttcaaaaattaaagacacttttgatgttagacgcgttagagcgggaaaaccttatactattttagcagcaaaagattcaactgaaaaagcccaagtttttatttacaaaaacaataaatctgttgcaacaattgtagagtttaacgattctatcattcatagctataagtacagaaaagaaattaaaacaatagaaaaagaagtacacggtaaatttattctagcttttctcaatctatggatagtttgcatataa

SEQ ID NO: 20002 - protein, 162 aa, Unknown
  Obtained from environmental sample
  SIGNAL (1)...(18)
  misc_feature (1)..(162): Xaa is any amino acid
MKKIIFLLVTLIIFNSCKEDKPENIEEIQTILQPKIIYEFGYKLNDYKVINDTIKKGESFGVILDRHHVDYPIINKIASKIKDTFDVRRVRAGKPYTILAAKDSTEKAQVFIYKNNKSVATIVEFNDSIIHSYKYRKEIKTIEKEVHGKFILAFLNLWIVCI

SEQ ID NO: 20003 - DNA, 423 bp, Unknown
  Obtained from environmental sample
  misc_feature (1)..(423): n is a, c, g, or t
ttgatcggtcgagtacgcaaatatagaaaaaccagcaccgttgcacaggccaagtttagtgtaaaatactgtcttgcccttctattggtgaaaggctctatcagctttaccaacatcgatgagaaatctttaaccgatccggatattatctcactaatgcaaaaaataaatgtgctgttcgacgaggatataaacaaagatttcccgcgttgtagaccatgcaagattattcttacgacttcagataatgaatataaagcagaaaattattatcgccgcggggacccagaaacgcccatgagccaagatgaaattgaaaataaatttcgcgaattaaccaatggttttttaccgaattccgaccaagaaaaatacattaagtgggttggctcaatcgaaaccaccaccgaatggccactctaa

SEQ ID NO: 20004 - protein, 140 aa, Unknown
  Obtained from environmental sample
  misc_feature (1)..(140): Xaa is any amino acid
MIGRVRKYRKTSTVAQAKFSVKYCLALLLVKGSISFTNIDEKSLTDPDIISLMQKINVLFDEDINKDFPRCRPCKIILTTSDNEYKAENYYRRGDPETPMSQDEIENKFRELTNGFLPNSDQEKYIKWVGSIETTTEWPL

SEQ ID NO: 20005 - DNA, 495 bp, Unknown
  Obtained from environmental sample
  misc_feature (1)..(495): n is a, c, g, or t
ttgaaagaattattagaacgccatagccagcgtatcactcgaaaaattgaaatcctacaggcaaaaagcaatagtctttctaaatggaggtttattgtttttactatagctatagtatttagcatctttgggattaataacttgaatgactacctctatgtagtaacgctagctggtattatcatcacctttctattcttggtaagctggcaacgcaaagtaacaagtgcactggaaaaatttggctatttaaagaagattacagacggtcatatagctcgcatcaatcttgattggaatcacatggatgctccttttattccatctatttccaaacatcatccttttggtgacgaatttaacattgtaggcgagtttcgattcatcattaataaatatggatctatacagggggtccagtttatcgattggtgtgaaaaaaacctgtgccagaatactgctaggcggatgaaaaagtttaagcgtcaagtttaa

SEQ ID NO: 20006 - protein, 164 aa, Unknown
  Obtained from environmental sample
  misc_feature (1)..(164): Xaa is any amino acid
MKELLERHSQRITRKIEILQAKSNSLSKWRFIVFTIAIVFSIFGINNLNDYLYVVTLAGIIITFLFLVSWQRKVTSALEKFGYLKKITDGHIARINLDWNHMDAPFIPSISKHHPFGDEFNIVGEFRFIINKYGSIQGVQFIDWCEKNLCQNTARRMKKFKRQV

SEQ ID NO: 20007 - DNA, 381 bp, Unknown
  Obtained from environmental sample
  misc_feature (1)..(381): n is a, c, g, or t
atgtttttatgtacatctcgactccacttgatgaggcattttaaaacaaaaagaggctttttaaagcctctttttttagtttattttgtttttttaattgcaatgtacaatccatacaaaaaactaattataattttaaaaccccatatacgctgccatttcccttcagaaaaatttacttcatttacttttgcaaaatcgccagcaaaaatagctctccaactcgtcataaataacgaaatgagtgtaacaaatagtaaaaacggaagcgcaatttttaaaacgtttgtccaaaaccctggagattttagtttttctaatatggtcattattgtagttttttattattgtgatgtctatcgtgatctcgtgttgttttaa

SEQ ID NO: 20008 - protein, 126 aa, Unknown
  Obtained from environmental sample
  misc_feature (1)..(126): Xaa is any amino acid
MFLCTSRLHLMRHFKTKRGFLKPLFLVYFVFLIAMYNPYKKLIIILKPHIRCHFPSEKFTSFTFAKSPAKIALQLVINNEMSVTNSKNGSAIFKTFVQNPGDFSFSNMVIIVVFYYCDVYRDLVLF

SEQ ID NO: 20009 - DNA, 621 bp, Unknown
  Obtained from environmental sample
  misc_feature (1)..(621): n is a, c, g, or t
ttggtaaagaaatatttttttaaaattgtgtatgcagcaacaagagatctcttttttgaagaaattagacaagatcacaaacgtagatattatatcaatgacagcattttagttcctactaaagatggtgcggaagtttctatggtggtaattcaacgaaaaggaattgcatctactaaaaaacccgctgtattgattgcttctatttatgcgggaacaaatgaagttggagccatgttatctgcctctaaaggctatgttggagtcattatgaataccagaggtaaacgtttaagtagtggacaagtaaaaccatttgaacatgaaaataccgatgtgtatgaagccattgattggattagtaaacaaccatggtctaatggaaaagtagggatgtatggtggtagttataatggatttactcaatgggcatctctaaaacacaaagtacatccagctttaaaaacaatcgttccaatggtagctattgcaccaggaattgattatccgatggaaaataatgttttgcataattattcctattcgtggaacttttatgtaacaaataataaatttttagatgataaacttcaaatgattataatcgttgggaaacattaa

SEQ ID NO: 20010 - protein, 206 aa, Unknown
  Obtained from environmental sample
  misc_feature (1)..(206): Xaa is any amino acid
MVKKYFFKIVYAATRDLFFEEIRQDHKRRYYINDSILVPTKDGAEVSMVVIQRKGIASTKKPAVLIASIYAGTNEVGAMLSASKGYVGVIMNTRGKRLSSGQVKPFEHENTDVYEAIDWISKQPWSNGKVGMYGGSYNGFTQWASLKHKVHPALKTIVPMVAIAPGIDYPMENNVLHNYSYSWNFYVTNNKFLDDKLQMIIIVGKH

SEQ ID NO: 20011 - DNA, 372 bp, Unknown
  Obtained from environmental sample
  misc_feature (1)..(372): n is a, c, g, or t
atgctgaatgtgcagcggtttcctatcccggattttggaaggatttggagaaggtttcaaattatgagtgatcctaaagcagatgaagttcacatttatttgatgttttatgatttcgaaattcatcctgatgagatttctaaaatattgaatttaaatcctactaaaactggattaaaaggcgaaaaatatattttgagttatgatcggaaaagaagttataaatctaattggtgggaatttagaaaggattatgaaatgggagaaaagtgggtgcaagaatctatcgatgaatttattttagaaattattgagccgaggaagaaagagattagtgaggtaatgagtaaaggagatggggattttcagtag

SEQ ID NO: 20012 - protein, 123 aa, Unknown
  Obtained from environmental sample
  misc_feature (1)..(123): Xaa is any amino acid
MLNVQRFPIPDFGRIWRRFQIMSDPKADEVHIYLMFYDFEIHPDEISKILNLNPTKTGLKGEKYILSYDRKRSYKSNWWEFRKDYEMGEKWVQESIDEFILEIIEPRKKEISEVMSKGDGDFQ

SEQ ID NO: 20013 - DNA, 522 bp, Unknown
  Obtained from environmental sample
  misc_feature (1)..(522): n is a, c, g, or t
atgtgggtctatttcaatgtcccggaagcccaatacctcaacttcaagtcgcattctccttccggggacaaaacgaaggtcaaactcctgatggccaacaatgagcaattcgggtatccgggtattgtcgaaaccattgaagcggaattcaaccacgaaacgggcaatatcccgttcagggccactttctccaatccggaacgcttgctgagacacggagaaaccggtaatatactcatgccggttccgctcaaggacgccatcatcattccccaaaaggcgacttacgaaattctggataaaaaatatgtgtatgtggtgggagacgaccacgtggtgcggtcaagacagatcgtaattgctgaggaattgccccatctgtatgtggtgaaatccggactggaagaaaatgaaaagattctcctggaagggcttcggaaagctaaggaaggtgaccatatcgaggtcgatttccttgagccagtggaagtcatgtctaaactgaatgttccagccgagtaa

SEQ ID NO: 20014 - protein, 173 aa, Unknown
  Obtained from environmental sample
  misc_feature (1)..(173): Xaa is any amino acid
MWVYFNVPEAQYLNFKSHSPSGDKTKVKLLMANNEQFGYPGIVETIEAEFNHETGNIPFRATFSNPERLLRHGETGNILMPVPLKDAIIIPQKATYEILDKKYVYVVGDDHVVRSRQIVIAEELPHLYVVKSGLEENEKILLEGLRKAKEGDHIEVDFLEPVEVMSKLNVPAE

SEQ ID NO: 20015 - DNA, 765 bp, Unknown
  Obtained from environmental sample
  misc_feature (1)..(765): n is a, c, g, or t
gtgatggatgcggaactgaagccgggacgggccacgtttctggaaggcagggttcaggatctcgaacgaggaacttccatttctgaagccaacattcacatttttgacccgcaaacacaggaagaactcctcaaatttgacacccgcaaggacggtctcttctggaaagtgctggaccccgacaccgactattcagtagtggctaccaaacccaattacctttctacccggattgatatcattcaggacagcctgcattcggattccgtccagatgcagctggatctcgtccccatggaggtcaacaaggtggtcaaagtgatctaccacgcttacaaagaagccggaacaaatgtcctgggacgccgcgacctcaacgaaatcgcctatttgctgttggacaatccggaaatcagtgttgaactcagttcgcatacggacagccggggcagtgcaggttacaacaagaagctttcccagacccgtgctgatgctgcagcccgctacctgatttctcgcggagtcagcaaggaccgcatcattgcccggggtgacggcgaagaaaaactcttcaacaattgtagtgacggcaaaaactgctcggaagagctccatgcacaaaaccgccgcaccgaagtaaaaatcatccgcattgacccggaaatccagttggacaaagaagagaagaactcaggtggtaccggcagtattccgtccgaactcaagggaacgaaaatcgcaggtccatccaggcctaaaaaatga

SEQ ID NO: 20016 - protein, 254 aa, Unknown
  Obtained from environmental sample
  DOMAIN (109)...(209): OmpA family
  misc_feature (1)..(254): Xaa is any amino acid
MMDAELKPGRATFLEGRVQDLERGTSISEANIHIFDPQTQEELLKFDTRKDGLFWKVLDPDTDYSVVATKPNYLSTRIDIIQDSLHSDSVQMQLDLVPMEVNKVVKVIYHAYKEAGTNVLGRRDLNEIAYLLLDNPEISVELSSHTDSRGSAGYNKKLSQTRADAAARYLISRGVSKDRIIARGDGEEKLFNNCSDGKNCSEELHAQNRRTEVKIIRIDPEIQLDKEEKNSGGTGSIPSELKGTKIAGPSRPKK

SEQ ID NO: 20017 - DNA, 423 bp, Unknown
  Obtained from environmental sample
  misc_feature (1)..(423): n is a, c, g, or t
ttgtatatttcgtacttagtaacctctttaaatatcaatcacatggccgacggaacaaaagtactcattgtcgaagacgacaagttcctatcagagctcatctcgacaaagctttcaaaggaagggtttgatgtaaaccttgcaaccgatggagaatcggggcttgagaaagcagtatcagatagtccggaaattattttgctcgacatcatgctccctggtatgagcggattcgaagtattagaaggtcttaaatcacatgcagatgatgcagtgaaaaatattccagtgcttatcctttcaaattttggacaggaaagtaaggtccagcaaggactcaagcttggcgcaaaagattatctcgtgaaggcaaactttacaacaggagaaatcgtagaaaagatcaaagctgcacttgcgtaa

SEQ ID NO: 20018 - protein, 140 aa, Unknown
  Obtained from environmental sample
  DOMAIN (19)...(140): Response regulator receiver domain
  misc_feature (1)..(140): Xaa is any amino acid
MYISYLVTSLNINHMADGTKVLIVEDDKFLSELISTKLSKEGFDVNLATDGESGLEKAVSDSPEIILLDIMLPGMSGFEVLEGLKSHADDAVKNIPVLILSNFGQESKVQQGLKLGAKDYLVKANFTTGEIVEKIKAALA

SEQ ID NO: 20019 - DNA, 654 bp, Unknown
  Obtained from environmental sample
  misc_feature (1)..(654): n is a, c, g, or t
gtgttgtccaacaagcaacggcactcaaaaatgtacacaatgaaggttttggataatttgccaatcgaaattgtaaaaaatggtgatattatgaaagatgcagtggagtattacagtaaaacatccgcagaaaaatcttctataattgctgatttagatttaaagaaaaacgaatttgtattagcaacaattcatcgacaagaaaacaccgatgatgtacagaaattaaaatcgatttttgctggtttagaagaaattaataaagaatgtaacgtggttttacctttgcatcctagaactaacaaaatattagaaaaaaataatattcaaccaaaaatcactttgatacatcctgttggttattttgccatgttagaattattaaaacattgtaaactcgtaatttcggatagcggcggattacaaaaagaagcattcttcaacaaaaagaattgcattattgtaagagaagaaaccgaatggattgaattggtagaaaacggttttgcagaaattgttggaagcaatcaaactaaaattatacatgcatttcacaagtttaaaaaaatggaaatggattttaataaagaattgtacggtaataacgttggagaaaggattcatcaatctattttaacattgctaactaaataa

SEQ ID NO: 20020 - protein, 217 aa, Unknown
  Obtained from environmental sample
  DOMAIN (1)...(212): UDP-N-acetylglucosamine 2-epimerase
  misc_feature (1)..(217): Xaa is any amino acid
MLSNKQRHSKMYTMKVLDNLPIEIVKNGDIMKDAVEYYSKTSAEKSSIIADLDLKKNEFVLATIHRQENTDDVQKLKSIFAGLEEINKECNVVLPLHPRTNKILEKNNIQPKITLIHPVGYFAMLELLKHCKLVISDSGGLQKEAFFNKKNCIIVREETEWIELVENGFAEIVGSNQTKIIHAFHKFKKMEMDFNKELYGNNVGERIHQSILTLLTK

SEQ ID NO: 20021 - DNA, 534 bp, Unknown
  Obtained from environmental sample
  misc_feature (1)..(534): n is a, c, g, or t
ttgatgaatgcagatagaaacccaatttcgttatggaaagcaatttctgatatttgtaatgagaatgctgattttgcagctgattatgaaatccaatttgtaggaaagatagcctccgaagttcgcgatagtttagacgaatatcaaataaagaatgtgttagatgttggttatgtttcgcatcaagaagtaactaaatatcaacaaaaatcacaagttttattgctttctgtaaacaatgtaaaaagtgcaaaaggcgttattacaggaaaaatatttgagtatttacaggcaaaacgccctatcttagctattggaccaacaaacggagatttggcagagattttaaaagaaacaaatgcaggaattattataaattttggagatgtagaaaacttgaaaaaagaaattttacaactatatacttcttttaaaaacgaaagtttagaatcaaattctagcaatatagaacactatcatcgcagaaatttaacagagaaattagccaacatcattaaagaaaccgtttcgtaa

SEQ ID NO: 20022 - protein, 177 aa, Unknown
  Obtained from environmental sample
  misc_feature (1)..(177): Xaa is any amino acid
MMNADRNPISLWKAISDICNENADFAADYEIQFVGKIASEVRDSLDEYQIKNVLDVGYVSHQEVTKYQQKSQVLLLSVNNVKSAKGVITGKIFEYLQAKRPILAIGPTNGDLAEILKETNAGIIINFGDVENLKKEILQLYTSFKNESLESNSSNIEHYHRRNLTEKLANIIKETVS

SEQ ID NO: 20023 - DNA, 318 bp, Unknown
  Obtained from environmental sample
  misc_feature (1)..(318): n is a, c, g, or t
atgaaagatatatctaaatttgcatctgataacaatgtagagataagaatcggtgttgaccaaaacatctatcttttaggattaccagatgcttctacaccatttgaatctccaaaagagagttctactattatcgcttgtgcgggtaatctttgtccttactcattttggagtatcaaaaacgagactcagtaccttcctctaactaagatagcagagcatggcatcactgtcggtttttctggatgtatcaaaggttgtggaagaaaacccaaattcagcacacacagacataggtctggtaggtctaaagactaa

SEQ ID NO: 20024 - protein, 105 aa, Unknown
  Obtained from environmental sample
  misc_feature (1)..(105): Xaa is any amino acid
MKDISKFASDNNVEIRIGVDQNIYLLGLPDASTPFESPKESSTIIACAGNLCPYSFWSIKNETQYLPLTKIAEHGITVGFSGCIKGCGRKPKFSTHRHRSGRSKD

SEQ ID NO: 20025 - DNA, 867 bp, Unknown
  Obtained from environmental sample
  misc_feature (1)..(867): n is a, c, g, or t
atgagcgctgcaaatatggcatttgaacttgtgtatcatgcgaagtttgaaaattgtatcttgataggacaagatctctcttatggtaaagatggaaaaagccatagcgatggacacttgtatggacgaaatgataaaaaaagaagagacgatgatatggaagttgtcgcttacggtggagagggttttgtaaaaacaagtagagtatggaacctttttagaaacttttttgaatcagacatcgtagtagcaaatcaagatggcttgagggtgattaactctactgagggtggtgcgagaattgaaggtactatagagcttccgtttaaaaaagcgatagaagaggctgtagatttagagtttaaaaaagagttgattacactggatataccttccgaagatgatatagaaaaaaaacaacagattgcccaagataagatagatgagatgatatcttatggcacaaagctgcaaaaagatgtagaagagttatttagcgaagtgatgaaagagtgtgaagccatagaagaggtagatgggttaaataatcttgaaaaagtagattatgagtcattagctgctactatggaaaaactagatgtggtaaaagcacactttgatgagcaaaagtttgtcgatatcttcatagatgcaacacaagccatgatagtccaccaagaactaaatcctcgcaaaacttcaagtaagagatcgttgaaaactgatgatgatcgacgaaaacagatgatcgattgggttttttgcccaccgtttttggctcttctcccttgttggcatgatgccggctgttttaataccagtaaagcgtggcggaaaagcttctacaacatagtaaataccacgtaa

SEQ ID NO: 20026 - protein, 288 aa, Unknown
  Obtained from environmental sample
  misc_feature (1)..(288): Xaa is any amino acid
MSAANMAFELVYHAKFENCILIGQDLSYGKDGKSHSDGHLYGRNDKKRRDDDMEVVAYGGEGFVKTSRVWNLFRNFFESDIVVANQDGLRVINSTEGGARIEGTIELPFKKAIEEAVDLEFKKELITLDIPSEDDIEKKQQIAQDKIDEMISYGTKLQKDVEELFSEVMKECEAIEEVDGLNNLEKVDYESLAATMEKLDVVKAHFDEQKFVDIFIDATQAMIVHQELNPRKTSSKRSLKTDDDRRKQMIDWVFCPPFLALLPCWHDAGCFNTSKAWRKSFYNIVNTT

SEQ ID NO: 20027 - DNA, 582 bp, Unknown
  Obtained from environmental sample
  misc_feature (1)..(582): n is a, c, g, or t
atgataacaaatccattatttaaaaaatccactgaagtattggctgatttttacaatgataagggtataaaagcagcaatagttgataccgaacaaatttatcaaaaatattcgtatggggtaagagagttatattctataaaagacttaatcaaagaagttcatactaaaggaaaaggcaaacttaaacatgtattattggtaggtgattcgagttgggattggcgtgataatggagaaaacaatcaatacagtagctgggcaaacagaaatgacatatctttgagaatatatactaattttgttcaccaaaaaaaatacacccgtgattttatcaatcgagattttgtcccgactggccaataccattcccctgaaggtcattcagccagcgataactggtttgtttcgattgttccagaaaaaaacatcttaggtgaagattatattcctgatattgcaattggcagatttcctggttcgtctgtagaagaaattgatgccatgattgcaaaaaccattaaatacactaatgatacaaaagtcggtccttggaaaagcagaaatcttatggattactaa

SEQ ID NO: 20028 - protein, 193 aa, Unknown
  Obtained from environmental sample
  misc_feature (1)..(193): Xaa is any amino acid
MITNPLFKKSTEVLADFYNDKGIKAAIVDTEQIYQKYSYGVRELYSIKDLIKEVHTKGKGKLKHVLLVGDSSWDWRDNGENNQYSSWANRNDISLRIYTNFVHQKKYTRDFINRDFVPTGQYHSPEGHSASDNWFVSIVPEKNILGEDYIPDIAIGRFPGSSVEEIDAMIAKTIKYTNDTKVGPWKSRNLMDY

SEQ ID NO: 20029 - DNA, 486 bp, Unknown
  Obtained from environmental sample
  misc_feature (1)..(486): n is a, c, g, or t
gtgaatgattggtttgatgttaaccgggatatttctggtttttatcatttaatcgactcaattgagcaaactaaaaatttttcaactaagtactatgggttacgattaatggggattgttgatctatttgaagccttatgttggtgtgttataggtcagcaaataaaccttacttttgcccataaaataaaaacacgattggtttcacaatttggagaaagattgaactatcaaggcataacttattattgttttccgacaccacaaattttaaataaggccagtcataatgaattggttaaaatgcaattttctaagcaaaaaatcacctatttacaaaatatttctaaagtgttttgtgatgaagaaatgagtaaacaggaattaatgaaaatgccctctaataaacaattggatcaattacaagccattaaaggcataggtccatggactgctaattatgtatcactgaactcattannnnat

SEQ ID NO: 20030 - protein, 162 aa, Unknown
  Obtained from environmental sample
  misc_feature (1)..(162): Xaa is any amino acid
MNDWFDVNRDISGFYHLIDSIEQTKNFSTKYYGLRLMGIVDLFEALCWCVIGQQINLTFAHKIKTRLVSQFGERLNYQGITYYCFPTPQILNKASHNELVKMQFSKQKITYLQNISKVFCDEEMSKQELMKMPSNKQLDQLQAIKGIGPWTANYVSLNSLXX

SEQ ID NO: 20031 - DNA, 606 bp, Unknown
  Obtained from environmental sample
  misc_feature (1)..(606): n is a, c, g, or t
ttgtctttaactccacttacgctaaaaagttatcgaagtatggcagctatgcgtgagcttcagccacaactgaaagagcttcaagagaagttcaaggacaacccacagaagcaacagcaggaaacgatgaagctgtataaaaaggaaaaagtaaaccctcttggtggctgtttaccgaaccttgtacaatttccaattttaattacgctttggagatttttccaaaattctattttgctacgtcaggagtcattcctttgggccaatgacctttcagcgcctgattatatcattcacttgccgttcagcatcccatttttgggcgaaaatattgcgggctttgttctgttgatgtctgctgcaatggttgtacagagtagattaacaggcggaatgagtggcggcggtggcggtaacaacgctatggctcaacaaatgaaaataatgcagtacatcttcccatttatgatgctctttatcttcaacaaatttgccgcaggcttaagtttatactacctcgtattcaacgtgctttctatcattcagcagtactttatcaataaaagtattcatgctaaaaaagaagccgctgtagttaccaaataa

SEQ ID NO: 20032 - protein, 201 aa, Unknown
  Obtained from environmental sample
  DOMAIN (1)...(191): 60Kd inner membrane protein
  misc_feature (1)..(201): Xaa is any amino acid
MSLTPLTLKSYRSMAAMRELQPQLKELQEKFKDNPQKQQQETMKLYKKEKVNPLGGCLPNLVQFPILITLWRFFQNSILLRQESFLWANDLSAPDYIIHLPFSIPFLGENIAGFVLLMSAAMVVQSRLTGGMSGGGGGNNAMAQQMKIMQYIFPFMMLFIFNKFAAGLSLYYLVFNVLSIIQQYFINKSIHAKKEAAVVTK

SEQ ID NO: 20033 - DNA, 639 bp, Unknown
  Obtained from environmental sample
  misc_feature (1)..(639): n is a, c, g, or t
atggagttgtcaaacaaatacaataaagagattaaaggctttaatgtgtttacacataaagccaacttaggagagcatgactcgagcgaatggacttatattcgtaagaatggagaaagatttcctgtgcaattagtagttacggcgattaaaaactctgaaagagaaataacaggttatttaggtgtagctacagatatatccaaattaaagaaaatggaagcttctttggtaaagtcaaaactcaaagccgaagcagccaacaaatccaaatctgaatttttggctaatatgagtcatgagataagaactcctttaaatggtgttataggttttactgatttgctaatgagaacaaatctttctgacgtacagaaaaaatatatggatactgtatataattcagcaaatgtttggttagatttattgagcgacatccttgatttttctaaaatcgaagcgggtaaattagaaataagtaaagaaagaacagatttagtccagctttgtgggcaaactattgacattattagacatcaagcacacgaaaaaagattggaattattgctagacatccctccaaacacaaataggtttatacaggcagattcagtaaggttgcgtcagatattgacaaat

SEQ ID NO: 20034 - protein, 213 aa, Unknown
  Obtained from environmental sample
  DOMAIN (28)...(70): PAC motif
  misc_feature (1)..(213): Xaa is any amino acid
MELSNKYNKEIKGFNVFTHKANLGEHDSSEWTYIRKNGERFPVQLVVTAIKNSEREITGYLGVATDISKLKKMEASLVKSKLKAEAANKSKSEFLANMSHEIRTPLNGVIGFTDLLMRTNLSDVQKKYMDTVYNSANVWLDLLSDILDFSKIEAGKLEISKERTDLVQLCGQTIDIIRHQAHEKRLELLLDIPPNTNRFIQADSVRLRQILTN

SEQ ID NO: 20035 - DNA, 765 bp, Unknown
  Obtained from environmental sample
  misc_feature (1)..(765): n is a, c, g, or t
atgaataagaaaaaaacgaaatcgacatctgtcattaaaaaaatagcaaaatggttttttggaattgtattatttctaatccttttattagcaacggttccctatttatttaaagacaaaataaacacaatgattaccaaaagcattaacgaaaaagtaaatgcaacggtatcatttgaagatgtagatctaagtttattaagaagttttccgttggccaatttgtccatttctaaattacatattttaaacaacgctccgtttaaaggcgacacgcttttttatgcaaatgaaattcatttaaaaatgagcattggagaattatttaaagatgcttctgaagccatggatatcaaaagtttttatcttgataaaagttttttaaacattgtgtttgataagaaaggaaataagaattttgacattgcaaaagaagctacaacagcaacaaatcaaacaaaaagcgaacctttttctttaaatattgaagaatatgcagttgatcatttaaatgtaatttataatgataaatcttctaacacaacaatcaaaataagtgagataaatcattctggaaaaggtaattttaacaaagctattctcgatttaaaaaccactacaaaagcaaacttttctgcggatgtaaatggtactaattatatgaattctgttgcctatttctttagatgcagttttaggaatcgatttaaaaacaatctctttacatttaacgaaaccaagcttttatcacccaattgcccttaa

SEQ ID NO: 20036 - protein, 254 aa, Unknown
  Obtained from environmental sample
  misc_feature (1)..(254): Xaa is any amino acid
MNKKKTKSTSVIKKIAKWFFGIVLFLILLLATVPYLFKDKINTMITKSINEKVNATVSFEDVDLSLLRSFPLANLSISKLHILNNAPFKGDTLFYANEIHLKMSIGELFKDASEAMDIKSFYLDKSFLNIVFDKKGNKNFDIAKEATTATNQTKSEPFSLNIEEYAVDHLNVIYNDKSSNTTIKISEINHSGKGNFNKAILDLKTTTKANFSADVNGTNYMNSVAYFFRCSFRNRFKNNLFTFNETKLLSPNCP

SEQ ID NO: 20037 - DNA, 909 bp, Unknown
  Obtained from environmental sample
  misc_feature (1)..(909): n is a, c, g, or t
gtggatcaagaatcggctgaggcgggcatgttggaattagttgatgatgcgaaggatctaattgtagaaaattttggcgaaccgatagatttcaaatatgaagcatccgcgcatcaggaattgttaaatcgaattgagaaagtattcaaagaaacagaattgattatcgataggggcttttttagcaatccccaagatttaatttggatcaaagaaatacatccggtttttaaggattggttactttgtcacaagttcacgaatgctcagagtgaccatttgtgcggcagacttccatattatttttctctagagcttaatgatgtttggggggcaaaaccggattattttaatggaattacaaacacacttgatacgccattctacctcgcagagacaaagcttcgcgggagattgcagtacaactccgccttacaaagaaaacttcacgaaaggatgttcaatgaggcatttggggttgaggaggtttatgttcaaacgcgagcatcgttcaagcaaaagaaggcaaaancaaaatttgataaaataaagaaaaactatgaagatcctagttcttccattgttattgctgaaagtatattggaagactggatcacgaaacccaagccttcaccggcaataagaatcattagtggtgggcctggctcaggcaaatcatctttagcgaaacggttttcggcaaaagttgcgcgagatgaaataatgccagtgtattttgttcctcttcattttttcaactatcaacaatcctttcgtttggcattgaaggattattttcaagacgatagattccttaggcgagaaccgcttgcaagcgattcctcagaaagcggacaattcaatccttctggcttgcgaagggttagattaagtagcaatcgtgggtaa

SEQ ID NO: 20038 - protein, 302 aa, Unknown
  Obtained from environmental sample
  misc_feature (1)..(302): Xaa is any amino acid
MDQESAEAGMLELVDDAKDLIVENFGEPIDFKYEASAHQELLNRIEKVFKETELIIDRGFFSNPQDLIWIKEIHPVFKDWLLCHKFTNAQSDHLCGRLPYYFSLELNDVWGAKPDYFNGITNTLDTPFYLAETKLRGRLQYNSALQRKLHERMFNEAFGVEEVYVQTRASFKQKKAKXKFDKIKKNYEDPSSSIVIAESILEDWITKPKPSPAIRIISGGPGSGKSSLAKRFSAKVARDEIMPVYFVPLHFFNYQQSFRLALKDYFQDDRFLRREPLASDSSESGQFNPSGLRRVRLSSNRG

SEQ ID NO: 20039 - DNA, 504 bp, Unknown
  Obtained from environmental sample
  misc_feature (1)..(504): n is a, c, g, or t
atggtaaaaaacgctaacaccacaataggtaatttttataactatttctcaagcaaagaagacgtcttcgccgtgcttgtagatgacctttatcaaaagcttatttattttgtaaataatcataatgtagaagacgaaaatccattcataattgatgaattagactatattcaagtacgacatttaataagtggtacactaaacaacatagctgacgacttccttataaaaacaatacttcttttggaatgttcaaaaggtacaaaatatgaaagcacaaaaaacattcttgcagactatataaacctgcatttcctcgatcacaaagaccaaataaatcccgaatatcagccaaaagaaatcggaatagtgctttcaaaaggttttacagatggtgcgatatccattttaaaatcggaatttgataaagataagaaaatagatttgatgacagaatactttttattcttcgcatatggcacactaaaaatattaaagaaataa

SEQ ID NO: 20040 - protein, 167 aa, Unknown
  Obtained from environmental sample
  misc_feature (1)..(167): Xaa is any amino acid
MVKNANTTIGNFYNYFSSKEDVFAVLVDDLYQKLIYFVNNHNVEDENPFIIDELDYIQVRHLISGTLNNIADDFLIKTILLLECSKGTKYESTKNILADYINLHFLDHKDQINPEYQPKEIGIVLSKGFTDGAISILKSEFDKDKKIDLMTEYFLFFAYGTLKILKK

SEQ ID NO: 20041 - DNA, 312 bp, Unknown
  Obtained from environmental sample
  misc_feature (1)..(312): n is a, c, g, or t
ttgattataacaacttctatgaccatcaatacaaaaaccatttataaaattatgaaagctagatgggatatagaaaacaggatattcaacaatcttaaaaacaatgctaatcttaatcattgttttgttcatggtggtaacgccgttggagcagtactatacttgatgtttattgcatccaatttatttcaattatttaaacaaagaaggttaaagaaccatatatccaatcaaatagagcttgcaagactattactaaaaggattgtatttagcagagagaaaagatatcttaattctaaataatacttag

SEQ ID NO: 20042 - protein, 103 aa, Unknown
  Obtained from environmental sample
  misc_feature (1)..(103): Xaa is any amino acid
MIITTSMTINTKTIYKIMKARWDIENRIFNNLKNNANLNHCFVHGGNAVGAVLYLMFIASNLFQLFKQRRLKNHISNQIELARLLLKGLYLAERKDILILNNT

SEQ ID NO: 20043 - DNA, 678 bp, Unknown
  Obtained from environmental sample
  misc_feature (1)..(678): n is a, c, g, or t
gtggatcaagaatcggctcgaggaaccggacgtagaagactgggcagtatttctgttaccagcatgaagcagaattacatcaaacgatgtgtggctgtagcaggtgacaccctggagatccgtcaccgccaaatctatatcaatggtgaaaagggatggaatccggaattcatgcaatcctcctactatctgctgggcctggaccgggaaacactggacaaagaaggcttccgaaaccactttgaaccgattgggaagagttcactcttgccccaatttgcagctgatcaaaacaacaacatcatcccttaccagatgatgcacagcaaccaggtagtcatgggcaacattgacacctgtacccattgggcggcgcatatgaccgaagccaaggctgcggaactgaaacaaaaataccccaacatctacctggaagcaacggaagacagtgtcttgaagtttaccccggtcaaaatttacgtgtcagatgccctcgcccgtcttcgcaagggaaacatcaagggagatttgtaccccaaagtcccctacctcaacaactggaccaaggacaatttcgggccgatctacattcccaaaaagggagcgaccatccagcttgatccgcgcaatgtactgacctacgaaaaggttatcagcgtttacgaaggccacgaactt

SEQ ID NO: 20044 - protein, 226 aa, Unknown
  Obtained from environmental sample
  misc_feature (1)..(226): Xaa is any amino acid
MDQESARGTGRRRLGSISVTSMKQNYIKRCVAVAGDTLEIRHRQIYINGEKGWNPEFMQSSYYLLGLDRETLDKEGFRNHFEPIGKSSLLPQFAADQNNNIIPYQMMHSNQVVMGNIDTCTHWAAHMTEAKAAELKQKYPNIYLEATEDSVLKFTPVKIYVSDALARLRKGNIKGDLYPKVPYLNNWTKDNFGPIYIPKKGATIQLDPRNVLTYEKVISVYEGHEL

SEQ ID NO: 20045 - DNA, 789 bp, Unknown
  Obtained from environmental sample
  misc_feature (1)..(789): n is a, c, g, or t
gtgtatcgctggagctttgaatcggctgagatattgcctaaaaagttaagttggaatcataaagctcttcgttcaaaatcttggcgaagcttctttgtatggtgggaagaactactactgcccggagatctaatgcatattatttccagaaaatattatgtagaagctacacttcaaaaagcactggaatcaggatttgaacaaattgtaattatgggttcaggatttgatcataatggagctttatttgcttccaaaggtattccggtttttgaaattgacactccgaatatgaccaaccataaacggaatatgctacatcaatcagggtatgatctagataaacttcatctatgtgcaattgatccaagtaatcaaaatattgaaaaagtattaatacagtctggagtatttgatttcaacaaaaagactattttcttggccgaaggcttctttgattatctttctctcgaaagcgttaaatctatattagagaatattactagttttagtaataactttaagctcgttagtacattctttgaccttggtgaacttaatttctttcatcgatttatgtttactagcggtgttgctatggttggagaaactttaaaatttcccttaaataaaaaggagttggtagaacttttaaagcaatttgatatctcaanctcgcatcaaaccagctacaaagatatcgccgaacggcttatagttaacatgaatacaattctgcccgtcttgctgggttttacattcttgaaaggcagtacaatcaataattga

SEQ ID NO: 20046 - protein, 262 aa, Unknown
  Obtained from environmental sample
  misc_feature (1)..(262): Xaa is any amino acid
MYRWSFESAEILPKKLSWNHKALRSKSWRSFFVWWEELLLPGDLMHIISRKYYVEATLQKALESGFEQIVIMGSGFDHNGALFASKGIPVFEIDTPNMTNHKRNMLHQSGYDLDKLHLCAIDPSNQNIEKVLIQSGVFDFNKKTIFLAEGFFDYLSLESVKSILENITSFSNNFKLVSTFFDLGELNFFHRFMFTSGVAMVGETLKFPLNKKELVELLKQFDISXSHQTSYKDIAERLIVNMNTILPVLLGFTFLKGSTINN

SEQ ID NO: 20047 - DNA, 552 bp, Unknown
  Obtained from environmental sample
  misc_feature (1)..(552): n is a, c, g, or t
ttgaaaaaatggattttaaagaacaaaatcgcttcttcaaaagatttagataagctagaaagcgaagctctcattattgttaacgaagcaaaaaaagaagcttgggacgcctatatgactcctattaaaaaagaaaaagcccatgtactcgggttgcttcagaatcttcaaaaagaaactggcgaaaaaagggttggggacgcaattagaaaactaaaaatgtttcctaattcaatccgcaaagatatttactctgcggcacgtaaatctctccattatactgctggtaaagaaagtccttctcgtaatgagttaacgcaatggttatcaataagtgataaagaaaatcatgaccgctataattcacatttactaagcgagactccattttcacctttgcgtattgacgaaattaaaccccagtacaatcctgactcacccatggttgatggaaggcttgtgattagagacaatttcgagaagttgttcaaaaaatatccaaatacactaatttttggcgaagatgcaggacaattggggggatgtgaataa

SEQ ID NO: 20048 - protein, 183 aa, Unknown
  Obtained from environmental sample
  misc_feature (1)..(183): Xaa is any amino acid
MKKWILKNKIASSKDLDKLESEALIIVNEAKKEAWDAYMTPIKKEKAHVLGLLQNLQKETGEKRVGDAIRKLKMFPNSIRKDIYSAARKSLHYTAGKESPSRNELTQWLSISDKENHDRYNSHLLSETPFSPLRIDEIKPQYNPDSPMVDGRLVIRDNFEKLFKKYPNTLIFGEDAGQLGGCE

SEQ ID NO: 20049 - DNA, 792 bp, Unknown
  Obtained from environmental sample
  misc_feature (1)..(792): n is a, c, g, or t
atgaaactacacatagatatcgattgcttttttgtatccgcacatagaataaataatccccaatatcataacatcccactagcagttggaggtagaagcaatctctctatatttgaaacagataaaaaacaaagagtatcaagtcaaataagtggtgcttttactagctcaattctctcccctacttcaaacatgagttttgaagagtattttttagatgaacagaaacgccctagaggtatcataacaacttcttcttatgaagcaagaagttatggtgtaaaaacagctatgagtgtatctgaagctttgagatggtgtcctaatcttacggttcttccaccaaactaccctttatatcataaactttcccatgatttaaaacttcttttagaaaaggagattccgtcaattgaacaattcagtatagatgagttttttggagatatttctggttggattgaagataatgatgtatatgattttggggtgatgctaaaagaaaaaatagcaaaagagttgcaacttccagtttctataggtatagcaaaatcaaaatggatagcaaaactagcaacagaatatgcaaaaccgtacaatgtaaaatatgtcaaaacaaaatatgtagacagttttataaaagatataccaatagcaaaatttccaggaataggaaaagggtatcaaacacgacttaaaagatacaacatcaacacactaggtgagattcagcaaaaaagagaactattttacagttgggggacaatctgngaacacaaactttacaaatag

SEQ ID NO: 20050 - protein, 263 aa, Unknown
  Obtained from environmental sample
  DOMAIN (5)...(263): impB/mucB/samB family
  misc_feature (1)..(263): Xaa is any amino acid
MKLHIDIDCFFVSAHRINNPQYHNIPLAVGGRSNLSIFETDKKQRVSSQISGAFTSSILSPTSNMSFEEYFLDEQKRPRGIITTSSYEARSYGVKTAMSVSEALRWCPNLTVLPPNYPLYHKLSHDLKLLLEKEIPSIEQFSIDEFFGDISGWIEDNDVYDFGVMLKEKIAKELQLPVSIGIAKSKWIAKLATEYAKPYNVKYVKTKYVDSFIKDIPIAKFPGIGKGYQTRLKRYNINTLGEIQQKRELFYSWGTIXEHKLYK

SEQ ID NO: 20051 - DNA, 381 bp, Unknown
  Obtained from environmental sample
  misc_feature (1)..(381): n is a, c, g, or t
ttgttaaaaaaagacgctatgaaaatatattcatttgaaaaattaattgtctggcaagaatcaaaaaacctaataatcgagatatataaaatcacaaaaggttttccgtctaatgaaaaatttggattaattagtcaattaagaagagcatctgtatctattgcttcaaatttagcagaaggtacatcgagaaaaacaacgaaagacaaagctcattttacaacaattgcatttagttctgcaatggaagtgttaaatcaaatcataatttctaaagaattgaactttgtttctgaaaaagattatattttagtccgagaaaaattagaaaaaattacaaacatgctaaatgggttaagaaaaacgcaactaaacccataa

SEQ ID NO: 20052 - protein, 126 aa, Unknown
  Obtained from environmental sample
  DOMAIN (10)...(119): S23 ribosomal protein
  misc_feature (1)..(126): Xaa is any amino acid
MLKKDAMKIYSFEKLIVWQESKNLIIEIYKITKGFPSNEKFGLISQLRRASVSIASNLAEGTSRKTTKDKAHFTTIAFSSAMEVLNQIIISKELNFVSEKDYILVREKLEKITNMLNGLRKTQLNP

SEQ ID NO: 20053 - DNA, 411 bp, Unknown
  Obtained from environmental sample
  misc_feature (1)..(411): n is a, c, g, or t
ttgacaaaggcaccatctgcggtaagaaaggctcaagacaatatcgaaaatgcaaacttagatgagtttattggcgtgcatcacgtgaactttttcaattcaaaaaaagaagtttttggcaacaccactattttgtttaatccgccttatggcgaacgattgaatattgataccgaagaattttacaagaaaattggagatacgcttaaaaatggatatccagattctaaagtgtggtttatcacttcagatttagaagctttaaaacatgttggattgcgaacttcaaaaagaattccgcttaaaaatggagatttagattgtcgtttggttcgttatgatatctatgcagggacaagaaaaatacgttctgacgaacgtgaaattccagaaacagatttagaagattaa

SEQ ID NO: 20054 - protein, 136 aa, Unknown
  Obtained from environmental sample
  misc_feature (1)..(136): Xaa is any amino acid
MTKAPSAVRKAQDNIENANLDEFIGVHHVNFFNSKKEVFGNTTILFNPPYGERLNIDTEEFYKKIGDTLKNGYPDSKVWFITSDLEALKHVGLRTSKRIPLKNGDLDCRLVRYDIYAGTRKIRSDEREIPETDLED

SEQ ID NO: 20055 - DNA, 405 bp, Unknown
  Obtained from environmental sample
  misc_feature (1)..(405): n is a, c, g, or t
atgaataagaaactaggattaaaagtactatttcaaaatccaattgccgttttaatggaagggataagagttcgagaacaatcttattttaagaaaaagcttattgatcaatataacattgaaaagcttccatcaattaatattttggatttattcccaagtttggatgaagaaatagattcctatagttttttaaatggtacatccctcattactgatttagttttgcttaagtcattggcaaaaaggatagataaatgtgcctatttagaaataggtagttggaggggtgagagcttggtcaatgtttcgaatgttaccgaagattgtacatccttaacattgtcaagtgacgacatgaaacaattaatttcggagaagactcggccgatcttgatccactag

SEQ ID NO: 20056 - protein, 134 aa, Unknown
  Obtained from environmental sample
  misc_feature (1)..(134): Xaa is any amino acid
MNKKLGLKVLFQNPIAVLMEGIRVREQSYFKKKLIDQYNIEKLPSINILDLFPSLDEEIDSYSFLNGTSLITDLVLLKSLAKRIDKCAYLEIGSWRGESLVNVSNVTEDCTSLTLSSDDMKQLISEKTRPILIH

SEQ ID NO: 20057 - DNA, 651 bp, Unknown
  Obtained from environmental sample
  misc_feature (1)..(651): n is a, c, g, or t
atgagcgagctaaaagctctattgctgaagcaaggtgtaacgttcagttttaataccaaggtcgttgacatcaaagaaaaagcagatggcagcttagatgttataagctccgatcgtcaaaaaataagcggaacgcacgttgtagtatgttctgggacttggacacccgatttgatgaagaaactagatattaaacttcctgtacaagcgggaaaagggtatagcataactcttaaagcaccgtcaaaaatcccaaagataaacgttgtactagcggagcgtaaagtagcgataacaccaatcaatggagatctacgatttgctggaacgatggaagttgccggtcatgacacctctgtaactgcagctaaaataaatgctcttaaaaaatctgttcttccctactttcctgaatattccttagaatatttagataagcaatcggtttgggttgggctacgtccttgttcccctgatggcttaccgtatgttggtaaaataaactctcgtagaaatgtgtatgtttccacgggccattccatggttgggatgagcctaagctttgccaatggtgaaacaatcagccaactaataacgcagggccaagctaaactttctcatccattgacagatcctaatcgttatatgtga

SEQ ID NO: 20058 - protein, 216 aa, Unknown
  Obtained from environmental sample
  misc_feature (1)..(216): Xaa is any amino acid
MSELKALLLKQGVTFSFNTKVVDIKEKADGSLDVISSDRQKISGTHVVVCSGTWTPDLMKKLDIKLPVQAGKGYSITLKAPSKIPKINVVLAERKVAITPINGDLRFAGTMEVAGHDTSVTAAKINALKKSVLPYFPEYSLEYLDKQSVWVGLRPCSPDGLPYVGKINSRRNVYVSTGHSMVGMSLSFANGETISQLITQGQAKLSHPLTDPNRYM

SEQ ID NO: 20059 - DNA, 390 bp, Unknown
  Obtained from environmental sample
  misc_feature (1)..(390): n is a, c, g, or t
atggacaataagttagaacagtacaaaaaagagattaagaaaaagcacaggtttagtttttggagtgttccttattatcaagagaaaattgagttcaatattgatagtaatctatttaaaattataagcagtaatgtaattgagaatttaggttggaaattgattacagaagagaaagacctgcttactgtagaatcaagtgagaaatggaaaacagatggaataatagatatatcgttaaaagaggaatcagttctaacggtgaaaagcgaaaccatgttcaatcaaagatgggataatggccaaaattcagttcgagttaaattatttttgaaagtatttactgatgaatatganagcttggtggctaatcagaaagttatattgtga

SEQ ID NO: 20060 - protein, 129 aa, Unknown
  Obtained from environmental sample
  misc_feature (1)..(129): Xaa is any amino acid
MDNKLEQYKKEIKKKHRFSFWSVPYYQEKIEFNIDSNLFKIISSNVIENLGWKLITEEKDLLTVESSEKWKTDGIIDISLKEESVLTVKSETMFNQRWDNGQNSVRVKLFLKVFTDEYXSLVANQKVIL

SEQ ID NO: 20061 - DNA, 633 bp, Unknown
  Obtained from environmental sample
  misc_feature (1)..(633): n is a, c, g, or t
atgatcaagaatcggtcgagaatcgatttattatcgccttcattgtctgaaattactgaaatagtaaatgaaccagtcgccgctgcaggcctatcatatgaatttaatacaaatagttatgaatctttaaatgatattattatttcaaaagcgcaaaagataggcaatgtcttgcctattttaagccatacacttaataagttgtgttgcgatatagatgaagaaaacgaactcaaatttaacagttattatgaaaaaggtggattaataggatcgctgataaataaagcggatgaaattaatactcgatttaacaaatctgaaattaattcatttaaaaataaacttcattatttaatacagtttactcctgaaaaaaataataaaatattttgtgctaaagcaaaaataaaacatttccaaaatacaccttcaaaaaaaatcattttatatttaatagaggcacacctcatacaaactgaaatttttgataacaaaagctttatttctttcattcatgagtcacttttagaagagtcagaattctttaagtcttggatacctgataatcaattaaatttatccattatcaatgaaatacacacattaagtccaccattggcaaaacaataa

SEQ ID NO: 20062 - protein, 210 aa, Unknown
  Obtained from environmental sample
  misc_feature (1)..(210): Xaa is any amino acid
MIKNRSRIDLLSPSLSEITEIVNEPVAAAGLSYEFNTNSYESLNDIIISKAQKIGNVLPILSHTLNKLCCDIDEENELKFNSYYEKGGLIGSLINKADEINTRFNKSEINSFKNKLHYLIQFTPEKNNKIFCAKAKIKHFQNTPSKKIILYLIEAHLIQTEIFDNKSFISFIHESLLEESEFFKSWIPDNQLNLSIINEIHTLSPPLAKQ

SEQ ID NO: 20063 - DNA, 714 bp, Unknown
  Obtained from environmental sample
  misc_feature (1)..(714): n is a, c, g, or t
gtgttaaaaaaaggaatgaataccttcaaatcaatgaaaattggatatataacaaaacaatccccgcacgatataaaagcttattcgggcacacattatagtatgcttagagctcttcagactcaatttgaagatgtagttgctttgggaccaattgatcatccgtataaaaatatagtaagactgaaagggcgcctattaaggctttttgataagcgagtatatagatatcaatacaatgtggcccttgcaaagaagatggcaacaattcttgataaaagaattgaagagtttaagcctgatgtattaataggctctttagtaagtcctgaagttgcatatctaaaaagtaaattgccgttgtttcttaccaccgactctactttcccattattacacgaagtatatgcaagtcattcaaatcttaatcagattactataaaaaatgctagacatttagaaagaatggcttttgaaagagctacaaaacttattgtgcctttgcaatggattgcagattcagctattagtgattatggaatttcgagcgagaaaattgaggtagttccttatggatccaattttgattttcaagtttcagaagctcaagtaaatgcaatgattaaaaaaagggtatctgatactaagctcaatctgctttttgtaggaattcgctgggaagaacacggtgggccattcgctgttgaagttttn

SEQ ID NO: 20064 - protein, 238 aa, Unknown
  Obtained from environmental sample
  misc_feature (1)..(238): Xaa is any amino acid
MLKKGMNTFKSMKIGYITKQSPHDIKAYSGTHYSMLRALQTQFEDVVALGPIDHPYKNIVRLKGRLLRLFDKRVYRYQYNVALAKKMATILDKRIEEFKPDVLIGSLVSPEVAYLKSKLPLFLTTDSTFPLLHEVYASHSNLNQITIKNARHLERMAFERATKLIVPLQWIADSAISDYGISSEKIEVVPYGSNFDFQVSEAQVNAMIKKRVSDTKLNLLFVGIRWEEHGGPFAVEVX

SEQ ID NO: 20065 - DNA, 597 bp, Unknown
  Obtained from environmental sample
  misc_feature (1)..(597): n is a, c, g, or t
ttgttttgcaacaaacctttgtatggcggaacgtataattttgtggtagaagaatttgataaattcggaattgaatattcgtttacaaaggatttatccatcgaatcttttcaaaaagaaatcaaagaaaacaccaaagtgttgtacatagaaactccatctaacccgttgttaaccattacagacatgcaattggttgcagatttagcaaagaaaaatgacattgtaacaatgattgacaatacgtttgcatcgccaataaatcaaactccaattgatttcggaattgatattatgctgcattctgcaacaaaatatatgggcgggcattcagatattttggcaggcgcagttgctgcatcaaatgaacatattgataaaatttggaacatcgcaaaaaacttaggcggaagtttgagtgattttaccgtttggatgttagagcgtagtttaaaaacgatgagtctacgtgtaaaacgtcaaagtaaaaatgcgttgaaaatggcaaaatatttagctacaaataaaaatgtatctagagtttattatccaggattaaaaggcatccaaattataaattggcaaaaaaacaaatga

SEQ ID NO: 20066 - protein, 198 aa, Unknown
  Obtained from environmental sample
  DOMAIN (2)...(193): Cys/Met metabolism PLP-dependent enzyme
  misc_feature (1)..(198): Xaa is any amino acid
MFCNKPLYGGTYNFVVEEFDKFGIEYSFTKDLSIESFQKEIKENTKVLYIETPSNPLLTITDMQLVADLAKKNDIVTMIDNTFASPINQTPIDFGIDIMLHSATKYMGGHSDILAGAVAASNEHIDKIWNIAKNLGGSLSDFTVWMLERSLKTMSLRVKRQSKNALKMAKYLATNKNVSRVYYPGLKGIQIINWQKNK

SEQ ID NO: 20067 - DNA, 333 bp, Unknown
  Obtained from environmental sample
  misc_feature (1)..(333): n is a, c, g, or t
atgttagtttataggttttataaaaaaaaattaaaaaagtcagttgtagattggttaaaatatactgaagatacatttggtgatattttatggaaatggtattgggaatataatgcattacaccaaacttatgatattcaaaatttaaggccaatctgccctaaatgtaatacttcaatgaagttgcatttagatagattacaagagtttgcgagttgtcctagatgtgacaatgaaattcttgaatttaaaaaaccagatcaaattaactcattaataaaagataatgtaccaagagatttgtctaacattaatctactcgataaaaactag

SEQ ID NO: 20068 - protein, 110 aa, Unknown
  Obtained from environmental sample
  misc_feature (1)..(110): Xaa is any amino acid
MLVYRFYKKKLKKSVVDWLKYTEDTFGDILWKWYWEYNALHQTYDIQNLRPICPKCNTSMKLHLDRLQEFASCPRCDNEILEFKKPDQINSLIKDNVPRDLSNINLLDKN

SEQ ID NO: 20069 - DNA, 312 bp, Unknown
  Obtained from environmental sample
  misc_feature (1)..(312): n is a, c, g, or t
atgaaaataaagattagatgtcttttaatatttttaaccctttcaccttttgtacaagcccaaaatcatgttactgaatatgattcaatttactctgtacatctcaaagaattgagatatataaaaataagcatcccaaaaaaatataatcctagtgataaagaaaagttagatgtattatatgtcttggatggagaatgggcaacatcattgtcagaaactgtttgtgagtttttagaatacgctgaatttattcctacaaatatgataatagttagtatcccaaaccattataaagatggaataatatga

SEQ ID NO: 20070 - protein, 103 aa, Unknown
  Obtained from environmental sample
  SIGNAL (1)...(20)
  misc_feature (1)..(103): Xaa is any amino acid
MKIKIRCLLIFLTLSPFVQAQNHVTEYDSIYSVHLKELRYIKISIPKKYNPSDKEKLDVLYVLDGEWATSLSETVCEFLEYAEFIPTNMIIVSIPNHYKDGII

SEQ ID NO: 20071 - DNA, 819 bp, Unknown
  Obtained from environmental sample
  misc_feature (1)..(819): n is a, c, g, or t
ttggtttttggtggagttggtttgggcaagacccacttggcacatgccataggtgttgagataaaggataaatacccagaccgtacggttttgtatatatccgcggaaaaattcacccagcagtatattgaatccgtaaagaaaaatacacgaaacgattttattcacttttatcaattgatagatgtgctcattatcgatgatgttcaatttttatccgggaaatcgggtacccaggatgtattcttccacatattcaatcatttgcaccaaaacgggaaacaagtgatcctaacatcggacaaggcacctgttgacatgcaggatattgaacagcgattgctttcgagattcaaatggggattatcggccgaattgcaaaatccggattacgaaacaaggatttccatcttaaagaacaaattgtatcgcgatggtgttgaaatgcctgaagatatcatcgattatgttgccaaacatatcaaaaccaatattcgagagttggaaggcgccattatatccttgatagcgcaatcctcattcaacaagaaagaggttactttggaattggcacaacaagtggtcgaaaaattcgtcaagaataccaaacgcgaagtctctatagattatatccaaaaagtagtttccgattactttgaaatggatgtggccacccttcaatccaaaacaagaaaaagacatatcgtccaagctaggcaactggctatgttcttcggcaaaaaattaccaatgcttccttggcaagtattggtccacaattgcgaaaagggaccatgccactgttctccatgcctgtaa

SEQ ID NO: 20072 - protein, 272 aa, Unknown
  Obtained from environmental sample
  DOMAIN (3)...(264): Bacterial  dnaA  protein
  misc_feature (1)..(272): Xaa is any amino acid
MVFGGVGLGKTHLAHAIGVEIKDKYPDRTVLYISAEKFTQQYIESVKKNTRNDFIHFYQLIDVLIIDDVQFLSGKSGTQDVFFHIFNHLHQNGKQVILTSDKAPVDMQDIEQRLLSRFKWGLSAELQNPDYETRISILKNKLYRDGVEMPEDIIDYVAKHIKTNIRELEGAIISLIAQSSFNKKEVTLELAQQVVEKFVKNTKREVSIDYIQKVVSDYFEMDVATLQSKTRKRHIVQARQLAMFFGKKLPMLPWQVLVHNCEKGPCHCSPCL

SEQ ID NO: 20073 - DNA, 579 bp, Unknown
  Obtained from environmental sample
  misc_feature (1)..(579): n is a, c, g, or t
ttgatccccaccactttaggggacaacgagccattggaagtattgcccatttccataaaaagggtgattgaagccgttgaccactatattgtggaaaacgaaaaatcggccagacggttcatcaaaaaaatatcccctagaaaatcgcaacccggattgcatatcgaagtgctcaacaaatataccgaagcggaaagccttcctacttttttacaaccatgccttgaaggccttaatgttgggattatctccgaagccggttgccccggtattgccgaccccggtgccgatgtggtgcgcattgcccatcaaaagaacatacaggtggttcccctagtaggaccctcatccattgtattggctttaatgtccagcggaatgaacggacagaatttcgcatttaacggttacctcccaattgattcggtggatcgaaaaaaaaccatcaaatcgcttgaaaaaaaatcgagggatataaaacagtcccaaattttcattgaaaccccgtatcggaatgataaattattcaaagaacttttggcctcactttcgaacagcactcgattgttattgctttga

SEQ ID NO: 20074 - protein, 192 aa, Unknown
  Obtained from environmental sample
  misc_feature (1)..(192): Xaa is any amino acid
MIPTTLGDNEPLEVLPISIKRVIEAVDHYIVENEKSARRFIKKISPRKSQPGLHIEVLNKYTEAESLPTFLQPCLEGLNVGIISEAGCPGIADPGADVVRIAHQKNIQVVPLVGPSSIVLALMSSGMNGQNFAFNGYLPIDSVDRKKTIKSLEKKSRDIKQSQIFIETPYRNDKLFKELLASLSNSTRLLLL

SEQ ID NO: 20075 - DNA, 585 bp, Unknown
  Obtained from environmental sample
  misc_feature (1)..(585): n is a, c, g, or t
ttgaataataaaaactccatattaaagctaagatttgtaggtaagggaatttctccatctagttttacagctagggaactaggagatttacttgtagagctgcaaaaagggatgagtgctttagttgattcttttggggattctgattggtctgaaaacaatcatcttttgagcttgactgaaataaagaatgagtccaatggactgtttttctcatctaattaccctaaagctgaacaggcttactatcaaattactaaagctgcaaataacaaaaacctatttcatttaccacgggaatctttcagcgcaattaagatgatttcaaaatttgctaagaataaaaaatgcaatgctgaaatttcatacaattctggaactgagagagtgttttctgtaataactcccgaagataatctaataactcctgaagaagtatatttaacagaaacaagagaattttatggtgagattacaagaattggtggtacagaaccaagagttagatttaagacatttgatggaaaaactcgaaatggcgatctttccaagaatttggcaaggagtatagctgataagcttnna

SEQ ID NO: 20076 - protein, 195 aa, Unknown
  Obtained from environmental sample
  misc_feature (1)..(195): Xaa is any amino acid
MNNKNSILKLRFVGKGISPSSFTARELGDLLVELQKGMSALVDSFGDSDWSENNHLLSLTEIKNESNGLFFSSNYPKAEQAYYQITKAANNKNLFHLPRESFSAIKMISKFAKNKKCNAEISYNSGTERVFSVITPEDNLITPEEVYLTETREFYGEITRIGGTEPRVRFKTFDGKTRNGDLSKNLARSIADKLX

SEQ ID NO: 20077 - DNA, 696 bp, Unknown
  Obtained from environmental sample
  misc_feature (1)..(696): n is a, c, g, or t
ttgggatgcgaattattcatggaatatggactttcagaaaccccatgttattcgtgttatctgccgcttactataaatgataaagatcacgagaaatggatccagggctttggatacccaagtattgttgttgctattctggctaacgaaatggctattcatgataaacatggaaatgcactagaagaaggagaacgaggggagattgtaatacgcggtgtgaacgtgatgaaaggttatttcaataatcaagatgccaatgaaagcgcgtttaaaaatggatggtttaggagtggtgatgaaggattctataagaaagatgaacagggaaacgctttttattttataacaggtagaatcaaggaattgatcatcagaggtggaattaactttgctcctttggaaattgatgaggttattaataaagcgccaggagtgaaagctggaattgccgttggctttgaaaatgactggtatggcgaggaagtaggcgcatacgtagaaattttagaaggtaaggtagaaaatccagaggaaattatagcgtactgtaaagaacatcttccacatgcaaaaactccgaaagtaatagtttttgggaatgagataccggtcacctcaacaggtaaataccaacgtagaaaagtagcgcatttgtttaaggagtggaaagaggttcagtttaggaaacactaa

SEQ ID NO: 20078 - protein, 231 aa, Unknown
  Obtained from environmental sample
  misc_feature (1)..(231): Xaa is any amino acid
MGCELFMEYGLSETPCYSCYLPLTINDKDHEKWIQGFGYPSIVVAILANEMAIHDKHGNALEEGERGEIVIRGVNVMKGYFNNQDANESAFKNGWFRSGDEGFYKKDEQGNAFYFITGRIKELIIRGGINFAPLEIDEVINKAPGVKAGIAVGFENDWYGEEVGAYVEILEGKVENPEEIIAYCKEHLPHAKTPKVIVFGNEIPVTSTGKYQRRKVAHLFKEWKEVQFRKH

SEQ ID NO: 20079 - DNA, 507 bp, Unknown
  Obtained from environmental sample
  misc_feature (1)..(507): n is a, c, g, or t
gtggatcaagaatcggctcgagaaccggtttcagaaaattctttancagatatgaaattgcaattcgattttatcaatgacatcaatactaaaatatcagaaatacataaagcattgattaatatcggcgaaataaaagcacaaattaagacattaaaaggcgctattaaagacaaacaaaaacacaaagaactattatcttatgctgataaattggctaaaaaaatcacaaaaattgagactaccttatatcaaacaaaaagtaaaagtggtcaagatccgttgaattttccaatcagattaaacaataaattagcgcatttaaattcgttaacaagaatgggtacatataagccaactgatcaagatgttgcttttaaaaatgaaattgttagagatattgacacggaattatcaaaattatatgtagtatttaataacgatgtaaaacagctaaatcagaaagtaaaagagagtcagattgatttaatccaattagataaataa

SEQ ID NO: 20080 - protein, 168 aa, Unknown
  Obtained from environmental sample
  misc_feature (1)..(168): Xaa is any amino acid
MDQESAREPVSENSLXDMKLQFDFINDINTKISEIHKALINIGEIKAQIKTLKGAIKDKQKHKELLSYADKLAKKITKIETTLYQTKSKSGQDPLNFPIRLNNKLAHLNSLTRMGTYKPTDQDVAFKNEIVRDIDTELSKLYVVFNNDVKQLNQKVKESQIDLIQLDK

SEQ ID NO: 20081 - DNA, 591 bp, Unknown
  Obtained from environmental sample
  misc_feature (1)..(591): n is a, c, g, or t
ttgcttcggctcgagaaagagacacaattaatcattgttttgggcactgcatttcgggtcgccttcttttcggaaaattgggaacgcgccattgaaatcgtgcaggaagcatttgcccatccccggttcaacgcctccccattccgcgtagccgtctggcactattgccattcctgcgccctgctcaagaccaaaaagaccagcgaagccctccgcgccctcaacgaagccaccctcctgctctccgacaaaatgggctggaacctcaccttccgtttgcacgaaatcatggtcctccacgaagccggcatgtacgacctcctggaaagcaaaattctcaacatgcgccaatttgtgaagcgcacccagaaaaacagcgatctctaccggcccatgaagctgattcagatcctgatggagtggcacaaaaacagcctcgacatcaaaaaaacctataccaacatcaaaaagcagctcaaagacctgcaaaattaccacaaagaaatcccctttgacccttctaccggcgagctcatccgcctcgaaacctggatggaagaggtgaatactgctttgacggggggaagttag

SEQ ID NO: 20082 - protein, 196 aa, Unknown
  Obtained from environmental sample
  misc_feature (1)..(196): Xaa is any amino acid
MLRLEKETQLIIVLGTAFRVAFFSENWERAIEIVQEAFAHPRFNASPFRVAVWHYCHSCALLKTKKTSEALRALNEATLLLSDKMGWNLTFRLHEIMVLHEAGMYDLLESKILNMRQFVKRTQKNSDLYRPMKLIQILMEWHKNSLDIKKTYTNIKKQLKDLQNYHKEIPFDPSTGELIRLETWMEEVNTALTGGS

SEQ ID NO: 20083 - DNA, 513 bp, Unknown
  Obtained from environmental sample
  misc_feature (1)..(513): n is a, c, g, or t
ttgatattgggtcttttactttttgctttgattgccattgtgtttttatttttattaaagaaacaagtaaataaaagagtcgtggaattaaccaaaagtgaattacagttaaaacaaatcattaatcttgtgcctcatatgatttatgtgacaaatagtaatggagatgtattgttagcaaatgaaacagccagcaggtattttggtatgtcattatcagaatttgaaaacagtaatattcgtgatttaagcaaagaatataaacgatttaaaaaattaataaatgaggatggctatcataaaaatgatgatttacatcataatgtagagattagtgccagggattcccaaggttcaagacatactttgtttttatcaaaaaaatcttatgtcggcagtaatacatttgaagaatcaacagtaacagtcgcagttgacattacagatattaaagactttgaagagaacattcacatttatggatcaacacgattcattaacgaaattacctaa

SEQ ID NO: 20084 - protein, 170 aa, Unknown
  Obtained from environmental sample
  SIGNAL (1)...(20)
  DOMAIN (35)...(95): PAS domain
  misc_feature (1)..(170): Xaa is any amino acid
MILGLLLFALIAIVFLFLLKKQVNKRVVELTKSELQLKQIINLVPHMIYVTNSNGDVLLANETASRYFGMSLSEFENSNIRDLSKEYKRFKKLINEDGYHKNDDLHHNVEISARDSQGSRHTLFLSKKSYVGSNTFEESTVTVAVDITDIKDFEENIHIYGSTRFINEIT

SEQ ID NO: 20085 - DNA, 645 bp, Unknown
  Obtained from environmental sample
  misc_feature (1)..(645): n is a, c, g, or t
ttgaaagaaggtttgatgagcttacttgggatggttacaaatgaaacaggggttccgtatgatatttccgggatgtctatagggactgttcattctatttgtcaggattttttagtggatcatgaccgacgtttctctgaggaacacgagcgaagcagacctccattgctcatggattcactggagcaatacttcaaagtgtatcgtagaagttattggcgagagttattagaggcaggaggatatttaaccactgataatatcgaaatcgatgagaaaaatgcccaagaagaattaaatcttttctttgctgggtttagttcgtattcaaggcattatgcagccaagagtattattgatgtattcaaccgattttctgaggaaagtttagatccaaataaagtcatttccgaagataaggtacttcagaaagtcctgaagatgtacaaatactatacggatagccaacaaaaaggaaaaatccatacagttgacttttccttacttcagcaaaaggctttcaataagattaaaaatttcgaaggttcgaaaagagtctttagatatattatcatagatgaataccaagatacgaattcaatccaagagaagatatattttgagctagctagtcaatgtaaannt

SEQ ID NO: 20086 - protein, 215 aa, Unknown
  Obtained from environmental sample
  misc_feature (1)..(215): Xaa is any amino acid
MKEGLMSLLGMVTNETGVPYDISGMSIGTVHSICQDFLVDHDRRFSEEHERSRPPLLMDSLEQYFKVYRRSYWRELLEAGGYLTTDNIEIDEKNAQEELNLFFAGFSSYSRHYAAKSIIDVFNRFSEESLDPNKVISEDKVLQKVLKMYKYYTDSQQKGKIHTVDFSLLQQKAFNKIKNFEGSKRVFRYIIIDEYQDTNSIQEKIYFELASQCKX

SEQ ID NO: 20087 - DNA, 693 bp, Unknown
  Obtained from environmental sample
  misc_feature (1)..(693): n is a, c, g, or t
atgaatgtaattattatagaagacgaaaaaccagcagcaagaagattaagtaggatgttggtagaattgggagtagaagcaaataaaatgctgcattctgtagaagaatccatcgagtggtttcagaataatgaacatccagatttaattttcttagacatacaattgtcggatggtttgtcttttgaaatttttgaacatgttacgatttctagtgccataatttttacaacggcttatgatgaatatgcgctaaaagcgtttaaattaaatagcatcgattatttattaaaaccaattgatgaagacgaattaaaagctgcggtagaaaaatataaaagtcaccgtgtaaaacaagcagatgttcagttaaattttgaagacatcaaaaaactattggtaaacccgatcgatagaaaatacaaaaagcgttttaccataaaagttgggcaacatttaaagattgtatctacagatgatgttgagtgtttttacagcgaaaacaaagcaacctatattcatacaaccacaaacagaagttatttgttagatggcgctttagaacaagtacaaaccgaattagatccagaaaaattctttcgagtaaacagaacttttatcttgcaaatatcagcaataaaagacattgttgcttatacaaacagtcgcnttaaatcatttaactctatctga

SEQ ID NO: 20088 - protein, 230 aa, Unknown
  Obtained from environmental sample
  DOMAIN (151)...(230): LytTr DNA-binding domain
  misc_feature (1)..(230): Xaa is any amino acid
MNVIIIEDEKPAARRLSRMLVELGVEANKMLHSVEESIEWFQNNEHPDLIFLDIQLSDGLSFEIFEHVTISSAIIFTTAYDEYALKAFKLNSIDYLLKPIDEDELKAAVEKYKSHRVKQADVQLNFEDIKKLLVNPIDRKYKKRFTIKVGQHLKIVSTDDVECFYSENKATYIHTTTNRSYLLDGALEQVQTELDPEKFFRVNRTFILQISAIKDIVAYTNSRXKSFNSI

SEQ ID NO: 20089 - DNA, 723 bp, Unknown
  Obtained from environmental sample
  misc_feature (1)..(723): n is a, c, g, or t
ttgattatggcaacattcaattattacctccgagaaaaactaaagcaacataaaacaaatgatccgagatccattcatttagttgtgaattggacacctgaaagaggaaagagatcaaggcttgttacctcaactaccattaaaacctcaattcttgattgggacgttaataagcaagctattaaggatagaaaggttgttgcttatagagagctgaataaccaattcttaggtaagttcaagtcagaggctgtgaggctatataacggctttattagagagaacgatagattcccattcaaagatgaattaaagagcctgtatggaagagaattaacattattaggtaagactgagtcagctggtaaaaagcatactcttctttcgttcattgatgaattcatagtgaagtcaaagaccagagctaatctaaatacaggaaagactatctcaccttctactatacagtcatacaagagaacattgaagtatctcaaggaatatcatgagatcaagcctataagctttgatagtattgatctaaagttctataatgagttctatgcgtttctaatggagaagcaattctctaccaataccattggaaagctcttcaaagagattaaggtatttatgaatgaagctttagaggaaggattaacagagaataaggcatggaagagtaagaagttcagaaggtatcggagctcgaccgattcttga

SEQ ID NO: 20090 - protein, 240 aa, Unknown
  Obtained from environmental sample
  misc_feature (1)..(240): Xaa is any amino acid
MIMATFNYYLREKLKQHKTNDPRSIHLVVNWTPERGKRSRLVTSTTIKTSILDWDVNKQAIKDRKVVAYRELNNQFLGKFKSEAVRLYNGFIRENDRFPFKDELKSLYGRELTLLGKTESAGKKHTLLSFIDEFIVKSKTRANLNTGKTISPSTIQSYKRTLKYLKEYHEIKPISFDSIDLKFYNEFYAFLMEKQFSTNTIGKLFKEIKVFMNEALEEGLTENKAWKSKKFRRYRSSTDS

SEQ ID NO: 20091 - DNA, 369 bp, Unknown
  Obtained from environmental sample
  misc_feature (1)..(369): n is a, c, g, or t
gtgacatctaaaaatgcctcaaaaattgagagtgagcctgtaatttttaccttttttattgacaaacctttgtatcaaaaaacgtggtttattgtaagtgttattggctttttagcaattgtttttttcttaatgatttacttttattttaaaagaaagcaaacagaaaatcaacaaaaaatcgaaaagctaacgttggaaaatcatttaattactttagagcaaaaagcgttgcaattacaaatgaatccgcattttatttttaatgttttaaacggaattaaagcatttggaaataacggaaacacaaaagagttaaacagtacaatcagtcagtttgcaaacttgttacgctcacttttacacaaa

SEQ ID NO: 20092 - protein, 123 aa, Unknown
  Obtained from environmental sample
  DOMAIN (74)...(123): Histidine kinase
  misc_feature (1)..(123): Xaa is any amino acid
MTSKNASKIESEPVIFTFFIDKPLYQKTWFIVSVIGFLAIVFFLMIYFYFKRKQTENQQKIEKLTLENHLITLEQKALQLQMNPHFIFNVLNGIKAFGNNGNTKELNSTISQFANLLRSLLHK

SEQ ID NO: 20093 - DNA, 330 bp, Unknown
  Obtained from environmental sample
  misc_feature (1)..(330): n is a, c, g, or t
ttgccaaaaaaaatatcattacacactttagataaaattgtggtggtttctttggatgaagtaatccgatgtaaatccgacaataattatactactttttattttgaaaacggttctaaaattatggttaccaaaaccttaaaattttatgcagatttattaaaagacaattctttcttacgcgttcatcaaagtcatttgataaacaccaaatacatcaaagaatttataaaatcagatggaggttatttagtgttaaaagacaaaagtaccgtttcagtttccgttcgtaaacgagcagaagttattgaagcacttgccaatctttaa

SEQ ID NO: 20094 - protein, 109 aa, Unknown
  Obtained from environmental sample
  DOMAIN (11)...(107): LytTr DNA-binding domain
  misc_feature (1)..(109): Xaa is any amino acid
MPKKISLHTLDKIVVVSLDEVIRCKSDNNYTTFYFENGSKIMVTKTLKFYADLLKDNSFLRVHQSHLINTKYIKEFIKSDGGYLVLKDKSTVSVSVRKRAEVIEALANL

SEQ ID NO: 20095 - DNA, 630 bp, Unknown
  Obtained from environmental sample
  misc_feature (1)..(630): n is a, c, g, or t
atgtcatctaaaaaactatcagaaaccttatcttctggtttgtcgcaactcaatattaatgaagataaagttgatgagttacttgagtttatctacctgttagaaaaatggaataaaacttataatattactgccattcgcgatttggagcagatggtaattctacatattatcgatagcgccgcagtttacaactatttagaaggaaactcaataattgatgtgggaacaggcggaggaatacccggaattatatttgcaatccttaatccaaacctaaaaataaccttattagactccaaccaaaaaaaaaccagattcttaagatttgttaaaagacaaatgaatttaaagaatattgaggttgtttgtgaaagagttgagaaatatcaacccaatttctcctatgatgtggtaatatccagagctttttctgaggtgggacaatttttaaagctttctaaccatctttgttcgaataaaggaaagatatatgccatgaaaggaccaagaaaagaatctgaatataatgccatagtttatggttttaaattaattgatgacattgatataaatgttccttttttagatgccactagacgattgttgatatttaataaaaatatatga

SEQ ID NO: 20096 - protein, 209 aa, Unknown
  Obtained from environmental sample
  DOMAIN (23)...(204): Glucose inhibited division protein
  misc_feature (1)..(209): Xaa is any amino acid
MSSKKLSETLSSGLSQLNINEDKVDELLEFIYLLEKWNKTYNITAIRDLEQMVILHIIDSAAVYNYLEGNSIIDVGTGGGIPGIIFAILNPNLKITLLDSNQKKTRFLRFVKRQMNLKNIEVVCERVEKYQPNFSYDVVISRAFSEVGQFLKLSNHLCSNKGKIYAMKGPRKESEYNAIVYGFKLIDDIDINVPFLDATRRLLIFNKNI

SEQ ID NO: 20097 - DNA, 378 bp, Unknown
  Obtained from environmental sample
  misc_feature (1)..(378): n is a, c, g, or t
atggttacctcccgtaaaaatgacttggaatttaagtacatcatgaatggcatggcagttcaagatcacactttaaaagaagatggcattcactctggaagtattcggcaatttaatgccgatagcagtgcttggtatgttcactattacaccacagcaagtgcaagctcaagcctgaaaacttggactgggggcaaaaccaacgataaaatcattttgtacagcgatcaaaaagcaccaaatggtatggacggtttatataaaatcagcttttatgatatctctacagaaggatttaactggattggtgaatgggttaaccaagatgaatccattatcttccccacttggaagattgagtgtaaaaaaagagtataa

SEQ ID NO: 20098 - protein, 125 aa, Unknown
  Obtained from environmental sample
  misc_feature (1)..(125): Xaa is any amino acid
MVTSRKNDLEFKYIMNGMAVQDHTLKEDGIHSGSIRQFNADSSAWYVHYYTTASASSSLKTWTGGKTNDKIILYSDQKAPNGMDGLYKISFYDISTEGFNWIGEWVNQDESIIFPTWKIECKKRV

SEQ ID NO: 20099 - DNA, 528 bp, Unknown
  Obtained from environmental sample
  misc_feature (1)..(528): n is a, c, g, or t
ttgcgaaaagaaatgtataaaaaacgcgcaagaaatagatctgcagctaaaaaagaatacgatttatggatttgtgcagaactagaaaaattggtaaaagaaaaaaacgcaaaagtggttcatgcctatttaccaatgggaacagaaattgatattcgtccgtttatacaaaaaatgttggagcaaaatatcaaaattatttctccaaaaacgttaccaaaacgtcagttagaaaatttagaattacatgctttagaagacgtagaaaaaggcgtttttggtacgtcgcatccagcaaattctaccatttattttggaaattacgatttggttattgtgccaggtttggcttttgatcatcagaattttagattgggttatggcggcggatattacgatacgtttttagtgcaacatccaacaacttttaaaatcggaattttttatccgtttcaagaagtagctgctgttcctaaagaaaaccacgatgtttgtttggatcgaattttagtaaaggaattagtctag

SEQ ID NO: 20100 - protein, 175 aa, Unknown
  Obtained from environmental sample
  DOMAIN (1)...(172): 5-formyltetrahydrofolate cyclo-ligase family
  misc_feature (1)..(175): Xaa is any amino acid
MRKEMYKKRARNRSAAKKEYDLWICAELEKLVKEKNAKVVHAYLPMGTEIDIRPFIQKMLEQNIKIISPKTLPKRQLENLELHALEDVEKGVFGTSHPANSTIYFGNYDLVIVPGLAFDHQNFRLGYGGGYYDTFLVQHPTTFKIGIFYPFQEVAAVPKENHDVCLDRILVKELV

SEQ ID NO: 20101 - DNA, 357 bp, Unknown
  Obtained from environmental sample
  misc_feature (1)..(357): n is a, c, g, or t
atggggagcaatttagcgtggattgaataccggatgttatcgatcagacaggttaccacgagacgaattgaagagtatatgtctcaaaaatctggtgtagatttgtctaaagtgtttgatcaatatttaagagattatagaattccagaatttacttacagtagtaaaggaaatcaattaaaatacaaatggaataacactgtagacggatttaacatgccgataaaagtgacaatcaatggagaaactaaaagcctacaaccaactgatgtttggaaaacagtacaattagaggtttctaatccaattgtaaaagtggatgaaaattattatgtaacttctaaaaaactagactaa

SEQ ID NO: 20102 - protein, 118 aa, Unknown
  Obtained from environmental sample
  misc_feature (1)..(118): Xaa is any amino acid
MGSNLAWIEYRMLSIRQVTTRRIEEYMSQKSGVDLSKVFDQYLRDYRIPEFTYSSKGNQLKYKWNNTVDGFNMPIKVTINGETKSLQPTDVWKTVQLEVSNPIVKVDENYYVTSKKLD

SEQ ID NO: 20103 - DNA, 324 bp, Unknown
  Obtained from environmental sample
  misc_feature (1)..(324): n is a, c, g, or t
ttgatggctatatttaacattcagattcagattaaaaaacttatctcaactattttgaaaaagatctttttcactatttcatgcttcgttgttttatcaattcttacttttagcggatgtgataaaaacgatagttgttcatcagaacctaatttattggtttctcaagatcaacttgccttagatatcgccgctattgatgcctacctctccaaaaatggaattagttcccaaaccgatgaaacgggcattcgttatgctgtcaataagaaagaccagtggccaggcagattatgcagtattggcaaagtatctatcaagtaa

SEQ ID NO: 20104 - protein, 107 aa, Unknown
  Obtained from environmental sample
  misc_feature (1)..(107): Xaa is any amino acid
MMAIFNIQIQIKKLISTILKKIFFTISCFVVLSILTFSGCDKNDSCSSEPNLLVSQDQLALDIAAIDAYLSKNGISSQTDETGIRYAVNKKDQWPGRLCSIGKVSIK

SEQ ID NO: 20105 - DNA, 444 bp, Unknown
  Obtained from environmental sample
  misc_feature (1)..(444): n is a, c, g, or t
atgcagttacctatacttgtagaaaaatttcaacagaaagatataatagcttttgaagctctttacaatatgtatggcaaaagtatccacggtgttatttacaatatcgttagagattatgctgctgcagatgacattttacaagatgtttttgttaaagtttggaataattctagtaattactcaactgaaaaaggtcgcttttttacttggcttttaactattgccagaaaagctgctttagataaaatacattcaaaaacaattaatccctctgaacataatcttaataagcagtgctttgctgatattatagaaactaatgagtttttaaatactgaaaatgatggcttagatattaaagtatttgtatcaaaacttgccaacagttgtattgatgttattgagcttatctattttaagggctataaccaaaaagaaacn

SEQ ID NO: 20106 - protein, 148 aa, Unknown
  Obtained from environmental sample
  DOMAIN (21)...(88): Sigma-70 region 2
  misc_feature (1)..(148): Xaa is any amino acid
MQLPILVEKFQQKDIIAFEALYNMYGKSIHGVIYNIVRDYAAADDILQDVFVKVWNNSSNYSTEKGRFFTWLLTIARKAALDKIHSKTINPSEHNLNKQCFADIIETNEFLNTENDGLDIKVFVSKLANSCIDVIELIYFKGYNQKET

SEQ ID NO: 20107 - DNA, 549 bp, Unknown
  Obtained from environmental sample
  misc_feature (1)..(549): n is a, c, g, or t
ttggatagcatcattttggttcctgctggattattatgcttaggttatgaaaacaaacagttaactagtgaaaagaatcaactttcaaatgaaatcattcaactaacgacaaaaatcagcacaaatgaaagtgatagaaaatttttagaacttgaaattgaaaaagtagataccaatttaaaagaatctaaagaacttatatcgattttaagagaccgacatattattgcggttcctcttgctgggcaagccatatcactaaatgcgtatgctaaaatatactgggataaaagcactaaaaccatttatttagatgcccaaggattaccagaacctcctgaaggaaaagtatatcaattatggtcattaactttagagcctttaacatctaaaagtttaggcacactcaatgattttgattcggtaaccaacaaaatatttactcttaaaaatgctaatgcttctcaagcttttggtattactcttgaaccagaaggtggcagtataacgcctacattagatcaattatacacccttggaatcgtttaa

SEQ ID NO: 20108 - protein, 182 aa, Unknown
  Obtained from environmental sample
  misc_feature (1)..(182): Xaa is any amino acid
MDSIILVPAGLLCLGYENKQLTSEKNQLSNEIIQLTTKISTNESDRKFLELEIEKVDTNLKESKELISILRDRHIIAVPLAGQAISLNAYAKIYWDKSTKTIYLDAQGLPEPPEGKVYQLWSLTLEPLTSKSLGTLNDFDSVTNKIFTLKNANASQAFGITLEPEGGSITPTLDQLYTLGIV

SEQ ID NO: 20109 - DNA, 510 bp, Unknown
  Obtained from environmental sample
  misc_feature (1)..(510): n is a, c, g, or t
atggaagaatattatgtttatgcattaattgaccctcacaataatgaaattttttatattggaaaagggaaagggaatagaattaataaacacttcaaagaattaaaaaaatacattcaacttttagaaaatggaattccaactataaaaggaaagttttcaaactacaacaaaattgaaagaatgcgtgtaattcaaaacatggggctggtaacaaaagctgaaaaacttattgaagaaatttctgaaaaagccgcttttgtattagaagaaattttggtagagagaattggcaggaaatttctagaatctggtcctttgttaaatttctctcctggaggagattggaaatacccaaaaatcatgctaaaagaaagtgaaaagattcaaatggaaactgtaaaaaaagactttcctgaattaataactgtaataaataaaattccaaatactgctattgaatcggaagctataaaaaatttcaagaaaaatcctttaatgttcgattaa

SEQ ID NO: 20110 - protein, 169 aa, Unknown
  Obtained from environmental sample
  misc_feature (1)..(169): Xaa is any amino acid
MEEYYVYALIDPHNNEIFYIGKGKGNRINKHFKELKKYIQLLENGIPTIKGKFSNYNKIERMRVIQNMGLVTKAEKLIEEISEKAAFVLEEILVERIGRKFLESGPLLNFSPGGDWKYPKIMLKESEKIQMETVKKDFPELITVINKIPNTAIESEAIKNFKKNPLMFD

SEQ ID NO: 20111 - DNA, 513 bp, Unknown
  Obtained from environmental sample
  misc_feature (1)..(513): n is a, c, g, or t
atgagaaaaatattatttacttgtttcttgctaatactttcactttttagttatgctcaaaacaacgtcgaaatttctttacaacaagatttaagactcttcttagttggagatcaaaaaggaaacgcccctttaactacaaacatcttatctaaaattgaagtacctgtttataatcttcaagaaagtcacttagctacttatatatctctagagtatgccgatctgattggaaaaaactttaaaagatatgctataggtgcaggatatgttgttaaaagcatttatagaaaaattggtgctggtatctatttagattatggaaaaatttacagacaagaagaaggtttttctagctttagcctaagtggagaacttaattttagaataaacgataaactaaaatttatttgtacacaacaacttactcaaagaaaagatttaaaagttctgtataacagctctaacgaatatgttattagtgggtttgttggtctaaaatatagcttataa

SEQ ID NO: 20112 - protein, 170 aa, Unknown
  Obtained from environmental sample
  SIGNAL (1)...(19)
  misc_feature (1)..(170): Xaa is any amino acid
MRKILFTCFLLILSLFSYAQNNVEISLQQDLRLFLVGDQKGNAPLTTNILSKIEVPVYNLQESHLATYISLEYADLIGKNFKRYAIGAGYVVKSIYRKIGAGIYLDYGKIYRQEEGFSSFSLSGELNFRINDKLKFICTQQLTQRKDLKVLYNSSNEYVISGFVGLKYSL

SEQ ID NO: 20113 - DNA, 417 bp, Unknown
  Obtained from environmental sample
  misc_feature (1)..(417): n is a, c, g, or t
ttgataaccaaaaatgccaccaaaaaaatatctacctgcaaaaaccttcaaactacagaccattatgaggttaacaagtacctcattcgagtcaatactactgaatattatgaagacccagaattatggtattgggagcaattgagctatctattaaaagatggattttcagtccctattgaaatcaaaagagcagatttaacatctgacatgtatatatcagcatcctttaaaagtagaaatgcggacttaagagcacaagctatacctgaccatcaagtgcaattgatgttaaatggttccattattaccacctatgactggaatggtaaagctagattcaacagtgacaaggttaaaattccaactgaattattgaaaccagaggatcaatataataacatttatggttcctaa

SEQ ID NO: 20114 - protein, 138 aa, Unknown
  Obtained from environmental sample
  misc_feature (1)..(138): Xaa is any amino acid
MITKNATKKISTCKNLQTTDHYEVNKYLIRVNTTEYYEDPELWYWEQLSYLLKDGFSVPIEIKRADLTSDMYISASFKSRNADLRAQAIPDHQVQLMLNGSIITTYDWNGKARFNSDKVKIPTELLKPEDQYNNIYGS

SEQ ID NO: 20115 - DNA, 303 bp, Unknown
  Obtained from environmental sample
  misc_feature (1)..(303): n is a, c, g, or t
atgataacaaatccattatttaaaaaatccactgaagtattggctgatttttacaatgataagggtataaaagcagcaatagttgataccgaacaaatttatcaaaaatattcgtatggggtaagagagttatattctataaaagacttaatcaaagaagttcatactaaaggaaaaggcaaacttaaacatgtattattggtaggtgattcgagttgggattggcgtgataatggagaaacaatcatactatgcacagaacatacttggatatatactaattgttcacaaaatacaccctga

SEQ ID NO: 20116 - protein, 100 aa, Unknown
  Obtained from environmental sample
  misc_feature (1)..(100): Xaa is any amino acid
MITNPLFKKSTEVLADFYNDKGIKAAIVDTEQIYQKYSYGVRELYSIKDLIKEVHTKGKGKLKHVLLVGDSSWDWRDNGETIILCTEHTWIYTNCSQNTP

SEQ ID NO: 20117 - DNA, 498 bp, Unknown
  Obtained from environmental sample
  misc_feature (1)..(498): n is a, c, g, or t
gtggaagcattacttcacttttattatgccctaatttttggtatttttaccacatacacagttaaagtgaaagaaaaatacgacattgttattattggtagtggtttgggcggattggtttcggcaaatatcttggcacgccatggttatcgtgtatgtgtattggagaaaaacaatcaatttggaggtaatttgcaaatatttattagagataaaaaaatatttgatacaggtgtacattatatcggaagtttagataaagggcaaaatctttatagttattttaaatatttaggcattatggatgacctgaaacttcaaaagttagatgtagataaatatgatgttatcacttttgatcatacagaacacgagttttaccatgcacagggttataaaaattttacaaaatcattgatcaagcaattccccgaagaggaaaaagcgattcatgcttattgtaaaaaagtgcaagctgcctgtaatagttttcccggg

SEQ ID NO: 20118 - protein, 166 aa, Unknown
  Obtained from environmental sample
  misc_feature (1)..(166): Xaa is any amino acid
MEALLHFYYALIFGIFTTYTVKVKEKYDIVIIGSGLGGLVSANILARHGYRVCVLEKNNQFGGNLQIFIRDKKIFDTGVHYIGSLDKGQNLYSYFKYLGIMDDLKLQKLDVDKYDVITFDHTEHEFYHAQGYKNFTKSLIKQFPEEEKAIHAYCKKVQAACNSFPG

SEQ ID NO: 20119 - DNA, 603 bp, Unknown
  Obtained from environmental sample
  misc_feature (1)..(603): n is a, c, g, or t
ttgcagatcatcaacctcgacaacattaccaaaattttagccccgcttaccaatactgtagtgttggccagtatcgactatcgtcagaataaaatcgctaaaacttgcaaagaattaaagattccctgcgttcaaaccagtgaatacacccttaaaactcggttacaaatagtaaaatctgaaaagaaaaacctgattaaacgttggcgaacctacctatgggagtacttccaagaaaaaaataatattcaatcagtgagcgaagcaagcggagttcagtgcaatggaacaccaanctatgaagcctataaaaacttaaataaaaactgcttactgtattttgactcccgagtaaatcaagacagcattatttccactgaagcattaacacaacgaatatcgacacttaattctaataagcctatcagattggttttttcagggcggcttaatgcaatgaaaggcgctgatcacctagttcattttgccaaagagctaaaaaatctcggcgtaaactttcacttaaccatttgcggtgacggcgaagcaacccagatattagcaggctattacagatataaattaaaaaagcggtttaattag

SEQ ID NO: 20120 - protein, 200 aa, Unknown
  Obtained from environmental sample
  misc_feature (1)..(200): Xaa is any amino acid
MQIINLDNITKILAPLTNTVVLASIDYRQNKIAKTCKELKIPCVQTSEYTLKTRLQIVKSEKKNLIKRWRTYLWEYFQEKNNIQSVSEASGVQCNGTPXYEAYKNLNKNCLLYFDSRVNQDSIISTEALTQRISTLNSNKPIRLVFSGRLNAMKGADHLVHFAKELKNLGVNFHLTICGDGEATQILAGYYRYKLKKRFN

SEQ ID NO: 20121 - DNA, 360 bp, Unknown
  Obtained from environmental sample
  misc_feature (1)..(360): n is a, c, g, or t
ttgcgcactccgaccctttactatgagcgtatcgtctcaaatatggtttccaatgcgatcaagtactcgccaaaaggcaaagatgtcagaatcgcattgcggatcaaccaaaaccgaattgaaaccatggtaaaggatgaaggtcccggaatcagcaccgatgaccaaaagaaaatgttcggaaagtttcagcgcctgagtgccagacctaccggcggcgaaagctcaagcggattgggactcgcaatcgtgaaatcgtttgccttgcagattggcggtgagatcaaggtgaagagtatgcttgggaaaggtgcagaattcgtgctgtctatcccttcctcaaattccagtcaaccgtaa

SEQ ID NO: 20122 - protein, 119 aa, Unknown
  Obtained from environmental sample
  DOMAIN (3)...(114): Histidine kinase-, DNA gyrase B-, and HSP90-like ATPase
  misc_feature (1)..(119): Xaa is any amino acid
MRTPTLYYERIVSNMVSNAIKYSPKGKDVRIALRINQNRIETMVKDEGPGISTDDQKKMFGKFQRLSARPTGGESSSGLGLAIVKSFALQIGGEIKVKSMLGKGAEFVLSIPSSNSSQP

SEQ ID NO: 20123 - DNA, 579 bp, Unknown
  Obtained from environmental sample
  misc_feature (1)..(579): n is a, c, g, or t
atgacagcaaattataatgccaacgctggaaacagcggagtgacgtcaagtgctgttaacgtagccgatttacctgcgcctgtttataataaacttagagttgtaggtataagcgcaaacctagtccaacaagacaagatcacccaagaacttatctataccgctaaagtagaaaagttcgaaaatgacgaatggaaaccgacaacagacttagaagagacacagaagcttcaactcaactggtatttcattaaaaataatgatgagatggataccgacatactgacagataatgccaccgatgatgatatagaaatagacggcttgaaaatgatcgtaaacattcaagatgataacctagagaagttcggacacgctcactgcttcgtcaatagtcctgacgaagaaggccacatcttcacagaactcaaacgccaacttaatgttgaagaagtcctaggcaagaatgtactcgatgttaacgcaagcaaagtaaactaccgagttcaactaaacatagacaatccaacagcagatgagataaaaaacctaaaagtagaaatctatgaaaaagactcn

SEQ ID NO: 20124 - protein, 193 aa, Unknown
  Obtained from environmental sample
  misc_feature (1)..(193): Xaa is any amino acid
MTANYNANAGNSGVTSSAVNVADLPAPVYNKLRVVGISANLVQQDKITQELIYTAKVEKFENDEWKPTTDLEETQKLQLNWYFIKNNDEMDTDILTDNATDDDIEIDGLKMIVNIQDDNLEKFGHAHCFVNSPDEEGHIFTELKRQLNVEEVLGKNVLDVNASKVNYRVQLNIDNPTADEIKNLKVEIYEKDS

SEQ ID NO: 20125 - DNA, 423 bp, Unknown
  Obtained from environmental sample
  misc_feature (1)..(423): n is a, c, g, or t
gtgcattacgtaaaatcgtcgcatttgaaggaaattgaaaagacggtacaaaaggcaatgaagttgggcgatggcggcgagcgtcctgaaaatgacattgaagccatgggcaagacactcgatcgatccggcattgcacctaaggccattgttctgattgctgacaacaatagtccggttcgggatctttcgcttttcaataaactgcgggcacaaaaagtcccggtatacgtgattgtatgcggtgctattcatgggtttgtcagcgtagagtatttggaaattgcgcgccgaaccaagggcaaagtgtttacgatggaaggtgaattggcgggcttgctggatctgaatgaaggagaaaccatcgaggttggcacgcaaaaatttattgttagggacagaaagctggttttgactcggtag

SEQ ID NO: 20126 - protein, 140 aa, Unknown
  Obtained from environmental sample
  misc_feature (1)..(140): Xaa is any amino acid
MHYVKSSHLKEIEKTVQKAMKLGDGGERPENDIEAMGKTLDRSGIAPKAIVLIADNNSPVRDLSLFNKLRAQKVPVYVIVCGAIHGFVSVEYLEIARRTKGKVFTMEGELAGLLDLNEGETIEVGTQKFIVRDRKLVLTR

SEQ ID NO: 20127 - DNA, 795 bp, Unknown
  Obtained from environmental sample
  misc_feature (1)..(795): n is a, c, g, or t
ttgataaaaaatagaatttatcgagatccatacgatactctagatggtaaaagatcgaaagtagttgatcaactcgatctcgtgtatttcgctaaatgcgcttattgtgagcggatatgcaaagcggatgtcgagcactaccggccgaaaaaagcggtgaaagaagattccactcatgagggctattattggctgtgttatgagtggagcaatcttattccttcatgtatcacttgtaaccgcgaaggggccaagcacaataaattctcaatcgctggcacccgcgtagcagcaccgccctttttacctgatggcacccttgatttttcgttgatgaaagccaattgtgcaattctcaaaaatgaaatcccagacttattacaccctgaggttgatcctccagatgacttttttgagtttgaggccgaccctgccggcgagggaatcagaattaaggggaaggatgcaggtaaccgaggtgaaaaaactatcgatatttgcaagctgaaccgtaaggaactgaaactcatgcgtcaaaaacatatcgttgatgactttacggaaactgttcattgcatttttcaacaacacaccttcaatcagcgcagtaaacgtgaattgaaaagcggtattcacgatgcgttacacgcactccatcgaaaaagtcaaaatgaaacctttgatttcacttttctaagaaaatatgtcatcgaaaacaaagataactttaagaagatcgtgattcccttcttggaaaaaggtgttcaacaggtgaccttgaccgcatttgaangt

SEQ ID NO: 20128 - protein, 265 aa, Unknown
  Obtained from environmental sample
  misc_feature (1)..(265): Xaa is any amino acid
MIKNRIYRDPYDTLDGKRSKVVDQLDLVYFAKCAYCERICKADVEHYRPKKAVKEDSTHEGYYWLCYEWSNLIPSCITCNREGAKHNKFSIAGTRVAAPPFLPDGTLDFSLMKANCAILKNEIPDLLHPEVDPPDDFFEFEADPAGEGIRIKGKDAGNRGEKTIDICKLNRKELKLMRQKHIVDDFTETVHCIFQQHTFNQRSKRELKSGIHDALHALHRKSQNETFDFTFLRKYVIENKDNFKKIVIPFLEKGVQQVTLTAFEX

SEQ ID NO: 20129 - DNA, 486 bp, Unknown
  Obtained from environmental sample
  misc_feature (1)..(486): n is a, c, g, or t
ttgagtgaattggtgccgggatatgcacaagcaattggattcgaaagcgctgcgagaaaagcagaaaccaacaatcctattagtatacaagacaatcatgacagtgatgagattataattcataccgatgaagaggatatcgtttattttgaaatatccagagaacaattagaaaccgctatgatggttgcgagggagaactatgaaaatatgtccgataatcttaaggaaatgaggaatccatatattgatttaaataatgactcaagatcaaatgccaggattcaaaaggatgtatcccccctttcacttccggaagaatttaaaattgatccttataagaaaagcgtattctggcaaaaaattgatgctgaacctgaatatagagaagaaataatgcagttggttaaatccaatctggaaaaggccatgcatacgcataaaaagtatgcacataaatttacggatctaaaactaaaggaatag

SEQ ID NO: 20130 - protein, 161 aa, Unknown
  Obtained from environmental sample
  misc_feature (1)..(161): Xaa is any amino acid
MSELVPGYAQAIGFESAARKAETNNPISIQDNHDSDEIIIHTDEEDIVYFEISREQLETAMMVARENYENMSDNLKEMRNPYIDLNNDSRSNARIQKDVSPLSLPEEFKIDPYKKSVFWQKIDAEPEYREEIMQLVKSNLEKAMHTHKKYAHKFTDLKLKE

SEQ ID NO: 20131 - DNA, 732 bp, Unknown
  Obtained from environmental sample
  misc_feature (1)..(732): n is a, c, g, or t
ttgggattcacaagagctggtcagcagatgggtggaactcttgaactggagagtgaaaaaggaataggcagtactttctattttgaactggcttttccgatatcggcaaataaaggatcatcggtgtctgaaaaacagaagatcttcactaatctgagtgatatcaaaatccttgtagtggatgatgacgaacttaaccagcaagtaatcagggggttattggagcgtcatcaattgtctgtagatattgcctgtagtggacaggaggctatagataaattgaaagtagatcactacgacctggtgttaatggatattcagatgccagcaatggatggatatgaaacaacccgaaagatcagaaaattgcaactgcgtaatagattgccgatcatcgcattgacagcgaatacaatgcctggcatccaggaaaaatgtttgaaagcagggatggatgactatatttccaagcctattgatagcgggattttattaaaaaagatagagtccctgtttggatgtgaagagctggcaacaccggttaaatcggagaagatgtcaaccaaaaatggtgcgctgctctctttgttgctggatttgcccggtgtcaacgcaaagcaggctattgatcgcctggatattgacccggttgattatctgaggttattaaagcagtttgcatcaaaccataaaaacgatataacaaaatctggcgaaagggatagaagnnnn

SEQ ID NO: 20132 - protein, 244 aa, Unknown
  Obtained from environmental sample
  DOMAIN (55)...(176): Response regulator receiver domain
  misc_feature (1)..(244): Xaa is any amino acid
MGFTRAGQQMGGTLELESEKGIGSTFYFELAFPISANKGSSVSEKQKIFTNLSDIKILVVDDDELNQQVIRGLLERHQLSVDIACSGQEAIDKLKVDHYDLVLMDIQMPAMDGYETTRKIRKLQLRNRLPIIALTANTMPGIQEKCLKAGMDDYISKPIDSGILLKKIESLFGCEELATPVKSEKMSTKNGALLSLLLDLPGVNAKQAIDRLDIDPVDYLRLLKQFASNHKNDITKSGERDRXX

SEQ ID NO: 20133 - DNA, 819 bp, Unknown
  Obtained from environmental sample
  misc_feature (1)..(819): n is a, c, g, or t
ttgacttcggtcagtattgagtacgtaaaacaaccccatgaggacgtgcccgccatagcggtatattacaaggtgttgctaaccttgacggaaagcgaaaatgaggaacattataaggaacttaagcaagtgctaaccaaatggaatgatagttttcctgttggggagttaagggatacatggggctttgcgcaaaactattgcatccgtaaaattaacacgggtaatgcaggttattttcaggaactgtttaccaactacacctttctacttgaaaaagaaattattatcgagaatggttttcttgctcaattcgattttaagaacatagtaaccattgccctaaggcttaaagaattcggctgggtagagacctttattgccaaatacagcgatttgctggagccaacccatcgtgcaaatgccattgcttataaccaagcgcgattgcattacagcagaaatcaacacaaggaagccctgaggcagctgttatcggtggaatttacggatgtgtattaccaccttgattcaaaagtgctattacttaaaatatactatgagctggatgattacgaacccttactgtctttgattgatacctttatggtttacctgcgcaggaacaagttgatatccgattaccaaaaactgatttacaccaattttgcccgttttgttaaaaaaatgacccgtataaaactgggtagcaaaaagtcagtaaaggaaataggtgtagaaatggatatagtgaaacaaatagncgacatcaattggntcaaagagaaagtggatgaactacagacatctcaagcatga

SEQ ID NO: 20134 - protein, 272 aa, Unknown
  Obtained from environmental sample
  misc_feature (1)..(272): Xaa is any amino acid
MTSVSIEYVKQPHEDVPAIAVYYKVLLTLTESENEEHYKELKQVLTKWNDSFPVGELRDTWGFAQNYCIRKINTGNAGYFQELFTNYTFLLEKEIIIENGFLAQFDFKNIVTIALRLKEFGWVETFIAKYSDLLEPTHRANAIAYNQARLHYSRNQHKEALRQLLSVEFTDVYYHLDSKVLLLKIYYELDDYEPLLSLIDTFMVYLRRNKLISDYQKLIYTNFARFVKKMTRIKLGSKKSVKEIGVEMDIVKQIXDINWXKEKVDELQTSQA

SEQ ID NO: 20135 - DNA, 753 bp, Unknown
  Obtained from environmental sample
  misc_feature (1)..(753): n is a, c, g, or t
gtgggggttccaatacctttctcggaggagaaacattttgaaaaacattatttctctcgttctcacaaagtctattctgacaagcttgccaaactggtagtaagaatggatgctgcctcaaaaggcaaagtgctgaataggctgacttcgatatacccccacatttttattgatgaagctcaagacttggcaggttttgaccttgaagtaattcgacttcttgcaattgatgcaactactcttactatgtcctgtgacccaagacaagtcacctatctaacacataatcccaagaaatttaagaagtaccgcaatggtcgactaaaagattatctattagaagaatgtgatgatttagcgttttcgattgacgaaacgacccttgctaaatcacaccgttgcaatgatttgatatgcaagttctcaaatagcctttaccctgagattgagccatgtgaaacgaataataacatcgaaacagatcacgatggagtctttcttgtagttccggaaaaaattgatcagtatctactacagtactctcctacccaattacgttggaatgtcggtgaaatggatataagaaaagagtttgaggcgctcaatattggtcaagcaaaaggactttcgtttgaccgagttctaatctatccgactgaaagcatgattgattggatagtggacaacaaatttaaattgaaagaaggaacaagagccaaattatatgttgccattacacgtgcgagatattna

SEQ ID NO: 20136 - protein, 251 aa, Unknown
  Obtained from environmental sample
  misc_feature (1)..(251): Xaa is any amino acid
MGVPIPFSEEKHFEKHYFSRSHKVYSDKLAKLVVRMDAASKGKVLNRLTSIYPHIFIDEAQDLAGFDLEVIRLLAIDATTLTMSCDPRQVTYLTHNPKKFKKYRNGRLKDYLLEECDDLAFSIDETTLAKSHRCNDLICKFSNSLYPEIEPCETNNNIETDHDGVFLVVPEKIDQYLLQYSPTQLRWNVGEMDIRKEFEALNIGQAKGLSFDRVLIYPTESMIDWIVDNKFKLKEGTRAKLYVAITRARYX

SEQ ID NO: 20137 - DNA, 375 bp, Unknown
  Obtained from environmental sample
  misc_feature (1)..(375): n is a, c, g, or t
ttgaccactataattaatgtaaatatgaattcaaatcctaaaatagcggtttttggtggaggaagttgggcaacggcaattgtaaaaatgttaaccgaaaatttagaaaatgttggttggtatatgcgcaatgtttctgcaattgaacacattaaaaaattccataataatccaaattatttaagttctgctgaactaataccagaaaaattagacatatctaacgatataaattattttgtaagtaattatgatgttttaatatttgtaattccgtctgcttttttaaaatctgaattagaaaaaataacagtttcttttgatgataaaatattttttctgcaattaaaggaattgtaccagaaacaggattaa

SEQ ID NO: 20138 - protein, 124 aa, Unknown
  Obtained from environmental sample
  misc_feature (1)..(124): Xaa is any amino acid
MTTIINVNMNSNPKIAVFGGGSWATAIVKMLTENLENVGWYMRNVSAIEHIKKFHNNPNYLSSAELIPEKLDISNDINYFVSNYDVLIFVIPSAFLKSELEKITVSFDDKIFFLQLKELYQKQD

SEQ ID NO: 20139 - DNA, 465 bp, Unknown
  Obtained from environmental sample
  misc_feature (1)..(465): n is a, c, g, or t
atgcttaacgaaatcggcgatgtgaaaaacatcccggaatatgttgcaaaagcaaaagacaagaacgatccgttccgcctgatgggctttggtcaccgcgtttacaaaaactacgatccgcgcgccaaagtcatgcaggaaacctgccacgaagttctcaaagaactcaacgtcagcgatccgttgcttgacgttgcgcaggaacttgaacgtattgcacgtgaagacgagtacttcatcgagaagaaactctatccaaacgtcgatttctactcgggcatcatctttaaggcgatgggcattccggtcagcatgtttaccgtgctgttcgcggttgcacgtaccgtcggctggatcgcccagtggaaagaaatgatcgaagatccttcgcagaaaatcggtcgtccgcgtcagctgtttaccggcgtcgcagaacgtccgtttgttccggtcgacaagcgttaa

SEQ ID NO: 20140 - protein, 154 aa, Unknown
  Obtained from environmental sample
  DOMAIN (1)...(136): Citrate synthase
  misc_feature (1)..(154): Xaa is any amino acid
MLNEIGDVKNIPEYVAKAKDKNDPFRLMGFGHRVYKNYDPRAKVMQETCHEVLKELNVSDPLLDVAQELERIAREDEYFIEKKLYPNVDFYSGIIFKAMGIPVSMFTVLFAVARTVGWIAQWKEMIEDPSQKIGRPRQLFTGVAERPFVPVDKR

SEQ ID NO: 20141 - DNA, 426 bp, Unknown
  Obtained from environmental sample
  misc_feature (1)..(426): n is a, c, g, or t
ttgggcgaatttaatctagaaacctatctgtctttaaaaaagaacttaggcaacagttatattttaaaaacctattggtaccacaataaacttgtaggttttatgtcgggtttaataaataacgatgctttagatgcgcattttgttggcatcgattatgctgtaaataaagagttggccatttaccaacgcatgttgtatgattatgttcaaatagcgatacatcaacaattaaaagtaattaattttggaagaacagcaagcgaaattaaaacatcaattggggcagttccgcaaggtttaacctgttatatccgtcataaaaaatcgataacaaacaaatttataaagcattttttaagctatatagaaaccaaaccgtttaagcagcaaaatccttttaaatctaaaactttaacccagtaa

SEQ ID NO: 20142 - protein, 141 aa, Unknown
  Obtained from environmental sample
  misc_feature (1)..(141): Xaa is any amino acid
MGEFNLETYLSLKKNLGNSYILKTYWYHNKLVGFMSGLINNDALDAHFVGIDYAVNKELAIYQRMLYDYVQIAIHQQLKVINFGRTASEIKTSIGAVPQGLTCYIRHKKSITNKFIKHFLSYIETKPFKQQNPFKSKTLTQ

SEQ ID NO: 20143 - DNA, 441 bp, Unknown
  Obtained from environmental sample
  misc_feature (1)..(441): n is a, c, g, or t
atgaaaaaattcatattctcggtactaactttattgctagttgggctttctgcgcctataaaagcacagaatagtggcgatccagaaacaatgtttaaaaaacacatcaacaaaatggttgaaagtgttgaaaaaacagacgctccagatgagaaaagagtgatcttaaataattcttttgatgatttaataggagctattgaaaaagtagaatctatgaaggctgttcctgaaactgataaagaaggtctcgcggtatttaaagctgatattcaggaaaagaaaaatgagcttaatggagtaaacgggtttagtcctgttgctaataataaccttaacaattttgccaattttgttcaacaagaccttgagcaagctgatacggtaacgattggagtaactactcttctattaatcattatccatttattactgctttga

SEQ ID NO: 20144 - protein, 146 aa, Unknown
  Obtained from environmental sample
  SIGNAL (1)...(17)
  misc_feature (1)..(146): Xaa is any amino acid
MKKFIFSVLTLLLVGLSAPIKAQNSGDPETMFKKHINKMVESVEKTDAPDEKRVILNNSFDDLIGAIEKVESMKAVPETDKEGLAVFKADIQEKKNELNGVNGFSPVANNNLNNFANFVQQDLEQADTVTIGVTTLLLIIIHLLLL

SEQ ID NO: 20145 - DNA, 306 bp, Unknown
  Obtained from environmental sample
  misc_feature (1)..(306): n is a, c, g, or t
gtggaagttacaagcgactcggggttggctaacaaagcttggttccagttttcggaagaaggggagttcggtattgatgcttcaaatgcttaccaattcaacccactttcctctcactatgtaagtttatcatcgattcttaatgacaccacaaaactcgatatcggtagtctgccttttattacggaagtcatcgagataccgctcgaacttaaaagaagcgtatgtatttacggtaactcaatcaaaagcaaaggctgcgcagagcttaaacaccgtgccaagtattgcgagtgtggtaagtaa

SEQ ID NO: 20146 - protein, 101 aa, Unknown
  Obtained from environmental sample
  misc_feature (1)..(101): Xaa is any amino acid
MEVTSDSGLANKAWFQFSEEGEFGIDASNAYQFNPLSSHYVSLSSILNDTTKLDIGSLPFITEVIEIPLELKRSVCIYGNSIKSKGCAELKHRAKYCECGK

SEQ ID NO: 20147 - DNA, 408 bp, Unknown
  Obtained from environmental sample
  misc_feature (1)..(408): n is a, c, g, or t
atgcgtcaaccatttgatgtaatgccaggagcggaaggttggcaattgtcgaatccaccaatattatcgatggcagcaattaaagcatctttagatatgtttgctgaagttggcatggaagcattacgagaaaaatcagaaaaattaactggttattttgagtttttaattcatgaaatgaattcagatagtataaaaatcatcacaccaaaaaatccaaaagaacgcggttgtcaattatcaattcaagtaaagaatgcggataaaaggttgcataaaaagctaaccgaaaataatatcattacagattggcgagaaccagatgtaattcgctgtgcacctgtaccaatgtataacagttttgaagatgtgtatagaatggtggaagttttaaaaggattgttgtaa

SEQ ID NO: 20148 - protein, 135 aa, Unknown
  Obtained from environmental sample
  misc_feature (1)..(135): Xaa is any amino acid
MRQPFDVMPGAEGWQLSNPPILSMAAIKASLDMFAEVGMEALREKSEKLTGYFEFLIHEMNSDSIKIITPKNPKERGCQLSIQVKNADKRLHKKLTENNIITDWREPDVIRCAPVPMYNSFEDVYRMVEVLKGLL

SEQ ID NO: 20149 - DNA, 327 bp, Unknown
  Obtained from environmental sample
  misc_feature (1)..(327): n is a, c, g, or t
atgaaatacgaaatattacaatcaactaattattaccatatatttaatcaaggaaataatggagaaaatatatttattgaagatattaattatgcttattttttagagttgataaaaaagcatttacttccggttgttaatatattatcatattgtttgttaaaaaatcattttcatttattagtttatgtaaaagaaattgagaacgaagaaaaagtatcacaatcattttctaatttttttaattcatattcaaaatcaatcaataaaaaatataaaagaagtggtagtttatttagagatcgatttaagagaattagggnttga

SEQ ID NO: 20150 - protein, 108 aa, Unknown
  Obtained from environmental sample
  DOMAIN (50)...(103): Protein of unknown function (DUF1568)
  misc_feature (1)..(108): Xaa is any amino acid
MKYEILQSTNYYHIFNQGNNGENIFIEDINYAYFLELIKKHLLPVVNILSYCLLKNHFHLLVYVKEIENEEKVSQSFSNFFNSYSKSINKKYKRSGSLFRDRFKRIRX

SEQ ID NO: 20151 - DNA, 567 bp, Unknown
  Obtained from environmental sample
  misc_feature (1)..(567): n is a, c, g, or t
ttgattggtgagtacatagataagcagagagattacgtacgcaagagttatttaaacttagcaaaggagtcaaacctagaaggtgaagtaaataatgacatgttacttatttacgaaaccattgatcatagcgacgatttacaaacaatgttaaaaagtcctattatcaaatcatcaaataaaaggaacgttttagaagctctttttactggaaaaataaatgctctttctttagggttatttcatttactagatgataataaacggatggtaatgttagggcaaatagcacaacaatataccattatttataacttcttaaaattgaaagatacagctattgttacaactgctgttcctttaacaaccgatttagaagcacaaattttaaagaaagtaattgaacttactgggaataaaacaagtatagaaaacagagtagatccaaaaattattggaggatttatcttacgtgtaggagatatgcaatatgacgcaagtctctcaaacaattttagtgaattaagaaaggaatttgacaacagtcattatattccaaaaatttaa

SEQ ID NO: 20152 - protein, 188 aa, Unknown
  Obtained from environmental sample
  DOMAIN (13)...(179): ATP synthase delta (OSCP) subunit
  misc_feature (1)..(188): Xaa is any amino acid
MIGEYIDKQRDYVRKSYLNLAKESNLEGEVNNDMLLIYETIDHSDDLQTMLKSPIIKSSNKRNVLEALFTGKINALSLGLFHLLDDNKRMVMLGQIAQQYTIIYNFLKLKDTAIVTTAVPLTTDLEAQILKKVIELTGNKTSIENRVDPKIIGGFILRVGDMQYDASLSNNFSELRKEFDNSHYIPKI

SEQ ID NO: 20153 - DNA, 402 bp, Unknown
  Obtained from environmental sample
  misc_feature (1)..(402): n is a, c, g, or t
ttgttctcaaaagaagatttttttaactctgatgttgttttaaatcaacttaaagatgttgttgattacattgttttggctgggtttttattaaaaattccatctaccattattgatgcatacccaaataaaatcatcaatatccaccctgcattattaccaaaatatggcggaaaaggaatgtacggaatgcatgtacataatgcagtaaaagaaaataaagactctgaaactggaattaccattcattttgtaaatgaaaattatgatgaaggcgctatcatttttcaagcaacaacaaaacttaaaagttctgattccgcagaagttattgctcaaaaaattcataccttagagtatgcacattttccgaaagtaatagaatcggtaattttacaataa

SEQ ID NO: 20154 - protein, 133 aa, Unknown
  Obtained from environmental sample
  DOMAIN (2)...(127): Formyl transferase
  misc_feature (1)..(133): Xaa is any amino acid
MFSKEDFFNSDVVLNQLKDVVDYIVLAGFLLKIPSTIIDAYPNKIINIHPALLPKYGGKGMYGMHVHNAVKENKDSETGITIHFVNENYDEGAIIFQATTKLKSSDSAEVIAQKIHTLEYAHFPKVIESVILQ

SEQ ID NO: 20155 - DNA, 582 bp, Unknown
  Obtained from environmental sample
  misc_feature (1)..(582): n is a, c, g, or t
ttggtgaaattaccctttcaaaacttaagatctgaaggagaaattaatgaacgtgattttttagacagagcagagctactatgttctttgggacaaaatgtaatgattactaactttcaggagtattataaattagtagagtatttttctgaatttaccaaagctaggatgggactggcaatgggagtttataatttaatcgaaatttttgatgaaaaatattatcgaaatttaagtggtgggattctagaagcttttggaaaactattctttaaagatctaaaagtatatttgtatccattaaaaaatcatgaaactggagaattaatgactagtgagaatttaaaggtacatcctcgtatgaaagaactttacaaattctttaaatacaatggaaagatgttagatattaaagattttaatccagatatcttagacattttatctagaaatgttcttaagatgattgttaacggagaaaaaggttgggaagaaatgcttccagaaggtattcccgaaattattaaagaagaacgtttatttggctacagcaaaagaaattttaaaaataaaaagatctaa

SEQ ID NO: 20156 - protein, 193 aa, Unknown
  Obtained from environmental sample
  misc_feature (1)..(193): Xaa is any amino acid
MVKLPFQNLRSEGEINERDFLDRAELLCSLGQNVMITNFQEYYKLVEYFSEFTKARMGLAMGVYNLIEIFDEKYYRNLSGGILEAFGKLFFKDLKVYLYPLKNHETGELMTSENLKVHPRMKELYKFFKYNGKMLDIKDFNPDILDILSRNVLKMIVNGEKGWEEMLPEGIPEIIKEERLFGYSKRNFKNKKI

SEQ ID NO: 20157 - DNA, 381 bp, Unknown
  Obtained from environmental sample
  misc_feature (1)..(381): n is a, c, g, or t
atggatgttgagaccgatggctctgttaatgctaaagaagctttgacaattgctggtaagattctcaaagaacatatcgaaaagttcatcaccgaaaaaattgacgagcctttcactcaagaagaagaagaagtggatgctgaaaagcaacgcgtagcaaatcttttacgtacaagtattgaagatttgaacttgagtgttcgtgcttataattgtttgaaatcagctaatatcaatagtattggcgaattggtttctcgtgatgagcaagatcttctgaaattccgaaacttcggtaagaagtctcttacagagcttcttgaggtaattgaagagaaaaatcttcagttcggaatggatgtatcaaaatatttggactaa

SEQ ID NO: 20158 - protein, 126 aa, Unknown
  Obtained from environmental sample
  DOMAIN (45)...(112): Bacterial RNA polymerase, alpha chain C terminal domain
  misc_feature (1)..(126): Xaa is any amino acid
MDVETDGSVNAKEALTIAGKILKEHIEKFITEKIDEPFTQEEEEVDAEKQRVANLLRTSIEDLNLSVRAYNCLKSANINSIGELVSRDEQDLLKFRNFGKKSLTELLEVIEEKNLQFGMDVSKYLD

SEQ ID NO: 20159 - DNA, 708 bp, Unknown
  Obtained from environmental sample
  misc_feature (1)..(708): n is a, c, g, or t
ttgagggccggagctttgaatcggctgagaatagataaatgtatgagttcagggagatgtactgcggcgaatcctggcggaggcaccatcgatccattgtacgtgatcatgggggccctgcgtgaatattttggcggatacattttgaacaaaaatgtaattggctctttttacgggaacgaatttgataaagctcaaatattcaaagtattgtgtcaatattatctgagttcggtaggaatggaagacgatgtagagttttatacatctgagtcaggacattcccagattggatccaaattgatttgtgcaaagctcgcagaacagttcatggtaagtgaaaaggattttggtccacgtaaaggataccgattgcccccggaagatgacttgtacaaatccgcaaaggagttgactggaaacagccagtccttatacaattttaagcggtacagttatcttttgggaatcacgatcaaaaacaaacttgaaggcaagccggcgatcaattttgccaatgctggccacaaggcgcaattggcgattgatatatttaaggatttcaacgcatttggtgatcggtcaattagggtcgactattttttcggagtcccacgcgtgacacgaattaccatttcgaaagagaacctgatttggactgaaatcgagagatttaaaacccaaattggggtgcgtgactacgaataa

SEQ ID NO: 20160 - protein, 235 aa, Unknown
  Obtained from environmental sample
  misc_feature (1)..(235): Xaa is any amino acid
MRAGALNRLRIDKCMSSGRCTAANPGGGTIDPLYVIMGALREYFGGYILNKNVIGSFYGNEFDKAQIFKVLCQYYLSSVGMEDDVEFYTSESGHSQIGSKLICAKLAEQFMVSEKDFGPRKGYRLPPEDDLYKSAKELTGNSQSLYNFKRYSYLLGITIKNKLEGKPAINFANAGHKAQLAIDIFKDFNAFGDRSIRVDYFFGVPRVTRITISKENLIWTEIERFKTQIGVRDYE

SEQ ID NO: 20161 - DNA, 738 bp, Unknown
  Obtained from environmental sample
  misc_feature (1)..(738): n is a, c, g, or t
atgaaaagtattatctacatggccgcacttatcatactgagtgtaaaaggaacgagttacgctcaaccgttggtgctattgggttttggaaaaccatcctatcagctaaaagaagaaaaaaatcttccgcataggcatgtagtacacctggatgaaaagagaaacatcatggacattcggatgcgtggcttgttcgaatattcctacattaagaacatagacagtattctcaaagtctttatgcaagacatagaattttataaagattctcttgatggaatcggctccggcaatatgcgcatagcggccacatatttacctgatgattacgcccccagatttcgcttcaaaacatacgaatcggatggacaatattttgtaaaaaaggacggtgaaacttcttttttgaaaaccaaacaggataccatacatatttcaatcgtattcgaggtacctgattctgcagacagaaaaatatttcgctggagaagatacgcgcatacacatatctacttttacctaaacaaatacactgacatagaaacctatgtcaaagagggaaatcttcaacaatacatagacacaatgaaacaggctgccttacgtgaaactaaaggaaaaagcgcgatatttaccacattaatttacaatccatttttacgtaatgagaacgtaaaactgtctgcatctaagcatagacctcttgtagaacactcgctgaatcaagtatattcgnna

SEQ ID NO: 20162 - protein, 246 aa, Unknown
  Obtained from environmental sample
  SIGNAL (1)...(19)
  misc_feature (1)..(246): Xaa is any amino acid
MKSIIYMAALIILSVKGTSYAQPLVLLGFGKPSYQLKEEKNLPHRHVVHLDEKRNIMDIRMRGLFEYSYIKNIDSILKVFMQDIEFYKDSLDGIGSGNMRIAATYLPDDYAPRFRFKTYESDGQYFVKKDGETSFLKTKQDTIHISIVFEVPDSADRKIFRWRRYAHTHIYFYLNKYTDIETYVKEGNLQQYIDTMKQAALRETKGKSAIFTTLIYNPFLRNENVKLSASKHRPLVEHSLNQVYSX

SEQ ID NO: 20163 - DNA, 660 bp, Unknown
  Obtained from environmental sample
  misc_feature (1)..(660): n is a, c, g, or t
atgataaagagaaatggctccatgggaatgtcgaaaggcgccaacatggtaaacaagaagggcacgcactttaactcacagactggtaaggtcaacatccagaagcacccatggggtctctattcagactactgggagtggatgagtcccaaggatgatgagttgtggcacaccaatggtcgtatgaatgagatctggcagtcaggttttgatgacaccaagcgccgtccatacatcacccagcggtggccagaagcctttgttgaaatccatcctgatgatgcagccaaacgcggcattgagtctggtgacaaagtcatgctctactctgatcgtgtaccttacttcaaggacactatcaaggcagttcatggcagtgacttccagttcgatacgctgaagaaaaatggtcatatcgagctggacaaagcagcgattgagtctgtagctatcgtgacacctgcagtgaagcaaggcgtaatgtacagcaatatgctggatacacgtcagccttctaacagcctgcaggggcgagtgatagataacatcagtggtaactacaactacaaactgggtgtatgccgagtcaagaagatcggtgaatccgagtataagaaagactttagtaaaatgtcttttgcaccacgtaatgtagtgtaa

SEQ ID NO: 20164 - protein, 219 aa, Unknown
  Obtained from environmental sample
  DOMAIN (55)...(193): Molydopterin dinucleotide binding domain
  misc_feature (1)..(219): Xaa is any amino acid
MIKRNGSMGMSKGANMVNKKGTHFNSQTGKVNIQKHPWGLYSDYWEWMSPKDDELWHTNGRMNEIWQSGFDDTKRRPYITQRWPEAFVEIHPDDAAKRGIESGDKVMLYSDRVPYFKDTIKAVHGSDFQFDTLKKNGHIELDKAAIESVAIVTPAVKQGVMYSNMLDTRQPSNSLQGRVIDNISGNYNYKLGVCRVKKIGESEYKKDFSKMSFAPRNVV

SEQ ID NO: 20165 - DNA, 339 bp, Unknown
  Obtained from environmental sample
  misc_feature (1)..(339): n is a, c, g, or t
atgtcagaagaaaacatcatgctcgtcgaccaggaagaattgctgcgcatgaccaccgatgtcgtggcttcctacctgtcacacaattcgatgccagccgataatgtgcccganctgatccgctcggttcataccgcgatgaaagaagtgtccggcattgaattgaaacaggaaaacaaatcgaagccggccgtgtctgtcgcaaaatccatcagcgatgattacattgtctggctcgaagacggcaagaaactccaaatgctgaagcgtatttgcggtcgcaatacaaaatgtcgccagacgattattcgcggaaatggaatctgccttcagactaan

SEQ ID NO: 20166 - protein, 113 aa, Unknown
  Obtained from environmental sample
  DOMAIN (9)...(101): ROS/MUCR transcriptional regulator protein
  misc_feature (1)..(113): Xaa is any amino acid
MSEENIMLVDQEELLRMTTDVVASYLSHNSMPADNVPXLIRSVHTAMKEVSGIELKQENKSKPAVSVAKSISDDYIVWLEDGKKLQMLKRICGRNTKCRQTIIRGNGICLQTX

SEQ ID NO: 20167 - DNA, 885 bp, Unknown
  Obtained from environmental sample
  misc_feature (1)..(885): n is a, c, g, or t
ttgatcggctcgagcataccattgcttagtaataactatgaaattgatttagatgtgaagtttattggtcttgctgattatatagtgagcggatctgttgattttagctggacttcaaaacttaacttcacagaaaaagataaagctcaagatgctctcgaaacaggttcgtacgtataccttgctgatgaacttgaagaatttaagctcaccaaacctggtaaggacgaaaccactcttaacggaaacgtacagtgggcagcaactagaaccaagttctttactcaattcatcaagccgttacacaccaccgaaggcgccattcttacaggagaaattaccggcgagatagatagcccttcagtgcaataccactacacttctgcaattacttcagatgtttcaagtggagaatctctttcttaccagctttttgttggtcctttgaaatactacgacatcaagaaagttgatgaacatggttatgacatggtaaaagttggctacaactggttacgttttttctctgatccttttgtgcgttttatcattatcccattcttcacattctttagccaatttataggtaattacggtgttcttgttgtgatttttgccgctggtgtaaaacttgtcttaactccacttacgctaaaaagttatcgaagtatggcagctatgcgtgagcttcagccacaactgaaagagcttcaagagaagttcaaggacaanccacagaagcaacagcaggaaacgatgaagctgtataacaaggaaaaagtaaaccctcttggtggctgtttaccgaaccttttacaatttccaattttaattacgctttggagattttccaaaattctaatttgctacgtcaggagtcatnnn

SEQ ID NO: 20168 - protein, 295 aa, Unknown
  Obtained from environmental sample
  DOMAIN (196)...(295): 60Kd inner membrane protein
  misc_feature (1)..(295): Xaa is any amino acid
MIGSSIPLLSNNYEIDLDVKFIGLADYIVSGSVDFSWTSKLNFTEKDKAQDALETGSYVYLADELEEFKLTKPGKDETTLNGNVQWAATRTKFFTQFIKPLHTTEGAILTGEITGEIDSPSVQYHYTSAITSDVSSGESLSYQLFVGPLKYYDIKKVDEHGYDMVKVGYNWLRFFSDPFVRFIIIPFFTFFSQFIGNYGVLVVIFAAGVKLVLTPLTLKSYRSMAAMRELQPQLKELQEKFKDXPQKQQQETMKLYNKEKVNPLGGCLPNLLQFPILITLWRFSKILICYVRSHX

SEQ ID NO: 20169 - DNA, 459 bp, Unknown
  Obtained from environmental sample
  misc_feature (1)..(459): n is a, c, g, or t
atgttacaaataacaaaactaggtggacaacgtgttaaagatggattcttatttactacagcaagccctgntgaattatgttcaaaaaaagcttatcaattaggaataagaacgattttctatattgacccatatcctggaatttcacaagatcaaatattaaaaggtggctcaattagtacaaggcctataatgattcccttctctggtgcaattggaaatgcttacaataaactctatgaaacttttatgtcctataaagatgaagtttctatgacacttgaaataaaatcaaaaaacaaatttggaattcaattcaaaggaatattaaaaaaactcaaaagtaaagatgaaaatatttctaattatttaaaagaaaataaaaacattacagatgaagacgttatcaaactattatcagaagcaatagaaaaaagaaatgaaaaatcagaatcttaa

SEQ ID NO: 20170 - protein, 152 aa, Unknown
  Obtained from environmental sample
  misc_feature (1)..(152): Xaa is any amino acid
MLQITKLGGQRVKDGFLFTTASPXELCSKKAYQLGIRTIFYIDPYPGISQDQILKGGSISTRPIMIPFSGAIGNAYNKLYETFMSYKDEVSMTLEIKSKNKFGIQFKGILKKLKSKDENISNYLKENKNITDEDVIKLLSEAIEKRNEKSES

SEQ ID NO: 20171 - DNA, 429 bp, Unknown
  Obtained from environmental sample
  misc_feature (1)..(429): n is a, c, g, or t
ttgtgggagtttgatcggcntgagaaacacagaatatgtatggggcggtttagagtcggtaaacgtgcaaaggcaaagatacacaaggaagataagtcatcactcatagtaagtcatgacggttataagaacatcggctgtgatcataaaagaagttggaatactttagacaacaggttggaaataatggatgagatactaggccctattaagttttcttttgcttattttcattttcatcctagtttaagtgtgaaagaaatggggaatggtatttataaaattgggaatctgagggtagaatttttgggatatacatcaattgaaattcaagattatttattctcagcaggttttaataatcagaaagaagcaaaattacttcaggtacaatttagcaaacggttagagacaaatatatttatatga

SEQ ID NO: 20172 - protein, 142 aa, Unknown
  Obtained from environmental sample
  misc_feature (1)..(142): Xaa is any amino acid
MWEFDRXEKHRICMGRFRVGKRAKAKIHKEDKSSLIVSHDGYKNIGCDHKRSWNTLDNRLEIMDEILGPIKFSFAYFHFHPSLSVKEMGNGIYKIGNLRVEFLGYTSIEIQDYLFSAGFNNQKEAKLLQVQFSKRLETNIFI

SEQ ID NO: 20173 - DNA, 324 bp, Unknown
  Obtained from environmental sample
  misc_feature (1)..(324): n is a, c, g, or t
atgaaaatattactattaacgttttattttagaccagatttatgtgctggttcatttcgaaataccgcattagttgattcattaattcctaagctaaatgtagatgatagtctagatatagtcacaacatttcctaaccgttatgctagttttgatgtagaagcctctgaaacagaaatgatttcagaaaaaattaaaatttctcgaatacagnttccaaaacataaaaatggctttttagaccaagtagtttcttttaaaacttattataaggaagcactaaaattagttaaagaaactaattacgaattggtactcggttaa

SEQ ID NO: 20174 - protein, 107 aa, Unknown
  Obtained from environmental sample
  misc_feature (1)..(107): Xaa is any amino acid
MKILLLTFYFRPDLCAGSFRNTALVDSLIPKLNVDDSLDIVTTFPNRYASFDVEASETEMISEKIKISRIQXPKHKNGFLDQVVSFKTYYKEALKLVKETNYELVLG

SEQ ID NO: 20175 - DNA, 495 bp, Unknown
  Obtained from environmental sample
  misc_feature (1)..(495): n is a, c, g, or t
ttgcacaagattattcctcaagttgcaaagaatgtcgaaaactatgggtacaagtttaaaataataggggatggaggagcaaaagggaaactcgaagaaaagttaacagaattagaagttaaaaatgttgaattaattaaccctgtgaataggcaacagttgcttcaatactataaagacacagactatctatttttacatctcaatgattatgctgcttttaaaaaagtgctaccatccaagatttttgaatatgctgtaacagagaaacccattattgcaggagtggggggctatgcgagtgagtttttggaaaaaaatgtagagggaatatttttgtttgatccttgtgatgtagatgctttttctaatgggctcattaaagataaattgaccgcagatgtggttgatcgaactcagtttagagatgaattttctcgctcaaatataatggataaaatggcgaatgacatcttagatacatttagagcttaa

SEQ ID NO: 20176 - protein, 164 aa, Unknown
  Obtained from environmental sample
  misc_feature (1)..(164): Xaa is any amino acid
MHKIIPQVAKNVENYGYKFKIIGDGGAKGKLEEKLTELEVKNVELINPVNRQQLLQYYKDTDYLFLHLNDYAAFKKVLPSKIFEYAVTEKPIIAGVGGYASEFLEKNVEGIFLFDPCDVDAFSNGLIKDKLTADVVDRTQFRDEFSRSNIMDKMANDILDTFRA

SEQ ID NO: 20177 - DNA, 714 bp, Unknown
  Obtained from environmental sample
  misc_feature (1)..(714): n is a, c, g, or t
ttgaaaactgtggaaacncggtatgcgggagcgagtgggcaaatggtgacgntggggtatgagtttccggagtattaccgccgacttgagagcagatgcgcattcttatggccccggatcacccttaacgacaaatacacagtttattaccctaaatacaacctttacccggctgaatgggaattgctggattcttccgcagcagatttgacctttttcattccttctgcgctttatgacgatgaaggaaaggcaaatgtggaaatgagctgtaaatgtacgcgtgggaggacgaggctgggttatgagaaggtggagttgaaacaggaaaaaaaggagaaggtgaaggtggagattgtggtggaaaagatggtgaggaaggagaaaatatctaaaacctaccccaatatgccactgaatctcaagatattgattggaggaatcatttacaaagtttctccaatttccaataagcctcctaaaaatcctcctgtttggtgttggaataaagaccttacaatgagcttggaaatattagaacaagattcaatcaatattcgagcggtaaatgaagcaaccgtcgaccatgaaatacaatactatacagcttcttttttccttccgattggtcagacaagcagcgaaaaggagaaaaggaaacttaaatttattagacaatccgaagtaatcaagaaacctatttcctttttctga

SEQ ID NO: 20178 - protein, 237 aa, Unknown
  Obtained from environmental sample
  misc_feature (1)..(237): Xaa is any amino acid
MKTVETRYAGASGQMVTXGYEFPEYYRRLESRCAFLWPRITLNDKYTVYYPKYNLYPAEWELLDSSAADLTFFIPSALYDDEGKANVEMSCKCTRGRTRLGYEKVELKQEKKEKVKVEIVVEKMVRKEKISKTYPNMPLNLKILIGGIIYKVSPISNKPPKNPPVWCWNKDLTMSLEILEQDSINIRAVNEATVDHEIQYYTASFFLPIGQTSSEKEKRKLKFIRQSEVIKKPISFF

SEQ ID NO: 20179 - DNA, 597 bp, Unknown
  Obtained from environmental sample
  misc_feature (1)..(597): n is a, c, g, or t
ttgtcttatactagcctttcagttttaaattctggtgatgctgcttctaaaaatatttcaacaaataaattcaatgaagttttaaatagcaatgatattaaacaaattgttattgtgaacagaagtaatgcgcaaatctaccttaccgaaaaagcgttaaacaaagaagcgtataaaaaatataaaaagacaaccgtttttaatcagaaagcacctgctttttcttatgattttggtgatttacaaaatttcgaaaatcaacttactgaggctaaaaaaacgcacaatttagattttgatcaaaaaaacatagaacaaacaagttttatggatcaaatttttgccttcttacctttcattattttaatcgcaatttggttgttctttatgaagagaatgtctggaggcggagctggcggaggcggtggtggtcaaatttttaatattggcaagtctaaagcaaaactttttgacaaagacaccaaagtaaaaactacttttaacagatgttgctggtttagaaggtgcaaaagaagaagtgcaagaaattgtagacttcttaaaaaacccagaaaaatatactgctttaggaggtaa

SEQ ID NO: 20180 - protein, 198 aa, Unknown
  Obtained from environmental sample
  DOMAIN (17)...(168): FtsH Extracellular
  misc_feature (1)..(198): Xaa is any amino acid
MSYTSLSVLNSGDAASKNISTNKFNEVLNSNDIKQIVIVNRSNAQIYLTEKALNKEAYKKYKKTTVFNQKAPAFSYDFGDLQNFENQLTEAKKTHNLDFDQKNIEQTSFMDQIFAFLPFIILIAIWLFFMKRMSGGGAGGGGGGQIFNIGKSKAKLFDKDTKVKTTFNRCCWFRRCKRRSARNCRLLKKPRKIYCFRR

SEQ ID NO: 20181 - DNA, 324 bp, Unknown
  Obtained from environmental sample
  misc_feature (1)..(324): n is a, c, g, or t
atgaaactatgtaagcaaaccnacgataaacttcttcactcaaatatttcttttgaaagtgggaatctggaaacgttaaaacgactggtagaacaagattttggcattacgctgatgccttacctgtctatgcaagatcatgatacacgttgtgcaaatggtgtaatcaaagagtttatggatcctgttccaacacgcaaaattcgcttggtatacagccgtgagtttttgaagcaaaatattgtcaacgcttttgtggaaacgattaaggaatccatccctgacgaattgaaagatgtgaaagacgaaatggtagtggaatga

SEQ ID NO: 20182 - protein, 107 aa, Unknown
  Obtained from environmental sample
  misc_feature (1)..(107): Xaa is any amino acid
MKLCKQTXDKLLHSNISFESGNLETLKRLVEQDFGITLMPYLSMQDHDTRCANGVIKEFMDPVPTRKIRLVYSREFLKQNIVNAFVETIKESIPDELKDVKDEMVVE

SEQ ID NO: 20183 - DNA, 678 bp, Unknown
  Obtained from environmental sample
  misc_feature (1)..(678): n is a, c, g, or t
ttgttggctaagaaccaaaatggatataaaaacctggcaaaacttagttctgtcggttttatagaaggctactattacaaattcgctcgcgttgacaaagaagcgatcaaagaatatgcagaagatcttatttgcctgagtggaggtattcgtggtgaacttgcagatctgattttgaacaaaggggaagagtatgctgaagaagcattgctttggtggaaagatgtatttggagatgatttttatctggaagtcatcaaccatgagttagatgaagaacacaaagtaaacgaagtattcaaagagttttccaaaaaacatggcgtaaagttagttgctacaaacaatgtgttctatttggaaaaagaagattctgaagcccatgatgcacttatttgtattgatgacggaaaactgaaaagcacaccgattggtagagggaaagatttcagatgggggtttccaaataatgagttttatttcaaaactacagaagagatgaaggcgttgtttctggatatgccagaagccattttgtcgaccaaggaaattgtagataaagttgaaccaattaagctttccagagatgtaattctgccaaatttcgagttaccagaaggttttgaacggaggatgatacntaaagcatcttgccatgaaagtctcgaccgatcttga

SEQ ID NO: 20184 - protein, 225 aa, Unknown
  Obtained from environmental sample
  DOMAIN (1)...(126): PHP domain C-terminal region
  misc_feature (1)..(225): Xaa is any amino acid
MLAKNQNGYKNLAKLSSVGFIEGYYYKFARVDKEAIKEYAEDLICLSGGIRGELADLILNKGEEYAEEALLWWKDVFGDDFYLEVINHELDEEHKVNEVFKEFSKKHGVKLVATNNVFYLEKEDSEAHDALICIDDGKLKSTPIGRGKDFRWGFPNNEFYFKTTEEMKALFLDMPEAILSTKEIVDKVEPIKLSRDVILPNFELPEGFERRMIXKASCHESLDRS

SEQ ID NO: 20185 - DNA, 918 bp, Unknown
  Obtained from environmental sample
  misc_feature (1)..(918): n is a, c, g, or t
gtggtcaagaattcggtcgagctatttaattctccgtatggcattaccttggctcacaatggtaatttgacgaatacgatagagctgtcgaatggtgtattgaaatctgatatgcgccatatcaatacgaactctgactctgaagtgttgctcaatgtgtttgcgcacgaacttcaatgccttggcaagcttgttccgacgcatgaagagatattcaaagcggtacgtaaagtacaccaacgtgttaaaggagcgtatgcagtaatcgctatgattactggttacggtgttttggcatttagagatcctcatggaattcggcctgtttgtttcggaaagcgtgaaaccgaacaaggcgtagaatacatggtggcctctgaaagtgttgctctacaggcattaggttttactattgagcgcgatattgatccaggcgaagcgatttacattgagaacgacggtactttgcatacggcgcagtgtgctgataatccaagtcttcacccctgtattttcgaacatgtatattttgctcgtccggattcgatcattgacaaaatatcggtctacaaggcccgtttgaaaatgggtgagatgctggctaaaaaagtacttaagctacgtccagaccatgatatagatgtcgtggtgccgattcctgataccagccgaacttctgctatgcagatggcgaatgagttaggtgtcaagtttcgggaaggtttcattaagaatcgttatatcggtcgtacctttataatgcctggtcagagcgagcgcaaaaagtcagttaaacagaagctgaaaccaattgagctggaatttcagggtaagaatgtcatgttggtcgatgactcaatcgtgcgtgtaccacgtgcagtgaaatcgttcaatgggcgcgggatgcggtgcaaagaa

SEQ ID NO: 20186 - protein, 306 aa, Unknown
  Obtained from environmental sample
  misc_feature (1)..(306): Xaa is any amino acid
MVKNSVELFNSPYGITLAHNGNLTNTIELSNGVLKSDMRHINTNSDSEVLLNVFAHELQCLGKLVPTHEEIFKAVRKVHQRVKGAYAVIAMITGYGVLAFRDPHGIRPVCFGKRETEQGVEYMVASESVALQALGFTIERDIDPGEAIYIENDGTLHTAQCADNPSLHPCIFEHVYFARPDSIIDKISVYKARLKMGEMLAKKVLKLRPDHDIDVVVPIPDTSRTSAMQMANELGVKFREGFIKNRYIGRTFIMPGQSERKKSVKQKLKPIELEFQGKNVMLVDDSIVRVPRAVKSFNGRGMRCKE

SEQ ID NO: 20187 - DNA, 639 bp, Unknown
  Obtained from environmental sample
  misc_feature (1)..(639): n is a, c, g, or t
ttgaagcctatgcgtaacctactatttttaattgttttaattgccaatacctctcttttgttcgcccaggaaagcaatatgaacaatacggaaattgccgagttcaaggccaagatcaatgagacgtccaaggccacgaacaccatacaaagtaatttcacacaatataaacatctggattttttatccaacgatattaccacacaaggaaaaatggcttttaaggcccccaacatggttaaatgggagtatacagaacccttcaaatacagcataatttttaagggtgataaattaataattaacgattccggaaccaaaagcaatatggatctgggaaatagtgctttgtttagaaaactaaaccaattgattgtaaatagtgtaaagggcaacttgttccaggattcggatttcacaatgagttattttaaaagccaaaattattataaggtcatctttatccctaaagacgaaaaaataaaaagttatatcgcttcttttattttgtttttcgataaggaaaaagccgatgtcctagaagttaaaatggtggaacccacaaatgattttaccagaattgtctttactgaccgactgatcaataaacctttggacaatgaagtattttctaactag

SEQ ID NO: 20188 - protein, 212 aa, Unknown
  Obtained from environmental sample
  SIGNAL (1)...(20)
  misc_feature (1)..(212): Xaa is any amino acid
MKPMRNLLFLIVLIANTSLLFAQESNMNNTEIAEFKAKINETSKATNTIQSNFTQYKHLDFLSNDITTQGKMAFKAPNMVKWEYTEPFKYSIIFKGDKLIINDSGTKSNMDLGNSALFRKLNQLIVNSVKGNLFQDSDFTMSYFKSQNYYKVIFIPKDEKIKSYIASFILFFDKEKADVLEVKMVEPTNDFTRIVFTDRLINKPLDNEVFSN

SEQ ID NO: 20189 - DNA, 357 bp, Unknown
  Obtained from environmental sample
  misc_feature (1)..(357): n is a, c, g, or t
ttgcaatccggcattgccactgaattcatagaaaattattgctcaaacggcaacaaaatattcgtaaaccacttagtcatctgtgaattggtgtggatattgaaaaaatgctacaagctatcaaagcccaaaactattaatgtcattcagcatattcttcagatctcacaatttagcatagaaaatgcccagataatctggcaagcattaacggattataaaaaaggctcagctgattttgcagactatgtagttggacgcaccaatatattcaacgattgtgacaaaacaataactttcgacaaaaaagccagtaaatcaactgggttctcactattacacacaaaaactaactga

SEQ ID NO: 20190 - protein, 118 aa, Unknown
  Obtained from environmental sample
  misc_feature (1)..(118): Xaa is any amino acid
MQSGIATEFIENYCSNGNKIFVNHLVICELVWILKKCYKLSKPKTINVIQHILQISQFSIENAQIIWQALTDYKKGSADFADYVVGRTNIFNDCDKTITFDKKASKSTGFSLLHTKTN

SEQ ID NO: 20191 - DNA, 735 bp, Unknown
  Obtained from environmental sample
  misc_feature (1)..(735): n is a, c, g, or t
ttgttagaaaccattccgtatttcaaaaactcaaaaattggcgttgttcaaacacgttggggacatatcaatagaaattattctacacttacaagaatccaagcttttgcgttagatgcacattttacgctagaacaagttggtagaaatagtaaaaatcacttcataaactttaacggaactgctggtgtttggcgaaaagaatgtatttatgatgctggtaattgggaaggcgacacattaactgaagatttagatttaagttatagagcacagttgaaaaactggaaattcaaatatttagaacacgtagaaactccggctgaattgcctgttgttattagtgcagcaagatcgcaacaatttaggtggaacaaaggcggcgcagaaaattttcaaaaaatggcaaagcgagttttgtctaataaaaaagttcattttaaaacaaaaattcacggaattttacatttattaaacagcaccatgtttttaaacgtattcattgtagcggttttaagcgtgcctatgttgtatattaaaaatgaatatactcatttaaaaaactacttttatttgatgagtttctttgtgataagttctctcatcttttttatttgtcattggtttatgtctcggaataattatggcggcggattcaataaattcttaaaatacattgttacttttttttacctttttttctattgcaaggggttttccttacacaatccatag

SEQ ID NO: 20192 - protein, 244 aa, Unknown
  Obtained from environmental sample
  misc_feature (1)..(244): Xaa is any amino acid
MLETIPYFKNSKIGVVQTRWGHINRNYSTLTRIQAFALDAHFTLEQVGRNSKNHFINFNGTAGVWRKECIYDAGNWEGDTLTEDLDLSYRAQLKNWKFKYLEHVETPAELPVVISAARSQQFRWNKGGAENFQKMAKRVLSNKKVHFKTKIHGILHLLNSTMFLNVFIVAVLSVPMLYIKNEYTHLKNYFYLMSFFVISSLIFFICHWFMSRNNYGGGFNKFLKYIVTFFYLFFYCKGFSLHNP

SEQ ID NO: 20193 - DNA, 504 bp, Unknown
  Obtained from environmental sample
  misc_feature (1)..(504): n is a, c, g, or t
ttgattgtaaaagaagaaacagttgctattcaaattccagccggagttacagaaggtgtgcagttaaaagttgcaggaaaagggaatgaagcgccaggaaaaaattcaatttcaggtgatttattagtattgattgaagaaattcagcacgctaccttaaaaagagaaggaaccaatatacattacgatttatatattaacttatctgaagcggttttaggcatcagcaaagaagttgaaacggttacagggaaagtgaaaattaagattgacccaggaacgcaatcaggaaaaattttacgattaaaaggaaaaggattgcctagtatagaacgttatggaaatggagatttcttaattcatattaatgtttggactccgcaagagctaaataaagaacaaaaaaagttctttgaagacatgcaaaacgatgctaattttaaaccaagtccaaatgcatcggataaatctttttttgaaaaagtaaaagatatgtttatgtaa

SEQ ID NO: 20194 - protein, 167 aa, Unknown
  Obtained from environmental sample
  DOMAIN (20)...(142): DnaJ C terminal region
  misc_feature (1)..(167): Xaa is any amino acid
MIVKEETVAIQIPAGVTEGVQLKVAGKGNEAPGKNSISGDLLVLIEEIQHATLKREGTNIHYDLYINLSEAVLGISKEVETVTGKVKIKIDPGTQSGKILRLKGKGLPSIERYGNGDFLIHINVWTPQELNKEQKKFFEDMQNDANFKPSPNASDKSFFEKVKDMFM

SEQ ID NO: 20195 - DNA, 384 bp, Unknown
  Obtained from environmental sample
  misc_feature (1)..(384): n is a, c, g, or t
atgtatgaaaaatcacctaactatttaataaacgataaagagtttgtctgtaatggaccattcaagctaatacgctggaaaaaacaaaatgaaatcgttgctgtccgtaacaagagatattgggataaagcagctgtctctattaacaaaatcacaatggtaatggtcgatcaagatactgcctttaacatgtaccaacaaaatgaactcgactggattggctctccttattcacaaattccaatagatgctatttcccacttgaaggaaagtaacctattagaaaaagacgattttcttggaactttctggatacgaacaaatataaactcccatcctctccataacaaacacttcagaaaaaggctcgcaatggccattcan

SEQ ID NO: 20196 - protein, 128 aa, Unknown
  Obtained from environmental sample
  DOMAIN (1)...(73): Bacterial extracellular solute-binding proteins, family 5 Middle
  misc_feature (1)..(128): Xaa is any amino acid
MYEKSPNYLINDKEFVCNGPFKLIRWKKQNEIVAVRNKRYWDKAAVSINKITMVMVDQDTAFNMYQQNELDWIGSPYSQIPIDAISHLKESNLLEKDDFLGTFWIRTNINSHPLHNKHFRKRLAMAIX

SEQ ID NO: 20197 - DNA, 912 bp, Unknown
  Obtained from environmental sample
  misc_feature (1)..(912): n is a, c, g, or t
atgaagtcaaatgaacgcgaaatcatacaaaataaatttatgcaaggcgaactatcctgtattgtagccaccattgcttttggtatgggcattgataaagcagatgtgcgccgtgtgattcattatgatttgcctaaatccattgaaaattattcgcaagagattggccgttctggtcgtgatggtgaaaattctttatgtgaagtgatggcaaacaaagaaaacctcacagtgctagagaattttgtctacggagacacccctgaagccgcatcaataaaacaatttttagagcagatacaaaacacccaagaaccttttttagaattaaaaatggtagcgctttctaaagaattaaacatgcgaatcttacccttaaaaacgttgttagtatatttggagattgaaggagttatcactccgaaatacacttattttgaggagtattcatttaaaaatatcgaaaatattgatggaataattaataaatttcagggtgaacgtcgggcatttatacaagccatatttaatgattgtctagtcaaacagaagtacacttatgtggatattcaagccatattgagccattatcaaacccaaaggtcacgcattgtggttgcacttgaatactttgatgaaaaaggcatacttgaacttcaagccaaacaatccgttgaacgttttcaaatcaataacaagacttttgacttgcaatcattaaccaataagatgcatgaattgtctgtcattaaagagaaagtcgaaatnaaacgtattcacaatatgttgggtttcttcgaatctaaagattgcctaagttataaattagatcaatatttcggagaagaattaccattccaagttgcggacattgttccgtttgtaagtctggttcacgtaatttcacagtga

SEQ ID NO: 20198 - protein, 303 aa, Unknown
  Obtained from environmental sample
  DOMAIN (1)...(62): Helicase conserved C-terminal domain
  misc_feature (1)..(303): Xaa is any amino acid
MKSNEREIIQNKFMQGELSCIVATIAFGMGIDKADVRRVIHYDLPKSIENYSQEIGRSGRDGENSLCEVMANKENLTVLENFVYGDTPEAASIKQFLEQIQNTQEPFLELKMVALSKELNMRILPLKTLLVYLEIEGVITPKYTYFEEYSFKNIENIDGIINKFQGERRAFIQAIFNDCLVKQKYTYVDIQAILSHYQTQRSRIVVALEYFDEKGILELQAKQSVERFQINNKTFDLQSLTNKMHELSVIKEKVEXKRIHNMLGFFESKDCLSYKLDQYFGEELPFQVADIVPFVSLVHVISQ

SEQ ID NO: 20199 - DNA, 300 bp, Unknown
  Obtained from environmental sample
  misc_feature (1)..(300): n is a, c, g, or t
atgtactcgctcattattctcatcacgcaaatcatctcgctttacacctgggtcatcattatcggcgctgtgctgagctggctcatcgccttcaatgtgatcaacacgcaaaatcgtttcgtctatacggtggtcgatattatctaccgtttgacggagccggtgctggcgccattgcgccgcattctgcctgatcttggcggcattgatatttcgcctgtggttttgctgctgctgttgttctttgcccagaacctgatttgggaaatttacgggtcttttgctgtcggcgcgatgtga

SEQ ID NO: 20200 - protein, 99 aa, Unknown
  Obtained from environmental sample
  DOMAIN (1)...(90): YGGT family
  misc_feature (1)..(99): Xaa is any amino acid
MYSLIILITQIISLYTWVIIIGAVLSWLIAFNVINTQNRFVYTVVDIIYRLTEPVLAPLRRILPDLGGIDISPVVLLLLLFFAQNLIWEIYGSFAVGAM

SEQ ID NO: 20201 - DNA, 642 bp, Unknown
  Obtained from environmental sample
  misc_feature (1)..(642): n is a, c, g, or t
gtggagctaaaggaattaacaccatctctatgtaggaatattagaaaagacggctctcatatagatttacttattgcttctaaagctattatcgataacaataaaaggtttgtgattgatacttttcaagacgttaccgaaatgcaaaagtataaaaggctattcgaagaagcaggaaagatagctaaactgggtggatggcagtttgactatactacaaaggaggaagtatggacaaaggaaatctaccagatattttcattagatccgaaaagctcaaaaacaggccttagccttattaaaaactgctttctttctaatggttttgaaaagctagaagcagagatatgtaagctagagagtggagaaccttatgttatagaacttgaggtaaaagatttctcaggtaatgaaaaatggatgaaatttactggccagcctgtaatagaaaatggtgaagtaacagaggcttttggttcgatacaggatgttactgacgagaaattgagagaactagaattagaaaagaatgaaaacagatatcggtttcttttcgagaatagtcctcatccaatgcttatttactctaaaaaagactattccatttctgaagtaaataaagcgggttgtaggtcattatga

SEQ ID NO: 20202 - protein, 213 aa, Unknown
  Obtained from environmental sample
  DOMAIN (8)...(48): PAC motif
  misc_feature (1)..(213): Xaa is any amino acid
MELKELTPSLCRNIRKDGSHIDLLIASKAIIDNNKRFVIDTFQDVTEMQKYKRLFEEAGKIAKLGGWQFDYTTKEEVWTKEIYQIFSLDPKSSKTGLSLIKNCFLSNGFEKLEAEICKLESGEPYVIELEVKDFSGNEKWMKFTGQPVIENGEVTEAFGSIQDVTDEKLRELELEKNENRYRFLFENSPHPMLIYSKKDYSISEVNKAGCRSL

SEQ ID NO: 20203 - DNA, 624 bp, Unknown
  Obtained from environmental sample
  misc_feature (1)..(624): n is a, c, g, or t
ttgatgattaatagaagagttaaccccagcagaaagcttatagatactaagcaacaagaaaacgagttaaatataattcgagaacagtttgatttaggagaagaaagtgcaggccgtttatggaaaatattattagcaagaaaagcagccatctcaagttctgaaatactataccacgaattgaaaaatatattttctaaaaataatttagatatggtttcccaaggtcattttgaaagtacttggataaatcctgattcatcatctttaactccaaggggaaataaagcattcaaggtggtttgtaaatatttaggattaccaacaacttatttaagaataatatacaccataaagaaccggaatattaatggaaggcgaaatgcaactcgtatttatagcaaattattaaaagacctttttaatgatggctgttttgatgaaggagcaaatcctaagcaaatattaattctaaaaatagattactacaaaaacaatcacaatttggatgaattagggattgatgaagaaaaagcattagagggtttaactacattaatagagctcattaaacctgagctgtcttttaaagaaattggaaacatagaaaaaagagaggaatga

SEQ ID NO: 20204 - protein, 207 aa, Unknown
  Obtained from environmental sample
  misc_feature (1)..(207): Xaa is any amino acid
MMINRRVNPSRKLIDTKQQENELNIIREQFDLGEESAGRLWKILLARKAAISSSEILYHELKNIFSKNNLDMVSQGHFESTWINPDSSSLTPRGNKAFKVVCKYLGLPTTYLRIIYTIKNRNINGRRNATRIYSKLLKDLFNDGCFDEGANPKQILILKIDYYKNNHNLDELGIDEEKALEGLTTLIELIKPELSFKEIGNIEKREE

SEQ ID NO: 20205 - DNA, 588 bp, Unknown
  Obtained from environmental sample
  misc_feature (1)..(588): n is a, c, g, or t
atgaaaaaaacaaaacttgcaatattaggatttggaacagttggtcagggaatttgtgaaattcttctacaaaagaaagaacagttaaagaaacaatacaattttgattttgaagttgttgcagtttctgattttaataatgggaatgtttataacccaaatggattggatatttcacaaatgctcgaagaggctaaagcaaagaaaaaattcacaaaagatatagttaaatgggataatataacattaatcaaaaaatgcaatgcagatgtgctttgtgaactcacttataccgatctggaaacaggcggacccgcaattgatcattgtaaaactgctttgaaatccggaataaatgtagtaacaagtaataaagggcctgcagctctgcaatatcctgagatgaaggaaatcgccgatgcaaataatgtgaaatttttgatcgagggaactgtctgtgcaggaacacctgtgatcaatttaacagacggacctctcgctggttgtgagatttcacaaatcagacgaatcttaatgggactaccaattatttgttgtctcgaatggaacaggcatgggttcgactga

SEQ ID NO: 20206 - protein, 195 aa, Unknown
  Obtained from environmental sample
  DOMAIN (3)...(155): Homoserine dehydrogenase, NAD binding domain
  misc_feature (1)..(195): Xaa is any amino acid
MKKTKLAILGFGTVGQGICEILLQKKEQLKKQYNFDFEVVAVSDFNNGNVYNPNGLDISQMLEEAKAKKKFTKDIVKWDNITLIKKCNADVLCELTYTDLETGGPAIDHCKTALKSGINVVTSNKGPAALQYPEMKEIADANNVKFLIEGTVCAGTPVINLTDGPLAGCEISQIRRILMGLPIICCLEWNRHGFD

SEQ ID NO: 20207 - DNA, 765 bp, Unknown
  Obtained from environmental sample
  misc_feature (1)..(765): n is a, c, g, or t
ttgtcaagaatggcttgtattggagttgataaacatcgtcaatttgcccgtggcggtttaggggctgtaatgggttcaaaaaaacttaaagctgtatttgtggatggttctactaaaattgaatattttgataataaaaaatttgaagagataaataaacaattcacaaaagatgttttggataatgacggagtgaaatttcgtcgggaaaaaggaactatgaagtgtgtgcgtagcggtcaggaaagttcttatcttcctacaaaaaattttcaaaaaggagtttatgataaatttgaagatctaagttccgaaactgccagaaaggaattaaactgggaggatacaggatgttttaattgtgcaatccgttgttcaaaatgggcaagatgggataatcacgaattagaaggaccggaatatgagactacagcatatctcggatcaggatgtgaaatttcaaatatcaaagatgttacctgggcaaatgagatatgtaatgatcttggacttgatacgatcagtacaggagttacatgttcttttgcaatggaatgctttgaaaaaggttatttggataactggtcaaatcttaatctggtctggggaaatgcagaagctcaacgggaatttatcaaactaattgcaaaaagacagggtgttggagagatatttgcagatgggacaaaaatagcatcagaaaaaattggaaaagacagtaaggattttgctataaatatctacgggatggaaatttcagggtaa

SEQ ID NO: 20208 - protein, 254 aa, Unknown
  Obtained from environmental sample
  DOMAIN (48)...(254): Aldehyde ferredoxin oxidoreductase, domains 2 & 3
  misc_feature (1)..(254): Xaa is any amino acid
MSRMACIGVDKHRQFARGGLGAVMGSKKLKAVFVDGSTKIEYFDNKKFEEINKQFTKDVLDNDGVKFRREKGTMKCVRSGQESSYLPTKNFQKGVYDKFEDLSSETARKELNWEDTGCFNCAIRCSKWARWDNHELEGPEYETTAYLGSGCEISNIKDVTWANEICNDLGLDTISTGVTCSFAMECFEKGYLDNWSNLNLVWGNAEAQREFIKLIAKRQGVGEIFADGTKIASEKIGKDSKDFAINIYGMEISG

SEQ ID NO: 20209 - DNA, 357 bp, Unknown
  Obtained from environmental sample
  misc_feature (1)..(357): n is a, c, g, or t
atggataagctcgtactaaaggggctgcgatttcatggtttgcacggagtttttgagcaagagaaaatcatagggaatatattcgaagtagatcttgaatttactttatctaatcaaaaagctggcgaaacagatgatctaaaacacacgattgattatgcatcggcgcgtacaattgtagcagatatcatgaaaagtcattctctgaacttaatcgaaactctttctctaaaaattggtgaacagctttttaaagagtttgaaatagattcattagaagtaaaagtaagaaagatgaatccaccgatggaaggcgaaaccgaatattctgaagttacgatctactggcctcggtaa

SEQ ID NO: 20210 - protein, 118 aa, Unknown
  Obtained from environmental sample
  DOMAIN (4)...(116): Dihydroneopterin aldolase
  misc_feature (1)..(118): Xaa is any amino acid
MDKLVLKGLRFHGLHGVFEQEKIIGNIFEVDLEFTLSNQKAGETDDLKHTIDYASARTIVADIMKSHSLNLIETLSLKIGEQLFKEFEIDSLEVKVRKMNPPMEGETEYSEVTIYWPR

SEQ ID NO: 20211 - DNA, 453 bp, Unknown
  Obtained from environmental sample
  misc_feature (1)..(453): n is a, c, g, or t
atgagagtggacttttattggtcaaaattcttgaaggaagaaataaaattaccaaatgaagaatcatttgaattaaaagaagggttggaaaaagagatgaaagttaaattacgtgtaaatcaatctttttttagaagtacagttttgtcttcctatgattttaaatgttgcttaacaggtatagatattcccgaattattaatcgcaagtcatattattccttgggcaaaagacaaaaaaaacagattaaaccctcaaaatggattatgcttaaataatctacacgataaggcatttgataaagggcttataacttttgatgctaatcttaaaatgatattatcaagtcagttaaagagtaataaaagtgaaaatataaaattatattttcataaattagaaggtaaaacacttttacttcctaagagatttatcccagatgaaaatttttag

SEQ ID NO: 20212 - protein, 150 aa, Unknown
  Obtained from environmental sample
  misc_feature (1)..(150): Xaa is any amino acid
MRVDFYWSKFLKEEIKLPNEESFELKEGLEKEMKVKLRVNQSFFRSTVLSSYDFKCCLTGIDIPELLIASHIIPWAKDKKNRLNPQNGLCLNNLHDKAFDKGLITFDANLKMILSSQLKSNKSENIKLYFHKLEGKTLLLPKRFIPDENF

SEQ ID NO: 20213 - DNA, 306 bp, Unknown
  Obtained from environmental sample
  misc_feature (1)..(306): n is a, c, g, or t
gtggacaaagaatcggcnccagtgctgaaaaagtatcgattangttgcgattgnggtaaaactaaaaatatagtgatcttttttttatatgatgaacccttcgactccgctcaggatggaaacaaaaaatcaagactctcttttcttttttttctttatttacttttttccattgctgaaaagaaacaaaaatctagtcttattataattttatggaattctaaaaagaaattccactatcgtgtccagaccgttgagttccccaatcaagttgaggacaagctttggattcttgccgtttcatag

SEQ ID NO: 20214 - protein, 101 aa, Unknown
  Obtained from environmental sample
  misc_feature (1)..(101): Xaa is any amino acid
MDKESAPVLKKYRLXCDXGKTKNIVIFFLYDEPFDSAQDGNKKSRLSFLFFLYLLFSIAEKKQKSSLIIILWNSKKKFHYRVQTVEFPNQVEDKLWILAVS

SEQ ID NO: 20215 - DNA, 741 bp, Unknown
  Obtained from environmental sample
  misc_feature (1)..(741): n is a, c, g, or t
atggatatcctttacaagaggcggcgcatcgataactgggccgagctggatttggggaatcaaattcaaccctgcataacacagaaccatgtctttcgagcgacgccatatgttaaagatcgctctcattcagcattcctttcaacatggggcaacacctttggccaggattattttctcagcacgggcaagcaaacgaccaatttggcatcaataaacaaaggcgtactgagcgctttccccactccgcttccgccgctggaagagcagaggcgcatcattgacctggttgaagaacggctttctgccatatctaagctagaggcggagatagaagaaaaacttgtatacgcagaccaagaaaagcaggcaattttagctgacgctttttctggtcgcctagtagaagcacaaaatggcgatggcgatacttctgagttattgcaccggattctgacggaagctagaaagagtataaaaatcacccccaaacagaaacgaaggaaaaaacattcgtccgaggaactaagcgtgaaacataatctaatttatattctaaaagaacaaggcgagatatctgtttcagcgctaatgaatgaagctggttacgggaatgacgaaattgaagccttctatgaaaaattggccgagatatcagattctatagttgagctgcgccctagcgacaacaattcgaaaaactggccctatgaaagcgaagtaagactaaagttgaagtag

SEQ ID NO: 20216 - protein, 246 aa, Unknown
  Obtained from environmental sample
  misc_feature (1)..(246): Xaa is any amino acid
MDILYKRRRIDNWAELDLGNQIQPCITQNHVFRATPYVKDRSHSAFLSTWGNTFGQDYFLSTGKQTTNLASINKGVLSAFPTPLPPLEEQRRIIDLVEERLSAISKLEAEIEEKLVYADQEKQAILADAFSGRLVEAQNGDGDTSELLHRILTEARKSIKITPKQKRRKKHSSEELSVKHNLIYILKEQGEISVSALMNEAGYGNDEIEAFYEKLAEISDSIVELRPSDNNSKNWPYESEVRLKLK

SEQ ID NO: 20217 - DNA, 909 bp, Unknown
  Obtained from environmental sample
  misc_feature (1)..(909): n is a, c, g, or t
ttgagtacatcgaacgggtttttcttacgcagatatttcctttcggtttactcaaacaaatttcaaaaaaaaatgagtaaactaagaatagccattcaaaaatcgggaagattaaacgaagattccttacaaattttaaaagattgtggaatttccatcgacaacggaaaagaccagttaaaagcagtttcaagtaattttccgttggaagttttttacttgagaaacggagatattccacaatatcttagagacggcgttgtagaaattgccattatcggagaaaatgtgctgatagaaaaaggtgaagatatcaacattgcagaaaaattaggtttttctaaatgcaaggtttcacttgcaattcctaaaaacgaaacttataatggaatcgattatttcaacaacaaaaaaattgcaacatcttatccgaatacggtaaagaaatatttgcttgataaaggagttgatacgcaattacacatcattaatggttctgtagaaattgctccgaatattggattggcagacggaatttgtgacatcgtatcaagcggaagcaccctttttaaaaataatttaaaggaagtagaggtgttgttaacatcggaagcggttttggcagtttctcctttaatttcggaagaaaatcaacaagtactaaacaaattacagtttcggattaaagcggttttaaaaggacgaaattcaaaatatgtcctgttaaacgctccgaatgnaaaattagcagaaatcactgcttgtttacctggaatgaaaagtccgactgttttaccgctgggcaacaaaacgttggagttctgtgcactctgtatttgttacaatcagttttgggaaattttgctgtgttgcacgaacaggacgcgaggactttactgtgtccattga

SEQ ID NO: 20218 - protein, 302 aa, Unknown
  Obtained from environmental sample
  DOMAIN (74)...(232): ATP phosphoribosyltransferase
  misc_feature (1)..(302): Xaa is any amino acid
MSTSNGFFLRRYFLSVYSNKFQKKMSKLRIAIQKSGRLNEDSLQILKDCGISIDNGKDQLKAVSSNFPLEVFYLRNGDIPQYLRDGVVEIAIIGENVLIEKGEDINIAEKLGFSKCKVSLAIPKNETYNGIDYFNNKKIATSYPNTVKKYLLDKGVDTQLHIINGSVEIAPNIGLADGICDIVSSGSTLFKNNLKEVEVLLTSEAVLAVSPLISEENQQVLNKLQFRIKAVLKGRNSKYVLLNAPNXKLAEITACLPGMKSPTVLPLGNKTLEFCALCICYNQFWEILLCCTNRTRGLYCVH

SEQ ID NO: 20219 - DNA, 339 bp, Unknown
  Obtained from environmental sample
  misc_feature (1)..(339): n is a, c, g, or t
atgatttatatatgcaacaaatctggaaaatctacaaatccaagtaaaggagtctccgcatattcaaaaagtagaacaattgccccattacatttggggaaaaccgatgggaatcctccttttgatgagttatatttaatagatttagatagtgattgtcttccaatagccttttacgtaaatacatacgaccaaataatcagtaaagttgaagatccaaataggaaaaagatagctggatcaaaaatgaaagatctcgtaaatggaacaactaatgggtcgagtttttatgatttttctgagaataagataagtgaattgaaaaaagcaataaattaa

SEQ ID NO: 20220 - protein, 112 aa, Unknown
  Obtained from environmental sample
  misc_feature (1)..(112): Xaa is any amino acid
MIYICNKSGKSTNPSKGVSAYSKSRTIAPLHLGKTDGNPPFDELYLIDLDSDCLPIAFYVNTYDQIISKVEDPNRKKIAGSKMKDLVNGTTNGSSFYDFSENKISELKKAIN

SEQ ID NO: 20221 - DNA, 468 bp, Unknown
  Obtained from environmental sample
  misc_feature (1)..(468): n is a, c, g, or t
atgctgcgaaaaaaattatatttgttcgaagcttacatatatgcaggcttcaaaagaaccactcgaagatcaaaattaaaccgacaggctatcttttttttgaaaaatttagttcacagtgtcctgattgtcaccgctttgtctttgttcggtagtctgcatgcgcagtcgttgaatgaaggagcaaggctggtggatgcccgtatcgacttgaaagagactgcggtgaagggatcttttgtggtcatcgaatatgaaatcccttattccggcatggttgagatccggctcttcgacaagatgggcaacaagatctggcaaaatcagtaccctgatcagtacggagagaacagaatcgtactaaaagcttccaaatttcatcccggagaaacctacacttacgccttaaattacaagaaagacgaagtgaaggagaaaattatcgttccacccatcggatacgattga

SEQ ID NO: 20222 - protein, 155 aa, Unknown
  Obtained from environmental sample
  misc_feature (1)..(155): Xaa is any amino acid
MLRKKLYLFEAYIYAGFKRTTRRSKLNRQAIFFLKNLVHSVLIVTALSLFGSLHAQSLNEGARLVDARIDLKETAVKGSFVVIEYEIPYSGMVEIRLFDKMGNKIWQNQYPDQYGENRIVLKASKFHPGETYTYALNYKKDEVKEKIIVPPIGYD

SEQ ID NO: 20223 - DNA, 531 bp, Unknown
  Obtained from environmental sample
  misc_feature (1)..(531): n is a, c, g, or t
atgaatgagaatttgaaagcttttgaagagctcctaaatataatggatgaactacgtttgaaatgtccttgggataaaaaacaaacgctagaaagtctaagaaccctaactattgaggaaacctacgaattggctgatgccattttgaagaatgataaggaggagataaagaaggagttaggcgatttgctattacacatcgtattctatgctaagattggctctgaaaccaatgatttcgatattgcggatgtttgtaaaggcattagtgagaaattgatctatcgtcatcctcatattttttctgatgtaaaagttgctgatgcgcgtgaagtagaggagaactgggaacaactgaagcttaaagaccaaggtggtaaaggtactgttctagaaggcgttcctcaatcattgcctgcaatggtaaaagccaatcgtattcaagataaggtgagaggcgttggtttcgattgggaagaaaaagagcaagttgggacaaggttaaggaagaaatctcagaacttgaagtag

SEQ ID NO: 20224 - protein, 176 aa, Unknown
  Obtained from environmental sample
  DOMAIN (28)...(101): MazG nucleotide pyrophosphohydrolase domain
  misc_feature (1)..(176): Xaa is any amino acid
MNENLKAFEELLNIMDELRLKCPWDKKQTLESLRTLTIEETYELADAILKNDKEEIKKELGDLLLHIVFYAKIGSETNDFDIADVCKGISEKLIYRHPHIFSDVKVADAREVEENWEQLKLKDQGGKGTVLEGVPQSLPAMVKANRIQDKVRGVGFDWEEKEQVGTRLRKKSQNLK

SEQ ID NO: 20225 - DNA, 660 bp, Unknown
  Obtained from environmental sample
  misc_feature (1)..(660): n is a, c, g, or t
atgttacaaaaaaccattcttgttcttctatttttactaacaacaagcaattctttttcacaaattaatgctgtaactgataaaggagaagcagtcatactttataagaataatacttgggagtatgtaaatgatagtattatcgaaacgaaagaaattttaactaataattttgaatttaagaaagataaaacctcaacttttttggtaaaaagcaataaaattccaattggtatctggataaatccaaaaaaatggagctttaaaaaatccagtacaaatgaagctgcagagttttcgtttaccttaaagaatggagatttatatggaatggttttgactgagagaactgaaatccctttacaaaaccttaaagaaatcgctttaggtaatgctaaagaagcagctccagacgctaaagttgataaagaagaatttcgaattgttaatggtaacaaaatattactgatggagattagcgggactacacaggctatcaaatttaaatactacgcatatcataatccaagtaaacaaggagttgtgcaattagttacctactgctcattaatttatttgaagatacaaaaaaacctggagaaatttacatggattgtcgaattgatccaccaaaacaatcaaaaaatcaaattcgaannn

SEQ ID NO: 20226 - protein, 220 aa, Unknown
  Obtained from environmental sample
  SIGNAL (1)...(20)
  misc_feature (1)..(220): Xaa is any amino acid
MLQKTILVLLFLLTTSNSFSQINAVTDKGEAVILYKNNTWEYVNDSIIETKEILTNNFEFKKDKTSTFLVKSNKIPIGIWINPKKWSFKKSSTNEAAEFSFTLKNGDLYGMVLTERTEIPLQNLKEIALGNAKEAAPDAKVDKEEFRIVNGNKILLMEISGTTQAIKFKYYAYHNPSKQGVVQLVTYCSLIYLKIQKNLEKFTWIVELIHQNNQKIKFEX

SEQ ID NO: 20227 - DNA, 495 bp, Unknown
  Obtained from environmental sample
  misc_feature (1)..(495): n is a, c, g, or t
atggggtgtgggtggcctgggggtgaacaaatacattctcaggagtttacaaaagtaaaaataagaaaaaagttcattgtgacgcgccgcaataaaatcaaagaaaacatagtatttatcgaggccaacatgaccagaaattcgcatattttttctcaattagattttttttctgccaaacgtaatcctggttacgccttgctggtaaatgcgccgtggggatccggtaagagttttttgcttcgaaagtggatggggccgcgcaaagattgcctatatgtaagcctttacggcctcgttgatagtaagggcatagaggatgaaatatttaacagcttactaaccatgaaaggttcattaaagccgccaaagggagtttcaacatttcaagaattaagcaagaagtgggctggtatttcgatcaacctaacaggcgcataccgacgacaagcattgaaagcattaccccgtattctcgttttcgatgatctccng

SEQ ID NO: 20228 - protein, 165 aa, Unknown
  Obtained from environmental sample
  misc_feature (1)..(165): Xaa is any amino acid
MGCGWPGGEQIHSQEFTKVKIRKKFIVTRRNKIKENIVFIEANMTRNSHIFSQLDFFSAKRNPGYALLVNAPWGSGKSFLLRKWMGPRKDCLYVSLYGLVDSKGIEDEIFNSLLTMKGSLKPPKGVSTFQELSKKWAGISINLTGAYRRQALKALPRILVFDDLX

SEQ ID NO: 20229 - DNA, 540 bp, Unknown
  Obtained from environmental sample
  misc_feature (1)..(540): n is a, c, g, or t
atgaaatttatcattaatccaattcttattttattggcagttattattttatctttaaatgttaaagctgatgagaaaaaggaaccagctgttagaactattagtccttgtctttctgattctagataccaacaatttgatttttggctaggtcaattcgatgtttacggtgacttaaaaaagaaaacaccattagcaggaaaaaacactattgtaaaacaacaaaatggctgtttaattatcgaatcctggaaaggttcaaaaggatcaacaggtatgagcatgaattattatgacggaactaaagataagtgggtccaacattgggtaagcgcagatggaacaaccattaatattgagggcaatataattgacggttcaatggttttagtgggtaaaatttactatgctaatgtgaaggaaaataaaatcagaaactttaaaggcacttggacgcctttagaaaaccaagtggttcgtcaattttttgaagaatccatggattctggtaaaacttggaagccctcgaccgattcttga

SEQ ID NO: 20230 - protein, 179 aa, Unknown
  Obtained from environmental sample
  SIGNAL (1)...(20)
  misc_feature (1)..(179): Xaa is any amino acid
MKFIINPILILLAVIILSLNVKADEKKEPAVRTISPCLSDSRYQQFDFWLGQFDVYGDLKKKTPLAGKNTIVKQQNGCLIIESWKGSKGSTGMSMNYYDGTKDKWVQHWVSADGTTINIEGNIIDGSMVLVGKIYYANVKENKIRNFKGTWTPLENQVVRQFFEESMDSGKTWKPSTDS

SEQ ID NO: 20231 - DNA, 603 bp, Unknown
  Obtained from environmental sample
  misc_feature (1)..(603): n is a, c, g, or t
ttgaaatggtttctcaagtccttttggcgaagcaattttaaatggttagaaaaaagaaaaaactggagtaagattcgaattcatttgaattctgcgaaagtttttattgacaacaagcagtttgaagaaattgaagaagaaacgtacttagaattgtctgattctaaagcaaccttatctggtgagcttatcgattttatcactgaagaaaacggaagtttaacgacaatacctattggagcaacattgcctttttttagtaataaaaaaacatttatcggcgcaaaagaatattcgtatgaaggtgctattatccataaaaaattagacaaagaatacattttaaaaacagcttttttgtttttaaatacgccccatttttggggaggaaaaacgccttttggagttgacagttctggttttacacaaatggtttataaactttgcggttatcaattattacgaagcgcaaaagaacaagcaactcaaggagaagtgctaagttttatagaagaaagcgaacccggagatttgctttttttgatgataatgaaggaattattacacatgttgaactactcgagccgattcttggtccagtag

SEQ ID NO: 20232 - protein, 200 aa, Unknown
  Obtained from environmental sample
  misc_feature (1)..(200): Xaa is any amino acid
MKWFLKSFWRSNFKWLEKRKNWSKIRIHLNSAKVFIDNKQFEEIEEETYLELSDSKATLSGELIDFITEENGSLTTIPIGATLPFFSNKKTFIGAKEYSYEGAIIHKKLDKEYILKTAFLFLNTPHFWGGKTPFGVDSSGFTQMVYKLCGYQLLRSAKEQATQGEVLSFIEESEPGDLLFLMIMKELLHMLNYSSRFLVQ

SEQ ID NO: 20233 - DNA, 729 bp, Unknown
  Obtained from environmental sample
  misc_feature (1)..(729): n is a, c, g, or t
atgacgccttatggaataagtttttgtaaagaagtgatcaaagagttaaccacatacaatccaattattgtaagtgtttttgcgtacggagttgatatttgtgcgcataaagaagcattcaaaaacaaactacaaaccattgcagttttagcacatggatttgaacaaatttatccaaaaacacataaaaagtacatcagtcaagtgaatgaaaatggcggatttatcacagaattttggcatgatgaagatccgttaagagaacattttttacagcgaaatagaattgtagcaggaatttctcaagcaacaattatcatagaatccgcagaaaaaggcggctctttggttactgctgatattgccaattcgtacgatagagatgtgtttgctgttccaggaagaacaacagacttgtatagtaaaggttgtaaccgcttgattaaagacaacaaagcggcgctgttaacatccgcagaagatgttgcaaaaatgttgaattgggatcttgattcaaaacagaaaaaaacaaaaaccattcaaaaacaattgtttgtggagttgaatacgaacgaacaaaaagtgtacgattatttgcttaaaaacggcaaacaactcttagatattattgccatagaatgcaatattcctatttacaaattagcgcctttattattacaattagaaatgaaaggcgttgtacaacctttgccaaggaaaattgtttga

SEQ ID NO: 20234 - protein, 242 aa, Unknown
  Obtained from environmental sample
  DOMAIN (3)...(156): SMF family
  misc_feature (1)..(242): Xaa is any amino acid
MTPYGISFCKEVIKELTTYNPIIVSVFAYGVDICAHKEAFKNKLQTIAVLAHGFEQIYPKTHKKYISQVNENGGFITEFWHDEDPLREHFLQRNRIVAGISQATIIIESAEKGGSLVTADIANSYDRDVFAVPGRTTDLYSKGCNRLIKDNKAALLTSAEDVAKMLNWDLDSKQKKTKTIQKQLFVELNTNEQKVYDYLLKNGKQLLDIIAIECNIPIYKLAPLLLQLEMKGVVQPLPRKIV

SEQ ID NO: 20235 - DNA, 693 bp, Unknown
  Obtained from environmental sample
  misc_feature (1)..(693): n is a, c, g, or t
atggaaaatttgaaaatcacatgtgttattgttgatgatgagcccattgccctaaatttagtggaaagctatgtagagaaaactccatttctagttcttaaaaagaaatgcagtagcgctattgaagcgttggagtttttgaaatcagaacctgtcgatttgttgtttttggatatacaaatgcccgatttaactgggattgaattttcaaaaatgttacccaaagaaacacgtgttattttcacaacggcattcgatcaatatgctttggaaggctttaaagtggaagctctagattacttactaaagccattcgattacgccgagtttttagcagcagccaataaggcgaatacgtggtttagtttagtgaaaggaaaacagcaaacgactctttctaaggagaaggaattcctttttgttaagtctgattacaaacaacttcgtatcaaattggccgatgtactgtatttcgaaagcctcaaggattatatcaaaatatggttaaaggataacccaaagccgattttaacactcatgagtttgaaatctcttgaggaagaactcccagcctcagagtttatgcgtgttcatcgctcttttatagtgtctttaaaaaacattgaagtgattgagcggagtcaaatcattattaataatcaacgcattgcggttctcgatccgattctttga

SEQ ID NO: 20236 - protein, 230 aa, Unknown
  Obtained from environmental sample
  DOMAIN (145)...(224): LytTr DNA-binding domain
  misc_feature (1)..(230): Xaa is any amino acid
MENLKITCVIVDDEPIALNLVESYVEKTPFLVLKKKCSSAIEALEFLKSEPVDLLFLDIQMPDLTGIEFSKMLPKETRVIFTTAFDQYALEGFKVEALDYLLKPFDYAEFLAAANKANTWFSLVKGKQQTTLSKEKEFLFVKSDYKQLRIKLADVLYFESLKDYIKIWLKDNPKPILTLMSLKSLEEELPASEFMRVHRSFIVSLKNIEVIERSQIIINNQRIAVLDPIL

SEQ ID NO: 20237 - DNA, 372 bp, Unknown
  Obtained from environmental sample
  misc_feature (1)..(372): n is a, c, g, or t
atgaacataggacaaatcgaaaaaaacttaaatcaactaattaaatcagttgattctgaaacttttatttatgacttgcttcgtgcattcaacttacccaaagcttccattacacggcttcaaaaaggcaatttaaatttatcaaaagttgatggtgaaatttcttggaaaaagaaattatcctttaaccaagtctttgatggcaacttacattctcaaatcacagatatccaccaaaacatcaaacacgatcaaagatttctcattgttaccgattacaaaatactattagccattgatacaaagactgccgaaacgctagatattaatatcactgacttgcctaaacattatgatttcttttgtgcctga

SEQ ID NO: 20238 - protein, 123 aa, Unknown
  Obtained from environmental sample
  misc_feature (1)..(123): Xaa is any amino acid
MNIGQIEKNLNQLIKSVDSETFIYDLLRAFNLPKASITRLQKGNLNLSKVDGEISWKKKLSFNQVFDGNLHSQITDIHQNIKHDQRFLIVTDYKILLAIDTKTAETLDINITDLPKHYDFFCA

SEQ ID NO: 20239 - DNA, 471 bp, Unknown
  Obtained from environmental sample
  misc_feature (1)..(471): n is a, c, g, or t
atgggagctggaaaaaccatcgaaatttctattagagacaaacaagtaaccgttcgcgattatgttcgtggaattccgttaggaaaagtagtagacgtagtttctaaaatgaatacgggtggtaaatatgattcgaaagcttttaaaaaatcggttggattaaatggagttgggacaaaagctgtaaatgcgttgtcagaatactttaaagtgcaatctataagagaaaataaaactgcttgggcagaatttaatcaaggaaatatagttgaagtagaggatgcacacgaatcatcgttaagaaaaggaacaaaagtgcagtttattcctgatgaaactatttttggtaaatataaattcagaaatgaatatgttgccaaaatgttgaaaaactatgtgtatttaaacacaggtttaaccattttgtttaatggagaaaatttcactcagaaacggattaaagattattag

SEQ ID NO: 20240 - protein, 156 aa, Unknown
  Obtained from environmental sample
  misc_feature (1)..(156): Xaa is any amino acid
MGAGKTIEISIRDKQVTVRDYVRGIPLGKVVDVVSKMNTGGKYDSKAFKKSVGLNGVGTKAVNALSEYFKVQSIRENKTAWAEFNQGNIVEVEDAHESSLRKGTKVQFIPDETIFGKYKFRNEYVAKMLKNYVYLNTGLTILFNGENFTQKRIKDY

SEQ ID NO: 20241 - DNA, 432 bp, Unknown
  Obtained from environmental sample
  misc_feature (1)..(432): n is a, c, g, or t
atgaagttagatttaaacagcgtaaatccgaaagcagatatcatgatcgaaggtgcaactttgcacgatttgacgaatatagatgttgttattccacgtaataaattagttgtaattactgctttgtctggctctgggaaatcatctttagcttttgacacgttatatgcagaaggacaacgacgttatgttgaaagtttgtcttcgtatgcgcgtcagtttttaggaaaactgcacaaacctaaagtagattatatcaaaggaattgcgccagcaattgctattgtacaaaaagtaaattctacaaatccaagatctacagttggcacatcaacagagatttacgattatatgaaattattgtttcccagaattggcaacacctactcgcctatttctaacgaacaagtcaaggagagatacggttgctga

SEQ ID NO: 20242 - protein, 143 aa, Unknown
  Obtained from environmental sample
  misc_feature (1)..(143): Xaa is any amino acid
MKLDLNSVNPKADIMIEGATLHDLTNIDVVIPRNKLVVITALSGSGKSSLAFDTLYAEGQRRYVESLSSYARQFLGKLHKPKVDYIKGIAPAIAIVQKVNSTNPRSTVGTSTEIYDYMKLLFPRIGNTYSPISNEQVKERYGC

SEQ ID NO: 20243 - DNA, 420 bp, Unknown
  Obtained from environmental sample
  misc_feature (1)..(420): n is a, c, g, or t
atgaaaagcaaaggcatttacggattgtcaaaaattttgattgaaaaatacaacggggaagttccgcaaagttttgaaggattggaagaattgcctgccgttggacacaaaacagcaagtgtggtgatgagtcaagcttttggaattcctgcttttccggttgatacacatattcacagattaatgtatcgttggaatttatccaacggaaaaaacgttacacaaacagaaaaagatgcaaaacgattatttccaaaagaactttggaacgaattgcatttacaaattatctggtacggacgtgaatattctccagcgcgtggttgggatttagaaaaagatatcattacaaaaacaattggacgacaagctgttttagatgactattataaaaatagactcaagaaaaaagataaatag

SEQ ID NO: 20244 - protein, 139 aa, Unknown
  Obtained from environmental sample
  misc_feature (1)..(139): Xaa is any amino acid
MKSKGIYGLSKILIEKYNGEVPQSFEGLEELPAVGHKTASVVMSQAFGIPAFPVDTHIHRLMYRWNLSNGKNVTQTEKDAKRLFPKELWNELHLQIIWYGREYSPARGWDLEKDIITKTIGRQAVLDDYYKNRLKKKDK

SEQ ID NO: 20245 - DNA, 387 bp, Unknown
  Obtained from environmental sample
  misc_feature (1)..(387): n is a, c, g, or t
ttgtggatgaaaaagaagtggagacaatcaatgtgttacaagcttcaattactggaatgcaacgttctattgcgcaattacatccgcagccaagaatttattattgttgatggaaataagtttaaaccgtataaaaaagttccgcacgaaaccattgtaaaaggcgatgcaaaatatttgagtattgccgcagcttcggtgttggcaaaaacgtatagagatgagtttatggaaaaaattcatcaagaatttccgatgtatcattggaaacaaaataaaggatatccaacaaaacaacacagaaatgccattcgagaattcggaatcacaaaatatcacagaaaaacgtttcgcttgcttccagaacaattaaaacttgatttgtaa

SEQ ID NO: 20246 - protein, 128 aa, Unknown
  Obtained from environmental sample
  DOMAIN (4)...(120): Ribonuclease HII
  misc_feature (1)..(128): Xaa is any amino acid
MWMKKKWRQSMCYKLQLLECNVLLRNYIRSQEFIIVDGNKFKPYKKVPHETIVKGDAKYLSIAAASVLAKTYRDEFMEKIHQEFPMYHWKQNKGYPTKQHRNAIREFGITKYHRKTFRLLPEQLKLDL

SEQ ID NO: 20247 - DNA, 477 bp, Unknown
  Obtained from environmental sample
  misc_feature (1)..(477): n is a, c, g, or t
ttggctatcaatatcaaattaaaagaagggaaaaagaatttttgntttngagaaataactgcagtnttgggaggtgatagcagatatattgcgcatccaaaattgttttattacagtccaaaatacagtgttaatttaattactgacatgaataatattggtaaaataccttgtactagaagagattattgtaaattttctggcggatttagacctggaggaaactctggaactggttttaatgtagcttcttcagacattggttttttaacgttgcaaaacaataaggcaaaagaaattgaagtaaaatttgcagcggctaactttagttattctcctaaaaaaacgtgggatttaagtgggtttgctatttattctggttctaaaacagaactagaacaaggaagtacaaggaattatatagacaattcttttacagaaacaaccacaagtaatcttcgcaaaattctaacttag

SEQ ID NO: 20248 - protein, 158 aa, Unknown
  Obtained from environmental sample
  misc_feature (1)..(158): Xaa is any amino acid
MAINIKLKEGKKNFXFXEITAVLGGDSRYIAHPKLFYYSPKYSVNLITDMNNIGKIPCTRRDYCKFSGGFRPGGNSGTGFNVASSDIGFLTLQNNKAKEIEVKFAAANFSYSPKKTWDLSGFAIYSGSKTELEQGSTRNYIDNSFTETTTSNLRKILT

SEQ ID NO: 20249 - DNA, 723 bp, Unknown
  Obtained from environmental sample
  misc_feature (1)..(723): n is a, c, g, or t
atgttagccgagcagatcgcgaagtccttgaatcttcccctgatccaatggcacataaagtcgactaccaaggcgcagcagggcctctacgaatacgacgctgtctctcggctcagagactcgcagctgggggacgacaaggtgcacgatatctcaaactacatcgtgcgcggcaaaatctgggaatctttcgcctcggatcagcaatcggtgctgttgatcgatgagatcgacaaggcggatatcgagtttcctaacgacctgttgttggagctggacaagatggagttcttcgtctacgagacgaagcaactcataaaggcagagacgcgaccgatcgtcatcatcaccagtaacaacgaaaaggaattgccggacgccttcctgcgtcgctgcttcttccactacatcgaatttccggacacgctcacgatggagaagatcgtcgatgttcactaccccaatatcaagaaagacctgctcagccaggcgatggatgtgttcttcgatgtgaggaagatacccggactcaagaagaagccttctacctcggagttgatcgactggctgaagctattgatggcggacgacatccccgaagatgtgctgaagagtcacagcgcgaagaatgcaatacctccattatatggcgcgctgttgaagaatgaacaagatgtgcatctattggaaaagctggcattcatgcatagagccaagagctag

SEQ ID NO: 20250 - protein, 240 aa, Unknown
  Obtained from environmental sample
  misc_feature (1)..(240): Xaa is any amino acid
MLAEQIAKSLNLPLIQWHIKSTTKAQQGLYEYDAVSRLRDSQLGDDKVHDISNYIVRGKIWESFASDQQSVLLIDEIDKADIEFPNDLLLELDKMEFFVYETKQLIKAETRPIVIITSNNEKELPDAFLRRCFFHYIEFPDTLTMEKIVDVHYPNIKKDLLSQAMDVFFDVRKIPGLKKKPSTSELIDWLKLLMADDIPEDVLKSHSAKNAIPPLYGALLKNEQDVHLLEKLAFMHRAKS

SEQ ID NO: 20251 - DNA, 681 bp, Unknown
  Obtained from environmental sample
  misc_feature (1)..(681): n is a, c, g, or t
ttgcttcagngtgattatcaccacagagaacaacagttgctggaagagcagtaccggaattatgatgaaaaatattgggataagaaaacttttgctccttcttgcctgatatattatgtgggcgtgaaaaaaaagatcaaaaaacttattcaccataatttgttttttgatgctgattttgaacaacattcaaaagaaatatataaatcgccacaatggcccaagcaccccctgttctatgtgtgttgcccgtcaaagacagatactaccgtagcacctgatgggcaagaaaatttgtttatactgatacctattgcgccgggcataacagattcgatggcaatgcgtgagcaatattttcctgaaataataaaacgcatagagcagcattgtggagacacaatcggagcgcatgtagtgtataaaaaaagttattgcctgaacgatttcatgcaggactataatgcctacaaaggtaatgcctatgggctagccaatactttgcgtcaaaccgcaatattgaaaccatcactaagaaataagaaagtggctaatctgctatatacggggcagctcacggtgccgggccccggtgtgccgccggcattaatatcaggcaaactggcagctgaagaagcaataaaaacgcttaaaaagaaattagatgaagcagttgtttga

SEQ ID NO: 20252 - protein, 226 aa, Unknown
  Obtained from environmental sample
  misc_feature (1)..(226): Xaa is any amino acid
MLQXDYHHREQQLLEEQYRNYDEKYWDKKTFAPSCLIYYVGVKKKIKKLIHHNLFFDADFEQHSKEIYKSPQWPKHPLFYVCCPSKTDTTVAPDGQENLFILIPIAPGITDSMAMREQYFPEIIKRIEQHCGDTIGAHVVYKKSYCLNDFMQDYNAYKGNAYGLANTLRQTAILKPSLRNKKVANLLYTGQLTVPGPGVPPALISGKLAAEEAIKTLKKKLDEAVV

SEQ ID NO: 20253 - DNA, 540 bp, Unknown
  Obtained from environmental sample
  misc_feature (1)..(540): n is a, c, g, or t
atgaaaactattttaagattgacaatttgtggactcatactactaaatgcatctttagcaagttgtcaatctgaaatggtatccatcaaaggaggaaaatatattcctttatatggaagagattcaatgaaagttgctattgttgattttctgatggatgtatatcctgttacaaatgaagagtatttaaaatttgtaaaagaaaatcccaagtggagaaggtctaaagtaattcgcctttttgcagataaaagatatttatctagctggaaaaatgatactgaacttggtgaaaataaaaaattaaaatcacccataacaaatgtttcttggtttgcagctaaaaattattgcgaaagccaaggaaaaagactaccaacaatagatgaatgggaatatgtagcaatggcaaatacaaagataccagatgctagaacaatagaatcctataataagtttattttaggttggtacgaaaaaacaaaaacctttgacaatgtgatcggttctacctttaacaatttactggagagtatatga

SEQ ID NO: 20254 - protein, 179 aa, Unknown
  Obtained from environmental sample
  SIGNAL (1)...(20)
  DOMAIN (22)...(177): Domain of unknown function (DUF323)
  misc_feature (1)..(179): Xaa is any amino acid
MKTILRLTICGLILLNASLASCQSEMVSIKGGKYIPLYGRDSMKVAIVDFLMDVYPVTNEEYLKFVKENPKWRRSKVIRLFADKRYLSSWKNDTELGENKKLKSPITNVSWFAAKNYCESQGKRLPTIDEWEYVAMANTKIPDARTIESYNKFILGWYEKTKTFDNVIGSTFNNLLESI

SEQ ID NO: 20255 - DNA, 777 bp, Unknown
  Obtained from environmental sample
  misc_feature (1)..(777): n is a, c, g, or t
atgttatcaagttttacgccagccaaggtgctgaaaggtgcattccagaacaaagaaaaaaagaagtttagaagtgcattagtagtttttcaatttagtgtttctttagtagtaattattggtttactggttataaataagcaattgaatttcattcagaatcaatctttaggattccaaaaagatcaaacggttattgtccacgatgcctatacattgcgctccaatctggatgtatataaaaagcagttattgaaagaacctgagttcaaaaacgctaccatttcaagctatcttcctattaatggattctctatgaacgagcagaccttttggccaaaaggacaagatcctgttcagggaaataactcttctatgcaggtttggaatgtcgatgaagactatatacccactttaggaatggaaattacagaaggtcgcaatttttccatagatagagaaactgatgaaaatacagtgatcttgaatgaagctttggctcaacgatttggttttgaaaaccctattggagaaatcatcaccacattttctcaaaattcagatggaagttttgatactgaaaacctacgtgaatttataattattggagtagtaaaaaatttcaacttcagatcactcaaagagagcattactcctcttgggctcttcaaagtagcancgtggaaatattatttcaaattgatgccaaaatgcactaatgcctttcaaactgaaaatccttggaagatggttctggaaactttactatcttcttaa

SEQ ID NO: 20256 - protein, 258 aa, Unknown
  Obtained from environmental sample
  misc_feature (1)..(258): Xaa is any amino acid
MLSSFTPAKVLKGAFQNKEKKKFRSALVVFQFSVSLVVIIGLLVINKQLNFIQNQSLGFQKDQTVIVHDAYTLRSNLDVYKKQLLKEPEFKNATISSYLPINGFSMNEQTFWPKGQDPVQGNNSSMQVWNVDEDYIPTLGMEITEGRNFSIDRETDENTVILNEALAQRFGFENPIGEIITTFSQNSDGSFDTENLREFIIIGVVKNFNFRSLKESITPLGLFKVAXWKYYFKLMPKCTNAFQTENPWKMVLETLLSS

SEQ ID NO: 20257 - DNA, 549 bp, Unknown
  Obtained from environmental sample
  misc_feature (1)..(549): n is a, c, g, or t
ttgattagtatctcaatagagaagaaattagtacgccattattttatgagaataagacttattagaaaaaatgatttggcttccgttagtgtattgaatgagcacgcaatacctcatgtaaacagtctaactatagacgagttggagtggtttatggaaaatagccaactctttgttgtggctgaagaagacgatgtgattattggctttatgattgttcttgggccaggaattacttacgaaagtctcaattaccagtattttgtagctcactacaagaactttgattatgtagaccgtattgttgtagccgactcgcataaaggcaaaggaattggaacagctttatatagctaccttactgatcatagcacatcaaagtttgttacttgcgaagtgaatttgatcccaccgaatccattatccatcaaatttcatgagaataaaggttttaaagaagtggcaaggcaaaaatctgaaggcggtaaaaaaatggcttctttacgagtaaaagatttgagtgagaaaaaaccccgtttactcgcttag

SEQ ID NO: 20258 - protein, 182 aa, Unknown
  Obtained from environmental sample
  DOMAIN (59)...(152): Acetyltransferase (GNAT) family
  misc_feature (1)..(182): Xaa is any amino acid
MISISIEKKLVRHYFMRIRLIRKNDLASVSVLNEHAIPHVNSLTIDELEWFMENSQLFVVAEEDDVIIGFMIVLGPGITYESLNYQYFVAHYKNFDYVDRIVVADSHKGKGIGTALYSYLTDHSTSKFVTCEVNLIPPNPLSIKFHENKGFKEVARQKSEGGKKMASLRVKDLSEKKPRLLA

SEQ ID NO: 20259 - DNA, 744 bp, Unknown
  Obtained from environmental sample
  misc_feature (1)..(744): n is a, c, g, or t
atgtggctgaccggttttgatgtccccgttctggacaccatgtacatcgacaagccgatccaacggcataatctgatccagaccatttcgcgggtgaaccgcaagtttgagcagaaggaaaaagggttgatcgtggactacatcggcattcgcaggcagatgaatctggcgctgaaggagttcaatgacccggacaagaacaattttgaggacatccggcaatccattgtggtggtgcgtgaccatctggacctgatggcaaagatcttccacaagtttgacagtcgcccctatttccggggaactcctctggaacaattgcacaccctcaaccaggccgccgaatacgttcagctcacccaggaattggagaaacgcttcatgtacctggtcaagcgcatgaaagccgcttacgatatttgtgcaggcagtggggcctttacgcaggaagagcaggaccacatccatttttattttgcggttcgctctatcgtattcaagctcaccaaaggcgatgcgcccgataccgctcagatgaatgcgcgggtgcaaaagatgattatggacgctcttcacagccagggcatcgaagagatcctcaaactcggcgaagacgacaccaccgaaatcgacattttcgacgaagactaccttgccaaaatcgacaagatcaagctgcccaataccaagctcaaattgctgcaaaagctgctggccaaggccatcggtgagtcnaaaaagtga

SEQ ID NO: 20260 - protein, 247 aa, Unknown
  Obtained from environmental sample
  misc_feature (1)..(247): Xaa is any amino acid
MWLTGFDVPVLDTMYIDKPIQRHNLIQTISRVNRKFEQKEKGLIVDYIGIRRQMNLALKEFNDPDKNNFEDIRQSIVVVRDHLDLMAKIFHKFDSRPYFRGTPLEQLHTLNQAAEYVQLTQELEKRFMYLVKRMKAAYDICAGSGAFTQEEQDHIHFYFAVRSIVFKLTKGDAPDTAQMNARVQKMIMDALHSQGIEEILKLGEDDTTEIDIFDEDYLAKIDKIKLPNTKLKLLQKLLAKAIGESKK

SEQ ID NO: 20261 - DNA, 414 bp, Unknown
  Obtained from environmental sample
  misc_feature (1)..(414): n is a, c, g, or t
ttggatgctattttgtccttttccaagcacgccgaaacactcagtaaagaaggatcaaaaagcggcgaagaggttgaaaatctcatttattgctaccatccttttccgaaggaagaggaaaataaagtaagaaaaaaacgacgacttgaagaagacccaattgatgaaaatgaatcctcagaagactcagaggacgatgacacgccccagcctataatcttccccgacggattcaacccaatcattggtgccgataattattttgaaacaggcgcacgcaatactgctgccagaggcaccatccttataaagaacaacattgtgatcactggaagtatgctcaccacgcgcaaaaagaaatccgtgtacgggcaaaattgtgaattggaatttaacggcctgccaactcaatga

SEQ ID NO: 20262 - protein, 137 aa, Unknown
  Obtained from environmental sample
  misc_feature (1)..(137): Xaa is any amino acid
MDAILSFSKHAETLSKEGSKSGEEVENLIYCYHPFPKEEENKVRKKRRLEEDPIDENESSEDSEDDDTPQPIIFPDGFNPIIGADNYFETGARNTAARGTILIKNNIVITGSMLTTRKKKSVYGQNCELEFNGLPTQ

SEQ ID NO: 20263 - DNA, 735 bp, Unknown
  Obtained from environmental sample
  misc_feature (1)..(735): n is a, c, g, or t
atgaaggtaattgatttaagttgcgatgttggagaaggagtagagaatggacatctggtaaggtcgtatatttcgtcgtgtaatatagcctgtggaggtcattttggggatgaaaaatcgattgatgaaaccattcaattagctattgagaataaagttaagattggcgcacacccatcatttcctgataaaaaaaattttggaagaaaaatgatgaatatttctgatgaggatttacaaaaaagtattgtttttcaactagatttatttcaaaaatgtttacaaaaaaagaatgtgaaactacatcatattaaagcccatggagctttatataatttaattgctaaggataaaaaagcggcaacagtttttgttaatgctattaaaaaatatgtagagaaagcttatttgtatgttccatataattcagaaattgaaaaagtagctattgaaaataacatcaacattaaatacgaagcttttgctgatcggaattataatagtgatttgtctttggtttcaagaactgaatcaaatgcaattattacgaatccaaccaaagtttatgaacatgtattaaatatgattcagaacgattgcgtaaaaacagtttcaaattcactattaaaaataaaatcggatactttttgtattcatggcgataatcaaaatgctctcgaaattttgcaagaagtaacagcactattaaaaactcaaaagatacaaattgcctag

SEQ ID NO: 20264 - protein, 244 aa, Unknown
  Obtained from environmental sample
  DOMAIN (3)...(239): LamB/YcsF family
  misc_feature (1)..(244): Xaa is any amino acid
MKVIDLSCDVGEGVENGHLVRSYISSCNIACGGHFGDEKSIDETIQLAIENKVKIGAHPSFPDKKNFGRKMMNISDEDLQKSIVFQLDLFQKCLQKKNVKLHHIKAHGALYNLIAKDKKAATVFVNAIKKYVEKAYLYVPYNSEIEKVAIENNINIKYEAFADRNYNSDLSLVSRTESNAIITNPTKVYEHVLNMIQNDCVKTVSNSLLKIKSDTFCIHGDNQNALEILQEVTALLKTQKIQIA

SEQ ID NO: 20265 - DNA, 708 bp, Unknown
  Obtained from environmental sample
  misc_feature (1)..(708): n is a, c, g, or t
ttgcctgaaacaaggtatgtttatcatttctttaaatctaataccaatgaaaattctgagcaggaaataaataattttagagaaagaatattatcaggagaaagttttgaaacactggctgaaatgtattcggattcagaatctaggcataaaaaaggatttttagggcgaattaaaaaaggagatttttcatcagagtttgatgatataattttctctttagaaataaatgaattgagtccggttgttaaaactaaagacggttttcatttgtttaaagtatcagaaagactaaacgttacaaaatataaactttttgaaattaaaaatgtggtatataaagacttgtactatgaaaagaatgttgcattaattaaacaagaagcattggctttagttgacaatctaaatccaatatcgattctagataaagagaaatttgaagagatatttaatgaaaaatctatacaagataagttatatcaaataggagatgaagagttgttattggggcagttttttttactgttacaagattttcaaaaaaacaatcccagtataaatattgcagaaaaatattttttattatttgaagagtatgcctattctgaaataatttatcaaaatatgctcaaagaaaatattagttatagtcaacccaaaataatagagagtttaatcgcacaatcattattgcgaggaatctag

SEQ ID NO: 20266 - protein, 235 aa, Unknown
  Obtained from environmental sample
  DOMAIN (9)...(96): PPIC-type PPIASE domain
  misc_feature (1)..(235): Xaa is any amino acid
MPETRYVYHFFKSNTNENSEQEINNFRERILSGESFETLAEMYSDSESRHKKGFLGRIKKGDFSSEFDDIIFSLEINELSPVVKTKDGFHLFKVSERLNVTKYKLFEIKNVVYKDLYYEKNVALIKQEALALVDNLNPISILDKEKFEEIFNEKSIQDKLYQIGDEELLLGQFFLLLQDFQKNNPSINIAEKYFLLFEEYAYSEIIYQNMLKENISYSQPKIIESLIAQSLLRGI

SEQ ID NO: 20267 - DNA, 390 bp, Unknown
  Obtained from environmental sample
  misc_feature (1)..(390): n is a, c, g, or t
atgcaatccattcttgaagatataaataacggaaaaatagacttcaatgaggcaataaaaacacactcaactatacaaaagaaatttcctcatatggaattaaataatattgcaaagcatcgcatgtctaaaatatttgggatcagaattacttataatatcatttctatggaactgggtagtgttagtgatattatcgagactaaatcaggttatctttggattataaaacttaataatgtcaccgaagagcagcagttaccattaattgaagttagcgaccacataaaagatattctaataaatcaacaaattgcaaatattcaatatgaattatttaatgagatagttgaaaaacaaaatattctatttaaatcatctatactttaa

SEQ ID NO: 20268 - protein, 129 aa, Unknown
  Obtained from environmental sample
  misc_feature (1)..(129): Xaa is any amino acid
MQSILEDINNGKIDFNEAIKTHSTIQKKFPHMELNNIAKHRMSKIFGIRITYNIISMELGSVSDIIETKSGYLWIIKLNNVTEEQQLPLIEVSDHIKDILINQQIANIQYELFNEIVEKQNILFKSSIL

SEQ ID NO: 20269 - DNA, 318 bp, Unknown
  Obtained from environmental sample
  misc_feature (1)..(318): n is a, c, g, or t
ttgataactgattatgctaaatggctaaaaaaagggcacgatgatactacctattctttaaactttaaacaatttaccaaagaagctanaaaacaccaaaaagaaggtgaaaaatttaaatctgtatttcaatttgaatctaatttaaaatttgaatctccaaaaagtgaacttcctttaataaaaaaagacattattgacggtgataaaagaatagcttggcatcaaaatttagcaaaagacatttacattaatgaagctttaaatgtgttgagtgaattacaaatgaaaaatttgaatcaactcgttaaaaactaa

SEQ ID NO: 20270 - protein, 105 aa, Unknown
  Obtained from environmental sample
  misc_feature (1)..(105): Xaa is any amino acid
MITDYAKWLKKGHDDTTYSLNFKQFTKEAXKHQKEGEKFKSVFQFESNLKFESPKSELPLIKKDIIDGDKRIAWHQNLAKDIYINEALNVLSELQMKNLNQLVKN

SEQ ID NO: 20271 - DNA, 519 bp, Unknown
  Obtained from environmental sample
  misc_feature (1)..(519): n is a, c, g, or t
atgaatttacatttaaaactggagaacattttatttctagacatagaaaccgttccgcaagaagcatcctggagtgcagtttctgaaaacacaaaactactttttgatcaaaaaacaaaataccaacgcaaagaagaatttaccgttgaggaattttacgaacgtgctggaatttgggcagaattcggaaaaattatttgtatttcggtgggttattttgtaattcaaaaaaacgaaaaacaattgcgggtaaaatcgttttatggtgacgatgaaaaagagttattagttgactttaaaaaactgttagacacacattttaacaagaatgaacacgttctatgcgcacacaacggaaaagaatctgactttccgtacatccgccgaagaatgattgtgcaacgaattgaattggccaaaaacttcatttatctggaaaaaaccttgcggaattccgcatttagacccctggaatcatggaagttggcagatttaactctcatcctctttaaaatataa

SEQ ID NO: 20272 - protein, 172 aa, Unknown
  Obtained from environmental sample
  misc_feature (1)..(172): Xaa is any amino acid
MNLHLKLENILFLDIETVPQEASWSAVSENTKLLFDQKTKYQRKEEFTVEEFYERAGIWAEFGKIICISVGYFVIQKNEKQLRVKSFYGDDEKELLVDFKKLLDTHFNKNEHVLCAHNGKESDFPYIRRRMIVQRIELAKNFIYLEKTLRNSAFRPLESWKLADLTLILFKI

SEQ ID NO: 20273 - DNA, 474 bp, Unknown
  Obtained from environmental sample
  misc_feature (1)..(474): n is a, c, g, or t
atggcagatggccagttgggatcaatcaagataagttttaaggagagaattttttatccaattgctgaccacccttctcttcaaattattcccttaatcaatcaaatttttggtgattatgaactattcaaagcctcaatcgtgacaatttcaggaaaacaaaatagtaagggggtattttcaaatccaatggaaatgcatgaatttgtaatcattcatgctgcgcttaatcaaacaaagatcattcaaaagccatggtatagtgttgaactccgaagaaatcaagaacaaaatcactttcccattcagacagataagggtatcccctccaaaattaaggacgtttcttggttttatgctaatggtaatattgtcaatgttcaggcattagggcaattgttactggaaatattaaaaaaacttgaatataaagggctaattcacaaactcatccccggagcaaaaacaagttaa

SEQ ID NO: 20274 - protein, 157 aa, Unknown
  Obtained from environmental sample
  misc_feature (1)..(157): Xaa is any amino acid
MADGQLGSIKISFKERIFYPIADHPSLQIIPLINQIFGDYELFKASIVTISGKQNSKGVFSNPMEMHEFVIIHAALNQTKIIQKPWYSVELRRNQEQNHFPIQTDKGIPSKIKDVSWFYANGNIVNVQALGQLLLEILKKLEYKGLIHKLIPGAKTS

SEQ ID NO: 20275 - DNA, 558 bp, Unknown
  Obtained from environmental sample
  misc_feature (1)..(558): n is a, c, g, or t
ttgacgatttgccccatgaactggattccattcccaagtcctgatttgagtccggaagaagagatcgaacaggaattgcgcaccaaaaccgcccgcacccgttgcatgtcgggcatgttgatgtgcctgacccgcgaacagcgattgatttacattctgggggatgtattcaacctggaccacaatgtaggcgcggaggtttttggcgtttcgaaacaaaattaccgggtcaagttgtcgcgcacccgaaaggactttcatgccttcatgaaccagcaatgcggcctggtcaagctatccaatccctgccggtgctccaaaaaagccaaagcgatggaagccgccggcaaaatgcaaaccgatgtcaaattattcgaccccaaattcaccgcaaccattgcagcctacgcggaaaaagtaggcgatgaagtggccgatatcgtggaccgaaaatacattgattttttccaaaagcatcccaccaaggaggactttgatgctgaaaccgtcatccatgagatcatcaatgatgaaggtttgcataagtattttgattga

SEQ ID NO: 20276 - protein, 185 aa, Unknown
  Obtained from environmental sample
  misc_feature (1)..(185): Xaa is any amino acid
MTICPMNWIPFPSPDLSPEEEIEQELRTKTARTRCMSGMLMCLTREQRLIYILGDVFNLDHNVGAEVFGVSKQNYRVKLSRTRKDFHAFMNQQCGLVKLSNPCRCSKKAKAMEAAGKMQTDVKLFDPKFTATIAAYAEKVGDEVADIVDRKYIDFFQKHPTKEDFDAETVIHEIINDEGLHKYFD

SEQ ID NO: 20277 - DNA, 354 bp, Unknown
  Obtained from environmental sample
  misc_feature (1)..(354): n is a, c, g, or t
atggacaacttattttttagtgttgcatttaataaatgcgatttaaaactctataagaaaataatgtctccagaaatagagttttatgatgatcgctctggacttaatacctcttataaggtagaaattgcctcttttaaagacagatgttctagacctttcgctgtaaccagaaaactagtgagtgctacggtacatgttttaggaaattatggggctgtagaaataggtgtccatgaattttatgaggatggtaaaaaagtacaaagaggaaaatttattattatctgggaaagaaaagagggttcttggattataaaacgaactgtaagctacgaccatgagccagtttaa

SEQ ID NO: 20278 - protein, 117 aa, Unknown
  Obtained from environmental sample
  misc_feature (1)..(117): Xaa is any amino acid
MDNLFFSVAFNKCDLKLYKKIMSPEIEFYDDRSGLNTSYKVEIASFKDRCSRPFAVTRKLVSATVHVLGNYGAVEIGVHEFYEDGKKVQRGKFIIIWERKEGSWIIKRTVSYDHEPV

SEQ ID NO: 20279 - DNA, 795 bp, Unknown
  Obtained from environmental sample
  misc_feature (1)..(795): n is a, c, g, or t
atggttcaaagaaaaaataacgaagctttattatatgttcgggtgtcgagtaaagaacaagagaaggatggatactctctcgatgctcaggaaaaacttggaagagaatatgctaaacgtcaaaatttagaaattgtccgtatgtggaaagtttctgaatcagcttggaaaaaagaacggacagcattcaatctgatggttgattattctaaaaaacactcagaagtaaagcatattatttttgacataacagatagaatgacaagaaacgattttgataaacttaaaattgtttcattgattaaagagcatgataagagtatacatttttccagaacaaacaagataatagataaggattccggttctgatgctgagttcatgtttgatattgaagttgcagtcgcaaagaagatgtcaaatgatatatcaagaaaagccaaaatgggtttagaagagaaagccgaacaaggcgaatatccttcaactgcaccaattggttatataaataataaagaaactcatttaatcgatattgatcctgaaaggtctgcatttattaaatcggcatttcttgaaatgggatcaggcaattattcactaagcactttagcagaaaaattatatagagatggcttaaggtcaaaaagaggtcttaaagttataaagccaacattagctcatttgttgaagaaccctttttattatggttgttcctatggacaactacatttacaacgtatcatgagtcaatttaacaaaacgccatatgatttagtcagagtgtttactnna

SEQ ID NO: 20280 - protein, 265 aa, Unknown
  Obtained from environmental sample
  DOMAIN (9)...(160): Resolvase, N terminal domain
  misc_feature (1)..(265): Xaa is any amino acid
MVQRKNNEALLYVRVSSKEQEKDGYSLDAQEKLGREYAKRQNLEIVRMWKVSESAWKKERTAFNLMVDYSKKHSEVKHIIFDITDRMTRNDFDKLKIVSLIKEHDKSIHFSRTNKIIDKDSGSDAEFMFDIEVAVAKKMSNDISRKAKMGLEEKAEQGEYPSTAPIGYINNKETHLIDIDPERSAFIKSAFLEMGSGNYSLSTLAEKLYRDGLRSKRGLKVIKPTLAHLLKNPFYYGCSYGQLHLQRIMSQFNKTPYDLVRVFTX

SEQ ID NO: 20281 - DNA, 693 bp, Unknown
  Obtained from environmental sample
  misc_feature (1)..(693): n is a, c, g, or t
atgaaaagtaaaaaagttttgccgtttaataacttaattaaatccggtgaatgcggatgtaaggtcttaggggagatcaaaaaganacgatatacatattatcattgcacgttctttaaaggtcgtcacaatggcgagaatgcttatttgagcgaagatagattggcaatactctttgaagattcagtaagaaaagtatcaatctcaaaagaaaaagttgaatgggcgaaaaatgtcttgaaggattcaaagatagatcaaaacaagatacaggatcaaaaactttcttctttaatacgtaacaaaacaaagattgaaaaaagaatcaatagactttacgatcttcgcattgacggtgaaattgataatgatatatttaaactaaaagagaatgagtataagagtcagttaatcgatttggaagcatcccttaagctaagtcaaaatgtaaacttaaattattatgaagatggttgtaaaatcctcgaactttctaatcgtctatatcctaattacttaaagtctgattcagatgataaggcgagaatactaaagctcatagcttcgaactttattttgaatgggctaagtgtaaatgccacatacaataaaccgtttatttttatggaaaatttaggtgagcgtattataaagcggggtcgacgagactcgaactcgcggcctcctgcgtga

SEQ ID NO: 20282 - protein, 230 aa, Unknown
  Obtained from environmental sample
  misc_feature (1)..(230): Xaa is any amino acid
MKSKKVLPFNNLIKSGECGCKVLGEIKKXRYTYYHCTFFKGRHNGENAYLSEDRLAILFEDSVRKVSISKEKVEWAKNVLKDSKIDQNKIQDQKLSSLIRNKTKIEKRINRLYDLRIDGEIDNDIFKLKENEYKSQLIDLEASLKLSQNVNLNYYEDGCKILELSNRLYPNYLKSDSDDKARILKLIASNFILNGLSVNATYNKPFIFMENLGERIIKRGRRDSNSRPPA

SEQ ID NO: 20283 - DNA, 438 bp, Unknown
  Obtained from environmental sample
  misc_feature (1)..(438): n is a, c, g, or t
gtggaacctcaaactgtcgtgaaaatcttcgtcattgccggcgagccttccggtgacctccacggcaaaaacctcttgcgcgccctcaaagcacagcacaacggacccattgagttccggggagtcggaggggacggactggctgaagaaggtgtgcatctcgttcgccacatccgcgacaccaatttcatgggcttcgtgcaggtgatcgccaatctgggcaaaatccggcaactctttcgcgatgtcaaagcggacatcatcgaattcgaccccgatgcagttatcctcatcgattatccgggtttcaacctccgcctggccaaattcctccaccaacacggcatcaaagtcctctactacatttcccctcaggtctgggcctggaaaaagggccgggtcaagcaaatcaaggcttatgtggaccgcatgtgctga

SEQ ID NO: 20284 - protein, 145 aa, Unknown
  Obtained from environmental sample
  DOMAIN (9)...(145): Lipid-A-disaccharide synthetase
  misc_feature (1)..(145): Xaa is any amino acid
MEPQTVVKIFVIAGEPSGDLHGKNLLRALKAQHNGPIEFRGVGGDGLAEEGVHLVRHIRDTNFMGFVQVIANLGKIRQLFRDVKADIIEFDPDAVILIDYPGFNLRLAKFLHQHGIKVLYYISPQVWAWKKGRVKQIKAYVDRMC

SEQ ID NO: 20285 - DNA, 813 bp, Unknown
  Obtained from environmental sample
  misc_feature (1)..(813): n is a, c, g, or t
ttgtccttttccgccgggagaatcctcgatgtcttttattcccggcactggaacgagatcattaccgacccgctccaactggaagtttacgtcaaaaaatcagcctgctaccccaatttgtacgtctccggtatctgcaagcaatacgtcggcaagttttcggacgcctccaaggaaacattgcaggccgtttccagcatcgaaaccgaggatgaatatgtacagcgaaaaatccagaagatcgtggaaatgaacaagaagggctactacaaaccgcgccgttccctcaagagacgggaccgcaacaaggagattcagccatttcccgatctcgcggaaaccctgcgacagctttccaaaagttccctgaaacaagaggagaaaagagacagcctggaaaagatattggtcgcgatttcctatgatcaaatcggaattgcggtgagaagccttgagttaattgatcctcgagatatcgaattcgggtccggcgattggtggaaatattggtttttggaaagggattggggctttttcaattataattttgcgaatgaagcggatcgggaagagtttttgcaaaaatacgattcgaaatcgcagcaagaattgtataccggaatgctggatgatgccgaatccaatggctatcggattgattacaaaagaccggatggatcgctcgactacgacaagattaccaaatgctcaatacgattcgtggtgctatgtgggggtgacgctgctcaaaggccactgttttgcccgatcaagtctggagcaaattcgaacacctgggtatcggaagactga

SEQ ID NO: 20286 - protein, 270 aa, Unknown
  Obtained from environmental sample
  misc_feature (1)..(270): Xaa is any amino acid
MSFSAGRILDVFYSRHWNEIITDPLQLEVYVKKSACYPNLYVSGICKQYVGKFSDASKETLQAVSSIETEDEYVQRKIQKIVEMNKKGYYKPRRSLKRRDRNKEIQPFPDLAETLRQLSKSSLKQEEKRDSLEKILVAISYDQIGIAVRSLELIDPRDIEFGSGDWWKYWFLERDWGFFNYNFANEADREEFLQKYDSKSQQELYTGMLDDAESNGYRIDYKRPDGSLDYDKITKCSIRFVVLCGGDAAQRPLFCPIKSGANSNTWVSED

SEQ ID NO: 20287 - DNA, 420 bp, Unknown
  Obtained from environmental sample
  misc_feature (1)..(420): n is a, c, g, or t
atgaattcattcaaaaaattaacaaatcggattttgattttatcaagcggatttttgattatagtaatcggaatttcttattttttgtatggtatgaatgaacaaaaacaatcagtttgcggaactgaaacaccagaattcttttgcggaactgtcaatctttcggaaaatgcacgaaatggaaaacagatatttaatgcgaattgtgctgcttgtcacaaactgaacaaaaatatgactggaccagctttggcgaaaactgattctactcgactttggaattggatgactttaaaaaaaggaaaaatagatagttctaaaatcagcgaattaggaattgattatcacagaaatctttggggaaaatcattaaaacaaactgaattgaatgaactttatgaatatataaaagcggaataa

SEQ ID NO: 20288 - protein, 139 aa, Unknown
  Obtained from environmental sample
  DOMAIN (59)...(139): Cytochrome c
  misc_feature (1)..(139): Xaa is any amino acid
MNSFKKLTNRILILSSGFLIIVIGISYFLYGMNEQKQSVCGTETPEFFCGTVNLSENARNGKQIFNANCAACHKLNKNMTGPALAKTDSTRLWNWMTLKKGKIDSSKISELGIDYHRNLWGKSLKQTELNELYEYIKAE

SEQ ID NO: 20289 - DNA, 702 bp, Unknown
  Obtained from environmental sample
  misc_feature (1)..(702): n is a, c, g, or t
atgagttttacggtaatgagtgaaaacgttttagacgaaccttacgcaccacagtactataatgtatacatgaaaggtgccttaattggtatgtgtattgacatcatcttacgtgaagaaagtaatggtaacagaggtattttatcattaatgaaagaattatctaacaaatacggaaaaaacaaaccttttgaagatgataagttaatagaagaaattactgcaatgacttatcctagtgttggcgaatttttaaacacgcatgttgttggtggtacaccaatagattattcggtttactttaaaaaagtaggattaagtttagatacgggaaaagttaaaactaactacatccaaaacgacggaactttaatttttgctccagatagagaaacaatgactattccttttagcgaagctgttaaggataatagtttttggaatgacaatggtgttttaccaggagatgttttaaaatcagttgatggtaaagaattaaccttagctacagcacaacaaattttaactgcaatgtacatgtggcaaccaggtacagacattaatgtcgtttcagatagaaaaggagaagaaatagttattaaaactaaattaactcagtcgtatactaacggaacaaaattagtcgaagatgctaatgccacagaagcacaaaaagcagtaagacagttggtaaaaggctaa

SEQ ID NO: 20290 - protein, 233 aa, Unknown
  Obtained from environmental sample
  misc_feature (1)..(233): Xaa is any amino acid
MSFTVMSENVLDEPYAPQYYNVYMKGALIGMCIDIILREESNGNRGILSLMKELSNKYGKNKPFEDDKLIEEITAMTYPSVGEFLNTHVVGGTPIDYSVYFKKVGLSLDTGKVKTNYIQNDGTLIFAPDRETMTIPFSEAVKDNSFWNDNGVLPGDVLKSVDGKELTLATAQQILTAMYMWQPGTDINVVSDRKGEEIVIKTKLTQSYTNGTKLVEDANATEAQKAVRQLVKG

SEQ ID NO: 20291 - DNA, 825 bp, Unknown
  Obtained from environmental sample
  misc_feature (1)..(825): n is a, c, g, or t
gtggatcaagaatcggctcgagaagatggcttagctttagggacgttatgtgtttacgaccatgaacctagacaactaacagaaattcagaaaaaagcccttataactttangtaaacaagtcatgaacttatttgatttaagattaaataataggcttttagatgaatccaaaaaagagttattagagcgtaatgctgatttaagcaaatttgctagtcacgtgtctcacgatttaaaatctccactagcaaacattatatctttaactgcctttttaaaggaagaagaaggtaatgtttttactgaagaatctattgattacattaattatattgaagaatctgcagattctcttaaaaattatattgacggaattttaatacattataaagctaacgagttattaaatgaagataaacaaaccattgccttaaatgcgctttttgaagaagttaaacgcatacacctgttagacgatttacaatttaaaacaaatacaaaaaaccaaaacatatttattaataaagctgctgttactcaaattttaataaatttagtggacaacgctttaaaatataataacaaaccaaatcctgaggttattttaaactattctgaaaataagaattttcatattttctctgtgacagataatggaattggtattgcgcaagagcaacaaaacgaagtatttacattatttaataacaataatcaaacagacgcaaaaggtaataaagggactggcattgcattgtctactgtaaaaaacttagtccaaaaactaatggtgatatcgtttctaaatcccaaattgccataa

SEQ ID NO: 20292 - protein, 274 aa, Unknown
  Obtained from environmental sample
  DOMAIN (67)...(135): His Kinase A (phosphoacceptor) domain
  misc_feature (1)..(274): Xaa is any amino acid
MDQESAREDGLALGTLCVYDHEPRQLTEIQKKALITLXKQVMNLFDLRLNNRLLDESKKELLERNADLSKFASHVSHDLKSPLANIISLTAFLKEEEGNVFTEESIDYINYIEESADSLKNYIDGILIHYKANELLNEDKQTIALNALFEEVKRIHLLDDLQFKTNTKNQNIFINKAAVTQILINLVDNALKYNNKPNPEVILNYSENKNFHIFSVTDNGIGIAQEQQNEVFTLFNNNNQTDAKGNKGTGIALSTVKNLVQKLMVISFLNPKLP

SEQ ID NO: 20293 - DNA, 762 bp, Unknown
  Obtained from environmental sample
  misc_feature (1)..(762): n is a, c, g, or t
atgaccgaaaatattaatcgagaaattacactcttaaaaccagaagatgttttcttgataattgatcgcgtaaagcaaaaatttgattttccaattcattttcatccagaatacgagttaaattttattttaaatggaagaggaattagaagagttgtaggaagctctatggaagaaattggcgatgttgaactcgttttagtaggttctaatttagaacatggttgggaaacatataactgtaaaagaaataaaatttatgaaattaccattcagtttcatgaaaatttatttagtgaaaaattactctctttaaaaaactttaaaccaataaaagatttatttgcaagatctaaacaaggtgtgctttttgatgaaaaaacagccatccatttaatgtcaaaaataaaagcactttcatcaaaaaatggtattgatgattttgtaaaacttttaaaacttcttgaagaacttgccaattcaaaaaaccaacgtatactttctactaatatagaaagaaacaaccaatttgaaggcagtgaaaaaattaaaaaagtgcatgattttttaaacgaaaattatgcacgaaaaatctctttacatgaaatttctgatttggtaaatatgagtcaaagctcttttaatcgctttataaaaaaaagaacaggaaaaacgtctatcgagtttacaaatgatacaagaattagttacgcaacaaaatttctagtagaaacagattatccattggagaatagggtataa

SEQ ID NO: 20294 - protein, 253 aa, Unknown
  Obtained from environmental sample
  DOMAIN (185)...(231): Bacterial regulatory helix-turn-helix proteins, AraC family
  misc_feature (1)..(253): Xaa is any amino acid
MTENINREITLLKPEDVFLIIDRVKQKFDFPIHFHPEYELNFILNGRGIRRVVGSSMEEIGDVELVLVGSNLEHGWETYNCKRNKIYEITIQFHENLFSEKLLSLKNFKPIKDLFARSKQGVLFDEKTAIHLMSKIKALSSKNGIDDFVKLLKLLEELANSKNQRILSTNIERNNQFEGSEKIKKVHDFLNENYARKISLHEISDLVNMSQSSFNRFIKKRTGKTSIEFTNDTRISYATKFLVETDYPLENRV

SEQ ID NO: 20295 - DNA, 567 bp, Unknown
  Obtained from environmental sample
  misc_feature (1)..(567): n is a, c, g, or t
atggcaacaacttcagatattagaaatggactttgtattaaattcaacaatgatatttataaggtaatagaatttttacatgttaaacctggtaaagggcctgcatttgtgagaactaaattaaaatctgtaaccaatggtaaagtggtagacaatacttttccggcaggcagaaaaattgaagatgtgagagtagagactcataaatttcaatttttatacccagagggaaatacgtatcattttatgaatacccaagattacaatcaaattactttagaaagagaagtgttagatgcccctgaattaatgaaggaaggtgaagttgttacggtgattatcaatgcagaagatgacatgccactttcagtagaaatgcctgcacctgttattttagaaattactcatgccgagcctggagttaaaggaaatacggcaaccaatgctacaaaacctgcaacggtagaaactggagcaacgataaatgttcctctttttatcaatgagggtgacaaagtaaaagtaggtacagaaaaaggtaattatttagaaagagttaaagaataa

SEQ ID NO: 20296 - protein, 188 aa, Unknown
  Obtained from environmental sample
  DOMAIN (1)...(186): Elongation factor P (EF-P)
  misc_feature (1)..(188): Xaa is any amino acid
MATTSDIRNGLCIKFNNDIYKVIEFLHVKPGKGPAFVRTKLKSVTNGKVVDNTFPAGRKIEDVRVETHKFQFLYPEGNTYHFMNTQDYNQITLEREVLDAPELMKEGEVVTVIINAEDDMPLSVEMPAPVILEITHAEPGVKGNTATNATKPATVETGATINVPLFINEGDKVKVGTEKGNYLERVKE

SEQ ID NO: 20297 - DNA, 315 bp, Unknown
  Obtained from environmental sample
  misc_feature (1)..(315): n is a, c, g, or t
atgacttcaaaagaattaatacatgcttattataaggcttggctaaaaagcaatcaaaaagaagtaagaacaatacttaattttgacctaaagttccgaagtcctgaagagaattttgatagtgctaatgactttcttaatacctgttggaagtattctgatggttttcaggtcatgacgatagaacatgaagtgtatgatataactggaggatatgtagtatatagttcaggtgatctctgttgtggagaattgcttaaagtcaaagatggaaagattacagaaatttatgtaactttcaatcctattcactag

SEQ ID NO: 20298 - protein, 104 aa, Unknown
  Obtained from environmental sample
  misc_feature (1)..(104): Xaa is any amino acid
MTSKELIHAYYKAWLKSNQKEVRTILNFDLKFRSPEENFDSANDFLNTCWKYSDGFQVMTIEHEVYDITGGYVVYSSGDLCCGELLKVKDGKITEIYVTFNPIH

SEQ ID NO: 20299 - DNA, 822 bp, Unknown
  Obtained from environmental sample
  misc_feature (1)..(822): n is a, c, g, or t
atgaacaaaattgggatttcaactttaaactcgtaccgtggctctcaattatttgaatgtatcggaattaaaacctctacagtcgaaaaatatttcccaaatacaccaacacgtattcaaggtattggcttaagagaaattgaacaagaaattgttaaacgtcacaaaagagcttttcataaaaatacagaaccacaaattgaagttggaggagattacagatggagacgtggacaagaaaaacacatgtttaacccattaacagttgccaagcttcaagaatcggtaaaaaccaataaagcatctacatttaaggagttttcagacttagtaaacgatcaatctaaaaacctaatgactattagaggtttgtttgagtttgatcaatttgaccccattcctttagaggaagtagaaccttggacagaaattgtaaaacgtttcaaaaccggagccatgtcttatggttctattagtaaagaagcacatgaaaatttagcggttgcgatgaacagaattggagggaaatctaattctggtgaaggaggagaagaccaagaacgtttctacaaaagctcacaaggagactggagaaactcagcaatcaaacaagtcgcttcagggcgttttggagtcacttccaactacctaacaagcgcaagcgaaattcaaataaaaatagcacaaggtgcaaaacctggtgaaggtggacaattaccctggaccaaaagtgaatccaagaaattgcaaaaacaagaaactcgacaccatatgttgggtttatctcaccacccaccacatcacgatttttatttcatttga

SEQ ID NO: 20300 - protein, 273 aa, Unknown
  Obtained from environmental sample
  DOMAIN (82)...(264): Conserved region in glutamate synthase
  misc_feature (1)..(273): Xaa is any amino acid
MNKIGISTLNSYRGSQLFECIGIKTSTVEKYFPNTPTRIQGIGLREIEQEIVKRHKRAFHKNTEPQIEVGGDYRWRRGQEKHMFNPLTVAKLQESVKTNKASTFKEFSDLVNDQSKNLMTIRGLFEFDQFDPIPLEEVEPWTEIVKRFKTGAMSYGSISKEAHENLAVAMNRIGGKSNSGEGGEDQERFYKSSQGDWRNSAIKQVASGRFGVTSNYLTSASEIQIKIAQGAKPGEGGQLPWTKSESKKLQKQETRHHMLGLSHHPPHHDFYFI

SEQ ID NO: 20301 - DNA, 786 bp, Unknown
  Obtained from environmental sample
  misc_feature (1)..(786): n is a, c, g, or t
atgataaggattatttcttttttactaccccttctattttttctgaattgtcaaaaaaagctttcaccaattgataatggaaattttgttggagaatggtatgtattaaattttgaggaaggaaaagaacactggaaaattgatacagaaaacaacgttcttttccgtaacaaaaataatgaattaactggtcggtactacattgaaaaattaattttcggatcagattctgatctagataccgttcgagtcttaatctctaatgataaaaaggatactttaggtattgattgggttgaaactcttggggaattcccaactgaaatacctcctgatacaattagattttatcattcttttgtaatggttaggaataaaaaattccctaaaacttatttatcaaaaaaagaaatagtagactttttagaaaattcatattgggaatacgaattcgataatactagaataaatttttttttatcggactctgttctccaaaatgatgaaaagttggcttacgttaaaatgaaagggtgtagaaatatttcatcctctaaccagtcttggactcttgatactctaaccaataatatagtatttagttttacaacaggtggatggacagaggcaatgttcattaaagaaattaaaaccaatggttttgttgtagaccaagacgaattttattggtttagaaaaaataaggtcatcaataaaagctctccatgggatgtatccaatatgattgagatggattatgaacacaatttctcgaccgattcttga

SEQ ID NO: 20302 - protein, 261 aa, Unknown
  Obtained from environmental sample
  SIGNAL (1)...(19)
  misc_feature (1)..(261): Xaa is any amino acid
MIRIISFLLPLLFFLNCQKKLSPIDNGNFVGEWYVLNFEEGKEHWKIDTENNVLFRNKNNELTGRYYIEKLIFGSDSDLDTVRVLISNDKKDTLGIDWVETLGEFPTEIPPDTIRFYHSFVMVRNKKFPKTYLSKKEIVDFLENSYWEYEFDNTRINFFLSDSVLQNDEKLAYVKMKGCRNISSSNQSWTLDTLTNNIVFSFTTGGWTEAMFIKEIKTNGFVVDQDEFYWFRKNKVINKSSPWDVSNMIEMDYEHNFSTDS

SEQ ID NO: 20303 - DNA, 825 bp, Unknown
  Obtained from environmental sample
  misc_feature (1)..(825): n is a, c, g, or t
ttgcagtgtcaaacggaggagcggttatctaaggggttaaacggacgcggcgatgagcttaaatatcaacgcaccctttggncggatatggccaatgagctactgcctaagaataaaaccattagtgagaaatcctaccgtgagctgggcatcaatcgtttgccaaaaatgaaactgggtaaatcactatataaggatattctcaaaggcaatcgttcagtgattcacgaatacaacgagacgattgatgagatcaatgcttacattgaaaaaaatggtttagtaattgagtacgacgacaagggacgtattgacctagaaagcaatgaacaagaggttaacggcgtcacaatacattataaaaagcgtaaaccctttgcgcgaattgagctcagtaatatccgatttgtagatcctgccgttgaacttgaacccgctatccctaaaagtaacagtcagacgcatagtgatgcggccaatgatcacgcacttgatgagcttttagcaatctcagccgactttgtgagtcaaaaaaagatggtacgcagcgccttattctcaaccattgataggctgcatgaagagttagcacaccagtctaaacagaccatcactattgacaaaaatattaaaagcacaccgaggttcaccgaagaggtgggacaggattacagcacgtcccgccaaaaaatgattgagcttgctaggcagataagcacaaaagagcaaagtgaggcantaaaggcggctttagcgttggttgaggagtttagacaagatgataccctacaaacagnccgcgctgtctcgagccgaattctttga

SEQ ID NO: 20304 - protein, 274 aa, Unknown
  Obtained from environmental sample
  misc_feature (1)..(274): Xaa is any amino acid
MQCQTEERLSKGLNGRGDELKYQRTLWXDMANELLPKNKTISEKSYRELGINRLPKMKLGKSLYKDILKGNRSVIHEYNETIDEINAYIEKNGLVIEYDDKGRIDLESNEQEVNGVTIHYKKRKPFARIELSNIRFVDPAVELEPAIPKSNSQTHSDAANDHALDELLAISADFVSQKKMVRSALFSTIDRLHEELAHQSKQTITIDKNIKSTPRFTEEVGQDYSTSRQKMIELARQISTKEQSEAXKAALALVEEFRQDDTLQTXRAVSSRIL

SEQ ID NO: 20305 - DNA, 672 bp, Unknown
  Obtained from environmental sample
  misc_feature (1)..(672): n is a, c, g, or t
atgttaaagtctatgggagcaaaggtttatgtttgtcctgcacatgttaaggcagacgatcctcgttcttattacgaagtcgcaaaacgtttgcacgaagagaataaaggttctatttatatcaatcaatattttaaccaattaaatattgatgcacattacaatacaactggtccagaaatttgggatcagacaagtggtgaaattacgcacttaatcgcttgtagtggaacaggaggaacaatttctggaatttctaagtacctaaaggaacaaaatccagatgtaaaagttattggtgttgatgcttatggttctgtattaaaaaaatatcatgaaacacgtgagtttgatgataaagagatttatccatatagaattgaaggattgggtaaaaacctaattccaacagcaacagattttgatttaatagacaaatttataaaagttactgatgaagaaagtgcacatactgcacgagagatttcaaattcagaaggtctttttgttggttatacaagtggagcagcaatgcaagccataaaacaactagaagaaaaaggtgagtttaagtcaacagataaagtggtagtggtttttccagatcatggatcgcgttatatgagtaaagtctataatgataaatggatggcgagaacaaggcttttttga

SEQ ID NO: 20306 - protein, 223 aa, Unknown
  Obtained from environmental sample
  DOMAIN (1)...(203): Pyridoxal-phosphate dependent enzyme
  misc_feature (1)..(223): Xaa is any amino acid
MLKSMGAKVYVCPAHVKADDPRSYYEVAKRLHEENKGSIYINQYFNQLNIDAHYNTTGPEIWDQTSGEITHLIACSGTGGTISGISKYLKEQNPDVKVIGVDAYGSVLKKYHETREFDDKEIYPYRIEGLGKNLIPTATDFDLIDKFIKVTDEESAHTAREISNSEGLFVGYTSGAAMQAIKQLEEKGEFKSTDKVVVVFPDHGSRYMSKVYNDKWMARTRLF

SEQ ID NO: 20307 - DNA, 642 bp, Unknown
  Obtained from environmental sample
  misc_feature (1)..(642): n is a, c, g, or t
atggcaatcacaccctttaatgatgataaaacactgaaaaagctaaacgagctgatcgactatgacatggttattttggtcagtagcaatncggttgaacaatgtgtaaaactaattggaacagatactctaaaagataaatctctagttactaccggaaaaaaaacagcccaggctttgatcaatcataatttatcagtcgatttttgcccagaaaaattctttaacagcgaagcattactctcaattgaagcattcaaagaacaatcaaaagataaaaaaatcgcaattattcgtggctcaagtggcagagattacctaaaaaataatttaatcgcattagatgccagcgtagattacatcgatgtttactcaagacattgcccacagcaaaacttgaatgaattaaaaacagcttggcaacaaaataagctcgatgtggttttattaactagtgcttccagtactgcaagtttctttgatttggctaaagatgaagattgggtcaatgaactcacagtattaattggtagctcaagaatgcaacacgagattcctgcacagtttaagggtaaaatacttatcgcagaagaccctagcgatgaaacacttttcaagaaactgactttagaatatggatga

SEQ ID NO: 20308 - protein, 213 aa, Unknown
  Obtained from environmental sample
  DOMAIN (1)...(197): Uroporphyrinogen-III synthase HemD
  misc_feature (1)..(213): Xaa is any amino acid
MAITPFNDDKTLKKLNELIDYDMVILVSSNXVEQCVKLIGTDTLKDKSLVTTGKKTAQALINHNLSVDFCPEKFFNSEALLSIEAFKEQSKDKKIAIIRGSSGRDYLKNNLIALDASVDYIDVYSRHCPQQNLNELKTAWQQNKLDVVLLTSASSTASFFDLAKDEDWVNELTVLIGSSRMQHEIPAQFKGKILIAEDPSDETLFKKLTLEYG

SEQ ID NO: 20309 - DNA, 387 bp, Unknown
  Obtained from environmental sample
  misc_feature (1)..(387): n is a, c, g, or t
atgaaaatgaaatttacctttttattattaattatttcgacaatttcgatttatggacaagacagtttaaaaaaaataactcgtgaaaaattagttggagaaaaaataaaatttttattagacaatgataattctcgaggatatgcaaatttcggaaaaaacgaaaatgcttatccatatttagattacgaagaatttaaagaaagagttgcaactatcattagtaaaaataaaggagtttatgaattacaaatggacgataatgaggaaaaggtatttatgaaaatatatgatttttcaaatattccaaataacataggtttaattactttattagaacaagcaagagcaaactatgtgggaaagacttttttaataaagagttag

SEQ ID NO: 20310 - protein, 128 aa, Unknown
  Obtained from environmental sample
  SIGNAL (1)...(19)
  misc_feature (1)..(128): Xaa is any amino acid
MKMKFTFLLLIISTISIYGQDSLKKITREKLVGEKIKFLLDNDNSRGYANFGKNENAYPYLDYEEFKERVATIISKNKGVYELQMDDNEEKVFMKIYDFSNIPNNIGLITLLEQARANYVGKTFLIKS

SEQ ID NO: 20311 - DNA, 564 bp, Unknown
  Obtained from environmental sample
  misc_feature (1)..(564): n is a, c, g, or t
atgtttgatagggtttctgataaaatagaatgtgataaagttgtaattgacgattttaaagctgcctatgatgccacaaaatatttattaagccagggccgaaaaaaaatagctctaattagtacaattaatgatttgaatatcggaaaattaagaattagcggatacaaaaaagcattaaaagataattctaatcacaacaatgttgaattaatcattaaaataaataataaaaccgaatataattctgtcatttcttcgttatttgatgatcataatgatttagacggtatttttgccactgataatgtttcagccattactgctttaaaaatagccaacttaaaaggattgaaggttcctgaaaatattggagtcattggattctcagatgataaaatttcaagattatcattccctacattaactactgtttctcagaatgcattagatattggtaaaaattcggcaagaatgttaattgagagattaaaaaatgatacttcagaagaatttaaaacaaaagttatagaaacagatttggtaatacgggaatcaacgtaa

SEQ ID NO: 20312 - protein, 187 aa, Unknown
  Obtained from environmental sample
  misc_feature (1)..(187): Xaa is any amino acid
MFDRVSDKIECDKVVIDDFKAAYDATKYLLSQGRKKIALISTINDLNIGKLRISGYKKALKDNSNHNNVELIIKINNKTEYNSVISSLFDDHNDLDGIFATDNVSAITALKIANLKGLKVPENIGVIGFSDDKISRLSFPTLTTVSQNALDIGKNSARMLIERLKNDTSEEFKTKVIETDLVIREST

SEQ ID NO: 20313 - DNA, 612 bp, Unknown
  Obtained from environmental sample
  misc_feature (1)..(612): n is a, c, g, or t
gtgtttgcaaaactcagcatttctaattttatatttttaaaatttggtgtcatgaaaagattaacattcataatgggacttttactgttaacggcttgttcctcaactaaatttgttgacagttggaggaatcaggaaataacttcctttcaaccaaaaaaactcttggtggttggaatgacggctaatcttgccgctcgtaagatatttgaagaagagctaaaaaacagttttttacatcgtaatattaatgctgttgaaagttcactaatttttgatgaaatttttacggactccaaaaaaagtgaagaagaaattgatcaaatggtaaaaaagatagctaaagatgtatttgacgcaattttgatcactgcaataaaaggagttgatgggaaaccaanttatatgaccggtacaacaactggttattacgatctaaactatcattggagaaggtttgcacggtactattatagatttcaagacattttttacaaacctaattactatgaaacctctatatataatttgaaggacaatgaccaccagtcatttgggtgggttgggacatcggatattatagaatcccaatactattatatccactgttaa

SEQ ID NO: 20314 - protein, 203 aa, Unknown
  Obtained from environmental sample
  misc_feature (1)..(203): Xaa is any amino acid
MFAKLSISNFIFLKFGVMKRLTFIMGLLLLTACSSTKFVDSWRNQEITSFQPKKLLVVGMTANLAARKIFEEELKNSFLHRNINAVESSLIFDEIFTDSKKSEEEIDQMVKKIAKDVFDAILITAIKGVDGKPXYMTGTTTGYYDLNYHWRRFARYYYRFQDIFYKPNYYETSIYNLKDNDHQSFGWVGTSDIIESQYYYIHC

SEQ ID NO: 20315 - DNA, 330 bp, Unknown
  Obtained from environmental sample
  misc_feature (1)..(330): n is a, c, g, or t
ttggaacgttttgaaaatgtgatttctaactattttgagaatggcatattattggaaaatgggattccaacagtaactgacattgcaaaacaattgaacatttcgccaaactacttaggaagtttattgcgaattcatacccaacaaaccacacaacaacacattcaaaacaagctcatagaaaaagccaaagagaaactatcaaccactaatttgtcagtaagtgaaatcgcttatgaattgggttttgagcatccgcagtctttcagtaaactatttaaaagcaaagttgaaatgaacccatcggaatttaggaagagttttaattga

SEQ ID NO: 20316 - protein, 109 aa, Unknown
  Obtained from environmental sample
  DOMAIN (62)...(106): Bacterial regulatory helix-turn-helix proteins, AraC family
  misc_feature (1)..(109): Xaa is any amino acid
MERFENVISNYFENGILLENGIPTVTDIAKQLNISPNYLGSLLRIHTQQTTQQHIQNKLIEKAKEKLSTTNLSVSEIAYELGFEHPQSFSKLFKSKVEMNPSEFRKSFN

SEQ ID NO: 20317 - DNA, 486 bp, Unknown
  Obtained from environmental sample
  misc_feature (1)..(486): n is a, c, g, or t
atgactgattacgctaaattcatttttaattgtaacgaactgcctaaagaggttgaaaatacaaatgcatttttccgtcgatttataatattaccattcaaggtaactattccgcccaaagaacaagacaaaaacctttcaaagaaaattatagaatctgaactatcaggagtgtttaactgggtcttaaacggactagaaagactattaaaacaacaagattttagtcaaagtgctattgttgaaaatgaaatactccaatatcaaaaagaaagtgatagtgttttactttttttagatgaaaaaggctataaaccctcgcacgaacattttagaaccctatctgaaatatattcagaatacaaatactattgtcaagataatggttatagactatgttcaaacaaaacagtttcagtaagactcgaaaaaagtgggtttaccaaaaaaaggcaaccaatgggacaagtcttttttattgaataa

SEQ ID NO: 20318 - protein, 161 aa, Unknown
  Obtained from environmental sample
  misc_feature (1)..(161): Xaa is any amino acid
MTDYAKFIFNCNELPKEVENTNAFFRRFIILPFKVTIPPKEQDKNLSKKIIESELSGVFNWVLNGLERLLKQQDFSQSAIVENEILQYQKESDSVLLFLDEKGYKPSHEHFRTLSEIYSEYKYYCQDNGYRLCSNKTVSVRLEKSGFTKKRQPMGQVFFIE

SEQ ID NO: 20319 - DNA, 567 bp, Unknown
  Obtained from environmental sample
  misc_feature (1)..(567): n is a, c, g, or t
atgaaatattggaaagacgatattgctattttcttttccaatgctgtagataaaaaagttaaaaaagaatttatggctttcgccgaaaagactttacaacacgttgattctttatccataaaagaagtcaaacatgtcgaagactctaattatattgtttattacaatgatggttttgagtacgaatcaagaatgagcaattatagcaaatccgacttctacatgcattggaacaataaaaatcaaatttatagattatctattagacttataaaggaagacttttttacacctaaattacgcttaagtgaattaaaaaaatattttataaaatcattagggcattttgagtttaaccaaagtatagacaacaagcactttttttctggtagtcatgataatgattatcaattatcagattttgatactgaaattattaaataccattattcctacggaatatgtaaaggtaccaacttagaaacatttgaagacaatcataaaaaagcaaaagagttattaaaaaacaagcaaatattactgaccttttatcatgagtttgaataa

SEQ ID NO: 20320 - protein, 188 aa, Unknown
  Obtained from environmental sample
  misc_feature (1)..(188): Xaa is any amino acid
MKYWKDDIAIFFSNAVDKKVKKEFMAFAEKTLQHVDSLSIKEVKHVEDSNYIVYYNDGFEYESRMSNYSKSDFYMHWNNKNQIYRLSIRLIKEDFFTPKLRLSELKKYFIKSLGHFEFNQSIDNKHFFSGSHDNDYQLSDFDTEIIKYHYSYGICKGTNLETFEDNHKKAKELLKNKQILLTFYHEFE

SEQ ID NO: 20321 - DNA, 321 bp, Unknown
  Obtained from environmental sample
  misc_feature (1)..(321): n is a, c, g, or t
gtgatcaagaatcggctcgagtttactaaaagtatatcggccgatgcagctacgttaacaatacatataaagggtaagtttgactttaatttagtgcaatcttttcgccaagcgtatgcgcaaatagataaaagcattactaaagtaattatcgacctaagggaaaccgattacatggacagctcagcattaggtatgctgctaaatatgcaaaaaagcatagatacacaggtcaataaatttgagatcagcaactgccaaccacaattaaaaaaaatattacaaatatctcggtttgataagaagtttgatattaactag

SEQ ID NO: 20322 - protein, 106 aa, Unknown
  Obtained from environmental sample
  DOMAIN (9)...(105): STAS domain
  misc_feature (1)..(106): Xaa is any amino acid
MIKNRLEFTKSISADAATLTIHIKGKFDFNLVQSFRQAYAQIDKSITKVIIDLRETDYMDSSALGMLLNMQKSIDTQVNKFEISNCQPQLKKILQISRFDKKFDIN

SEQ ID NO: 20323 - DNA, 324 bp, Unknown
  Obtained from environmental sample
  misc_feature (1)..(324): n is a, c, g, or t
atgaaagttaattcaaatgatactaatttagcatcgcagtttatatcgaacggttcagaagtaaaagttaataaacctgcaaatggtaaagagcaattaaatagtgaaatggagcgactagctaaggatatatattataaagatcagnctaaagagccagagncgacttataataagtcaatgaacataataacaaataatgttgtatcaccaagggaagcagaagaaaaagcgttaaatattattcgaatagatactgttaatcttaatatgccgggtggtgaagtttctaactcggttgacaaaatgtttactcagtattga

SEQ ID NO: 20324 - protein, 107 aa, Unknown
  Obtained from environmental sample
  misc_feature (1)..(107): Xaa is any amino acid
MKVNSNDTNLASQFISNGSEVKVNKPANGKEQLNSEMERLAKDIYYKDQXKEPEXTYNKSMNIITNNVVSPREAEEKALNIIRIDTVNLNMPGGEVSNSVDKMFTQY

SEQ ID NO: 20325 - DNA, 756 bp, Unknown
  Obtained from environmental sample
  misc_feature (1)..(756): n is a, c, g, or t
atggagcatttattttggaacctaataagatttaagcatatttactgcgaagtgccttcttttgggtattctcaactaaatgggtttaatcaaatgatgtctgagaaagggcagcaaataaagcctttaaaaagtgtagaacgtatagttcaagaagaacttgtaccgcaattcgctaaaagcgatgttaaattgatacaacaataccgcattccatcactaaaaaaatatgatgaaaacttcgatcaattccaatttaagccaattcctataagaaaagagttcaacgttttagctactgaatgggaggacaaacaaggaaacacaatgctttctattattcggcagtatgttacatataccaaagaagcctgttattgggggtttaatgttaatacaatggatgctccaaaagcccattttaaagacgctaaaacaatatatatatatgctttagaaaactcaaaatacaatccaatttggttgcaaacccgctatatgaaagatgctcaattagcggcacaaaaccaaaaattacacgaaggaagaatgagagggcttagagcagagtaccaagacattttaaaaagaggagatgaacataatgctatggtagatcgtaatcataaaaagtttatggatgctcatttagaacgtcaaactgtttcagcctctggcacttcatatcaagtaaatgctggcagtagagaatattggataaacgctaacggtgagtatattccctcagataattga

SEQ ID NO: 20326 - protein, 251 aa, Unknown
  Obtained from environmental sample
  misc_feature (1)..(251): Xaa is any amino acid
MEHLFWNLIRFKHIYCEVPSFGYSQLNGFNQMMSEKGQQIKPLKSVERIVQEELVPQFAKSDVKLIQQYRIPSLKKYDENFDQFQFKPIPIRKEFNVLATEWEDKQGNTMLSIIRQYVTYTKEACYWGFNVNTMDAPKAHFKDAKTIYIYALENSKYNPIWLQTRYMKDAQLAAQNQKLHEGRMRGLRAEYQDILKRGDEHNAMVDRNHKKFMDAHLERQTVSASGTSYQVNAGSREYWINANGEYIPSDN

SEQ ID NO: 20327 - DNA, 621 bp, Unknown
  Obtained from environmental sample
  misc_feature (1)..(621): n is a, c, g, or t
atgagtaaacattatttacagctaaaagacggctaccccgacttaatggttatccataacggcaaagtacattttgaagaagtaaaagccccaggcgacaagctaaggcgaaatcaattaacgactatagataacttaaagagcagtggttttgaggtacatatagccgttgttaaatggtttatagatcccaaccgcatttacagcgtagttgatttagaaacgacaggcgcattaaaaggcggtaacaaaataaccgaaattggcttagttaaagtacagcatggcaaagtaatcgatacctggactactttagttaacccacagcgacatatacctgggtttatcacgtcgttaaccggtattagcgatagcatggtaagtaatgcgccagtatttgcagatatagtaaaacctttaatggctaaattagcgggaagcatttttgttgcgcacaatgttaactttgactacgggtttattaaaaaagaatgcgaaatggcaaaggtgccttttaaaatgcccaagttgtgcactgtggtggaatcgcgtaaagcctttgcgggcttaaagtcgtactcgttgggtaatttgtccaagcactttaattttaaactttaa

SEQ ID NO: 20328 - protein, 206 aa, Unknown
  Obtained from environmental sample
  DOMAIN (68)...(206): Exonuclease
  misc_feature (1)..(206): Xaa is any amino acid
MSKHYLQLKDGYPDLMVIHNGKVHFEEVKAPGDKLRRNQLTTIDNLKSSGFEVHIAVVKWFIDPNRIYSVVDLETTGALKGGNKITEIGLVKVQHGKVIDTWTTLVNPQRHIPGFITSLTGISDSMVSNAPVFADIVKPLMAKLAGSIFVAHNVNFDYGFIKKECEMAKVPFKMPKLCTVVESRKAFAGLKSYSLGNLSKHFNFKL

SEQ ID NO: 20329 - DNA, 657 bp, Unknown
  Obtained from environmental sample
  misc_feature (1)..(657): n is a, c, g, or t
ttgccgagccaggaccgccaaaatggcttgattcaccggtcatcccatctagaaagttggggaattcagaaactattggcgtgggcacggccaatccctttaccaccaaagcgttcaccggcagcatcggcatcccgcttccctggtgtggatattaatattcgtgatgaggatgagacggttttagaattcggtgagtttggggaaatatgtattaaaggtgacaatgtcatcgcaagctaccacaatatcgacaatactgggttcttcaccgctgacggctatctaaagactggtgacatcgggtctatggacgagaagggctacgtaaaaatctatgatcgcaaaaaagacatgattatcgtcagtggctttaatgtctatcctaatgaagtggaaaacgtgatcgagcgacatcctaaagtagctgaatgttccgtcgttggtatggatgatgaattacagggacagtcggtcaaagtctttatcgttaaagcggatgccagtctgacaacagatgaaatcatacagttctgtaaagaagatctgacggggtacaaatgccccagacagatcgaatttattgatgaattgcccaagtcgacagtcggtaagatattgcgtcatgagctcagaaaatcggctaataaaacatga

SEQ ID NO: 20330 - protein, 218 aa, Unknown
  Obtained from environmental sample
  misc_feature (1)..(218): Xaa is any amino acid
MPSQDRQNGLIHRSSHLESWGIQKLLAWARPIPLPPKRSPAASASRFPGVDINIRDEDETVLEFGEFGEICIKGDNVIASYHNIDNTGFFTADGYLKTGDIGSMDEKGYVKIYDRKKDMIIVSGFNVYPNEVENVIERHPKVAECSVVGMDDELQGQSVKVFIVKADASLTTDEIIQFCKEDLTGYKCPRQIEFIDELPKSTVGKILRHELRKSANKT

SEQ ID NO: 20331 - DNA, 801 bp, Unknown
  Obtained from environmental sample
  misc_feature (1)..(801): n is a, c, g, or t
ttgacttcggtcaggaagaagtcgtgcgtatctaaaagaagtgacaattacattcgtcattacttaccgttattagagttatatcaaacctttttaaccgaaatggatgtgatttccgcgaaagcgaaatatgctaaatccatgaacgctattttaccagaaattagcgaagacagagcgttatacttgcgtgatgcctaccatccactactctatttaaataatttagagaaaaaagaaactacgtttccgcagaccattggactaaaagaagacagtaggattattgtgatttctggaccaaatgctggaggtaaatccattacattaaaaaccgttggtttactgcaagtcatgttgcaatccggttttttaattcctgtgcatgagcgtagcaaagcctttttatttgatcgtattgttagcgatattggagataatcaatccatcgagaatcatttaagtacctatagctaccgtttaaaacagatgaattatttcttgaaaaaaattaacaagaatacgctgtttttaattgacgaatttgtcactggatctgatccagaattaggaggtgctttagctgaaacttttttggaagaattttatgctagaaaagcctacggaattattaccacacattacgctaacctaaaaatgttggntaatgaaaaggacgaaatgattaacgctaacatgatgtttgacgagcgtaccttggaaccaatgtacaaattagcattaggtcaagcaggtaatagtttacgtttgaagttcgccaaaaaatggaattccgtatag

SEQ ID NO: 20332 - protein, 266 aa, Unknown
  Obtained from environmental sample
  DOMAIN (50)...(262): MutS domain V
  misc_feature (1)..(266): Xaa is any amino acid
MTSVRKKSCVSKRSDNYIRHYLPLLELYQTFLTEMDVISAKAKYAKSMNAILPEISEDRALYLRDAYHPLLYLNNLEKKETTFPQTIGLKEDSRIIVISGPNAGGKSITLKTVGLLQVMLQSGFLIPVHERSKAFLFDRIVSDIGDNQSIENHLSTYSYRLKQMNYFLKKINKNTLFLIDEFVTGSDPELGGALAETFLEEFYARKAYGIITTHYANLKMLXNEKDEMINANMMFDERTLEPMYKLALGQAGNSLRLKFAKKWNSV

SEQ ID NO: 20333 - DNA, 450 bp, Unknown
  Obtained from environmental sample
  misc_feature (1)..(450): n is a, c, g, or t
atggcagttaatacagataaaaactcatacacaatactatttgcagtagcaatggtagtagtggtaggttctttattagcatttacagcgtcttctttaagacctgcaattgatgaaaatgaacgtatggaaaaacaacaaaacattctttatgctattggcgttaacgagaatggagataatgacattgtttttgtaggtacagataaagtaggtgatttattttcttctaaaatttcagaacaattagttctagaagtaaaagacggaaagattataaatgaaatgtcgcgtcaagagtacatggacgctcataacaatcaagagccttatttaatagacgttaagaaacaacaaacgagagcaaaagaaggtaaatcaggatttttacctttatttgttggagagaaagaggtgaaactgttttacgttgccccaattagagggtaa

SEQ ID NO: 20334 - protein, 149 aa, Unknown
  Obtained from environmental sample
  misc_feature (1)..(149): Xaa is any amino acid
MAVNTDKNSYTILFAVAMVVVVGSLLAFTASSLRPAIDENERMEKQQNILYAIGVNENGDNDIVFVGTDKVGDLFSSKISEQLVLEVKDGKIINEMSRQEYMDAHNNQEPYLIDVKKQQTRAKEGKSGFLPLFVGEKEVKLFYVAPIRG

SEQ ID NO: 20335 - DNA, 405 bp, Unknown
  Obtained from environmental sample
  misc_feature (1)..(405): n is a, c, g, or t
ttggtatattctgaacatggccagaattttctcaagaccatgttaagattagtgtccgaaagagataatctgagtgttgttgcagatcaaatagggactccaacttatgcaggtgatttggccaaggttattctaaagataattactgaaaggcataccgaatatggcatttatcattttagcaatgagggagttgccagttggtatgattttgcaaaagctatatttgatgagtcaaacaccaaagtcaagttattgccaataaattcggaggcatacccaacacctgcggcgaggccttcttttagtgtaatggacaaaactaaaatcaaagaaatattggacttggaaattccatactggagggatagtttaaaggattgtctgtccaaaatgaagatttag

SEQ ID NO: 20336 - protein, 134 aa, Unknown
  Obtained from environmental sample
  DOMAIN (1)...(125): RmlD substrate binding domain
  misc_feature (1)..(134): Xaa is any amino acid
MVYSEHGQNFLKTMLRLVSERDNLSVVADQIGTPTYAGDLAKVILKIITERHTEYGIYHFSNEGVASWYDFAKAIFDESNTKVKLLPINSEAYPTPAARPSFSVMDKTKIKEILDLEIPYWRDSLKDCLSKMKI

SEQ ID NO: 20337 - DNA, 468 bp, Unknown
  Obtained from environmental sample
  misc_feature (1)..(468): n is a, c, g, or t
atgcaagtagctaaaaatatagaaagtttaaggaatttatcacaaattctatctcctgctaattttaaaaaaatagtaaaggataggaattattttgatacattttatcgtataagcaaacacactaaaatatcagattctacaactaactttgaagttattaatgctatttacaaatcacttttaggtacttacaaaaatgaatacgtttataaaaatattcttttaaatcaaaaacttcttaaaaagtatagcttaaaaaaatcaatagcattatcagaatttaaaatgggtaattcaatagcagatttggttattttaaatggtgaagctcgcgtttatgagattaaaactgaattagatggtttagataaattagataaacaattagcagattataaaaaatttgctgataaaatctatgtagtttcaaattcaaaacacattcctaatctattagttaaatta

SEQ ID NO: 20338 - protein, 156 aa, Unknown
  Obtained from environmental sample
  misc_feature (1)..(156): Xaa is any amino acid
MQVAKNIESLRNLSQILSPANFKKIVKDRNYFDTFYRISKHTKISDSTTNFEVINAIYKSLLGTYKNEYVYKNILLNQKLLKKYSLKKSIALSEFKMGNSIADLVILNGEARVYEIKTELDGLDKLDKQLADYKKFADKIYVVSNSKHIPNLLVKL

SEQ ID NO: 20339 - DNA, 459 bp, Unknown
  Obtained from environmental sample
  misc_feature (1)..(459): n is a, c, g, or t
ngaaatcctaaaggaatatcttatttatatatagctgataagttagaaacatcattatatgaaacaagagcatctttatttgattatgttacagttggcgaatttcgtttaaatgaagatttaaaaattcttaatttaagaaatccaaaagacgaccctattccttggtctgaaaatgaggccatagaagattttttaacctatgttccatttatacagactttacaaaaagagatctcattaccaataagaaaaagagataaacaattagattatattcctactcaatacatttcagaatttatcaaatcattaggttttgatggtgtagaatatcagagttcattatttgctgaaggttataatttagccattttcaatcctgataaattaaaatgtattgatacaaaagtttatgaaattgagaatataaaactgcatcataaaatattaaagtaa

SEQ ID NO: 20340 - protein, 152 aa, Unknown
  Obtained from environmental sample
  misc_feature (1)..(152): Xaa is any amino acid
MNPKGISYLYIADKLETSLYETRASLFDYVTVGEFRLNEDLKILNLRNPKDDPIPWSENEAIEDFLTYVPFIQTLQKEISLPIRKRDKQLDYIPTQYISEFIKSLGFDGVEYQSSLFAEGYNLAIFNPDKLKCIDTKVYEIENIKLHHKILK

SEQ ID NO: 20341 - DNA, 696 bp, Unknown
  Obtained from environmental sample
  misc_feature (1)..(696): n is a, c, g, or t
gtgtttgtttttattccagatgatatttatatcgttaatgcagaatcggctacaactacagtagctataaagtttttaaagagttttttcagaaaaacaagtacgcaaaattcgaatcttccagtaaacgattggtttcgtaaaattgaagaaattctaaatagcgaaagtcacgaactacgtgaaatgcaatttgaaaccgatgcagacagatcacatttagtatccttaattaatatggtggctaccgaatatttaaacaaacaatctttcgatatttttattattgaaaattcattgtctgttattttgcatcttattgcgagaaatattcagtttataaatacttcagattcggtaaaggaagtaaagtcttcaaaaattcagcaaatcatcaattatattcattctaatatttataattccgaagtattatctaccaaaagtttagcagaagaatttcatatggcagataattacatcagcgaatattttaaaaaacataccgatgtgtcgttaaaaaaatacattatcaactacaaattaaaacttgttgagactagattgaagtataccgatttacaatattctgaaattgctgcagaactcggttttacagattctagtcatttaaacaaaacctttcaagcctataaaggcacaagtttaagtgcttttaaagcgagtttgaactag

SEQ ID NO: 20342 - protein, 231 aa, Unknown
  Obtained from environmental sample
  DOMAIN (182)...(228): Bacterial regulatory helix-turn-helix proteins, AraC family
  misc_feature (1)..(231): Xaa is any amino acid
MFVFIPDDIYIVNAESATTTVAIKFLKSFFRKTSTQNSNLPVNDWFRKIEEILNSESHELREMQFETDADRSHLVSLINMVATEYLNKQSFDIFIIENSLSVILHLIARNIQFINTSDSVKEVKSSKIQQIINYIHSNIYNSEVLSTKSLAEEFHMADNYISEYFKKHTDVSLKKYIINYKLKLVETRLKYTDLQYSEIAAELGFTDSSHLNKTFQAYKGTSLSAFKASLN

SEQ ID NO: 20343 - DNA, 546 bp, Unknown
  Obtained from environmental sample
  misc_feature (1)..(546): n is a, c, g, or t
ttgacttcggtcgagagacgttcgatggagcttacaaagataagatatgccattgcaaaagaagaaaatatgccagcatatattgtttttagtgataaaactttaaaattaatggcaagtgttttgccaacaacagaaaatgaatttttatcaatttctggagttggtatgaacaaaatggaaaaatatggaactgaatttatggatgttattcgtaaatttaaagcggttgcaaaacctagaaaaatacctacaactaataaaacatatagtttttataaagaaggattgagtcctgcagaaattgcagaaaaaagagaattatcgattactacaattttttctcacttatctcaattatttgctgagggaaaagacatcgacttagaaaaatatgtaaccaaagaaactgttgataaagtacgagttgtttttaatcagtttaatcaaaaaaatgaactaaaaccaatttacgaaaaactaaatgaagaggtttcctacagtcaaattagaatgagtatcactttaatttcaaaaaacgagtag

SEQ ID NO: 20344 - protein, 181 aa, Unknown
  Obtained from environmental sample
  DOMAIN (1)...(81): HRDC domain
  misc_feature (1)..(181): Xaa is any amino acid
MTSVERRSMELTKIRYAIAKEENMPAYIVFSDKTLKLMASVLPTTENEFLSISGVGMNKMEKYGTEFMDVIRKFKAVAKPRKIPTTNKTYSFYKEGLSPAEIAEKRELSITTIFSHLSQLFAEGKDIDLEKYVTKETVDKVRVVFNQFNQKNELKPIYEKLNEEVSYSQIRMSITLISKNE

SEQ ID NO: 20345 - DNA, 561 bp, Unknown
  Obtained from environmental sample
  misc_feature (1)..(561): n is a, c, g, or t
atggtatcctatagaactatgaaaaacacaatacttcttatattactgtcatccacaatcttgaagagtcaaagttttaccagtaaagattggaaagtaatggataacaagcttacaacgaccctcacttttaccaaatcagaaatccaaaagattcagggtttttcctttaattctgtttgggataaccaactaagttattcttcaaaccttggttattatggaggtattgccgaacttcatattttaaaaatgaataacgaaattcaaactctctataactttgaagataatattggtttagggcaaatcgatttaaccttttatgattataatatggacggagcaattgatttttctgttccaatcgaatgtggaaaatcgtgttattttaaatactatttattcaaccccaaatctcaaaaatttgtacatcaaaaagaatgggattatttacgtattcaaaaaataaatagaaaaaagaaactaatcattacccaaccagatggtcacccaaaagtgtggacagatattatattcagcatctggnccgattcttga

SEQ ID NO: 20346 - protein, 186 aa, Unknown
  Obtained from environmental sample
  misc_feature (1)..(186): Xaa is any amino acid
MVSYRTMKNTILLILLSSTILKSQSFTSKDWKVMDNKLTTTLTFTKSEIQKIQGFSFNSVWDNQLSYSSNLGYYGGIAELHILKMNNEIQTLYNFEDNIGLGQIDLTFYDYNMDGAIDFSVPIECGKSCYFKYYLFNPKSQKFVHQKEWDYLRIQKINRKKKLIITQPDGHPKVWTDIIFSIWXDS

SEQ ID NO: 20347 - DNA, 777 bp, Unknown
  Obtained from environmental sample
  misc_feature (1)..(777): n is a, c, g, or t
gtgcaaaagatgaagctaaaacagaaatttataaaaactgacgttcacactacagaaactgttagtaaaactttagaaattacacctattagtcacgcaacgatggtattaaattatggcaacgaaaccatatacgtagatcctacaggaggaaaaaaagcgtttgaaggtcaaaaagacccaacgattattttaattacagatatacatggtgaccatttaagtattgatactttgaaagagctaaatctaaataatgccttgctagttgtgcctcaagcagtagctgatacatttgaagcagattttaagcctatgatgcgaattatagctaatggacaaactgctgtggtaaaggatatcccgttagaagcaattgcaatgtataatttaccagaagacgagacctctagacatcctaaaggacgcggaaatggttatattttaacttttggtcgagaacgtgtttacatctctggagatactgaggatattactgaaatgagagctttacaaaatattgataaagcatttgtatgtatgaatctaccttacactatgactgtagatagtgctgcaagtgctgttttagattttaaacctaaacaagtatatccatttcactacagagggaaagatggtttgagtgatgttgctaaatttaaagcgttagttaatgaaggtaatcctgatattgaggttatccaattagaatgtatcctgaagaaaaataattatatatttggaattgtgaatccccctcgagccgattcttga

SEQ ID NO: 20348 - protein, 258 aa, Unknown
  Obtained from environmental sample
  misc_feature (1)..(258): Xaa is any amino acid
MQKMKLKQKFIKTDVHTTETVSKTLEITPISHATMVLNYGNETIYVDPTGGKKAFEGQKDPTIILITDIHGDHLSIDTLKELNLNNALLVVPQAVADTFEADFKPMMRIIANGQTAVVKDIPLEAIAMYNLPEDETSRHPKGRGNGYILTFGRERVYISGDTEDITEMRALQNIDKAFVCMNLPYTMTVDSAASAVLDFKPKQVYPFHYRGKDGLSDVAKFKALVNEGNPDIEVIQLECILKKNNYIFGIVNPPRADS

SEQ ID NO: 20349 - DNA, 642 bp, Unknown
  Obtained from environmental sample
  misc_feature (1)..(642): n is a, c, g, or t
atgaaaaaacatttactattttttttgaccactattttaagtataagtggctattcccaaatcacttttaataatggctactatatagataatgctaatcaaaaaattaattgccaaattaaaaatattgactggaaaaataatccaactgaatttgaatatagattgtcagaaaatagtgattaccaaacagcttcaataacaacagttaaggagtttaatattaatgacgacataaaatacatacgagcaaaagttgatattgatagatctagtaataaacttgaaaaattaagtaataataaaagacctacttttaaagaggaagaactttttttaaaagtattagttgaaggagaatttatgttatttcaatatgtagacaacaatctatcacgatatttttacagtaaaaataatagcgatatcgagcagttaatttacaaatcttataaatctgattataataaagttaatacaaataataggtttagacaacagttatggaatgatttaaaatgtccaacatttgaattaagtgacattgaaaatttaaaatacaagaaacaatcgttagttaactttttcgaaaaatataacacgtgcaataacttagagtataaagtcactgctcagaagtaa

SEQ ID NO: 20350 - protein, 213 aa, Unknown
  Obtained from environmental sample
  SIGNAL (1)...(19)
  misc_feature (1)..(213): Xaa is any amino acid
MKKHLLFFLTTILSISGYSQITFNNGYYIDNANQKINCQIKNIDWKNNPTEFEYRLSENSDYQTASITTVKEFNINDDIKYIRAKVDIDRSSNKLEKLSNNKRPTFKEEELFLKVLVEGEFMLFQYVDNNLSRYFYSKNNSDIEQLIYKSYKSDYNKVNTNNRFRQQLWNDLKCPTFELSDIENLKYKKQSLVNFFEKYNTCNNLEYKVTAQK

SEQ ID NO: 20351 - DNA, 438 bp, Unknown
  Obtained from environmental sample
  misc_feature (1)..(438): n is a, c, g, or t
atgaagattaataaaatagaaattaaaaattggaggtccattattaatgaaaacattcaatttcaggatttaattattcttattggccaaaataatcatggaaaatctaatgttttaagttcactattatttttctttggagaaatcaaagctcaagaatttgattttaatggagaatcaaatgaactatcagttgagatagaatttgttgatttaaacgaaagtgaaaaagtaacgtttcaaaaatatgtgtctgctgaaagcactattaatgtaagaaaaactgcaaaaaaagatggtagttttagttacaatggatttattcaagatcctgatgaagattggttaaaagaatctaaaatcagtgattttttaagaagagatgaagccgaaaaattgccattagtaaaatatttacctgctactggaagaatttaa

SEQ ID NO: 20352 - protein, 145 aa, Unknown
  Obtained from environmental sample
  misc_feature (1)..(145): Xaa is any amino acid
MKINKIEIKNWRSIINENIQFQDLIILIGQNNHGKSNVLSSLLFFFGEIKAQEFDFNGESNELSVEIEFVDLNESEKVTFQKYVSAESTINVRKTAKKDGSFSYNGFIQDPDEDWLKESKISDFLRRDEAEKLPLVKYLPATGRI

SEQ ID NO: 20353 - DNA, 525 bp, Unknown
  Obtained from environmental sample
  misc_feature (1)..(525): n is a, c, g, or t
atgtttggtttatttgaaaataacgaaatcaccgaaaccaactttattaaaaataccgaaaccattttctacagtagaaatgatgatggtacccttatcggaattgataaagccatctcttcatcaattaaaattttatttcagcaaaaagccattaccgatatctactattataccgatgtagaaagtatactttataaagaagaagattttcctgcaaacgcgagagaactaaaagggttcaattggcgaggcgaagaacaattgctaaaaaaagaagatttgtttatcaacgaccctcctttagatttacccaaaattacaggaatcccgttaccggaagaagaggacgaattttttgatgaaaaagaagagggagaagaaaacaaagaaatgatgctcaacaaaaattctaggctaactccaaaaatacttcaaaatcgagaaaaggatactttacaactcaagcaatccaacgctccgcaattaaaagaagatcaacctaccttaaagtctgaagaatga

SEQ ID NO: 20354 - protein, 174 aa, Unknown
  Obtained from environmental sample
  misc_feature (1)..(174): Xaa is any amino acid
MFGLFENNEITETNFIKNTETIFYSRNDDGTLIGIDKAISSSIKILFQQKAITDIYYYTDVESILYKEEDFPANARELKGFNWRGEEQLLKKEDLFINDPPLDLPKITGIPLPEEEDEFFDEKEEGEENKEMMLNKNSRLTPKILQNREKDTLQLKQSNAPQLKEDQPTLKSEE

SEQ ID NO: 20355 - DNA, 765 bp, Unknown
  Obtained from environmental sample
  misc_feature (1)..(765): n is a, c, g, or t
atggttgagttattgaatgaagaaaactcgatagttggttttccttattctaaatatgtatcatcagcaaaaacaagagctttaattgatgcaggaaaaatacaagaaattggaaaagaaagttcgctaaacacagaaatcttattggatttacaaccagaattagtggttggttatagtgtttcttctgctgataaatctctaacaaccattcaaaaatctggcataaaagtaatttataatggagattggctagaagaaactcctctaggaagagctgaatggattaagttttttggagtttggtttgataaggaaaaacaagcagacagtatttttaaagtgattgaagctaattatttagatgcaaaacaaatcgctctaaaatcgactaaaaaacccactattttatcgggtgcaataatgagcaaggatatttggaatttacctgctggagaaagttttgtcgctcaatttttaattgatgcgaatctagactatctctggaaaaacacagaaggcaaaggaagtttatctttgagttttgaaagtgtttttgataaaggccaaaatgccgattattggattactcctggttatttttcatcaaaagaacagcttttaaatagtaatgaaatctataagaaatttactgcttttcaaaacgacaaaatctatacaccaatccttaaaaaaggtgaaacaggtggcgcaatttactatgaattagcaggaacaagaccagatttggttttacaagattna

SEQ ID NO: 20356 - protein, 255 aa, Unknown
  Obtained from environmental sample
  DOMAIN (1)...(230): Periplasmic binding protein
  misc_feature (1)..(255): Xaa is any amino acid
MVELLNEENSIVGFPYSKYVSSAKTRALIDAGKIQEIGKESSLNTEILLDLQPELVVGYSVSSADKSLTTIQKSGIKVIYNGDWLEETPLGRAEWIKFFGVWFDKEKQADSIFKVIEANYLDAKQIALKSTKKPTILSGAIMSKDIWNLPAGESFVAQFLIDANLDYLWKNTEGKGSLSLSFESVFDKGQNADYWITPGYFSSKEQLLNSNEIYKKFTAFQNDKIYTPILKKGETGGAIYYELAGTRPDLVLQDX

SEQ ID NO: 20357 - DNA, 627 bp, Unknown
  Obtained from environmental sample
  misc_feature (1)..(627): n is a, c, g, or t
atgaagggaatacaaattaaacaaccttttcagtctggtggtttagaaaataattttgaattaaatttttctacaattgggtatgaagatctaaaggtatctttggcaattagttctaatggagctgctaatagaatattggcggaatattttaatggaacaaactggttatctaccaatgttatagacgcaagtcaaactataaacgaggattttgaattaaaagaatttgatttttctaatattactttcgcaaatgaaaatgataattttaaaatgagatttaggtttgagggaatagatatgactattgaggatggtaaagaagtaagaataaacaatgtagccataactgcagttgataaaaatgttttgtatgcccaagaatttactaaaatagaagaaataataaatatctatccaaaccctacaaaaagtaaaattaatatttcttctgatgcaaaaatcagtaaaattttaatttataatacttttggtaaattgatttatcaatcaacagaaaaaatagataattctatagatgtaagtagttttgntaaaggtatttatttgctaaaagtgtttacagacgggacttcaatcactaaaaaaattataaaaaattaa

SEQ ID NO: 20358 - protein, 208 aa, Unknown
  Obtained from environmental sample
  misc_feature (1)..(208): Xaa is any amino acid
MKGIQIKQPFQSGGLENNFELNFSTIGYEDLKVSLAISSNGAANRILAEYFNGTNWLSTNVIDASQTINEDFELKEFDFSNITFANENDNFKMRFRFEGIDMTIEDGKEVRINNVAITAVDKNVLYAQEFTKIEEIINIYPNPTKSKINISSDAKISKILIYNTFGKLIYQSTEKIDNSIDVSSFXKGIYLLKVFTDGTSITKKIIKN

SEQ ID NO: 20359 - DNA, 318 bp, Unknown
  Obtained from environmental sample
  misc_feature (1)..(318): n is a, c, g, or t
ttgaaagtaattatagtgggtaccgacttatatgatctcaagccttcccatattaacgctgctttttcggctcttgataccaacgatgcggtaataggtccagcagaagatggcgggtattacttattaggcttaaaaacactacacccagaggtctttaaaaataaagagtggggaacagaaaccgtgtttaaggacacgataaacgatttaaaaaacaacagtgtatataggctggaaacattaaacgatattgatgtttatgaagatttagcacacaatacaacattaaaaaatataattgcaaaaaatgattaa

SEQ ID NO: 20360 - protein, 105 aa, Unknown
  Obtained from environmental sample
  misc_feature (1)..(105): Xaa is any amino acid
MKVIIVGTDLYDLKPSHINAAFSALDTNDAVIGPAEDGGYYLLGLKTLHPEVFKNKEWGTETVFKDTINDLKNNSVYRLETLNDIDVYEDLAHNTTLKNIIAKND

SEQ ID NO: 20361 - DNA, 351 bp, Unknown
  Obtained from environmental sample
  misc_feature (1)..(351): n is a, c, g, or t
ttgttgaataaattttacgtaaataaatacaccttcaatcaacaatgtaagacttgggacgatacaaaaacaaaagtagataagcttgatgcagaaattaaaaaatacaataagtctattccagacttagaagaaaaacagaaaaaggcaattgaaaaattcaaatcatattctgaagctcttagcaaccttaacacttataagaataactattcagattatcttaaaacaaaacaagatttaaatgatttaaatgattgtaaactgcccaaaatagttcaaaatggtaatattgattttgattttaagaacttgactgtaaaacaaattattcagtcaataaggatgtaa

SEQ ID NO: 20362 - protein, 116 aa, Unknown
  Obtained from environmental sample
  misc_feature (1)..(116): Xaa is any amino acid
MLNKFYVNKYTFNQQCKTWDDTKTKVDKLDAEIKKYNKSIPDLEEKQKKAIEKFKSYSEALSNLNTYKNNYSDYLKTKQDLNDLNDCKLPKIVQNGNIDFDFKNLTVKQIIQSIRM

SEQ ID NO: 20363 - DNA, 708 bp, Unknown
  Obtained from environmental sample
  misc_feature (1)..(708): n is a, c, g, or t
atggtcaacacctttattatcaccccggagacgggagtacctttangaaaaaaatcagcttccataaaattgtttgaagatttgttgaagatccatcgaagccttggaattcctaagattggcaaatacattgtaggtagtagtgctattatatttttcttgtttcttcttacctccggtttatttctatggtggaaaaagtataaatcaaattttaaaaagggaattaaaattaaatggaaacgaaatagaaaaagatttaactacgatgtacataagtcacttggaatatttttttcccttcctttggctgtaatggccttttctggtggatattttacttataacagctactataaggatggtttgaagttaatagatggttttataggcaataaacaacctgaaaaaaagattgaagcaggtaccgggatcgatatactgcacttattggagactccagacaaccaatatgcactccgggcaatttattttcctcaagatggaaatgaagtgtatcaatttagatatatcaaaaaccgatttataaaccccggtctaagaaaaaccagggaattaaaattagataataatagtaataccatttattcctcatcctttaacgacgacccggttagcgaacagatagcagcacaattttatccgattcatattggagacatggcaggcatgctggggagaatttag

SEQ ID NO: 20364 - protein, 235 aa, Unknown
  Obtained from environmental sample
  misc_feature (1)..(235): Xaa is any amino acid
MVNTFIITPETGVPLXKKSASIKLFEDLLKIHRSLGIPKIGKYIVGSSAIIFFLFLLTSGLFLWWKKYKSNFKKGIKIKWKRNRKRFNYDVHKSLGIFFSLPLAVMAFSGGYFTYNSYYKDGLKLIDGFIGNKQPEKKIEAGTGIDILHLLETPDNQYALRAIYFPQDGNEVYQFRYIKNRFINPGLRKTRELKLDNNSNTIYSSSFNDDPVSEQIAAQFYPIHIGDMAGMLGRI

SEQ ID NO: 20365 - DNA, 696 bp, Unknown
  Obtained from environmental sample
  misc_feature (1)..(696): n is a, c, g, or t
atgaaacttaaaaaagtactaaaaataatagctggtgtaatcatcttttttacattaccaagtttgttgttttttggatttgtttactttaaatataacgaagatttacctattggtaatcaaacagaaaaagctgatattttagcacataaaatgctaatatccttaaacgctgacgcgtacaaagctactaataatttggaatggacctttagccaaaaacaccactacaaatggaataaaaaagagaataactgtgaagtctattggaaaaaaaacaaggtaatattagaccttaacaatccgtctaaaagtcaagtttttataaacaaacaagaagttaatactaaccagaaggaagaacttatccaaacagcaacagactactttaacaacgattccttttggttagttgcaccatataaagtatttgactatggtacgtctagaagcattgttaagcataatggtaaagatgctttaatggtgacttactttgaaggaggctctactcctggagattcttatttatggattttagatgacaattataaacctacaaaatttaaaatgtgggttgatattttacctattggaggtttggaagccacatggagtgattggaaaacaaccgagtctaaagcagagttacctaccaaccatcattattattttgttttnacatcgagcgtctga

SEQ ID NO: 20366 - protein, 231 aa, Unknown
  Obtained from environmental sample
  misc_feature (1)..(231): Xaa is any amino acid
MKLKKVLKIIAGVIIFFTLPSLLFFGFVYFKYNEDLPIGNQTEKADILAHKMLISLNADAYKATNNLEWTFSQKHHYKWNKKENNCEVYWKKNKVILDLNNPSKSQVFINKQEVNTNQKEELIQTATDYFNNDSFWLVAPYKVFDYGTSRSIVKHNGKDALMVTYFEGGSTPGDSYLWILDDNYKPTKFKMWVDILPIGGLEATWSDWKTTESKAELPTNHHYYFVXTSSV

SEQ ID NO: 20367 - DNA, 561 bp, Unknown
  Obtained from environmental sample
  misc_feature (1)..(561): n is a, c, g, or t
ttggtatcagtcaaaaaaaagaccttagagcatccaaaagcttgcccattaaacagagctaaatatctaagtaaactgggcgactacatcgctcaaggctatgcaattgtatacatggatgagagtggcttcgaggctgagaccatccgctctcatggctatgcacctattggtaccccttgcatcgatagctataactggcaaggtaaaaaacgcaccaatgttattggtgccttatatgaaaaagcgttatttgcacttgattacttcgaaaagaatatcaatggcgacatattctacaactggtgcaaaaacacgctaataccaagtcttaaaataaaatgcgtaatcgtcatggataacgccagctttcataaacgcgttcagagattactcaacaggcatggtcatcgcttgttatttctaccgccttacagccctgatttaaaccctattgaaaaaaaatgggcacaggctaagtttctacgacaagggtggatggagaataatttacctaagctgtttcatgatatgggttgtaccaattttattctggattga

SEQ ID NO: 20368 - protein, 186 aa, Unknown
  Obtained from environmental sample
  misc_feature (1)..(186): Xaa is any amino acid
MVSVKKKTLEHPKACPLNRAKYLSKLGDYIAQGYAIVYMDESGFEAETIRSHGYAPIGTPCIDSYNWQGKKRTNVIGALYEKALFALDYFEKNINGDIFYNWCKNTLIPSLKIKCVIVMDNASFHKRVQRLLNRHGHRLLFLPPYSPDLNPIEKKWAQAKFLRQGWMENNLPKLFHDMGCTNFILD

SEQ ID NO: 20369 - DNA, 561 bp, Unknown; identical to SEQ ID NO: 20367
  Obtained from environmental sample
  misc_feature (1)..(561): n is a, c, g, or t

SEQ ID NO: 20370 - protein, 186 aa, Unknown; identical to SEQ ID NO: 20368
  Obtained from environmental sample
  misc_feature (1)..(186): Xaa is any amino acid

SEQ ID NO: 20371 - DNA, 339 bp, Unknown
  Obtained from environmental sample
  misc_feature (1)..(339): n is a, c, g, or t
atgaataaattaatttcaatcgtcttagtttgtattacgttaatgagtactggtgttttagcacatagtgatcatgcccatggctacattaatgatcaacaagcgattagtatcgcagctaaatcaataaaaaaattgacctttaaagactatggttttgaagttggaaaattaaatgattcttggcaagatatttcttcagaagcgttttcagtcataagcaagaacggtgactattatgttgttcaagcatcaaataataacggtagtgatcacgtttatttcaaaatagctaaaaatggtcagctactagatgtaaaaccgaagaacgatttctaa

SEQ ID NO: 20372 - protein, 112 aa, Unknown
  Obtained from environmental sample
  SIGNAL (1)...(18)
  misc_feature (1)..(112): Xaa is any amino acid
MNKLISIVLVCITLMSTGVLAHSDHAHGYINDQQAISIAAKSIKKLTFKDYGFEVGKLNDSWQDISSEAFSVISKNGDYYVVQASNNNGSDHVYFKIAKNGQLLDVKPKNDF

SEQ ID NO: 20373 - DNA, 354 bp, Unknown
  Obtained from environmental sample
  misc_feature (1)..(354): n is a, c, g, or t
gtgatgattgtggttgatatgttattaactggttttgattctaagtatttaaatacattatatgtagataaaaatttaaaatatcacggtttaatacaagcctattctcgtaccaatagagtaataaacgatacaaagccttatggtaatattttagtgtttagaaaccaggaagaagaagtaaataaagcaatgattcgtttctctggagctaaaatagaaaaagcaaaagaaatttggttagtagattcagcacctaaagtaatagctaaatataaagatgcggttgttaaattaaaccaatttatggaggctaaaggtttagactgtttaccttcagaagtaacaatttaa

SEQ ID NO: 20374 - protein, 117 aa, Unknown
  Obtained from environmental sample
  misc_feature (1)..(117): Xaa is any amino acid
MMIVVDMLLTGFDSKYLNTLYVDKNLKYHGLIQAYSRTNRVINDTKPYGNILVFRNQEEEVNKAMIRFSGAKIEKAKEIWLVDSAPKVIAKYKDAVVKLNQFMEAKGLDCLPSEVTI

SEQ ID NO: 20375 - DNA, 645 bp, Unknown
  Obtained from environmental sample
  misc_feature (1)..(645): n is a, c, g, or t
atggtaaagtttgctatgaaagaaaaatttaaattcaaacaatttactgtgtatcaagaaaagtgcgccatgaaaattggtactgatggtgttttgctaggggcttgggcttcattaaaacataacccaaattcagtgttggatattggcaccggcacaggtgtcattgccttacaactagcacaacgcagcgatgccgagctaattgatgccttagaaattgatgacaatgcttatgagcaagccgtagaaaattttgaacaatcaccatggaataatagattattctgttaccacatatctttagaagaatttactaaagagattgatgaaaaatacgatttaatagtatctaatccgcctttctataatgacgagtttgaaagtaatagtagggcaagaaacacagctagatttacatcagccttgtccttcaataacttactggattctgtgtcaaaattattatctgaacgtggaagtttttcagtaattataccgtttaaagaagaagttaattttatagatcttgcagaaaaaaacaatctctttatttccaagatctgcagagtcaaagggtcaccaaattcagaaattacacgtagtttactagagttttctttttataaaaaggaaaagttataa

SEQ ID NO: 20376 - protein, 214 aa, Unknown
  Obtained from environmental sample
  misc_feature (1)..(214): Xaa is any amino acid
MVKFAMKEKFKFKQFTVYQEKCAMKIGTDGVLLGAWASLKHNPNSVLDIGTGTGVIALQLAQRSDAELIDALEIDDNAYEQAVENFEQSPWNNRLFCYHISLEEFTKEIDEKYDLIVSNPPFYNDEFESNSRARNTARFTSALSFNNLLDSVSKLLSERGSFSVIIPFKEEVNFIDLAEKNNLFISKICRVKGSPNSEITRSLLEFSFYKKEKL

SEQ ID NO: 20377 - DNA, 597 bp, Unknown
  Obtained from environmental sample
  misc_feature (1)..(597): n is a, c, g, or t
atgagtgaatacttagttcccaaaatggattgttctgcggaagaacagatggttcgtatggcgctatcttcaattgatggtgttcaaaaactcatctttgatttacctaaccggtctttaaaggttctacataatcaaaaagatgaaaatataactaccaaacttgaagctttgggttttggtgcaaagcttgtgaagactgaaacttatataagcaatcaacaggctaagcaaacaagtacctataccattcctaaaatggattgctctgctgaagagcaaatggtccgtatggctcttgcagatattgaagcagttaaaggtcttacttttgatcttcccaatcgaaaactgaaagtcttccataatgaagggagtcagcaaattacggccaaactcgaaggactgggttttggggcgaaacttgatgaaatacagctttcttcaggcgatatacctaatgaacctgatcctgtgagacaagctaaagtacttaaactgttattaggtattaatgctctacttttctttatagaattcactcacgcgcgtanttattgcnnncgcngttctcanncacggantgtgattggctga

SEQ ID NO: 20378 - protein, 198 aa, Unknown
  Obtained from environmental sample
  misc_feature (1)..(198): Xaa is any amino acid
MSEYLVPKMDCSAEEQMVRMALSSIDGVQKLIFDLPNRSLKVLHNQKDENITTKLEALGFGAKLVKTETYISNQQAKQTSTYTIPKMDCSAEEQMVRMALADIEAVKGLTFDLPNRKLKVFHNEGSQQITAKLEGLGFGAKLDEIQLSSGDIPNEPDPVRQAKVLKLLLGINALLFFIEFTHARXYCXRXSXXRXVIG

SEQ ID NO: 20379 - DNA, 384 bp, Unknown
  Obtained from environmental sample
  misc_feature (1)..(384): n is a, c, g, or t
gtgaataaaaaaatagaacaatttaaaacccgagacgaatttctttttaccattaaaaaaacaattactggcgatattgtgggcttagtttatattaaaaatttggattggaaaatcaaacaaggagagttcgcctattgtgtggactacaacatacagggtaaaggcattggtacaaaagccatccaagcgctttctaattatgcttttaaaaccttaactttaaatacgcttactgccattataaataaagaaaatagagctagtataaacgtggttaaaaataatggttttacttggtcgcgcacattaaaaaacgaatttactcctagagatcaatcccctttagatatggagttatacacattgcacaatgaaagataa

SEQ ID NO: 20380 - protein, 127 aa, Unknown
  Obtained from environmental sample
  DOMAIN (18)...(99): Acetyltransferase (GNAT) family
  misc_feature (1)..(127): Xaa is any amino acid
MNKKIEQFKTRDEFLFTIKKTITGDIVGLVYIKNLDWKIKQGEFAYCVDYNIQGKGIGTKAIQALSNYAFKTLTLNTLTAIINKENRASINVVKNNGFTWSRTLKNEFTPRDQSPLDMELYTLHNER

SEQ ID NO: 20381 - DNA, 543 bp, Unknown
  Obtained from environmental sample
  misc_feature (1)..(543): n is a, c, g, or t
atggggactatctgccgagttaaaactccagatttcgaaacgcgtgtgtctatacttaataacaaattgtatcgcgatggtgtggaaatgcccgacgatattatcgagtacgtggcaaaacatattaaatctaatattcgtgagcttgaaggtgctattatttcattaattgcgcaatcgtcttttaataaaaaagaaattaatattgaattagcaaaacaggttgtagagaaatttgttaagaacactaaacgtgaagtctctatagattacattcagaaaatagtttcagattacttccaaatggatgtcgataccttacaatctaaaacacgaaaacgtaatattgttcaagccagacaattagctatgttttttgctaagaaattaacaaaagcatcgttagcaagtattggttcgcaaataggaaaacgagatcacgctaccgttttgcacgcttgtaaaactgttgataatttatctgctaccgacaaacaatttaaaaagtacgttgaagatcttactaaaaaattatctgtataa

SEQ ID NO: 20382 - protein, 180 aa, Unknown
  Obtained from environmental sample
  DOMAIN (1)...(157): Bacterial  dnaA  protein
  misc_feature (1)..(180): Xaa is any amino acid
MGTICRVKTPDFETRVSILNNKLYRDGVEMPDDIIEYVAKHIKSNIRELEGAIISLIAQSSFNKKEINIELAKQVVEKFVKNTKREVSIDYIQKIVSDYFQMDVDTLQSKTRKRNIVQARQLAMFFAKKLTKASLASIGSQIGKRDHATVLHACKTVDNLSATDKQFKKYVEDLTKKLSV

SEQ ID NO: 20383 - DNA, 657 bp, Unknown
  Obtained from environmental sample
  misc_feature (1)..(657): n is a, c, g, or t
ttgtattctttggttgcaaaaatggtttctaatggaggttttgatgagcgaacttatagaggagcttctgttgtagaattaattcatacagcaactttagtacatgatgatgttgtagatgattcgaatagaagacgaggttttttctcccttaatgctttatggaaaaataaaattgctgttttagtgggcgattttttattatctaaaggattgcttttatccatagataatgaagattttgatttattgaaactaatttcaattgctgttcgtgaaatgagcgaaggtgaattactacaaattgaaaaagccagaaaattagatattacagaagatatttattttgatattatcagaccaaaaaccgcgactttaattgcagcttgttgtggaataggtgcagcttctgtgggtgcaaaccaagatactgtgcaacaaatgcgaaagtttggcgaatatattgggatcgcttttcaaataaaagacgatttgttcgattattctgatgaaaaaatagggaagcctacaggaattgatatcaaagagcaaaaaatgacgttgcctttaatttatacgttgaataactgttcaaaaaaggaaaatcttggattatcaattctatcaaaaaacacaataaagataaagttagagtaa

SEQ ID NO: 20384 - protein, 218 aa, Unknown
  Obtained from environmental sample
  DOMAIN (1)...(218): Polyprenyl synthetase
  misc_feature (1)..(218): Xaa is any amino acid
MYSLVAKMVSNGGFDERTYRGASVVELIHTATLVHDDVVDDSNRRRGFFSLNALWKNKIAVLVGDFLLSKGLLLSIDNEDFDLLKLISIAVREMSEGELLQIEKARKLDITEDIYFDIIRPKTATLIAACCGIGAASVGANQDTVQQMRKFGEYIGIAFQIKDDLFDYSDEKIGKPTGIDIKEQKMTLPLIYTLNNCSKKENLGLSILSKNTIKIKLE

SEQ ID NO: 20385 - DNA, 570 bp, Unknown
  Obtained from environmental sample
  misc_feature (1)..(570): n is a, c, g, or t
atggcaacaaaaagcatactaaacaaaaagtctatggactttttagaaacatatttaaacaatgcatcaccaactggctacgaatgggatggtcaaaaaatatggatggattacctaaaaccttatgtagacacgttttttacagacacctacggaactgctgtgggagttataaatcctgatgcaaaatttaaagtggtaattgaaggtcacgctgacgaaatctcttggtacgttaactatatttctgataatggattaatttatgtagtaagaaatggtggtagtgatcatcaaattgcacctagtaaaatagttaatattcatactaaaaatggtattgtaaaaggggtttttggatggcctgcaatacatacacgtaataaagctaaggaagaagctccaaaancaaacaacattacaatagacgttggtgcaaaagataaagaggaggtagaaaaaatgggcgtgcatgttggctgtgttattacctatccagatgagtttcatattttaaatggagacaaatttgtttgtcgtgctttagataaccgtatgggtggtttatga

SEQ ID NO: 20386 - protein, 189 aa, Unknown
  Obtained from environmental sample
  DOMAIN (52)...(189): M42 glutamyl aminopeptidase
  misc_feature (1)..(189): Xaa is any amino acid
MATKSILNKKSMDFLETYLNNASPTGYEWDGQKIWMDYLKPYVDTFFTDTYGTAVGVINPDAKFKVVIEGHADEISWYVNYISDNGLIYVVRNGGSDHQIAPSKIVNIHTKNGIVKGVFGWPAIHTRNKAKEEAPKXNNITIDVGAKDKEEVEKMGVHVGCVITYPDEFHILNGDKFVCRALDNRMGGL

SEQ ID NO: 20387 - DNA, 462 bp, Unknown
  Obtained from environmental sample
  misc_feature (1)..(462): n is a, c, g, or t
atggttgatccaaccgtttctggacctaaactaatttttaagggattagctagattgttttttaaaaagcctaataaactgcgttatttgtttaatgcattacagtttaattatctaataagaagctcacgctgtcaacatttaaacatatggttaaaacagccagaatctattttaaaaatagcaaattctacttttaatcataacaagaacatcctattaaagctagatatagaaggtagcgaatatgattttttagatgaagtctcttctaatttggattacttttcagctttagttttcgagtttcatgatttacataaacatcatgatcgcgtttataattttataaactcatgccaatcacaatttgatttagtgtatttaggtattaatccatcaggaggttttgatggtaaagacagacctaagtgtattgagataactatggaaagaaaataa

SEQ ID NO: 20388 - protein, 153 aa, Unknown
  Obtained from environmental sample
  misc_feature (1)..(153): Xaa is any amino acid
MVDPTVSGPKLIFKGLARLFFKKPNKLRYLFNALQFNYLIRSSRCQHLNIWLKQPESILKIANSTFNHNKNILLKLDIEGSEYDFLDEVSSNLDYFSALVFEFHDLHKHHDRVYNFINSCQSQFDLVYLGINPSGGFDGKDRPKCIEITMERK

SEQ ID NO: 20389 - DNA, 363 bp, Unknown
  Obtained from environmental sample
  misc_feature (1)..(363): n is a, c, g, or t
atgaacgttaaaaaactatcaataataattcctgcatataatgagggaaatactattcatcttattttagataaagtaaaatctgttgacttattaaatagtatagaaaaggaagttattattgttaatgatttttcaaccgataatacagaaaatgccataaaaaaatatatgataaataatcaaggtttgtctatcaaatattttaaacaagataaacataacggtaaaggagccgntttgcatagaggtattacggaggctacaggtgattatttaatcattcaagatgcagatttagaatatgacccaaaagaatataatctattattaagacctgttttcgatggattggcgatgtag

SEQ ID NO: 20390 - protein, 120 aa, Unknown
  Obtained from environmental sample
  misc_feature (1)..(120): Xaa is any amino acid
MNVKKLSIIIPAYNEGNTIHLILDKVKSVDLLNSIEKEVIIVNDFSTDNTENAIKKYMINNQGLSIKYFKQDKHNGKGAXLHRGITEATGDYLIIQDADLEYDPKEYNLLLRPVFDGLAM

SEQ ID NO: 20391 - DNA, 702 bp, Unknown
  Obtained from environmental sample
  misc_feature (1)..(702): n is a, c, g, or t
gtgtatcatcaggatacctcagacattatagaagatcaaggtgtaaaaattcatttaatttctaaaaagacatcaccattatttacatggtatttttatagaaagcgcctgcaaaattatattaattctgttgtagaaacacagaagatagatgtaatagaagcacctgattggacaggtattacagcttttatgaagctaacagcacctgtagtcattaagcttcatggtagtgatgcttacttttgcaagctagaggaaagacgtcagaaatttaaaaattttgtttttgaaaaattagcactacaatcagctactgcttacatcgctccaactacctttgcaggagaagttactgctaagattttcggtttaaaccgaaaaaaaataaagacgattcataatggagtacaactagattattttaataattatacacctgaaatttacgaccctaaaacgttaatatatgttggaacgattatcagaaaaaaaggtgttttggagctagctgaaatctttaatgcaattttagagacagaacctaacgctaaattaaaattaataggaggtgatgcttcagacataaaaacaggacaaacatctacttatgctttaatgcaatctatcttttcagatcaagctaaacaaaatgtagagtatttgggtaaataccttacagcgatgttaagcacatattaa

SEQ ID NO: 20392 - protein, 233 aa, Unknown
  Obtained from environmental sample
  misc_feature (1)..(233): Xaa is any amino acid
MYHQDTSDIIEDQGVKIHLISKKTSPLFTWYFYRKRLQNYINSVVETQKIDVIEAPDWTGITAFMKLTAPVVIKLHGSDAYFCKLEERRQKFKNFVFEKLALQSATAYIAPTTFAGEVTAKIFGLNRKKIKTIHNGVQLDYFNNYTPEIYDPKTLIYVGTIIRKKGVLELAEIFNAILETEPNAKLKLIGGDASDIKTGQTSTYALMQSIFSDQAKQNVEYLGKYLTAMLSTY

SEQ ID NO: 20393 - DNA, 624 bp, Unknown
  Obtained from environmental sample
  misc_feature (1)..(624): n is a, c, g, or t
gtgagtaaagctatttatattgtcactactgaacccaatagtggaaaatcaattgtttcgttgggccttatgcaacttctactaggtaaaactgccaaagttggttatttcaggcctataatagatgatgttcctaacggaaaaatagacaaccatattgatacggttttaagctacttcaacgtagacatgaaacctgctgaggcctatgcttatacacgtagccaagtcgtacaattaaaaaataaagacaaagacgatgaaatcgttggtcatatcattcataaatacaagactattgaaaatcgttttgattttgtcctagtagaaggcaccgatttctctggtgaaggagcaattatagagtgggatattaacgtacttattgcgaaaaatttaggtatacctgcaattattctggcaagtggaaaaaacaaaancttagatgagttattgggtaacctttacatggcctatgactcatttaaagaaaaaggcgttgaagttttattgattatagcaaataaagtacagncagaaaatttagacctagtaaccaatggggctaaaggaaaaatacctaacaatgtattaatcggcaccattcttgtaatactattctag

SEQ ID NO: 20394 - protein, 207 aa, Unknown
  Obtained from environmental sample
  misc_feature (1)..(207): Xaa is any amino acid
MSKAIYIVTTEPNSGKSIVSLGLMQLLLGKTAKVGYFRPIIDDVPNGKIDNHIDTVLSYFNVDMKPAEAYAYTRSQVVQLKNKDKDDEIVGHIIHKYKTIENRFDFVLVEGTDFSGEGAIIEWDINVLIAKNLGIPAIILASGKNKXLDELLGNLYMAYDSFKEKGVEVLLIIANKVQXENLDLVTNGAKGKIPNNVLIGTILVILF

SEQ ID NO: 20395 - DNA, 660 bp, Unknown
  Obtained from environmental sample
  misc_feature (1)..(660): n is a, c, g, or t
atgatcatattaattatcaattctggtagttcttcaataaaatatcaacttttagaaatgccttctgctcaagttatttgcgcaggcacgatagaacgtattggtagtaccgaatctatttcaacatttaaatctcaagattataaaattgaaaatatctccgaaataacaaatcacaaagaaggactcaaaacaataacagcgctattacttgattctgaaaaaggagttcttaaaaccaccgatgatattgatgccattggccatcgtgttgtacatggtggtagtacctatacaaagaccactctaataaatgaaaaggttaagaacaaaattaaaaacctttctccactagctcctttacataaccctgccaacctggtaggaatcgaaatggctgaaaaaatttttaattctgcaaagcaaatagcggtatttgatactgcctttcacggtacggtacctataaaagccaaaaaatatgcaatacctaatgaattatatgatcataagggtattcaggcttatgggtttcatggcactagtcacaaatacgtttctgagaaagcttcggaatatttaggaaacaaaaatgccaaactaatttctattcatttagaaacgggtgcagtatcactcgagccgattcttgatcaatag

SEQ ID NO: 20396 - protein, 219 aa, Unknown
  Obtained from environmental sample
  DOMAIN (2)...(219): Acetokinase family
  misc_feature (1)..(219): Xaa is any amino acid
MIILIINSGSSSIKYQLLEMPSAQVICAGTIERIGSTESISTFKSQDYKIENISEITNHKEGLKTITALLLDSEKGVLKTTDDIDAIGHRVVHGGSTYTKTTLINEKVKNKIKNLSPLAPLHNPANLVGIEMAEKIFNSAKQIAVFDTAFHGTVPIKAKKYAIPNELYDHKGIQAYGFHGTSHKYVSEKASEYLGNKNAKLISIHLETGAVSLEPILDQ

SEQ ID NO: 20397 - DNA, 417 bp, Unknown
  Obtained from environmental sample
  misc_feature (1)..(417): n is a, c, g, or t
atgaaaaaatcaaaaaaccagttgtcaattttactttttttaagtctcttttgtgtctttactaattgcgaaaaggaagatgattttttgagtaaagaattaaatgaacttaaaaattcaaataagaagctaaacgcagagttagattctcttaaaaaattatatataaatccatttaagcaatacgaaaacatcgttcttgatgaaagcaaaaataatcctgattccataattaatgaatatgaaaaattaattaaaaatcatcctaattcattttggaaacatgaatcagaacgaagaattaaaaatattgaaaaaagaaaaaaatattggactaaaaaaaatggttggaaattaaatgacattcccaaaaagcctctaaatgatgaacaaagtataagttgtcctggatgttaa

SEQ ID NO: 20398 - protein, 138 aa, Unknown
  Obtained from environmental sample
  misc_feature (1)..(138): Xaa is any amino acid
MKKSKNQLSILLFLSLFCVFTNCEKEDDFLSKELNELKNSNKKLNAELDSLKKLYINPFKQYENIVLDESKNNPDSIINEYEKLIKNHPNSFWKHESERRIKNIEKRKKYWTKKNGWKLNDIPKKPLNDEQSISCPGC

SEQ ID NO: 20399 - DNA, 699 bp, Unknown
  Obtained from environmental sample
  misc_feature (1)..(699): n is a, c, g, or t
atgacttatttagagaccgtaaattggatgttctctcaacttccaatgtatcaaaaacaaggtcagactgcttttaaaaaagacttaactaataccataaatttagctaagcatcttaaaaatccacagcataaatttaaatctatccatgttgcaggaaccaatggtaaaggctctagtagtcatatgttggcgtctattttacaagaagcaggatataaagtaggtttatatacttctccgcatttaaaagattttagagagcgtattaaaattaatggtaaagtggttagtaaaccctttgtaattggttttataaaacgaaacaaaacgtttttagatgctaataaattgtctttttttgaaatgacagttggcatggcatttgactattttgctaaacaaaaagtagatattgctgttattgaggttggattaggtggtcgtttagactctacaaatattattacaccagaagtgtctttaattactaatattggtttagaccatgttcagtttttgggtaacaccttaagtttaatagcttcagaaaaagcgggaataattaaacctaatattcctgttgttattagtgaaacgcaacctgagacgcagtctgtttttaccgctttcgctgaaaggaataatagccaatacatttgcagatcaagtagcagtgaagatttacaattgacttaa

SEQ ID NO: 20400 - protein, 232 aa, Unknown
  Obtained from environmental sample
  DOMAIN (15)...(230): Mur ligase family, catalytic domain
  misc_feature (1)..(232): Xaa is any amino acid
MTYLETVNWMFSQLPMYQKQGQTAFKKDLTNTINLAKHLKNPQHKFKSIHVAGTNGKGSSSHMLASILQEAGYKVGLYTSPHLKDFRERIKINGKVVSKPFVIGFIKRNKTFLDANKLSFFEMTVGMAFDYFAKQKVDIAVIEVGLGGRLDSTNIITPEVSLITNIGLDHVQFLGNTLSLIASEKAGIIKPNIPVVISETQPETQSVFTAFAERNNSQYICRSSSSEDLQLT

SEQ ID NO: 20401 - DNA, 321 bp, Unknown
  Obtained from environmental sample
  misc_feature (1)..(321): n is a, c, g, or t
ttgattttagcgtcatctttcaaccgggaaatttataattactatacggatttcaaaccaaccgaaattggaagtttctatataaaagtttttgaagtaacttcaaacgaccatctttctgcggagagaatgaaaattaggtcaaaagttaaagtagaaaatttagaaccaaaattatatttaggagagttttctatttacgaaggttcttggggagataaatatggagcaagaattgaattatggtttgaacctataaacggaaataaagattataaaataaccgaaaggaattacgttgtcgaaggttggatgagataa

SEQ ID NO: 20402 - protein, 106 aa, Unknown
  Obtained from environmental sample
  misc_feature (1)..(106): Xaa is any amino acid
MILASSFNREIYNYYTDFKPTEIGSFYIKVFEVTSNDHLSAERMKIRSKVKVENLEPKLYLGEFSIYEGSWGDKYGARIELWFEPINGNKDYKITERNYVVEGWMR

SEQ ID NO: 20403 - DNA, 573 bp, Unknown
  Obtained from environmental sample
  misc_feature (1)..(573): n is a, c, g, or t
ttggtatcagtcaaaaaaaagactttagaacatccaaaagcctgtccgatcaaaagagcgatatatcagaataagcttgatatctttaaacaacaaggctatcccattgtttatatatacgcgcgcggctttgagcacgagactattcgctctcatgggtacacattaattggtacaccttgtattgatagctacaattggcaaggtaaaaagcgaaccaacgttatcggtgctctgtatgaaaagatgctgtttgcactagattactttaagcacaacattaacagcagcatattctacgaatggtgcaagttcacacttattccaagtcttaaaaccaaatgcgtgattgtgatggataatgccagatttcataagagtaagcgtattcaaaagctactgaataggcatggtcatcgtattttatggttgccgccgtacagccctgatctgaaccctatcgaaaagaaatgggctcaggtgaagtttctacgccaaggctggatggaaaacgacttatccaaattgttttatgatatttgtcctggccataacaattttattttgaactga

SEQ ID NO: 20404 - protein, 190 aa, Unknown
  Obtained from environmental sample
  misc_feature (1)..(190): Xaa is any amino acid
MVSVKKKTLEHPKACPIKRAIYQNKLDIFKQQGYPIVYIYARGFEHETIRSHGYTLIGTPCIDSYNWQGKKRTNVIGALYEKMLFALDYFKHNINSSIFYEWCKFTLIPSLKTKCVIVMDNARFHKSKRIQKLLNRHGHRILWLPPYSPDLNPIEKKWAQVKFLRQGWMENDLSKLFYDICPGHNNFILN

SEQ ID NO: 20405 - DNA, 729 bp, Unknown
  Obtained from environmental sample
  misc_feature (1)..(729): n is a, c, g, or t
atgaaatgtatccttatagatgatgagcctcttgctttagaattattagaagattttgtgtctaaaattccgtatttggaattagtggcaagttgctccaatgcttttgaagctactactattttacaaacacaaaaaatagatttaatttttacagatatagaaatgccagatttttctggaatcgattttataaaatctttagaggtaaaaccactttttatttttacaacagcgtattcgcattatgcagtagaaggttttaatttaaatgccatcgattatcttgtgaaaccaattccttttcatcgatttttaaaggcagtttcaagagctcaaaatttattacaattaaaggtcgatgaaaaaactccaactgtaaatactcaggttacgcctcattttatatttgtaaaatctgaatatgaaaatttaaaaataaacttggcagacattaaatatatagaatctttaaaagattatattaaaattcacacacacaaagaaaaaccaattttaacattaagtagcctaaagagttttgaagagaaattgggcaaatcaaattttattcgtgtacacaaatcttatattgtttctttaaaacacatttattctgtgccaagaaatagaattatcattgatgataattggattcctattggtttaaattatagagaagactttatcagaaaaattgacattaatattataattctattggtctaa

SEQ ID NO: 20406 - protein, 242 aa, Unknown
  Obtained from environmental sample
  DOMAIN (142)...(234): LytTr DNA-binding domain
  misc_feature (1)..(242): Xaa is any amino acid
MKCILIDDEPLALELLEDFVSKIPYLELVASCSNAFEATTILQTQKIDLIFTDIEMPDFSGIDFIKSLEVKPLFIFTTAYSHYAVEGFNLNAIDYLVKPIPFHRFLKAVSRAQNLLQLKVDEKTPTVNTQVTPHFIFVKSEYENLKINLADIKYIESLKDYIKIHTHKEKPILTLSSLKSFEEKLGKSNFIRVHKSYIVSLKHIYSVPRNRIIIDDNWIPIGLNYREDFIRKIDINIIILLV

SEQ ID NO: 20407 - DNA, 897 bp, Unknown
  Obtained from environmental sample
  misc_feature (1)..(897): n is a, c, g, or t
ttgaggagatgtatatggcagcatagtattcaaggtaaaaatgatgctaagaaaatatcattgcatcataatcatactttaatttacggaaagagcgattttcaaataaaacgtttagataggacatcagaacacaatgtagcctataaaaatccagataaagacccaaagggcgattggcgttcaggagatgtgaggagtccaaatttaagagaaaatttaaagtacgatattttaacaccgagtggtaaaattattaatccacctgctaaaggttggagatggagtgagaatctaactaaagaaaaaatatctacaggcgaaataatttttaataaagatgaaactaagattgttagaaaaatatatctatcagaacaaaaaggtagagttgtagaaagtatttggtttggtaacgatgttggtacaacaagagatgcgaatacgttgctaaaatctatatttgatagtaaagttccatttaacacacctaagcctcataaattaatcgagagaattataaaagtcgtagcaaatgagaatgatattattcttgactcatttgcaggttctgggacaacagctcacgcagttttaaaccttaataaagtagataatggtaatcgtaaatttatcattgtagagatggaagattatgcagaggatattacgtctgaaagagtaaaaagagttataacgggttacggtaaggataaaaaatcagttgaaggaattggaggttcttttgatttctacgaattagcgcaaactatattcaaggacaatgaaaatcttaatgaagaagtagaagaagataagattagaaacttactctactataccgagacaaaacaaccacttacaagaacacaatccaagaagctaaatacctggnct

SEQ ID NO: 20408 - protein, 299 aa, Unknown
  Obtained from environmental sample
  DOMAIN (1)...(228): DNA methylase
  misc_feature (1)..(299): Xaa is any amino acid
MRRCIWQHSIQGKNDAKKISLHHNHTLIYGKSDFQIKRLDRTSEHNVAYKNPDKDPKGDWRSGDVRSPNLRENLKYDILTPSGKIINPPAKGWRWSENLTKEKISTGEIIFNKDETKIVRKIYLSEQKGRVVESIWFGNDVGTTRDANTLLKSIFDSKVPFNTPKPHKLIERIIKVVANENDIILDSFAGSGTTAHAVLNLNKVDNGNRKFIIVEMEDYAEDITSERVKRVITGYGKDKKSVEGIGGSFDFYELAQTIFKDNENLNEEVEEDKIRNLLYYTETKQPLTRTQSKKLNTWX

SEQ ID NO: 20409 - DNA, 498 bp, Unknown
  Obtained from environmental sample
  misc_feature (1)..(498): n is a, c, g, or t
atgcaattgtataatcaatactgtaacggcatgctcgttgtggctcttagatttgtaaaggacactatggaagccgaagatgtggtgcaagaagcctttataaaggcattttcaaaattagaacaatataaggcggaggtcagttttggcgcttggttaaaacgcattgttattaataaatgtattgatgttttaaagtcgaaaagacaacgtgtggtagaattagaagcgtatcatctaaacgttattgaagataataatgacgatgattggactatcgaggcaggtatatctatagctgatgtgaaattagcaattgaagccttaccagaaaaatacaaatatgttgtactgctgtatttaatggagggttacgatcataaagaaatttctgaaattttaaaaattacagagattgcttcccggacacaattatcgcgagggaaacaaaaattaaaagaagtattaaaattgaaaagaaatgggacaagatcttag

SEQ ID NO: 20410 - protein, 165 aa, Unknown
  Obtained from environmental sample
  DOMAIN (105)...(154): Sigma-70, region 4
  misc_feature (1)..(165): Xaa is any amino acid
MQLYNQYCNGMLVVALRFVKDTMEAEDVVQEAFIKAFSKLEQYKAEVSFGAWLKRIVINKCIDVLKSKRQRVVELEAYHLNVIEDNNDDDWTIEAGISIADVKLAIEALPEKYKYVVLLYLMEGYDHKEISEILKITEIASRTQLSRGKQKLKEVLKLKRNGTRS

SEQ ID NO: 20411 - DNA, 699 bp, Unknown
  Obtained from environmental sample
  misc_feature (1)..(699): n is a, c, g, or t
gtggatcaaagaatcggctcgagaacactgttgacaaaaataaaaagtggacaaaacacacaggacattcaggatattttaaagaatacctcattagaaatgttaagcacagcattaaaaacggatactgaaaaactagcgttttgggtgaatatatacaatgcctatattcaaattatattaaccgataaaccagaattgtttgaggatcgaggtgcttttttcaagaaaaaacaaattgctattgccggcaacatggtgtcttttgacaaaattgaacatggtataattagaaaatcgcaatggaaattaggactgggtaaaattagaaaatggtttcctaataaatttgagcgcgcattgcgtgttgacgaacgcgatttcagaattcattttgttttaaattgtggtgctaaaaattgtccacctgtcgctatttatacgccagataatctagaagcacagtttgatatgagctctagaaattatttaataaaaacaaccacctatgataacgaaaagaaaattgtaaccatttcacctttgtttaaatggtttcgaggcgattttggctctaaaaatgacataaaagatatactgaaatcttatgctatattagcgaccactgaaaaattctcgatagattacggngattatgattggacattagatttagataattgggcagattttaattaa

SEQ ID NO: 20412 - protein, 232 aa, Unknown
  Obtained from environmental sample
  DOMAIN (25)...(164): Protein of unknown function, DUF547
  misc_feature (1)..(232): Xaa is any amino acid
MDQRIGSRTLLTKIKSGQNTQDIQDILKNTSLEMLSTALKTDTEKLAFWVNIYNAYIQIILTDKPELFEDRGAFFKKKQIAIAGNMVSFDKIEHGIIRKSQWKLGLGKIRKWFPNKFERALRVDERDFRIHFVLNCGAKNCPPVAIYTPDNLEAQFDMSSRNYLIKTTTYDNEKKIVTISPLFKWFRGDFGSKNDIKDILKSYAILATTEKFSIDYGDYDWTLDLDNWADFN

SEQ ID NO: 20413 - DNA, 330 bp, Unknown
  Obtained from environmental sample
  misc_feature (1)..(330): n is a, c, g, or t
ttggaaattgaaaaatccaactgcaaaagcagtttatttttttgtgtcataaaatacgcttgtgaagtaaatcacgcgcattttaaaccacaaaaaatccacatgccgtgtggaattttccagttcaagttgggagagcagatcgaacctgcgaagactagtcagcgatttcagtctgccctcgtggcggttaatatctcccaaaacgagggtaattatcaagctctattcttttggcaaaaaaggtcttttcttatatgcccattaaaccaaaaatctatgaatctatatcaaaagattgttacttccttaataaagaattttatnnng

SEQ ID NO: 20414 - protein, 110 aa, Unknown
  Obtained from environmental sample
  misc_feature (1)..(110): Xaa is any amino acid
MEIEKSNCKSSLFFCVIKYACEVNHAHFKPQKIHMPCGIFQFKLGEQIEPAKTSQRFQSALVAVNISQNEGNYQALFFWQKRSFLICPLNQKSMNLYQKIVTSLIKNFXX

SEQ ID NO: 20415 - DNA, 465 bp, Unknown
  Obtained from environmental sample
  misc_feature (1)..(465): n is a, c, g, or t
atgaactcaagaacaatcgaaaaaaatattggagaatctacaaaaatcgattggaaaaaccccaaagcaattggaagttcttcattttatctaaagtcatttaaagcaaaaaataattcaacggaatttataaaagaaaactctaaatgtagttttgaaaaatattcaaatggaattctattaaggtcaaacttgtcaaatgaaataagtgctttaacaattaaagagtcggaaatcgaatacataaaattaatacgtggaaaagaaagcgttgaacctctgactttatcaccaatgtggattatgttgaaattaggagcttctaaattagttgcgagatatttcagaattgcgctcggagaatattcaataggtgaaatgaaattaaaaattgagacagaaaatcaaattatggaattcacgcaaaatggatatatatttgagagaccaattgagtttctttaa

SEQ ID NO: 20416 - protein, 154 aa, Unknown
  Obtained from environmental sample
  misc_feature (1)..(154): Xaa is any amino acid
MNSRTIEKNIGESTKIDWKNPKAIGSSSFYLKSFKAKNNSTEFIKENSKCSFEKYSNGILLRSNLSNEISALTIKESEIEYIKLIRGKESVEPLTLSPMWIMLKLGASKLVARYFRIALGEYSIGEMKLKIETENQIMEFTQNGYIFERPIEFL

SEQ ID NO: 20417 - DNA, 618 bp, Unknown
  Obtained from environmental sample
  misc_feature (1)..(618): n is a, c, g, or t
atggctggatcggccatatgttttgaaaaatacattgaggccattggaggcaaagagaaattaatgggtgttgaatcctattccctgatggcagaagccgaaatgcaaggcatgatattaaacctagaagttaagaaaacctctaagaatcagtttatgcaagatgtgaaggtcatggggaattcaatgagcaagcaagttgttgatggcgacaaggggtatgtggtaatgcaaggtcaacgaaaagacctaagtgaagacgaattaaaaaaggtaaaggaagaatcggcgcctttcccagaattgaacctgttaaacactgatgttgtcatagaaggtattgaagttattgatggaaaaaaggcctacaagattaaaatatcagatgaaaaaacttctttctatgatattgaaactggattaaaggtccaagatgctgtaagcgttgaggcccaagggcaacggataaataccactttcaattatactgattacaaggaagtatccgggattaagtttccgtttttgtttatacaaaccatggggccacaaaaatttgattatatagttaaggaaatcaaggttaatgaaggtgtatctgatgtagattttgaataa

SEQ ID NO: 20418 - protein, 205 aa, Unknown
  Obtained from environmental sample
  misc_feature (1)..(205): Xaa is any amino acid
MAGSAICFEKYIEAIGGKEKLMGVESYSLMAEAEMQGMILNLEVKKTSKNQFMQDVKVMGNSMSKQVVDGDKGYVVMQGQRKDLSEDELKKVKEESAPFPELNLLNTDVVIEGIEVIDGKKAYKIKISDEKTSFYDIETGLKVQDAVSVEAQGQRINTTFNYTDYKEVSGIKFPFLFIQTMGPQKFDYIVKEIKVNEGVSDVDFE

SEQ ID NO: 20419 - DNA, 471 bp, Unknown
  Obtained from environmental sample
  misc_feature (1)..(471): n is a, c, g, or t
atgttgcgtctggaatatcccaatacggaatatggtttaatagatacgaagtacttccaattcaaaaagaacctattgagcaatttaaagcaaaagagcaacaacgcccttaacttggattatcccacaataaaagggtccttattcattacatataaggaggtcgacaacaatattgataaattattgatggatgcccaaagactgtctattgaacattctactaaagcagatgggatattgccacatccattcgtgaatgaagacgacaaggtttacggaatgtactttgaggttattggtgatgccgcttcacaggcacaattttacgttaccgatagtaccaaacattttgttacagggtctctttatttttacaccaaacctaactatgattccatttatcctgcagcgtcatatttacagaacgatattaaaaaaatcatggaaagtttaaggtggaaagaataa

SEQ ID NO: 20420 - protein, 156 aa, Unknown
  Obtained from environmental sample
  misc_feature (1)..(156): Xaa is any amino acid
MLRLEYPNTEYGLIDTKYFQFKKNLLSNLKQKSNNALNLDYPTIKGSLFITYKEVDNNIDKLLMDAQRLSIEHSTKADGILPHPFVNEDDKVYGMYFEVIGDAASQAQFYVTDSTKHFVTGSLYFYTKPNYDSIYPAASYLQNDIKKIMESLRWKE

SEQ ID NO: 20421 - DNA, 840 bp, Unknown
  Obtained from environmental sample
  misc_feature (1)..(840): n is a, c, g, or t
atgactgctcgtccatcagtttataaattgatgaaagaattgcaattggaacgtaaaaagaaaactactgaagctgaacaaattctttgggaacaattaaagactaaaaaattagattttaaatttagaagacagcatattgttgatgagtttattgtcgattttatttgtatcgaaaaaaacttaattattgaagttgatggcaaatatcataatacaaaagaacagcaagaagcagatgatttaagaacaaaaattctacaagatttaggtttcaaagtaatcagattcacaaatgaagaagtaattggaaacacagaagaaacagtaaaaaaaataacacaacagttagaacataacagtgataaaagcctcccttttggggaggttggaggggccattcttcccccacatattttagtgatgactgcaacaccaattcctagaactttggcaatgtcagtttatggagatttagatatttctgtaattgacgaattgcctccaggaagaaaggaagtaaaaaccgttcatagatttgatagtaatagattatcggtttttaaatttatgaaagatgaaatagcaaaaggcagacaagtatacattgtgtatcctctgattcaggaatctgaaagcatggattataaagatttaatggatggttttgaaagtgtttctcgcgaatttccattgccaaaatatcaaataagtattgtgcatggaaaaatgaaacctgcagacaaagagcatgagatgcaccgttttgttaagccacgaaactcaaattatggtagcaacaactgggaattgaaagttggggtaaaatgtgccccaatg

SEQ ID NO: 20422 - protein, 280 aa, Unknown
  Obtained from environmental sample
  DOMAIN (11)...(118): Protein of unknown function (DUF559)
  misc_feature (1)..(280): Xaa is any amino acid
MTARPSVYKLMKELQLERKKKTTEAEQILWEQLKTKKLDFKFRRQHIVDEFIVDFICIEKNLIIEVDGKYHNTKEQQEADDLRTKILQDLGFKVIRFTNEEVIGNTEETVKKITQQLEHNSDKSLPFGEVGGAILPPHILVMTATPIPRTLAMSVYGDLDISVIDELPPGRKEVKTVHRFDSNRLSVFKFMKDEIAKGRQVYIVYPLIQESESMDYKDLMDGFESVSREFPLPKYQISIVHGKMKPADKEHEMHRFVKPRNSNYGSNNWELKVGVKCAPM

SEQ ID NO: 20423 - DNA, 381 bp, Unknown
  Obtained from environmental sample
  misc_feature (1)..(381): n is a, c, g, or t
ttgcctgagtacaaaagtatgttctctccaacaattacattaaacatcactcacaaatctgaattagaagacctagaatatgaaaattttgaagaattattaagcttaagtcaattaggaatttctaatcttttaactgattttaaagtcttgaaaaaatatgagccttattatatttcaggatgtaaattttatgaatacgatgctgaatatatatttgaacatatagacctcagagaacctttaaaagttgaattaaaagtattgaaagcagaacataacaatttttattatgattttaactgtcatcaatctaaagaagcgaatgaaaccgcgattaatgaatttttaagttttaaaaatagtattaaattaatttaa

SEQ ID NO: 20424 - protein, 126 aa, Unknown
  Obtained from environmental sample
  misc_feature (1)..(126): Xaa is any amino acid
MPEYKSMFSPTITLNITHKSELEDLEYENFEELLSLSQLGISNLLTDFKVLKKYEPYYISGCKFYEYDAEYIFEHIDLREPLKVELKVLKAEHNNFYYDFNCHQSKEANETAINEFLSFKNSIKLI

SEQ ID NO: 20425 - DNA, 855 bp, Unknown
  Obtained from environmental sample
  misc_feature (1)..(855): n is a, c, g, or t
ttgctgaagggaaattttgatgaaattttaaaatctgaatctttaactgcaaaatatttaaatgaagaattaaaaattgaagtgccaaaaaaacgtagaacttcaaaaaataacattcaaattattggtgcaagagaacataatttacagaatatagatgttatatttccactagattctttaacggttataactggtgtttctggttcaggaaaaagtacgttgattaagaaaattctatatccatccatgcaaaaaaagctaaatggttatggagataaaattggtcagtttacagaaattaaggggaattttgaaaatataaaacacgtagaatttatagatcaaaatccaattgggcgttcttcgcgatcaaatcctgtaacctatataaaagcttatgatgatattagagctttatattcgaatgagaaattatcaaaaataagaaattataaacccaaacatttttcttttaatgtagaaggtggacgttgtgaaacttgtaaaggtgaaggtgaagttactattgaaatgcaatttatggcagacgtacatttggaatgtgatgtttgtaatggaaaacgtttcaaaaaagaagttttagaagtaaagtttgatggaaaatcaatcgatgatattttaaacctaactatagatgatgctgtagcttttttctctgaaaatttagtgactaaaatcgctaaaaaactaaaaccattgcaagatgttggtttgggttatgttactttggggcaatcttcttccacactttctggtggagaagctcaacgtataaaactcgcatcttttttagtaaaaggaaccacaaaagacaaagccttattattttga

SEQ ID NO: 20426 - protein, 284 aa, Unknown
  Obtained from environmental sample
  misc_feature (1)..(284): Xaa is any amino acid
MLKGNFDEILKSESLTAKYLNEELKIEVPKKRRTSKNNIQIIGAREHNLQNIDVIFPLDSLTVITGVSGSGKSTLIKKILYPSMQKKLNGYGDKIGQFTEIKGNFENIKHVEFIDQNPIGRSSRSNPVTYIKAYDDIRALYSNEKLSKIRNYKPKHFSFNVEGGRCETCKGEGEVTIEMQFMADVHLECDVCNGKRFKKEVLEVKFDGKSIDDILNLTIDDAVAFFSENLVTKIAKKLKPLQDVGLGYVTLGQSSSTLSGGEAQRIKLASFLVKGTTKDKALLF

SEQ ID NO: 20427 - DNA, 519 bp, Unknown
  Obtained from environmental sample
  misc_feature (1)..(519): n is a, c, g, or t
atgaagcctgatatttccacaataaatcctaaagaaaacatcattattaaaggtgcaaaactgcacaatttaaaaaatattgatgttgtaattccaagaaataaactcgttgtaattactggactttctggttctggtaaatcttcgctggcttttgatacgttgtatgcagaaggtcaaagacgatatgtggagagtttatcttcttatgctcgtcagtttttggggaaattagacaaaccaaaagtagattatattaaaggtattgctcctgcaattgctattgagcaaaaagtaaattctacaaatccaagatctacagtgggtacatccacagaaatttacgattatataaaattattatatgccaggattggaaagacctactctcctatttctggaaatgaagtaaaaaaagatacagtttctgatgtggtaaaatttgttcagaaatttgaagaaagaacaaaacttttattatttgctcctgttactattgatgaaaaaccgagaacttaa

SEQ ID NO: 20428 - protein, 172 aa, Unknown
  Obtained from environmental sample
  misc_feature (1)..(172): Xaa is any amino acid
MKPDISTINPKENIIIKGAKLHNLKNIDVVIPRNKLVVITGLSGSGKSSLAFDTLYAEGQRRYVESLSSYARQFLGKLDKPKVDYIKGIAPAIAIEQKVNSTNPRSTVGTSTEIYDYIKLLYARIGKTYSPISGNEVKKDTVSDVVKFVQKFEERTKLLLFAPVTIDEKPRT

SEQ ID NO: 20429 - DNA, 498 bp, Unknown
  Obtained from environmental sample
  misc_feature (1)..(498): n is a, c, g, or t
ttgttaatctataaattttatctcatgaaaattttaaagaaaataggatttgcattattgttgatattaatagttgctcaattttttgggcctgaaaaaaatgatggaaatattgatactgtaaatgcatttgtggcagaaacaaatcctacagaagaagtgttgtctattatgaaaacaagctgtttcgattgccattctgcaaaaacaaattatccttggtataactcaattacgccagttaattattggttggatgatcatataaaagacggaaaaaaacatcttgatttttctaaatggagtgaatattctttaaagaagaaagaacacaaaatggacgaattgcatgaagaagtagaaaaaggcgaaatgccattagattcttatacttggactcatgatgaggcaaatttaacacaagaacaagtggatgctattgtaacttggggcaaaaaagtacaagcagagtataagcaacaaatgagcgcagaataa

SEQ ID NO: 20430 - protein, 165 aa, Unknown
  Obtained from environmental sample
  misc_feature (1)..(165): Xaa is any amino acid
MLIYKFYLMKILKKIGFALLLILIVAQFFGPEKNDGNIDTVNAFVAETNPTEEVLSIMKTSCFDCHSAKTNYPWYNSITPVNYWLDDHIKDGKKHLDFSKWSEYSLKKKEHKMDELHEEVEKGEMPLDSYTWTHDEANLTQEQVDAIVTWGKKVQAEYKQQMSAE

SEQ ID NO: 20431 - DNA, 666 bp, Unknown
  Obtained from environmental sample
  misc_feature (1)..(666): n is a, c, g, or t
atgagtcaaaaattagaaaatgcgaagaaattatatctcgaaggaattagagatggaaaagtaagagaagctgtaacaaaatatacgggagacagatatacacaacacagtacaggtgttgctgacggtattgaaggttttgttgattttttcgaaccttttgttgaacgcagtaagtctagagatatacaagttgtacgtggactagtagatggatcaaaagtttttcttcatgtttatcaagatatcaataatggagaagctaaatgggttactgctgatatttttgatacggacgaaaatgataaaatagttgaacattgggatatcattcaagcttatcaagaaaaaatagcctctggtcgtactatggtagatggaccaacagaaatagaagatcttgaagacactgataaaaataaagctttgattcaaaatttttatgatgatgtattgattggtggaaattttaataatattaccaattttatttctgctgagcaatatgaccaacacaatcctaatgtggctgatggcttagaagcatttggtaaatatgttcaaaatatggctgctgaaggaatttacagcagctacgaaaagctacatgttcttgtaggggcaagtaaactttgttgctgcactaagtcatgcaaaaatgaataa

SEQ ID NO: 20432 - protein, 221 aa, Unknown
  Obtained from environmental sample
  misc_feature (1)..(221): Xaa is any amino acid
MSQKLENAKKLYLEGIRDGKVREAVTKYTGDRYTQHSTGVADGIEGFVDFFEPFVERSKSRDIQVVRGLVDGSKVFLHVYQDINNGEAKWVTADIFDTDENDKIVEHWDIIQAYQEKIASGRTMVDGPTEIEDLEDTDKNKALIQNFYDDVLIGGNFNNITNFISAEQYDQHNPNVADGLEAFGKYVQNMAAEGIYSSYEKLHVLVGASKLCCCTKSCKNE

SEQ ID NO: 20433 - DNA, 357 bp, Unknown
  Obtained from environmental sample
  misc_feature (1)..(357): n is a, c, g, or t
atgcatatgatgattttttatggaatcactaaagcattttatatgaatttattacatcgtataaacaatgaattaggtgcagatttcagattagataagttcgatttttattgtcattataatcctataaacggagaagttagaagctatttagtgagtttaaaacaacaagatgtttatattaaagaattagacaaaacctactcttttgactataatgaactcatttggacagaattatcaaagaagtattcctttaccgaaatagaaaatatttgtaaatcctcaaattttaaattgattcataacttcttagattgtaagcattattttaatgatagtttatggagtgtttaa

SEQ ID NO: 20434 - protein, 118 aa, Unknown
  Obtained from environmental sample
  misc_feature (1)..(118): Xaa is any amino acid
MHMMIFYGITKAFYMNLLHRINNELGADFRLDKFDFYCHYNPINGEVRSYLVSLKQQDVYIKELDKTYSFDYNELIWTELSKKYSFTEIENICKSSNFKLIHNFLDCKHYFNDSLWSV

SEQ ID NO: 20435 - DNA, 324 bp, Unknown
  Obtained from environmental sample
  misc_feature (1)..(324): n is a, c, g, or t
atgacagcacaagactttattcttaaatcttaccagaccacagtagaaaacggatctgtaaaatgggaatcaccaagcaatatcgcattagtaaaatattgggggaaaaaggaacatcaaattccagaaaacccatcaattagttttaccctttcaaactgtaaaacgattacagaagtaacttttactaagaaagaaagtgagggctttagtttcgatgttttttttgaaggtataaaaaatgaagcctttaagcctaaaattcagacgttttttaagcgcatagagaattatgtgccttttttaaaggagntatcattttaa

SEQ ID NO: 20436 - protein, 107 aa, Unknown
  Obtained from environmental sample
  misc_feature (1)..(107): Xaa is any amino acid
MTAQDFILKSYQTTVENGSVKWESPSNIALVKYWGKKEHQIPENPSISFTLSNCKTITEVTFTKKESEGFSFDVFFEGIKNEAFKPKIQTFFKRIENYVPFLKEXSF

SEQ ID NO: 20437 - DNA, 684 bp, Unknown
  Obtained from environmental sample
  misc_feature (1)..(684): n is a, c, g, or t
atggcagatcaaatgaaaaggaagggaatttctttagatataactaaattaaagcaagagttaaaatctgaggtattattgatcagtgcccgtaagaatttaggaatagtagaacttaaaacggcaattttaaattataaagaagtcgatactacaactattgcgaatattgcaaatcgcgtagattcagagttttttaaaaaagtaaaaagtgagtttaaggaaatgtcgctttacaaagcttggctattaataactcagcaacataattttcccaatattgacccggaattaaaaaagcgtattgatatatttagagatgatattgaaaagttacagaaaatgcagaataaagaaaccattttgcgttatcagtacattaatgatatcctcaaaaaaacgtataccttcgataatgaaaaagcaacaggattacgttttaaacttgacaaaatattaacacatagaatttttggatatgtaatatttgcaggaatcttactgttaatatttcaatcaatttttgactggacacgtgtgcctatggattttattgatgctgcatttgcacaattgagtgaatttgcaaaaaatcaattacccccctggtgtttttacaaatttaattgcccgaaggtatcatacccggaattggaggaatcgcaatttttatacctcaaatag

SEQ ID NO: 20438 - protein, 227 aa, Unknown
  Obtained from environmental sample
  DOMAIN (1)...(203): Ferrous iron transport protein B
  misc_feature (1)..(227): Xaa is any amino acid
MADQMKRKGISLDITKLKQELKSEVLLISARKNLGIVELKTAILNYKEVDTTTIANIANRVDSEFFKKVKSEFKEMSLYKAWLLITQQHNFPNIDPELKKRIDIFRDDIEKLQKMQNKETILRYQYINDILKKTYTFDNEKATGLRFKLDKILTHRIFGYVIFAGILLLIFQSIFDWTRVPMDFIDAAFAQLSEFAKNQLPPWCFYKFNCPKVSYPELEESQFLYLK

SEQ ID NO: 20439 - DNA, 885 bp, Unknown
  Obtained from environmental sample
  misc_feature (1)..(885): n is a, c, g, or t
ttgtcgtgtattaataaatacatcaattattaccaattatctatttcaataaacagtttaaaacacgctatttttatgaaaaataaattattttttttcgcactatttttagtcttaagtacgtcttgcagtaaaaaaagttatacggttatgcataatgattattctgtgctaacaggagatgaggtagcctatcatttatctaaaggccttttaaaaatagagattgtttataccttaaacgagccaaagctggataaacatgaagggaacacacagtgtataaataacaacgcaaaagtaactattgaagaccctattaagattacaaaattgttggtagcagatacgtccaaaacctattatataataggtcaaaaagtgtcaaatactttttttgtaaatacaagtgagacgccacaaaatagtatagccaaagacagtgtttttatttctgcaaatagtgtaaaaagtgataaggcattatcctttttaacggattctaatattgaagttggtgcttacaattccgttttaaatataaagaataacatgtctaaaattacatcaaaagatgaagctgagtttgcactaaaattgttgcatttatataaaaagcaatctactagaaaggacgataaagaaaagcgttatataaaaaaaactaagctaaaatatacggtcattattgatccttcaaaacgctacgttaaacaaggtcattggtctaccattaaagacaataaaatatatcacactattgcgccagatcatctttttggagaatacgtgacgttaaacgatgttgtgactttacaactacccatgcccacnacgaaaaaacgtaacaaaagtagcgactcaaaaaaccattggaaggtgtag

SEQ ID NO: 20440 - protein, 294 aa, Unknown
  Obtained from environmental sample
  misc_feature (1)..(294): Xaa is any amino acid
MSCINKYINYYQLSISINSLKHAIFMKNKLFFFALFLVLSTSCSKKSYTVMHNDYSVLTGDEVAYHLSKGLLKIEIVYTLNEPKLDKHEGNTQCINNNAKVTIEDPIKITKLLVADTSKTYYIIGQKVSNTFFVNTSETPQNSIAKDSVFISANSVKSDKALSFLTDSNIEVGAYNSVLNIKNNMSKITSKDEAEFALKLLHLYKKQSTRKDDKEKRYIKKTKLKYTVIIDPSKRYVKQGHWSTIKDNKIYHTIAPDHLFGEYVTLNDVVTLQLPMPTTKKRNKSSDSKNHWKV

SEQ ID NO: 20441 - DNA, 546 bp, Unknown
  Obtained from environmental sample
  misc_feature (1)..(546): n is a, c, g, or t
gtgacctttggtaataccgacacgaaacaggtaatgcgacctcgtattgatatttttgctcttaatgaacaaatgaaatttctagaggtaataggtgaaataaagaaacacggttattctcgaattcccgtatttggtgaaaacatagacactgtcaaaggcgtgttgtatgtaaaagatttgttgccttatttagatagaaagacatttaattggatgaccttaatacgtgaaccgtatttcgttcctgaaaataagaagcttgatgatttattagcagaatttcaggaaaagaaaaatcacttagcaattgtggtcgatgaatatggtggaacttctgggttggtcacattagaagatattattgaggaaatagttggtgatattagtgatgaatttgatgatgaagatttgattttttctaagttagatgattttaattacgtttttgaaggtaaaactccactcaaagatttttaccgtgtaataaaattagaagacaacgatttctttgaagaaactaaaggagaatcggaaactcttgca

SEQ ID NO: 20442 - protein, 182 aa, Unknown
  Obtained from environmental sample
  DOMAIN (12)...(66): CBS domain
  misc_feature (1)..(182): Xaa is any amino acid
MTFGNTDTKQVMRPRIDIFALNEQMKFLEVIGEIKKHGYSRIPVFGENIDTVKGVLYVKDLLPYLDRKTFNWMTLIREPYFVPENKKLDDLLAEFQEKKNHLAIVVDEYGGTSGLVTLEDIIEEIVGDISDEFDDEDLIFSKLDDFNYVFEGKTPLKDFYRVIKLEDNDFFEETKGESETLA

SEQ ID NO: 20443 - DNA, 480 bp, Unknown
  Obtained from environmental sample
  misc_feature (1)..(480): n is a, c, g, or t
gtgacctttggtaataccgacgcgaaacaggtaatgcgacctcgtattgatatttttgctcttaatgaacaaatgaaatttctagaggtaataggtgaaataaagaaacacggttattctcgaattcccgtatttggtgaaaacatagacactgtcaaaggcgtgttgtatgtaaaagatttgttgccttatttagatagaaagacatttaattggatgaccttaatacgtgaaccgtatttcgttcctgaaaataagaagcttgatgatttattagcagaatttcaggaaaagaaaaatcacttagcaattgtggtcgatgaatatggtggaacttctgggttggtcacattagaagatattattgaggaaatagttggtgatattagtgatgaatttgatgatgaagatttgattttttctaagttagatgattttaattacgtttttgaaggtaaaactccagtcaaagatttttaa

SEQ ID NO: 20444 - protein, 159 aa, Unknown
  Obtained from environmental sample
  DOMAIN (12)...(66): CBS domain
  misc_feature (1)..(159): Xaa is any amino acid
MTFGNTDAKQVMRPRIDIFALNEQMKFLEVIGEIKKHGYSRIPVFGENIDTVKGVLYVKDLLPYLDRKTFNWMTLIREPYFVPENKKLDDLLAEFQEKKNHLAIVVDEYGGTSGLVTLEDIIEEIVGDISDEFDDEDLIFSKLDDFNYVFEGKTPVKDF

SEQ ID NO: 20445 - DNA, 312 bp, Unknown
  Obtained from environmental sample
  misc_feature (1)..(312): n is a, c, g, or t
atgaccaacgagatatttcttctaaacatatcaggaccagataaaccaggtttaacctccagtttaactaacgttttatcgcaatatggtgctaaaattttagatataggtcaggctaatatacacgatacgttgtcattgggttttatgtttgagatagaatctggtaacaactcagcagcagttttaaaagatctattatttaaagcttatgagttaggtgtcaaagctaaattcacaccaatatctttagaggattacgaaaaatgggtaggtctacaaggtaaggatagatacattataccattttag

SEQ ID NO: 20446 - protein, 103 aa, Unknown
  Obtained from environmental sample
  DOMAIN (6)...(76): ACT domain
  misc_feature (1)..(103): Xaa is any amino acid
MTNEIFLLNISGPDKPGLTSSLTNVLSQYGAKILDIGQANIHDTLSLGFMFEIESGNNSAAVLKDLLFKAYELGVKAKFTPISLEDYEKWVGLQGKDRYIIPF

SEQ ID NO: 20447 - DNA, 312 bp, Unknown; identical to SEQ ID NO: 20445
  Obtained from environmental sample
  misc_feature (1)..(312): n is a, c, g, or t

SEQ ID NO: 20448 - protein, 103 aa, Unknown; identical to SEQ ID NO: 20446
  Obtained from environmental sample
  DOMAIN (6)...(76): ACT domain
  misc_feature (1)..(103): Xaa is any amino acid

SEQ ID NO: 20449 - DNA, 420 bp, Unknown
  Obtained from environmental sample
  misc_feature (1)..(420): n is a, c, g, or t
ttgctcgatcagtcagggattgattttgacattaaaaatttgatcggtaataaagctatggttatttatttttacccaaaagatgatacaccggggtgtatcaaagaagcttgcagttttcgtgatgaatatgaagcttttactgataaggacgtagcagtgattggaattagtgcagacaatgttgcatcgcataaaaaatttgctgagaaataccaattgccatatactttgctttctgacagtgacaaaaaggtcagaaaattgtttggcgtaaagaattcattattaggcattttaccgggaagggtaacttatgtaattgataaagacggtattgttagattaatatttgaaaatcagtttagggcagaaaaacatattacagaatcgttaagaatattaaaagaattaaactaa

SEQ ID NO: 20450 - protein, 139 aa, Unknown
  Obtained from environmental sample
  DOMAIN (1)...(130): AhpC/TSA family
  misc_feature (1)..(139): Xaa is any amino acid
MLDQSGIDFDIKNLIGNKAMVIYFYPKDDTPGCIKEACSFRDEYEAFTDKDVAVIGISADNVASHKKFAEKYQLPYTLLSDSDKKVRKLFGVKNSLLGILPGRVTYVIDKDGIVRLIFENQFRAEKHITESLRILKELN

SEQ ID NO: 20451 - DNA, 390 bp, Unknown
  Obtained from environmental sample
  misc_feature (1)..(390): n is a, c, g, or t
atgagtataaattatcccataaagtttaggcccattttaaaggaaacaatttggggaggtgaaaagctcattactactttaaataaacagtctgatgaaaagaatattggcgaaagttgggaaatatcaggtgtagatagaaatatttcagtagtagctaatggtaagttaaaaggagagacgctagagaatttattgatcatttacagagatgccttagttggtaaaaaagtttttgatgaattttcctataagtttccattactgatcaaatttattgatgcgaaagaagcattaagcattcagttacaccccaaagatcaattggcaaaagaaagacataattcgtccggtaaaacagaaatgtggtatgttatgcaagcagattag

SEQ ID NO: 20452 - protein, 129 aa, Unknown
  Obtained from environmental sample
  misc_feature (1)..(129): Xaa is any amino acid
MSINYPIKFRPILKETIWGGEKLITTLNKQSDEKNIGESWEISGVDRNISVVANGKLKGETLENLLIIYRDALVGKKVFDEFSYKFPLLIKFIDAKEALSIQLHPKDQLAKERHNSSGKTEMWYVMQAD

SEQ ID NO: 20453 - DNA, 546 bp, Unknown
  Obtained from environmental sample
  misc_feature (1)..(546): n is a, c, g, or t
ttgctatacgcgcgggcaagtgatgcttacagttacaatacaggcgataaaatgataagctataacgatgagcaaattaaagacttaattataagcgattttaaaggtaagcgcataaatattttagcgcctgtagtccgttctcgtaaaggacattatcgcgaactattcgagcaaatcgcaaaacaaggttttgtaaaggtaagaacagacggtgagattgtagaccttaaaaaagggatgaaactggatcgctataaaatgcatgatatcgaaattgtaatcgatagactaaaaatagacgatagtacggaaaatgataaacgtttagccgaaaccataaatacagcaatgtatcatggagacgatgtgcttttagtaatcgatcaagatacgcaagaagcacgttattttagtcggaatttaatgtgtccgagttctggtatatcatatcccaatccagaaccaaataatttttctttcaactctccaaaaggtgcttgtagcaactgtaatggtattggcgaactctatcaaggtaaatga

SEQ ID NO: 20454 - protein, 181 aa, Unknown
  Obtained from environmental sample
  misc_feature (1)..(181): Xaa is any amino acid
MLYARASDAYSYNTGDKMISYNDEQIKDLIISDFKGKRINILAPVVRSRKGHYRELFEQIAKQGFVKVRTDGEIVDLKKGMKLDRYKMHDIEIVIDRLKIDDSTENDKRLAETINTAMYHGDDVLLVIDQDTQEARYFSRNLMCPSSGISYPNPEPNNFSFNSPKGACSNCNGIGELYQGK

SEQ ID NO: 20455 - DNA, 825 bp, Unknown
  Obtained from environmental sample
  misc_feature (1)..(825): n is a, c, g, or t
ttgtggctgggatttggagatgatgttaccatagatgctggtacagcaatatgttcaggaggttctgtacctttagatacaaacttacctacagcaactcatacttggtatttagacggagttgttataccaggagaaacgggatctactttaaacgcaacggaaaatggtgtttatagtgttgatgttgttttttctgctacatgtcaagcgacagattctgttttaatagaatttattccaggaccaatggtggaaaataccattgatattattacatgtaataatccttccggaaatgaaatttttgatttaacggttaatgattccgaagcgataggaagtcaaatcgctgcagacgtaactattagttatcataatagtttgtcagatgcacaattgggacttaatcctattgcggatccagccaactatattggaaatgaaacctatccagaaattattcatatcagaattgaagatgtggcatcaggaacttgttcagatgttgatacttttaatctagatgtgataacttcggttcttaaccaagcaccagacatggaggtttgtgatgatgtgtctaatgatggagttgaaatgtttaatttagaattacagactgcaacagttttaggtacgcaactagcttcagaatatacagtaacgtatcataactcatttgcagatgctgattcaggtgataacccattagttagtccatataatggtagcaatggtgaatatatttttgttcgtatcgaaagcttaattgattcagactgttatacagctactaccttaccaaacgaggatttaccttaa

SEQ ID NO: 20456 - protein, 274 aa, Unknown
  Obtained from environmental sample
  misc_feature (1)..(274): Xaa is any amino acid
MWLGFGDDVTIDAGTAICSGGSVPLDTNLPTATHTWYLDGVVIPGETGSTLNATENGVYSVDVVFSATCQATDSVLIEFIPGPMVENTIDIITCNNPSGNEIFDLTVNDSEAIGSQIAADVTISYHNSLSDAQLGLNPIADPANYIGNETYPEIIHIRIEDVASGTCSDVDTFNLDVITSVLNQAPDMEVCDDVSNDGVEMFNLELQTATVLGTQLASEYTVTYHNSFADADSGDNPLVSPYNGSNGEYIFVRIESLIDSDCYTATTLPNEDLP

SEQ ID NO: 20457 - DNA, 741 bp, Unknown
  Obtained from environmental sample
  misc_feature (1)..(741): n is a, c, g, or t
atgacaaaaattaatgtgattaagttagtaaaaatccttaaaagcgacgctaaatatggttttccaaaactaattttaggaggtccagatattacctataattgcaaaaactatctcaatactggtgttgattttctcatcattggagaaggcgaacaaaccactttagaattatataatgctattgcaaataatgaagactttagcgcaattacaggtatggcttacttagaaaacggaaacgttataaaaacgcctccaagagctaaaatgaaagacctatcagatttacccttgcctaacagagctgctattcctgtagaaaaatatttaagtacttggaaaacacatcatggccaaagctccatgactataagcacacagcgtggttgtccatacacgtgtaaatggtgcagtactgctgtctacggacaaagttacagaagacgaccagcagaaatggtggctgcagaaatgcggatgctaaaagacacttataatccggatggtatttggtttgtagatgatgtgttttctgtgagccataaatggataagagaatttcataaagaagtccttaaacaagatgctataattccttttgaatgtattaccagagcagaacgactcaatgacgaaattttacaattattaaaagaagcggttgtcttagaatttggattggtgcagaaagtggttctcaaaaaatcattgatgctatggattgacgtgtcgatgtag

SEQ ID NO: 20458 - protein, 246 aa, Unknown
  Obtained from environmental sample
  misc_feature (1)..(246): Xaa is any amino acid
MTKINVIKLVKILKSDAKYGFPKLILGGPDITYNCKNYLNTGVDFLIIGEGEQTTLELYNAIANNEDFSAITGMAYLENGNVIKTPPRAKMKDLSDLPLPNRAAIPVEKYLSTWKTHHGQSSMTISTQRGCPYTCKWCSTAVYGQSYRRRPAEMVAAEMRMLKDTYNPDGIWFVDDVFSVSHKWIREFHKEVLKQDAIIPFECITRAERLNDEILQLLKEAVVLEFGLVQKVVLKKSLMLWIDVSM

SEQ ID NO: 20459 - DNA, 531 bp, Unknown
  Obtained from environmental sample
  misc_feature (1)..(531): n is a, c, g, or t
gtgtctcaaaaagatgctttaactaacaaggtcaaagctttagaagaagaaatacaacttcttacttcaaaattttctgaactcaatcaaaaatatgatgcattaattacacaagctcaaaaccaaaaccaagaattcacgaatcaaaaaatcgctgaaatcaatagtctcaatagtgagttcagcgataataaaaccaaagtatttaacaattatcaagaaataatcaatcaaattaataaggacaacaaagctgaaaaagaaaaggcaataaatagtctaaacacgatttctgataatgaaaacaaggtcaaaaacaaaaaatctgaattaaaacaccaagctttttatattgaagatattgagcattgtaaagatgaaaagaaaaaacttgaagcgaatatttcaaattctaaaagcactattctagattctaaaaaccaaatcgcaactactcgcaaagaatgggaatttaatacgaaagaagtcgaaagaaattatcaagtagtattcgaccaagaaactgaannn

SEQ ID NO: 20460 - protein, 177 aa, Unknown
  Obtained from environmental sample
  misc_feature (1)..(177): Xaa is any amino acid
MSQKDALTNKVKALEEEIQLLTSKFSELNQKYDALITQAQNQNQEFTNQKIAEINSLNSEFSDNKTKVFNNYQEIINQINKDNKAEKEKAINSLNTISDNENKVKNKKSELKHQAFYIEDIEHCKDEKKKLEANISNSKSTILDSKNQIATTRKEWEFNTKEVERNYQVVFDQETEX

SEQ ID NO: 20461 - DNA, 519 bp, Unknown
  Obtained from environmental sample
  misc_feature (1)..(519): n is a, c, g, or t
atgaaaaataatcgtattgagaacaaaaaaggagttgaaaagtcaagaggtaatcacattaataaaagtaagaattctgaattatatagagaaataagcacccctataacgcgctatttagaacaaagttctataaatagaataccattttacagaactaaaatgtttattattaaaatattttctgaattaaaccttataaatatgctaaaaattgctttatttgggacaaagtatatgtataatcagatacttgacaaaagaaataaagcacgttactctattagcgaacaccgttgcgttccctttatagaaagcgctaacgtgtcatatttttcttctggcaaggttattgggttatctaaaataaaccatattgtacaacgttttttaaaaaaatctcaagtacaagaacgtctaaaaaagcaaatagcaaacaaattacaaacaattctaagcacagaagacgttgctgtattattgatgccaancatttatgtgtttcttttcgaagtataa

SEQ ID NO: 20462 - protein, 172 aa, Unknown
  Obtained from environmental sample
  DOMAIN (83)...(168): GTP cyclohydrolase I
  misc_feature (1)..(172): Xaa is any amino acid
MKNNRIENKKGVEKSRGNHINKSKNSELYREISTPITRYLEQSSINRIPFYRTKMFIIKIFSELNLINMLKIALFGTKYMYNQILDKRNKARYSISEHRCVPFIESANVSYFSSGKVIGLSKINHIVQRFLKKSQVQERLKKQIANKLQTILSTEDVAVLLMPXIYVFLFEV

SEQ ID NO: 20463 - DNA, 573 bp, Unknown
  Obtained from environmental sample
  misc_feature (1)..(573): n is a, c, g, or t
atgaaaaaaatattagtagttggcggaagtaaaggtattggtaacgccattgtaaaacaattagtaaaagaccataccgtatacaattttagtcgtacagctcctactgtaacttatgacaatttgaaacattattctggagatatcttaagcgataacgttccagaaatcgaggctttagattctattatatattgcccaggaagcattaatctaaagcctatctcccgattatcgttagacgaatttagaagtgatttcgaaattaatgttattggtgcaattaaaacgattcagcactatctcccacaattaaaaaagggaaaccaaccttctattttattatttagtaccgtagcctctactttaggaatgccatttcacacaagtgttgcagcatcaaaatctggtgttgaaggcttagtaaagtctttaggagccgaattagcgcccaccattcgtgttaatgccatcgctccaaccgttacagataccggtttggcatcaaaattacttcgtaacgaaaaaatgatagaaaacataactgagcgccatccattaaaaaagatttaa

SEQ ID NO: 20464 - protein, 190 aa, Unknown
  Obtained from environmental sample
  DOMAIN (4)...(190): short chain dehydrogenase
  misc_feature (1)..(190): Xaa is any amino acid
MKKILVVGGSKGIGNAIVKQLVKDHTVYNFSRTAPTVTYDNLKHYSGDILSDNVPEIEALDSIIYCPGSINLKPISRLSLDEFRSDFEINVIGAIKTIQHYLPQLKKGNQPSILLFSTVASTLGMPFHTSVAASKSGVEGLVKSLGAELAPTIRVNAIAPTVTDTGLASKLLRNEKMIENITERHPLKKI

SEQ ID NO: 20465 - DNA, 573 bp, Unknown
  Obtained from environmental sample
  misc_feature (1)..(573): n is a, c, g, or t
atgaaaaaaatattagtagttggcggaagtaaaggtattggtaacgccattgtaaaacaattagtaaaagaccataccgtatacaattttagtcgtacagctcctactgtaacttatgacaatttaaaacattattctggagatatcttaagcgataacgttccagaaatcgaggctttagattctattatatattgcccaggaagcattaatctaaagcctatctcccgattatcgttagacgaatttagaagtgatttcgaaattaatgttattggtgcaattaaaacgattcagcactatctcccacaattaaaaaagggaaaccaaccttctattttattatttagtaccgtagcctctactttaggaatgccatttcacacaagtgttgcagcatcaaaatctggtgttgaaggcttagtaaagtctttaggagccgaattagcgcccaccattcgtgttaatgccatcgctccaaccgttacagataccggtttggcatcaaaattacttcgtaacgaaaaaatgatagaaaacataactgagcgccatccattaaaaaagatttaa

SEQ ID NO: 20466 - protein, 190 aa, Unknown; identical to SEQ ID NO: 20464
  Obtained from environmental sample
  DOMAIN (4)...(190): short chain dehydrogenase
  misc_feature (1)..(190): Xaa is any amino acid

SEQ ID NO: 20467 - DNA, 603 bp, Unknown
  Obtained from environmental sample
  misc_feature (1)..(603): n is a, c, g, or t
ttggagaattcanaattaatcatccctgataaaagtaaaaaagatagcttgattgtctcatttattggttacaaatctcaattcatagctgttcctaatacatctcagtcggttgacgtcatcttagaaaaggaacaaacccaattagacgaagtcattctgaagggattcaccgcaaaaaccattgttaaaaacgcgattgatcaagtgcctcaaaactattttaatgaaccctatataagtaaaggtttttacagggtaagctcacaaaaagacaaacaatatattcatctctcagaggctgtctttgaggtatatcattcaaaaacagacaaaccataccgtcaatttcgtcttgataagaaaaggtcgatcaaagatgaggaagcctcaaaaggaatagatttaggccttagtccttcagggtgtaatggttttgatattgtcaataatattgacgatttgaattttcttaccaaaaaggggctaaaagagcattcctttaaaattgatgggcatatcaaggttgacggcaatgatgcttatcgagtttcatttgaccaaattaaatcaaatgtttcaggatataaaggatatatgctn

SEQ ID NO: 20468 - protein, 201 aa, Unknown
  Obtained from environmental sample
  misc_feature (1)..(201): Xaa is any amino acid
MENSXLIIPDKSKKDSLIVSFIGYKSQFIAVPNTSQSVDVILEKEQTQLDEVILKGFTAKTIVKNAIDQVPQNYFNEPYISKGFYRVSSQKDKQYIHLSEAVFEVYHSKTDKPYRQFRLDKKRSIKDEEASKGIDLGLSPSGCNGFDIVNNIDDLNFLTKKGLKEHSFKIDGHIKVDGNDAYRVSFDQIKSNVSGYKGYML

SEQ ID NO: 20469 - DNA, 660 bp, Unknown
  Obtained from environmental sample
  misc_feature (1)..(660): n is a, c, g, or t
atgacgcatgagtttaaaacgcctattgcaacaatcaatttggcattagacgcaatcagaaaccctaaagtaataaatgaccaagaaaaggtgaagcgttatttgggaatgataaaagaggaaaataaacgtatgcatgcacaagtagaaaatgtattacgtatctctaagttagagaaaaatgagttgaatattagtaaggaacgtatagagttacacgacttagttgaagatgcaattactcatgtagagctactagttgaagatagaaatggttatgtgaaaacgcatttagacgctgataaatcatcagttttagcgaacgatacacactttacaaatgtgattgttaatgtattagataatgctatcaaatactcagatgaggcaccagaaatagatgtgtatactgaaaatgttggagataatgttatattaaaaattgtagatcaaggcaatggaatgtctaagcaagttgccaatcgtgtgttcgaaaagttttatagagaacatactggtaatgtacataatgtaaaaggacatgggttaggtttagcttatgtaaaacgaatagtagatgaccatcaaggtcagatatcagtagaaagtgaccccggaaacggcagtacttttattataaagttgccgttaatatcttaa

SEQ ID NO: 20470 - protein, 219 aa, Unknown
  Obtained from environmental sample
  DOMAIN (1)...(61): His Kinase A (phosphoacceptor) domain
  misc_feature (1)..(219): Xaa is any amino acid
MTHEFKTPIATINLALDAIRNPKVINDQEKVKRYLGMIKEENKRMHAQVENVLRISKLEKNELNISKERIELHDLVEDAITHVELLVEDRNGYVKTHLDADKSSVLANDTHFTNVIVNVLDNAIKYSDEAPEIDVYTENVGDNVILKIVDQGNGMSKQVANRVFEKFYREHTGNVHNVKGHGLGLAYVKRIVDDHQGQISVESDPGNGSTFIIKLPLIS

SEQ ID NO: 20471 - DNA, 756 bp, Unknown
  Obtained from environmental sample
  misc_feature (1)..(756): n is a, c, g, or t
atgagtaatacacttacatcaattattggcccaactgccattggtaaaacagctttgagtattaaactggctcaacattttaattctgaaattatttctgctgattctcgtcaattttataaggagatgaatataggtacagctgtgccgtctaaagaagaacttagtgctgcatcacatcactttattcaacataaatcgattaatgaaaattacaatgtaggtgattttgagcgtgatgccatttataaaatagaacaattacatcaagtaaatcctatggttgtaatggttggtggatctggtttgtatgttaaagctgtaactaaaggcttagattactttcctgaagttgatacagatattagaactcaacttaataaacaattagaagaaaaagggctaactcctttacaagaacaacttaaatcactcgacacaaaaggttataaaactattgctattgataaccctcagcgcgttatcagagctttagaaatttgtgttggcacgggaaaaccttactcttcctttttaactaaccctgaaaaagagcgcaagtttaaagcgattaccattggattggatactgatcgttcaattatctatgatagaattaaccaacgtgtagatttaatggttgaaaacggattgttagaagaagtagaagctttaattcctaataaacattttaatgccttaaataccgttgggtataaagagttgttcgactattttgaaggaattccactttag

SEQ ID NO: 20472 - protein, 251 aa, Unknown
  Obtained from environmental sample
  DOMAIN (37)...(251): IPP transferase
  misc_feature (1)..(251): Xaa is any amino acid
MSNTLTSIIGPTAIGKTALSIKLAQHFNSEIISADSRQFYKEMNIGTAVPSKEELSAASHHFIQHKSINENYNVGDFERDAIYKIEQLHQVNPMVVMVGGSGLYVKAVTKGLDYFPEVDTDIRTQLNKQLEEKGLTPLQEQLKSLDTKGYKTIAIDNPQRVIRALEICVGTGKPYSSFLTNPEKERKFKAITIGLDTDRSIIYDRINQRVDLMVENGLLEEVEALIPNKHFNALNTVGYKELFDYFEGIPL

SEQ ID NO: 20473 - DNA, 423 bp, Unknown
  Obtained from environmental sample
  misc_feature (1)..(423): n is a, c, g, or t
ttgttttacaaaatagcgttagaaccattaagcgttcataaatttaaaagagtgtatttattactagctgttgcaatcgctgcaataataccttttataacgtttataaaatatatcgagcctactattgacacttcaacttttatctttgacgcttcatcaacaataccaatagatacaaactttaaaatagtagaagacactaactacttaccaataattttatggagtatttatgctttaggagtcggtttattctttattagattttgcgctaatctgtttcaaataatttcaaaaatcagaaaacatactaaagttaaaagccaatcttttatcaatgttttaatggaacaaatagaagttccgcatacgttttttaattatatctttttaaataaaaacaagtttgaaaataatcan

SEQ ID NO: 20474 - protein, 141 aa, Unknown
  Obtained from environmental sample
  misc_feature (1)..(141): Xaa is any amino acid
MFYKIALEPLSVHKFKRVYLLLAVAIAAIIPFITFIKYIEPTIDTSTFIFDASSTIPIDTNFKIVEDTNYLPIILWSIYALGVGLFFIRFCANLFQIISKIRKHTKVKSQSFINVLMEQIEVPHTFFNYIFLNKNKFENNX

SEQ ID NO: 20475 - DNA, 729 bp, Unknown
  Obtained from environmental sample
  misc_feature (1)..(729): n is a, c, g, or t
ttggccgaagaaacagaaaattcttggtatgtaaaccaatatgataatttgtctaattcaatttcacattacgagcaaactggtcctgaaatttgggagcaaaccgatggtaaaataactcattttgtagtgggtgttggaacaggtggtaccatttctggagttggtaaatttttaaaagagaaaaatccaaatattaaaatttggggggtagatgcttatggttcagtatttaaaaaatatcatgaaacaggtatatttgataagaatgaaatttattcatatataactgaagggataggagaagatattttacctaaaaatgttgattttgatgttatagacggatttactaaagtaacagataaagatgcagcggtttatacacgtaaacttgcaagagaagaaggtgtctttgttggaaattctgcaggttctgcgattaaaggcctattacaattaaaagaacattttaaatctgatgatgtagttgtggtattgtttcatgaccacggtagcaggtatgttggtaaaatgtttaatgatgagtggatgcgtgaaagaggtttcttagaggaggaagtaacagtagcctcagatttaattaaaaaccgaattaatgagccattagttactgcaaaaacggaagagttagtgtcgcatgcaattgacagaatgcgtcaatatgatatatctcaaattccggttgaagatagtgaaggttggtag

SEQ ID NO: 20476 - protein, 242 aa, Unknown
  Obtained from environmental sample
  DOMAIN (1)...(171): Pyridoxal-phosphate dependent enzyme
  misc_feature (1)..(242): Xaa is any amino acid
MAEETENSWYVNQYDNLSNSISHYEQTGPEIWEQTDGKITHFVVGVGTGGTISGVGKFLKEKNPNIKIWGVDAYGSVFKKYHETGIFDKNEIYSYITEGIGEDILPKNVDFDVIDGFTKVTDKDAAVYTRKLAREEGVFVGNSAGSAIKGLLQLKEHFKSDDVVVVLFHDHGSRYVGKMFNDEWMRERGFLEEEVTVASDLIKNRINEPLVTAKTEELVSHAIDRMRQYDISQIPVEDSEGW

SEQ ID NO: 20477 - DNA, 429 bp, Unknown
  Obtained from environmental sample
  misc_feature (1)..(429): n is a, c, g, or t
ttgtttcatcgaaatcatttcttggtaattcaattttttacttttttaccgtgggaattggtacctctgtgtatggctcaaataaaagaaataagttctcaatacaaagcattggaaaaacgcaatgtaacgattgcactaattagtcctcaacctcatcatttatccaggtcattagctaaaaaatataacttgaattttaattttttagtagatgtaaacaataaagtagcaaagcagttagagatttttcataaaaacggccttcctgccggaatgcaaatacttggctataaaaatgatactgttatgcatacagtaattattactaatacaaatggcaaaattattttttcacatctaactgacaattatagagttagaccagaacctgaaacttttttaaaagtccttgatagtattcaataa

SEQ ID NO: 20478 - protein, 142 aa, Unknown
  Obtained from environmental sample
  misc_feature (1)..(142): Xaa is any amino acid
MFHRNHFLVIQFFTFLPWELVPLCMAQIKEISSQYKALEKRNVTIALISPQPHHLSRSLAKKYNLNFNFLVDVNNKVAKQLEIFHKNGLPAGMQILGYKNDTVMHTVIITNTNGKIIFSHLTDNYRVRPEPETFLKVLDSIQ

SEQ ID NO: 20479 - DNA, 429 bp, Unknown; identical to SEQ ID NO: 20477
  Obtained from environmental sample
  misc_feature (1)..(429): n is a, c, g, or t

SEQ ID NO: 20480 - protein, 142 aa, Unknown; identical to SEQ ID NO: 20478
  Obtained from environmental sample
  misc_feature (1)..(142): Xaa is any amino acid

SEQ ID NO: 20481 - DNA, 456 bp, Unknown
  Obtained from environmental sample
  misc_feature (1)..(456): n is a, c, g, or t
atgcataaaggtattttagagtttcaaagattattagaatcaaaatcaaacggaaaattaaaagtcaaaatttttcctgatggtcaattaggttctgaaagagaaagtttagaattattgcaaattggaagtgtcgctgcaactaaagttagtgcctctatattgtctaattttgttccagaatacaatgttttaggaataccctacttatttaaagatagagaacatcaatttagtgttttagaaggacctattggaaaatcaattttagaaaaaggttctaaattctggctacgtggattatgttattatgatgcaggaagtagaagtttttacacaagtaccaaagctattagaacaccagaagatttaaaaggtcttaaaattagggtgcaaaataatcaaatggcaattaatatggtaaactcaatgggaggagctgctacacctttggnn

SEQ ID NO: 20482 - protein, 152 aa, Unknown
  Obtained from environmental sample
  DOMAIN (2)...(152): Bacterial extracellular solute-binding protein, family 7
  misc_feature (1)..(152): Xaa is any amino acid
MHKGILEFQRLLESKSNGKLKVKIFPDGQLGSERESLELLQIGSVAATKVSASILSNFVPEYNVLGIPYLFKDREHQFSVLEGPIGKSILEKGSKFWLRGLCYYDAGSRSFYTSTKAIRTPEDLKGLKIRVQNNQMAINMVNSMGGAATPLX

SEQ ID NO: 20483 - DNA, 639 bp, Unknown
  Obtained from environmental sample
  misc_feature (1)..(639): n is a, c, g, or t
ttgacttttatttctgaacaaacaattcaaccgtatattaaagaatctggtaatcccagtacatatcatgctcattattatgaattcccatggccaaaagaaatccttgaaggtctaggtgaaactatggtaaccttaagaataactctttcttattttattgagcctaaccccggagaaaaggggtattcgacaaaatattcttatcaatctgcagcccttaagttttctctcattcgccctggagaacctcatgataattttattacaagaacaaataaaataaataaggataatctacataaagaattaggtttgaaaaaaggtgaaaaaattccatctattgaattagatacaaaaactggtaacgacagatgggaattgggtgcagataatacgtttaaaggatccgtccatagcaattcttgggaaggaatagcagcagacgtagcatcatgtaattttttagcaatataccctcaagctactgggtggtggaaaaatctaaaaaagcaaaaaaagttcaatgaaaagctaaggtactcacttattgtttcgattgaaacaccagaaaacacaagtgatatttatacaaaaatagctcaacaagttgaagttaaaaatctaattaaagtgtaa

SEQ ID NO: 20484 - protein, 212 aa, Unknown
  Obtained from environmental sample
  misc_feature (1)..(212): Xaa is any amino acid
MTFISEQTIQPYIKESGNPSTYHAHYYEFPWPKEILEGLGETMVTLRITLSYFIEPNPGEKGYSTKYSYQSAALKFSLIRPGEPHDNFITRTNKINKDNLHKELGLKKGEKIPSIELDTKTGNDRWELGADNTFKGSVHSNSWEGIAADVASCNFLAIYPQATGWWKNLKKQKKFNEKLRYSLIVSIETPENTSDIYTKIAQQVEVKNLIKV

SEQ ID NO: 20485 - DNA, 408 bp, Unknown
  Obtained from environmental sample
  misc_feature (1)..(408): n is a, c, g, or t
atgaaaaatttatttttatttttaacaattctttcactatcatgtatgcaaaattctaagttaatatcatcaaaaaagattggattatatcaactgggtgaaaaaattcctgaaaattttaataaaaaaatttttgatttaacttcagatgaaaacaatataattgtatcaattattgttaaatctaaagaatacaaaactaaagaagggtttggagttggttctaatataaacacaatacagctttcatataaagattctaaaaaagaaccccttactttatctaaaggtaatacgccttttggaagcttaggagtaaaagtaactcataatgatattttgttcgtggataacaataatgacaatttagttgattttgtttggatagagtcttttaaaaaagattaa

SEQ ID NO: 20486 - protein, 135 aa, Unknown
  Obtained from environmental sample
  SIGNAL (1)...(17)
  misc_feature (1)..(135): Xaa is any amino acid
MKNLFLFLTILSLSCMQNSKLISSKKIGLYQLGEKIPENFNKKIFDLTSDENNIIVSIIVKSKEYKTKEGFGVGSNINTIQLSYKDSKKEPLTLSKGNTPFGSLGVKVTHNDILFVDNNNDNLVDFVWIESFKKD

SEQ ID NO: 20487 - DNA, 408 bp, Unknown; identical to SEQ ID NO: 20485
  Obtained from environmental sample
  misc_feature (1)..(408): n is a, c, g, or t

SEQ ID NO: 20488 - protein, 135 aa, Unknown; identical to SEQ ID NO: 20486
  Obtained from environmental sample
  SIGNAL (1)...(17)
  misc_feature (1)..(135): Xaa is any amino acid

SEQ ID NO: 20489 - DNA, 573 bp, Unknown
  Obtained from environmental sample
  misc_feature (1)..(573): n is a, c, g, or t
atggagcatcaattagccattttattgcctcactacaataatattgaagggttaactgctacattacattctttattaaccgaaacggaaccgtttacattaattgttgttgacgatggtagtaataaccagaagcaagtagatggcgtaatagcttcttttaagtccaagttggatattaccttattaaagcaaccaaaatgtcttggtgtaactgcagccttaaataatggtttaaattatattcttaaccaacctcattttaaatatatagcaagactagacgcaggagataagtgtataaataatagattagcaaaacaactgcaggcattacaattagatcccaagttaggattagtctctagctacgttacttttatagcaaaggataatagctttttatttaattttaaaccaccattagctcataataaattacaagaagccatttataaatacaatccatttatccatcctgctgtaatgtataagacggaagttgttaaactattgggttgtatccagaaaattatccagctcttgaagatcatgcttatttttttaaagtaa

SEQ ID NO: 20490 - protein, 190 aa, Unknown
  Obtained from environmental sample
  DOMAIN (6)...(173): Glycosyl transferase
  misc_feature (1)..(190): Xaa is any amino acid
MEHQLAILLPHYNNIEGLTATLHSLLTETEPFTLIVVDDGSNNQKQVDGVIASFKSKLDITLLKQPKCLGVTAALNNGLNYILNQPHFKYIARLDAGDKCINNRLAKQLQALQLDPKLGLVSSYVTFIAKDNSFLFNFKPPLAHNKLQEAIYKYNPFIHPAVMYKTEVVKLLGCIQKIIQLLKIMLIFLK

SEQ ID NO: 20491 - DNA, 675 bp, Unknown
  Obtained from environmental sample
  misc_feature (1)..(675): n is a, c, g, or t
gtgatgaagaaaaggaatttagagaaaaggaattcgttttataacaactcaaaccttttgttcaaaaaaatcttaaataccattcccagaccattgctcataagactgagtattattggtaggcctatactggcttttctactgaaaggaaataaatacacagaccccatagacgggaaatcctaccgaaagtttcttccttatgggtatgaagttgttcgcgaaaatgtactttccccaggaacactttctttggaacggcacagattgttctggctttatcttcaaaatgaaactggtttctttactaaaaatttgaaagttcttcactttgcgcccgagcaggcgttttataaaaagttccggaaaatgaaaaatctggattacaccacaaccgatctcaattcgccaatagctgatgtgaaagcggatatttgcaatctaccctttcaagaaaatgaattcgactttataatctgcaaccacgttttggaacacataccaaatgacaccaaagcgatgcaggaaatttatcgtgtattggcgcccggtggcacggcaattcttcaaattccctataaagcagatttagaaaaaacgtttgaagacgacagcattaccgacccaagagagcgtgcaaaaatatttggacaatacctggagccgattctgtga

SEQ ID NO: 20492 - protein, 224 aa, Unknown
  Obtained from environmental sample
  misc_feature (1)..(224): Xaa is any amino acid
MMKKRNLEKRNSFYNNSNLLFKKILNTIPRPLLIRLSIIGRPILAFLLKGNKYTDPIDGKSYRKFLPYGYEVVRENVLSPGTLSLERHRLFWLYLQNETGFFTKNLKVLHFAPEQAFYKKFRKMKNLDYTTTDLNSPIADVKADICNLPFQENEFDFIICNHVLEHIPNDTKAMQEIYRVLAPGGTAILQIPYKADLEKTFEDDSITDPRERAKIFGQYLEPIL

SEQ ID NO: 20493 - DNA, 675 bp, Unknown
  Obtained from environmental sample
  misc_feature (1)..(675): n is a, c, g, or t
gtgatgaagaaaaggaatttagagaaaaggaattcgttttataacaactcaaaccttttgttcaaaaaaatcgtaaataccattcccagaccattgctcataagactgagtattattggtaggcctatactggcttttctactgaaaggaaataaatacacagaccccatagacgggaaatcctaccgaaagtttcttccttatgggtatgaagttgttcgcgaaaatgtactttccccaggaacactttctttggaacggcacagattgttctggctttatcttcaaaatgaaactggtttctttactaaaaatttgaaagttcttcactttgcgcccgagcaggcgttttataaaaagttccggaaaatgaaaaatctggattacaccacaaccgatctcaattcgccaatagctgatgtgaaagcggatatttgcaatctaccctttcaagaaaatgaattcgactttataatctgcaaccacgttttggaacacataccaaatgacaccaaagcgatgcaggaaatttatcgtgtattggcgcccggtggcacggcaattcttcaaattccctataaagcagatttagaaaaaacgtttgaagacgacagcattaccgacccaagagagcgtgcaaaaatatttgtaaaacacctggagccgattctgtga

SEQ ID NO: 20494 - protein, 224 aa, Unknown
  Obtained from environmental sample
  misc_feature (1)..(224): Xaa is any amino acid
MMKKRNLEKRNSFYNNSNLLFKKIVNTIPRPLLIRLSIIGRPILAFLLKGNKYTDPIDGKSYRKFLPYGYEVVRENVLSPGTLSLERHRLFWLYLQNETGFFTKNLKVLHFAPEQAFYKKFRKMKNLDYTTTDLNSPIADVKADICNLPFQENEFDFIICNHVLEHIPNDTKAMQEIYRVLAPGGTAILQIPYKADLEKTFEDDSITDPRERAKIFVKHLEPIL

SEQ ID NO: 20495 - DNA, 630 bp, Unknown
  Obtained from environmental sample
  misc_feature (1)..(630): n is a, c, g, or t
atgacggcttatgaaaatttaaagttggtctgtaaaattaaaggggtcgattatataaagattgatgaaaaattagaaattgtcggacttttagatagaaagaacagcaagttcagcaacttttctttggggatgaaacagcgtctggctattgcctctgcccttttaaatgatccggaaatactaattttggatgaacctaccaacggattggacccacaaggcattcatcagatcagaagcttgatcaaacagattgccagcgaaggcaccactattttattggcgtcccatcttttagacgaagtcgaaaaagtatgttcccatgttgtggtgcttcgtaaaggggaaaaactttactcaggacgtgtagatgaaatgatttccagtcacggattttttgagttgaaatctatacagcacgacactttgttgtcttacctccaaaacaaccctgattttttaagtgttaaagtagaaggcgaactcatcaccgcttttctaaaccagcccatggatgcttctacattcaacaccttaatgttcgaaaaaggtattacgctctcccatctggtgaaacgcaaggaaagtttagaagaacaattcctgaaattaactgacaacaactaa

SEQ ID NO: 20496 - protein, 209 aa, Unknown
  Obtained from environmental sample
  DOMAIN (1)...(116): ABC transporter
  misc_feature (1)..(209): Xaa is any amino acid
MTAYENLKLVCKIKGVDYIKIDEKLEIVGLLDRKNSKFSNFSLGMKQRLAIASALLNDPEILILDEPTNGLDPQGIHQIRSLIKQIASEGTTILLASHLLDEVEKVCSHVVVLRKGEKLYSGRVDEMISSHGFFELKSIQHDTLLSYLQNNPDFLSVKVEGELITAFLNQPMDASTFNTLMFEKGITLSHLVKRKESLEEQFLKLTDNN

SEQ ID NO: 20497 - DNA, 654 bp, Unknown
  Obtained from environmental sample
  misc_feature (1)..(654): n is a, c, g, or t
atgaaaaccaacctaaaattatttcttcttatatatatatgcgttacttgtctttttagtaataaggctttttcgcagcatcaaacagatagcttatcatactatacaaatgctatagagaaagtaacttctgaagaaacgctagctaaggcgtatcaatatttaattgagcatttagaaattaaaaagaaaaaaaacagcaaattaggtatagcttatgatttatattttttagcaagaatagactacaaagtaggtttttatgatgatagtgaagtaagtgctgttgaagctttaaagatattagatggtctaaaagttaataattataatactaaactaacaacaggagttttaaaccttttgggacaagtctataatcaaaaaaacatgtttgataaagctaatgagacgtatttaaaagcgttatctattacttcgacttcaagagatagtttggtgttgtataataacatttctaatatttataaaaatcaaaaattatataataaagctcagagcacattaataaaagcaactaatttatttaatagggtagaagactcaatagaaaaggccagagttattgataatttagggtttataaaatttaaattaaataatcatggtgcatttgacgattttaagacagna

SEQ ID NO: 20498 - protein, 218 aa, Unknown
  Obtained from environmental sample
  misc_feature (1)..(218): Xaa is any amino acid
MKTNLKLFLLIYICVTCLFSNKAFSQHQTDSLSYYTNAIEKVTSEETLAKAYQYLIEHLEIKKKKNSKLGIAYDLYFLARIDYKVGFYDDSEVSAVEALKILDGLKVNNYNTKLTTGVLNLLGQVYNQKNMFDKANETYLKALSITSTSRDSLVLYNNISNIYKNQKLYNKAQSTLIKATNLFNRVEDSIEKARVIDNLGFIKFKLNNHGAFDDFKTX

SEQ ID NO: 20499 - DNA, 444 bp, Unknown
  Obtained from environmental sample
  misc_feature (1)..(444): n is a, c, g, or t
atggctaaattaaaaccgataattacgctgcaaagctacggtatttactcaacatgggataacgagagtaaagcattgccgcaaatagagcaatttactactgaggtcatcgctactcttgatgttgaatttggtttgatcataaatattaaaaaagccaaaggcgaaaaattacattacagcatttatcatcctaatatacccgatgatgaaggcgacataatgcctcctttttccggagtggtgtatgttaaagacagcgactggcatttttatttaggtgatactttatggccaccaattaataataaacttggtaattggcgcatgaccatagagtacaatggcaaacttatagcggataaaacatttaatgtagcactgcctacagagcgctcggctgtagagttttggcaagataggggatacaagcctctaaagtaa

SEQ ID NO: 20500 - protein, 147 aa, Unknown
  Obtained from environmental sample
  misc_feature (1)..(147): Xaa is any amino acid
MAKLKPIITLQSYGIYSTWDNESKALPQIEQFTTEVIATLDVEFGLIINIKKAKGEKLHYSIYHPNIPDDEGDIMPPFSGVVYVKDSDWHFYLGDTLWPPINNKLGNWRMTIEYNGKLIADKTFNVALPTERSAVEFWQDRGYKPLK

SEQ ID NO: 20501 - DNA, 576 bp, Unknown
  Obtained from environmental sample
  misc_feature (1)..(576): n is a, c, g, or t
ttggttataatgctactagcttcctataattataatcgttccaactatttttcagcagtggatgattccaatagttttactgctaatgctagtaattatgacgaaaacatcacagaaaaaggcgtatttatttcagatgcttctattccttctaaaataatagacaccaactatttacctgtatttttagaataccaaaatgacattgaagacgttatttttgagtacaacaaatcccttaaaccaaaagaggataaacgtggcttaaaatcggatatttttacctctaccaatcaaatgattgcaaaaaacagccgagaccgtcttaaagcagattacatgcaaacgctatctaatatttatagttttaaaatagacagtttagattataataatcctgactttatttatgctaaacacaataataaccaacagggttttgaaaccgttttatctttaaaaaacattacagaaggcaaacacgtgttaactataaacagactggttaaaaaggatagtgcgtttattaaaacaacacttttaaatatccctttttggtattttaatagtaattaa

SEQ ID NO: 20502 - protein, 191 aa, Unknown
  Obtained from environmental sample
  misc_feature (1)..(191): Xaa is any amino acid
MVIMLLASYNYNRSNYFSAVDDSNSFTANASNYDENITEKGVFISDASIPSKIIDTNYLPVFLEYQNDIEDVIFEYNKSLKPKEDKRGLKSDIFTSTNQMIAKNSRDRLKADYMQTLSNIYSFKIDSLDYNNPDFIYAKHNNNQQGFETVLSLKNITEGKHVLTINRLVKKDSAFIKTTLLNIPFWYFNSN

SEQ ID NO: 20503 - DNA, 705 bp, Unknown
  Obtained from environmental sample
  misc_feature (1)..(705): n is a, c, g, or t
atgcgtagatatgtgcaaagtttaggttataaagagttaaactggaatntaggctgtccttatccaatggttactaaatccggaatgggttctggtttaatatgtaatccaacaaaaattgacgagattttaaagcgtgcacataacgagagcgacataacggtttccatgaaaatgagaatgggttatgaacatgctgccgaaattttagacaccttccctatcctagatagctatccactaaaaaacattgcgatacatgccagaattggcaagcaattatacataggaccagtagatttggaagcgtttgagcgttgtattactggcacaaaacacaagttatattacaatggtgatattacgtctgtagaaagttttaaagctatggaagcacgcttccctagtattgatcattttatgattggtcgtggactaattgcagatccgtttttaccaagtatgattaaaaataacaccacaacatatcctaaagaccgttgggagatctttagtcagtttcatgatacaatttaccaacagtacgacgactacctttctggtccaacaccaataaaaatgaacatgttaggcttttgggagtttttctcgcagtcgttttctaatcctcaaaaaacttataaagccattaaaaaagctagtaatcctgtaaaataccaacaagcagttgctactattttaaan

SEQ ID NO: 20504 - protein, 235 aa, Unknown
  Obtained from environmental sample
  misc_feature (1)..(235): Xaa is any amino acid
MRRYVQSLGYKELNWNXGCPYPMVTKSGMGSGLICNPTKIDEILKRAHNESDITVSMKMRMGYEHAAEILDTFPILDSYPLKNIAIHARIGKQLYIGPVDLEAFERCITGTKHKLYYNGDITSVESFKAMEARFPSIDHFMIGRGLIADPFLPSMIKNNTTTYPKDRWEIFSQFHDTIYQQYDDYLSGPTPIKMNMLGFWEFFSQSFSNPQKTYKAIKKASNPVKYQQAVATILX

SEQ ID NO: 20505 - DNA, 549 bp, Unknown
  Obtained from environmental sample
  misc_feature (1)..(549): n is a, c, g, or t
atgaaaatgagaatgggttatgaacatgctgccgaaattttagacaccttccctatcctagatagctatccactaaaaaacattgcgatacatgccagaattggcaagcaattatacaaaggaccagtagatttggaagcgtttgagcgttgtattactggcacaaaacacaagttatattacaatggtgatattacgtctgtagaaagttttaaagctatggaagcacgcttccctagtattgatcattttatgattggtcgtggactaattgcagatccgtttttaccaagtatgattaaaaataacaccacaacatatcctaaagaccgttgggagatttttagtcagtttcatgatacaatttaccaacagtacgacgactacctttctggtccaacaccaataaaaatgaaaatgttaggcttttgggagtttttctcgcagtcgttttctaatcctcaaaaaacttataaagccattaaaaaagctagtaatcctgtaaaatacaaacaagcagttgctactattttaaataacgaaaagtag

SEQ ID NO: 20506 - protein, 182 aa, Unknown
  Obtained from environmental sample
  misc_feature (1)..(182): Xaa is any amino acid
MKMRMGYEHAAEILDTFPILDSYPLKNIAIHARIGKQLYKGPVDLEAFERCITGTKHKLYYNGDITSVESFKAMEARFPSIDHFMIGRGLIADPFLPSMIKNNTTTYPKDRWEIFSQFHDTIYQQYDDYLSGPTPIKMKMLGFWEFFSQSFSNPQKTYKAIKKASNPVKYKQAVATILNNEK

SEQ ID NO: 20507 - DNA, 603 bp, Unknown
  Obtained from environmental sample
  misc_feature (1)..(603): n is a, c, g, or t
atgctagatgaagcactgaagcaatacgaactagtattgaagttaaaaggcaatgaagtagaaagtcttcataatatatcagtcattcaaaatagattaaataaccctactgcggcaaaaaaatatatcgataatgcttataacttagagcctcatagccaaataattatccatacaagaataaaaatatacttaaacttaagtctgtttactgatgttattttactttgtgacgcataccttaaattatttaatgaaaatatgagtgtttataattcaatgggtatagcctataaagctctttgcctatgggatgatgctatcgaagtgctaagtagagcagtagagttaaataatgactttatagagggaaagaaaaacctagcaagttgttatcatctgaacggtaactttaataaagctatagaattatataaagaggttattaagcaaagcccacttgatttagatacgcatcactggctaaacagtcttttatgggagttgggtgacaatacatttttagattcatatttgatagcaagaaagatttcatcaaacataggtattactactgagttagccgaaaagcttatcgtgtga

SEQ ID NO: 20508 - protein, 200 aa, Unknown
  Obtained from environmental sample
  DOMAIN (122)...(155): TPR Domain
  misc_feature (1)..(200): Xaa is any amino acid
MLDEALKQYELVLKLKGNEVESLHNISVIQNRLNNPTAAKKYIDNAYNLEPHSQIIIHTRIKIYLNLSLFTDVILLCDAYLKLFNENMSVYNSMGIAYKALCLWDDAIEVLSRAVELNNDFIEGKKNLASCYHLNGNFNKAIELYKEVIKQSPLDLDTHHWLNSLLWELGDNTFLDSYLIARKISSNIGITTELAEKLIV

SEQ ID NO: 20509 - DNA, 321 bp, Unknown
  Obtained from environmental sample
  misc_feature (1)..(321): n is a, c, g, or t
atgcatcgaagtacaatcgaactaaaaaagatactttataacacaaaatactggatcgaaaacgaaacatattcacctgaagaaattacgattagatttaaacatcaaattgtctcaattcattgtttcccaaatggaaatggaagacattcaagattaatggctgacattattattgaattcatttttaaaaaagaaatttttagttggcaaaaatctaatatggtaaaagcagatgaaactttaaaaaaatacattgaagcattaaaaaaagctgatgatggagatataaatgcgttaataaagtttgctaaaaattaa

SEQ ID NO: 20510 - protein, 106 aa, Unknown
  Obtained from environmental sample
  misc_feature (1)..(106): Xaa is any amino acid
MHRSTIELKKILYNTKYWIENETYSPEEITIRFKHQIVSIHCFPNGNGRHSRLMADIIIEFIFKKEIFSWQKSNMVKADETLKKYIEALKKADDGDINALIKFAKN

SEQ ID NO: 20511 - DNA, 354 bp, Unknown
  Obtained from environmental sample
  misc_feature (1)..(354): n is a, c, g, or t
gtggtgtattctttacataaacacaaaaatagtctaaaaggttttgcagctttatcagaacttaaagcaagttttacacactatataaaagatttaggtatcgagcttattgatgttaagcaagaacagctaaacaaaattcaagacagaggtcttacagaaactgcatggttacaattattattaaccatgaaattttggatggatgatacttctgcttcatttgaaaaaacagacatttttatagaaaaatctgtaaacacaagtttggatgtattaaatgtcatgcctttaaaaagtattattgactttggaaaattcatctttaaagaaaaaattaagatgagtaattaa

SEQ ID NO: 20512 - protein, 117 aa, Unknown
  Obtained from environmental sample
  misc_feature (1)..(117): Xaa is any amino acid
MVYSLHKHKNSLKGFAALSELKASFTHYIKDLGIELIDVKQEQLNKIQDRGLTETAWLQLLLTMKFWMDDTSASFEKTDIFIEKSVNTSLDVLNVMPLKSIIDFGKFIFKEKIKMSN

SEQ ID NO: 20513 - DNA, 534 bp, Unknown
  Obtained from environmental sample
  misc_feature (1)..(534): n is a, c, g, or t
atgattttaaaatctttagcgcttttaaactataaaaatttcgactctaaatcattcgagtttaaccatactattaactgccttgttggtaataatggtgttggaaaaaccaatgtattggatgcaatctaccatttatcctttggtaaaagctactttaatcctgtagcatcacagaatattaaatatgacgaagagttttttgttattaatggtgaatatgacaaagacgaaaaaacagaaaacattgtagtaagtctgaaaaaaggacaaaaaaaaattataaaaagaaacagtaaagcttacgacaagtttagtgatcacattggttttttacctttagtgataataagtcctgctgacagagatttaattattgaaggtagtgatactagacgaaaatttattgatagcgttattagccaaagcgataaaaactacttaagtaatttaattaattacaacaaaattttatctcaacgcaactcattgcttaatattttgctgcaatcacacttatatatgatactgtag

SEQ ID NO: 20514 - protein, 177 aa, Unknown
  Obtained from environmental sample
  DOMAIN (1)...(141): RecF/RecN/SMC N terminal domain
  misc_feature (1)..(177): Xaa is any amino acid
MILKSLALLNYKNFDSKSFEFNHTINCLVGNNGVGKTNVLDAIYHLSFGKSYFNPVASQNIKYDEEFFVINGEYDKDEKTENIVVSLKKGQKKIIKRNSKAYDKFSDHIGFLPLVIISPADRDLIIEGSDTRRKFIDSVISQSDKNYLSNLINYNKILSQRNSLLNILLQSHLYMIL

SEQ ID NO: 20515 - DNA, 840 bp, Unknown
  Obtained from environmental sample
  misc_feature (1)..(840): n is a, c, g, or t
gtggatcacagaatcggctcgagagcttttgaaaacaactccagaaagtctaagaaaaaaggtgaagctaattaccactttgaattactaaaagtaaatgcagatggacaaaaaacaacagcgtttaaaaaggcagataaatttatctcgtcaatggagttaatcaaaacagaggacagattatcatgtgttggtttttacggagttaaagatcaaggtaattataatggtgtttgtttgtttaatttaaatccagatacgcttgctatggagactgaaaaatttacacctttctctgatgagtttatgacagataaatatggtaataaagaaaacagaaaaaaaagaaaacagaaaaagggtattaaaaatatagattttaaaggcatttttacaatggataatggtgacattattgtaaacgcagaggagttttttattaccacacatacatctatgaatggtagtggtggaatgtctacttataccatttaccattttaatgacatcatgagcgttagattagataaggatggtgacttaaaatgggctagaaacatcaacaaagcacaaacagggcttactaatagctcttacacttcaattccagtaggagaaacaacttacttttttataaactgctctgataatattaaaaaacttagtgcagaccgtattgcttttaaacaaactaaagccaaaaagtctaacctttacatgatatctattgatcaaaatggtgcttttgattttgaaaaattaatagacgacaaagactctaaagtctattacaaggttaatgatggtgttgtaaaccttattgatcgcacagttatttaa

SEQ ID NO: 20516 - protein, 279 aa, Unknown
  Obtained from environmental sample
  misc_feature (1)..(279): Xaa is any amino acid
MDHRIGSRAFENNSRKSKKKGEANYHFELLKVNADGQKTTAFKKADKFISSMELIKTEDRLSCVGFYGVKDQGNYNGVCLFNLNPDTLAMETEKFTPFSDEFMTDKYGNKENRKKRKQKKGIKNIDFKGIFTMDNGDIIVNAEEFFITTHTSMNGSGGMSTYTIYHFNDIMSVRLDKDGDLKWARNINKAQTGLTNSSYTSIPVGETTYFFINCSDNIKKLSADRIAFKQTKAKKSNLYMISIDQNGAFDFEKLIDDKDSKVYYKVNDGVVNLIDRTVI

SEQ ID NO: 20517 - DNA, 720 bp, Unknown
  Obtained from environmental sample
  misc_feature (1)..(720): n is a, c, g, or t
atggagttaatcaaaacagaggacagattatcatgtgttggtttttacggagttaaagatcaaggtaattataatggtgtttgtttgtttaatttaaatccagatacgcttgctatggagactgaaaaatttacacctttctctgatgagtttatgacagataaatatggtaataaagaaaacagaaaaaaaagaaaacagaaaaagggtattaaaaatatagattttaaaggcatttttacaatggataatggtgacattattgtaaacgcagaggagttttttattaccacacatacatctatgaatggtagtggtggaatgtctacttataccatttaccattttaatgacatcatgagcgttagattagataaggatggtgacttaaaatgggctagaaacatcaacaaagcacaaacagggcttactaatagctcttacacttcaattccagtaggagaaacaacttacttttttataaactgctctgataatattcaaaaacttagtgcagaccgtattgcttttaaacaaactaaagccaaaaagtctaacctttacatgatatctattgatcaaaatggtgcttttgattttgaaaaattaatagacgacaaagactctaaagtctattacaaggttaatgatggtgttgtaaaccttaatgatcgcacagttattttaccaggtacaacgaaaaaaatacacgaattttaa

SEQ ID NO: 20518 - protein, 239 aa, Unknown
  Obtained from environmental sample
  misc_feature (1)..(239): Xaa is any amino acid
MELIKTEDRLSCVGFYGVKDQGNYNGVCLFNLNPDTLAMETEKFTPFSDEFMTDKYGNKENRKKRKQKKGIKNIDFKGIFTMDNGDIIVNAEEFFITTHTSMNGSGGMSTYTIYHFNDIMSVRLDKDGDLKWARNINKAQTGLTNSSYTSIPVGETTYFFINCSDNIQKLSADRIAFKQTKAKKSNLYMISIDQNGAFDFEKLIDDKDSKVYYKVNDGVVNLNDRTVILPGTTKKIHEF

SEQ ID NO: 20519 - DNA, 570 bp, Unknown
  Obtained from environmental sample
  misc_feature (1)..(570): n is a, c, g, or t
ttggctgacagcataattccatataaatttttaaacgacaaaataggtcctcaatctgatgtcgtgtcagaagatttaactaataacttatttttgaaaaacaataaaggcatcattcaacttaaagccactaacaacgataaattggttttaactagagattattatgatgacagactaattgttgggtatgaaaacatatcacaaattaatgactctatctatgcgcttaacttaaataatggctttttattactaaatgcaaaccaaaattttaccgttaaaaaaccagttaaaccactaatcgaaaaaatacaagtaaacgacattagagtaaagattgacacttcggtaatagagttaccaaataacggaaaactaagcatatctatagcctctccaaactctaacaatcattttgttgaatacagtttaagcacaaatcctactaaatgggacaaagtagataatgaaaacttagtattgtccaacatcataaatggagacttttcactattattcaggacttccaataaagcaggcgaaacctctccagtaaaaacaatangn

SEQ ID NO: 20520 - protein, 190 aa, Unknown
  Obtained from environmental sample
  misc_feature (1)..(190): Xaa is any amino acid
MADSIIPYKFLNDKIGPQSDVVSEDLTNNLFLKNNKGIIQLKATNNDKLVLTRDYYDDRLIVGYENISQINDSIYALNLNNGFLLLNANQNFTVKKPVKPLIEKIQVNDIRVKIDTSVIELPNNGKLSISIASPNSNNHFVEYSLSTNPTKWDKVDNENLVLSNIINGDFSLLFRTSNKAGETSPVKTIX

SEQ ID NO: 20521 - DNA, 531 bp, Unknown
  Obtained from environmental sample
  misc_feature (1)..(531): n is a, c, g, or t
ttgaagacaaaatatatttgggctgcacatgcttacaaaggcttaataaaagtaaagttaaataacacctttgattccattattgattataaggaatataacacaaaagcaactgcttccgactacaacattaaagtctataaaattcaaaacaatatttgctttaaaaccaatgatggatggaaaacctacgagccattggctgacagcataattccatataaatttttaaacgacaaaataggtcctcaatctgatgtcgtgtcagaagatttaactaataacttatttttgaaaaacaataaaggcatcattcaacttaaagccactaacaacgataaattggttttaactagagattattatgatgacagactaattgttgggtatgaaaacatatcacaaattaatgactctatctatgcgcttaacttaaataatggctttttattactaaatgcaaaccaaaattttaccgttaaaaaaccagttgaaaccactaatcgacaaaatacaagtaaacgacattag

SEQ ID NO: 20522 - protein, 176 aa, Unknown
  Obtained from environmental sample
  misc_feature (1)..(176): Xaa is any amino acid
MKTKYIWAAHAYKGLIKVKLNNTFDSIIDYKEYNTKATASDYNIKVYKIQNNICFKTNDGWKTYEPLADSIIPYKFLNDKIGPQSDVVSEDLTNNLFLKNNKGIIQLKATNNDKLVLTRDYYDDRLIVGYENISQINDSIYALNLNNGFLLLNANQNFTVKKPVETTNRQNTSKRH

SEQ ID NO: 20523 - DNA, 513 bp, Unknown
  Obtained from environmental sample
  misc_feature (1)..(513): n is a, c, g, or t
atgcaaaccaaaattttaccgttaaaaaaccagttgaaaccactaatcgacaaaatacaagtaaacgacattagagtaaagattgacacttcggtaatagagttaccaaataacggaaaactaagcatatctatagcctctccaaagtctaacaatcattttgttgaatacagtttaagcacaaatcctactaaatgggacaaagtagataatgaaaacttagtattgtccaacatcaaaaatggagacttttcactattattcaggacttccaataaagcaggcgaaacctctccagtaaaaacaataaatcttcatgtattaccaccatggtacaagtctagtacaggttgtataatatacgcattaggcttcattttaactttaggtattatgtatttacttcatacaagaaacatgagaaggaaccaaaatagtagactggattttaaaaggagcaggacagctctaaaggaaccatctcgcaatgacgtagaatattacttaaaatga

SEQ ID NO: 20524 - protein, 170 aa, Unknown
  Obtained from environmental sample
  misc_feature (1)..(170): Xaa is any amino acid
MQTKILPLKNQLKPLIDKIQVNDIRVKIDTSVIELPNNGKLSISIASPKSNNHFVEYSLSTNPTKWDKVDNENLVLSNIKNGDFSLLFRTSNKAGETSPVKTINLHVLPPWYKSSTGCIIYALGFILTLGIMYLLHTRNMRRNQNSRLDFKRSRTALKEPSRNDVEYYLK

SEQ ID NO: 20525 - DNA, 468 bp, Unknown
  Obtained from environmental sample
  misc_feature (1)..(468): n is a, c, g, or t
atgagtactcgcaaacctactattctcgataatgaagccgcagattttgattataaacttaaagaaacaactggctctctactggtagctgatagctttgcgagtgaagttaaaggtaaaaaggggctgtctcgtattttaaaagcgacgggctactcgatagatggttttaaagcggcttataaatatgaagcggcctttaggcaagttatttggcttaactttttactacttatcgttttaatatttatgccttttgctatctatataaaaatgctgctgttaatagtttcgtttctatcgcttatcgtcgagctattcaatacaggtatcngaagctgcgttgacataattctacagaacaacattcgntcgataaaaatagctaagatgtcggtctgctgccagttttggggtaatgaattgttggttatggtgatgcttattacgtctataagaaaaccttga

SEQ ID NO: 20526 - protein, 155 aa, Unknown
  Obtained from environmental sample
  DOMAIN (43)...(145): Prokaryotic diacylglycerol kinase
  misc_feature (1)..(155): Xaa is any amino acid
MSTRKPTILDNEAADFDYKLKETTGSLLVADSFASEVKGKKGLSRILKATGYSIDGFKAAYKYEAAFRQVIWLNFLLLIVLIFMPFAIYIKMLLLIVSFLSLIVELFNTGIXSCVDIILQNNIRSIKIAKMSVCCQFWGNELLVMVMLITSIRKP

SEQ ID NO: 20527 - DNA, 495 bp, Unknown
  Obtained from environmental sample
  misc_feature (1)..(495): n is a, c, g, or t
atgagtaaaaagcttcaaaaagatatttgcaacgaaacactttttaattctatttttaaaaagtatgcaaaagatttacacgattttctgtattataaattcggcgaacatttagaccctaaagataaaactcaagaagcatttatcaagttatgggaaaattgtgctaaagtaacacccgaaaaggcgaaaagttatgtatttactattggtaataatttaatgttaaacgaaacgaagcaccaaaaagtcgttttaaaataccaaaaaaacataccaaaatctcatactaacgaaaccccagagtttataatggaaggtaatgagtatatgcaaaagttgcaactggctatatctaatttaaccgaagcccagcgtatcgcctttttattaaatagagttgaaggcaaacgccacaaagagattgcagcacttttagggattagtacaaaagctgtagaaaaacgtatctattggtgctctaanaaaaattaa

SEQ ID NO: 20528 - protein, 164 aa, Unknown
  Obtained from environmental sample
  DOMAIN (18)...(84): Sigma-70 region 2
  misc_feature (1)..(164): Xaa is any amino acid
MSKKLQKDICNETLFNSIFKKYAKDLHDFLYYKFGEHLDPKDKTQEAFIKLWENCAKVTPEKAKSYVFTIGNNLMLNETKHQKVVLKYQKNIPKSHTNETPEFIMEGNEYMQKLQLAISNLTEAQRIAFLLNRVEGKRHKEIAALLGISTKAVEKRIYWCSXKN

SEQ ID NO: 20529 - DNA, 516 bp, Unknown
  Obtained from environmental sample
  misc_feature (1)..(516): n is a, c, g, or t
atgagtaaaaagcttcaaaaagatatttgcaacgaaacactttttaattctatttttaaaaagtatgcaaaagatttacacgattttctgtattataaattcggcgaacatttagaccctaaagataaaactcaagaagcatttatcaagttatgggaaaattgtgctaaagtaacacccgaaaaggcgaaaagttatgtatttactattggtaataatttaatgttaaacgaaacgaagcaccaaaaagtcgttttaaaataccaaaaaaacataccaaaatctcatactaacgaaaccccagagtttataatggaaggtaatgagtatatgcaaaagttgcaactggctatatctaatttaaccgaagcccagcgtatcgcctttttattaaatagagttgaaggcaaacgccacaaagagattgcagcacttttagggattagtacaaaagctgtagaaaaacgtatttatggtgctctaaaaaaattaagagaagatattgatactatttag

SEQ ID NO: 20530 - protein, 171 aa, Unknown
  Obtained from environmental sample
  DOMAIN (18)...(84): Sigma-70 region 2
  misc_feature (1)..(171): Xaa is any amino acid
MSKKLQKDICNETLFNSIFKKYAKDLHDFLYYKFGEHLDPKDKTQEAFIKLWENCAKVTPEKAKSYVFTIGNNLMLNETKHQKVVLKYQKNIPKSHTNETPEFIMEGNEYMQKLQLAISNLTEAQRIAFLLNRVEGKRHKEIAALLGISTKAVEKRIYGALKKLREDIDTI

SEQ ID NO: 20531 - DNA, 726 bp, Unknown
  Obtained from environmental sample
  misc_feature (1)..(726): n is a, c, g, or t
ttgtttagctttttaggagttattttaatcgctttctttgggtttattgggtttagtcaaattattacatcaccttcagaacgtgctcaaaaaagagaattagagaatttgaagttacattatgagttgattgataagagattagaggaaagttctgatattttatcgcaattgcaagaaagagacaataatatttatagaagttactttgaagcaaaccccatccctgaagaacaaagaaaagctggttttggtggagttaacaggtataaaaatttagaaggttttgataattctgggttgataaaaaatttaacgaaagaagttgatattttatcaaaacaaatggtggtacaatctaaatctttagatgaaattgtagctttagcaaaagaaaaagaagatatgttagcttcgattcctgcaattttaccaatcaaaaaaggagaattttatgtggcttctggttacaaaatgagaatgcatcccattttaaaaattaataaatttcataaaggaatggattttacagccccaaaaggaacacctgtttatgcctctggaaatggaaaagttaccatagctcaaagaagtagtacttttggaaatgttgtttatattgaacatggttatggctacaaaacaatttatgcacatttaagtacaatcgaagttaaaaaatataacgaagtaaaacgagcgagacttaatanggtccgtcggtaa

SEQ ID NO: 20532 - protein, 241 aa, Unknown
  Obtained from environmental sample
  SIGNAL (1)...(19)
  DOMAIN (169)...(241): Peptidase family M23
  misc_feature (1)..(241): Xaa is any amino acid
MFSFLGVILIAFFGFIGFSQIITSPSERAQKRELENLKLHYELIDKRLEESSDILSQLQERDNNIYRSYFEANPIPEEQRKAGFGGVNRYKNLEGFDNSGLIKNLTKEVDILSKQMVVQSKSLDEIVALAKEKEDMLASIPAILPIKKGEFYVASGYKMRMHPILKINKFHKGMDFTAPKGTPVYASGNGKVTIAQRSSTFGNVVYIEHGYGYKTIYAHLSTIEVKKYNEVKRARLNXVRR

SEQ ID NO: 20533 - DNA, 411 bp, Unknown
  Obtained from environmental sample
  misc_feature (1)..(411): n is a, c, g, or t
atgactaaagaatcctttttaagggctttcatggaagacatctggaataaaaaacagtttgatcttgttaaaaaatatgtgcatcccgaatataaaatacatttggacactaccgacccttgggaaggaaagacactgtctcattctgaatttaaagagcgccttaaattctctttcaattcgtttccagatatgcatttcgaaattatctcagccattccagaagataatcatgtggctatcacttggatattaacaggtactaatctgggaaatattggcccctacccaccaacaaaaaagaccattaaaaccaatggtattaccatttatcattttgaagatggtttaattagtgggcacacacaagtctttgaccgcgtaaccgtaatgaaacaattaggattttaa

SEQ ID NO: 20534 - protein, 136 aa, Unknown
  Obtained from environmental sample
  misc_feature (1)..(136): Xaa is any amino acid
MTKESFLRAFMEDIWNKKQFDLVKKYVHPEYKIHLDTTDPWEGKTLSHSEFKERLKFSFNSFPDMHFEIISAIPEDNHVAITWILTGTNLGNIGPYPPTKKTIKTNGITIYHFEDGLISGHTQVFDRVTVMKQLGF

SEQ ID NO: 20535 - DNA, 831 bp, Unknown
  Obtained from environmental sample
  misc_feature (1)..(831): n is a, c, g, or t
atgaagaatcaaatagcttacatagatgaatttggaaataatggacttgatttcgataatcaaggagtaagtgacaccttcattgtaactgcaatcattattgatgaaaaaaatcttcaagaaattgaaagtaaattagagataatacgaaaaactaattttcaaactggagaaatcaaatcgtctaaagtcaaagataatgacacaagaagattaaaaattatatctgaactgaattatctggattatcatatattttcaatagttgttgataaaacaaaacttaaaggagaagggtttcaatataaaggttcgttttataaattccttcactctcttgtagatagagaattattcaaaacatttcctgatttacttgtagtttctgacgaacatggtggaaaagaatttaaagaaagttttattaaatacatgagaaaaaggcatattccaagcctatttcaacaatctgaattttgcttatctaacagcaaatctgagttgttagtgcaaatggctgattttgttactggaaccattgcaagatgctatgaacctaaaaaattaagtccaagaagaaatgaactcttaactgctttaaaacaaaaagtaattgaaatcagattgtggccacctgactataagccaatggcttatgatcctggtaaagattttgcaaattacgacccaactatctcgagtttaagtttaaatttagctagtcaatttctagataaatttgacaactcagatattccatatgtagtagaccaatgtacatgtttgaggtatttattatttcactttaggatanctcgagccgattcttga

SEQ ID NO: 20536 - protein, 276 aa, Unknown
  Obtained from environmental sample
  misc_feature (1)..(276): Xaa is any amino acid
MKNQIAYIDEFGNNGLDFDNQGVSDTFIVTAIIIDEKNLQEIESKLEIIRKTNFQTGEIKSSKVKDNDTRRLKIISELNYLDYHIFSIVVDKTKLKGEGFQYKGSFYKFLHSLVDRELFKTFPDLLVVSDEHGGKEFKESFIKYMRKRHIPSLFQQSEFCLSNSKSELLVQMADFVTGTIARCYEPKKLSPRRNELLTALKQKVIEIRLWPPDYKPMAYDPGKDFANYDPTISSLSLNLASQFLDKFDNSDIPYVVDQCTCLRYLLFHFRIXRADS

SEQ ID NO: 20537 - DNA, 612 bp, Unknown
  Obtained from environmental sample
  misc_feature (1)..(612): n is a, c, g, or t
atgatgctcatcttttggaaattattgaaagaaaagaaaatccccagagtacaaatgattatggacagcccgatgggtgccaatgtattggaactgtttcatagaactcgcgattggcacagattggaggacaacgaatgtgacgaaatgtgttctcactttacggtcgtaagcagttatcgggaaacaatggaattaagaacagacaacaagccaaaaatcgtgattgcaggaagcggaatgctcacaggcggaagaatgctaaactaccttgaaacacaggcacaaaaccccaacaacaccttgctttttgtgggttatcaagctgaaggtacgcgaggcagaaaattattggaaggcgataaggaactaaaagtctatggaaaatgggtgccctttgatatggaagttgcagaaattgaagggctttcggcacacgcagaccacgcagaacttatggactggatggataagataaaaaacaaacccgaacgtattttcattgtacacggtgaaaaagagagtgcagaagcattgcaaaaaggcatcaaggaaacctatgggtgggatgcagaaattccgcaattatacaccatcgaagaaatagaataa

SEQ ID NO: 20538 - protein, 203 aa, Unknown
  Obtained from environmental sample
  DOMAIN (129)...(174): RNA-metabolising metallo-beta-lactamase
  misc_feature (1)..(203): Xaa is any amino acid
MMLIFWKLLKEKKIPRVQMIMDSPMGANVLELFHRTRDWHRLEDNECDEMCSHFTVVSSYRETMELRTDNKPKIVIAGSGMLTGGRMLNYLETQAQNPNNTLLFVGYQAEGTRGRKLLEGDKELKVYGKWVPFDMEVAEIEGLSAHADHAELMDWMDKIKNKPERIFIVHGEKESAEALQKGIKETYGWDAEIPQLYTIEEIE

SEQ ID NO: 20539 - DNA, 612 bp, Unknown; identical to SEQ ID NO: 20537
  Obtained from environmental sample
  misc_feature (1)..(612): n is a, c, g, or t

SEQ ID NO: 20540 - protein, 203 aa, Unknown; identical to SEQ ID NO: 20538
  Obtained from environmental sample
  DOMAIN (129)...(174): RNA-metabolising metallo-beta-lactamase
  misc_feature (1)..(203): Xaa is any amino acid

SEQ ID NO: 20541 - DNA, 408 bp, Unknown
  Obtained from environmental sample
  misc_feature (1)..(408): n is a, c, g, or t
gtgagttcgaatctcactttgggatcaatgtgtaaaaaagcagaacaattaaagatgaatccaagtactgcctcaggaaggttagtgaaggatattatatttgggtttttagtcaaagaaaagattgtatgccatcattgtgatagaccaatgactagggaaaattacagtattgagcataaagaaccatggctagactcagaaaacccagtaggattgtattttgatttagagaatatcagttttagccacttacgttgtaatataaaagccagcagaaacaacatgacatcaaagcaaaaacatcctagtataagtgcctatgaaaatagaggttgtaggtgtgctgagtgtaccgagcttaaacggattcataataagaaatatagaaaaccattactaacctaa

SEQ ID NO: 20542 - protein, 135 aa, Unknown
  Obtained from environmental sample
  misc_feature (1)..(135): Xaa is any amino acid
MSSNLTLGSMCKKAEQLKMNPSTASGRLVKDIIFGFLVKEKIVCHHCDRPMTRENYSIEHKEPWLDSENPVGLYFDLENISFSHLRCNIKASRNNMTSKQKHPSISAYENRGCRCAECTELKRIHNKKYRKPLLT

SEQ ID NO: 20543 - DNA, 540 bp, Unknown
  Obtained from environmental sample
  misc_feature (1)..(540): n is a, c, g, or t
gtgtttnttgttcgttctatagttggggattccggaagtgtaatcggtatcgacttcactgatgaaatgattgataaagcaaatcaaaataatgaaaaaatgggttataaaaatgttgagttccgtatcggagatattgagactatgcccgttaatgacaatatcactgatgtggttgtcagtaactgtgttttgaatcttgttcctgataaaaagaaagcctttaatgaaatctataggatccttaagccgggcgctcatttttgtgtttctgatattgtcttgcaaggtgaactacctggaaatattaaaaaatctgcggaaatgtatgccggatgtgtctcaggagcagagcaacaagatgactatttaaatatcattaaagaagcaggatttaaggatattgaagtgaaaaagagcagtactatcaatttgcctgattcctttctaaaagattatataacagaaaaagagattgatagtttcaaaaaaagaaacgtgggaatatttagtattacagttgttggatataagaaataa

SEQ ID NO: 20544 - protein, 179 aa, Unknown
  Obtained from environmental sample
  DOMAIN (1)...(138): ubiE/COQ5 methyltransferase family
  misc_feature (1)..(179): Xaa is any amino acid
MFXVRSIVGDSGSVIGIDFTDEMIDKANQNNEKMGYKNVEFRIGDIETMPVNDNITDVVVSNCVLNLVPDKKKAFNEIYRILKPGAHFCVSDIVLQGELPGNIKKSAEMYAGCVSGAEQQDDYLNIIKEAGFKDIEVKKSSTINLPDSFLKDYITEKEIDSFKKRNVGIFSITVVGYKK

SEQ ID NO: 20545 - DNA, 702 bp, Unknown
  Obtained from environmental sample
  misc_feature (1)..(702): n is a, c, g, or t
ttgaaggatagctctcttaaaaaagagaaatcgaatttagatcaagagaaattaatacattgtaattatcaaaatagcttctacaattctcagcataaaactagacatataggtgaatttatggttgattttgatgatatagaatctgattttccagctttaatttcaaaatggttcgaactttatgaaactttcgattcagttcttttattattcttaaagcatttcaaagataaatatagattttcatctgataagtttatggatactattcgtgcagtcgaaaattttcatcgaataaaatttaataatgaaaggatacctcaagagagatttgaaaaattagtaaataaaatcattaatgaagctaatttagatttaatagattccgaatggctgactggaagattacaaggcaatgaaccgactttaaataatagattaaaggaacttatcggagaaagtgattctaaaactattaatgatagagttggtaaaatcaaaaagttctgctgggcagttacatcctcaagaaattattatactcattatgaccgaaaaataaaagtaacggcgaaaaaaggatcagacctttatgaattaactcgtacactaagagctatattaaccttatacatattgaaagaaatagggataaattatcaagattttagtaataatttaaaatatcatttcggttaa

SEQ ID NO: 20546 - protein, 233 aa, Unknown
  Obtained from environmental sample
  misc_feature (1)..(233): Xaa is any amino acid
MKDSSLKKEKSNLDQEKLIHCNYQNSFYNSQHKTRHIGEFMVDFDDIESDFPALISKWFELYETFDSVLLLFLKHFKDKYRFSSDKFMDTIRAVENFHRIKFNNERIPQERFEKLVNKIINEANLDLIDSEWLTGRLQGNEPTLNNRLKELIGESDSKTINDRVGKIKKFCWAVTSSRNYYTHYDRKIKVTAKKGSDLYELTRTLRAILTLYILKEIGINYQDFSNNLKYHFG

SEQ ID NO: 20547 - DNA, 765 bp, Unknown
  Obtained from environmental sample
  misc_feature (1)..(765): n is a, c, g, or t
ttgattcggttgnagcacctgacgattgcaagatcagagacaaaagtgataatgctagtattaatttttgattccacagataatattattggtatggatagaatcgtttataacgataatgaagacaataatcttaatgttaaaaaaaatattgcagaaaaaattgataatattagtgtcaaaatttctgcgcaattagtaaataatgaagttgaggctaaaatagaaacagctcaacaaaatgactttacaaccataaaagctacagctttcaataaaaccgaaattacaaaaagtttaatctttaaattaatggtttttgataaagaagaaagtgtagataaccttctagaagacaaaaagcaacgctttataatatctgccaaccaaaaaatagaacttgctgaggcttcatttaatattattggagatcagccagttatttgcgtcatgcttatttatgacttagataataatttgataggtcaagaccgagtggtttataatgataagtcaaatttagatatagaaaataaacaaaaattattagataaattaaaagaggaacaggcaaactctcaagacgtcaataaaggtaaaagagatggtttagaattaaaaggaatcgtagttgaagacacaaaaacaaaaccaggtagggacttttacaagttattttattctttatacactcaaaataatattaacgggaataaagtagtgacaatcaaggaggtattagcattaggtagaaacacgaaaata

SEQ ID NO: 20548 - protein, 255 aa, Unknown
  Obtained from environmental sample
  misc_feature (1)..(255): Xaa is any amino acid
MIRLXHLTIARSETKVIMLVLIFDSTDNIIGMDRIVYNDNEDNNLNVKKNIAEKIDNISVKISAQLVNNEVEAKIETAQQNDFTTIKATAFNKTEITKSLIFKLMVFDKEESVDNLLEDKKQRFIISANQKIELAEASFNIIGDQPVICVMLIYDLDNNLIGQDRVVYNDKSNLDIENKQKLLDKLKEEQANSQDVNKGKRDGLELKGIVVEDTKTKPGRDFYKLFYSLYTQNNINGNKVVTIKEVLALGRNTKI

SEQ ID NO: 20549 - DNA, 390 bp, Unknown
  Obtained from environmental sample
  misc_feature (1)..(390): n is a, c, g, or t
atgaaaaacaaaaaacacaattataacggaaaaagtattctctcaagatgcagctctattcttttaatacttgctttgatttctgtattttcctgcgcgccacttcaatattcattcgatgcacgagaaaatagcaaattttcaacatttgataatctgggcattgctaaagaagattttataaaacaatatggtcagcctacgaacaaaggactatatcagcaaacgcaagccaaaaaagtagaaaaattgtactacacagagaagattaaggactttttagttaccacggagtttatttttgaaaacaatattctaaaacaaatggaaagagttgaaacaagaaataactttcaagaaatcagagagcatttagaaatgataaactga

SEQ ID NO: 20550 - protein, 129 aa, Unknown
  Obtained from environmental sample
  misc_feature (1)..(129): Xaa is any amino acid
MKNKKHNYNGKSILSRCSSILLILALISVFSCAPLQYSFDARENSKFSTFDNLGIAKEDFIKQYGQPTNKGLYQQTQAKKVEKLYYTEKIKDFLVTTEFIFENNILKQMERVETRNNFQEIREHLEMIN

SEQ ID NO: 20551 - DNA, 390 bp, Unknown
  Obtained from environmental sample
  misc_feature (1)..(390): n is a, c, g, or t
atgaaaaacaaaaaacacaattataacggaaaaagtattctctcaagatgcagctctattcttttaatacttgctttgatttctgtattttcctgcgcgccacttcaatattcattcgatgcacgagaaaatagcaaattttcaacatttgataatctgggcattgctaaagaagattttataaaacaatatggtcagcctacgaacaaaggactatatcagcaaacgcaagccaaaaaagtagaaaaattgtactacacagagaagattaaggactttttagttaccacggagtttatttttgaaaacaatattctaaaacaaatggaaagagttgaaacaagaaataactttcaagaaatcagagagcatttagaaatgataaaatga

SEQ ID NO: 20552 - protein, 129 aa, Unknown
  Obtained from environmental sample
  misc_feature (1)..(129): Xaa is any amino acid
MKNKKHNYNGKSILSRCSSILLILALISVFSCAPLQYSFDARENSKFSTFDNLGIAKEDFIKQYGQPTNKGLYQQTQAKKVEKLYYTEKIKDFLVTTEFIFENNILKQMERVETRNNFQEIREHLEMIK

SEQ ID NO: 20553 - DNA, 615 bp, Unknown
  Obtained from environmental sample
  misc_feature (1)..(615): n is a, c, g, or t
ttggaggaattattatcaacttctgatgataaaacgttggtaagtttaatgcacatcaacaacgaaattggtaatattttaaatgttgatgaaattactaaattatgtaaaaaatacgatgccttatttcattcagatactgtgcaggcaattgggcattataaaatcgatttaaaagaaactcccattgattttatagtcgcaagtgcccataaatttcatggaccaaaaggtgtaggtttcgcttattttaaaaaaggatttggaattttgccaatgtttcatggaggagatcaggaaagaggagcaaggtctagtacagaaaatgtacatagcattttaggtatggaaaaagcactttcaattgctatgaatcatctagaaaaagatcgaaattatatagaaagtttaaaggtgtactttatttctgaattaaaaagtatctcagataaaattgaatttaatggactttcatccaatttaaataaaagtagttatccaatcttaaatgttcgttttcctgtgagtaatgatatgttgttatttagtttagatatggcaggaattgctgtttctggaggttctgcttgccaaagtggaagtaataaaggataa

SEQ ID NO: 20554 - protein, 204 aa, Unknown
  Obtained from environmental sample
  DOMAIN (1)...(204): Aminotransferase class-V
  misc_feature (1)..(204): Xaa is any amino acid
MEELLSTSDDKTLVSLMHINNEIGNILNVDEITKLCKKYDALFHSDTVQAIGHYKIDLKETPIDFIVASAHKFHGPKGVGFAYFKKGFGILPMFHGGDQERGARSSTENVHSILGMEKALSIAMNHLEKDRNYIESLKVYFISELKSISDKIEFNGLSSNLNKSSYPILNVRFPVSNDMLLFSLDMAGIAVSGGSACQSGSNKG

SEQ ID NO: 20555 - DNA, 300 bp, Unknown
  Obtained from environmental sample
  misc_feature (1)..(300): n is a, c, g, or t
ttgatgcaatatttacctaacatactttttgcaattttactagcattcggaattgttttttttacaaagaacattaaaaaactaattcgtaatatcaagttaggaaaatctattaataggtctgacaatactaaattgcgatggaaaaatatggcatatgtagctttgggccagtctaaaatggttagccgtcctgttgcaggcttaatgcatatcatagtttatttaggttttataattataaatattgaagttcttgaaattattactgatgctcgagccgattctatgatccactag

SEQ ID NO: 20556 - protein, 99 aa, Unknown
  Obtained from environmental sample
  misc_feature (1)..(99): Xaa is any amino acid
MMQYLPNILFAILLAFGIVFFTKNIKKLIRNIKLGKSINRSDNTKLRWKNMAYVALGQSKMVSRPVAGLMHIIVYLGFIIINIEVLEIITDARADSMIH

SEQ ID NO: 20557 - DNA, 510 bp, Unknown
  Obtained from environmental sample
  misc_feature (1)..(510): n is a, c, g, or t
gtgcgtgatatgtttctgttcagttgctataccggtatcagttatgctgatattgaaatccttaaaccggaacatgttttagaaggtatggatggtaataattggattgttacgcatcgtcaaaaaactgagacagaagtaaaaatacccttattagataaggcgaaattactcttgggaaaatatgacaatcatcctatggctgtcatctcagaaaccttatttcccgtggttagcaatgtgaaaatcaatctgtatctcaaagaaattgcctctgtggttggaattagaaaaaacctcacctttcacatggctcgccacacctttgccacaactgttacattaaacaatggcgtgcctatagagacggtttctaaattattgggtcacaagaaaatatcaacaactcagatttatgcacgtgtattagaggatagattaagtaaggatatgattgatttacagaagatattgaatggtaaggatgaactgaagttaatcaataaatag

SEQ ID NO: 20558 - protein, 169 aa, Unknown
  Obtained from environmental sample
  DOMAIN (1)...(149): Phage integrase family
  misc_feature (1)..(169): Xaa is any amino acid
MRDMFLFSCYTGISYADIEILKPEHVLEGMDGNNWIVTHRQKTETEVKIPLLDKAKLLLGKYDNHPMAVISETLFPVVSNVKINLYLKEIASVVGIRKNLTFHMARHTFATTVTLNNGVPIETVSKLLGHKKISTTQIYARVLEDRLSKDMIDLQKILNGKDELKLINK

SEQ ID NO: 20559 - DNA, 879 bp, Unknown
  Obtained from environmental sample
  misc_feature (1)..(879): n is a, c, g, or t
ttggaacgtgcaaaggctatctattaccattttcaagaaaatatgttttggaataatgaataccgcatcctttcagacatacgcgtaaaagatgcctttgaaagcaaaacagggaatagttctgaaattaatcttggacttattaatgccttggaggccgcaggtttggacaccaaaataatgcttattgcttctcgaaaccaacctttgccgaccaaacaatatcctgtacttaccgattttaactatgcccttgtctacctaaacatcaacaacacaaagtatttgctggatgccacggataaatacactccttttggcgtactaccttttcgtgatctaaatatggaagggcgcgtaatggattttaaaaaaggaagttactggatgcctatcgagccttttgagaaaaacatgcactatgttaatatgcagctaaccgcagacgaatccggtcaattttcggggaaggtcagtgaagtttccacaggctatatttctgttgaaaagcgcaaagaatacaatgattataataaagaggaaatcattaaaaagaaacaaggcaaaaacgaaagtttaaatattacaaatctagaaatccaaaaccaaaaagatctagaacagccctataaagaaaattataacatttcactgcacgaacagccagtaggagacaaattatttatctacccatttttgatgccgacctatttttctgaaaacccttttaaacaagaaatccgncaatatcctgtagaatttggttttcccattacaaataattatttactttcttttgacgttagcaatcaatatgacatagtgaaaacaccatccaatccgcctttaaaatttcccaataacgatggtgaaatccng

SEQ ID NO: 20560 - protein, 293 aa, Unknown
  Obtained from environmental sample
  misc_feature (1)..(293): Xaa is any amino acid
MERAKAIYYHFQENMFWNNEYRILSDIRVKDAFESKTGNSSEINLGLINALEAAGLDTKIMLIASRNQPLPTKQYPVLTDFNYALVYLNINNTKYLLDATDKYTPFGVLPFRDLNMEGRVMDFKKGSYWMPIEPFEKNMHYVNMQLTADESGQFSGKVSEVSTGYISVEKRKEYNDYNKEEIIKKKQGKNESLNITNLEIQNQKDLEQPYKENYNISLHEQPVGDKLFIYPFLMPTYFSENPFKQEIRQYPVEFGFPITNNYLLSFDVSNQYDIVKTPSNPPLKFPNNDGEIX

SEQ ID NO: 20561 - DNA, 405 bp, Unknown
  Obtained from environmental sample
  misc_feature (1)..(405): n is a, c, g, or t
atgaaaacaaagaacaacttaggaaaaacagtactacttgcgttaacaattgtattactaatgggaaacaatatgcaagctcaagaaaaggaagtgtataacaaagatattaccaacaagaaagaaagaccatttatagtagataaggacgagtatccattcaagagtaattggtttgaaaaagacggaatatccatgcattatattgatgaaggcgaaggaattcctattgtattaacacacgggaatcctgattggtcttttttaaatagaaatataattaaacaactttctggagaagctaagagtaattgcgtacgatttacctggatttcggttttcaaacactccagaaaactttggctttacaccttcaggaacccgttgagtggattagggcctnnc

SEQ ID NO: 20562 - protein, 135 aa, Unknown
  Obtained from environmental sample
  misc_feature (1)..(135): Xaa is any amino acid
MKTKNNLGKTVLLALTIVLLMGNNMQAQEKEVYNKDITNKKERPFIVDKDEYPFKSNWFEKDGISMHYIDEGEGIPIVLTHGNPDWSFLNRNIIKQLSGEAKSNCVRFTWISVFKHSRKLWLYTFRNPLSGLGPX

SEQ ID NO: 20563 - DNA, 768 bp, Unknown
  Obtained from environmental sample
  misc_feature (1)..(768): n is a, c, g, or t
ttgattcggtcgagaaggcttacttgtacttatgtattccttaatgatgagtattatcaacatataacgacatccatttcagaaggcaaaaaactcttagccgttttaatcgatccagataaaatgaaactagaggctgtttcaaactttatctcaaaagtcaatcaatctatagcaacacatatttttgttggaggaagtgaagttaacgaaggagttactgagattttagttgaaagaattaaaaaatacaccgatttaccagtcgttttatttcctggtgatgtaattcaaattacagataaggctgatggtattttatttttgtccttaatttcaggaagaaatccagactatttaataggtaaacacgtagaagccgtttcaaaattaaaaagaacaaatttagaagtgatctccacaggatatcttctgattgaaaatggtaaacaaacttccgtagaacgcgtaagccaaacaaaaccattagaaagaaataatattcaacatattgtagatacggcaaaagccggagaatttctgggaaataaattaatttatctcgaagcaggcagtggagcaacacatgctatagaacctaaaattatttcagaagtaaaagaagaattaaatattccgcttattgttggtggaggtataagaactaaaaaagcaataaagttagcttataaagcaggtgcagatttagtagtgataggaacagcttttgaagagaatgaagaattttttgacgattttaaaaaatag

SEQ ID NO: 20564 - protein, 255 aa, Unknown
  Obtained from environmental sample
  DOMAIN (24)...(255): PcrB family
  misc_feature (1)..(255): Xaa is any amino acid
MIRSRRLTCTYVFLNDEYYQHITTSISEGKKLLAVLIDPDKMKLEAVSNFISKVNQSIATHIFVGGSEVNEGVTEILVERIKKYTDLPVVLFPGDVIQITDKADGILFLSLISGRNPDYLIGKHVEAVSKLKRTNLEVISTGYLLIENGKQTSVERVSQTKPLERNNIQHIVDTAKAGEFLGNKLIYLEAGSGATHAIEPKIISEVKEELNIPLIVGGGIRTKKAIKLAYKAGADLVVIGTAFEENEEFFDDFKK

SEQ ID NO: 20565 - DNA, 882 bp, Unknown
  Obtained from environmental sample
  misc_feature (1)..(882): n is a, c, g, or t
gtgatcagaatcggctcgagaccatataacaaaaacataaatttaaaaaacagagtcgttatggctccgatgacacgtagtcgcgcaaataacgatggtaatgtaccaatagaccaattacacggattatattatgagcaacgtgcttctgcaggcttaattattacagaaggatctcaagtatcaaaaaaagctgtcggttacatcaataccgcaggaatacatacagatgcgcaagtagaaggctggaaaaaagtaactaaacgtgtgcacgataaaggcggaaaaatctttattcaattatggcatgttggtcgtatgtcacatccagactttcataatggtgatttacctgtgtcatcttcagctttaaatccaaacgcaaaatcgtatacgcctgaggggtttaaagatactgtgacacctaaggcaatgactattcaagagattaaacaaacggttaaagattttcaagatgctgcagcaaatgcagtaaaagcaggttttgatggtgtagagattcattcatcaaatggttatttatttcaccagttttttaataattcatctaacaatagaacagatgaatatggtggaagcatagaaaataaaacacgttttttctttgaagttttagatgctataaaacaagtaattccgcaagaaaaaattggagcacgttttaacccttctttaaatggtctttttggaatgaccatggatgaggagactatacctacttttgaatatattatcaaaaaattaaatgattataatctagcatacgtacatttatcagaaccttttactgatgtttcagagattccgtatgcagtcaaagagattgctaagcattttagaccatatacaatggtacattaa

SEQ ID NO: 20566 - protein, 293 aa, Unknown
  Obtained from environmental sample
  DOMAIN (11)...(290): NADH:flavin oxidoreductase / NADH oxidase family
  misc_feature (1)..(293): Xaa is any amino acid
MIRIGSRPYNKNINLKNRVVMAPMTRSRANNDGNVPIDQLHGLYYEQRASAGLIITEGSQVSKKAVGYINTAGIHTDAQVEGWKKVTKRVHDKGGKIFIQLWHVGRMSHPDFHNGDLPVSSSALNPNAKSYTPEGFKDTVTPKAMTIQEIKQTVKDFQDAAANAVKAGFDGVEIHSSNGYLFHQFFNNSSNNRTDEYGGSIENKTRFFFEVLDAIKQVIPQEKIGARFNPSLNGLFGMTMDEETIPTFEYIIKKLNDYNLAYVHLSEPFTDVSEIPYAVKEIAKHFRPYTMVH

SEQ ID NO: 20567 - DNA, 465 bp, Unknown
  Obtained from environmental sample
  misc_feature (1)..(465): n is a, c, g, or t
ttggttaatacgtgtgtaaatgatatactagacggtttacagaaatttgatatagaaatctatcaatttgtaggtgatgaaattgtttttacctggaaatctaaaacggatttaaacaacaaagcttttagaattttcaataaaattgaaaaaaatctccagagaaaacagaaagactatctggcaaaatttaaagtattacctaagtttaaatctgcagtacatttgggagccgtttcggcaacaattattggagggcaaaattacaaagaaatggcctaccatggagatgttcttaatactacatcacgtttgttagaacaatgtcacttatataaaaagaaaattgttttttctgaaaactatttaaaaaatcagactaacctaatagatgaagctcttcaatatttagggagtgtacagttaagagggaagcaaaattacttaaatatttacggggtataa

SEQ ID NO: 20568 - protein, 154 aa, Unknown
  Obtained from environmental sample
  misc_feature (1)..(154): Xaa is any amino acid
MVNTCVNDILDGLQKFDIEIYQFVGDEIVFTWKSKTDLNNKAFRIFNKIEKNLQRKQKDYLAKFKVLPKFKSAVHLGAVSATIIGGQNYKEMAYHGDVLNTTSRLLEQCHLYKKKIVFSENYLKNQTNLIDEALQYLGSVQLRGKQNYLNIYGV

SEQ ID NO: 20569 - DNA, 438 bp, Unknown
  Obtained from environmental sample
  misc_feature (1)..(438): n is a, c, g, or t
atgaaaatattacttcgcataagtttattactaatcactactatttcttgcacaagccaaaataataacactaaaaaattagatcttgtttttcttgacgaatgtaacggtcaaataattgaacctgaatataaaattgaagatttcccagaattcaattataaattaattactgtatttgtaaaacgtggtaatttaattggtcactttataacaacacttgaaaatcatagtgataccctaagagttcctaaaattttatttgcatttgatagtaaaaatcaatcaaaatctaaacgtcaacttagcatgaattgcgatcaagtttgtaacggcattgaaagtcagtattaccaaaatgggaatataacaatgacaggcaattttaaaaacggtaatcctgttgaaataaaagttaccgagaaaacggtcttttag

SEQ ID NO: 20570 - protein, 145 aa, Unknown
  Obtained from environmental sample
  SIGNAL (1)...(19)
  misc_feature (1)..(145): Xaa is any amino acid
MKILLRISLLLITTISCTSQNNNTKKLDLVFLDECNGQIIEPEYKIEDFPEFNYKLITVFVKRGNLIGHFITTLENHSDTLRVPKILFAFDSKNQSKSKRQLSMNCDQVCNGIESQYYQNGNITMTGNFKNGNPVEIKVTEKTVF

SEQ ID NO: 20571 - DNA, 438 bp, Unknown
  Obtained from environmental sample
  misc_feature (1)..(438): n is a, c, g, or t
atgaaaatattacttcgcataagtttattactaatcactactatttcttgcacaagccaaaataataacactaaaaaattagatcttgtttttcttgacgaatgtaacggtcaaataattgaacctgaatataaaattgaagatttcccagaattcaattataaattaattactgtatttgtaaaacgtggtaatttaattggtcactttataacaacacttgaaaatcatagtgataccctaagagttcctaaaattttatttgcatttgatagtaaaaatcaatcaaaatctaaacgtcaacttagcatgaattgcgatcaagtntgtaacggcattgaaagtcagtattaccaaaatgggaatataaaaatgaaaggcaattttaaaaacggtaatcctgttgaaattaaaagttacgagaaaacggtcttttag

SEQ ID NO: 20572 - protein, 145 aa, Unknown
  Obtained from environmental sample
  SIGNAL (1)...(19)
  misc_feature (1)..(145): Xaa is any amino acid
MKILLRISLLLITTISCTSQNNNTKKLDLVFLDECNGQIIEPEYKIEDFPEFNYKLITVFVKRGNLIGHFITTLENHSDTLRVPKILFAFDSKNQSKSKRQLSMNCDQVCNGIESQYYQNGNIKMKGNFKNGNPVEIKSYEKTVF

SEQ ID NO: 20573 - DNA, 414 bp, Unknown
  Obtained from environmental sample
  misc_feature (1)..(414): n is a, c, g, or t
atgaaacaacgcgaggaaacctctattgagttagaacctggtaaaaccattatagtacgcttgctttcggttggtattcctaatgaagacggtgttagaagtgtattttttagcgtgaatggtgaaaacaggtttgttgaagttttagaccgttctttaaacattaaaaaagaagaacacataaaaattgatcctgaaaattctaatcatattggtgcacctttacaaggatcgctttctaaagtaatagtgaaaaaaggtcaagacattaaagaaaatgatccgttgtttattattgaagctatgaaaatggaaacaaccgttacggcttttaaagctggaaaagttaaatcggttacacttaaagaaggtacaatggtaatgcaaaatgatttaattttaacggtagattaa

SEQ ID NO: 20574 - protein, 137 aa, Unknown
  Obtained from environmental sample
  DOMAIN (69)...(136): Biotin-requiring enzyme
  misc_feature (1)..(137): Xaa is any amino acid
MKQREETSIELEPGKTIIVRLLSVGIPNEDGVRSVFFSVNGENRFVEVLDRSLNIKKEEHIKIDPENSNHIGAPLQGSLSKVIVKKGQDIKENDPLFIIEAMKMETTVTAFKAGKVKSVTLKEGTMVMQNDLILTVD

SEQ ID NO: 20575 - DNA, 600 bp, Unknown
  Obtained from environmental sample
  misc_feature (1)..(600): n is a, c, g, or t
ttggagcctatagattttgatgctgaatacgaagtgtttaaaaagaagtttcaaaaagggtttactagagctcttgaaatagaagatttcttatcgtatactttatacccaaaagtgtttgaacaagcgcacgaaaactacaaattatatggtaatctcgcattagtacctaccaagaatttcttttatgggatgaaacaacgcgaggaaacctctattgagttagaacctggtaaaaccattatagtacgcttgctttcggttggtattcctaatgaagacggtgttagaattgtattttttagcgtgaatggtgaaaacaggtttgttgaagttttagaccgttctttaaacattaaaaaagaagaacacataaaaattgatcctgaaaattctaatcatattggtgcacctttacaaggatcgctttctaaagtaatagtgaaaaaaggtcaagacattaaagaaaatgatccgttgtttattattgaagctatgaaaatggaaacaaccgttacggcttttaaagctggaaaagttaaatcggttacacttaaagaaggtacaatggtaatgcaaaatgatttaattttaacgtag

SEQ ID NO: 20576 - protein, 199 aa, Unknown
  Obtained from environmental sample
  DOMAIN (133)...(199): Biotin-requiring enzyme
  misc_feature (1)..(199): Xaa is any amino acid
MEPIDFDAEYEVFKKKFQKGFTRALEIEDFLSYTLYPKVFEQAHENYKLYGNLALVPTKNFFYGMKQREETSIELEPGKTIIVRLLSVGIPNEDGVRIVFFSVNGENRFVEVLDRSLNIKKEEHIKIDPENSNHIGAPLQGSLSKVIVKKGQDIKENDPLFIIEAMKMETTVTAFKAGKVKSVTLKEGTMVMQNDLILT

SEQ ID NO: 20577 - DNA, 732 bp, Unknown
  Obtained from environmental sample
  misc_feature (1)..(732): n is a, c, g, or t
ttgttggaacagtttattaatagaaaaagctggcagacacatcctattgtcatgtctggaaatacggattgttaccaaccggctgaacaggaatttaaattgacccgccagtgtttggaagtttttttgaaatacaaacatcccgtagggattattacaaaaaacgcaatgattcttagagatctcgatttgctaaaggcattggccagagacaatttaattacggttaacctgtccattacgtcactgtcagaagaaacaaggcgtgtgttggaaccgcgaacggcaaccatcaaaaaacgattggaaactgtgaaaatcctctcggataacggtattcctgttaatgtgatgatggcacccattatcccttctatcaatagccatgaagtattgccattggccaaaagagtgtcagaaatgggtgcgttaagtatgggacataccattgtgcgactcaacggtgctattggagaaatttttacagattggattaataaaaccatgccggatcgtgccgacaaagtcttgcatcaaattgcaagttgccatggtggcaatttgaacgattcacgatatggtacgcggatgcgcggcgaaggtgaaattgccaatcaaattaacgccatggtaaaattggcaaagcttaaatattttaaaggaaaatcgatgcctgagctaaataccacgcttcacgaacagtttaaggatggtcaattgaaattgttttga

SEQ ID NO: 20578 - protein, 243 aa, Unknown
  Obtained from environmental sample
  misc_feature (1)..(243): Xaa is any amino acid
MLEQFINRKSWQTHPIVMSGNTDCYQPAEQEFKLTRQCLEVFLKYKHPVGIITKNAMILRDLDLLKALARDNLITVNLSITSLSEETRRVLEPRTATIKKRLETVKILSDNGIPVNVMMAPIIPSINSHEVLPLAKRVSEMGALSMGHTIVRLNGAIGEIFTDWINKTMPDRADKVLHQIASCHGGNLNDSRYGTRMRGEGEIANQINAMVKLAKLKYFKGKSMPELNTTLHEQFKDGQLKLF

SEQ ID NO: 20579 - DNA, 681 bp, Unknown
  Obtained from environmental sample
  misc_feature (1)..(681): n is a, c, g, or t
atgtctggaaatacggattgttaccaaccggctgaacaggaatttaaattgacccgccagtgtttggaagtttttttgaaatacaaacatcccgtagggattattacaaaaaacgcaatgattcttagagatctcgatttgctaaaggcattggccagagacaatttaattacggttaacctgtccattacgtcactgtcagaagaaacaaggcgtgtgttggaaccgcgaacggcaaccatcaaaaaacgattggaaactgtgaaaatcctctcggataacggtattcctgttaatgtgatgatggcacccattatcccttctatcaatagccatgaagtattgccattggccaaaagagtgtcagaaatgggtgcgttaagtatgggacataccattgtgcgactcaacggtgctattggagaaatttttacagattggattaataaaaccatgccggatcgtgccgacaaagtcttgcatcaaattgcaagttgccatggtggcaatttgaacgattcacgatatggtacgcggatgcgcggcgaaggtgaaattgccaatcaaattaacgccatggtaaaattggcaaagcttaaatattttaaaggaaaatcgatgcctgagctaaataccacgcttcacgaacagtttaaggatggtcaattgaaattgttttga

SEQ ID NO: 20580 - protein, 226 aa, Unknown
  Obtained from environmental sample
  misc_feature (1)..(226): Xaa is any amino acid
MSGNTDCYQPAEQEFKLTRQCLEVFLKYKHPVGIITKNAMILRDLDLLKALARDNLITVNLSITSLSEETRRVLEPRTATIKKRLETVKILSDNGIPVNVMMAPIIPSINSHEVLPLAKRVSEMGALSMGHTIVRLNGAIGEIFTDWINKTMPDRADKVLHQIASCHGGNLNDSRYGTRMRGEGEIANQINAMVKLAKLKYFKGKSMPELNTTLHEQFKDGQLKLF

SEQ ID NO: 20581 - DNA, 510 bp, Unknown
  Obtained from environmental sample
  misc_feature (1)..(510): n is a, c, g, or t
atgaactcaagaacaatcgaaaaaaatattggagaatctacaaaaatcgattggaaaaaccccaaagcaattggaagttcttcattttatctaaagtcatttaaagcaaaaaataattcaacggaatttataaaagaaaactctaaatgtagttttgaaaaatattcaaatggaattctattaaggtcaaacttgtcaaatgaaataagtgctttaacaattaaagagtcggaaatcgaatacataaaattaatacgtggaaaagaaagcgttgaacctctgactttatcaccaatgtggattatgttgaaattaggagcttctaaattagttgcgagatatttcagaattgcgctcggagaatattcaataggtgaaatgaaattaaaaattgagacagaaaatcaaattatggaattcacgcaaaatggatatatatttgagagacaattgagtttctttaaaaacctgaattacggagaaaaattaataattgaaatgaacgaataa

SEQ ID NO: 20582 - protein, 169 aa, Unknown
  Obtained from environmental sample
  misc_feature (1)..(169): Xaa is any amino acid
MNSRTIEKNIGESTKIDWKNPKAIGSSSFYLKSFKAKNNSTEFIKENSKCSFEKYSNGILLRSNLSNEISALTIKESEIEYIKLIRGKESVEPLTLSPMWIMLKLGASKLVARYFRIALGEYSIGEMKLKIETENQIMEFTQNGYIFERQLSFFKNLNYGEKLIIEMNE

SEQ ID NO: 20583 - DNA, 510 bp, Unknown; identical to SEQ ID NO: 20581
  Obtained from environmental sample
  misc_feature (1)..(510): n is a, c, g, or t

SEQ ID NO: 20584 - protein, 169 aa, Unknown; identical to SEQ ID NO: 20582
  Obtained from environmental sample
  misc_feature (1)..(169): Xaa is any amino acid

SEQ ID NO: 20585 - DNA, 648 bp, Unknown
  Obtained from environmental sample
  misc_feature (1)..(648): n is a, c, g, or t
gtggtcaagaatcggctgacattagattatattgccctactcgaatcacatggtattgtagtattccgtttgccaatggaagtaaaagaagttgatgcattctctttttatcatgatgggcgacctatagtatttttgaatacagcgaagtcagcagaaagaatgcgcttcgatgctgctcatgaacttggtcacttagttctgcacagtgatgataaaaatgtacttgaaaatatgaaggacaaagagcacgaagctgataggtttgcttccagttttttaatgccgaaagaagcatttgtagttatggctccaaacaatctaaatctgccgaatctaatcagctataaaaaatactggaaagtgtctcttgcagctatgaactataacttacacactaatggattattaactgattggctttatcgttctaattgtatcgagtttagtaaacaaggatataataagttagaacctgaacctattgaacgtgaacgaccgattctacttaataagattattaaggttctcttagaaaaagaaggtaggaatttttatgagaatattgattttggctatcaaattttagatgatataacgttcaagttaattagtgaaaatactaagcctagactgaagttactctaa

SEQ ID NO: 20586 - protein, 215 aa, Unknown
  Obtained from environmental sample
  DOMAIN (14)...(132): Domain of unknown function (DUF955)
  misc_feature (1)..(215): Xaa is any amino acid
MVKNRLTLDYIALLESHGIVVFRLPMEVKEVDAFSFYHDGRPIVFLNTAKSAERMRFDAAHELGHLVLHSDDKNVLENMKDKEHEADRFASSFLMPKEAFVVMAPNNLNLPNLISYKKYWKVSLAAMNYNLHTNGLLTDWLYRSNCIEFSKQGYNKLEPEPIERERPILLNKIIKVLLEKEGRNFYENIDFGYQILDDITFKLISENTKPRLKLL

SEQ ID NO: 20587 - DNA, 423 bp, Unknown
  Obtained from environmental sample
  misc_feature (1)..(423): n is a, c, g, or t
atgttagatatctctcctaaaatgattgatatttctcaaaccgaactagatgacgcgcaacgagaagtttataattcatttaaaaaggttaatattttaggctataaagccgataaaattgataaaacaatctataactcagaattagaaaaagcgaaaatcgtttttaagaataaaaactatagtgagttaatggagtttagcgataatggaatgaagtttagaataaacactattggaaaaggcgaggagatcgatgagtttattcttttagcaagctcagaagaggttggtttcgccgttgttcgtgttattggagataatatgcaaaccgagaaattagtagggcttatggaaaaaatgaaagatattgatgtcgataaaaaccaattaggaaaagtaatggcctattttaataattaa

SEQ ID NO: 20588 - protein, 140 aa, Unknown
  Obtained from environmental sample
  misc_feature (1)..(140): Xaa is any amino acid
MLDISPKMIDISQTELDDAQREVYNSFKKVNILGYKADKIDKTIYNSELEKAKIVFKNKNYSELMEFSDNGMKFRINTIGKGEEIDEFILLASSEEVGFAVVRVIGDNMQTEKLVGLMEKMKDIDVDKNQLGKVMAYFNN

SEQ ID NO: 20589 - DNA, 408 bp, Unknown
  Obtained from environmental sample
  misc_feature (1)..(408): n is a, c, g, or t
atgaaggtaattaattcaatattcataatagacgacgatcctattacagtttttggaattcgaaaaatgctgagtaccacggttgaattcaaaaccattagcacgtatggcaatggtaaattagctattgatggcattaaaaaagttataaacgaaaataagccagtacccgaagtgatttttttggatattaacatgcccattatggatggatggcagtttttggaagaatttatagtattgccaattgaaaaaaaggtccgtgttaatatcgtgacttcttcaattgatccagctgattataaaaattatgagtattataatgataaatcgcatcactttataacttttaacacaaaaccaattaagagttctgaaatagctgctatcacaataccagctgaataa

SEQ ID NO: 20590 - protein, 135 aa, Unknown
  Obtained from environmental sample
  DOMAIN (5)...(135): Response regulator receiver domain
  misc_feature (1)..(135): Xaa is any amino acid
MKVINSIFIIDDDPITVFGIRKMLSTTVEFKTISTYGNGKLAIDGIKKVINENKPVPEVIFLDINMPIMDGWQFLEEFIVLPIEKKVRVNIVTSSIDPADYKNYEYYNDKSHHFITFNTKPIKSSEIAAITIPAE

SEQ ID NO: 20591 - DNA, 420 bp, Unknown
  Obtained from environmental sample
  misc_feature (1)..(420): n is a, c, g, or t
atgtacattttaatgaaggtaattaattcaatagtcataatagacgacgatcctattacagtttttggaattcgaaaaatgctgagtaccacggttgaattcaaaaccattagcacgtatggcaatggtaaattagctattgatggcattaaaaaagttataaacgaaaataagccagtacccgaagtgatttttttggatattaacatgcccattatggatggatggcagtttttggaagaatttatagtattgccaattgaaaaaaaggtccgtgttaatatcgtgacttcttcaattgatccagctgattataaaaattatgagtattataatgataaatcgcatcactttataacttttaacacaaaaccaattaagagttctgaaatagctgctatcacaataccagctgaataa

SEQ ID NO: 20592 - protein, 139 aa, Unknown
  Obtained from environmental sample
  DOMAIN (9)...(139): Response regulator receiver domain
  misc_feature (1)..(139): Xaa is any amino acid
MYILMKVINSIVIIDDDPITVFGIRKMLSTTVEFKTISTYGNGKLAIDGIKKVINENKPVPEVIFLDINMPIMDGWQFLEEFIVLPIEKKVRVNIVTSSIDPADYKNYEYYNDKSHHFITFNTKPIKSSEIAAITIPAE

SEQ ID NO: 20593 - DNA, 516 bp, Unknown
  Obtained from environmental sample
  misc_feature (1)..(516): n is a, c, g, or t
ttgtcaacagaagtagatgcacttagagataatatcttttattttattaaaaatttagatgaatctagcttaaacgcaagtaacttttacatcaatattttaggttatttacaagacatgacgcagtcgttagattacattactaaaatgagtcataaacacgtaaacaacaatcataaaaaattaaagtttagtcaaataaaagagcttaaagaaattgatgcacgttttgatttgtttttcaataatacaccaaacgcctttaattcacgctcatttgaacaaataggagatattttaggaagaaagaatgaaataatggaacttgtttcctctaaaatcattaaacaagtagagcgtacaagaactgaagagtctagtccaaaaaatacaaccttatattttaatttattatcagaaactaaagatttacttagtgctactatgaatcttttagaagagtaccataatgctcatgatgcatctgtaactcctgcaactttagaagaggaataa

SEQ ID NO: 20594 - protein, 171 aa, Unknown
  Obtained from environmental sample
  misc_feature (1)..(171): Xaa is any amino acid
MSTEVDALRDNIFYFIKNLDESSLNASNFYINILGYLQDMTQSLDYITKMSHKHVNNNHKKLKFSQIKELKEIDARFDLFFNNTPNAFNSRSFEQIGDILGRKNEIMELVSSKIIKQVERTRTEESSPKNTTLYFNLLSETKDLLSATMNLLEEYHNAHDASVTPATLEEE

SEQ ID NO: 20595 - DNA, 936 bp, Unknown
  Obtained from environmental sample
  misc_feature (1)..(936): n is a, c, g, or t
ttggaagttttgactcggctgaggggatctgtgtatacctatancctaaaagagggtatcgaagatgggtttttagcgccctataaagtggttcgaattgatatcgatgtcgacctacaagggtggcgtccaaccaaaggacagacagataggcatggtgagttgattgaagatcgtatctataaccaaaaagactttgatcgtagtctggtgattgatgagcgtactgaattggtggctcagaccatcacaagctaccttgagcgtactgacccaatggccaaaaccattgtgttctgtaatgatattgatcatgcagagcgtatgcgccgtgctctgattaactgcaatcccgagcaggtcaaaaagaacgaaaagtatgtcatgaaaatcacgggcgatgatgagttgggcaaagcacagcttgataacttcatcaatccaaagaaaccttatccagtaatagcgacgacgtcagagctaatgacaacaggcgttgatgcacaaacttgtaagcttatcgtgttagatcaaaacatcaaatcgatgactaagtttaagcaaattattggccgtggcactcgtatcaatgataaatacggcaagctatggtttacgattcttgacttcaaaaaagcgactgagctatttgcagatgagcgcttcgatggtattcctgaacgtatcatgaccgtgacgccagcacaaattaatgaaggaagtgctgagctagacgaagtggtcgatggagaatcagacgcagagttagatattgctaatggtactgatctggnctacaaaanccaagatgataagagtggctttgatttaggggctggtatgggtgatgacataggtgtcagtgaaaccgngaaaaaaataccatgtgaaaggtgtagctgtaaaagtaacggcacagtgtatccagtattatga

SEQ ID NO: 20596 - protein, 311 aa, Unknown
  Obtained from environmental sample
  misc_feature (1)..(311): Xaa is any amino acid
MEVLTRLRGSVYTYXLKEGIEDGFLAPYKVVRIDIDVDLQGWRPTKGQTDRHGELIEDRIYNQKDFDRSLVIDERTELVAQTITSYLERTDPMAKTIVFCNDIDHAERMRRALINCNPEQVKKNEKYVMKITGDDELGKAQLDNFINPKKPYPVIATTSELMTTGVDAQTCKLIVLDQNIKSMTKFKQIIGRGTRINDKYGKLWFTILDFKKATELFADERFDGIPERIMTVTPAQINEGSAELDEVVDGESDAELDIANGTDLXYKXQDDKSGFDLGAGMGDDIGVSETXKKIPCERCSCKSNGTVYPVL

SEQ ID NO: 20597 - DNA, 663 bp, Unknown
  Obtained from environmental sample
  misc_feature (1)..(663): n is a, c, g, or t
ttgtatccaaaagagaacaacgacatatttgaatttagattattagaaaaagacatagcctatattgctttaaattcattttcaagttgggacataatggatttattttcagctaaacttcctgaaatacgaaaagcaaaaaaattgataatcgatttaagaaaaaatggtggtggcgatggaaatatagcgcgagaaattattaaatatcttacgaacgacaccattatttacgggtcaaaatcaaaaagcagagaaaatatttcttattataaagctattggtaaatacacaaaggcaagtgatacattaaataacaattggtcaaaacaagcctacctaacttatcacgataattattattttgattttccatacaattcctataacaccgcaaatatggacattgaaagaattgaaatgccaactgcgatattgattggacataatactgcatcggcttccgaagattttttaatttatgcagataatcaagaaaatatgacaaaaatcggagagccaacttttggaagtacaggacaacctatgatatttgacttaccaaatggtggaataggacgagtttgcacgaaaaaagatacttatccagatggtcgcgaatttgtcggttatggaataaaccagatatcgaaattaaactaa

SEQ ID NO: 20598 - protein, 220 aa, Unknown
  Obtained from environmental sample
  DOMAIN (18)...(219): Peptidase family S41
  misc_feature (1)..(220): Xaa is any amino acid
MYPKENNDIFEFRLLEKDIAYIALNSFSSWDIMDLFSAKLPEIRKAKKLIIDLRKNGGGDGNIAREIIKYLTNDTIIYGSKSKSRENISYYKAIGKYTKASDTLNNNWSKQAYLTYHDNYYFDFPYNSYNTANMDIERIEMPTAILIGHNTASASEDFLIYADNQENMTKIGEPTFGSTGQPMIFDLPNGGIGRVCTKKDTYPDGREFVGYGINQISKLN

SEQ ID NO: 20599 - DNA, 387 bp, Unknown
  Obtained from environmental sample
  misc_feature (1)..(387): n is a, c, g, or t
atgaaaattaaacttaagggtaaatcggacaagcttaaatattttgagacttataaagaggctgctgttttcgcaaaagaattgtcaagtagtttaaccacgacaatcaagcttggggtaaatggtaatacattttttgtttatttaccgatggggtatgacgctccgccgataccgattgaaaacgaattaacttcaccttcttatgacgaatatgacgaatatgacgaatatgctgatatcgaacaattaaataatcagaatgaaatcattgatgaactatgggactctgttgcatctttagcccgtagtgatgaagatggatggtattacgaggacatcgatccaggaatggaaaacaatgttatcgataagtcatatgaataa

SEQ ID NO: 20600 - protein, 128 aa, Unknown
  Obtained from environmental sample
  misc_feature (1)..(128): Xaa is any amino acid
MKIKLKGKSDKLKYFETYKEAAVFAKELSSSLTTTIKLGVNGNTFFVYLPMGYDAPPIPIENELTSPSYDEYDEYDEYADIEQLNNQNEIIDELWDSVASLARSDEDGWYYEDIDPGMENNVIDKSYE

SEQ ID NO: 20601 - DNA, 693 bp, Unknown
  Obtained from environmental sample
  misc_feature (1)..(693): n is a, c, g, or t
atgttggccagttcaggagtctttagaaaaacacttgaaacaaccatgattgccatgatggatttaattggcgaccgctatatttatccattaatttcaacagcaagtaaagctattaataccatagccaatgcaaactttagaatgcaatcgccgccttgcccatttacggtttattacgatggcgtagactctgtgatgtttgaagaatttcctagtggtgaagccatgaggcacctagccaaaaatttagacgaaagaaacgacttgattagagatcctgaatttagagaggcctttaaaaaggaaataaagaaaaaatttgcgcccaaagtttggcataaagatttaagcaaaaccttgattattgattgtccagattcgagcatgattggtaaaaacttttatgatcttgctgaagaacaccagcagcatcccgtagatttctttttggacactataattcaatatgataaaaagattagatggacaaccaccattgccaatgatcgcgttgaaaaatatcatggcttgtataatcataaacataatttaattagcttctcggatgctggagcccacttaaacaatatggccttctataattttccgttgaaaatgataaaagtcgtccaagaatctatagatgctggcaagccaattatgtccatggaaaaatgtatctggcgataa

SEQ ID NO: 20602 - protein, 230 aa, Unknown
  Obtained from environmental sample
  misc_feature (1)..(230): Xaa is any amino acid
MLASSGVFRKTLETTMIAMMDLIGDRYIYPLISTASKAINTIANANFRMQSPPCPFTVYYDGVDSVMFEEFPSGEAMRHLAKNLDERNDLIRDPEFREAFKKEIKKKFAPKVWHKDLSKTLIIDCPDSSMIGKNFYDLAEEHQQHPVDFFLDTIIQYDKKIRWTTTIANDRVEKYHGLYNHKHNLISFSDAGAHLNNMAFYNFPLKMIKVVQESIDAGKPIMSMEKCIWR

SEQ ID NO: 20603 - DNA, 693 bp, Unknown
  Obtained from environmental sample
  misc_feature (1)..(693): n is a, c, g, or t
atgttggccagttcaggagtctttagaaaaacacttaaaacaaccatgattgccatgatggatttaattggcgaccgctatatttatccattaatttcaacagcaagtaaagctattaataccatagccaatgcaaactttagaatgcaatcgccgccttgcccatttacggtttattacgatggcgtagactctgtgatgtttgaagaatttcctagtggtgaagccatgaggcacctagccaaaaatttagacgaaagaaacgacttgattagagatcctgaatttagagaggcctttaaaaaggaaataaagaaaaaatttgcgcccaaagtttggcataaagatttaagcaaaaccttgattattgattgtccagattcgagcatgattggtaaaaacttttatgatcttgctgaagaacaccagcagcatcccgtagatttctttttggacactataattcaatatgataaaaagattagatggacaaccaccattgccaatgatcgcgttgaaaaatatcatggcttgtataatcataaacataatttaattagcttctcggatgctggagcccacttaaacaatatggccttctataattttccgttgaaaatgataaaagtcgtccaagaatctatagatgctggcaagccaattatgtccatggaaaaatgtatctggcgataa

SEQ ID NO: 20604 - protein, 230 aa, Unknown
  Obtained from environmental sample
  misc_feature (1)..(230): Xaa is any amino acid
MLASSGVFRKTLKTTMIAMMDLIGDRYIYPLISTASKAINTIANANFRMQSPPCPFTVYYDGVDSVMFEEFPSGEAMRHLAKNLDERNDLIRDPEFREAFKKEIKKKFAPKVWHKDLSKTLIIDCPDSSMIGKNFYDLAEEHQQHPVDFFLDTIIQYDKKIRWTTTIANDRVEKYHGLYNHKHNLISFSDAGAHLNNMAFYNFPLKMIKVVQESIDAGKPIMSMEKCIWR

SEQ ID NO: 20605 - DNA, 489 bp, Unknown
  Obtained from environmental sample
  misc_feature (1)..(489): n is a, c, g, or t
atgatagatgaagaattcaaagagttgatgaatgacaaaataacggtgcatattgctgatgatcatcaaattttaattgatggtgttattgcggtactcggtttagagaaagatattgaagtggttggttattctttgaacggtgagcaggtactcgattggtttcatgagcattctgccgatgtgctggtattagatatcaatatgccaaaagtagatggtatcgaagtattgcgtcaatttcaaaattatgatgatgttccacaggtgatcatattatccagctatgatgatataaaattaattaaggaagtacttagtatgggcgcaaaagggttcgtgccaaaaaaatctgccggtgaacatattgtcaatgccatccgcaatgtatctaagggtcaccaataccttagtgaagaggttaaggaaccaatgattaagaccttaatgggtaaaccaatgcatgataacgattcccaggcaagtann

SEQ ID NO: 20606 - protein, 163 aa, Unknown
  Obtained from environmental sample
  DOMAIN (14)...(135): Response regulator receiver domain
  misc_feature (1)..(163): Xaa is any amino acid
MIDEEFKELMNDKITVHIADDHQILIDGVIAVLGLEKDIEVVGYSLNGEQVLDWFHEHSADVLVLDINMPKVDGIEVLRQFQNYDDVPQVIILSSYDDIKLIKEVLSMGAKGFVPKKSAGEHIVNAIRNVSKGHQYLSEEVKEPMIKTLMGKPMHDNDSQASX

SEQ ID NO: 20607 - DNA, 468 bp, Unknown
  Obtained from environmental sample
  misc_feature (1)..(468): n is a, c, g, or t
atgatagatgaagaattcaaagagttgatgaatgacaaaataacggtgcatattgctgatgatcatcaaattttaattgatggtgttattgcggtactcggtttagagaaagatattgaagtggttggttattctttgaacggtgagcaggtactcgattggtttcatgagcattctgccgatgtgctggtattagatatcaatatgccaaaagtagatggtatcgaagtattgcgtcaatttcaaaattatgatgatgttccacaggtgatcatattatccagctatgatgatataaaattaattaaggaagtacttagtatgggcgcaaaagggttcgtgccaaaaaaatctgccggtgaacatattgtcaatgccatccgcaatgtatctaagggtcaacaatactttagtgaagaggttaacgaaaaaatgatgaagaccttaatgggtaaaaccagtgcatga

SEQ ID NO: 20608 - protein, 155 aa, Unknown
  Obtained from environmental sample
  DOMAIN (14)...(135): Response regulator receiver domain
  misc_feature (1)..(155): Xaa is any amino acid
MIDEEFKELMNDKITVHIADDHQILIDGVIAVLGLEKDIEVVGYSLNGEQVLDWFHEHSADVLVLDINMPKVDGIEVLRQFQNYDDVPQVIILSSYDDIKLIKEVLSMGAKGFVPKKSAGEHIVNAIRNVSKGQQYFSEEVNEKMMKTLMGKTSA

SEQ ID NO: 20609 - DNA, 309 bp, Unknown
  Obtained from environmental sample
  misc_feature (1)..(309): n is a, c, g, or t
ttggttattgtagttgttacagttgtaagtgcccaccaaataaaaatccaacaggtaaatgcaaacataaaaggcaaaccaacaaagttgaaatacactaaaaacacttgccaccattttaacggttttcttcttttaccaacaatatgttctttttcaatttgggtattcgaaatatcttcaaaatctaagtttccaccttcaatactggtatcaaaatcggtatcaatatccacatcaaaatcaacgtcgaaatctgctccagaaatcatagtaacaaatccaatacaaaataagtatcaacattaa

SEQ ID NO: 20610 - protein, 102 aa, Unknown
  Obtained from environmental sample
  misc_feature (1)..(102): Xaa is any amino acid
MVIVVVTVVSAHQIKIQQVNANIKGKPTKLKYTKNTCHHFNGFLLLPTICSFSIWVFEISSKSKFPPSILVSKSVSISTSKSTSKSAPEIIVTNPIQNKYQH

SEQ ID NO: 20611 - DNA, 354 bp, Unknown
  Obtained from environmental sample
  misc_feature (1)..(354): n is a, c, g, or t
ttgacatcatggagaactgcaggaaaaaccttgaaccttgaaacttccaatatggnttcagtaaatatgaatgaaaggggaaaaaaggttaaaattcaaacgccttatcaatctgaacctatctatggcgtgttagaactggcagaaatatttacaccatacaaaggaaaaacaccagctacacgatcttattacattcaaatacctcaatcttatgtacaaagtataaaaggaggtaacgtatctgttatgtttgagtcgtatgtatgcaagccaggtttttattcacaaaccgctacaaaagaatatacctattcaagttgggtactttggatctctgatgttccattgtaa

SEQ ID NO: 20612 - protein, 117 aa, Unknown
  Obtained from environmental sample
  misc_feature (1)..(117): Xaa is any amino acid
MTSWRTAGKTLNLETSNMXSVNMNERGKKVKIQTPYQSEPIYGVLELAEIFTPYKGKTPATRSYYIQIPQSYVQSIKGGNVSVMFESYVCKPGFYSQTATKEYTYSSWVLWISDVPL

SEQ ID NO: 20613 - DNA, 351 bp, Unknown
  Obtained from environmental sample
  misc_feature (1)..(351): n is a, c, g, or t
atggaatttgtacaacagtatttgcaaagtgagcgtttacttggcttaagcgcaggaattataggcttattatctattactactggtataattttttacgttaacaaaccacaatttaaagtctttgcgattaccatgttaatcattggattaatagaagctggattatttataactggttactttttagtaaacaatcaaaataacgtaaataaaaaaatagaacaatttgaaagtaataaagacaactatttaaagactgacaaaatagttgtggataaaaacctgaaagccttttttatccttaaattaatttatgccataacgtttataaccttagctattgtgtga

SEQ ID NO: 20614 - protein, 116 aa, Unknown
  Obtained from environmental sample
  misc_feature (1)..(116): Xaa is any amino acid
MEFVQQYLQSERLLGLSAGIIGLLSITTGIIFYVNKPQFKVFAITMLIIGLIEAGLFITGYFLVNNQNNVNKKIEQFESNKDNYLKTDKIVVDKNLKAFFILKLIYAITFITLAIV

SEQ ID NO: 20615 - DNA, 807 bp, Unknown
  Obtained from environmental sample
  misc_feature (1)..(807): n is a, c, g, or t
atggagtatgaaaactgccaagaatgtttttattctaaagagcaaacggaacgagcttataaaaaaatagaagaaaaatacagtaaagagaaacaattagaacttggatatttaaagaaaacgaaattcttttttgaagaagaatatgaagatccagaagaaccgatatatattgataaagaaaaacttctgtttcctaatgaatttacgtctatcaaagaattaattacaataattgataaagaattaaataagttagaatcgataagtgttgaaaataaaactaacaacgttaaaccagatatgtatagtcaatacaataatgatataaacgaagaagttttattagtagaggagttagaaaagcgtttagcgattgaagcagttgagtacaagaagaattgcgacgatctttgggaaacctatactttcgaccccaagtattttgatacatacatttctggtgatttatacaatgtttgttttaagtctatttatgaaaaaataaagcctttaaacgactttgaaattaataaatacctaacactatcagtaaatcaatttaagacgcatacaccaaccaaaagagcagaagcatttaaaagaatttaccacgatacatattggtatccaaactatatggagtacaatccaaatcaatacgagaataaatatcctgttcacgtttggaagcattatacaaatcatttccacttatttaaagaagcatcagagaatatgttaaaggactttaaaaaaggcttaattggtcatggtagaaaacaagaagtaattgaaaagccatag

SEQ ID NO: 20616 - protein, 268 aa, Unknown
  Obtained from environmental sample
  misc_feature (1)..(268): Xaa is any amino acid
MEYENCQECFYSKEQTERAYKKIEEKYSKEKQLELGYLKKTKFFFEEEYEDPEEPIYIDKEKLLFPNEFTSIKELITIIDKELNKLESISVENKTNNVKPDMYSQYNNDINEEVLLVEELEKRLAIEAVEYKKNCDDLWETYTFDPKYFDTYISGDLYNVCFKSIYEKIKPLNDFEINKYLTLSVNQFKTHTPTKRAEAFKRIYHDTYWYPNYMEYNPNQYENKYPVHVWKHYTNHFHLFKEASENMLKDFKKGLIGHGRKQEVIEKP

SEQ ID NO: 20617 - DNA, 834 bp, Unknown
  Obtained from environmental sample
  misc_feature (1)..(834): n is a, c, g, or t
atgttttattctaaagagcaaacggaacgagcttataaaaaaatagaagaaaaatacagtaaagagaaacaattagaacttggatatttaaagaaaacgaaattcttttttgaagaagaatatgaagatccagaagaaccgatatatattgataaagaaaaacttctgtttcctaatgaatttacgtctatcaaagaattaattacaataattgataaagaattaaataagttagaatcgataagtgttgaaaataaaactaacaacgttaaaccagatatgtatagtcaatacaataatgatataaacgaagaagttttattagtagaggagttagaaaagcgtttagcgattgaagcagttgagtacaagaagaattgcgacgatctttgggaaacctatactttcgaccccaagtattttgatacatacatttctggtgatttatacaatgttttttttaagtctatttatgaaaaaataaagcctttaaacgactttgaaattaataaatacctaacactatcagtaaatcaatttaagacgcatacaccaaccaaaagagcagaagcatttaaaagaatttaccacgatacatattggtatccaaactatatggagtacaatccaaatcaatacgagaataaatatcctgttcacgtttggaagcattatacaaatcatttccacttatttaaagaagcatcagagaatatgttacaggactttaaaaaaggcttaattggtaatggtagaaaacaagaagtaattgaaaagccaaggactaaagctaaattcaagcatcatcgtttacttataaaaagtggcatttga

SEQ ID NO: 20618 - protein, 277 aa, Unknown
  Obtained from environmental sample
  misc_feature (1)..(277): Xaa is any amino acid
MFYSKEQTERAYKKIEEKYSKEKQLELGYLKKTKFFFEEEYEDPEEPIYIDKEKLLFPNEFTSIKELITIIDKELNKLESISVENKTNNVKPDMYSQYNNDINEEVLLVEELEKRLAIEAVEYKKNCDDLWETYTFDPKYFDTYISGDLYNVFFKSIYEKIKPLNDFEINKYLTLSVNQFKTHTPTKRAEAFKRIYHDTYWYPNYMEYNPNQYENKYPVHVWKHYTNHFHLFKEASENMLQDFKKGLIGNGRKQEVIEKPRTKAKFKHHRLLIKSGI

SEQ ID NO: 20619 - DNA, 351 bp, Unknown
  Obtained from environmental sample
  misc_feature (1)..(351): n is a, c, g, or t
ttgatgaaatatattttttactcttttctttttcttttttttatttcttgtgataaaaaacaagaacaactaactttagaaacagggatttctcacaacttagcaaaatatagaaaacagcaaatagcagatgttgtttataatttaaattttaaaattccagaggaaaaaacaagtccaattccatcgaatttagatctcaattttacagtaaatgatttaaaaaatgatgtttatttagattttaatgaagaaacttcaaaactaaaatcgataaaagtaaatggagaaacatccacaattaatcatcaaaaagagcacattattattgataaaacaaacttggtttaa

SEQ ID NO: 20620 - protein, 116 aa, Unknown
  Obtained from environmental sample
  misc_feature (1)..(116): Xaa is any amino acid
MMKYIFYSFLFLFFISCDKKQEQLTLETGISHNLAKYRKQQIADVVYNLNFKIPEEKTSPIPSNLDLNFTVNDLKNDVYLDFNEETSKLKSIKVNGETSTINHQKEHIIIDKTNLV

SEQ ID NO: 20621 - DNA, 702 bp, Unknown
  Obtained from environmental sample
  misc_feature (1)..(702): n is a, c, g, or t
atggatgcaagtgggaatatcctttccttttatcaaggaaattgtaatctgagaggtgaaggcttagttaatctgggcgccgaattaggacaaatcaaacaagtttcggccggagccatagagcatgatttatcaagcgacattaccactcttgatttaatttttggtgtagatttctttatgaatgatcaggctatgaaaataatggaaacagcttttactcaggccaatttaaagcgcacgaatataaataaacagacctacacgagaaagatagctgaaattatgggtcgcaaaagagcagaattagctgtgcgcgaaatggatgacaatggaacatttaagacattgccaaatgaacttttacacagcatttatttcaacaatctagattttatctgggacaaagaagccaaggcatatcaatcaattggagaaattggaattggtattatcaacgacaaacaaattaataagagcataaaaggtaaaattgaattggataagaagcgaagtggtaaccgattgaccatgtaccttgagatcgataattcaacatggttcttttttgaatatcaccatggtgtgatgttcgtacgctcttcgaatgaagaattcaatacaattctgcacgaaaccaaagaagacaaacgtgaatttaaagatcctttaaagaagatccaattctcgaccgattcttga

SEQ ID NO: 20622 - protein, 233 aa, Unknown
  Obtained from environmental sample
  misc_feature (1)..(233): Xaa is any amino acid
MDASGNILSFYQGNCNLRGEGLVNLGAELGQIKQVSAGAIEHDLSSDITTLDLIFGVDFFMNDQAMKIMETAFTQANLKRTNINKQTYTRKIAEIMGRKRAELAVREMDDNGTFKTLPNELLHSIYFNNLDFIWDKEAKAYQSIGEIGIGIINDKQINKSIKGKIELDKKRSGNRLTMYLEIDNSTWFFFEYHHGVMFVRSSNEEFNTILHETKEDKREFKDPLKKIQFSTDS

SEQ ID NO: 20623 - DNA, 690 bp, Unknown
  Obtained from environmental sample
  misc_feature (1)..(690): n is a, c, g, or t
ttggaagcaagaggattcctcacctttaataagaatttacaggcctatcaaattgctccaaaagacaagttacaagatatggatgcaagtgggaatatcctttccttttatcaaggaaattgtaatctgagaggtgaaggcttagttaatctgggcgccgaattaggacaaatcaaacaagtttcggccggagccatagagcatgatttatcaagcgacattaccactcttgatttaatttttggtgtagatttctttatgaatgatcaggctatgaaaataatggaaacagcttttactcaggccaatttaaagcgcacgaatataaataaacagacctacacgagaaagatagctgaaattatgggtcgcaaaagagcagaattagctgtgcgcgaaatggatgacaatggaacatttaagacattgccaaatgaacttttacacagcatttatttcaacaatctagattttatctgggacaaagaagccaaggcatatcaatcaattggagaaattggaattggtattatcaacgacaaacaaattaataagagcataaaaggtaaaattgaattggataagaagcgaagtggtaaccgattgaccatgtaccttgagatcgataattcaacatggttcttttttgaatatcaccactcctgtgatgttcgtacgctcttcgaatga

SEQ ID NO: 20624 - protein, 229 aa, Unknown
  Obtained from environmental sample
  misc_feature (1)..(229): Xaa is any amino acid
MEARGFLTFNKNLQAYQIAPKDKLQDMDASGNILSFYQGNCNLRGEGLVNLGAELGQIKQVSAGAIEHDLSSDITTLDLIFGVDFFMNDQAMKIMETAFTQANLKRTNINKQTYTRKIAEIMGRKRAELAVREMDDNGTFKTLPNELLHSIYFNNLDFIWDKEAKAYQSIGEIGIGIINDKQINKSIKGKIELDKKRSGNRLTMYLEIDNSTWFFFEYHHSCDVRTLFE

SEQ ID NO: 20625 - DNA, 873 bp, Unknown
  Obtained from environmental sample
  misc_feature (1)..(873): n is a, c, g, or t
gtggatcaagatncggctccagcccgtgaatcgagaccgaatagtgcaacaacactattgaacatactccaaccgatattcgacatcgactttcacccatcgagttatgggtacaggccgaaacgaagctgtcatgacgctatcagtaaagcgagtgtatttatccgtaaataccatcgcgactgggtcgtagacatggatttgtcgaagtgttttgacctgcttgatcatgctttgataattagcagtgttagacgcaaagtgacggacagtagtattttaaagctgattaatcagttcttaaaaagcggggtaatgataggcgaacactgggaggctagtacgataggaagcccacaaggtggcgtaattagcccgttattggcgaatatctacctagatgctttcgatcaagaaatgaaaaagcgtaatcaccgaatagtgaggtatgcagatgatatcttgattttgtgcagcacagaaaaagcagcgcaagaagcacttaaggcatcgacccaaatactagagcgagacttgaaattaaccgtgaaccaaaagaaaacccatattgctcatagcagcaaaggtgtgaagtttttgggagtagagataggtagccagtggacacggatacaagcatcaaaactcatcgtgtttaaacaaaaagtgaagcaattaacaaaacgtaacggcggcataaatttagcagaagtaataaagcggctaaatccagttgtgcgcggttttgtacattattttagtatagccaattgtaagcgagaactaaaaggcttggcaggttggatcagacgacaactaacggcaatacagctgacgttgtggaagaagccttcaagctacatcgacgactaa

SEQ ID NO: 20626 - protein, 290 aa, Unknown
  Obtained from environmental sample
  DOMAIN (2)...(204): Reverse transcriptase (RNA-dependent DNA polymerase)
  misc_feature (1)..(290): Xaa is any amino acid
MDQDXAPARESRPNSATTLLNILQPIFDIDFHPSSYGYRPKRSCHDAISKASVFIRKYHRDWVVDMDLSKCFDLLDHALIISSVRRKVTDSSILKLINQFLKSGVMIGEHWEASTIGSPQGGVISPLLANIYLDAFDQEMKKRNHRIVRYADDILILCSTEKAAQEALKASTQILERDLKLTVNQKKTHIAHSSKGVKFLGVEIGSQWTRIQASKLIVFKQKVKQLTKRNGGINLAEVIKRLNPVVRGFVHYFSIANCKRELKGLAGWIRRQLTAIQLTLWKKPSSYIDD

SEQ ID NO: 20627 - DNA, 618 bp, Unknown
  Obtained from environmental sample
  misc_feature (1)..(618): n is a, c, g, or t
atggaaatcacgtctaccaacatagcaaaaccaacaactattgtctggaatggaaaaacacaaaccacaggaatttataaaagcccaactccagcaggtatttatctagaaaaagaagacgttaaaggcgatgaggtctctgaccgcaaacatcatggtggcatttttaaagcctgctatttattttcggaagaccattatgcgtattggcaaaacttatatccaaatttagattttaattacgggatttttggcgaaaacctaaccgttaaaggtctagacgaaactaaaataactgttggtgatatttataaaattggcactgctttagtgcaagtcacgcaacccagagaaccttgttttaaattaggcatccgttttggtacgcaaacaattcttaaacaatttattaagcatgcacgaccaggaacttacgttcgtgttttggaagaaggcttgataaaacccggagataaaatgatcttggtacaagctgcaacagagagcttaaccacagcgcaattattcaccttaatttttgcgaaacaaaaagaccaatctcaattaagtttaattataaataatgatgcgattccattaaaaaacgctcaaaactag

SEQ ID NO: 20628 - protein, 205 aa, Unknown
  Obtained from environmental sample
  DOMAIN (39)...(162): MOSC domain
  misc_feature (1)..(205): Xaa is any amino acid
MEITSTNIAKPTTIVWNGKTQTTGIYKSPTPAGIYLEKEDVKGDEVSDRKHHGGIFKACYLFSEDHYAYWQNLYPNLDFNYGIFGENLTVKGLDETKITVGDIYKIGTALVQVTQPREPCFKLGIRFGTQTILKQFIKHARPGTYVRVLEEGLIKPGDKMILVQAATESLTTAQLFTLIFAKQKDQSQLSLIINNDAIPLKNAQN

SEQ ID NO: 20629 - DNA, 450 bp, Unknown
  Obtained from environmental sample
  misc_feature (1)..(450): n is a, c, g, or t
ttggttggttatatagattcggatttacaaaccgatccaaaggattttaacgtgcttttagaacatattaatgattatgatttggtaacgggtgttcgcgcaaaccgtaaagatagttttgttaaaaacatgtcttctactattgccaatggaattcgccgtacatttactaaagatggcatggacgatacaggttgtccgcttaaagttataaaaactgattatgccaagcggattcccatgtttgaaggtttgcatcgctttcttcctgctatgattttattgcaaaaaggtaagattgtccaaatcccggttaaacacttcccacgggttgccggagaagccaaatttggcgtttggaatcgcttaattggaccactaatggattgtttcgcgtacctctggatgaagaaaaagtatattaattatacggttgagaaacacaattaa

SEQ ID NO: 20630 - protein, 149 aa, Unknown
  Obtained from environmental sample
  misc_feature (1)..(149): Xaa is any amino acid
MVGYIDSDLQTDPKDFNVLLEHINDYDLVTGVRANRKDSFVKNMSSTIANGIRRTFTKDGMDDTGCPLKVIKTDYAKRIPMFEGLHRFLPAMILLQKGKIVQIPVKHFPRVAGEAKFGVWNRLIGPLMDCFAYLWMKKKYINYTVEKHN

SEQ ID NO: 20631 - DNA, 777 bp, Unknown
  Obtained from environmental sample
  misc_feature (1)..(777): n is a, c, g, or t
atggtcaagtattatcagttgatatttgaagatatgattgataagctgataacttctaaaatcgataccaaagaaacaagcaaaggagtttcgcttaaaaaattgaaagaaaataaagatggtaaaattattgaccatttgtttgagtacgattcgttaatagatcgtgatgaaagtattttttacattggagattcaaagtattataaaaccaacaatgaagttcaagaaaactctatttataagcaatttacgtatgccaagaatgtaattcaattcaatatagatttattgaatgagggcaaacaaatcaataaaaacatcagatatagggataaagtaactgaaggatataatattactccaaacttctttattcaaggcgtagtaacggatatttttaattttgatgatgataaacttgcaatcgattttaataaaggaattaaacattcttatcattttaaagaacgtatttttgatagagattccttatttgttaatcattattcaataaattttctatttgttttaaaatcctacactaataaaagtacttttgaattacagaaatatagagaggaaatccacttaaagtttagaaataattttgtttcctatttaaaaaagcaaaaattgtttaaattttattacacagaatttgaaaataaagaattattgaagcaatttatagatacagaatttagaaatttaactggtagggtttatatttcaaaatcgaatgataaacgtttaattcttgctgtaagtcgtttc

SEQ ID NO: 20632 - protein, 259 aa, Unknown
  Obtained from environmental sample
  misc_feature (1)..(259): Xaa is any amino acid
MVKYYQLIFEDMIDKLITSKIDTKETSKGVSLKKLKENKDGKIIDHLFEYDSLIDRDESIFYIGDSKYYKTNNEVQENSIYKQFTYAKNVIQFNIDLLNEGKQINKNIRYRDKVTEGYNITPNFFIQGVVTDIFNFDDDKLAIDFNKGIKHSYHFKERIFDRDSLFVNHYSINFLFVLKSYTNKSTFELQKYREEIHLKFRNNFVSYLKKQKLFKFYYTEFENKELLKQFIDTEFRNLTGRVYISKSNDKRLILAVSRF

SEQ ID NO: 20633 - DNA, 714 bp, Unknown
  Obtained from environmental sample
  misc_feature (1)..(714): n is a, c, g, or t
atgttgctaactggtgatacagaacatacagttaaaattgaggctattgaagccttaaaacgattaaaatggaaatatccacatctaaaaattaaagatcgctttatagtggctaaaattttagacgaatgtcaattatatcaaaatacattagctgttatacacactcaaattgtgttacaatataaaatgaaatcggtaaccatggagtctacagatgaaaacgaagccagaaacggacttatccatttgctagaacaacgattggacagacaactgcaacgcattttaaggtttttaggcattaaatatcctccaaatgatgttgacccaatcttaaacaccatcatgcatggtaacgaagagcagcgcattcatgcaatcgagtttatagataacattctaaacagtcagcttaaaaaagaattaattccagtagccgaatctgtattattagattctaatcaagaagacaccttcaaaaaattaaaccttaaagtttttagcgaaattgaatgttataacgagcttttaaaacgaacagacgtacaactacaatttgctgtctcatatcttattgaaaaatccaataacaccaaatttaaaccggtttaccacttggtgttacttcatgaaactaataaaaaaattagagcaaaaaccgaaagtcctaaggccttacttcctgattacttcatcactatatgctgctaa

SEQ ID NO: 20634 - protein, 237 aa, Unknown
  Obtained from environmental sample
  misc_feature (1)..(237): Xaa is any amino acid
MLLTGDTEHTVKIEAIEALKRLKWKYPHLKIKDRFIVAKILDECQLYQNTLAVIHTQIVLQYKMKSVTMESTDENEARNGLIHLLEQRLDRQLQRILRFLGIKYPPNDVDPILNTIMHGNEEQRIHAIEFIDNILNSQLKKELIPVAESVLLDSNQEDTFKKLNLKVFSEIECYNELLKRTDVQLQFAVSYLIEKSNNTKFKPVYHLVLLHETNKKIRAKTESPKALLPDYFITICC

SEQ ID NO: 20635 - DNA, 819 bp, Unknown
  Obtained from environmental sample
  misc_feature (1)..(819): n is a, c, g, or t
gtggatcaagaatcggcccaggtgatgacagtctatacaaaaggttacaaaagaagtatagattttgaagatgctgcttatgtaatattggttatcgaaaagtttaaatctcaaaaagccattaacacattaatgttgctaactggtgatacagaacatacagttaaaattgaggctattgaagccttaaaacgattaaaatggaaatatccacatctaaaaattaaagatcgctttatagtggataaaattttagacgaatgtcaattatatcaaaatacattagctgttatacacactcaaattgtgttacaatataaaatgaaatcggtaaccatggagtctaaagatgaaaacgaagccagaaacggacttatccatttgctagaacaacgattggacagacaactgcaacgcatttttaggtttttaggcattaaatatcctccaaatgatgttgacccaatcttaaacaccatcatgcatggtaaagaagagcagcgcattcatgcaatcgagtttttagataacattctaaacagtcagcttaaaaaagaattaattccagtagccgaatctgtattattagattctaatcaagaagaccaattaccacaattaaaccttaaagtttttagcgaaattgaatgttataacgagcttttaaaacgaaaagacgtaaaactaaaatttgctggtttatatcttattgaaaaatcaaataacaccaagtttaaaccgcttttagaattggtgttaattaatgaaactaataaaaaattagagcaaaaccgaaagtctttagggcttacttcttga

SEQ ID NO: 20636 - protein, 272 aa, Unknown
  Obtained from environmental sample
  misc_feature (1)..(272): Xaa is any amino acid
MDQESAQVMTVYTKGYKRSIDFEDAAYVILVIEKFKSQKAINTLMLLTGDTEHTVKIEAIEALKRLKWKYPHLKIKDRFIVDKILDECQLYQNTLAVIHTQIVLQYKMKSVTMESKDENEARNGLIHLLEQRLDRQLQRIFRFLGIKYPPNDVDPILNTIMHGKEEQRIHAIEFLDNILNSQLKKELIPVAESVLLDSNQEDQLPQLNLKVFSEIECYNELLKRKDVKLKFAGLYLIEKSNNTKFKPLLELVLINETNKKLEQNRKSLGLTS

SEQ ID NO: 20637 - DNA, 354 bp, Unknown
  Obtained from environmental sample
  misc_feature (1)..(354): n is a, c, g, or t
atggatcaatcgggattgatacacgctataaataaacaaaaacaggaaattaatgtttccattactttaaaacaagaatctcaacggtttacacaattgctatttaatgcgttatttgacagagcaaccaatacacaagaggcacttgtagagctggaggatttatttcgagtgattagagatttagcgtgccctcatattgctggcaaaccttgtaaaacttggaaagacttttgtttaactatacctaatttgtttacgagtttaaaaaaagacgcgaaaactatttatgaaacgatccagcagcccaatctatggaagaattatttgcatatcctgcgagccgattcttga

SEQ ID NO: 20638 - protein, 117 aa, Unknown
  Obtained from environmental sample
  misc_feature (1)..(117): Xaa is any amino acid
MDQSGLIHAINKQKQEINVSITLKQESQRFTQLLFNALFDRATNTQEALVELEDLFRVIRDLACPHIAGKPCKTWKDFCLTIPNLFTSLKKDAKTIYETIQQPNLWKNYLHILRADS

SEQ ID NO: 20639 - DNA, 525 bp, Unknown
  Obtained from environmental sample
  misc_feature (1)..(525): n is a, c, g, or t
atgctagaaatggccttggttgaaaacattcagcgtaaaaatttagatccgattgaagtagctctttcttaccaacgtttaattgatgaaattcagttaacacaagaggaattaagtactagagttggtaaaaaacgttctacagtaaccaattatttacgtttgttaaaattagacccaattttacaaacaggaatgagagatggttttatttctatgggtcatggacgtgccatgattaatgttgataatacagaagatcaattagccatttacgagaaaattttacgtgataaattatctgtaagacaaacagaagatttggttaaaagtctaaaatctggtgctattgcaaaaccgaaaaagaaagctattcctgcttttgtgaaagaaagtcagaaagaaattggtgctttttttgggcataaaatagatattactgttgctaataatggcaaaggaaaaatatcaattccttttcattcagaagaagattttaatcgtattaaaaacttgctaaaataa

SEQ ID NO: 20640 - protein, 174 aa, Unknown
  Obtained from environmental sample
  misc_feature (1)..(174): Xaa is any amino acid
MLEMALVENIQRKNLDPIEVALSYQRLIDEIQLTQEELSTRVGKKRSTVTNYLRLLKLDPILQTGMRDGFISMGHGRAMINVDNTEDQLAIYEKILRDKLSVRQTEDLVKSLKSGAIAKPKKKAIPAFVKESQKEIGAFFGHKIDITVANNGKGKISIPFHSEEDFNRIKNLLK

SEQ ID NO: 20641 - DNA, 600 bp, Unknown
  Obtained from environmental sample
  misc_feature (1)..(600): n is a, c, g, or t
atgagtcctaaaggaaaaaaaacttttgatgtattaatcgaaataccaaaaggaagccgtaacaaatatgaatacgattttgatttaaaaaagatccgttttgatcgtttgttgttttcttccatgatgtatcctgctgattatggtttcattccggaaactctagctttggatggagatccattagacgttttggtgttaggtactgaacctacctttcctatgtgcgttgttgaagtaaaacctattggtgtgttccatatggctgatgaaaaaggaaacgacgagaaagtaatctgtgtaccagtttctgatcctatttggaatagtcttaacgatttatctgacgtgaatgctcatcaaattaaagaaattgaacatttctttcaagtgtataaagatttggaaaagaaaaaagttgatgtaggtggatggggagatgcccaagaggcttatgacatccttaataaatgtgttctccgttacgaaaacagtgagcataaaacaacgggaatttactatttactgtcattcctttcttataaaaatcggaacctcttatataacataaggcgtcctttcggtcatcgggcgaattaa

SEQ ID NO: 20642 - protein, 199 aa, Unknown
  Obtained from environmental sample
  DOMAIN (10)...(164): Inorganic pyrophosphatase
  misc_feature (1)..(199): Xaa is any amino acid
MSPKGKKTFDVLIEIPKGSRNKYEYDFDLKKIRFDRLLFSSMMYPADYGFIPETLALDGDPLDVLVLGTEPTFPMCVVEVKPIGVFHMADEKGNDEKVICVPVSDPIWNSLNDLSDVNAHQIKEIEHFFQVYKDLEKKKVDVGGWGDAQEAYDILNKCVLRYENSEHKTTGIYYLLSFLSYKNRNLLYNIRRPFGHRAN

SEQ ID NO: 20643 - DNA, 486 bp, Unknown
  Obtained from environmental sample
  misc_feature (1)..(486): n is a, c, g, or t
atggctgtacacaaacttattttagatgatgtttttgaagaggatttatgtactttaatagcaattcattgtacacttgaagattatcgtttagcatatctcctaaataaatatttaggaataagccttgctagaaccccattagatttggattaccaaaatggaaaatcaacgtattcaatttttgaatgggaagatactaaacagcaaacgatatggagtttagtttctaatgtctgtaaaacagaagattacaggcaaaggaaaaacgaatcattatttgattctcaagaaaaaattacgaggacagcatatttagtaccagaatataaaacggttgattattttttaaaaatagataatgaaatcaattttagtaaagaaaaatatattctaaataatgtattaaaagcacctcaaattgctacagcttactgtattgatatcgatcaattaaaatctaaagacaatttaatttttaactaa

SEQ ID NO: 20644 - protein, 161 aa, Unknown
  Obtained from environmental sample
  misc_feature (1)..(161): Xaa is any amino acid
MAVHKLILDDVFEEDLCTLIAIHCTLEDYRLAYLLNKYLGISLARTPLDLDYQNGKSTYSIFEWEDTKQQTIWSLVSNVCKTEDYRQRKNESLFDSQEKITRTAYLVPEYKTVDYFLKIDNEINFSKEKYILNNVLKAPQIATAYCIDIDQLKSKDNLIFN

SEQ ID NO: 20645 - DNA, 528 bp, Unknown
  Obtained from environmental sample
  misc_feature (1)..(528): n is a, c, g, or t
atgtcaaaaaaagctaaagtattaattgttgatgatgatgctcttaatcgaattgtactcgaaaaaacacttagcgatgagcatgaggtgtttttagttaaaagtggtgacgaagcgcttacttttataaaaacaacacaagttgatttaattatactcgatattgttatgccaggaatgaatggctacgaagtactggttaaattaaaagaagattcagcaacgcaaatgatcccggttatttttatatcggcaaatagcagccatgatgacgagtctaaaggtttagaactaggtgcaatggattatataactaagccattttgttcatcaattgtgcgcgtaagagtacgtaatcaactgcttattaagcaaaaaaatgatttgcttgaaatgttagcttcgattgatggcctaaccgaaatacccaatagacgcaacctagacgaaaacctatctcgtgaatggcgtaaaagtaggccaaaaacaaccagtttcagggctacttatggatatagatcactttaa

SEQ ID NO: 20646 - protein, 175 aa, Unknown
  Obtained from environmental sample
  DOMAIN (5)...(125): Response regulator receiver domain
  misc_feature (1)..(175): Xaa is any amino acid
MSKKAKVLIVDDDALNRIVLEKTLSDEHEVFLVKSGDEALTFIKTTQVDLIILDIVMPGMNGYEVLVKLKEDSATQMIPVIFISANSSHDDESKGLELGAMDYITKPFCSSIVRVRVRNQLLIKQKNDLLEMLASIDGLTEIPNRRNLDENLSREWRKSRPKTTSFRATYGYRSL

SEQ ID NO: 20647 - DNA, 510 bp, Unknown
  Obtained from environmental sample
  misc_feature (1)..(510): n is a, c, g, or t
ttgttcaaaactaatcctcttaaatctataatgaagaacgctttactcctattatttgtttttagcacagtcacaatttttgctcaagaagccgatacagattttaaaaacattgcaaatattgaagatgccgaactttatattgaaaaaagtgcttctaaaaaaaacaagttaatggtttttaacgaagagaaacacaaatctactttagcacaaaccttgttggcaatgcctattggaactacaaaaacggtgccttctcagtttacaaaaacagtttacaaaatcattgagaaatctaacgacccccattaccgaattagttatatttattttgatgaaagtaaaatagatataaatgaaatttacaaaatgcgtaaaactattttatataaatacgaaaatggtatgcctttcgccgatttagccaatcgctattctatggatgataccgcattgcgtggtggtgatactggttggttcaagactatgaattgntatagaaattga

SEQ ID NO: 20648 - protein, 169 aa, Unknown
  Obtained from environmental sample
  misc_feature (1)..(169): Xaa is any amino acid
MFKTNPLKSIMKNALLLLFVFSTVTIFAQEADTDFKNIANIEDAELYIEKSASKKNKLMVFNEEKHKSTLAQTLLAMPIGTTKTVPSQFTKTVYKIIEKSNDPHYRISYIYFDESKIDINEIYKMRKTILYKYENGMPFADLANRYSMDDTALRGGDTGWFKTMNXYRN

SEQ ID NO: 20649 - DNA, 747 bp, Unknown
  Obtained from environmental sample
  misc_feature (1)..(747): n is a, c, g, or t
atggatgttattcatttttatcagatgattgacatattgattgttgatgaggttcaagttttatccggtaaatcaggcactcaagatgtgtttttccatatttgtaaccatgtacatcaaaatggcaaacaagttattttaacttctgataaggctccggtagatatgcaagatattgagcagcgtttgttatcccgttttaaatggggactttcagctgagttgcaatcacctgattatgaaaccaggatatcaatacttcataataaactatttagagatggtgttgaaatgccagaagaaatagtagagtatatcgccaaaaatattgaaaccaacgtaagagaattagaaggtgttttgatttcaatgattgctcaagcttcttttaatagaaaaggatttacactagctttgaccaagcagatggtagataagtttgttaaaaacaccaaacgagaagtgtcaatagattatattcaaaaagtagtatccaaatactttgaaatggatgttactactttacaatctaaaacaagaaagcgtcatattgtacaagctcgtcagttagcaatgtattttgccaaaagaatgaccaaggcttctttggccagtataggttctcaaattggtagtagagatcacgctactgtattacatgcttgtaaaacagtagataatcttaccgagacagataagcaattcagaaaatacgttgaagatattacacaaaagttgtcattttaa

SEQ ID NO: 20650 - protein, 248 aa, Unknown
  Obtained from environmental sample
  DOMAIN (2)...(225): Bacterial  dnaA  protein
  misc_feature (1)..(248): Xaa is any amino acid
MDVIHFYQMIDILIVDEVQVLSGKSGTQDVFFHICNHVHQNGKQVILTSDKAPVDMQDIEQRLLSRFKWGLSAELQSPDYETRISILHNKLFRDGVEMPEEIVEYIAKNIETNVRELEGVLISMIAQASFNRKGFTLALTKQMVDKFVKNTKREVSIDYIQKVVSKYFEMDVTTLQSKTRKRHIVQARQLAMYFAKRMTKASLASIGSQIGSRDHATVLHACKTVDNLTETDKQFRKYVEDITQKLSF

SEQ ID NO: 20651 - DNA, 324 bp, Unknown
  Obtained from environmental sample
  misc_feature (1)..(324): n is a, c, g, or t
gtgaagaccattattgttaccgaaaaagtgaatgaaataaagggtgacaatcttttttatgaacaggtagatttttcaaaggatttagcacagcaaatttgtaagattttgtataagcatgaaatacaatcaattattattgagggtggtagacaaacgttgcaaacttttattgatgctaatttatgggatgaggcaagaatttttattggaggaaaaactttttcaatgggagttattgcacctaatattagtggtgaagaaacttgtacgataaaaatccaaaatgatatattaaaaattcttaaaaacaaaaattgttaa

SEQ ID NO: 20652 - protein, 107 aa, Unknown
  Obtained from environmental sample
  misc_feature (1)..(107): Xaa is any amino acid
MKTIIVTEKVNEIKGDNLFYEQVDFSKDLAQQICKILYKHEIQSIIIEGGRQTLQTFIDANLWDEARIFIGGKTFSMGVIAPNISGEETCTIKIQNDILKILKNKNC

SEQ ID NO: 20653 - DNA, 438 bp, Unknown
  Obtained from environmental sample
  misc_feature (1)..(438): n is a, c, g, or t
ttgttaaagggagatacatataagaccatagcaagatcgtcagacgaggttatatttaaggacagaggtagtaaatttttgggttatgcctatccgttgcaatgtgaagaaaaggttaaagagataattgaccgattaaaaaaaaatcaccataaggcacgccattggtgttacgcctggcaaataggaactgatgccgttcaatttcgagttaatgatgatggtgagcctaataattctgcaggacagcccatttatggtcaaattctttcaaaggaattaacaaatgttttagtggttgtagtgcgctattttggtggcacaaaattaggagttggaggtttggtgaatgcctatagaacagcagctcaattagcattagaatcatctcaaataattacaaaaacttgtcgatattcatttcaaacttattttncc

SEQ ID NO: 20654 - protein, 146 aa, Unknown
  Obtained from environmental sample
  DOMAIN (21)...(128): Uncharacterized protein family UPF0029
  misc_feature (1)..(146): Xaa is any amino acid
MLKGDTYKTIARSSDEVIFKDRGSKFLGYAYPLQCEEKVKEIIDRLKKNHHKARHWCYAWQIGTDAVQFRVNDDGEPNNSAGQPIYGQILSKELTNVLVVVVRYFGGTKLGVGGLVNAYRTAAQLALESSQIITKTCRYSFQTYFX

SEQ ID NO: 20655 - DNA, 612 bp, Unknown
  Obtained from environmental sample
  misc_feature (1)..(612): n is a, c, g, or t
atggaaaaaacaattacattactcaaacctgcttatcgtcaatactcacgagcagagcttcgctatatatttgatatccctgtagattcaaatgatatttcgcgtattttaaactcacttagccaagagtactcattacttagtagtgaggataaaaagaagtttcagcctgagctaacagagagccaaattataaaaaaactgaaattaaataccctcatgggaggtaaagttactacgaccaataaacagccttctacatttaataaatgtgattttaaaactatatggaagagctcgttacctgaagattttatcgataaaaatacgaatacgtttaattacttttgtaaaaaagtatttgaagcactaaataataaaaccttagactttaaaacagccaatattcagtggcgtcaattagcaaaaggacaatattttaactttgcctctaaagagctaacagcgcttaaaacattgggtaaacctaaagtaattcttcacacaccaaaggataaatcaaatatcgaaacccttgatattcaattttcttgtaaatgcaaccaaaagacactgcaagcttttaaactctttgccacagagggtcattaa

SEQ ID NO: 20656 - protein, 203 aa, Unknown
  Obtained from environmental sample
  misc_feature (1)..(203): Xaa is any amino acid
MEKTITLLKPAYRQYSRAELRYIFDIPVDSNDISRILNSLSQEYSLLSSEDKKKFQPELTESQIIKKLKLNTLMGGKVTTTNKQPSTFNKCDFKTIWKSSLPEDFIDKNTNTFNYFCKKVFEALNNKTLDFKTANIQWRQLAKGQYFNFASKELTALKTLGKPKVILHTPKDKSNIETLDIQFSCKCNQKTLQAFKLFATEGH

SEQ ID NO: 20657 - DNA, 756 bp, Unknown
  Obtained from environmental sample
  misc_feature (1)..(756): n is a, c, g, or t
ttgaggggcaaaggcatgaccgcgctagacgacaagatcaacgaacgtttctccggccttgtggtgcgcaaagatttggtgaaggcggtcaaaggcaacgcgatcgttccgacctatgtgttggaatatctgttggggcaatattgcgcgaccaacgatgaggcttcgatccagtcaggcattgagactgtccgcgagatcttgcgcaagcactacgtccatcgcaatgaggctggtctcatcaagtccaacatacgcgagaaggggcgctggaagatcatcgatcggattagcgtggcgctcaatgacaagagtgatgcctatgaagctagcttcgctaacctcggtatttccaaagttctgatcgattccggtacggtgaaggcgcacccgaagcttctggttggcggcgtctggtgcatagctgacattgagtatgactataccgatgaaaaaaatgtaacgccttggatactcggtagcatgaagccgatccagctgtcgcagttcgattatgaggcctatctcgaagcgcgcaaaggtttcacgacggacgaatggattgatcttttgttccagacagtgggtttcgatcccgaaatgtctgggcgccgttcaaagcttatccagttgatgaggcttattccatttgtcgaacgaaattataatttgatcgagcttggaccaaagggaacaggcaagtccaaatatttgcggaattctccgtcatggcttcttgtctcaaggggtgaatga

SEQ ID NO: 20658 - protein, 251 aa, Unknown
  Obtained from environmental sample
  misc_feature (1)..(251): Xaa is any amino acid
MRGKGMTALDDKINERFSGLVVRKDLVKAVKGNAIVPTYVLEYLLGQYCATNDEASIQSGIETVREILRKHYVHRNEAGLIKSNIREKGRWKIIDRISVALNDKSDAYEASFANLGISKVLIDSGTVKAHPKLLVGGVWCIADIEYDYTDEKNVTPWILGSMKPIQLSQFDYEAYLEARKGFTTDEWIDLLFQTVGFDPEMSGRRSKLIQLMRLIPFVERNYNLIELGPKGTGKSKYLRNSPSWLLVSRGE

SEQ ID NO: 20659 - DNA, 564 bp, Unknown
  Obtained from environmental sample
  misc_feature (1)..(564): n is a, c, g, or t
atgtgccagcaagttctattgatatcaacattcatcctacgaaaacgggaaattaagtttgataatgaaaaggcattgtatgcgatgttaagacccacagtaaaacacattttagggcaatataatgtagctcctgttttagactttaacagagattctaatttagatacttcttatcatcaaactaaaaacattgtaaaaggttccactccaaaaattacagtggatcctgattttaatccttttaaagaagccaaacaaaaagaaattacatctccctataaaagagaacaacacacacaaaggtgggaatctttatatacttctgttgctattacagatgaagaaaaacaagaggaattatttagtcatcaagaggaagtaaaaacacaaaaaacatttcaaattcagcgtaaatatgttttaagtttgataaaatctggagttgttttaatcaaccaatcattggctcatcaacgtgttttgtatgaagaatttttagaaagcattacagtaaaagaggcgaatagtcagcaattctcgagccgattcttagtccactag

SEQ ID NO: 20660 - protein, 187 aa, Unknown
  Obtained from environmental sample
  misc_feature (1)..(187): Xaa is any amino acid
MCQQVLLISTFILRKREIKFDNEKALYAMLRPTVKHILGQYNVAPVLDFNRDSNLDTSYHQTKNIVKGSTPKITVDPDFNPFKEAKQKEITSPYKREQHTQRWESLYTSVAITDEEKQEELFSHQEEVKTQKTFQIQRKYVLSLIKSGVVLINQSLAHQRVLYEEFLESITVKEANSQQFSSRFLVH

SEQ ID NO: 20661 - DNA, 300 bp, Unknown
  Obtained from environmental sample
  misc_feature (1)..(300): n is a, c, g, or t
atgactagaaaagaattaattccaatggcaaatgcccacattacccaacatactaatggaggggataagaccgattggcaaatacaagaaaatattactgataggaccctaggaagcttaccttttaatttaaaggaagatcaagtattccatattatggatatcataaggaaatacgagcttgaagcttttaacacaggtataaaatttggaaagactgaaggccttaaggcttatacagagcgtataaaacaactggaatctaatttagaaagagccagtaatgaaaatgacgtctag

SEQ ID NO: 20662 - protein, 99 aa, Unknown
  Obtained from environmental sample
  misc_feature (1)..(99): Xaa is any amino acid
MTRKELIPMANAHITQHTNGGDKTDWQIQENITDRTLGSLPFNLKEDQVFHIMDIIRKYELEAFNTGIKFGKTEGLKAYTERIKQLESNLERASNENDV

SEQ ID NO: 20663 - DNA, 504 bp, Unknown
  Obtained from environmental sample
  misc_feature (1)..(504): n is a, c, g, or t
ttgcgtatatctcaacgtgaaaagaatgaattaaatataagtaaggatagagtacgcttgcacgacctaatagaagatgcgatttcacatatagaattaattgtagaagatagaggtggttttattgaaaccgatttaaaagccgataaatcttcagtgttagcaaatgaaacacattttacaaatgtattggtaaatattcttgataatgctgtaaagtattcaccagatgcacccaaaatacttattgaaactgtaaatgttggaaataatattatcgtaaaaattaaagacaacggaagcggaatgagtaaagccgtaccaaaacgagtattcgagaagttctatcgcgaacatactggaaatattcataatgttaaaggtcacggtttaggcttagcttacgtaaaaagaatagtagaagaccacgagggtcatatctcagtagaaagtgaaaaagaaaaaggaagtacttttattataaagcttccgctaatatcataa

SEQ ID NO: 20664 - protein, 167 aa, Unknown
  Obtained from environmental sample
  DOMAIN (55)...(166): Histidine kinase-, DNA gyrase B-, and HSP90-like ATPase
  misc_feature (1)..(167): Xaa is any amino acid
MRISQREKNELNISKDRVRLHDLIEDAISHIELIVEDRGGFIETDLKADKSSVLANETHFTNVLVNILDNAVKYSPDAPKILIETVNVGNNIIVKIKDNGSGMSKAVPKRVFEKFYREHTGNIHNVKGHGLGLAYVKRIVEDHEGHISVESEKEKGSTFIIKLPLIS

SEQ ID NO: 20665 - DNA, 660 bp, Unknown
  Obtained from environmental sample
  misc_feature (1)..(660): n is a, c, g, or t
atgaggaagaaaatttttcttgtattaatcattttaatgagcttatctctaggagggataatcttcgttcaaagctattatataaggaattctgttaaaaatgaagaagatcagtttaaatttaacgttaagaaagcgttacgttatgttacaaataagattgaaaaagaagaatataaagaccatattttaaagttaagacgattaatagataaaggtgaacttataaatatagacaccacctctatttctaatttatacattaaacaatacgacgaaaatacaaacgaaacactggtttatagaaatggtattatagaggagaattataagttatcctcctcgctctttgatattggtttagatagtacaagtataaagcgtattataaacgaaaatgaaacaaaagtttataaatcgagtaatattgatggtaaggaaaatgtagaagtcatccaatttggagaccttagtagaactgctgatttagtttacgaaaaccattacaataatacagcgtacagaagaacaattcttaaaagagtttcgatagagcaaataaacaaaatattaaagttacgtttaatgcaagatgatatcgatatggattatgagtttgccaattatagtcaccggtttagcaacaaaaatccaaactga

SEQ ID NO: 20666 - protein, 219 aa, Unknown
  Obtained from environmental sample
  SIGNAL (1)...(18)
  misc_feature (1)..(219): Xaa is any amino acid
MRKKIFLVLIILMSLSLGGIIFVQSYYIRNSVKNEEDQFKFNVKKALRYVTNKIEKEEYKDHILKLRRLIDKGELINIDTTSISNLYIKQYDENTNETLVYRNGIIEENYKLSSSLFDIGLDSTSIKRIINENETKVYKSSNIDGKENVEVIQFGDLSRTADLVYENHYNNTAYRRTILKRVSIEQINKILKLRLMQDDIDMDYEFANYSHRFSNKNPN

SEQ ID NO: 20667 - DNA, 525 bp, Unknown
  Obtained from environmental sample
  misc_feature (1)..(525): n is a, c, g, or t
atgggagactctaaaatgggacttcatgcaagattaatgtctcaagcactaagaaaattaactgcatctattagtaaaactaattgtactgttatttttattaaccaattacgtgaaaaaattggtgttatgtttggtaacccagatacaacaactggtggtaatgctttaaagttttacgcttctgttaggttggatattagacgatctacacaaataaaagatagcaatggagaagtacttggtaataaaaccagagttaaagtggttaaaaacaaagtagctccaccttttagaatggctgaatttgacatcatgtatggtgaaggcgtaagtaaagttggagaaatattagatgtagcagttgaaaaagaaattgtcaagaaaagcggttcgtggtttagctatgaagacactaaacttggtcaaggtcgagatgctgttaaactaataattaaagataatccagaattatttgaagagttagaacagaaaattaaacaagctattaaagacagtctttaa

SEQ ID NO: 20668 - protein, 174 aa, Unknown
  Obtained from environmental sample
  DOMAIN (1)...(172): recA bacterial DNA recombination protein
  misc_feature (1)..(174): Xaa is any amino acid
MGDSKMGLHARLMSQALRKLTASISKTNCTVIFINQLREKIGVMFGNPDTTTGGNALKFYASVRLDIRRSTQIKDSNGEVLGNKTRVKVVKNKVAPPFRMAEFDIMYGEGVSKVGEILDVAVEKEIVKKSGSWFSYEDTKLGQGRDAVKLIIKDNPELFEELEQKIKQAIKDSL

SEQ ID NO: 20669 - DNA, 339 bp, Unknown
  Obtained from environmental sample
  misc_feature (1)..(339): n is a, c, g, or t
ttgcgagaatacacttcgcataaccataggcacaactacagaaaacaaaaaactaataaccatattaaaaacattgaaataatgaagaaacgagtattgtttatagaccgcgacggcactatcataaaagaaactgtggatgagcaaattgatgcttttgacaaaatgattttttaccccaaagtgtttacttacctcggaaaaatcgcaaaggaattggattttgagttggtgatgattaccaaccaagacggtttgggaactgatgcatttccagaggaaacgttttggcccgtgcataatttcattgtgaaatcctttgaaactgaaggcgtataa

SEQ ID NO: 20670 - protein, 112 aa, Unknown
  Obtained from environmental sample
  misc_feature (1)..(112): Xaa is any amino acid
MREYTSHNHRHNYRKQKTNNHIKNIEIMKKRVLFIDRDGTIIKETVDEQIDAFDKMIFYPKVFTYLGKIAKELDFELVMITNQDGLGTDAFPEETFWPVHNFIVKSFETEGV

SEQ ID NO: 20671 - DNA, 480 bp, Unknown
  Obtained from environmental sample
  misc_feature (1)..(480): n is a, c, g, or t
atgagaataataccagcaatagatatcatagacggcaagtgtgtgcgcctttcaaaaggcgattacagcacgaagaagatttataacgaaaatccactagaaatcgccaaacaatatgaaggccacggaattcaatatttgcatttggtagatttggacggcgccaaaagtaagcacatagtaaaccataaggttttggaagaaatcgcctcccaaacctcattaaaaatagattttggtggcggtttgaaaaccgacgaagatttacgtattgcatttgaatgcggcgcaaaccaaatcactggtggcagtatagccgttaaaaaccctgatactttcaaaagttggttacaaaaattcggtagtgaaaaaatcattttaggtgcggatgcaaaggatgaaaaagtagcaatcagtggttggaccgaagattcaaatgaagctttaatacctttctcgagccgattcttgatccactag

SEQ ID NO: 20672 - protein, 159 aa, Unknown
  Obtained from environmental sample
  DOMAIN (2)...(159): Histidine biosynthesis protein
  misc_feature (1)..(159): Xaa is any amino acid
MRIIPAIDIIDGKCVRLSKGDYSTKKIYNENPLEIAKQYEGHGIQYLHLVDLDGAKSKHIVNHKVLEEIASQTSLKIDFGGGLKTDEDLRIAFECGANQITGGSIAVKNPDTFKSWLQKFGSEKIILGADAKDEKVAISGWTEDSNEALIPFSSRFLIH

SEQ ID NO: 20673 - DNA, 663 bp, Unknown
  Obtained from environmental sample
  misc_feature (1)..(663): n is a, c, g, or t
ttgaaaaaagtcttaatccatactcattttcacaaacgcaaaacaggcgttacaagaagcatagaaaatgtgcttcctttttttgttgatgaatttgaaacctatgtttatggttctaatattgatggaactcaaataagtacctcaaaattaaaaaaaatattattttcttcggatgtaaaaaccattgtgcattgtcatagaaataatgaattaatgcgaatgcttttttatcgacttttaggtgctaaatttctgttaatagcaacaagacatgcagaaacaaaaccctctaaattaacgctgtttttgcttaaaaaagcagataaagtaattacgcttataaaaagtatgagtaacaattcagggattgaaaacaccatagttggtcatggagttaaggtgcatgaatttgtgccaaatccactaaagaagttacctaaaatttctcaaaagaacatcattttaaatgcaggcagaataagaaatgcaaaaggacaattagatttattagaggctgccaaagttttagtaaattataaagattgggcattggttttagttggcaaaatagacaaaccagaattttcggaagaattaaaagcgattgttaaaaaacatcatttagagaatcaagtttattttgtgaaggaaaccagannc

SEQ ID NO: 20674 - protein, 221 aa, Unknown
  Obtained from environmental sample
  misc_feature (1)..(221): Xaa is any amino acid
MKKVLIHTHFHKRKTGVTRSIENVLPFFVDEFETYVYGSNIDGTQISTSKLKKILFSSDVKTIVHCHRNNELMRMLFYRLLGAKFLLIATRHAETKPSKLTLFLLKKADKVITLIKSMSNNSGIENTIVGHGVKVHEFVPNPLKKLPKISQKNIILNAGRIRNAKGQLDLLEAAKVLVNYKDWALVLVGKIDKPEFSEELKAIVKKHHLENQVYFVKETRX

SEQ ID NO: 20675 - DNA, 465 bp, Unknown
  Obtained from environmental sample
  misc_feature (1)..(465): n is a, c, g, or t
ttgcaaaaaatatactttcttcatttttatcgattatatttacacatcaaaattacagataaaaaaatgaacatacaatttgatattttaagaaaatctagagcactacttttaaaggaaatagaaggtttaaccttggctgaaattcacaaaataccagaaggattcaaaaataatattgcttggaatgtagcacatgtagtagttacacagcaattgttgcattataaattttctgatttaaattgcttgtgtccagacgatttaattgataattacagaaaaggaactgtgccaacaaaaaactttacagaagaagaatttgatgaagtaaaagagttgctaatgggttttcctgacacattacaagaagattatgaagctggtatttttgagaattacacagaatacactaacagtacaggcattgttttacgtctatgtaatccctgtgccgattcttga

SEQ ID NO: 20676 - protein, 154 aa, Unknown
  Obtained from environmental sample
  misc_feature (1)..(154): Xaa is any amino acid
MQKIYFLHFYRLYLHIKITDKKMNIQFDILRKSRALLLKEIEGLTLAEIHKIPEGFKNNIAWNVAHVVVTQQLLHYKFSDLNCLCPDDLIDNYRKGTVPTKNFTEEEFDEVKELLMGFPDTLQEDYEAGIFENYTEYTNSTGIVLRLCNPCADS

SEQ ID NO: 20677 - DNA, 489 bp, Unknown
  Obtained from environmental sample
  misc_feature (1)..(489): n is a, c, g, or t
ttgatcaacaaacgccttctcataaaaaacctattggctcacaatgatgagaacagcttctatgataaaaagcgtcagattgatattggggaaaaggaagggaaagcaaaatttttaaagcatgtttgtgccttgtccaataccaacccaaagaacaactcttatatcgtcataggcgttgaggatgatgacaatagtattaggggtgttgatttttttgacgatagtaaaattcaaaacttaatcaatgcgtatttaataaatccgcccattgtgcagtatgaaaatataccatttccacatttacctgatgataaagtggtgggtttggtaaccattagggctattgatggacttacttcgttaaaaaagaatatctggaaatataatggtggttcagtgttttttaaagatgggaatatgagtatgcccaaggtttttgaagttgaaatcaaggaagtcaatttctcaaatttgggaggccaatga

SEQ ID NO: 20678 - protein, 162 aa, Unknown
  Obtained from environmental sample
  misc_feature (1)..(162): Xaa is any amino acid
MINKRLLIKNLLAHNDENSFYDKKRQIDIGEKEGKAKFLKHVCALSNTNPKNNSYIVIGVEDDDNSIRGVDFFDDSKIQNLINAYLINPPIVQYENIPFPHLPDDKVVGLVTIRAIDGLTSLKKNIWKYNGGSVFFKDGNMSMPKVFEVEIKEVNFSNLGGQ

SEQ ID NO: 20679 - DNA, 357 bp, Unknown
  Obtained from environmental sample
  misc_feature (1)..(357): n is a, c, g, or t
gtgctagaagattccataagtgaactttctgaagtttttgtgaccaacaaacagctttcaattgaagaaattttggctaatgttagggaaaatatttccaaaaactatgcattagaaggaacacaaagggtttttatgcgagaaagtaataattttaatctcaaggattttgattttgaaattgctaaatcttccaactttaaaaaatccgaaatcaagggcatcaataaaaattttgaagccatgaaaagccatcttattaataatacgtccaattattatgaagatacacttttcgatgcgcagcatgactcagatagtacactagtaaatgttgttaaagcaactaagttgtaa

SEQ ID NO: 20680 - protein, 118 aa, Unknown
  Obtained from environmental sample
  misc_feature (1)..(118): Xaa is any amino acid
MLEDSISELSEVFVTNKQLSIEEILANVRENISKNYALEGTQRVFMRESNNFNLKDFDFEIAKSSNFKKSEIKGINKNFEAMKSHLINNTSNYYEDTLFDAQHDSDSTLVNVVKATKL

SEQ ID NO: 20681 - DNA, 456 bp, Unknown
  Obtained from environmental sample
  misc_feature (1)..(456): n is a, c, g, or t
atgtataataaagaaatagaaacgcttccactagtaaaacttaggaaacttcagagcgaacgtttagtaaaccttgtaaacagtatttataaaactgtccccttttataaaaatcaatttgatgaagctggtgtagatatttcaacaataaaatctattgatgatcttcataaattaccttttacaaaaaaaacggatttaagagatcagtatccttttggtttcttaacagtacctgaaagtaaattagcacgtattcattgttctagtggtaccacaggaaagccaactgtggttgcatatacaaagaaagatttagatgttttttctgaagttgttgcccgttctttagctgcaggtggtgccaaaccaggaatgaaaatgcataacagttatggttacggcttatttactggaggtattggtattcattacggagcggacatattagtatga

SEQ ID NO: 20682 - protein, 151 aa, Unknown
  Obtained from environmental sample
  misc_feature (1)..(151): Xaa is any amino acid
MYNKEIETLPLVKLRKLQSERLVNLVNSIYKTVPFYKNQFDEAGVDISTIKSIDDLHKLPFTKKTDLRDQYPFGFLTVPESKLARIHCSSGTTGKPTVVAYTKKDLDVFSEVVARSLAAGGAKPGMKMHNSYGYGLFTGGIGIHYGADILV

SEQ ID NO: 20683 - DNA, 648 bp, Unknown
  Obtained from environmental sample
  misc_feature (1)..(648): n is a, c, g, or t
atgaaacaaattattatatttttacttgtaattattgccttgcttattggttatggaaaatataaccaatataaaagatattcatcacccgaaattaattacaaaagcgataaaaatattgatgtttcttatcacaatcaagaacttttaataaattattatgaagctgttgaaactttagatagttatgtaatgttgcaatggtctgccaacaaaattgatgtaagaactccagaagatgatgatattgaaacaaaaatagcagtagaaaactacgctaaaaaacttgctaaagttcattattatgaagctattcttgaaaattctaccaaattaaaggaaaaaggacttgacaacaatgcaataaaatttcttgaaactacaggaactgacttcaatactcaccaaagaaaattaaaaaccgagaaaattaaaaaccttttcaactcgaacgtaaaactttataatggcgaaaaaaatgctattatttatgaagttcacaaagagttacatagaaaaggtgatactattactgtggatggtgtttaccgaattgaaacatttaatgctataaaagcttttgaagaaaaaaacaatcttttagctgatggttatttagatgatctaacgttagaacatgatgtttga

SEQ ID NO: 20684 - protein, 215 aa, Unknown
  Obtained from environmental sample
  misc_feature (1)..(215): Xaa is any amino acid
MKQIIIFLLVIIALLIGYGKYNQYKRYSSPEINYKSDKNIDVSYHNQELLINYYEAVETLDSYVMLQWSANKIDVRTPEDDDIETKIAVENYAKKLAKVHYYEAILENSTKLKEKGLDNNAIKFLETTGTDFNTHQRKLKTEKIKNLFNSNVKLYNGEKNAIIYEVHKELHRKGDTITVDGVYRIETFNAIKAFEEKNNLLADGYLDDLTLEHDV

SEQ ID NO: 20685 - DNA, 795 bp, Unknown
  Obtained from environmental sample
  misc_feature (1)..(795): n is a, c, g, or t
gtgggctggcagacactagtggatcacagaatcggctcgagagttggcagacacaacaaaataaataatgctttaaatggtcgagtttctggagttcaaattacgaatcaatcaagtacaagttcagcaataagaattagaggaaattcatcgatttctaaaaataaagagcctttatatattgttgatggtgttcctatcaacaataattacaattcaatcattcaagatttggataaagatgatattcaaaaaattaatgtttataaaggaaataaagctaagaatttgtatggaaatgcagcatctaatggttgcattgtaatcactactaaaaaaggaaattacagattagaaaatgaagattcgtatgcacaaattcatgaaaataaatttaaaagagtgcaactttctcctttgtcaactttttctatagatgttgataaagcttcttatagcaacgtaagaagaatgattaataatggcgaaaaagttccttttgatgctgtaaaaattgaggaaatgattaattatttcgattatcaatatccacaanctacagacgaacatcctttttcgatcaacacagaatttgtagaaacaccttggaatgcaactacaaaattggttaaaattggtttgcaaggcaaaacctttgagcaagaagatttaccagcatcaaacttaacttttttgattgatgtgtctggtactatgggtgctcaaaataaattacctttattaaaatcggcttttaagctgttggtaaatcaattaagaaaagagcataaatag

SEQ ID NO: 20686 - protein, 264 aa, Unknown
  Obtained from environmental sample
  misc_feature (1)..(264): Xaa is any amino acid
MGWQTLVDHRIGSRVGRHNKINNALNGRVSGVQITNQSSTSSAIRIRGNSSISKNKEPLYIVDGVPINNNYNSIIQDLDKDDIQKINVYKGNKAKNLYGNAASNGCIVITTKKGNYRLENEDSYAQIHENKFKRVQLSPLSTFSIDVDKASYSNVRRMINNGEKVPFDAVKIEEMINYFDYQYPQXTDEHPFSINTEFVETPWNATTKLVKIGLQGKTFEQEDLPASNLTFLIDVSGTMGAQNKLPLLKSAFKLLVNQLRKEHK

SEQ ID NO: 20687 - DNA, 672 bp, Unknown
  Obtained from environmental sample
  misc_feature (1)..(672): n is a, c, g, or t
ttgggaagtaaaaataaattaaaacgtttcgaagaaaatgaaacgttcaaaaatgtcattcagcctactagagaagaagttattagtgacttctctttaaaaggtaagtggcattctttttttgaaaacgaaaatcctattattgttgagttgggttgtggaaaaggcgaatatacaattgctttggccagaaaaaatccaaacaaaaactatattggaatcgatattaaaggtgctcgtttttggagaggtgcaaaaactgctatcgaagaaaatttaccaaatgttgcgtttataagaacacaaattgaattggtagatttcatttttgcaaaaaatgaggtttcagaaatttggataacttttccagatcctcaaattaaatttcagcgtacaaaacacagaatgacgaattcgaattttatgaaaaaataccgcactattttaaaagaagatggtattatgaatttaaaaaccgattctgaatttatgcatggttacactttaggtttgttgcatggagaaggccatgaaattttatatgcaaatcataatgtgtataaaaatgaaggtgctccaaaagaagttacagaaacgcaaaccttttacgaaaaccaatatttagaagttaataagccaattacatacattcaattccggattgaagtatag

SEQ ID NO: 20688 - protein, 223 aa, Unknown
  Obtained from environmental sample
  DOMAIN (34)...(222): Putative methyltransferase
  misc_feature (1)..(223): Xaa is any amino acid
MGSKNKLKRFEENETFKNVIQPTREEVISDFSLKGKWHSFFENENPIIVELGCGKGEYTIALARKNPNKNYIGIDIKGARFWRGAKTAIEENLPNVAFIRTQIELVDFIFAKNEVSEIWITFPDPQIKFQRTKHRMTNSNFMKKYRTILKEDGIMNLKTDSEFMHGYTLGLLHGEGHEILYANHNVYKNEGAPKEVTETQTFYENQYLEVNKPITYIQFRIEV

SEQ ID NO: 20689 - DNA, 357 bp, Unknown
  Obtained from environmental sample
  misc_feature (1)..(357): n is a, c, g, or t
atgattaatggtgaagctaatgtttgttttttccaacaccttcttcgtaaaaacgaatattattcgcaaaccatggttgattggaaatggcctgagtatgcaacaccaacctatattaaaagtcatattcataatgatgtattagataaatcaaaaagtgaatatgtgttagtaccaactttccgttgcccaacattaatacactcgcgttctggtaacgccaaatggttagtggaaatctctaatagaaatccaatttggatgcatccggatgatgctgcaaaatggggctttaaacccggagatttggtaaaaatgaacacagatatagcctatttcatggataaattttggtaa

SEQ ID NO: 20690 - protein, 118 aa, Unknown
  Obtained from environmental sample
  misc_feature (1)..(118): Xaa is any amino acid
MINGEANVCFFQHLLRKNEYYSQTMVDWKWPEYATPTYIKSHIHNDVLDKSKSEYVLVPTFRCPTLIHSRSGNAKWLVEISNRNPIWMHPDDAAKWGFKPGDLVKMNTDIAYFMDKFW

SEQ ID NO: 20691 - DNA, 381 bp, Unknown
  Obtained from environmental sample
  misc_feature (1)..(381): n is a, c, g, or t
atggctcaaattaattttgtgatggtcagaagtcctaagcttattaaaaataatcagattggctatggttgggcgagcgttaatttttctcagtttgagactatcaaagatttaattgacaaaggcttcaaagacatcgatagaggacgacaaancaaccaaataaagcgctattttaatcttaagcaaggtgactatgtgattgtccctttttctggagcagttgctattgcggaaatagttggcgagaaaagttatcaacctgttaccgaaggcattcagtatggggaaaatagaatatctgtccaatatctaaagcataaggatggttactttatccctagaggtaatttatcaactgccctggaaaacagactttaa

SEQ ID NO: 20692 - protein, 126 aa, Unknown
  Obtained from environmental sample
  misc_feature (1)..(126): Xaa is any amino acid
MAQINFVMVRSPKLIKNNQIGYGWASVNFSQFETIKDLIDKGFKDIDRGRQXNQIKRYFNLKQGDYVIVPFSGAVAIAEIVGEKSYQPVTEGIQYGENRISVQYLKHKDGYFIPRGNLSTALENRL

SEQ ID NO: 20693 - DNA, 963 bp, Unknown
  Obtained from environmental sample
  misc_feature (1)..(963): n is a, c, g, or t
ttggggccagttttcaaaaaaccggggggaaaatttaaaaacggacttttctatttcaggaaggtttatgacaccagccccggtttggaagtggggatgaaaaacggattgcttttcaaagtgatcggtttggaaataacgatgtgttcactattccatcaaaaggggggcacacctaaccggatcacttatcattcagcgaatgaccaagtaactgattttacagcagataatgatattatttttactactgccagaaattttgttcaattagaacgggaacttgaaatccattcggttaacgcaaatggtggtacccctttcagattattaaatgctgttgggtttgacgcaaccctttcccttaataaaaaatttattgcctttacccgcggttcttgtagaattgaacgtgaagcgtatcaaggtcctgccaacagagacctttggctttatgacataataaatgacaagtataatcaattgaccacgtttaatggtcaagatctttcgccacaatgggcagacgacaatacaatttatttccaatcagcaagaagtggtaaatacaatgtccataaattatctattgatgaaaatggaaataaaacaggagagatcacacaaatatcttctttaaaagatatgggattattttcttttgacctaagcaaaaatgggaatgacattgtgatggtttctggcgataaagtttggcttttagacacgaaaacaaagaatgctatacctttttcaataattattaacagtgattacagatttgatccggtagttagaaaaacttttactgaagatgcatcagaaatagaggtgtcacctgacggtaaatacagtgcattagtaataagaggtgaaatttttataactgaaaatgacagtaaaaaaagcagaactgtaaatgtttctgtttctccttataaagataatgaggtggttggctga

SEQ ID NO: 20694 - protein, 320 aa, Unknown
  Obtained from environmental sample
  misc_feature (1)..(320): Xaa is any amino acid
MGPVFKKPGGKFKNGLFYFRKVYDTSPGLEVGMKNGLLFKVIGLEITMCSLFHQKGGTPNRITYHSANDQVTDFTADNDIIFTTARNFVQLERELEIHSVNANGGTPFRLLNAVGFDATLSLNKKFIAFTRGSCRIEREAYQGPANRDLWLYDIINDKYNQLTTFNGQDLSPQWADDNTIYFQSARSGKYNVHKLSIDENGNKTGEITQISSLKDMGLFSFDLSKNGNDIVMVSGDKVWLLDTKTKNAIPFSIIINSDYRFDPVVRKTFTEDASEIEVSPDGKYSALVIRGEIFITENDSKKSRTVNVSVSPYKDNEVVG

SEQ ID NO: 20695 - DNA, 327 bp, Unknown
  Obtained from environmental sample
  misc_feature (1)..(327): n is a, c, g, or t
ttggcattcattagaaaaaacaaaaaactgaatatgaaaagaataattattttagcatttattgcattatcaattaactcttacggacaatctgaaaaacaaattgactctttgaattatgctcatatgaaaattgcagttccagagaattgcgaagcaaaatcagagtacgaattattagactgcgacggaatttcaattcaatggctgtacctaaatgatgaaatgctgaaaactgtaccaaatcaatttattggacaattcacaaatcaaaagacaactaaaaaacggactgaaataaaatgtagctcctcgaccgattcttga

SEQ ID NO: 20696 - protein, 108 aa, Unknown
  Obtained from environmental sample
  misc_feature (1)..(108): Xaa is any amino acid
MAFIRKNKKLNMKRIIILAFIALSINSYGQSEKQIDSLNYAHMKIAVPENCEAKSEYELLDCDGISIQWLYLNDEMLKTVPNQFIGQFTNQKTTKKRTEIKCSSSTDS

SEQ ID NO: 20697 - DNA, 579 bp, Unknown
  Obtained from environmental sample
  misc_feature (1)..(579): n is a, c, g, or t
ttggaaccgattcacaatattgaaaaatggttttcttggatggacgaactcgctgagcaaaactatgtagttattgatgattttatagataacaatctttataaagaaattaaaaaattcctttttgataaattagatgcttttgaccaagcaggaattggtgctcttgatcaaaatatcattaaaaaaacaattcgtggagacaaaacgtattggttaaataaagaacgagattctgaaattaaagatttttgggacttattagccgaaacaaaaaacacgttgaatagatattgttatttaagtttatctggtgacgaatttcatctggctcattatccttctggaggatattatgcaagacatttagatcaatttgatgggcgaaataacagaatgatttccatgattatttatcttaatgaaaattggcagccaggaaatggtgggcaattacaaattttagataaaaacagagaactacaattagtagaaccaattgcaaaacgttgtgtctcatttaacagtgatcaagtgccacatgcagttctaaaatctttcaaagataggtatagttaa

SEQ ID NO: 20698 - protein, 192 aa, Unknown
  Obtained from environmental sample
  misc_feature (1)..(192): Xaa is any amino acid
MEPIHNIEKWFSWMDELAEQNYVVIDDFIDNNLYKEIKKFLFDKLDAFDQAGIGALDQNIIKKTIRGDKTYWLNKERDSEIKDFWDLLAETKNTLNRYCYLSLSGDEFHLAHYPSGGYYARHLDQFDGRNNRMISMIIYLNENWQPGNGGQLQILDKNRELQLVEPIAKRCVSFNSDQVPHAVLKSFKDRYS

SEQ ID NO: 20699 - DNA, 882 bp, Unknown
  Obtained from environmental sample
  misc_feature (1)..(882): n is a, c, g, or t
gtgcatatggttcaggatacagtagtgcaagtgcagtttttggatgaaaaatttactgtagacaccaaagaaaacggacgctataaagcgaaaatcaccattggcgcctacggcaaacgcactaacctagacgttagtttaaatcgtacgtttatcaaaaataaatcgccttatttagccgtaaaaacgcatgtaaaaggcgactttcctaatgatatggtggcgttacataattttgaagggggttactgtggggtgtctaaagtggagggtgacagtattaatgtgtgttatatcaccaatttagcagcgtttaaaaaatataaggacattgaggagtttcaacaacaggtactttataaaaacaagcacataaaaacgatttttgaaaataccacgccagtgtttgatatcccattaaccatcagccagatttcgtttgaccgcaaaccaccggtagaagagcatatgatcatgtgtggcgattccgcgggaatgattcaccctctgtgtggcaacggtatgagtatggctattagaagtgctcaaatggcctcaggccttattcttgactattttgaacataccatttccagaagcactttagaagtatcctacgcgaaagcttggaatcaaaatttcaaaaatcggttgaaagttggtcatttcgtttctaaattattcaacaatagtacactttcagaaacagcgcttattacactaaaaaaaatgcccttcttgatgccttttattattaagcaaacccacgggaaaaccgatgcttgtaaaatgagttttttaatcgacactaggcatcggactgaagcggaagaaatcatggatgatttttcattcatggccctgtactttatgatacgctaa

SEQ ID NO: 20700 - protein, 293 aa, Unknown
  Obtained from environmental sample
  misc_feature (1)..(293): Xaa is any amino acid
MHMVQDTVVQVQFLDEKFTVDTKENGRYKAKITIGAYGKRTNLDVSLNRTFIKNKSPYLAVKTHVKGDFPNDMVALHNFEGGYCGVSKVEGDSINVCYITNLAAFKKYKDIEEFQQQVLYKNKHIKTIFENTTPVFDIPLTISQISFDRKPPVEEHMIMCGDSAGMIHPLCGNGMSMAIRSAQMASGLILDYFEHTISRSTLEVSYAKAWNQNFKNRLKVGHFVSKLFNNSTLSETALITLKKMPFLMPFIIKQTHGKTDACKMSFLIDTRHRTEAEEIMDDFSFMALYFMIR

SEQ ID NO: 20701 - DNA, 501 bp, Unknown
  Obtained from environmental sample
  misc_feature (1)..(501): n is a, c, g, or t
atgaaagtaaaaataactgccgttgccaagcaattgccaaaatattctagagacacaaaggacatcattccgtatttaaacgtgtggctagatgggcaggaggagcgctttcaacgtaaagtgatcaaattgtttgaaaatgcaggggtagataagcggtattctattatggatgcggaagaagtgtttttgaatagctctttcgaagaaaaaaatgacatttatatccgagaagttataaccttaggagaacaagccttattgaaatcgttagaaaaagccaagcttcagccaactgatattgactatatcatcacggtcagttgtacaggcattatgattccgtccttagatgcctatctgatcaatcggttaaaaatgcgacaggatattatccgtttgccagtaactgaaatgggttgtgccgcaggagtttcagggattatttatgccaagaactttttaaaatccaatccctcgagccgatctgatcactggtaa

SEQ ID NO: 20702 - protein, 166 aa, Unknown
  Obtained from environmental sample
  DOMAIN (2)...(165): Chalcone and stilbene synthases, N-terminal domain
  misc_feature (1)..(166): Xaa is any amino acid
MKVKITAVAKQLPKYSRDTKDIIPYLNVWLDGQEERFQRKVIKLFENAGVDKRYSIMDAEEVFLNSSFEEKNDIYIREVITLGEQALLKSLEKAKLQPTDIDYIITVSCTGIMIPSLDAYLINRLKMRQDIIRLPVTEMGCAAGVSGIIYAKNFLKSNPSSRSDHW

SEQ ID NO: 20703 - DNA, 639 bp, Unknown
  Obtained from environmental sample
  misc_feature (1)..(639): n is a, c, g, or t
ttggcttgtgcttggcggaaagttactcgcacatttgcccgctacttgccatatacaaacacgttatgtgcaaggcgaaaaaaaatccgaactaataagaatatgagttttttaaaatcaatatttagtacaaaagaggaacctataaactcgtactctgatttttggaaatggtttgaacagaacgaaaaaaaattctataaagttcttaaagaccaagggaacataaacaaagtgttttttgacagacttgccccaaaactaaacgaattaaaagatggattttggtttcttgctggaatgtatgatgataacacagcagaattaattttaacagctgatggtgtaataaaaaacattgcatttgttgaggaattggcacagtctgcaccgaaaatgaataattggaaaattacagcgctcaaacaaccatctgacttaaatcaattcggaattgaaatggacggctataaatttgacgaaagtaaaatgagcttctattcgactgaccataaacaaatgccagatgagattgacattacaattactcataaagattttaacgaagaaaacagagccgtaatgacaaatggaatttaccttgctttggacaattctcttggcgaattaaattcataa

SEQ ID NO: 20704 - protein, 212 aa, Unknown
  Obtained from environmental sample
  misc_feature (1)..(212): Xaa is any amino acid
MACAWRKVTRTFARYLPYTNTLCARRKKIRTNKNMSFLKSIFSTKEEPINSYSDFWKWFEQNEKKFYKVLKDQGNINKVFFDRLAPKLNELKDGFWFLAGMYDDNTAELILTADGVIKNIAFVEELAQSAPKMNNWKITALKQPSDLNQFGIEMDGYKFDESKMSFYSTDHKQMPDEIDITITHKDFNEENRAVMTNGIYLALDNSLGELNS

SEQ ID NO: 20705 - DNA, 324 bp, Unknown
  Obtained from environmental sample
  misc_feature (1)..(324): n is a, c, g, or t
ttgatttttgtaaatatattaatttatttttgtgatatgcaaaatttaccaaacgacaaatcgcttattctttttgatggtgtatgcaacctttgcaacacatcaatacaatttgttataaaacacgatacaaaaaacaagtatctatttgctcctttacaaagtaatattggtcagtccattatccagaaatataacttggatacaagcaaaacagactctatattactctattccaatactaaaggcttaaaggttaaatctactgctgctttagtaatagccacacacttgggatttccgataaatatgttaggtgtataa

SEQ ID NO: 20706 - protein, 107 aa, Unknown
  Obtained from environmental sample
  DOMAIN (16)...(105): Protein of unknown function, DUF393
  misc_feature (1)..(107): Xaa is any amino acid
MIFVNILIYFCDMQNLPNDKSLILFDGVCNLCNTSIQFVIKHDTKNKYLFAPLQSNIGQSIIQKYNLDTSKTDSILLYSNTKGLKVKSTAALVIATHLGFPINMLGV

SEQ ID NO: 20707 - DNA, 411 bp, Unknown
  Obtained from environmental sample
  misc_feature (1)..(411): n is a, c, g, or t
gtgggattattaattggtcagaaacttttttcgaacatctcttttcgaagatcacctaaaaaatttaaagaaaaaattgtagcttctaaagtttctggagaagataatggtgtaagttttaatagggcagaagattcaaatatcgatttatatgaaaatagtattgaggttttcaacgatttggtttcgccaatttctggcaatgcttttagttattataattataaattagaaggaactttttatgataataatggcaaactcatcaataaaattaatgtgttgccaaaacgtaaaaacgaccgaatttttgaaggttcaatttacattgtagaagatgattgggctttgtatggctctgatttaacaacgactggtaaacaggtaaatcttccttttgtaactctttag

SEQ ID NO: 20708 - protein, 136 aa, Unknown
  Obtained from environmental sample
  misc_feature (1)..(136): Xaa is any amino acid
MGLLIGQKLFSNISFRRSPKKFKEKIVASKVSGEDNGVSFNRAEDSNIDLYENSIEVFNDLVSPISGNAFSYYNYKLEGTFYDNNGKLINKINVLPKRKNDRIFEGSIYIVEDDWALYGSDLTTTGKQVNLPFVTL

SEQ ID NO: 20709 - DNA, 684 bp, Unknown
  Obtained from environmental sample
  misc_feature (1)..(684): n is a, c, g, or t
atggaaagaagaacctgttttcaatttatgaaaaaaaaatctcatatctattttgtccctggcttagctgctagttctacaatttttgaaaatttagatctgcctaaagagcaatttgaaattcattatttagattggttggtgccaatatccttaaatgaaagtatcagtgattatgccaaacgaatgtgtgagaatattttgcataaaagccctatttggatcggtgtctcttttggtggcgttatggtacaagaaatgagtaaaatcatttctacaaagaaaatagttattatttctagtgttaaatcaaaaaatgaattacctagacgattacgggttgcaaaaactactaaagcctataaactgttccctacgaaggttgttacaaatctcgaacaatttgctaactacgcttccggagaaacagtaaaaaaaaggatagatctataccgtaaatatttatctatgcgggatgaaaattacctaccttgggcaattcgcattatttccaattggcaacaagaagaacctaatccagaaacaatacatattcatggaagtaatgacggtatttttccaattaaacacatcaaaaaatgtcttcttattaaagggggaacacatgttatgatttcgaataaagccactgaaattactaatttattaattgaagttatttag

SEQ ID NO: 20710 - protein, 227 aa, Unknown
  Obtained from environmental sample
  misc_feature (1)..(227): Xaa is any amino acid
MERRTCFQFMKKKSHIYFVPGLAASSTIFENLDLPKEQFEIHYLDWLVPISLNESISDYAKRMCENILHKSPIWIGVSFGGVMVQEMSKIISTKKIVIISSVKSKNELPRRLRVAKTTKAYKLFPTKVVTNLEQFANYASGETVKKRIDLYRKYLSMRDENYLPWAIRIISNWQQEEPNPETIHIHGSNDGIFPIKHIKKCLLIKGGTHVMISNKATEITNLLIEVI

SEQ ID NO: 20711 - DNA, 711 bp, Unknown
  Obtained from environmental sample
  misc_feature (1)..(711): n is a, c, g, or t
atgagcagttgtcctatcttagcagagagagacagcttgagcattggttatgattggttcgtacgggggtcaaaagttagtcaagccagccgagaaatgatagaaatatggcaaaggaagatgaagttcactaccaatgatttggttgagtcagcaatattctgcagcattgtctacggtggtcttaatgatattgaggtattaaaagcattttacgaatggcttttggctgaacgcgaagtctatagaatagatttacctagtgaaggtaatacggtaggtgttgagagtgtgccgattattctattagttattgacgatgatagttatgggtgttgggagtcatctagtagaaactcaagtgatacgtctgacagcgaattaaaacgctatgttgagtatgttccagatgacatgacgctatgctttttatacgcactaaaagatggaattgttaaaaagggacttactaaatcgtttgatacattaattaatgatattagtaaaaagcttacactgaaaaataaagataaaacaaagccatacctctcacacctgatcaaatacgccaactatcattggaggcaattagaaggcgctaatattgacaatgcattagctacaattagacaaggtagggttaaaactacaggcctacctaagaataagctgcttaattacaacagagaaaaaatcaactctaatatntaa

SEQ ID NO: 20712 - protein, 236 aa, Unknown
  Obtained from environmental sample
  misc_feature (1)..(236): Xaa is any amino acid
MSSCPILAERDSLSIGYDWFVRGSKVSQASREMIEIWQRKMKFTTNDLVESAIFCSIVYGGLNDIEVLKAFYEWLLAEREVYRIDLPSEGNTVGVESVPIILLVIDDDSYGCWESSSRNSSDTSDSELKRYVEYVPDDMTLCFLYALKDGIVKKGLTKSFDTLINDISKKLTLKNKDKTKPYLSHLIKYANYHWRQLEGANIDNALATIRQGRVKTTGLPKNKLLNYNREKINSNX

SEQ ID NO: 20713 - DNA, 999 bp, Unknown
  Obtained from environmental sample
  misc_feature (1)..(999): n is a, c, g, or t
ttgaatcggctcgagaagctaaggtatagatataacttctgttcaggatgtggcgtttgtgcggctacaaaaggttcgccttttaaaatgcatttaacgaagaatggtaattttgagcctatagttatagataaagaattattagataataatgttgtatgcccttttggcgatcatgagcacgatgaaactaaaattgcagatgaaaaattcaaaaataaaaaaaatataagttttgatacacaagttgggtattacaataaaatatatgcaggacatataaataaaggattatatcgacaaaaaggaagttctggaggaagtgtgtcttggttgtgtaatgaactgttagaaaaaaaaattgtagattttgtagtgcatgtaaaagtgtctgaatctaaagacctgatgtatcaatacaatattagttctaacaaagaagaagttcaaaatggagctaaatctagatactatccagtttctttggaaggagttttagaaaaaataaaagaaatagaaggtaggtatttaattgtaggagttccttgttttataaaaggtatcaatttaatcagaaaacaagatgctgtttttcaacaaagaattctattaactgcggcaatattttgtgggcatttaaaaacgacacattatttagaatctattatcagtcaattttctttagacaaatcagaagtagaatcttttgattttagacataagattgaaggaagagtagcgtctgattacggaacaaaaattagtacgaaaacaggaggtgaatataccaagttaaataccgaggattttggcaccaattggggttcgcggatgtctaacttgaaagcctgtgactattgtgatgatgtgattgctgaaacagttgatatctctttggagatgctgcttaccaactatttccatgattttcagtcccacttccttgtacttgaatcaactgtgttaacttttgcgaaccattcattgccaacattttga

SEQ ID NO: 20714 - protein, 332 aa, Unknown
  Obtained from environmental sample
  DOMAIN (174)...(302): Coenzyme F420 hydrogenase/dehydrogenase, beta subunit C terminus
  misc_feature (1)..(332): Xaa is any amino acid
MNRLEKLRYRYNFCSGCGVCAATKGSPFKMHLTKNGNFEPIVIDKELLDNNVVCPFGDHEHDETKIADEKFKNKKNISFDTQVGYYNKIYAGHINKGLYRQKGSSGGSVSWLCNELLEKKIVDFVVHVKVSESKDLMYQYNISSNKEEVQNGAKSRYYPVSLEGVLEKIKEIEGRYLIVGVPCFIKGINLIRKQDAVFQQRILLTAAIFCGHLKTTHYLESIISQFSLDKSEVESFDFRHKIEGRVASDYGTKISTKTGGEYTKLNTEDFGTNWGSRMSNLKACDYCDDVIAETVDISLEMLLTNYFHDFQSHFLVLESTVLTFANHSLPTF

SEQ ID NO: 20715 - DNA, 486 bp, Unknown
  Obtained from environmental sample
  misc_feature (1)..(486): n is a, c, g, or t
ttgaaaaaaacaccaaaaattagcgtaattattccagcatataatgtagggaattatatttcagatactatcaattctgttttaagtcagaattatgatttagaatctatcgaagttattgttgtaaatgatggttccactgatgatactttagaacatattaagcatttttttaaatttaatcaagttatacttcttgatgttgagaacgggggggttagtaaggctagaaatttgggaatacagagatcgtctggagatttcattgcttttctagatggagacgatacatgggaacctcaatttttgacagaaatggtttcttttgcaaagaagaataatttaaaaactgtaagttgtctttacaatagaattgaatctggaattaaaagttatcagatttatacgataccatctaataaagaattatttaaatggtatgtaggatataaaggtatgacaatcaatactaattcttggttataa

SEQ ID NO: 20716 - protein, 161 aa, Unknown
  Obtained from environmental sample
  DOMAIN (8)...(161): Glycosyl transferase
  misc_feature (1)..(161): Xaa is any amino acid
MKKTPKISVIIPAYNVGNYISDTINSVLSQNYDLESIEVIVVNDGSTDDTLEHIKHFFKFNQVILLDVENGGVSKARNLGIQRSSGDFIAFLDGDDTWEPQFLTEMVSFAKKNNLKTVSCLYNRIESGIKSYQIYTIPSNKELFKWYVGYKGMTINTNSWL

SEQ ID NO: 20717 - DNA, 684 bp, Unknown
  Obtained from environmental sample
  misc_feature (1)..(684): n is a, c, g, or t
atgctaatgccccaactcatcttcaaatcggctcctggactttccactcagtatgtgtcaattcttgaagtaggcggtgcatatacgcataaatttaaggaaatattagagtttctaaagctaaaaacactggttgtgacagatatagattctgtagattctgtaaatggagaacgatgtgaagtcaatggtggtatagatggagaattaacatctaatcacacactgaaggattggattcccaaaaagtctaaaatcacagaacttatcgcttgtgaggaaaagaataaaattgaaaataatattgttagagtagcatatcaaacaactgaaaacggtattgtaggtagaagctttgaggaagctttcattaacacgaatctggatcttttaaaatcaaattacaccgacgataaaggcgaggagaaaaatgtgaaaaaccttttcagtttcgcaaaggttaagactcttgagactttaaattctgaaactccatttgaactagcacctacaagttcaagcgcaaaaactaatttggcatttgatgtaatgtccttccctgaagatgatatttcaaattggcaagtcccagtatatatagatgaaggtctgacatggttagaaaaacctatcgatcaaactattactaacgaaatcgttgatgcaactggagaagaagactaa

SEQ ID NO: 20718 - protein, 227 aa, Unknown
  Obtained from environmental sample
  misc_feature (1)..(227): Xaa is any amino acid
MLMPQLIFKSAPGLSTQYVSILEVGGAYTHKFKEILEFLKLKTLVVTDIDSVDSVNGERCEVNGGIDGELTSNHTLKDWIPKKSKITELIACEEKNKIENNIVRVAYQTTENGIVGRSFEEAFINTNLDLLKSNYTDDKGEEKNVKNLFSFAKVKTLETLNSETPFELAPTSSSAKTNLAFDVMSFPEDDISNWQVPVYIDEGLTWLEKPIDQTITNEIVDATGEED

SEQ ID NO: 20719 - DNA, 846 bp, Unknown
  Obtained from environmental sample
  misc_feature (1)..(846): n is a, c, g, or t
atgaaacaggaaataccaaagggtgctgaaaaggaaaaaggtagtgtagagtttataaatagtgaaaattatcctgacaaaattaagggtcaaaaggtaaaagaatatgaagattcattgatgccacaaaaaagtaaaaactatgattacgttataaaggagttagagtcaaaagnctgggaattcggagcaggaagcgaagataaaattctaattatagcaaatagccgtgttgctcgaagaggtggttttggaaaactttacgggatttataatcgtagatttcctcttggtgctgcagatgctctaattaaacgagagcatcctttaacagccctttttgttgggtctatggataaaaaaacatctatagagaggaagactggaatagaacatttagtaaatcattatgataatggttcgtataatgaaatatctagttttttaaaacgtaatggctctcaatcaatcaatttaaaaaagcattccgataagaaggttattaacgaaaaaattgaaggattgataactacaagaaatacaaaatcaactaaagatgttttagattatgcactagaaaacaagcttattgttctttcgaaaggtatgtatagattacaagaaaaggttaataaaaatacagatggactatctgatgatgaaaaggctaaaatagaaaaagagaaaatcttttacgattctgtaatggcattaccctataaagagattatagccctttttgaatacacacaaaatcaaaatgttttttccaccaaacacggtactaaaggagaggaataccgtaatgttctagttgttattgatatactctcggccgattcttga

SEQ ID NO: 20720 - protein, 281 aa, Unknown
  Obtained from environmental sample
  misc_feature (1)..(281): Xaa is any amino acid
MKQEIPKGAEKEKGSVEFINSENYPDKIKGQKVKEYEDSLMPQKSKNYDYVIKELESKXWEFGAGSEDKILIIANSRVARRGGFGKLYGIYNRRFPLGAADALIKREHPLTALFVGSMDKKTSIERKTGIEHLVNHYDNGSYNEISSFLKRNGSQSINLKKHSDKKVINEKIEGLITTRNTKSTKDVLDYALENKLIVLSKGMYRLQEKVNKNTDGLSDDEKAKIEKEKIFYDSVMALPYKEIIALFEYTQNQNVFSTKHGTKGEEYRNVLVVIDILSADS

SEQ ID NO: 20721 - DNA, 687 bp, Unknown
  Obtained from environmental sample
  misc_feature (1)..(687): n is a, c, g, or t
gtgagtcaagatgttaattttgatatcatcaacattaataatttagatataggtgcatttattgaaggttttgaaaaatatgatcttgtattatttcatggtttaagtatttttcaaagtagactaattataaacgcacctaaaagcactaaaattttatggtttttttggggaggagaaatttataatcatccttatgaaccattaggagacatatatggtcaaaagacaagaaaagtttttaaaataaaaacgacttctaattattatattaatcttggtaaaacagtattaagaccattaaaatataaatttttattaaagagattatattttgacaatttaaatgctataaaaagggtaaattatgttagcactcaatttaaagaagattttaataatttactttcgaaaaatcttatcaggaaggatgccgtgaacgtgaaattcacgtattatccgttagaaattatcttcaaaaatgaagtagatcaaatagtcaataataataatattttattaggtaattctgcatcagaaacaaataatcatcttgaagcatttgatttacttaaagatcttaatttaaagaatcgaaaaattattacgccgctaagttatgggaatatgaactatgccggagagataattaacactggaaatagaatgttttctaataatttttaa

SEQ ID NO: 20722 - protein, 228 aa, Unknown
  Obtained from environmental sample
  misc_feature (1)..(228): Xaa is any amino acid
MSQDVNFDIININNLDIGAFIEGFEKYDLVLFHGLSIFQSRLIINAPKSTKILWFFWGGEIYNHPYEPLGDIYGQKTRKVFKIKTTSNYYINLGKTVLRPLKYKFLLKRLYFDNLNAIKRVNYVSTQFKEDFNNLLSKNLIRKDAVNVKFTYYPLEIIFKNEVDQIVNNNNILLGNSASETNNHLEAFDLLKDLNLKNRKIITPLSYGNMNYAGEIINTGNRMFSNNF

SEQ ID NO: 20723 - DNA, 666 bp, Unknown
  Obtained from environmental sample
  misc_feature (1)..(666): n is a, c, g, or t
ttggactttattagtcctaaagtttttaaacaatctttttacagacctaatattgcttatatggtttgtgaagaagaggataagtactttagacttgaagccatattgcttaaaaacaaacaaccctcaattatatatgttagaaacagacgtctaacattagaaataacccaatacctagaaagtaaaaacataagcagcacttactatcatggaggattaaacaatactattaaagaccaacatttaaacgattggttaagtagtaaaaaacaagttatggttgccaccaatgcttttggaatgggaattgataaatctgatgtaaaaacagtaatacatattaacttacctgatagtatagaaagttattttcaagaagcgggacgtgctggtcgtgatgaagctaaagcttatgctgtaattttaaaaaacaacaatgataataatactttaaacaatcagtttttacaagttttaccaacggtagattttgtaaaaattgtttacagaaaactatgtagctattttcaaatatcctatggtgaaggtgcatatcaaacctttgattttaatattaatgagtttagcaaaacttataaatttaacactgtaactacttacaaagccttaaacatattggacaataccagtataataacgcnn

SEQ ID NO: 20724 - protein, 222 aa, Unknown
  Obtained from environmental sample
  DOMAIN (59)...(135): Helicase conserved C-terminal domain
  misc_feature (1)..(222): Xaa is any amino acid
MDFISPKVFKQSFYRPNIAYMVCEEEDKYFRLEAILLKNKQPSIIYVRNRRLTLEITQYLESKNISSTYYHGGLNNTIKDQHLNDWLSSKKQVMVATNAFGMGIDKSDVKTVIHINLPDSIESYFQEAGRAGRDEAKAYAVILKNNNDNNTLNNQFLQVLPTVDFVKIVYRKLCSYFQISYGEGAYQTFDFNINEFSKTYKFNTVTTYKALNILDNTSIITX

SEQ ID NO: 20725 - DNA, 504 bp, Unknown
  Obtained from environmental sample
  misc_feature (1)..(504): n is a, c, g, or t
atgattttgcaaaaggaaattgcaattgatccttctgaaaacgcaggaagcctacatgataaattaatgatgttaggtagtgacttaataatagacactataaaacttattgaaaaaggtgatgtcacaactacaccacagtccgaagatgccatttctagaacagcatataagcttaacagagataactgcaaaatagactttacacaacctatcgaagctatttacaataaaataagaggattaagcccatatcctgctgcttggtgcgaattgcataataatgacgacgttttagatatcaaaatttataaagctgaaaaagaatttgaagaccataatatagaagtaggtacaattattagcaataaatctacacttaaagtagctgttaaagagggttttataactatattagaattaaaattacctggaaaacgaaatatggaagtaaaatctcttttaaatggttataattttgacgaagacgcaaaacttcgctaa

SEQ ID NO: 20726 - protein, 167 aa, Unknown
  Obtained from environmental sample
  DOMAIN (60)...(159): Formyl transferase, C-terminal domain
  misc_feature (1)..(167): Xaa is any amino acid
MILQKEIAIDPSENAGSLHDKLMMLGSDLIIDTIKLIEKGDVTTTPQSEDAISRTAYKLNRDNCKIDFTQPIEAIYNKIRGLSPYPAAWCELHNNDDVLDIKIYKAEKEFEDHNIEVGTIISNKSTLKVAVKEGFITILELKLPGKRNMEVKSLLNGYNFDEDAKLR

SEQ ID NO: 20727 - DNA, 363 bp, Unknown
  Obtained from environmental sample
  misc_feature (1)..(363): n is a, c, g, or t
atgtacggcaatataaaagaacatttacaaaaggaaataattagtattaaaaatgctggtttatacaagtctgaacgtattataacttcatctcaagatgctgaaattaccatctctacaggcgaaaaagtaataaatttttgtgccaataattatttaggactatctaataatgctgaagtaattcaggcggcaaaagatacgttggatacgcacggttatggcatgtcatctgtacgttttatttgcggcacacaagatatccacaaaaaattggaacaaaaaattgctgatttctacgttttgaagataccattttatatgctgcgctttgatccatgcgctcgaccgatcaaactctaa

SEQ ID NO: 20728 - protein, 120 aa, Unknown
  Obtained from environmental sample
  DOMAIN (7)...(71): Aminolevulinic acid synthase domain
  misc_feature (1)..(120): Xaa is any amino acid
MYGNIKEHLQKEIISIKNAGLYKSERIITSSQDAEITISTGEKVINFCANNYLGLSNNAEVIQAAKDTLDTHGYGMSSVRFICGTQDIHKKLEQKIADFYVLKIPFYMLRFDPCARPIKL

SEQ ID NO: 20729 - DNA, 414 bp, Unknown
  Obtained from environmental sample
  misc_feature (1)..(414): n is a, c, g, or t
atgttgatcgaacgcggttcgggtttgttgaaagcgagtttttcaaaaaccgaaaccatagatgaggaaatgatctcaggaatgctcacggccataaaaacctttgttgaggatgcctttaatcagaaaaaccaggagttggaacttattgaatatgaactatacaatatacatatacaaagcttcgtcaactattatgtggcagtggtgatttccggtgcctatagtttgaaggcaaaggataaggttcaggatattattttcgacttttaccataatttcatggagatgaaccttgatcttatctataccagccgtcatctcgaacagccggttgacaccataagcagtaaacttgattccaaaaaagttagcagaataatttgggcatgcaaaaatcttagaagattgtga

SEQ ID NO: 20730 - protein, 137 aa, Unknown
  Obtained from environmental sample
  misc_feature (1)..(137): Xaa is any amino acid
MLIERGSGLLKASFSKTETIDEEMISGMLTAIKTFVEDAFNQKNQELELIEYELYNIHIQSFVNYYVAVVISGAYSLKAKDKVQDIIFDFYHNFMEMNLDLIYTSRHLEQPVDTISSKLDSKKVSRIIWACKNLRRL

SEQ ID NO: 20731 - DNA, 315 bp, Unknown
  Obtained from environmental sample
  misc_feature (1)..(315): n is a, c, g, or t
ttggaattatgttgtaatgttgctcctggagattttgcaaccaatattgcagaaggtagatatcatactccagtttttgatgattctgcttacaaggagaattataaaacgaacttagatttaatgaattctcatgttaatggaggcatggatcctatagaaatggccaaaactatttataaaatcataaatactaaaanacctaaaatacattataaagttggcgattttatgcagaaattttcaattgttttaaaacgaattttaccagataaaatgtatcaaaagttattaatgaatcattataaactttaa

SEQ ID NO: 20732 - protein, 104 aa, Unknown
  Obtained from environmental sample
  misc_feature (1)..(104): Xaa is any amino acid
MELCCNVAPGDFATNIAEGRYHTPVFDDSAYKENYKTNLDLMNSHVNGGMDPIEMAKTIYKIINTKXPKIHYKVGDFMQKFSIVLKRILPDKMYQKLLMNHYKL

SEQ ID NO: 20733 - DNA, 405 bp, Unknown
  Obtained from environmental sample
  misc_feature (1)..(405): n is a, c, g, or t
atgaaaaattacaaagaagtcgttggaatcgatgtttcaaaaaatacgatagatgcttattgttaccactctcaagttcacagggagtttgttaacgatattgtagggtataaaagcttattaaaatgggttttaaaaaccacaaaaggagttgctgttttttactgttttgagaatacaggctattattccttaaaattagcgctgtatctagatagtcaaaagattattcctgtagaagaaagtccattacagattaagcgcagttcaggtatcgtacacgacccgacggatcactccgatgcggcattaatagccgcgtacccgtgggtctaccgagaagaattaaaccaggtccagtaccgagtaagttctcattcaaaattcaggaaattgctagcttaa

SEQ ID NO: 20734 - protein, 134 aa, Unknown
  Obtained from environmental sample
  misc_feature (1)..(134): Xaa is any amino acid
MKNYKEVVGIDVSKNTIDAYCYHSQVHREFVNDIVGYKSLLKWVLKTTKGVAVFYCFENTGYYSLKLALYLDSQKIIPVEESPLQIKRSSGIVHDPTDHSDAALIAAYPWVYREELNQVQYRVSSHSKFRKLLA

SEQ ID NO: 20735 - DNA, 552 bp, Unknown
  Obtained from environmental sample
  misc_feature (1)..(552): n is a, c, g, or t
atgaaactatttgttactctttccgttttatttttttgtgtttttgccactgcgcaagagcaaaacccaaaccataagagtaaaacggttgccttcgaaaaggaaataaaaattgatagcgtaagtataaacccaatttattttttacttagatataaaaacaacacaactatagacacttctttttacgatgtggacttccagaaagctattttaacgtttagaaaacctcttgttacggattcggttgttataaactatgttaaatacccagagtttcttactaaaacgtatcagttatttgacaaatctgttattgtagaaaacaccgataacattaataaaatgtataaaatatcgcaacctaataccgacgacacattttctccttttgatggtttaaccacctccggaagtatttcgcgtggggtaaccattggaaacaatcagaattcggttttagacagtgaactcgatttacaaattacaggaaaattaaacgacaaggtttcccttcgtgcctcgattcaagatgctctcgagccgatctga

SEQ ID NO: 20736 - protein, 183 aa, Unknown
  Obtained from environmental sample
  SIGNAL (1)...(18)
  misc_feature (1)..(183): Xaa is any amino acid
MKLFVTLSVLFFCVFATAQEQNPNHKSKTVAFEKEIKIDSVSINPIYFLLRYKNNTTIDTSFYDVDFQKAILTFRKPLVTDSVVINYVKYPEFLTKTYQLFDKSVIVENTDNINKMYKISQPNTDDTFSPFDGLTTSGSISRGVTIGNNQNSVLDSELDLQITGKLNDKVSLRASIQDALEPI

SEQ ID NO: 20737 - DNA, 345 bp, Unknown
  Obtained from environmental sample
  misc_feature (1)..(345): n is a, c, g, or t
ttgcaggctctttttttatacctttgtgtcatggataaaacaaatcaaatatttggacttagagctattattgaagctttaaatgctggcgaacatgtagataaagtctttttgcaaaaaggacttaaaggcgacttgcttcaagaattagaaaccgtactaaaagacaagagagttaactcgtcttacgttccggntgagaaactaagtagattaccaaaaaccatcaccatgttcatttgccaattgccctgtaagtttatacatcgaggattgttgacatgtgtcaaaaaaatacaccccgtttttaataataatcanttaggtttcaactttgcgcactaa

SEQ ID NO: 20738 - protein, 114 aa, Unknown
  Obtained from environmental sample
  misc_feature (1)..(114): Xaa is any amino acid
MQALFLYLCVMDKTNQIFGLRAIIEALNAGEHVDKVFLQKGLKGDLLQELETVLKDKRVNSSYVPXEKLSRLPKTITMFICQLPCKFIHRGLLTCVKKIHPVFNNNXLGFNFAH

SEQ ID NO: 20739 - DNA, 549 bp, Unknown
  Obtained from environmental sample
  misc_feature (1)..(549): n is a, c, g, or t
ttggctacagattttgattcagaaaaaaatgatgataaacctacagtttctttaatgaccattcatcaatctaaaggattggaatatttatatgtatatgttgttggtttagaggaaaatttatttccatctgccatgagtatgaatacaagaagtgaattagaagaagaacgtagattgttctatgtggctttaaccagagcagaaaaagttgcttatttaacgtatgcacaaacacgttatagatggggtaaattaattgactcagaaccaagtcgttttttagaagaaattgacgatcagtatttacattacataactccaaaggttccagaatcttctgtaaatagatttattgataaaagtatttttgatgatgctccaaaaggaattcgttttcaaaaaccaatacaacgtaaaaaagcagaacgagatatcctaaaaaagaaagaaattattgttcctaaaaacttaaaaaaagtatctcaagcaacatcagcaaaagccaatttatttgcatggcatattgtagctggtaatatccgttga

SEQ ID NO: 20740 - protein, 182 aa, Unknown
  Obtained from environmental sample
  misc_feature (1)..(182): Xaa is any amino acid
MATDFDSEKNDDKPTVSLMTIHQSKGLEYLYVYVVGLEENLFPSAMSMNTRSELEEERRLFYVALTRAEKVAYLTYAQTRYRWGKLIDSEPSRFLEEIDDQYLHYITPKVPESSVNRFIDKSIFDDAPKGIRFQKPIQRKKAERDILKKKEIIVPKNLKKVSQATSAKANLFAWHIVAGNIR

SEQ ID NO: 20741 - DNA, 576 bp, Unknown
  Obtained from environmental sample
  misc_feature (1)..(576): n is a, c, g, or t
atgaccattgagaaaaacataatattagaaagagagactaaaaaaccaatacttattgatgccttctattccaaaaatctaaccaaccagtcaatagttatattttgtcatggatataaaggttttaaagattggggagcttggaacatcatggcagaaatgtttgcacaattgggctgctgctttataaaatttaacttttcacacaacggaggcacaatggaaaacccaattgattttccagacttagaagctttcggaaataacaattactccaaagaattagaagatctggacgctgttataacttggtctcaaaatcgttttgcatctaataaaactataaacattaataacataagtgtgataggtcacagtcgtggtggaggtattgccatacttaaatcttcaatagatacaagaatagcacaacttataacattagccagtgtaagtaattttgaaaatagatttggtactgaagaagctattaaaacttggaaagaagaaggcgttaaatatgttgtaaatggaaagaccaaacaacaaatgcctcattattatcaatttttttga

SEQ ID NO: 20742 - protein, 191 aa, Unknown
  Obtained from environmental sample
  misc_feature (1)..(191): Xaa is any amino acid
MTIEKNIILERETKKPILIDAFYSKNLTNQSIVIFCHGYKGFKDWGAWNIMAEMFAQLGCCFIKFNFSHNGGTMENPIDFPDLEAFGNNNYSKELEDLDAVITWSQNRFASNKTININNISVIGHSRGGGIAILKSSIDTRIAQLITLASVSNFENRFGTEEAIKTWKEEGVKYVVNGKTKQQMPHYYQFF

SEQ ID NO: 20743 - DNA, 795 bp, Unknown
  Obtained from environmental sample
  misc_feature (1)..(795): n is a, c, g, or t
atgaaaaatgtaattgtattattcagtgtcgcatctatggctttcagttgtttttcatctcaaggtttaccagtgaaacaagttgaaaaaaacatcgagcaatcaacttctacaaaaaaaataagcgaagaattgacgtctcaaaatacagcatcacaaagtgatatcgatcattcagaatggaatactcttttaaaaaagtatgtcgctgaaaatggccatgttaattataaaggttttaagaagaatgccgaaaaactaaatacctatatttcctatttagaaaatcaaaaaccgaccgaagaatggagcgttaataagcaactggcttattttataaatgtgtataacgccaataccattaaactaattaccgataattaccccttaaaaagcattaaagatattagtagtccgtggataaaagagcggtttaaaattggtgacaaatcattttctttagcgggattagaaaatggcatacttcgtaaaatgaacgaacccagaatacattttgctattaattgcgcttcaacatcttgtcctaaattattaaacgaagcgtataccgaagctaatgtgatggatttaatggaaaaagcaaccaaagggtttattaataacccttcaaaaaataagttgtctgaaaattcagcaaaaatatcagaaattttaaaatggtataaaagcgattttaccgaaaacggaagcattatcgattatattaataactacagcgctgttaaactaaacgcggataagcctatagattacatcgggtacgattggagttaa

SEQ ID NO: 20744 - protein, 264 aa, Unknown
  Obtained from environmental sample
  SIGNAL (1)...(19)
  DOMAIN (87)...(206): Protein of unknown function, DUF547
  misc_feature (1)..(264): Xaa is any amino acid
MKNVIVLFSVASMAFSCFSSQGLPVKQVEKNIEQSTSTKKISEELTSQNTASQSDIDHSEWNTLLKKYVAENGHVNYKGFKKNAEKLNTYISYLENQKPTEEWSVNKQLAYFINVYNANTIKLITDNYPLKSIKDISSPWIKERFKIGDKSFSLAGLENGILRKMNEPRIHFAINCASTSCPKLLNEAYTEANVMDLMEKATKGFINNPSKNKLSENSAKISEILKWYKSDFTENGSIIDYINNYSAVKLNADKPIDYIGYDWS

SEQ ID NO: 20745 - DNA, 615 bp, Unknown
  Obtained from environmental sample
  misc_feature (1)..(615): n is a, c, g, or t
atgactttcaataaaaaaaacatatccagacgtgattttataaccgtcggaactttaggcctaactgcaactgcaatttatccatcgtctttattttcatcttcatcaactgataaaaataactacgtttcaaaacgtccaccaataaagcaaagaaactttatttcttctgaagttgaaaataccataaaacaaaccaaaggaaaaattaaggatgataaactcaggtggatgtttgaaaactgctacccaaatacccttgacacaaccgtaaaacactctgaaaaggatggtcggcctgatacatttattataactggcgatattgaggctatgtggctaagagactcctctgctcaggtttggccatatcttcaattaatgactgcagacaaaaaattacagttgatgattgccggtttgatcaataggcaaacaaattgtatccaaattgatcgctatgcaaatgcttttaatgacggtccgattggaagttattgggaaacggacaaaacccaatttatgtccaaagagcttcacgaacggaagtgggagatagattccctctgctacccaattcgactcgctatctcgagccgattcttgatccactag

SEQ ID NO: 20746 - protein, 204 aa, Unknown
  Obtained from environmental sample
  DOMAIN (72)...(204): Protein of unknown function (DUF1237)
  misc_feature (1)..(204): Xaa is any amino acid
MTFNKKNISRRDFITVGTLGLTATAIYPSSLFSSSSTDKNNYVSKRPPIKQRNFISSEVENTIKQTKGKIKDDKLRWMFENCYPNTLDTTVKHSEKDGRPDTFIITGDIEAMWLRDSSAQVWPYLQLMTADKKLQLMIAGLINRQTNCIQIDRYANAFNDGPIGSYWETDKTQFMSKELHERKWEIDSLCYPIRLAISSRFLIH

SEQ ID NO: 20747 - DNA, 690 bp, Unknown
  Obtained from environmental sample
  misc_feature (1)..(690): n is a, c, g, or t
atgttggagtcgactgtggataatattagagtgataaatagttttgaaaaaggtttggctaaaagccgaaacatggcaataaaaaatacgattggtcagttatgtttaattgtagacgatgatgttaaatttaaaccagattttgataaaattattttagaagcgtataatagtaatcctaatgcagctattataacttttaaaatggaagattttgaaggtaatttatttaaaaattatcctcaagttaagtgtcatgatttagagtccattaaagaagttaattctgtagtgattacgtttaacactaaattaataaagcaaaacagcctactttttaatgtcaattttggattagggtccacttttgaaaccgcagacgaatatatttttatgcgagaggctttaaaattaaaaatgcagactatatttgagcccaaggtaatattgtcgcatccgttttttagttcaggcaaagactctggaaatgacaaattagtatatgccagaagtgctttatattacaaatattctggtgtattgggatacttaaaactatgtaaatatttatacattgtacataagcaaggtgcaataaaaacaaatcaaattattaaaaaatttaaagtaggtttaaaaggaatttcaacttataaaaatctagttaaattaggaattgaaaagtcttaa

SEQ ID NO: 20748 - protein, 229 aa, Unknown
  Obtained from environmental sample
  misc_feature (1)..(229): Xaa is any amino acid
MLESTVDNIRVINSFEKGLAKSRNMAIKNTIGQLCLIVDDDVKFKPDFDKIILEAYNSNPNAAIITFKMEDFEGNLFKNYPQVKCHDLESIKEVNSVVITFNTKLIKQNSLLFNVNFGLGSTFETADEYIFMREALKLKMQTIFEPKVILSHPFFSSGKDSGNDKLVYARSALYYKYSGVLGYLKLCKYLYIVHKQGAIKTNQIIKKFKVGLKGISTYKNLVKLGIEKS

SEQ ID NO: 20749 - DNA, 540 bp, Unknown
  Obtained from environmental sample
  misc_feature (1)..(540): n is a, c, g, or t
atgataatcgttatagcaccagaacaagatgttcctaatgaaatagaaacgcttcatcagttatttaaagctggtttacaatattatcatttaaggaaaccttttaaaaattatgaagaacacgttgcttacttaaagcaaatagaacctgaatatcacaacctcatcgttgttcattactttcacgagttggtaaacagcttcaatttaaaagggattcatttccaagaacaaaaacggattgacgctttagaaaatagtaaagggtattttaatacgttacaaatggtaggcaaaacaatgagcagttctttttcacgaccccatagatatagaaaactgcgaattcgaatgcgattatcatttactcagcccagtatttcttctatttctaaaaaagatttgaaggcaaggtttaatgtagccactatagatccttatagttggaatggttggatacctcaaagcgcagaaaaacgatgcaataggtataagggtctgggttcagaagtgttggaagcaaacatccgtgaggcnncn

SEQ ID NO: 20750 - protein, 180 aa, Unknown
  Obtained from environmental sample
  misc_feature (1)..(180): Xaa is any amino acid
MIIVIAPEQDVPNEIETLHQLFKAGLQYYHLRKPFKNYEEHVAYLKQIEPEYHNLIVVHYFHELVNSFNLKGIHFQEQKRIDALENSKGYFNTLQMVGKTMSSSFSRPHRYRKLRIRMRLSFTQPSISSISKKDLKARFNVATIDPYSWNGWIPQSAEKRCNRYKGLGSEVLEANIREAX

SEQ ID NO: 20751 - DNA, 657 bp, Unknown
  Obtained from environmental sample
  misc_feature (1)..(657): n is a, c, g, or t
atgattagcaaattacattatataacccaaggagacactccagaaattcatttagaaaacattcaaaaagcctgttcttctgggcctgattggattcagctacgtttaaaatatgtagacgaaaacacgctactcaaaacagcacaaaaagcgagggaactaacttctcattttcaaacgcgtttaattattaatgaccattataagattgcgaaagaagttaaagcagacggcgtccatttaggtcaaaccgacgcttgcccaatagaagtccgtgagtatcttggcaaattctatagcattgatggtacagccaacacattggaagattgtgaaaatcttataaaaaaaaaggttgattatattggtcttgggccgtataaattcacatcaactaaaacaaatttaagtccgattttaggattagaaggctatcaaactattttagatgccttaaaaacagatacgccaattattgctattggtggtattactttaagtgaggtatcaactattttagatactggtgtttttggcattgctgtttcagaagaaatcaccaaagacttcaataccattagcgcatttaatcaaataataaatggtccaacattagaacaacgttacacatttgataaagacaaaaacgatgaatga

SEQ ID NO: 20752 - protein, 218 aa, Unknown
  Obtained from environmental sample
  DOMAIN (2)...(203): Thiamine monophosphate synthase/TENI
  misc_feature (1)..(218): Xaa is any amino acid
MISKLHYITQGDTPEIHLENIQKACSSGPDWIQLRLKYVDENTLLKTAQKARELTSHFQTRLIINDHYKIAKEVKADGVHLGQTDACPIEVREYLGKFYSIDGTANTLEDCENLIKKKVDYIGLGPYKFTSTKTNLSPILGLEGYQTILDALKTDTPIIAIGGITLSEVSTILDTGVFGIAVSEEITKDFNTISAFNQIINGPTLEQRYTFDKDKNDE

SEQ ID NO: 20753 - DNA, 549 bp, Unknown
  Obtained from environmental sample
  misc_feature (1)..(549): n is a, c, g, or t
atgagcacttcaggaatcgctattattggctcgggccccacagcactttattgtttaaaacatattttagatatgcgtaatagtatactaaaacgctataaaaatatttcaatttttgaaagcggtaaaaaaatgggtgtgggaatgccttataatgaagacactaccgatatatttaatttatctaatatttcttcagaagaaattccagaattaacacaaaccttaaccgaatggttacgtcttcaaactaaggacgaactttctcgtctcaatataacggattttcctatcgaaaaaagcaaagtgtatagtcgcttagctttaggagcttattttcatagtcaatacaaggtgttaattcccagattaaaagaggcgggatttactatagaagaatttacgcaaagcaaagttaccgacctcattgacgacaataaaaatacgattacagtcgttgccaacaacacttcgactcatttctctaaagtttatattgcgactggccaccattggaatcacgaaaaagacccgcccgaatctgggtaa

SEQ ID NO: 20754 - protein, 182 aa, Unknown
  Obtained from environmental sample
  misc_feature (1)..(182): Xaa is any amino acid
MSTSGIAIIGSGPTALYCLKHILDMRNSILKRYKNISIFESGKKMGVGMPYNEDTTDIFNLSNISSEEIPELTQTLTEWLRLQTKDELSRLNITDFPIEKSKVYSRLALGAYFHSQYKVLIPRLKEAGFTIEEFTQSKVTDLIDDNKNTITVVANNTSTHFSKVYIATGHHWNHEKDPPESG

SEQ ID NO: 20755 - DNA, 483 bp, Unknown
  Obtained from environmental sample
  misc_feature (1)..(483): n is a, c, g, or t
atgatatttaatatgaaaccttatttttctttatcttatttcgtgctgtttttttgtggattgatgagcttaacttcttgtcaaacaaaagagccagctgttcctaaagatttagcagaacagcaagtaattccaaaacttgtgtctgttactgctacaggaagctcttttaaaatcgataaaaatacagttgtagaatatcagtcagaaaatataaaaccaattgcagagtatcttgtaaatttattacaaccagcaactgggtttgattttcctataaagaaaataacatcaaaagatatttcaaatcgtgttgttttaatgctaacagacagcatttctacaatggaaggttatcaattagaaattacagaagaaagtatttttataaaagcaaataaaccagcaggcttattttatggcgtacaaactttacgtcaattattgcctgcaagcatcgaaaaaggagtgaagattttctga

SEQ ID NO: 20756 - protein, 160 aa, Unknown
  Obtained from environmental sample
  misc_feature (1)..(160): Xaa is any amino acid
MIFNMKPYFSLSYFVLFFCGLMSLTSCQTKEPAVPKDLAEQQVIPKLVSVTATGSSFKIDKNTVVEYQSENIKPIAEYLVNLLQPATGFDFPIKKITSKDISNRVVLMLTDSISTMEGYQLEITEESIFIKANKPAGLFYGVQTLRQLLPASIEKGVKIF

SEQ ID NO: 20757 - DNA, 699 bp, Unknown
  Obtained from environmental sample
  misc_feature (1)..(699): n is a, c, g, or t
atgatacctaaaagccatagaggtttacaaaatttcgagtactcaaaagttcatgatacaacttatgattttccacaatttaaacattatccaaggctacaaaaagcgaacaatattgcagctgtggaaattcataaggagttattacttgaagaatatgcagatgaattcaattataagtatattaaaaaagacgcacaaattattgacggaattcattttttgagttataaaaatcaattgaatttatcgattattgcaaaacaaataaatgataaaggttctcattataaagatatttctttaagaaacgcctatgatgtttttttactctctaaaaaaacgacagcaaaatcggcttttaatgattttatcaaccttaaaaatcctttaaactgttttttagcttcttgttatacagtgtttaacaaacctacatctttagaatatattgaaactaaagaaaccaaagaatatattgatttctttaatagaaatatagaaaatgatgctcaaagtagaaagtttcataaaaaaactgaaacaaagctttttataaaacaaagactaaaaattattaaagattcaatttttgataaggaaaaaagaatctggctcataaaaagaacgaccgataaaaattggcagcatgaaaaaatggttcaattaggcttaaaaaaagctaaaccacccctttaa

SEQ ID NO: 20758 - protein, 232 aa, Unknown
  Obtained from environmental sample
  misc_feature (1)..(232): Xaa is any amino acid
MIPKSHRGLQNFEYSKVHDTTYDFPQFKHYPRLQKANNIAAVEIHKELLLEEYADEFNYKYIKKDAQIIDGIHFLSYKNQLNLSIIAKQINDKGSHYKDISLRNAYDVFLLSKKTTAKSAFNDFINLKNPLNCFLASCYTVFNKPTSLEYIETKETKEYIDFFNRNIENDAQSRKFHKKTETKLFIKQRLKIIKDSIFDKEKRIWLIKRTTDKNWQHEKMVQLGLKKAKPPL

SEQ ID NO: 20759 - DNA, 615 bp, Unknown
  Obtained from environmental sample
  misc_feature (1)..(615): n is a, c, g, or t
gtgtgttatcgttataaaaatgaaaatttaagggtacccgcatctaatgaaacctgtattgtatttatgggtaactctataactgaaggttggagtcaacatcatcctgaattttttataggtaagccttatatcaatcgtggtattggcggtcaaacaaccccccatatgttaatccgtttcagacaagatgtaatcgatctaaaccctaaagttgttgtcatattagcgggtactaacgatatagctggtaataccggcccaacgactcttaaaatgatttatgataacatcatttcaatgactgaaattgctcataccaatggtattaaagtaattatttcttcggtcttgccagcttttgattatccatggaaaccgggactaaatcctgataaaaaaattcctaaattgaatgaaatgctaaaaagatatgctgaaattaacgatattgtatatctcaattactttaccgccatggctgacgaacataatggattaaaaaaggagtatggttctgacggtgttcatccaaacaaaacaggttataaagttatggaaccacttgtcgaggaagcaatttcaaaagctttaaaacacaatggaactagataa

SEQ ID NO: 20760 - protein, 204 aa, Unknown
  Obtained from environmental sample
  DOMAIN (20)...(190): GDSL-like Lipase/Acylhydrolase
  misc_feature (1)..(204): Xaa is any amino acid
MCYRYKNENLRVPASNETCIVFMGNSITEGWSQHHPEFFIGKPYINRGIGGQTTPHMLIRFRQDVIDLNPKVVVILAGTNDIAGNTGPTTLKMIYDNIISMTEIAHTNGIKVIISSVLPAFDYPWKPGLNPDKKIPKLNEMLKRYAEINDIVYLNYFTAMADEHNGLKKEYGSDGVHPNKTGYKVMEPLVEEAISKALKHNGTR

SEQ ID NO: 20761 - DNA, 672 bp, Unknown
  Obtained from environmental sample
  misc_feature (1)..(672): n is a, c, g, or t
atgcctttagcagaagagtctattgaagataaacaaccagaagctaaaactgaagatcgcataaaatacgcacaacaatcaagttacggaacacctgaggttagaaaaaaaacaacacctgcaccagaaaataaagcaccagaggtgaagcctatagtttacaatttagaaagtgaaataaaggaatttgaagttaaagagcctgtagagattattcctgttagtgaaaatacaagttctgggatgaaacgttatgccttggatgattatgaagaaattgattcttcagtgagcacatcaaaaaagaaggaatcagaaattgaaaaagatttcgatgctgaggttgtattcgagaaaaaagtagttcaagaaatcacatctaacgatgctgatgacgatgatttagatccaatgaacagttctatttctgatattttaaaagaaagagcagatgaaagaagacgtaagatgaagaacttcaattataagtttaatgcttcaaaaattgatgaaattgaaaaaactccagcttacaaacgccaaggtttagatttgcaagatgcgcaacattcatcagacattaacacgtcaagaacgagtttaggagtcgatgacaacgacgatatacaactaagaagtaataactcatttctacacgaatacgtagactaa

SEQ ID NO: 20762 - protein, 223 aa, Unknown
  Obtained from environmental sample
  misc_feature (1)..(223): Xaa is any amino acid
MPLAEESIEDKQPEAKTEDRIKYAQQSSYGTPEVRKKTTPAPENKAPEVKPIVYNLESEIKEFEVKEPVEIIPVSENTSSGMKRYALDDYEEIDSSVSTSKKKESEIEKDFDAEVVFEKKVVQEITSNDADDDDLDPMNSSISDILKERADERRRKMKNFNYKFNASKIDEIEKTPAYKRQGLDLQDAQHSSDINTSRTSLGVDDNDDIQLRSNNSFLHEYVD

SEQ ID NO: 20763 - DNA, 663 bp, Unknown
  Obtained from environmental sample
  misc_feature (1)..(663): n is a, c, g, or t
atggaatcaattatgccgaaggaacttttgaggagctttcaaattcgagcgactcaaaggtgcaggcattctttaaaaattaatattatgggaaaatcaacttcacaaaaaataaaggtcggtgtttttgtagtgatcggaacaattcttcttgttgtagcactttattttattggaaaccaacagcatatgttcagtaaaaatattgaaatttatgctactttcgaaaatgtaaacggcttgactttgggtaacaacgtacgttattctggaattaatattggtacggtgagcaaaatagagatgattgatgaaggaaacattaccattcaaatgttggttgaagataaaacttcaaaattcatcaaaaaagacgccattgcttccattagttcagacggtctggttggaagtatggttgtgaatattattccgggaaaagttaaagacgcaaaacccgtaactgcgggtgataccattaagtcttatagtagaattggggccgacgatatgctttccacgttaaacacaaccaatgagaacgctgctttattgactgccgatttattgaagataaccaataaaattcttgaacgccaagggtacttgggtgccttggtttccaatactttgttagagcaaacattcgaaagactgtggtag

SEQ ID NO: 20764 - protein, 220 aa, Unknown
  Obtained from environmental sample
  DOMAIN (40)...(182): mce related protein
  misc_feature (1)..(220): Xaa is any amino acid
MESIMPKELLRSFQIRATQRCRHSLKINIMGKSTSQKIKVGVFVVIGTILLVVALYFIGNQQHMFSKNIEIYATFENVNGLTLGNNVRYSGINIGTVSKIEMIDEGNITIQMLVEDKTSKFIKKDAIASISSDGLVGSMVVNIIPGKVKDAKPVTAGDTIKSYSRIGADDMLSTLNTTNENAALLTADLLKITNKILERQGYLGALVSNTLLEQTFERLW

SEQ ID NO: 20765 - DNA, 336 bp, Unknown
  Obtained from environmental sample
  misc_feature (1)..(336): n is a, c, g, or t
atgaaaatacgatttgaaatttattctattaatcctttgaatagtgaaaaaaaatatattgccgatgcattaaaaaattctcaggatttggcttggacaccagacggaaccatgattatgggaactacggatgcattatataaattaaaacctggagttgataaaaattgggttgaatttgcatctttaaaaccttttggcttaaccggtatcactagattggctgtaagccctttaggaaataaaattgctattgttgttgatgaaatagttgagaatatagatgagtcagatgagtcagatgagtcagatgagtcagatgagtcagatgagtaa

SEQ ID NO: 20766 - protein, 111 aa, Unknown
  Obtained from environmental sample
  misc_feature (1)..(111): Xaa is any amino acid
MKIRFEIYSINPLNSEKKYIADALKNSQDLAWTPDGTMIMGTTDALYKLKPGVDKNWVEFASLKPFGLTGITRLAVSPLGNKIAIVVDEIVENIDESDESDESDESDESDE

SEQ ID NO: 20767 - DNA, 768 bp, Unknown
  Obtained from environmental sample
  misc_feature (1)..(768): n is a, c, g, or t
atgggcgggtattcgagtgagttcgaaatctccctcaatagcggacaagtggtttacgaaacgcttgatccttctaaatacaatgcgcatcgcattcacattttcaaagataaatgggtgtatgtaaaccttgaaaatgacgaacatcctattgataaaaacgatttttctgtgaccattgatggcgaaaagatcaaatttgactgcgttttcaatgctattcacggtacgcctggagaggatggatttatgcaagcctatttagatttggtaaacatcccccaaaccagctgcaatatgtaccaagcggcgctgacatttaataaacgcgattgtttgagcactttaaaaccgtatggtattcagacggcggaatctttttatgtcaatctaggcgatgctattgatgaagacgccatcattgccaaagtaggattgccttgttttgtaaaagccaacaaagcgggaagcagtttcggaatcagtaaagtttataaaaaagaagagttcaaaaaagctctagaaatcgcgtttaaagaggatgacgaagtgattattgagtcgtttttagatggtattgaagtatctgtaggtgtcattacgtataaaggcgaagtgaccgtgctcnctattaccgaaattgtaagtaataatgacttttttgattatcaggccaaatatttaggccaatctcaagaaatcacgccagcgcgattgaaaccgaacaagagaaaaagtcgtgacatgccaaagggtctacaagtttaa

SEQ ID NO: 20768 - protein, 255 aa, Unknown
  Obtained from environmental sample
  DOMAIN (108)...(254): D-ala D-ala ligase C-terminus
  misc_feature (1)..(255): Xaa is any amino acid
MGGYSSEFEISLNSGQVVYETLDPSKYNAHRIHIFKDKWVYVNLENDEHPIDKNDFSVTIDGEKIKFDCVFNAIHGTPGEDGFMQAYLDLVNIPQTSCNMYQAALTFNKRDCLSTLKPYGIQTAESFYVNLGDAIDEDAIIAKVGLPCFVKANKAGSSFGISKVYKKEEFKKALEIAFKEDDEVIIESFLDGIEVSVGVITYKGEVTVLXITEIVSNNDFFDYQAKYLGQSQEITPARLKPNKRKSRDMPKGLQV

SEQ ID NO: 20769 - DNA, 330 bp, Unknown
  Obtained from environmental sample
  misc_feature (1)..(330): n is a, c, g, or t
ttgttaagagtttacagaggtttacctaaaaacaaagcgttaattaaatttttatctcaagaaggaattaaacaaattttacagaaaaccgaaaatacatacatggcagacaacaataagttgatgccagaagtagatgaagatttatggtttgttgttgaagaaaaaaataatcaaattgatttaactgataaaggaattgcacatttatcagaaaaaacacaaaatgataatttctttgttttaccagatattggtgtaaaattggagaaattgatgctgctgaagctacaaaagaagaaaagcttctcaaaaagacgaattatataa

SEQ ID NO: 20770 - protein, 109 aa, Unknown
  Obtained from environmental sample
  misc_feature (1)..(109): Xaa is any amino acid
MLRVYRGLPKNKALIKFLSQEGIKQILQKTENTYMADNNKLMPEVDEDLWFVVEEKNNQIDLTDKGIAHLSEKTQNDNFFVLPDIGVKLEKLMLLKLQKKKSFSKRRII

SEQ ID NO: 20771 - DNA, 648 bp, Unknown
  Obtained from environmental sample
  misc_feature (1)..(648): n is a, c, g, or t
atgaactcgttattagatgtaattaaacgtgagcgtcctgatcatttagcagtttgttttgataaaggcggaagtgctgacagagtcgaaatgtttgaagcctataaagccaatcgtgacgaaacacctgaaggtattaaaactgctgtaccatatatcatggagattttaaaagccatgcatattccaattatggttaaagctggttatgaagcggatgatgttattgggactttagccaagcaagccgaaaaagaaggctaccaaacctttatggtaacacctgataaagattttgcgcaattagttagcgaaaacatttttatgtacagacctgtgtttggtggtggttatgaaacttggggaatcccagaagtacagaaaaaatttgaagtaacagaccctttacaagtcattgactttttaggaatgatgggagatgccagtgataatattcctggtttacctggtgttggagaaaaaaccggtaaaaagtttttagcacaatatggtagcatggaaaacctttttgctaacacacacgagcttaaaggtaaaatgaaagaaaagattgaagncaaccaagagttaggtttactttctaaaaaactagcaaccatcatgcttagacgttcctgtgacatttaa

SEQ ID NO: 20772 - protein, 215 aa, Unknown
  Obtained from environmental sample
  DOMAIN (133)...(214): 5'-3' exonuclease, C-terminal SAM fold
  misc_feature (1)..(215): Xaa is any amino acid
MNSLLDVIKRERPDHLAVCFDKGGSADRVEMFEAYKANRDETPEGIKTAVPYIMEILKAMHIPIMVKAGYEADDVIGTLAKQAEKEGYQTFMVTPDKDFAQLVSENIFMYRPVFGGGYETWGIPEVQKKFEVTDPLQVIDFLGMMGDASDNIPGLPGVGEKTGKKFLAQYGSMENLFANTHELKGKMKEKIEXNQELGLLSKKLATIMLRRSCDI

SEQ ID NO: 20773 - DNA, 675 bp, Unknown
  Obtained from environmental sample
  misc_feature (1)..(675): n is a, c, g, or t
gtgggaagtaaaaataaactaaagcgctttaacgaaaatgaaacatttaataacgtgtttcaaccttcgcgcgacgcactcgttaacgcagagtttgcaccaaaagggaactggcgtgaaactttttttaaaaacaacaaccctttagttttagaattaggttgtggaaaaggagaatactcagtagcattggcaaaaaaatatccgaataaaaactttattggtgtcgacataaaaggcgcacgtttttggagaggagcaaaaacaggtatcgaagaaaagatacctaacgttgcttttttacgcacgcaaattgaattaatagatcacgcatttgcagaaaacgaagtcgacgaaatttggattactttcccagatccacaaataaaatacaagcgtacaaaacacagaatgaccaacgccgaattcttagcacgttataaaaaaatattaaaaccagaaggtgttgttaacctaaaaaccgatagcgaatttatgcacgggtatactttagggttattgcaaggcgctggacacgaggtcttatatgctaaccataatgtgtataaacaagaaggaagcccagaagaagtaacaagcattcaaacctattacgaaggtcagtatttggctcaaaacaaaccaattacgtatattagatttaaaatcaagtaa

SEQ ID NO: 20774 - protein, 224 aa, Unknown
  Obtained from environmental sample
  DOMAIN (38)...(224): Putative methyltransferase
  misc_feature (1)..(224): Xaa is any amino acid
MGSKNKLKRFNENETFNNVFQPSRDALVNAEFAPKGNWRETFFKNNNPLVLELGCGKGEYSVALAKKYPNKNFIGVDIKGARFWRGAKTGIEEKIPNVAFLRTQIELIDHAFAENEVDEIWITFPDPQIKYKRTKHRMTNAEFLARYKKILKPEGVVNLKTDSEFMHGYTLGLLQGAGHEVLYANHNVYKQEGSPEEVTSIQTYYEGQYLAQNKPITYIRFKIK

SEQ ID NO: 20775 - DNA, 531 bp, Unknown
  Obtained from environmental sample
  misc_feature (1)..(531): n is a, c, g, or t
atgaaaatttacgataaaatattacttattttgactttagttttattctataactgtaatgaaaagcaaaatagaattgaaacttctaatatcaaaattgtcgaagttaacactaactataaagaaacagatatttacaaaactttagagaaatcagaattggataaaatcgttggaaaatactatgtagataatttttatcactatttaaaaagtggatttgaactaaaaatcaaaaaaccaaaagatgattttatgctttacacctttgaatttacaaacgatggagaagttatttttaaggacttaactgaattctatgattgcggaaatggaattttatcaattgacaaaggtaaatggaaagcgaaaggaaatggaatttatgaattgactttggacggagaatatgcgcttgaatcgaaattccatactgaatctgaatatagtttagtagatttaaaaaacggaaatattagaatgaaactgaacaagattttagtacataaaacaaacccatcttgggaataa

SEQ ID NO: 20776 - protein, 176 aa, Unknown
  Obtained from environmental sample
  misc_feature (1)..(176): Xaa is any amino acid
MKIYDKILLILTLVLFYNCNEKQNRIETSNIKIVEVNTNYKETDIYKTLEKSELDKIVGKYYVDNFYHYLKSGFELKIKKPKDDFMLYTFEFTNDGEVIFKDLTEFYDCGNGILSIDKGKWKAKGNGIYELTLDGEYALESKFHTESEYSLVDLKNGNIRMKLNKILVHKTNPSWE

SEQ ID NO: 20777 - DNA, 723 bp, Unknown
  Obtained from environmental sample
  misc_feature (1)..(723): n is a, c, g, or t
ttggttattgagccctacaaagactatccagcagacaaagcaggattaaaagctggtgacgaaattacagcagtagatggcacaatactagatggttttgatggtgatgcttcagaccttttaaaaggaacaccaaactctacattagaaattacctataaacgtcaaggaaaaataaatacaaccactgttacacgatctgaaatagaaattgatgctgttcctcacttttccatgatagacgctaaaacaggttatattgtgcttcaaaaatttaacgaaaaagcgtctttacaaactggttatgctttaaaagatttaaaagcacaaggtgcaacacaaataatcttagatttaagaggtaatcctggtggcttattaaacgaagcggttaatgtagttaacctgtttgtaccaaagggacaattagtagttaccacaaaatctaaagtaaaaaaatacaataaaacctattacacatctaaagaacctatagacacaaacatcccagttgtagtattaattgatggtcgcagtgcatctgcatcagagattgtttctgggacactacaagacattgatcgtgcagttatagttgggtctagaagttttggtaaaggactagtacaacgtcctaaaaagctaacttatggtacacaattaaaagtaacaatatcaagatattacacacctttctggaagatgtataccggctttagantt

SEQ ID NO: 20778 - protein, 241 aa, Unknown
  Obtained from environmental sample
  DOMAIN (83)...(241): Peptidase family S41
  misc_feature (1)..(241): Xaa is any amino acid
MVIEPYKDYPADKAGLKAGDEITAVDGTILDGFDGDASDLLKGTPNSTLEITYKRQGKINTTTVTRSEIEIDAVPHFSMIDAKTGYIVLQKFNEKASLQTGYALKDLKAQGATQIILDLRGNPGGLLNEAVNVVNLFVPKGQLVVTTKSKVKKYNKTYYTSKEPIDTNIPVVVLIDGRSASASEIVSGTLQDIDRAVIVGSRSFGKGLVQRPKKLTYGTQLKVTISRYYTPFWKMYTGFRX

SEQ ID NO: 20779 - DNA, 864 bp, Unknown
  Obtained from environmental sample
  misc_feature (1)..(864): n is a, c, g, or t
ttgatcattggaattacgatagacacatcattactgcgctacaaaaanaggggtatagatagttaccatattaaaattggaaattacagacacgcatcggtttttgataaaataacgaacgttattagcaaagtgtttttaaataaaaacttaaaaaaaataagacgccaagattttattgtagacgaattagatcgtttaggatttcaagatcaaatacttgttattaaccccgaagtgattgacttagaccaccatttacaaataaaaaaacggactgcaaaatatagtgcgtatttatacgatagtatggagagaaacccaataactcacttgttggaaggtgtttttgatactatttattcttttgatgtcaacgacgttaagcgatataattttcttcccattacgaattacaattacctttcagaagtaaaaaataaagtaaaggaagtttacgacgcggtttatgtgggatctttagatgatagagttcctttagtgattgagttagcgaagaaatttaaaactatggatttagattttaactgtattgtcttaggaaaaaataaaaaatttaatactcttaaaatagaaggtgcagaatatattgagtttaaagacagctatataacgcaagaccaattaattgaagaatacaaaaaagctaaagttattgttgattttgtacgtgaaaaacaaaccggattgagttttcgattttttgaagccttagcgttaaaaaagaaaatgattaccaataataaaaacgtggttaattactcgttttacaatcctaataatatttttgtaatggaggataataagaccctaccaaaccatactcttctggaccgatcttga

SEQ ID NO: 20780 - protein, 287 aa, Unknown
  Obtained from environmental sample
  misc_feature (1)..(287): Xaa is any amino acid
MIIGITIDTSLLRYKXRGIDSYHIKIGNYRHASVFDKITNVISKVFLNKNLKKIRRQDFIVDELDRLGFQDQILVINPEVIDLDHHLQIKKRTAKYSAYLYDSMERNPITHLLEGVFDTIYSFDVNDVKRYNFLPITNYNYLSEVKNKVKEVYDAVYVGSLDDRVPLVIELAKKFKTMDLDFNCIVLGKNKKFNTLKIEGAEYIEFKDSYITQDQLIEEYKKAKVIVDFVREKQTGLSFRFFEALALKKKMITNNKNVVNYSFYNPNNIFVMEDNKTLPNHTLLDRS

SEQ ID NO: 20781 - DNA, 837 bp, Unknown
  Obtained from environmental sample
  misc_feature (1)..(837): n is a, c, g, or t
atgttagacgaaggtgctaatgtagttagaatcaacttctctcacgcagattataaagacgttgaagaacgtgtaaaaatgatacgagaactaaacgacgagtttggttataatgcttccatattaggagacttgcaaggaccaaaacttcgtgtaggagtgatgaagggagaggtaattgtaaatgcaggagacgagattgtttttgcaacaggtaaacgttttgaagggaccaaagatcgtgtatacatgacttatgaccgttttccgcaggatgcaaaaccaggagaacgtatccttttagatgacggaaaattaatttttgaagtactatcaacagataaaaaatcagaagtaaaagctaaggtaattcaaggtggaccattaaaatctaaaaaaggagttaaccttcctaatacaaatatctctcagccagctttaacagaaaaagacgtcgaagacgctatttttgcatgtaagttaggagtcgattggatggccttatcatttgtgcgtcatgcagaggatttaatgcaattacaagaactaataaaaaaacatagcgatcataaaattccgattattgcaaaaatcgaaaaaccagaagcagtagaaaacatagacaaaattgtagcctattgtgacggattaatggtagcacgtggtgatcttggagtagagattcctgcagaagaagtaccattagttcaaaaacaactagtactacgtgcaaaacgtgccagaataccagtaattataacaacacagatatctcgagccgatcaaagctcaaagaaacccgnnnnnngtgattgcggtagtctgttggtgtcctag

SEQ ID NO: 20782 - protein, 278 aa, Unknown
  Obtained from environmental sample
  DOMAIN (1)...(270): Pyruvate kinase, barrel domain
  misc_feature (1)..(278): Xaa is any amino acid
MLDEGANVVRINFSHADYKDVEERVKMIRELNDEFGYNASILGDLQGPKLRVGVMKGEVIVNAGDEIVFATGKRFEGTKDRVYMTYDRFPQDAKPGERILLDDGKLIFEVLSTDKKSEVKAKVIQGGPLKSKKGVNLPNTNISQPALTEKDVEDAIFACKLGVDWMALSFVRHAEDLMQLQELIKKHSDHKIPIIAKIEKPEAVENIDKIVAYCDGLMVARGDLGVEIPAEEVPLVQKQLVLRAKRARIPVIITTQISRADQSSKKPXXXDCGSLLVS

SEQ ID NO: 20783 - DNA, 345 bp, Unknown
  Obtained from environmental sample
  misc_feature (1)..(345): n is a, c, g, or t
atggatattatgaatgttaaacattgtattttaataatcttgttggttagttattataaggtaaacgcccaaaaagtttatacaactgaagaaggtcatattatgatgatgactttggttgatgataaagccgtcaaggcagaaagccataaattggccttatatcttgattatgattccaaagtggttaacggtgtactcgaccttaagactttatcaacagatattcctgaaatcaataccattttacaacagcgggaaaaccctttaatactacggtttactggcacaattccatcacaagattttttatccaaacggcacgaccctatcaactttaattna

SEQ ID NO: 20784 - protein, 115 aa, Unknown
  Obtained from environmental sample
  misc_feature (1)..(115): Xaa is any amino acid
MDIMNVKHCILIILLVSYYKVNAQKVYTTEEGHIMMMTLVDDKAVKAESHKLALYLDYDSKVVNGVLDLKTLSTDIPEINTILQQRENPLILRFTGTIPSQDFLSKRHDPINFNX

SEQ ID NO: 20785 - DNA, 519 bp, Unknown
  Obtained from environmental sample
  misc_feature (1)..(519): n is a, c, g, or t
atgagggaagcgagagctttgantcggccgagaaaaagattagttggcacttattataaaacaagaaaaaaagatgactttaaagattgtaaatattgcaaatatataaatttcggatatcctgacattaacctaagaaaaaacggctttgaacttttactaaattataatcagcaaaacaacacttccagtggttctttatcaattaaattaaatagtttatatgtagatttatctaataaaatttctatcaaaataggggaattagccgtaaacaataattcctttgcagaaattgtaataactacacaaccatggtttgctgattttagcttttatggtgatgtttattatagtgatgattttattgaatatgccttaactgattttggttatagaaatagagctaaatcgagttatgacttgtatttcaatggatatatcccctttttaaaagagtataaaatcaaaagttcagaaatcattgatttaatagatgaaaaattggtagatgaataa

SEQ ID NO: 20786 - protein, 172 aa, Unknown
  Obtained from environmental sample
  misc_feature (1)..(172): Xaa is any amino acid
MREARALXRPRKRLVGTYYKTRKKDDFKDCKYCKYINFGYPDINLRKNGFELLLNYNQQNNTSSGSLSIKLNSLYVDLSNKISIKIGELAVNNNSFAEIVITTQPWFADFSFYGDVYYSDDFIEYALTDFGYRNRAKSSYDLYFNGYIPFLKEYKIKSSEIIDLIDEKLVDE

SEQ ID NO: 20787 - DNA, 492 bp, Unknown
  Obtained from environmental sample
  misc_feature (1)..(492): n is a, c, g, or t
atggaaaaatttaaaaaacgttgggaaatccaacaaaattggcaactattatttcctgtattaggatttttagcactagcatattctagctataagcttgctaataaaatgattgacaacaacatattcttagttattacttttactataataaccacttcagtattattaaagtttgtattatttctgtttaaaaaactagaaaacaagtgggaagtcacttataaatgggaaatgatacgcatatttatagtatttgcggttactggtagttcttctttatttgtaggaagaccaataatatattggttaggaattactaaagaaaacttaaatattgtggtctattggattttatatattatcattgggctaattttctatcaaataatgttagtcttttttgggtggctgtcagggcagcacaaattcttttgggagattgaaaaaaagatgataagacgttttggtttaggtaaactcgtagattaa

SEQ ID NO: 20788 - protein, 163 aa, Unknown
  Obtained from environmental sample
  misc_feature (1)..(163): Xaa is any amino acid
MEKFKKRWEIQQNWQLLFPVLGFLALAYSSYKLANKMIDNNIFLVITFTIITTSVLLKFVLFLFKKLENKWEVTYKWEMIRIFIVFAVTGSSSLFVGRPIIYWLGITKENLNIVVYWILYIIIGLIFYQIMLVFFGWLSGQHKFFWEIEKKMIRRFGLGKLVD

SEQ ID NO: 20789 - DNA, 387 bp, Unknown
  Obtained from environmental sample
  misc_feature (1)..(387): n is a, c, g, or t
atgtctaattactttgcacaaaccgaagccttaatgaatggtaaaaccgaagctgaagtactctcggaattaaacgcgcaatcactcggagaagatgcgatttctaagctgttgccttttaaagtatttgaaggaaacaagcctacaacttcattactaattcagaaattaacacctgaaagtttgggggaattgattgctatgtacgaacacaaaatctttgtacaaggtattatttggaacatttttagttatgatcaatttggagtagagctcggtaagcagttagcaaaatccattttaaacgaacttaataatgacgccaagagtgcagtacatgatggatctacgcaaaatctattgtcattttttaaggaaaaatgttaa

SEQ ID NO: 20790 - protein, 128 aa, Unknown
  Obtained from environmental sample
  misc_feature (1)..(128): Xaa is any amino acid
MSNYFAQTEALMNGKTEAEVLSELNAQSLGEDAISKLLPFKVFEGNKPTTSLLIQKLTPESLGELIAMYEHKIFVQGIIWNIFSYDQFGVELGKQLAKSILNELNNDAKSAVHDGSTQNLLSFFKEKC

SEQ ID NO: 20791 - DNA, 735 bp, Unknown
  Obtained from environmental sample
  misc_feature (1)..(735): n is a, c, g, or t
ttggtagaattaggcgctggagacggcacaaaaaccaagcaactgttaaaagcgcttgatcaacagcagtataattttgattacgcgcctattgatatttctgaacatgcgctcaaacatttaaaagcctcagtaaattctgaacttcccaaggtcaaaatcagccctaaacagggtgattattttaatgtgttggccgatttaaaacaatctgaagatccaataatcgtattgtttttaggatccaatatcggcaatctccctgatgcacgcgctaaggaatttttacaaaagctaagtgataaccttaaaaatggagatcgtgtagttcttggagtcgatttaattaaaccagaaagcattgtgttacctgcctataatgatgcccaagggattaccaagcgctttaacctcaatttattaacccggattaatagggagctagatgcaaatttcgatatcaatagctttaaacatctacccgagtacactgaaaaagaaggtattgccagaagttttctagtcagcacaaccaaacaaactgtcaccatcaaaaatctgaataagagttttaattttatagagggcgaaaagatccataccgaaaccagtagaaaatataacgatcaaattttaacagacatattagggcaatcgtccttaaaaattatcgatcgtttgacggattctcaaaacctttttgcggactatattttggagaaatgcaaagtctag

SEQ ID NO: 20792 - protein, 244 aa, Unknown
  Obtained from environmental sample
  misc_feature (1)..(244): Xaa is any amino acid
MVELGAGDGTKTKQLLKALDQQQYNFDYAPIDISEHALKHLKASVNSELPKVKISPKQGDYFNVLADLKQSEDPIIVLFLGSNIGNLPDARAKEFLQKLSDNLKNGDRVVLGVDLIKPESIVLPAYNDAQGITKRFNLNLLTRINRELDANFDINSFKHLPEYTEKEGIARSFLVSTTKQTVTIKNLNKSFNFIEGEKIHTETSRKYNDQILTDILGQSSLKIIDRLTDSQNLFADYILEKCKV

SEQ ID NO: 20793 - DNA, 531 bp, Unknown
  Obtained from environmental sample
  misc_feature (1)..(531): n is a, c, g, or t
ttgataaatttcgataattatataattgataaaatttgtgaagcagatgcctcaggcttaacggaatttatgattagtaatagtaaacgatttcaaagattttttcctaaaaccttggcacaaaacctaactttagaggattcaaaaaagtttgcatttctaaaatcacaagaacatgattctaaagtagaatttacctttgtgcttaaagatcaaaatccaattaaaattattgggcttgttattctaaaagaactagattgggataaaaaacaaggcgaatttgcctattgtattgatgctggttttgaagggaaaggtgtgatgagtaaagccgttaaagaattgtcactatatgctctggataagttggaattaagaacattacaaattgttgtgcatgaaagtaataaagggagtgttaaagtagctttaaattgtaattataagtggcataaaaccttacttaatgaatatgcccctcccaatgaatcatcgttagatatggaattatacgaattaataaaatga

SEQ ID NO: 20794 - protein, 176 aa, Unknown
  Obtained from environmental sample
  DOMAIN (69)...(150): Acetyltransferase (GNAT) family
  misc_feature (1)..(176): Xaa is any amino acid
MINFDNYIIDKICEADASGLTEFMISNSKRFQRFFPKTLAQNLTLEDSKKFAFLKSQEHDSKVEFTFVLKDQNPIKIIGLVILKELDWDKKQGEFAYCIDAGFEGKGVMSKAVKELSLYALDKLELRTLQIVVHESNKGSVKVALNCNYKWHKTLLNEYAPPNESSLDMELYELIK

SEQ ID NO: 20795 - DNA, 645 bp, Unknown
  Obtained from environmental sample
  misc_feature (1)..(645): n is a, c, g, or t
ttggtgtttccagaaggcatcaaaaactatagtgaatatatagaaaatcaaacccaactctataatcgtcgtaagcaagcaattgaccaagatgtcagctcactacaaaagatgatggtattagcccagcaagagctgagtatgaatgagccgttattatcgtatggtgatgtgagtcaggctgatatcatcaagttgcgtcggcaagttgctgaaattcaagctcaaattactaacaagcgtaataagtattttgaagaagcacagtcagagatgaccaaagcgcaagaagatttagatactgaacttgaacaattacgcgatcactcacaagtattagaagaaaaaaatctatttgcgccaacagacggtaaagtaaacaatatcctagtgactactatcggcggcgtggttaagcctggcgaaatcatcatgaaaatattgccaaccagtagtgatttgatcgtcgaggctaaaataaagcccgtagacattgcttatgtcaaagagcagcaggatgccactgtaaagcttgatgcttatgattattctatctttggtgctatgaatggtactgtgatctatattagtccagacacattaatggagcaaactccgaaaggggaagagccctattatcgtgnt

SEQ ID NO: 20796 - protein, 215 aa, Unknown
  Obtained from environmental sample
  misc_feature (1)..(215): Xaa is any amino acid
MVFPEGIKNYSEYIENQTQLYNRRKQAIDQDVSSLQKMMVLAQQELSMNEPLLSYGDVSQADIIKLRRQVAEIQAQITNKRNKYFEEAQSEMTKAQEDLDTELEQLRDHSQVLEEKNLFAPTDGKVNNILVTTIGGVVKPGEIIMKILPTSSDLIVEAKIKPVDIAYVKEQQDATVKLDAYDYSIFGAMNGTVIYISPDTLMEQTPKGEEPYYRX

SEQ ID NO: 20797 - DNA, 468 bp, Unknown
  Obtained from environmental sample
  misc_feature (1)..(468): n is a, c, g, or t
ttgtgtatgaaatggcttattgaatttgatgtgccagtgatgtttcattttgaggatacgtatgcacctaatgaaaaagtaaaatattcgcatcttttgcatattgatgatttggctgtagattatccagaattaaaaattgtaatttgtcatgttgggaatccttggattaaggattgtatggaaattgtgtacaaaaacaaaaacgtatatgcagatatttctgggttggttttaggtgatttttcttacaaattcgaacgttacatgaaacaagaaattgaagaaatgattatttatgctggaaatccaaagtacttattatatggtacagattggccaatttctaatatgaaatcgtatttaaaattcatggatcaattagatttaccagatgataaaaaagaattaattctctggaaaaatgctgcagaattgtataagattgatgttaataatttgaaatag

SEQ ID NO: 20798 - protein, 155 aa, Unknown
  Obtained from environmental sample
  misc_feature (1)..(155): Xaa is any amino acid
MCMKWLIEFDVPVMFHFEDTYAPNEKVKYSHLLHIDDLAVDYPELKIVICHVGNPWIKDCMEIVYKNKNVYADISGLVLGDFSYKFERYMKQEIEEMIIYAGNPKYLLYGTDWPISNMKSYLKFMDQLDLPDDKKELILWKNAAELYKIDVNNLK

SEQ ID NO: 20799 - DNA, 702 bp, Unknown
  Obtained from environmental sample
  misc_feature (1)..(702): n is a, c, g, or t
ttggatgttactgcacgttataacgaacctaatgttaaagtttttgaagaagaacgcgnattaacaatgatgttaatggtggacgtttctggttcagaatcttttggaactatcaatcaatttaaaaaagatacagttacagaaattgctgcaactttagctttttctgctactcaaaataacgataaagttggtttaattcttttttctgatgatattgaactttttattcctcccaaaaaaggaaaaagtcacgttttaagaattatcagagaactaatagaatttaaaccaaaaagtaaaaaaacaaatattagtatcgctttaaaatttttatcaagtgtgatgaaaaaaagagccatcgtttttatgctgtcggattttatggataatgattatgagaaaacagcaaaaatagcgagtaaaaaacacgatttaacaggaattagagtttacgacaaacatgatgaggaaattcctaatttaggaatggtaccaatgttagatgcagaaactggcgcgattcaatatgtaaatacatcatcaaaatcaacaagaaatagttacaaagcaaatgctttaagacttactgattattatataaatacgtttaaaaaaagtggtgcaggaaccatcaatacaagagttgacgaaagttatgtaaaaaaattattaggttattttaagtataaaggaaggtag

SEQ ID NO: 20800 - protein, 233 aa, Unknown
  Obtained from environmental sample
  DOMAIN (22)...(178): von Willebrand factor type A domain
  misc_feature (1)..(233): Xaa is any amino acid
MDVTARYNEPNVKVFEEERXLTMMLMVDVSGSESFGTINQFKKDTVTEIAATLAFSATQNNDKVGLILFSDDIELFIPPKKGKSHVLRIIRELIEFKPKSKKTNISIALKFLSSVMKKRAIVFMLSDFMDNDYEKTAKIASKKHDLTGIRVYDKHDEEIPNLGMVPMLDAETGAIQYVNTSSKSTRNSYKANALRLTDYYINTFKKSGAGTINTRVDESYVKKLLGYFKYKGR

SEQ ID NO: 20801 - DNA, 762 bp, Unknown
  Obtained from environmental sample
  misc_feature (1)..(762): n is a, c, g, or t
atggagcgcattaaaatgataatgacgcgaggaaaggatgatccaaaagaaatgtatgatttgttaggtacaaaagacgatagaaaagagttagatagacagtttaaaaatgaaaaatctaactttaaaattgccattgttgtagatatgtggttgactggttttgatgttccctttttagatactatgtatattgataaaccaatacagcagcataatttaatacaaaccatatctagagtaaacagaaagtacaaaacaaaatctaaaggtttagttgtagattatattggatttaaaaaacaaatgaatttggctttaaagcaatattctgcggttgatggtcagaattttgaagatattgaaacttcaatagttgtagtaaaagaccaattagatttattagcaaaactcttctataagtttgatgcatcagattatttttcgggagaaggcagaaaacaattagagtgtttaaataaaggagctgagtttgttcagataaccaaaaatatagaaacgcgttttatgaatattgtaaagcgtttaaaagctgcttatgatatttgttgtggaagtgaagtctttacggacattcaaaaagattatattcatttttacttagccattcgttctattgttttcaaactaacaaagggtaatgctccagatacagcacaaatgaatgttaaagtaagagaactgattaaggaagctttgcaaagtgatggtgtagaagaatcttctggagccgattcttga

SEQ ID NO: 20802 - protein, 253 aa, Unknown
  Obtained from environmental sample
  misc_feature (1)..(253): Xaa is any amino acid
MERIKMIMTRGKDDPKEMYDLLGTKDDRKELDRQFKNEKSNFKIAIVVDMWLTGFDVPFLDTMYIDKPIQQHNLIQTISRVNRKYKTKSKGLVVDYIGFKKQMNLALKQYSAVDGQNFEDIETSIVVVKDQLDLLAKLFYKFDASDYFSGEGRKQLECLNKGAEFVQITKNIETRFMNIVKRLKAAYDICCGSEVFTDIQKDYIHFYLAIRSIVFKLTKGNAPDTAQMNVKVRELIKEALQSDGVEESSGADS

SEQ ID NO: 20803 - DNA, 579 bp, Unknown
  Obtained from environmental sample
  misc_feature (1)..(579): n is a, c, g, or t
atggttggaattttgaatgagaacaatattagatatttcattaggatcaggaataatttcaaaatttattcctatcagaaacaaaaagagatcaaggcattttggttgttcaacaatttaaaaattggtgagttttataactatccaaaaatagtatcactccatggtcaaaaatgttatctatctggtagcaaaacttttgacagagatggtaaaatggagttcctgatcattgtttcgttcaatgtacccgaacaggcaatggtctattacaaacaaaggtggcaaatagaaacccattttagaggattgaaaagtagtggtttcaatattgaagagactcatgtaaccgatttggaaaggttagaaaaactctttctgttaacaatgattgcttttgtctggtgttacaaaatcggtgactttgtggatcagaacattaaaaaaataacaataaaaaaacatggtcgaagagctgtaagcatattcaaatacggcttagactgtttatcaaaatttctttttacaggtaataagccactagaatgcagtctcttcagttttttgtcatgtacttaa

SEQ ID NO: 20804 - protein, 192 aa, Unknown
  Obtained from environmental sample
  misc_feature (1)..(192): Xaa is any amino acid
MVGILNENNIRYFIRIRNNFKIYSYQKQKEIKAFWLFNNLKIGEFYNYPKIVSLHGQKCYLSGSKTFDRDGKMEFLIIVSFNVPEQAMVYYKQRWQIETHFRGLKSSGFNIEETHVTDLERLEKLFLLTMIAFVWCYKIGDFVDQNIKKITIKKHGRRAVSIFKYGLDCLSKFLFTGNKPLECSLFSFLSCT

SEQ ID NO: 20805 - DNA, 567 bp, Unknown
  Obtained from environmental sample
  misc_feature (1)..(567): n is a, c, g, or t
ttgatgttgaaaaaaagtattctactttctattgctgctctgtttatttctagtgccatatacttaggctctgctatttataccttgtatagcaaaaaaatgatttctgttgaccctagactcaaagaagtatctggtattgagtatgataagcataaacgcttatgggctattaacgacagcggcgacgaacctaaactttaccgactcaatgatgatggctcaattgctaaagaaatattagtgactaacgctgaaaatatagattgggaagatatgacccaaaataaatttggtcacttttttttaggtgattttggtaataacaccaatgagcgccgctggcttactatttataaaatagaaaaccccattgatattaaaaccgataccaccgaagctgaaataattaagtttacctaccccgagttagacggtacaccggttgctccagataaccgcaattatgacttagaggcgtttgtagcattaggtaggcacttatatttatttaccaaaaatcgtaccgaacctttgctggctttacactgtctctaccgtgcgtga

SEQ ID NO: 20806 - protein, 188 aa, Unknown
  Obtained from environmental sample
  SIGNAL (1)...(19)
  misc_feature (1)..(188): Xaa is any amino acid
MMLKKSILLSIAALFISSAIYLGSAIYTLYSKKMISVDPRLKEVSGIEYDKHKRLWAINDSGDEPKLYRLNDDGSIAKEILVTNAENIDWEDMTQNKFGHFFLGDFGNNTNERRWLTIYKIENPIDIKTDTTEAEIIKFTYPELDGTPVAPDNRNYDLEAFVALGRHLYLFTKNRTEPLLALHCLYRA

SEQ ID NO: 20807 - DNA, 498 bp, Unknown
  Obtained from environmental sample
  misc_feature (1)..(498): n is a, c, g, or t
ttggataaaataaaaaaggtctgtaaatttataactgtagaaggggactttgccgaaatctatcactatgaagacgttaaagaacggtttttaaaattagtgtcaagcaagaaaaaagccttagtagtaattaatgctaaagcctatgttggctacgattttaataaaattgaattaacatcaaaccataaaaaaaagaccgtaactattagtcattttccgcagccagaaattttgtctatcgagactaatattaattattacgataaaaaagatggctactttaatagatttgaagccacagatttgaccaatttaagcgaggaagctaagcaacatattagagacaaagttccagaaagcggattgtataatgtggctaaaaaagaagctttagaatctttacttcttgttgaaaatattgtagaaactattggttggactttggactattctgctttaaaaattagtgctaaacaagataagttattaaaataa

SEQ ID NO: 20808 - protein, 165 aa, Unknown
  Obtained from environmental sample
  misc_feature (1)..(165): Xaa is any amino acid
MDKIKKVCKFITVEGDFAEIYHYEDVKERFLKLVSSKKKALVVINAKAYVGYDFNKIELTSNHKKKTVTISHFPQPEILSIETNINYYDKKDGYFNRFEATDLTNLSEEAKQHIRDKVPESGLYNVAKKEALESLLLVENIVETIGWTLDYSALKISAKQDKLLK

SEQ ID NO: 20809 - DNA, 435 bp, Unknown
  Obtained from environmental sample
  misc_feature (1)..(435): n is a, c, g, or t
ttgtcttatatgtttaaaaaatatctttttttcgtgttgttttttgttggatatactatccaatcacaaaccatatctacagatttcagaaaaataaatattattgttaaaaaagacacgattcaaattgattctgttgccataaatccacagaaatttaagattttagattccttaaaaaatgatattcctactttggagtatcaaatagattttagcaacgctgttttaattatcaactcaaaaaaatattcgaatattactattgagtattttagaattccagattttatcaccaaaatttacagtccttttgatgaaaaattaattttacaaagcaactcaaaccaaggacaattatatagtttaaccaccaataaaaaagcagcagatttgaagctttttgatggtttgcaaaccagaggttttatnnnn

SEQ ID NO: 20810 - protein, 145 aa, Unknown
  Obtained from environmental sample
  misc_feature (1)..(145): Xaa is any amino acid
MSYMFKKYLFFVLFFVGYTIQSQTISTDFRKINIIVKKDTIQIDSVAINPQKFKILDSLKNDIPTLEYQIDFSNAVLIINSKKYSNITIEYFRIPDFITKIYSPFDEKLILQSNSNQGQLYSLTTNKKAADLKLFDGLQTRGFXX

SEQ ID NO: 20811 - DNA, 675 bp, Unknown
  Obtained from environmental sample
  misc_feature (1)..(675): n is a, c, g, or t
gtgtatggttttgtagatcacaacgacccaaatacttcttatagagaaaatattgacaaaaccgtaaaagccattggaaacaatccagaagttaagaaaaccattttagaaattatgtggcgtaaatttgctgaagcatctaacgaaactacagctaattacattaccgatacctatttattagacatagcaaaagccgataacgacagtaggattcttgatgttattgtcccttttaaaaatatttctctaggtaaaatcgctccagattttgatattacattagataataaaacgactaaactaagcgaattaaatagcgcagaaaattacgttcttctcttttggagtacaacgtgttcacactgtttagatgaagtaccccaactaaaaaagtacttagaaccaattagtgaagaaagcatacaagtgattgcgatagctttagaaaacgacaaaggacattgggaagaaacaataggagattttcctgattttattcacatctatggcgaaggtaaatgggagaatgaaattggaaacaactataacattagcggaacaccgtcttattttatattaaatagcaacaaagaaattatagccaaaccatacgatataaattcggttaaaaatttcttcgatacgcaaagagttanaacatctaaaaaataa

SEQ ID NO: 20812 - protein, 224 aa, Unknown
  Obtained from environmental sample
  misc_feature (1)..(224): Xaa is any amino acid
MYGFVDHNDPNTSYRENIDKTVKAIGNNPEVKKTILEIMWRKFAEASNETTANYITDTYLLDIAKADNDSRILDVIVPFKNISLGKIAPDFDITLDNKTTKLSELNSAENYVLLFWSTTCSHCLDEVPQLKKYLEPISEESIQVIAIALENDKGHWEETIGDFPDFIHIYGEGKWENEIGNNYNISGTPSYFILNSNKEIIAKPYDINSVKNFFDTQRVXTSKK

SEQ ID NO: 20813 - DNA, 543 bp, Unknown
  Obtained from environmental sample
  misc_feature (1)..(543): n is a, c, g, or t
atgacaccaaatgtgtttgtaaatatttctttattgcagcctcacaaagctacagaaaacgatttgccaatcagattatttggtataattccgattttggtagaggatacatccacaaaattagaaccgcaaattaaaatgccagaagaactgaaacctgaaaaagaatttacggtgaaagtatcagaaaaaaacaacaaatcaatgacctatactttggcaattgtggaagaaggattgttagatttaactagatttaaaacgccaaatgcatacgataatttttatgcaagagaagctttgggtgtaaaaacgtgggatatttttgatgatgtaattggagcatattcaggaagtgtagaccaagtttttgccattggtggagatggaaatttagccaaagggaaaaatcaaaaagcaaacagatttaaacctgtagtaaaatttttaggtccttttcagttggaagaaggagcagaaaaatctcataaaattacgttgccaaattatattggatctgtcagaacaatggtgattgcaggn

SEQ ID NO: 20814 - protein, 181 aa, Unknown
  Obtained from environmental sample
  misc_feature (1)..(181): Xaa is any amino acid
MTPNVFVNISLLQPHKATENDLPIRLFGIIPILVEDTSTKLEPQIKMPEELKPEKEFTVKVSEKNNKSMTYTLAIVEEGLLDLTRFKTPNAYDNFYAREALGVKTWDIFDDVIGAYSGSVDQVFAIGGDGNLAKGKNQKANRFKPVVKFLGPFQLEEGAEKSHKITLPNYIGSVRTMVIAG

SEQ ID NO: 20815 - DNA, 471 bp, Unknown
  Obtained from environmental sample
  misc_feature (1)..(471): n is a, c, g, or t
ttggtttgttatagcttgcaagctaatataatttcgcagatgcccacaaagattatagtcagaatagataaggcagacttcgcaaccgttgatttgtttgatatggacagtaaaatagacactggcgcgtacacttcatccatccattgccacaaggttttagtagatgctgagactgacgaattaatctgtttgttttatgatgaaggccatccgcattacaatggaaaagaaattaaatttaaggaatacacctttgctaaagtaaaaagtagtaatggcgtggtccaaaaacgatacaaagtaaaaactcccatagtcttattcgacaaaaaatacagtatttcattgaccttaagtacacgagaagatatgaaatatcccattttaataggtcgaaaatttctgacaaaaaaatttatcgttgatgttacccaaaaagatgtatcttttaacaacaaaaaaaaatag

SEQ ID NO: 20816 - protein, 156 aa, Unknown
  Obtained from environmental sample
  DOMAIN (29)...(153): Protein of unknown function (DUF785)
  misc_feature (1)..(156): Xaa is any amino acid
MVCYSLQANIISQMPTKIIVRIDKADFATVDLFDMDSKIDTGAYTSSIHCHKVLVDAETDELICLFYDEGHPHYNGKEIKFKEYTFAKVKSSNGVVQKRYKVKTPIVLFDKKYSISLTLSTREDMKYPILIGRKFLTKKFIVDVTQKDVSFNNKKK

SEQ ID NO: 20817 - DNA, 312 bp, Unknown
  Obtained from environmental sample
  misc_feature (1)..(312): n is a, c, g, or t
atgcccaaaaagattataggcagaatagataaggcagacttcccaanccttgatttgtttgatattgaccttaaaatagacactggcgcgtacacttcatccatccattggcacaaggttttagtagatgctgagactgacgaattaatctggttgttttatgatgaaggccatccgcattacaatgcgacagaatttaatttacggaatacacctttgctaaagttaaaagtagtaatggcgttgtccaaaaacgattcaagtaaaaactcccatattcttttcggacaaaaatcacgttttcttggnnan

SEQ ID NO: 20818 - protein, 104 aa, Unknown
  Obtained from environmental sample
  misc_feature (1)..(104): Xaa is any amino acid
MPKKIIGRIDKADFPXLDLFDIDLKIDTGAYTSSIHWHKVLVDAETDELIWLFYDEGHPHYNATEFNLRNTPLLKLKVVMALSKNDSSKNSHILFGQKSRFLGX

SEQ ID NO: 20819 - DNA, 627 bp, Unknown
  Obtained from environmental sample
  misc_feature (1)..(627): n is a, c, g, or t
atggtggtatctcaaataaattcacaaataacattattgtatctacaaacaaaagtagaaaaccaatactttgagcgtaaaggcttgggagataaagatattagtcctacaaaaatagcaaacgaacttattggtatgctaaattcagatggtggtgtactagcttttggtgttgcagacaatggtgctatagaagacttaaatacatttacaccagaaaaattaagtaattaccgcaacttaattcacgattttattgagccttttggtaatattcaattagaagaagttaccatatcaggacaccttatttttctgtttcacgtagaccaagatatcgagcgtatatacagacgaaaagacaatgaagatatttatttacgtatcgatgataaaaataaaaagctagatcgtgatgcagttcgtaaactagaatacgacaaacaaataagaaagtttgaagatgagttagaacccaatttcgattttaatgatttagatactaaattattagaacgctacaaacaaaaattgaactataaaggaagtttattagacttgttggtaaaaagacatctggctataaaaaaggaagaccaatatagtataaaaaaagcaggtgtttna

SEQ ID NO: 20820 - protein, 209 aa, Unknown
  Obtained from environmental sample
  DOMAIN (46)...(139): Divergent AAA domain
  misc_feature (1)..(209): Xaa is any amino acid
MVVSQINSQITLLYLQTKVENQYFERKGLGDKDISPTKIANELIGMLNSDGGVLAFGVADNGAIEDLNTFTPEKLSNYRNLIHDFIEPFGNIQLEEVTISGHLIFLFHVDQDIERIYRRKDNEDIYLRIDDKNKKLDRDAVRKLEYDKQIRKFEDELEPNFDFNDLDTKLLERYKQKLNYKGSLLDLLVKRHLAIKKEDQYSIKKAGVX

SEQ ID NO: 20821 - DNA, 510 bp, Unknown
  Obtained from environmental sample
  misc_feature (1)..(510): n is a, c, g, or t
atggttaccaaaagaggcatgggttctggcttgattagcgatgctgaaaaaataaatagtattctgcataaaattcataatgaatctgatattattgtttccatgaaaatgagaatgggttatgaaacacctgaagaaattttagatgttttacctattttagatacctatcctttaaaaaacattgctattcatgcaagaataggaaagcaattatacaaaggtggaaccaatttagaaggtttccagaaatgcttagacaatagcaaacacaaaatgtattataatggtgatatcacttctgttgcagcatttaaaaaattacaaaaacgttttacaactatagatcattggatgattggtagaggcttaattgcagatccttttttaccaagtatgataaaaaatgacacctctgaatatccacaaaatagatttgatatttttcaagaatttcacgaacgtatttatgcagaatatgatgcagctctttctggccaactcctataa

SEQ ID NO: 20822 - protein, 169 aa, Unknown
  Obtained from environmental sample
  misc_feature (1)..(169): Xaa is any amino acid
MVTKRGMGSGLISDAEKINSILHKIHNESDIIVSMKMRMGYETPEEILDVLPILDTYPLKNIAIHARIGKQLYKGGTNLEGFQKCLDNSKHKMYYNGDITSVAAFKKLQKRFTTIDHWMIGRGLIADPFLPSMIKNDTSEYPQNRFDIFQEFHERIYAEYDAALSGQLL

SEQ ID NO: 20823 - DNA, 600 bp, Unknown
  Obtained from environmental sample
  misc_feature (1)..(600): n is a, c, g, or t
gtgtatgttgttactttaaaaaaggaagattatcctgaaaacactaaagatgaatattttcctttaatgcaagaagccataggtaatctaaatgaaactattgaaaacttaaatgaagtagcattgtatagtgctttagataaggaagctttagtaccactaaacttattaaaatatagtaacaatgccatgtctaacattacagcagctactatatccaacaatgttgatgttaaaatattaatcgataacaatataactgttaatgcaatacctgcttacttggatagcattttaataaactttttaacaaacgcaattaagtatagaagacaaaatgtaaaccctgaaataacactaaaagcctacaaaactgaagtatataccatattaaaaattagtgataatggtcaaggtattgatttagataaacataaggacaagctatttgggatgtataatgtttttcacaagcataaagactctagaggattagggttatttatagtaaaaaatcaaatagatgcaattggtggtaaaattgaagtagaaagcattgtagatcaaggcactacttttactttatattttaaaaattaa

SEQ ID NO: 20824 - protein, 199 aa, Unknown
  Obtained from environmental sample
  DOMAIN (90)...(198): Histidine kinase-, DNA gyrase B-, and HSP90-like ATPase
  misc_feature (1)..(199): Xaa is any amino acid
MYVVTLKKEDYPENTKDEYFPLMQEAIGNLNETIENLNEVALYSALDKEALVPLNLLKYSNNAMSNITAATISNNVDVKILIDNNITVNAIPAYLDSILINFLTNAIKYRRQNVNPEITLKAYKTEVYTILKISDNGQGIDLDKHKDKLFGMYNVFHKHKDSRGLGLFIVKNQIDAIGGKIEVESIVDQGTTFTLYFKN

SEQ ID NO: 20825 - DNA, 573 bp, Unknown
  Obtained from environmental sample
  misc_feature (1)..(573): n is a, c, g, or t
atgaaattcaaatacttactttattttggaatattagtaatgctaggatgtggttcaagcgatgcagttaaaaaaacatctaagcgcacaacctattataaatgtttagatactattgaagctaaagctaaaatgaaattttacagtatgactattcctgatagttggtgtacttatgtagggtctcatgatgttgtatctcatgctcctaataacttaaaagacttgagagaaaatgaatttaaaaatgggatatatgttatgtctccaaattcagagtcatttaaaagtaaaaacattgaagaagcattagagcgtcattttttaagtgttaaaaatgcttcgtttttaacgccaaaggttaggtcacaagtgcatccaatttatggaaaatattatattgttacatcaaaaagtattacagatggtttcaaagtaattagattgtcaaccttatttaatcacaacaacaaagactatttaatctattattctgttattgaaaaagatgtcgatacttatattgaagacgctatgtcaattattgagacctttaaaattatagagcaataa

SEQ ID NO: 20826 - protein, 190 aa, Unknown
  Obtained from environmental sample
  misc_feature (1)..(190): Xaa is any amino acid
MKFKYLLYFGILVMLGCGSSDAVKKTSKRTTYYKCLDTIEAKAKMKFYSMTIPDSWCTYVGSHDVVSHAPNNLKDLRENEFKNGIYVMSPNSESFKSKNIEEALERHFLSVKNASFLTPKVRSQVHPIYGKYYIVTSKSITDGFKVIRLSTLFNHNNKDYLIYYSVIEKDVDTYIEDAMSIIETFKIIEQ

SEQ ID NO: 20827 - DNA, 795 bp, Unknown
  Obtained from environmental sample
  misc_feature (1)..(795): n is a, c, g, or t
gtgttattgtcgttagtggatcaaaaggaaattgaattaaaaaagaccgttaacttagcgcaaaataataaagatcgcagtgcgctgtatttagtaaacacagataaaggacgagagctgtataaaaaaattcgcttagcggtaaacgaaattcaagaccgagaaatgctgtttaaagttagccatttttctaagttagcaaaaataaaaaatgaagctaaaattacctttgttattaccgcagtcactagcggtttgctaattataggcatgtttgtacttacacggttaaatttaagaaatgctgcgcagtatcgtgcagagcttgaaaaacaaaacgaaacgctagctaacaaagtgacagagcgaactcaagagctaacgctttattcagatgagttgagccgcagtaaccgcgagctagaagagtttgcctttgtagcaagccatgacttgcaagagccactgcgtaaaattcaagcatttagtgatcgtctcgaaactatgtttaaagatgagctaggtgaaaaaggcatggattatatagcgcgcatgaaaaatgcagcgcagcgcatgtctaattcaattaatgacttattagagttttcgcgtattaccacccgtggcaaaaattttgttgataccgatttaaataatgtattaaatgatattttaagtgatttagaaattgcaattaaagagtctaatgcacaggttaatgtgggcgatatgccaataattcaggccgaaccaagccagatgcaacagttatttntaaacttaatttcaaacnnt

SEQ ID NO: 20828 - protein, 265 aa, Unknown
  Obtained from environmental sample
  DOMAIN (140)...(208): His Kinase A (phosphoacceptor) domain
  misc_feature (1)..(265): Xaa is any amino acid
MLLSLVDQKEIELKKTVNLAQNNKDRSALYLVNTDKGRELYKKIRLAVNEIQDREMLFKVSHFSKLAKIKNEAKITFVITAVTSGLLIIGMFVLTRLNLRNAAQYRAELEKQNETLANKVTERTQELTLYSDELSRSNRELEEFAFVASHDLQEPLRKIQAFSDRLETMFKDELGEKGMDYIARMKNAAQRMSNSINDLLEFSRITTRGKNFVDTDLNNVLNDILSDLEIAIKESNAQVNVGDMPIIQAEPSQMQQLFXNLISNX

SEQ ID NO: 20829 - DNA, 444 bp, Unknown
  Obtained from environmental sample
  misc_feature (1)..(444): n is a, c, g, or t
ttgttcgaaaaaatatatttggtaacaaatttagtacaagctaagaaccatgggaatgatcaggaaattgaagctataacaggctccgatgaattgaaaaattactccaccgaatcaaaaaaacctgttcaaaaggaaaaaataaaaatcaagcaaaatggatctatgaaaattgctgaattagttgaaaattataaaaaactcgaaggaaaaatagtacaaataagtggaaaatgtgtaaaagtaaatgcaaatataatgggcagaaattggatacacattaaagatggtagcaaagacgattatgatcttgtcattacctcagacacttttgtacccgaaggttcaccgataacaatgaaagctaccgtttctttaaataaagattttggtgctggttatcaatatgatctcattttagaaaatgggattattgtgaagtag

SEQ ID NO: 20830 - protein, 147 aa, Unknown
  Obtained from environmental sample
  misc_feature (1)..(147): Xaa is any amino acid
MFEKIYLVTNLVQAKNHGNDQEIEAITGSDELKNYSTESKKPVQKEKIKIKQNGSMKIAELVENYKKLEGKIVQISGKCVKVNANIMGRNWIHIKDGSKDDYDLVITSDTFVPEGSPITMKATVSLNKDFGAGYQYDLILENGIIVK

SEQ ID NO: 20831 - DNA, 633 bp, Unknown
  Obtained from environmental sample
  misc_feature (1)..(633): n is a, c, g, or t
nnactgccctgtggaacaatacgttatataaacgccgatggccgagtatatggtgatagcatagtcggtattaattctgatatttcaaagcgtattatcgctgaaaacgaagtactaaaactagctcaaaccgattatttaaccgggcttgcaaaccgtaacagcctaacaaagtttgctgaatgtgagtttagaaaagctaaacaagagaacagtaaagtagcttgtttatattttgacttagataaacttaagccaataaacgatactcacggccatatagttggcgattttgtattaaccgtaatagccgatcgtttaaaggatattacccgtaaaacagactgtatcgcgcgtattggcggggatgagttcgttgttataagcaccgatattgaaaacgtcaaccaaatagaaaaacaaataaccagatacttaaacgctattgagttacctattgtgttgcaagataacgaactcttaattacagtgagcattggctatgcgttatatcccgacgaagcagcaaacttagatgagttacttaacaaagcggataaaagaatgtatgaacataaaagtaaaaagcatgatcatgctaataacagccaaccacaagtcaatttaagttga

SEQ ID NO: 20832 - protein, 210 aa, Unknown
  Obtained from environmental sample
  DOMAIN (38)...(199): GGDEF domain
  misc_feature (1)..(210): Xaa is any amino acid
MLPCGTIRYINADGRVYGDSIVGINSDISKRIIAENEVLKLAQTDYLTGLANRNSLTKFAECEFRKAKQENSKVACLYFDLDKLKPINDTHGHIVGDFVLTVIADRLKDITRKTDCIARIGGDEFVVISTDIENVNQIEKQITRYLNAIELPIVLQDNELLITVSIGYALYPDEAANLDELLNKADKRMYEHKSKKHDHANNSQPQVNLS

SEQ ID NO: 20833 - DNA, 699 bp, Unknown
  Obtained from environmental sample
  misc_feature (1)..(699): n is a, c, g, or t
atgctttctaaattagtttcggcttacgaagaaactgcaaaaggaaagaaaactttaatctttaacaatggtattaatacctctattcaggtatttcatgcgtttaaaaaagcaggatatccaattgcacatttagataacaccaacacaaaaaaagaacgtgagcttattttaagatggtttcataaaacaccaggagccattattacgtctgtaagtatcttaaccactggttttgatgaaccaagtattgaggctattattctaaacagagcaacaaaatccttgactttatattaccaaatgattggtcgtggttctcgtatttacaataacacaaatacgtttgatgttattgatttagggaataactttcacagatttggaccttggggagcagatttagattggcagaaaatgtttagagcaccagattattatctgaatgctattttatctgacgaagaaattgaaagtacatttagatacgaattacctgctgatgttaaaaaggagtttgcaaaatctgaagatacttatttcgatatgaaaaaagtatatattgataccattcgttctggagaatcttctaaacgtgttttagaaaaatcgatagtgcaccatgcaaaaatgtgtatagaaaatagtgaagatgtttttgacgcactaatcttagcaaaaatgttaggagaggagnct

SEQ ID NO: 20834 - protein, 233 aa, Unknown
  Obtained from environmental sample
  DOMAIN (34)...(110): Helicase conserved C-terminal domain
  misc_feature (1)..(233): Xaa is any amino acid
MLSKLVSAYEETAKGKKTLIFNNGINTSIQVFHAFKKAGYPIAHLDNTNTKKERELILRWFHKTPGAIITSVSILTTGFDEPSIEAIILNRATKSLTLYYQMIGRGSRIYNNTNTFDVIDLGNNFHRFGPWGADLDWQKMFRAPDYYLNAILSDEEIESTFRYELPADVKKEFAKSEDTYFDMKKVYIDTIRSGESSKRVLEKSIVHHAKMCIENSEDVFDALILAKMLGEEX

SEQ ID NO: 20835 - DNA, 696 bp, Unknown
  Obtained from environmental sample
  misc_feature (1)..(696): n is a, c, g, or t
atggaattaacagccgagtatggtgcaccattaaaatttacctacttaccaaaaatttcagaaaacatcaacaaagcaaaagattggttccagaaagctattgataagcataattataaaggaaaatacttttatagttattgtacaaaaagttctcattttaaacatattttaaatgaagctttaaaaaatgacattcatatagaaacatcctctgcttttgatattgatatagttaacaatcttaaaaaagaaggcaaaataaaagatgatacgtatgtaatttgtaatggttttaaaagagatcaatacataaaaaacatcggagatctaattgagtcaggtcataaaaactgtgttcctataattgataattatgaggagttagcactacttcaaaatgaaactaaaaagaagtttaaggttggtattagaattgcttctgaagaagagcctaaatttgagttttatacttctagattaggaattggctacaaaaacatcgtttctttttacgaaagagaaattgcaaaaaataagcaggtagatttaaaaatgttacatttttttatcaatactggtatcaaagacaatgcttattattggaacgaattgatgaaatgtttaaaagtttacatcaacctaaaaaaagtatgcccaactttagatagtttaaaatctcgagccgattcttga

SEQ ID NO: 20836 - protein, 231 aa, Unknown
  Obtained from environmental sample
  misc_feature (1)..(231): Xaa is any amino acid
MELTAEYGAPLKFTYLPKISENINKAKDWFQKAIDKHNYKGKYFYSYCTKSSHFKHILNEALKNDIHIETSSAFDIDIVNNLKKEGKIKDDTYVICNGFKRDQYIKNIGDLIESGHKNCVPIIDNYEELALLQNETKKKFKVGIRIASEEEPKFEFYTSRLGIGYKNIVSFYEREIAKNKQVDLKMLHFFINTGIKDNAYYWNELMKCLKVYINLKKVCPTLDSLKSRADS

SEQ ID NO: 20837 - DNA, 552 bp, Unknown
  Obtained from environmental sample
  misc_feature (1)..(552): n is a, c, g, or t
atggcagatcaaatgaaaaggaagggaatttctttagatataactaaattaaagcaagagttaaaatctgaggtattattgatcagtgcccgtaagaatttaggaatagtagaacttaaaacggcaattttaaattataaagaagtcgatactacaactattgcgaatattgcaaatcgcgtagattcagagttttttaaaaaagtaaaaagtgagtttaaggaaatgtcgctttacaaagcttggctattaataactcagcaacataattttcccaatattgacccggaattaaaaaagcgtattgatatatttagagatgatattgaaaagttacagaaaatgccgaatacagaaaccattttgcgtcatcagtacattactgatatcctcaaaaaaacgtataccttcgataatgaaaaagcaacaggattacgttttaaactcgcacaaatattaacacatagaattttcggatatgtactatttgcaggaatcttactgttactatttcaatcaatttctgactggaacacgtgtgcctctggatcc

SEQ ID NO: 20838 - protein, 184 aa, Unknown
  Obtained from environmental sample
  DOMAIN (1)...(183): Ferrous iron transport protein B
  misc_feature (1)..(184): Xaa is any amino acid
MADQMKRKGISLDITKLKQELKSEVLLISARKNLGIVELKTAILNYKEVDTTTIANIANRVDSEFFKKVKSEFKEMSLYKAWLLITQQHNFPNIDPELKKRIDIFRDDIEKLQKMPNTETILRHQYITDILKKTYTFDNEKATGLRFKLAQILTHRIFGYVLFAGILLLLFQSISDWNTCASGS

SEQ ID NO: 20839 - DNA, 348 bp, Unknown
  Obtained from environmental sample
  misc_feature (1)..(348): n is a, c, g, or t
ttgatcggtcgagtgtggtggactgttaacagaaaaaaaagtaagttccaattatggaatgcagatgattatgatcacagattacatcctgaaaaattagttaaaatcatagagttgtctgaagaaatatttaacctagaaggtttagatattgaagtagaatatcaaggagaacaaaccattcaaaaatttggtttagaatttaaaaacaatactttccaactgacatcattagttaccgattgtttagcaaaggataaatgcggaatcccagaaccaaaacaaaaactaaaattttcagacatgcaagcaggagactcttgcgcaccaggttctggatgttgctaa

SEQ ID NO: 20840 - protein, 115 aa, Unknown
  Obtained from environmental sample
  misc_feature (1)..(115): Xaa is any amino acid
MIGRVWWTVNRKKSKFQLWNADDYDHRLHPEKLVKIIELSEEIFNLEGLDIEVEYQGEQTIQKFGLEFKNNTFQLTSLVTDCLAKDKCGIPEPKQKLKFSDMQAGDSCAPGSGCC

SEQ ID NO: 20841 - DNA, 480 bp, Unknown
  Obtained from environmental sample
  misc_feature (1)..(480): n is a, c, g, or t
atgcaaatcattaccataaataaagccaatttctcagaagtacaatctatttatcaacagggtattgctactggagttgcaacgtttgaaacagttgtacctgattgggagtattggaataataaccacttacctattggtcgtattttagcaataaaagacgaccaatttttaggttgggcgtctttaagtgctgtttcaaaaagaaaagtatattctggcgttgctgaagttagtgtttatgtgtcaaaacattttagagggcaaaaggttggagatttcctgctaaaaaagctaattaagattagcgaacaaaataatatttggaggctacaagctggaataatgagagcaaatactgctagtctaaaattacacaccaataatcaatttagaattattggctataaagaaaacataggacaattacatggtctgtggatggacaatataatgcttgaaagacgtagtaaaaaagng

SEQ ID NO: 20842 - protein, 160 aa, Unknown
  Obtained from environmental sample
  DOMAIN (49)...(132): Acetyltransferase (GNAT) family
  misc_feature (1)..(160): Xaa is any amino acid
MQIITINKANFSEVQSIYQQGIATGVATFETVVPDWEYWNNNHLPIGRILAIKDDQFLGWASLSAVSKRKVYSGVAEVSVYVSKHFRGQKVGDFLLKKLIKISEQNNIWRLQAGIMRANTASLKLHTNNQFRIIGYKENIGQLHGLWMDNIMLERRSKKX

SEQ ID NO: 20843 - DNA, 783 bp, Unknown
  Obtained from environmental sample
  misc_feature (1)..(783): n is a, c, g, or t
atgatgcaaggaaaaacacacgaaaacattaagactattcgtcccttaaaagacggagtgattgctgattttgatgcttcagagcaaatgattagtatgtttattaaaaatattccggcattaaagaaaaagttttttaatcctgcgttacgtatggtagtttgtattccttccggaattactgaagtcgaaatgcgagcagtaaaagaatcttgtgaacgtgtaaatggtaaagaagtttacttaatacacgagcctatggctgctgctattggtattggtgtagatataatgcaacccaaaggaaacatgattgttgatatcggaggcggtaccacagaaattgctgttattgctcttggaggtattgtatgtgataaatctgtaaaagttgctggtgatgtatttactaacgacattatttattacatgagaacgcagcataacttatatgttggagatagaacggctgaaaaaattaaaattcagattggtgcagctaccgaggatttagaattacctcctgaggatatgagtgttcaaggacgtgatttactaacaggtaaacctaagcaagtacagatttcattccgtgaaatcgctaaagctttagataaatctattttacgtatcgaagactctgttatggaaacattgtctcaaactccaccagagttagccgctgatatttataacacaggtatatatttagncgggtggtggctctatgttaagaggtttagacaaacgtttatctcaaaaaacagattacccgtttactag

SEQ ID NO: 20844 - protein, 260 aa, Unknown
  Obtained from environmental sample
  DOMAIN (1)...(252): MreB/Mbl protein
  misc_feature (1)..(260): Xaa is any amino acid
MMQGKTHENIKTIRPLKDGVIADFDASEQMISMFIKNIPALKKKFFNPALRMVVCIPSGITEVEMRAVKESCERVNGKEVYLIHEPMAAAIGIGVDIMQPKGNMIVDIGGGTTEIAVIALGGIVCDKSVKVAGDVFTNDIIYYMRTQHNLYVGDRTAEKIKIQIGAATEDLELPPEDMSVQGRDLLTGKPKQVQISFREIAKALDKSILRIEDSVMETLSQTPPELAADIYNTGIYLXGWWLYVKRFRQTFISKNRLPVY

SEQ ID NO: 20845 - DNA, 300 bp, Unknown
  Obtained from environmental sample
  misc_feature (1)..(300): n is a, c, g, or t
atgggattttttgatttcctaacggaagaaatagccatagatttaggaaccgcaaatacactgataattcacaatgacaaagttgttgtagacaatccatctatagtcgcaagagaccgcatcagcggaaaaatcatagctgttggtaaagaagccaacatgatgcaaggaaaaacacacgaaaacattaagactattcgtcccttaaaagacggagtgattgctgattttgatgcttcagagcaaatgattagtatgtttattaaacatattccgcgcttcacgaacaagttcttaana

SEQ ID NO: 20846 - protein, 100 aa, Unknown
  Obtained from environmental sample
  DOMAIN (8)...(100): MreB/Mbl protein
  misc_feature (1)..(100): Xaa is any amino acid
MGFFDFLTEEIAIDLGTANTLIIHNDKVVVDNPSIVARDRISGKIIAVGKEANMMQGKTHENIKTIRPLKDGVIADFDASEQMISMFIKHIPRFTNKFLX

SEQ ID NO: 20847 - DNA, 804 bp, Unknown
  Obtained from environmental sample
  misc_feature (1)..(804): n is a, c, g, or t
ttggtgtttccagaaggcatcaaaaactatagtgaatatatagaaaatcaaacccaactctataatcgtcgtaagcaagcaattgaccaagatgtcagctcactacaaaagatgatggtattagcccagcaagagctgagtatgaatgagccgttattatcgtatggtgatgtgagtcaggctgatatcatcaagttgcgtcggcaagttgctgaaattcaagctcaaattactaacaagcgtaataagtattttgaagaagcacagtcagagatgaccaaagcgcaagaagatttagatactgaacttgaacaattacgcgatcactcacaagtattagaagaaaaaaatctatttgcgccaacagacggtaaagtaaacaatatcctagtgactactatcggcggcgtggttaagcctggcgaaatcatcatgaaaatattgccaaccagtagtgatttgatcgtcgaggctaaaataaagcccgtagacattgcttatgtcaaagagcagcaggatgccactgtaaagcttgatgcttatgattattctatctttggtgctatgaatggtactgtgatctatattagtccagacacattaatggagcaaactccgaaaggggaagagccctattatcgtgtacagataaaaattactggtgctgaattttctgggcgcagtgatgagattgtcattaagcctgggatgacagcttccgtcgatattaaggcacagcagcgctcggtactatcatacttaactaagccccatactaagactttctctgagggactagggtga

SEQ ID NO: 20848 - protein, 267 aa, Unknown
  Obtained from environmental sample
  misc_feature (1)..(267): Xaa is any amino acid
MVFPEGIKNYSEYIENQTQLYNRRKQAIDQDVSSLQKMMVLAQQELSMNEPLLSYGDVSQADIIKLRRQVAEIQAQITNKRNKYFEEAQSEMTKAQEDLDTELEQLRDHSQVLEEKNLFAPTDGKVNNILVTTIGGVVKPGEIIMKILPTSSDLIVEAKIKPVDIAYVKEQQDATVKLDAYDYSIFGAMNGTVIYISPDTLMEQTPKGEEPYYRVQIKITGAEFSGRSDEIVIKPGMTASVDIKAQQRSVLSYLTKPHTKTFSEGLG

SEQ ID NO: 20849 - DNA, 627 bp, Unknown
  Obtained from environmental sample
  misc_feature (1)..(627): n is a, c, g, or t
gtgctgggtctctatctatccgaaagtgaaggcgctaatttttggctgagcgtactgactgatttacaaaatcgcggtgtggtagatatcctgattgcctccgtcgacggactgacaggcttcccagaagcaatacaaacaatattcccgcaaaccgaggtccagctctgcattgttcaccaaatacgcaactcactacgctacgtgggctccaagcatcacaaggcattcttggtggatcttaagcatgtttacaaggcattgaacaaagaggcggcagaatcagctctcgacgatcttgaaaaaatctggggcgacaaataccccattgtgattcagtcgtggcgaaagaagtgggataatttatccgtctattttcgctaccctgaagacattcgccgggttatttacacaaccaattcaattgaggcggtgcatcggcagtttcgaaagctgactaaaaccaagggtggctttccgaacgataatagcctgctcaaactgctatatcttggcattcagaacgccagtaagaagtggacgatgccgatccacaagtggaacctgacttatctcaactggccatcttctttgaaggtcgcgttgatgggcgccctcgatctgtga

SEQ ID NO: 20850 - protein, 208 aa, Unknown
  Obtained from environmental sample
  DOMAIN (1)...(183): Transposase, Mutator family
  misc_feature (1)..(208): Xaa is any amino acid
MLGLYLSESEGANFWLSVLTDLQNRGVVDILIASVDGLTGFPEAIQTIFPQTEVQLCIVHQIRNSLRYVGSKHHKAFLVDLKHVYKALNKEAAESALDDLEKIWGDKYPIVIQSWRKKWDNLSVYFRYPEDIRRVIYTTNSIEAVHRQFRKLTKTKGGFPNDNSLLKLLYLGIQNASKKWTMPIHKWNLTYLNWPSSLKVALMGALDL

SEQ ID NO: 20851 - DNA, 807 bp, Unknown
  Obtained from environmental sample
  misc_feature (1)..(807): n is a, c, g, or t
ttgacagagctttttgtaaaggtgctagactacaccataaatcctagtcctaaatataatctcactaccgaatataaaaacgagaaaaacaatcgtaaagcagatggtgccataatagatgatggtaaaactattgcagttgtagaacttaagggaacaaacacaaaagaccttgagagcataagaagacaagcttttgattacaaagtaaatcataaaggctgtcgctttgtcattacctctaattttgaaaaattgcgtttgtacatagatgatgcaacggagcacgaaccctttgatttatttcaactgactttagaagattttagcttattgtatttatgtcttcacaaaaataatttacttaatgccttaccacttaaaatcaaacaagattctattgttaaggaagaagaaatcaccaaggatttctataaggattactcacgctttaaaagggaattgtatcgtgatcttgtaaaacggaataagaaaacgctcaaaattactttagccaatgaacaaggcaaaagcgaagacctagaacagcagggcgatattgaccgtttagagaaaaatgtaaagctaaccttgtttaaaaaatcgcaaaaacttattgatagattcttatttatattttttgctgaagaccgagacctactggatttaaattacaccaaaaaggttttgcaggactggacagaagtgcgcaaactggatgtagatgaagctttgtacacacgttctaaaaaacactttgactacctggacaaaggtcgcacgatgatactggtacaaataaggtaa

SEQ ID NO: 20852 - protein, 268 aa, Unknown
  Obtained from environmental sample
  DOMAIN (25)...(97): Type I restriction enzyme R protein N terminus (HSDR_N)
  misc_feature (1)..(268): Xaa is any amino acid
MTELFVKVLDYTINPSPKYNLTTEYKNEKNNRKADGAIIDDGKTIAVVELKGTNTKDLESIRRQAFDYKVNHKGCRFVITSNFEKLRLYIDDATEHEPFDLFQLTLEDFSLLYLCLHKNNLLNALPLKIKQDSIVKEEEITKDFYKDYSRFKRELYRDLVKRNKKTLKITLANEQGKSEDLEQQGDIDRLEKNVKLTLFKKSQKLIDRFLFIFFAEDRDLLDLNYTKKVLQDWTEVRKLDVDEALYTRSKKHFDYLDKGRTMILVQIR

SEQ ID NO: 20853 - DNA, 684 bp, Unknown
  Obtained from environmental sample
  misc_feature (1)..(684): n is a, c, g, or t
ttgcaggagataagcttttcactgggaaccgctttcgcgaaagtgtttgaaaatggtggttttgatgttgtgattgggaatccgccttggggagcaaaattaccaagtgcagatttaaagtatgttaaatcaaagcatcaagatatcattgttagaatggttgattcgtttatgttttttatggataagtcaattgatattaccaaccaattaggaattattgggatgattataccagatgtaattctataccaaaaagataatactaaactgcgagaaaagattttaaaagaaactcatttgaatatcgcaattaatgtcggcgatggaatttttgatgaagtagcaaggccatcagcgattgttgtttactctaaaacgcaaaacgatagccctagtatcgttggtaatttcaataaatataatgatgtcgacattaatactattgacgtttgtgaggttgaaaaagatctgttttattcaatacctaatacagtatttgcgactcaaaacttaggtggatatgaaattttgaaaagacacaaaagcaagacccttaatgattttattgataaagatggaattcaaagaggtgttagccctgatcttaaagaggcattcatcgtagactctgaaactattaatcgtgagaaattagaaatagattatataaaacagacgtaa

SEQ ID NO: 20854 - protein, 227 aa, Unknown
  Obtained from environmental sample
  misc_feature (1)..(227): Xaa is any amino acid
MQEISFSLGTAFAKVFENGGFDVVIGNPPWGAKLPSADLKYVKSKHQDIIVRMVDSFMFFMDKSIDITNQLGIIGMIIPDVILYQKDNTKLREKILKETHLNIAINVGDGIFDEVARPSAIVVYSKTQNDSPSIVGNFNKYNDVDINTIDVCEVEKDLFYSIPNTVFATQNLGGYEILKRHKSKTLNDFIDKDGIQRGVSPDLKEAFIVDSETINREKLEIDYIKQT

SEQ ID NO: 20855 - DNA, 363 bp, Unknown
  Obtained from environmental sample
  misc_feature (1)..(363): n is a, c, g, or t
atgcgttatttttcatttaatatcacacaatttatatttaaaaaaccaagaatgtataattggataaatggtttaaagttttatgcagaaaaaggcgatgctggtttagttggaaatatctattataaattaatggattatgaagattctatgtttttgatagatagccttaaaaaagatgaattatttgtagacgtaggagcaaatttagggcactttagtttattagcaagcggaatttgtaaagcaaaatctatagctatagagccaataaaaacgactatggataaactgaatagaaatattaaattaaataatttaacctcatacataaactttataaatataggtaattggagataa

SEQ ID NO: 20856 - protein, 120 aa, Unknown
  Obtained from environmental sample
  misc_feature (1)..(120): Xaa is any amino acid
MRYFSFNITQFIFKKPRMYNWINGLKFYAEKGDAGLVGNIYYKLMDYEDSMFLIDSLKKDELFVDVGANLGHFSLLASGICKAKSIAIEPIKTTMDKLNRNIKLNNLTSYINFINIGNWR

SEQ ID NO: 20857 - DNA, 420 bp, Unknown
  Obtained from environmental sample
  misc_feature (1)..(420): n is a, c, g, or t
ttgttttatgatgtaaatggtaagccacatttaaaggatggcaaacatatttctattacccattcgtttacgttttctggagtaattgtgggtgataatgaagtgggtatagatatcgaaaaacaacgggagaaaattcagaaaatagcttctaaatttgtggagtatgaatttgaatatcttaaaaaagatgctaccgattatattaataagttaacggttatttggggagcaaaagaatcgctatacaagctttttgcaacacctggaatgctatttaaaaagcattttttagtcattccgttttgtatgaatgattttgaaaccgtagcgtggattgattacaacggaataaaaaaaaggtataccactaagtttttagagtttgaaggatttacttgtgcttatgccttagaataa

SEQ ID NO: 20858 - protein, 139 aa, Unknown
  Obtained from environmental sample
  misc_feature (1)..(139): Xaa is any amino acid
MFYDVNGKPHLKDGKHISITHSFTFSGVIVGDNEVGIDIEKQREKIQKIASKFVEYEFEYLKKDATDYINKLTVIWGAKESLYKLFATPGMLFKKHFLVIPFCMNDFETVAWIDYNGIKKRYTTKFLEFEGFTCAYALE

SEQ ID NO: 20859 - DNA, 594 bp, Unknown
  Obtained from environmental sample
  misc_feature (1)..(594): n is a, c, g, or t
ttgacgaaaggaagagaatacactactacttatagatacgttaaactagatattgaaaaacggtatatagatatcaatgaaaaatggctcttaacaacctttaaggattcaaataaaaattcaggatatttcgagtttaatccgaaaaataataagggtaaacaattaatagacggggtataccagtattccagtccaattaaagcaaagttaagtgataaacttatttttacgcgtcagtcatttacggaatttccaaatattcaatattcagatttaaactttaaaaggccaacagttataagtaatgccaatccacagcaaaaggattataattggggtactattgaattggtaaaatggacatccttagatggtaaagaacttacaggaatgttggttaaaccggagggttttgattcggctaaaaaatatcctatgatcgtgaatttctatgaaaaaagttcaaatagattgaattcgcacagagcgccttcaccgggtaggtcaacaataaactatagtttttatgccagccgagggtatctcatttttaaccatgatgtttattataaaattggctatacctggtga

SEQ ID NO: 20860 - protein, 197 aa, Unknown
  Obtained from environmental sample
  misc_feature (1)..(197): Xaa is any amino acid
MTKGREYTTTYRYVKLDIEKRYIDINEKWLLTTFKDSNKNSGYFEFNPKNNKGKQLIDGVYQYSSPIKAKLSDKLIFTRQSFTEFPNIQYSDLNFKRPTVISNANPQQKDYNWGTIELVKWTSLDGKELTGMLVKPEGFDSAKKYPMIVNFYEKSSNRLNSHRAPSPGRSTINYSFYASRGYLIFNHDVYYKIGYTW

SEQ ID NO: 20861 - DNA, 384 bp, Unknown
  Obtained from environmental sample
  misc_feature (1)..(384): n is a, c, g, or t
gtgtttacattttctatgcatggcaaaaataattatccatttaaaaaagaacaaagcgatttggatattgctttagaaaacaatgttggagacacggaatacctttctattttaaagaacacattacccaaactaattacaaactttcaacctgattttatctattatttatgtggtgtagacgtaattgctacagataaattaggaaaattaggattgacggttacaggctgcaaagcacgtgatcaatttgttttagaaacatgcaaagctaacaacctaccaattatgtgcagtatgggaggaggttacagtcctgacataaaaacaatagtagacgcacacgccaatacgtttagattagcacaagatatatatttttaa

SEQ ID NO: 20862 - protein, 127 aa, Unknown
  Obtained from environmental sample
  misc_feature (1)..(127): Xaa is any amino acid
MFTFSMHGKNNYPFKKEQSDLDIALENNVGDTEYLSILKNTLPKLITNFQPDFIYYLCGVDVIATDKLGKLGLTVTGCKARDQFVLETCKANNLPIMCSMGGGYSPDIKTIVDAHANTFRLAQDIYF

SEQ ID NO: 20863 - DNA, 306 bp, Unknown
  Obtained from environmental sample
  misc_feature (1)..(306): n is a, c, g, or t
ttgttccaaatgaccattatcaacaaaggatccaatctcaaaattggtgctcaaaaacccccaattaaaataattgccatgggaggccttggcgccaagatacattcggtcatgctgatgcttcctttgatagccaccggttacggcatacacagtgccaacgggtacgtcttcaatgattccatccctaaaaatataatcgtcttttataaattgacgagaagcaattcccatacttcccaaataaaacgattcgttagcaaaataaccaacaggatcatattcggcagacgtacttctttatag

SEQ ID NO: 20864 - protein, 101 aa, Unknown
  Obtained from environmental sample
  misc_feature (1)..(101): Xaa is any amino acid
MFQMTIINKGSNLKIGAQKPPIKIIAMGGLGAKIHSVMLMLPLIATGYGIHSANGYVFNDSIPKNIIVFYKLTRSNSHTSQIKRFVSKITNRIIFGRRTSL

SEQ ID NO: 20865 - DNA, 561 bp, Unknown
  Obtained from environmental sample
  misc_feature (1)..(561): n is a, c, g, or t
atgaagtttttaacgcaaccatttataactgagattgagactaaagtcaaacaaagcaattataatgggttttggttaaattacaataactattttatgggtaaagagcttaagcatggtgataaaatgaaaaaattagccttgtgtaaaaaacaggctggcgagtatgaacgtattgaggaagactcatggagtcacttagatatggaagtgcatgagcatccaattattgatggtccaattggtaaaatcacaagtgccattattcataaagattacaaaggattagaacattacatagcaagacacaacgcgtattcttcatgggaagcaaagcgctatttatttcttaaaaaaacaggctttaaaaatttgacatctcgtcaaaaaataaaatataaactaatcaatagtggattattaccaatggtatatttcatgggttcttatgtgcttaaattaggatttttagatggtgtagctggttatcgattagctaaatataaagccaattacttttttcaaattcaaactaaaataatagaactaaaacaaaaataa

SEQ ID NO: 20866 - protein, 186 aa, Unknown
  Obtained from environmental sample
  misc_feature (1)..(186): Xaa is any amino acid
MKFLTQPFITEIETKVKQSNYNGFWLNYNNYFMGKELKHGDKMKKLALCKKQAGEYERIEEDSWSHLDMEVHEHPIIDGPIGKITSAIIHKDYKGLEHYIARHNAYSSWEAKRYLFLKKTGFKNLTSRQKIKYKLINSGLLPMVYFMGSYVLKLGFLDGVAGYRLAKYKANYFFQIQTKIIELKQK

SEQ ID NO: 20867 - DNA, 546 bp, Unknown
  Obtained from environmental sample
  misc_feature (1)..(546): n is a, c, g, or t
ttgtactactcttttgaaacagataaatgtcaagaagaatatcataaatatacagcaaaaaggagtaaaattattattggattaatggtgtatcaaggattaaatacaacagatttaggcaatttaaaagaagaacatttacaattaaacaaaggtaaaatctatgttccaagcaccaaaagaagtaacgcaagagaattagaattaaaaccgtggcaaataatggaatttatcgaatatcaaaatgaagtaagaccaatgctacaaaaacgattagtaaattacagcgaacaactgttcccaatcaatacacgatttaatactataacctatcaaatcactaaaaaactaaaaaagataaatcataaaatcaagaacccgaagcaaataagagcatcagtaattacaaactggttaggtcaatacaacttaagaaaaacgcaatatcttgcaggacatcgttatataagttcaacagaaaagtatttacaagatgatctggaaaatctacacgaaatagtaaacaactttcatccaattagttaa

SEQ ID NO: 20868 - protein, 181 aa, Unknown
  Obtained from environmental sample
  DOMAIN (2)...(172): Phage integrase family
  misc_feature (1)..(181): Xaa is any amino acid
MYYSFETDKCQEEYHKYTAKRSKIIIGLMVYQGLNTTDLGNLKEEHLQLNKGKIYVPSTKRSNARELELKPWQIMEFIEYQNEVRPMLQKRLVNYSEQLFPINTRFNTITYQITKKLKKINHKIKNPKQIRASVITNWLGQYNLRKTQYLAGHRYISSTEKYLQDDLENLHEIVNNFHPIS

SEQ ID NO: 20869 - DNA, 423 bp, Unknown
  Obtained from environmental sample
  misc_feature (1)..(423): n is a, c, g, or t
atgaagcttagtaaattaatagtcctcattttcattattactttcgtagcgtgtattaggcaaagtaataaaattacaaataatcattttactaaggcgattgatgcttacatacaggagaatccattagatttacctattacaaaaaatgtttatagagatggattttcatacccatcatatcagatttattttaatgaaaaaggaggagatactttgatgagtattattcaaactcctcatttgacaaaagttgaattaatagactccataataaatccgaatgatatcgtttataagttattagagccagatggtttttatttgtacaaaaatgaatttcctttgatattttttaactctactaaatatttaaaggatgatattaagaataaaatagttcacgatatccgagatagttaa

SEQ ID NO: 20870 - protein, 140 aa, Unknown
  Obtained from environmental sample
  misc_feature (1)..(140): Xaa is any amino acid
MKLSKLIVLIFIITFVACIRQSNKITNNHFTKAIDAYIQENPLDLPITKNVYRDGFSYPSYQIYFNEKGGDTLMSIIQTPHLTKVELIDSIINPNDIVYKLLEPDGFYLYKNEFPLIFFNSTKYLKDDIKNKIVHDIRDS

SEQ ID NO: 20871 - DNA, 429 bp, Unknown
  Obtained from environmental sample
  misc_feature (1)..(429): n is a, c, g, or t
atggaagaaaacatttancaacaacttcttcaaaaggagatgcctttaaaagtgtttaattttgttgcaaataattcaaatgtagagtggagcttacacaaatttaatgtaagcaatgctaatgttgatctttatcagatagggtcttttcataatcctggcatttcgcctagctttgaatttagcaatataggtgaatggagagggatgatacattcccaccctacctcaattacattgaaagaaagattatcaggtctcccgtatgattcaggagtcgcagttgactatcaaaagagatatggaaaatatccatattatgtctattttccaagtatcaaaaaagcaagtagtattaaatgggttaaagatgctgttggttctgataaagttaggaagacacataatataagtaattataaattttaa

SEQ ID NO: 20872 - protein, 142 aa, Unknown
  Obtained from environmental sample
  misc_feature (1)..(142): Xaa is any amino acid
MEENIXQQLLQKEMPLKVFNFVANNSNVEWSLHKFNVSNANVDLYQIGSFHNPGISPSFEFSNIGEWRGMIHSHPTSITLKERLSGLPYDSGVAVDYQKRYGKYPYYVYFPSIKKASSIKWVKDAVGSDKVRKTHNISNYKF

SEQ ID NO: 20873 - DNA, 798 bp, Unknown
  Obtained from environmental sample
  misc_feature (1)..(798): n is a, c, g, or t
atgaaattgactcagatcaaatccacagtaattataatatttttactagtaggaagcgttgctgtggcacaaaccgaattaaaaaataaagttgtcgactttatgagtatgatgccaattgaaaacgcaagtgtttatattcaaaacacaacaattggtactattacaaatgcagatggtaagtttgtgttattagtgcctaaaacgtacgaaaaggataccattatcatttcttcaattggttttaaaagctacaaaacaacaatagatcagtttgataacgagtttgatattttattagaggaagatgtagcatccttagatgaaattttgattatcgcagaaaacagacccaaaaccggaaacgatattgtacttagagcgctagaaaaattagaaaacaaccttccagaattaccatacttacaaaaaggttttattagacataaagagcgaaataaaaaacaatttaaatggttggttgaaagtgcaattactttgtatgacgattccagttatgtcacaggaggaaaagataatcttaaaataaacgtagatcaggtcaggaaaagttacgatttacgtgatgtagatagtttgttttcatatgctacatatttaaaatataatgccaatgttaatttaaaacctaaaaatttacgaagagatactatcgctaaatcatcactaataaagtctattaaatggaatgatactagagtaaatggtttagataatttctttaacggaaaacttaatttagtacgtatttctaaacgtcaaaagcatgttaggtaa

SEQ ID NO: 20874 - protein, 265 aa, Unknown
  Obtained from environmental sample
  misc_feature (1)..(265): Xaa is any amino acid
MKLTQIKSTVIIIFLLVGSVAVAQTELKNKVVDFMSMMPIENASVYIQNTTIGTITNADGKFVLLVPKTYEKDTIIISSIGFKSYKTTIDQFDNEFDILLEEDVASLDEILIIAENRPKTGNDIVLRALEKLENNLPELPYLQKGFIRHKERNKKQFKWLVESAITLYDDSSYVTGGKDNLKINVDQVRKSYDLRDVDSLFSYATYLKYNANVNLKPKNLRRDTIAKSSLIKSIKWNDTRVNGLDNFFNGKLNLVRISKRQKHVR

SEQ ID NO: 20875 - DNA, 657 bp, Unknown
  Obtained from environmental sample
  misc_feature (1)..(657): n is a, c, g, or t
gtgaatgaagaaattggcaagcttcttgagtttatacataatatacaatcagttaatttagaccgctcatcaccaatgaacatcaaagatgaagagttgaaaaaaattatattatcagatagtcaagctaagaagataattcaagaaaatcatgaattgctcactgaggtacttcgttcggaagtcacaaaagaagatattatttcagtaggatttcgaaagaagcaacttgagtggtatgaaaaattattaaatgactcaaaatggtttgaagaaattaaagacagaaaaaaaacaaccaatgaaggactttggcagtattacttcgagaaaaatccttggatattcggttatggccttggctatattttcatagaaggattagacgacaaaaaactagaacaggtagtgcaaggtcacaacgtaaatagtcatggtaagcgtgttgatgctcttatgaagaccaaaggtattatatcaaacctttgctttgtagagataaaaacgcatacaactcaattgcttgactctaagccatatagaactggttgttgggcaccttcaaaagagttggctggtgcaatcgctcaagtacaaggaacggtagcttctgctgtcgatagtctcactaacaaggttagtgtaaacgataattag

SEQ ID NO: 20876 - protein, 218 aa, Unknown
  Obtained from environmental sample
  misc_feature (1)..(218): Xaa is any amino acid
MNEEIGKLLEFIHNIQSVNLDRSSPMNIKDEELKKIILSDSQAKKIIQENHELLTEVLRSEVTKEDIISVGFRKKQLEWYEKLLNDSKWFEEIKDRKKTTNEGLWQYYFEKNPWIFGYGLGYIFIEGLDDKKLEQVVQGHNVNSHGKRVDALMKTKGIISNLCFVEIKTHTTQLLDSKPYRTGCWAPSKELAGAIAQVQGTVASAVDSLTNKVSVNDN

SEQ ID NO: 20877 - DNA, 741 bp, Unknown
  Obtained from environmental sample
  misc_feature (1)..(741): n is a, c, g, or t
ttgatgaaaagctataaaagcttgaattccttattcaaaaaacttgtaactaaaaatgtaatatttggtttttctttttttcctgattcagaatctgattctatacattacaagagctacttgaataccaacaaacataagacttccctcgtgtttcaagaaaacttagaagctatacaggacatacttgagtttgagaacttaaaccagagagtaaaaataagtcttagtataaaagtgaacttcttattcatatctcagtcttttaacgatatgtttatagcatatgatgattcaaaaagcctaaaatactctctagatgataacttgaaaattcttaatagtgttaaggaggaaatgaaaactcacaaaatatcatcagtaaaaactactagttttgtaaatatttttgaagtttcctaccatagatattatgcaatgcttatgtttatgcagaaaaataatgaagaaggaattaaacaaatatttaattgcattagactaaattcatattttccttatgataactataatgactttaaaagacattttgccacgagatattatctagaaatactacctttattattatcagacgaagaaaatgaagaatctaatttttacgtagaagtgatgtcgacttacgatatactattatcaagaattgaagataatgtcatactattcactattgatatttttaaggaattcttagaaatcaaagatttgagcgaagcgcng

SEQ ID NO: 20878 - protein, 247 aa, Unknown
  Obtained from environmental sample
  misc_feature (1)..(247): Xaa is any amino acid
MMKSYKSLNSLFKKLVTKNVIFGFSFFPDSESDSIHYKSYLNTNKHKTSLVFQENLEAIQDILEFENLNQRVKISLSIKVNFLFISQSFNDMFIAYDDSKSLKYSLDDNLKILNSVKEEMKTHKISSVKTTSFVNIFEVSYHRYYAMLMFMQKNNEEGIKQIFNCIRLNSYFPYDNYNDFKRHFATRYYLEILPLLLSDEENEESNFYVEVMSTYDILLSRIEDNVILFTIDIFKEFLEIKDLSEAX

SEQ ID NO: 20879 - DNA, 450 bp, Unknown
  Obtained from environmental sample
  misc_feature (1)..(450): n is a, c, g, or t
atgttttcgtttataagaaaactttttacaaatacttccaacagattaataactgaaggcgaccccatgaaaaaatttcttattgtaggattaggaaatattggccctaaatatgaaaatacaaggcacaatattggctttaaaatacttgactttttagcagaaaaggaatcgcttatatttgaaagtgcaaaacttggggaagtaactacctataaattaaaaggaagaacttttctattattaaagcctagtacctacatgaaccttagtgggaaagctgtaagatattggctagaaaaagaaaagattcctttagaaaacttatttgtagttacagacgatttaaaccttccttttggttcttttagaataaagactaagggtagtgacggtggacataacggacttaaagacattcaaagtatattaaacactactaagtacann

SEQ ID NO: 20880 - protein, 150 aa, Unknown
  Obtained from environmental sample
  DOMAIN (27)...(150): Peptidyl-tRNA hydrolase
  misc_feature (1)..(150): Xaa is any amino acid
MFSFIRKLFTNTSNRLITEGDPMKKFLIVGLGNIGPKYENTRHNIGFKILDFLAEKESLIFESAKLGEVTTYKLKGRTFLLLKPSTYMNLSGKAVRYWLEKEKIPLENLFVVTDDLNLPFGSFRIKTKGSDGGHNGLKDIQSILNTTKYX

SEQ ID NO: 20881 - DNA, 702 bp, Unknown
  Obtained from environmental sample
  misc_feature (1)..(702): n is a, c, g, or t
atgagagtattcattttaataatatcattgttttttacattgttttcttgtcaagatgataataaagaagcagccaaaatagctaagattgatataaatcttgctgtagagcgttttgatatcgctttcgcggaagctaagccagaagatttaccgcaattaaaaatggcttatccattcatgtttcctaagcagtttgacgaccaattttggatacaaaaaatgaatgatactttgcaaaatcaattaagcgaagagactattaaaatatttccagacttaaaaacagaaacgcaggaaattaagcaattgtttaaacacttaaagtattattttccaaattttaagacgcctagagttatcacatctacctctgatgttgattaccgcaacaaggtaattgtaacagatactattgctattttagagttagatacctttttaggatcagatcattttttttatcaaggcttacaaacttatatctctgctaacatgactgcggatcagatagtcgtagacttggcaaatgcttatgcagagaagatggtgctaaactctaaacgtacaaacttgttagaagagatgatctattcagggaagcttttgtatataaaggataagattataccatttaaaactgatgctcaaaaaataggttacacacaattgcaattagatcggttctcgaccgattcttga

SEQ ID NO: 20882 - protein, 233 aa, Unknown
  Obtained from environmental sample
  SIGNAL (1)...(18)
  misc_feature (1)..(233): Xaa is any amino acid
MRVFILIISLFFTLFSCQDDNKEAAKIAKIDINLAVERFDIAFAEAKPEDLPQLKMAYPFMFPKQFDDQFWIQKMNDTLQNQLSEETIKIFPDLKTETQEIKQLFKHLKYYFPNFKTPRVITSTSDVDYRNKVIVTDTIAILELDTFLGSDHFFYQGLQTYISANMTADQIVVDLANAYAEKMVLNSKRTNLLEEMIYSGKLLYIKDKIIPFKTDAQKIGYTQLQLDRFSTDS

SEQ ID NO: 20883 - DNA, 708 bp, Unknown
  Obtained from environmental sample
  misc_feature (1)..(708): n is a, c, g, or t
atgaaacttgtactatcaccagcaaaatctttagattacaaaactaaattaccaactactaaaacaacggaatgtcgttttttggatgaagcagaacgtttaaacaaattattaaagaagaagtcggcaaaagatttatcgaaacttatgcatatttcggataatttaggacaattaaattacgaacgtaaccaagattgggaattgccatttacaaaagacaatgcaagacaagccatctatgcttttagtggagatgtctacagaggattagatgcttacactattgatactaagaaattagacaaggttgaagatacagtgcgtattatttctggattgtatggtattttaaaacctttagaccttgttcagccttatcgattagaaatgggaactaaaatgccagtaggtaaaaacaaaaatttatacgagttctggaggaaaaaagtgactcaatccttaaatgacgaattagaagatgatgagttgtttctaaatctggcaagtaacgagtattttaaagctatagacaccaaaaccttaaaagttccagttattaatatagcttttaaagaatttaaaaatggacagtataaaatcattgccatatttgctaaattagcgagagggttaatgacgaggtatgtcattgatactgatgcaaaaaccattgatgatattaaaggttttaattacgataactaa

SEQ ID NO: 20884 - protein, 235 aa, Unknown
  Obtained from environmental sample
  DOMAIN (1)...(235): Protein of unknown function (DUF328)
  misc_feature (1)..(235): Xaa is any amino acid
MKLVLSPAKSLDYKTKLPTTKTTECRFLDEAERLNKLLKKKSAKDLSKLMHISDNLGQLNYERNQDWELPFTKDNARQAIYAFSGDVYRGLDAYTIDTKKLDKVEDTVRIISGLYGILKPLDLVQPYRLEMGTKMPVGKNKNLYEFWRKKVTQSLNDELEDDELFLNLASNEYFKAIDTKTLKVPVINIAFKEFKNGQYKIIAIFAKLARGLMTRYVIDTDAKTIDDIKGFNYDN

SEQ ID NO: 20885 - DNA, 597 bp, Unknown
  Obtained from environmental sample
  misc_feature (1)..(597): n is a, c, g, or t
atgtttatagccagacgttttatgtattggcaagtgtatttacataaaacaggagtggttgcagagcaattattaatgcggatattaaaacgtgctaaagaattagtacaacaaggcgaaaaattgaattgtagtgatgctttattctattttctcaatacagaaataaatgccgaaagttttaatgttgaaactttaaccattttttcaaaattagacgattacgatattgttgctgccatgaaagattggcaaaactatgatgattttgtattgagtaatctctgtcaaatgattttggatagaaacttgctaaaaataaagttaaagaacaaaccaataaaaaaatcggacttaaaagcacattctgaagcattaattttaaaacataatataacaaagcatgaagctgattattttgtgtttcaaggtgagttaaccaatcaagcttacgagaataaaacacagaaaatcaatatattattcaaatccggaaaggtcaaagatattgttaaagcatcagaccaattaaacataaaagcactaagtaaacctatcactaaatattatatgtgctatcctaaaaagaaaatgtaa

SEQ ID NO: 20886 - protein, 198 aa, Unknown
  Obtained from environmental sample
  misc_feature (1)..(198): Xaa is any amino acid
MFIARRFMYWQVYLHKTGVVAEQLLMRILKRAKELVQQGEKLNCSDALFYFLNTEINAESFNVETLTIFSKLDDYDIVAAMKDWQNYDDFVLSNLCQMILDRNLLKIKLKNKPIKKSDLKAHSEALILKHNITKHEADYFVFQGELTNQAYENKTQKINILFKSGKVKDIVKASDQLNIKALSKPITKYYMCYPKKKM

SEQ ID NO: 20887 - DNA, 459 bp, Unknown
  Obtained from environmental sample
  misc_feature (1)..(459): n is a, c, g, or t
atgcttacgtgtagaacagttttactcgattttccaggctgtctaattgtggtctctcacgaccgttattttatggataagattgtagatcacttatttgtatttagaggcgatggtattgtagaaaatttccctggtaattataccgatttcagagtctacgacgacagcaaagatgctattgatgacgatgaggacacgtctaaaaaagaaaagaaaaactggaagaaagaaacgacgataaaactaagttataacgagcaaaaggaatacaaaaacttagagagtaaaatcagtagtttagaatatgataagaaagagttcgaaaagaaatttttgaatccagagttaacgtcagatgaaattaacgaactatccgcaaaacttcagaaaattattgatgttctagaagaaaaagaaatgcgctggttagaactcactgaaaaacaggaaggttaa

SEQ ID NO: 20888 - protein, 152 aa, Unknown
  Obtained from environmental sample
  misc_feature (1)..(152): Xaa is any amino acid
MLTCRTVLLDFPGCLIVVSHDRYFMDKIVDHLFVFRGDGIVENFPGNYTDFRVYDDSKDAIDDDEDTSKKEKKNWKKETTIKLSYNEQKEYKNLESKISSLEYDKKEFEKKFLNPELTSDEINELSAKLQKIIDVLEEKEMRWLELTEKQEG

SEQ ID NO: 20889 - DNA, 303 bp, Unknown
  Obtained from environmental sample
  misc_feature (1)..(303): n is a, c, g, or t
atgcaattgtataatcaatactgtaacggcatgctcgttgtggctcttagatttgtaaaggacactatggaagccgaagatgtggtgcaagaagcctttataaaggcattttcaaaattagaacaatataaggcggaggtcagttttggcgcttggttaaaacgcattgttattaataaatgtattgatgttttaaagtcgaaaagacaacgtgtggtagaattagaagcgtatcatctaaacgttattgaagataataatgacgatgattgtagtatcccatgcaggtatatctatagctga

SEQ ID NO: 20890 - protein, 100 aa, Unknown
  Obtained from environmental sample
  DOMAIN (3)...(71): Sigma-70 region 2
  misc_feature (1)..(100): Xaa is any amino acid
MQLYNQYCNGMLVVALRFVKDTMEAEDVVQEAFIKAFSKLEQYKAEVSFGAWLKRIVINKCIDVLKSKRQRVVELEAYHLNVIEDNNDDDCSIPCRYIYS

SEQ ID NO: 20891 - DNA, 648 bp, Unknown
  Obtained from environmental sample
  misc_feature (1)..(648): n is a, c, g, or t
naaaaaggaattttaaagtttataaaaaataaaaatgccacaaattttaagatttttttacatgctgcagagggttggcttcctcatcttcaatatgaacagaaaaaacctgttagagaaatttatcgtcattttaataggaaacaaattcttaatttaatcaacaaaataggttttataaatttagaagaattttttgcaatactctgtaaacctgcattaattaaagcttttaaagaagataaaaaattagatattgttaaaaatcttgagaataaagattttacttttttagattttataagtttaatggcaaaaaaacatacttatgtagattcttttaaagggatgaaatctgaattaacaaaagccaaagattctgttgaaaacgataaacccatcaattggatggaaacttttgacgatttaatgtatggcttaaattatcatgcagaattactttctgcagaagatcatttagtactcaataaaaaaataatgccttttttattgaatgttattgcagctttacctctacaatctgcaaataaacttttagcactctatgatgctaattgtatagaattaattacaggcaaagttactataaataataatttaaactctactgagatactttatctataa

SEQ ID NO: 20892 - protein, 215 aa, Unknown
  Obtained from environmental sample
  misc_feature (1)..(215): Xaa is any amino acid
MKGILKFIKNKNATNFKIFLHAAEGWLPHLQYEQKKPVREIYRHFNRKQILNLINKIGFINLEEFFAILCKPALIKAFKEDKKLDIVKNLENKDFTFLDFISLMAKKHTYVDSFKGMKSELTKAKDSVENDKPINWMETFDDLMYGLNYHAELLSAEDHLVLNKKIMPFLLNVIAALPLQSANKLLALYDANCIELITGKVTINNNLNSTEILYL

SEQ ID NO: 20893 - DNA, 510 bp, Unknown
  Obtained from environmental sample
  misc_feature (1)..(510): n is a, c, g, or t
atgcnccatttaggaactatttatacggactctatttatacgcctataaaaaatgttaagtatagcattgagaactttcgtgtagagcaaaaaacagattacgaaaaattagttttcgaaatcgttacagatggatctattcatcctaaagatgcactaaccgaagctgctaaaatcttaatacatcactttatgttattctctgatgagagaattacgcttgaagcggatgaaattgctcagactgaaacatatgatgaagaatctctacatatgcgtcaattacttaagactaaattagtagatttagacttatctgtaagagctcttaactgtttaaaagctgcagaagtagataccttaggagacctagtttcttataataaaaatgatttaatgaaattccgtaacttcggaaagaaatctttaacagagctagaagaactagtgaatgtaaaaggattaaatttcggaatggatctttcaaaatacaagttagataaagattaa

SEQ ID NO: 20894 - protein, 169 aa, Unknown
  Obtained from environmental sample
  DOMAIN (1)...(69): RNA polymerase Rpb3/Rpb11 dimerisation domain
  misc_feature (1)..(169): Xaa is any amino acid
MXHLGTIYTDSIYTPIKNVKYSIENFRVEQKTDYEKLVFEIVTDGSIHPKDALTEAAKILIHHFMLFSDERITLEADEIAQTETYDEESLHMRQLLKTKLVDLDLSVRALNCLKAAEVDTLGDLVSYNKNDLMKFRNFGKKSLTELEELVNVKGLNFGMDLSKYKLDKD

SEQ ID NO: 20895 - DNA, 699 bp, Unknown
  Obtained from environmental sample
  misc_feature (1)..(699): n is a, c, g, or t
ttggtaaagcaaaacgaaggtaaatccggaatcatatattgtttaagtcgtaaacgtgtagaggagttgtctcaagtgttacaagttaatgggatcaaagcggtaccatatcacgcaggtttggatgctaatgaaagatccaatcaccaagatatgtttttaatggaagatattgacgtggtagttgcaaccatagcttttggtatgggaatagacaaaccagatgtaagatttgtaattcatcacgatattcctaaaagtatagaaagctattaccaagagactggtcgtgcaggacgagatggaggagaaggtcattgtttagcttattatgcctataaggatatagaaaagttagagaagtttatgtcaggtaaacctgtagcagagcaagaaattggtcaagcactattgcaagaggtagtcgctttcgcggaaacttcaatatcaagacgtaaattcatattgcattattttggtgaatcatttgataacgaaacaggtgaaggtggagatatggatgataatatgcgtcatccaaaggaaaaacaagaagctaaagatgatgtaaaacttgtcctagaaattgtcgatgctaccaatgaaaaatataaggctaaagagttagtaaacgttattgtaggtaaatctaacgcgttaattagctctcataaaccgacgatcaacccttttttgtaa

SEQ ID NO: 20896 - protein, 232 aa, Unknown
  Obtained from environmental sample
  DOMAIN (26)...(102): Helicase conserved C-terminal domain
  misc_feature (1)..(232): Xaa is any amino acid
MVKQNEGKSGIIYCLSRKRVEELSQVLQVNGIKAVPYHAGLDANERSNHQDMFLMEDIDVVVATIAFGMGIDKPDVRFVIHHDIPKSIESYYQETGRAGRDGGEGHCLAYYAYKDIEKLEKFMSGKPVAEQEIGQALLQEVVAFAETSISRRKFILHYFGESFDNETGEGGDMDDNMRHPKEKQEAKDDVKLVLEIVDATNEKYKAKELVNVIVGKSNALISSHKPTINPFL

SEQ ID NO: 20897 - DNA, 444 bp, Unknown
  Obtained from environmental sample
  misc_feature (1)..(444): n is a, c, g, or t
atgaatatgggatttgtgaacaaacattatgggtggagatggaacgaagaagatcctattttcaagaataatgaattcattcataaggtcttgggatatgatgaacccaaagaccaatcatttgccacggacaaatttaaagaccttttctatccgggtgattttgatttacttcaaaaatcatggaaggaatataatgatggtaccgatcattcctttgaaataagttataggtttaagcataaggatgggtcttggagatggataaaagaatctgggctggccaatgaatctaatagttccaataatcctattgtgggcattggaaccattcaagaggttacggacaagaagaaaaagaattacccaattaattccattcttaaaaacgtttcaattataatactgagggtgcgacaagactcaacaacaatattatcttga

SEQ ID NO: 20898 - protein, 147 aa, Unknown
  Obtained from environmental sample
  DOMAIN (74)...(117): PAC motif
  misc_feature (1)..(147): Xaa is any amino acid
MNMGFVNKHYGWRWNEEDPIFKNNEFIHKVLGYDEPKDQSFATDKFKDLFYPGDFDLLQKSWKEYNDGTDHSFEISYRFKHKDGSWRWIKESGLANESNSSNNPIVGIGTIQEVTDKKKKNYPINSILKNVSIIILRVRQDSTTILS

SEQ ID NO: 20899 - DNA, 606 bp, Unknown
  Obtained from environmental sample
  misc_feature (1)..(606): n is a, c, g, or t
gtgactccgatatccaagaatagtaaaatattatttataactattaccttgtcttttgccattctaattgttctagtaaaggtagtattctttatgccttctgaaacactaccaatccctgtatatttgataacttcattggaaagtgatttagaaataatacatggtaaagaaccgtataactgcctcaacattatttctaaagacaagaactttaattttataagagaagatgctattcctatcataaaagggcttcccgaattgcttacttatctaaatagcgcattaaaggatagtactatgagtgactatctattcaagattgagaaacctactggtgttaacaagaaaatgcttaggcaagtaattgaaaataattttagtggtaaacaaagaaaaatagcgttcgagagtctcatagcagttattgatttagaaactcatgattcaaatgtgcaggattaccaacaatttaaagatgatctaatttactttaaatggaacttcggcggagttggattacttgttaaaaatatagagaaaaatgatctggagaattactgtgatatgattctggaaactcttataactcctaaaagttaa

SEQ ID NO: 20900 - protein, 201 aa, Unknown
  Obtained from environmental sample
  misc_feature (1)..(201): Xaa is any amino acid
MTPISKNSKILFITITLSFAILIVLVKVVFFMPSETLPIPVYLITSLESDLEIIHGKEPYNCLNIISKDKNFNFIREDAIPIIKGLPELLTYLNSALKDSTMSDYLFKIEKPTGVNKKMLRQVIENNFSGKQRKIAFESLIAVIDLETHDSNVQDYQQFKDDLIYFKWNFGGVGLLVKNIEKNDLENYCDMILETLITPKS

SEQ ID NO: 20901 - DNA, 345 bp, Unknown
  Obtained from environmental sample
  misc_feature (1)..(345): n is a, c, g, or t
atgagtgcatattactggcaaaacaaacataaaaaaagcccaataacgcgcaaaagcttgcctaaaactatcaacattgttattttacgtaaaagtcagccatgtaaagatgcttttatgtccaccattgccaatatgttgcagcagtacgcagaacaaaatcagttactcagttttgaaggcacgatggaaaccattattactggggtttattttcatcgcgccagtaaaagctcgccgcgacagccgcttatttataactctgggattatcgtggtcgggcaagggcataaagtaattcattttacagatcataaaatacaatatggtgcgggggattattaa

SEQ ID NO: 20902 - protein, 114 aa, Unknown
  Obtained from environmental sample
  misc_feature (1)..(114): Xaa is any amino acid
MSAYYWQNKHKKSPITRKSLPKTINIVILRKSQPCKDAFMSTIANMLQQYAEQNQLLSFEGTMETIITGVYFHRASKSSPRQPLIYNSGIIVVGQGHKVIHFTDHKIQYGAGDY

SEQ ID NO: 20903 - DNA, 714 bp, Unknown
  Obtained from environmental sample
  misc_feature (1)..(714): n is a, c, g, or t
ttgttaattacatcgcactcttcacatattctatctgaagcgggaattgattctgacaaaggttttaaaagaattcgatactttaatagaattgatagcggtattgaggtacaagactttaatactcttgaaatttcaaatgaaaaacaaaccgcaagatttttaaaacagtatttgaccctacacaaatctgacttgtttttttcagacaaagtaattatcgttgaaggcactacagaacgtatgctaatgccccaactcatcttcaaatcggctcctggactttccactcagtatgtgtcaattcttgaagtaggcggtgcatatacgcataaatttaaggaaatattagagtttttaaagctaaaaacactggttgtgacagatatagattctgtagattctgtaaatggagaacgatgtgaagtcaatggtggtatagatggagaattaacatctaatcacacactgaaggattggattcccaaaaagtctaaaatcacagaacttatcgcttgtgaggaaaagaataaaattgaaaataatattgttagagtagcatatcaaacaactgaaaacggtattgtaggtagaagctttgaggaagcttttattaacacgaatctggatcttttaaaatcaaattacaccgacgataaaggcgaggagaaaaatgtgaaaaacctttttagtttcgcaaaggttaagactcnn

SEQ ID NO: 20904 - protein, 238 aa, Unknown
  Obtained from environmental sample
  misc_feature (1)..(238): Xaa is any amino acid
MLITSHSSHILSEAGIDSDKGFKRIRYFNRIDSGIEVQDFNTLEISNEKQTARFLKQYLTLHKSDLFFSDKVIIVEGTTERMLMPQLIFKSAPGLSTQYVSILEVGGAYTHKFKEILEFLKLKTLVVTDIDSVDSVNGERCEVNGGIDGELTSNHTLKDWIPKKSKITELIACEEKNKIENNIVRVAYQTTENGIVGRSFEEAFINTNLDLLKSNYTDDKGEEKNVKNLFSFAKVKTX

SEQ ID NO: 20905 - DNA, 417 bp, Unknown
  Obtained from environmental sample
  misc_feature (1)..(417): n is a, c, g, or t
atgtggttatttttttttactatcgatataaaacataatttatttttttattacaaaccacaaaccacaaccactaatcacacaacaatgcacatagatttacctgaaaagcgatattacaaaatcggtgaagttgcaaaagctttcagcgtaaatacttcattaatccgtttttgggagaaagaatttgtcattatcaaacctaaaaagaacgctaaaggaaaccgactttttacgcaagaagatattgtaaacttcaaaataatcttcaacttagtaaaagaaagaggttttacgttagaaggagcaaagcaaaaactaaagaaaaatcctgataacatatttaataatcacgagattatctcaagattagaagctgtaaaagcggaacttcaaaagatcaaaaactcactttaa

SEQ ID NO: 20906 - protein, 138 aa, Unknown
  Obtained from environmental sample
  DOMAIN (41)...(78): MerR family regulatory protein
  misc_feature (1)..(138): Xaa is any amino acid
MWLFFFTIDIKHNLFFYYKPQTTTTNHTTMHIDLPEKRYYKIGEVAKAFSVNTSLIRFWEKEFVIIKPKKNAKGNRLFTQEDIVNFKIIFNLVKERGFTLEGAKQKLKKNPDNIFNNHEIISRLEAVKAELQKIKNSL

SEQ ID NO: 20907 - DNA, 552 bp, Unknown
  Obtained from environmental sample
  misc_feature (1)..(552): n is a, c, g, or t
ttgaattttcttgatcaaacagaagatttatcttgtaaaataattttcattactgcctatgaagaatatgcattaagggctctaaaaatgggtgctgtagattatcttttaaaacctgtagatattgaagagcttaaaattgcaatccataaaatttcagaattacctatagccgaacaaaaacaacaaataaatactgtaaaacaggcatggaataatgaaggggataaaataatattatcacttcatgataattttcaagtaatagatttaaacgaactactattttgtgagtcggacaaaggttatactacgttctattgtaatgatggtaaaaaatatgtagtttcaaaaaccttaaaggaatttgaggaacgtctttgtgaagctaattttacacgcccccatcaatcgtttatggtgaacttaaaattcatagacaagtatgataagtctggtgtgattcatttaaagaatggaaaaaaaataccagtgtcttctcgaaaaaaagattcttttttagctacatttttacattggaatgtaaactaa

SEQ ID NO: 20908 - protein, 183 aa, Unknown
  Obtained from environmental sample
  DOMAIN (84)...(178): LytTr DNA-binding domain
  misc_feature (1)..(183): Xaa is any amino acid
MNFLDQTEDLSCKIIFITAYEEYALRALKMGAVDYLLKPVDIEELKIAIHKISELPIAEQKQQINTVKQAWNNEGDKIILSLHDNFQVIDLNELLFCESDKGYTTFYCNDGKKYVVSKTLKEFEERLCEANFTRPHQSFMVNLKFIDKYDKSGVIHLKNGKKIPVSSRKKDSFLATFLHWNVN

SEQ ID NO: 20909 - DNA, 819 bp, Unknown
  Obtained from environmental sample
  misc_feature (1)..(819): n is a, c, g, or t
gtgcttgaatggaataggtctttatataaagtgcaatctaaaaacaaagaagcattagctatttttcaagaaacattagatatttataaagctattaaagatcaaaagggagtggctcaaagtttaaaccatataggagatatacagtttagtttaaaaaacgatacaaaagcattagcctattataaacaagcgttgaaaataaatgaagaaataggtttgcctattgggataggggcatcttattttggcatagcaaaagtatatgcccaaaataaacggtataaagaagcgctagaaatagctctaaaagcagaggaaataagtattacacatgaatttatagactcacaaagagatacaaaagaactgttgtcaaaaatctatgaaaacttaaacgattataaaaaatcattagattactttaaacaatataaaatattaaacgacagtcttttcaataaaaaaaatattgaaagaattacacaattagaatatgagtataaatacaaacaagagttagaatctgcaagtatcagagaattaaaactaaccaaaacagttgaatctacatcattagatttagaaaaatcaaaacgtaatttactactcggcgtgattggttttttattgctatcattaattctaatcgcaattattttctacctaagattaagaaacgaaaaatcaaaaactcaaaatgtaatcattgaacaaaagttattacgctctcaaatgacgccacactttatatttaactccctctcagttttacaagggatgattttaaataaagagggagaaaaatctgttagctaa

SEQ ID NO: 20910 - protein, 272 aa, Unknown
  Obtained from environmental sample
  DOMAIN (39)...(72): TPR Domain
  misc_feature (1)..(272): Xaa is any amino acid
MLEWNRSLYKVQSKNKEALAIFQETLDIYKAIKDQKGVAQSLNHIGDIQFSLKNDTKALAYYKQALKINEEIGLPIGIGASYFGIAKVYAQNKRYKEALEIALKAEEISITHEFIDSQRDTKELLSKIYENLNDYKKSLDYFKQYKILNDSLFNKKNIERITQLEYEYKYKQELESASIRELKLTKTVESTSLDLEKSKRNLLLGVIGFLLLSLILIAIIFYLRLRNEKSKTQNVIIEQKLLRSQMTPHFIFNSLSVLQGMILNKEGEKSVS

SEQ ID NO: 20911 - DNA, 828 bp, Unknown
  Obtained from environmental sample
  misc_feature (1)..(828): n is a, c, g, or t
atgaaaaacagtaaagaactaattgaccttttatctttaacaaatttagagaaaaataaattttctggcgaaagcgtaactattggaagtaaaatagtttttggtgggcaagttttagcgcaagctgtaaatgcagcttacagaacaattcctgcagacagatttttacattcgctacattcttactttttagaagctggagatttaacaatgcctatagaatacgatgttgcagaagtgagaaatggtggtagtttttctacaaggagagttactgctagtcaaaaaggaagaaccatttttattatggcagcttcttttcatattaaagaagatggttttgagcatcaaacagatataaaaatcgatattaaacaacctgaagaattgttaagttgggaagaaatggttgtaaaatttggtgctattttaccaaaaagaatttcatcttttttaaagattgaaagaccaatagattttaaacctgtgcatactccaaatcctttacaaccaaaaaatttacctgcaaatgaagaagtttggtttaaattaaaaggcgatattccaaaaatggatattcaactgaaacatcaaattttaacttatatttctgattacaatgttttaaatgcagcttttaatccgaatgcgaaagattataattttggcaatacaattactgctagtttagatcattctatgtggtttcttagagattttgaatttgatgattggatgcttttttctgcagaatcgccaaatagttatggtgcaagaggtttatctaaaggtcatatttttaccagagatggtaaatcagtggcttnn

SEQ ID NO: 20912 - protein, 276 aa, Unknown
  Obtained from environmental sample
  DOMAIN (148)...(276): Acyl-CoA thioesterase
  misc_feature (1)..(276): Xaa is any amino acid
MKNSKELIDLLSLTNLEKNKFSGESVTIGSKIVFGGQVLAQAVNAAYRTIPADRFLHSLHSYFLEAGDLTMPIEYDVAEVRNGGSFSTRRVTASQKGRTIFIMAASFHIKEDGFEHQTDIKIDIKQPEELLSWEEMVVKFGAILPKRISSFLKIERPIDFKPVHTPNPLQPKNLPANEEVWFKLKGDIPKMDIQLKHQILTYISDYNVLNAAFNPNAKDYNFGNTITASLDHSMWFLRDFEFDDWMLFSAESPNSYGARGLSKGHIFTRDGKSVAX

SEQ ID NO: 20913 - DNA, 378 bp, Unknown
  Obtained from environmental sample
  misc_feature (1)..(378): n is a, c, g, or t
ttgggttcatcaaccaaagaagctttgattaattcttatgataataccatactgtatttagataattttttaaatattctgatagaaaagctgaaaaaatcatctcaaaaaacaattttaatttacatttccgatcatggagaaaccctgggtgaagatgacaaatggttgcatgcacaagagcatgaagcatctaaaaacccagcaatgttagtttggtattctgataattttgagaaaagttacccaataaaaatcgataaaatgaagttgaaaaaaaatgattcaattacaaccgattttttgtttcatagtgttttagatctcagtaatattcaaggttttgaatatcaaaaagagcaaagtatattcaattaa

SEQ ID NO: 20914 - protein, 125 aa, Unknown
  Obtained from environmental sample
  misc_feature (1)..(125): Xaa is any amino acid
MGSSTKEALINSYDNTILYLDNFLNILIEKLKKSSQKTILIYISDHGETLGEDDKWLHAQEHEASKNPAMLVWYSDNFEKSYPIKIDKMKLKKNDSITTDFLFHSVLDLSNIQGFEYQKEQSIFN

SEQ ID NO: 20915 - DNA, 336 bp, Unknown
  Obtained from environmental sample
  misc_feature (1)..(336): n is a, c, g, or t
ttgtctttattaattgatatatggagtgtttcggcaaagttatctttatctgaagtattaagaattggattagaaaataaaatttgggatgaagattataacataattacaaaaagaaacagtatttatggtagtggaaaaagcttattaagtagtcttgctgttgctttaaggcatactgcatatccagacagtattgattataaaaaaatagggcaagcattttgtgaagcttttaatatttctattaacgaaaatacaaaagagccatataaatcatttacaacaggaaatccaaaatatataaaacaatttaaaagattattaaagatatag

SEQ ID NO: 20916 - protein, 111 aa, Unknown
  Obtained from environmental sample
  misc_feature (1)..(111): Xaa is any amino acid
MSLLIDIWSVSAKLSLSEVLRIGLENKIWDEDYNIITKRNSIYGSGKSLLSSLAVALRHTAYPDSIDYKKIGQAFCEAFNISINENTKEPYKSFTTGNPKYIKQFKRLLKI

SEQ ID NO: 20917 - DNA, 477 bp, Unknown
  Obtained from environmental sample
  misc_feature (1)..(477): n is a, c, g, or t
atggagtctccaaaacgtttagaaaaaattgcagattatattattgcacatcacaaacgtaaaacacataacaaagaatttacaggtatgttttgtgtgagtagtgtaaagacattaataaaatactatgacatacttcaaaagaaaaaagaagaaagtaagcacaatttaaaaattgctaccatttttagctatgttgccaatgaagaagatgcagatgcaaatggttttattccagaagaagtttctgttgttgaagatacacctgctttgtatggaatgaataaacatagtagagaaagtttagatgaatacattgctgattataacagtatgttttacacgaacttctcaactaaagatagccaatctttctacaattactataatgatatttctaaaaaagtaaaagaacgtacaatagatattctattagttgtaaatatgtttttaacagnttttgatagtcctgnttaa

SEQ ID NO: 20918 - protein, 158 aa, Unknown
  Obtained from environmental sample
  misc_feature (1)..(158): Xaa is any amino acid
MESPKRLEKIADYIIAHHKRKTHNKEFTGMFCVSSVKTLIKYYDILQKKKEESKHNLKIATIFSYVANEEDADANGFIPEEVSVVEDTPALYGMNKHSRESLDEYIADYNSMFYTNFSTKDSQSFYNYYNDISKKVKERTIDILLVVNMFLTXFDSPX

SEQ ID NO: 20919 - DNA, 516 bp, Unknown
  Obtained from environmental sample
  misc_feature (1)..(516): n is a, c, g, or t
atgtgcgcctttaatgatttaaaagtggtgattattggtcaagatccgtatcataattttaaacaagcaaacggcttgtgttttagtgtgaatgatggcgtctcacatccaccatctttaattaatatttttaaagaaattgaaacggatattggaaaagcatacccaaaatcagggaatttagaacgctgggcaaaacaaggtgtgtttttattaaatgcaacattatcggttcgggctcacgaagcgggaagtcatcaaaaaaaaggatgggaaacgtttactgatgctgtgattaaaacaataagtgaacacaacaataatgtaatctttttactttggggcggatttgcgaagaaaaaagcaaagttaattgatgccaataaacacactattttaacgtctggacatccgtctccattaagtgctaaccgtgggtattggtttgggaattcacactttagtcaagttaatacgctcttaaaaactcaaggaaaatcaccaatcgattggtaa

SEQ ID NO: 20920 - protein, 171 aa, Unknown
  Obtained from environmental sample
  DOMAIN (2)...(162): Uracil DNA glycosylase superfamily
  misc_feature (1)..(171): Xaa is any amino acid
MCAFNDLKVVIIGQDPYHNFKQANGLCFSVNDGVSHPPSLINIFKEIETDIGKAYPKSGNLERWAKQGVFLLNATLSVRAHEAGSHQKKGWETFTDAVIKTISEHNNNVIFLLWGGFAKKKAKLIDANKHTILTSGHPSPLSANRGYWFGNSHFSQVNTLLKTQGKSPIDW

SEQ ID NO: 20921 - DNA, 702 bp, Unknown
  Obtained from environmental sample
  misc_feature (1)..(702): n is a, c, g, or t
atgcacgtcaataacgaggttggtaatatactagatatggataaagttagtaaattatgtaaagctaataatgccatgttccatagtgacactgtacaatctgttggtcattacaagttagatttacaagagttagcaatagattttatggcagttagtggacataagtttcatggaccaaaaggtgttggttttgcttttataagaaaaaactcaggattaaaacctttaatttttggaggagagcaggaacgtggttatcgtgcaggcacagaagcggtacacaatattgttggtttagaagaagctttaaaattgtcctatgagaatttagaagaagaaagagcctatattactgacctaaaaaaatactttattgaaaagttagttttaaacttttctggagtgtcatttaacggaagcagtgcagattttgataaaagcacttatactgttttaaacgtttgtttaccaatagcaccagaaaaaggaccaatattattgtttcaactagatttaaaaggtattgcctgttctaaaggtagtgcctgtcaaagtggaagtgctaaaggtagtcatgtattatcacagattttatgtgatgaggacatgcaaaaaccttcaataagattctcttttagtaaatacaatacaaaggacgaaatagattatgttattgaggtgttacaagaatttatttaa

SEQ ID NO: 20922 - protein, 233 aa, Unknown
  Obtained from environmental sample
  DOMAIN (1)...(225): Aminotransferase class-V
  misc_feature (1)..(233): Xaa is any amino acid
MHVNNEVGNILDMDKVSKLCKANNAMFHSDTVQSVGHYKLDLQELAIDFMAVSGHKFHGPKGVGFAFIRKNSGLKPLIFGGEQERGYRAGTEAVHNIVGLEEALKLSYENLEEERAYITDLKKYFIEKLVLNFSGVSFNGSSADFDKSTYTVLNVCLPIAPEKGPILLFQLDLKGIACSKGSACQSGSAKGSHVLSQILCDEDMQKPSIRFSFSKYNTKDEIDYVIEVLQEFI

SEQ ID NO: 20923 - DNA, 606 bp, Unknown
  Obtained from environmental sample
  misc_feature (1)..(606): n is a, c, g, or t
atgaataacaaaatatttattattggtttaccgcgtacaggcactacaagtgtttgccatgcttttttagagtttggtataccaacagcgcatactgcttacacaaacaattgttttgataacgcccatgcaattgccgatacgccaatttttaatgattataaagccctcgataagtattatccggatgcaaaatttatttatttagagcgtgagcttaacgtatggctaccatcaataaagcaattattattacgtatgcatactaatttaacacgcactgatgggggctttaatattcatctaaagcattgttatttaaatatatttagtaatttaacaattgataatataaacgatgatagttacttaacgcattgttataacacgcatatcaatgacgctaaaaattattttaaacaccaagagcaacgctttttatcaataaatatagcaaaaccgcaaagctacaaaatgctctgtgattttttagcgattaaaagtaataaaacagattttgaaaaaatgaatatgggcggcaaagttactgcctggaacgatataaaacatccgctaaaagttgatcaacagcaaaagggcgcatag

SEQ ID NO: 20924 - protein, 201 aa, Unknown
  Obtained from environmental sample
  misc_feature (1)..(201): Xaa is any amino acid
MNNKIFIIGLPRTGTTSVCHAFLEFGIPTAHTAYTNNCFDNAHAIADTPIFNDYKALDKYYPDAKFIYLERELNVWLPSIKQLLLRMHTNLTRTDGGFNIHLKHCYLNIFSNLTIDNINDDSYLTHCYNTHINDAKNYFKHQEQRFLSINIAKPQSYKMLCDFLAIKSNKTDFEKMNMGGKVTAWNDIKHPLKVDQQQKGA

SEQ ID NO: 20925 - DNA, 813 bp, Unknown
  Obtained from environmental sample
  misc_feature (1)..(813): n is a, c, g, or t
ttgcagaaaaagatgaaagtgcactcattactggatgtatataggaaaaggcaatggaacgttgttggattttccttaggaccattggcctcttttcaattggaaggcttggtcaatgaatcaaatatttccacctccaatagtatcatacaatttaaggataattccatttctgatatacaattggctgaagttccttcaactgaatctactataaacgggttgaaaattaacaataattccttactcccactcgctggaatccttacatatttcggtaatcaatccaaaacaacctccaatttttctttactaggaacacaattaataagcaactttcggcagcggcgtatctttaacttcgggttaaaaattagtttagcaacaatttttacgctgctgctttttagttttctcctatttacaaattatactacaaaaattaacgaattaacaagcaccttggctttaaacaaaacacaaaagaatacgctgttaaaactttccgaagaagttgataaaaaaggaaagctaatccaagatgtttccttggcttcatccaaagcttcgtggtatttagatcaaattgggaactcaataccaaattcaatattattatcaaacatagactttcaacctatctcaaaaagcataaaaaaagatgaagaaattttaattcaaaaaaatgtaattgttataaaaggaaagtccgttaaaagtgcctatttttctaattggatcaataccttagaacaactaaattgggttgaaaatgtgctgatcaatgaattcgtacctcgaccgaattcttga

SEQ ID NO: 20926 - protein, 270 aa, Unknown
  Obtained from environmental sample
  misc_feature (1)..(270): Xaa is any amino acid
MQKKMKVHSLLDVYRKRQWNVVGFSLGPLASFQLEGLVNESNISTSNSIIQFKDNSISDIQLAEVPSTESTINGLKINNNSLLPLAGILTYFGNQSKTTSNFSLLGTQLISNFRQRRIFNFGLKISLATIFTLLLFSFLLFTNYTTKINELTSTLALNKTQKNTLLKLSEEVDKKGKLIQDVSLASSKASWYLDQIGNSIPNSILLSNIDFQPISKSIKKDEEILIQKNVIVIKGKSVKSAYFSNWINTLEQLNWVENVLINEFVPRPNS

SEQ ID NO: 20927 - DNA, 852 bp, Unknown
  Obtained from environmental sample
  misc_feature (1)..(852): n is a, c, g, or t
ttgaacaactgcaatacttgtgatgataaggacgtagccttaacaatttcgtcatcgtgccggtgtcccgctggtgtgaaatggcagagctttgccagaattccgcaaataatttttccccaagattatccaggatacccttcttccataatggacatctatttaattgaagccattgatgagcttttaagtacgatgtcagacaaggcatcatcaaaaacgctagaatatttgaaggatttggaggtaaaggtattactcaatgaatcggtaagcaattacgatggttcacaggttgtcacaaattgtgataagattattttaacaaaaaacctaatctggacagctggtgtgaaaggacagtttccaaaaggtattgataaaaaacacgtggtaaagggtaaccgcttaaaaacagactcatttttaatggtagaaggctacaaaaacatttttgccataggcgatatagcggctgtaattacagaagaaacgccaaaaggacatccgcaagtagcacaaacagctattcagcaaggtaaatatttaggtaatgtattattgaaaattattaaggatgagggtgtgaactctttcgaatataaagacaaaggttcattagctacagtagggaaacgtaaggcagtagctgatttgggcaaattcaaatttgcaggttatttcgcttggctattatggtcagttgtacacttattatccataagcggatttagaaatagattgatggttggttttaattgggcggtaagctatttcacttatgaaaagagcaaccgcctaattattagaaattttaaaccaaaaccgtcggttaataacacaaagaaataa

SEQ ID NO: 20928 - protein, 283 aa, Unknown
  Obtained from environmental sample
  misc_feature (1)..(283): Xaa is any amino acid
MNNCNTCDDKDVALTISSSCRCPAGVKWQSFARIPQIIFPQDYPGYPSSIMDIYLIEAIDELLSTMSDKASSKTLEYLKDLEVKVLLNESVSNYDGSQVVTNCDKIILTKNLIWTAGVKGQFPKGIDKKHVVKGNRLKTDSFLMVEGYKNIFAIGDIAAVITEETPKGHPQVAQTAIQQGKYLGNVLLKIIKDEGVNSFEYKDKGSLATVGKRKAVADLGKFKFAGYFAWLLWSVVHLLSISGFRNRLMVGFNWAVSYFTYEKSNRLIIRNFKPKPSVNNTKK

SEQ ID NO: 20929 - DNA, 588 bp, Unknown
  Obtained from environmental sample
  misc_feature (1)..(588): n is a, c, g, or t
atgcacaacgccattatatgttggggtctgcaaaactttttaatgaacacgaaggcgatgccgttgtgcgtaaactttagaggctgtagtggcgaggaaaatactaaattcaggtcttaccattctggaattactgaagatttagaggaagtgattcaatatattcttcaacgaaaagagtatagcgaaatttatcttaacggttttagtttaggaggcaatgtaattttgaagtacttaggcacacacgctaatttaccttccgaaataaagggagcagtggcaatttcggtacctgtgcatttaaaaggatcgatgttgcaattgcatacatttaaaaacattttgtataatattcggtttaagcgtcatttaatagataaacttaagcgtaaacgcgattatttccccgacgaactctcagtagaaactattaaaagtgtaaaaacgntaaaggattttgatgatgtgtacacctcaaaagctcacggttttaaagatgcttacgactattacgaaaagagcagtagtcttcagtttgtaaagtccattacgtcgcatacagctttgaagcctcaccggatctaa

SEQ ID NO: 20930 - protein, 195 aa, Unknown
  Obtained from environmental sample
  misc_feature (1)..(195): Xaa is any amino acid
MHNAIICWGLQNFLMNTKAMPLCVNFRGCSGEENTKFRSYHSGITEDLEEVIQYILQRKEYSEIYLNGFSLGGNVILKYLGTHANLPSEIKGAVAISVPVHLKGSMLQLHTFKNILYNIRFKRHLIDKLKRKRDYFPDELSVETIKSVKTXKDFDDVYTSKAHGFKDAYDYYEKSSSLQFVKSITSHTALKPHRI

SEQ ID NO: 20931 - DNA, 321 bp, Unknown
  Obtained from environmental sample
  misc_feature (1)..(321): n is a, c, g, or t
atggagttgttgaaaactgaagaaatgcaacagaatattgagcgcgttacacaatcacatcaacaatttaatgaacaaattaagcagcatccaaaggttgaaagtacacgacaattaggaattatgtttgccatagatttaaagatcaaaatggaacgttatggaaatttaagagataaaatatttaatcactttatggatgatggaatctttttaagaccacttggaaacactatttacattttagcaccttttgtgattacagatttagaattagaaaaaatttataaatcaatcgaaaaattattaaataccctctaa

SEQ ID NO: 20932 - protein, 106 aa, Unknown
  Obtained from environmental sample
  misc_feature (1)..(106): Xaa is any amino acid
MELLKTEEMQQNIERVTQSHQQFNEQIKQHPKVESTRQLGIMFAIDLKIKMERYGNLRDKIFNHFMDDGIFLRPLGNTIYILAPFVITDLELEKIYKSIEKLLNTL

SEQ ID NO: 20933 - DNA, 795 bp, Unknown
  Obtained from environmental sample
  misc_feature (1)..(795): n is a, c, g, or t
atggcagatgcgtttattagtggaaaagattctgaacggcagaccgcaggtgtaaaaagtacattggcaaatgcgctcaaacgaattagcacacagcgtatttttatggcattatccgcagatgaagtgcctctcaatataaatagtccagaaaatcgttgtgtgatttcgattgtcaataatccaaaatttgaaacttcatattccccagtgattgcaactataattcacacgattacaaagcaaatgagtgtgcgtaatagcgaaccttcatttcttttaatggaagaagcgcctacaatccgtttattgaatatgcaccgtattcctgcaacattacggagttataatatttctacagtttatgtaatgcaggacaagattcaaaatgatatgatgtacggagataaggcgagtaaagcaattttgagtaatctttcatatcagttttttggaaaagtaaacgatccagatactgcaaaatattatgagcggttttttgaaatagttaaagacccaacaaaaagcattagccgtggacacaacttagattttgatactcgaattacgactggagaaaaggagattccgaagattagagcggatgtatttttcagattaaaacagggcgaatttattacctatgcagatggaagggataaaaaggttcagtttaaattagcccaaattgaaagagagcttccactaagttccaaagagttttctaatgcagatttagcatctaattttgagaggatttatgaggaagcaaaatcaatttttaggacaccgtaa

SEQ ID NO: 20934 - protein, 264 aa, Unknown
  Obtained from environmental sample
  misc_feature (1)..(264): Xaa is any amino acid
MADAFISGKDSERQTAGVKSTLANALKRISTQRIFMALSADEVPLNINSPENRCVISIVNNPKFETSYSPVIATIIHTITKQMSVRNSEPSFLLMEEAPTIRLLNMHRIPATLRSYNISTVYVMQDKIQNDMMYGDKASKAILSNLSYQFFGKVNDPDTAKYYERFFEIVKDPTKSISRGHNLDFDTRITTGEKEIPKIRADVFFRLKQGEFITYADGRDKKVQFKLAQIERELPLSSKEFSNADLASNFERIYEEAKSIFRTP

SEQ ID NO: 20935 - DNA, 609 bp, Unknown
  Obtained from environmental sample
  misc_feature (1)..(609): n is a, c, g, or t
atgcataaaagcaatttttacatggttttatatgtgctgatgttattaagcttgttgttttcacacttaagtgtggctaaaacaatacatagcgagcgctcgctttatcgtaatatattagtggaagaaaccggtaatttacgctgtttaaagtttgatgaaaaatctagccaaagtagtcaaagttgcatgtatattaacgagccaaaaaagttagtttttaattacactaaattggtgttttcaagcttgttgctaatagaagatcctaaaaaagtacttattattggtttaggcggtggcactttgtctaacaccatttcagagctttaccctaaggcaataatcgaaaatattgaaatagatcctgcggtaattaaagtggcccgcgattactttaattttaaagaaagtactaaggtaacggcaaaagtacaagacggtcgtatttttataaaacgtgcggcgcttaaaaaacagcagtttgattggataattttagatgcatttaatggcgactacattcccgagcatttactaactaaagagttttttgaagagttaaaaagtgtgcttgcgagtgacggcgttattgcgnccaatacgtaa

SEQ ID NO: 20936 - protein, 202 aa, Unknown
  Obtained from environmental sample
  misc_feature (1)..(202): Xaa is any amino acid
MHKSNFYMVLYVLMLLSLLFSHLSVAKTIHSERSLYRNILVEETGNLRCLKFDEKSSQSSQSCMYINEPKKLVFNYTKLVFSSLLLIEDPKKVLIIGLGGGTLSNTISELYPKAIIENIEIDPAVIKVARDYFNFKESTKVTAKVQDGRIFIKRAALKKQQFDWIILDAFNGDYIPEHLLTKEFFEELKSVLASDGVIAXNT

SEQ ID NO: 20937 - DNA, 444 bp, Unknown
  Obtained from environmental sample
  misc_feature (1)..(444): n is a, c, g, or t
atgactacaaaaaaactcctattacaagcttgtaaagataatgttgaaaaacgcattacagactacagaaacgaaatcgctttaattaatgaagctattgaaaataatgacaaagaatctgaaggtgaagattctggcaatggcaaactattaaatgatcttgaaaaaaatgcaggttatttaaatgaagtccttaaaacacgtgagtttttagcacaaataaaccctaatagctcacataccacaggcgctataggaagtattgttaaaacggaaaccataacattttatttgtctacaagtgtgggacaaattgaaattgatgacgaaagctattacgctatttcgttacaatcccctattgggcaacttttaccagggaaatctaaaggagaacgttttacctttaatgatcaaaactatactattatagatattttataa

SEQ ID NO: 20938 - protein, 147 aa, Unknown
  Obtained from environmental sample
  misc_feature (1)..(147): Xaa is any amino acid
MTTKKLLLQACKDNVEKRITDYRNEIALINEAIENNDKESEGEDSGNGKLLNDLEKNAGYLNEVLKTREFLAQINPNSSHTTGAIGSIVKTETITFYLSTSVGQIEIDDESYYAISLQSPIGQLLPGKSKGERFTFNDQNYTIIDIL

SEQ ID NO: 20939 - DNA, 549 bp, Unknown
  Obtained from environmental sample
  misc_feature (1)..(549): n is a, c, g, or t
atgaaaaacaccaaaaaaattaatcctattagaattttaaaacgttctaaatttattgaagcagactataaagaagacttatctagcttaatcgatagatataaagaggttggatacagagatgctaggataatttctgactcgttaattattaatgataataaaacagtatcattaaatattaaattagaagaaggagaaaagtacacttttggagaggtaacatttattggtaatacagtatactctgatgaggttttaaaaagaaagctacgtattgaaaaaggagatacatataatggtgtacaacttcaaaaacgaattgcagataatacaaagcctgatggtgatgatttaacaaatttatatcaaaacaatgggtatttgttttcaacaattaatccagttgaggttaatgcagatggtaatgtaattgatatggaaattagaatatcagagggtaaccntgtatatttgataagggtatctgtagttggtaacacanagactaacgatcacgtatttatacaagagctcgaccgatcttga

SEQ ID NO: 20940 - protein, 182 aa, Unknown
  Obtained from environmental sample
  DOMAIN (13)...(71): Surface antigen variable number repeat
  misc_feature (1)..(182): Xaa is any amino acid
MKNTKKINPIRILKRSKFIEADYKEDLSSLIDRYKEVGYRDARIISDSLIINDNKTVSLNIKLEEGEKYTFGEVTFIGNTVYSDEVLKRKLRIEKGDTYNGVQLQKRIADNTKPDGDDLTNLYQNNGYLFSTINPVEVNADGNVIDMEIRISEGNXVYLIRVSVVGNTXTNDHVFIQELDRS

SEQ ID NO: 20941 - DNA, 399 bp, Unknown
  Obtained from environmental sample
  misc_feature (1)..(399): n is a, c, g, or t
atgaaactagaattaaaacacaaagccgcttatttaccttatgacatgagggtaaatatttcatcaaaaataggtaaaggattttatcatggcgatacactaatgacagataacgaatctttaacggggatcaatatttctttagttgatggtaaatacatcaaaccttatttaaggctattctcagaccttaacgaagatgaagcacttgagctggctgatgttttagggtgcttgaacaatgatcattttttaaatgcctttgaaagtggtggaaaatataatcttgatttcaaggacgcttgggaagttagggagtggctattggtaaagcacatcgacattttcggactaatagaagaaggattggcaattgatataaataccgtaaaaccatga

SEQ ID NO: 20942 - protein, 132 aa, Unknown
  Obtained from environmental sample
  misc_feature (1)..(132): Xaa is any amino acid
MKLELKHKAAYLPYDMRVNISSKIGKGFYHGDTLMTDNESLTGINISLVDGKYIKPYLRLFSDLNEDEALELADVLGCLNNDHFLNAFESGGKYNLDFKDAWEVREWLLVKHIDIFGLIEEGLAIDINTVKP

SEQ ID NO: 20943 - DNA, 711 bp, Unknown
  Obtained from environmental sample
  misc_feature (1)..(711): n is a, c, g, or t
atggaaaatcacacacaacatatagacttaatcaatcaatatttaaataaagaattatcaaatacagaggttttagcttttgaaaacaaacttaaaactgatgcggaatttaatgcaatttaccaagagcatttaatagtcttagaaggtataaaacgcacgcaacttaaagctgaaattgcttctgcaaaaaccagttatattcaactaaaatggattaaaactattggcttaataagtgttattgctttagttttaatcttagcttataacttgtttttaaaaacagaaacaactcaagattttgatcataaaaatcaaaatttaattgaaactaatattgattcaattcctattattgataaagtagaaatcttaaaacaaattgatagttcaaaaaagaaatttgtagttgtaaaaagaatagtaaaacaagtagaagtagatagtttaactaatctttatggaggaataacagttgtaaaggatactattataattgaaaaaataggatcttatactaaacaagaatttgaaaaaaactttccaacttataagcatataattccaaaaaacgattcaattattataaatattcaaaaagttgaaagagaatttggacctactgaaaccattgtaaattcaaatactaaaaaacttgaagaaattactgaaacaaaatttattaacgaccagttatcatcattttaa

SEQ ID NO: 20944 - protein, 236 aa, Unknown
  Obtained from environmental sample
  misc_feature (1)..(236): Xaa is any amino acid
MENHTQHIDLINQYLNKELSNTEVLAFENKLKTDAEFNAIYQEHLIVLEGIKRTQLKAEIASAKTSYIQLKWIKTIGLISVIALVLILAYNLFLKTETTQDFDHKNQNLIETNIDSIPIIDKVEILKQIDSSKKKFVVVKRIVKQVEVDSLTNLYGGITVVKDTIIIEKIGSYTKQEFEKNFPTYKHIIPKNDSIIINIQKVEREFGPTETIVNSNTKKLEEITETKFINDQLSSF

SEQ ID NO: 20945 - DNA, 834 bp, Unknown
  Obtained from environmental sample
  misc_feature (1)..(834): n is a, c, g, or t
atgcgtggaaaacataaaagcactccaatagaaaatttagttactgaagcagaaaagttggccgctaatggagtaaaagaacttattcttattgcccaagatttaacgtattatggtttagatctctataaaaaacgaaaccttgctgagttattagaaaacttggtaaaggtagaaggtatcgagtggattcgtttgcattatgcgtttcctacaggtttccctatggatgttttagatgtaatgaatcgtgagcctaagatttgcaactatttggatattccgttacaacatatttctgatgacctattaaaatcgatgcgtcgtggaacgacaaaagaaaaaaccacaaaactgattaaagagtttagagctattgttccagaaatgacgattagaacgacgcttattgtgggttaccctggagaaacagaagctcattttgaagaacttaaaaattgggtctcagagatgcgttttgaacgtttaggatgctttacctactcgcatgaagaaaatacacatgcttataatttagaagatgatgtgccagaagacgttaaaatacaacgtgctaatgagattatggaaattcaatctcagatttcttgggaattgaatcaagcaaaaatcggacaaacatttaaggttgtaatcgatagaaaggacggtaattattctgtgggacgaactgaatttgattcgccagatgttgataatgaagttttaattgatgccactacaanctatttaaaaccggagaattgcaaccataaggttattgagctgaagattgatcttatgggaagtgattcaacggatgtattacaattn

SEQ ID NO: 20946 - protein, 278 aa, Unknown
  Obtained from environmental sample
  misc_feature (1)..(278): Xaa is any amino acid
MRGKHKSTPIENLVTEAEKLAANGVKELILIAQDLTYYGLDLYKKRNLAELLENLVKVEGIEWIRLHYAFPTGFPMDVLDVMNREPKICNYLDIPLQHISDDLLKSMRRGTTKEKTTKLIKEFRAIVPEMTIRTTLIVGYPGETEAHFEELKNWVSEMRFERLGCFTYSHEENTHAYNLEDDVPEDVKIQRANEIMEIQSQISWELNQAKIGQTFKVVIDRKDGNYSVGRTEFDSPDVDNEVLIDATTXYLKPENCNHKVIELKIDLMGSDSTDVLQX

SEQ ID NO: 20947 - DNA, 843 bp, Unknown
  Obtained from environmental sample
  misc_feature (1)..(843): n is a, c, g, or t
atgctttggcaattacctaaaattaaaaaagcgataaaaaaagaacatcgcgcgacacaaaaaattattacggactataatattaagggtattatatctgataatagaatgggtgttttgtccaaaacggtaccttctgtatttataacgcatcaattaaatgtgttaagtggaagcactactaaattaagtacttattttcatgatcactatttaaaggcttttgatgaatgttggattccggattttgaaaaccaacctaatttaagcggaaaccttggtcataattttaaaaacaaaggtttaaacataaagtacattggtcctttaagtcggttagaaaaaattaagattaagccgaagtatgatatcatggttttgttgtctggaccagagccacaacgcactatattagaagaaaaactactatctgatttaattaactataaaggaaaggtgatgtttgttagaggaaaaattgaagcagaacagaccgttatgttggaatctccttttacgatttacaattttatgcaaaccgaagaattgcaacaggcacttaataaaagtgaacttgtggtgtctagatctggttatacaactattatggatttggccaagttgggtaaacaagcgttttttataccaacacctggacaatttgagcaagagtatatagctgactatttaaacaaccaagggattattgctagttgtagtcaggaagattttactttaaaacaattggaacgtgtgactgcctattctggctttaaggcttttaataacacgattgaatttaaaggggttgtctttgcttttccagggttaaagaaactnnnn

SEQ ID NO: 20948 - protein, 281 aa, Unknown
  Obtained from environmental sample
  DOMAIN (125)...(281): Glycosyltransferase family 28 C-terminal domain
  misc_feature (1)..(281): Xaa is any amino acid
MLWQLPKIKKAIKKEHRATQKIITDYNIKGIISDNRMGVLSKTVPSVFITHQLNVLSGSTTKLSTYFHDHYLKAFDECWIPDFENQPNLSGNLGHNFKNKGLNIKYIGPLSRLEKIKIKPKYDIMVLLSGPEPQRTILEEKLLSDLINYKGKVMFVRGKIEAEQTVMLESPFTIYNFMQTEELQQALNKSELVVSRSGYTTIMDLAKLGKQAFFIPTPGQFEQEYIADYLNNQGIIASCSQEDFTLKQLERVTAYSGFKAFNNTIEFKGVVFAFPGLKKLX

SEQ ID NO: 20949 - DNA, 351 bp, Unknown
  Obtained from environmental sample
  misc_feature (1)..(351): n is a, c, g, or t
atgttgatcaataaaaacaaactcatgaaaccaatttattttatttgtctatttattttagctttttcttgcaaaaaaacagacagaaccctcacaaaaataaccgctaaaaatattgctattgatactacaattatggcatcaccagaaattgatagcattgttaatctttataaagtagatttaacagacgaaatgggtaaaattttatcttttactgcgaaagatctttctaaaaaaaatactaaaatgcaaagtgatttaggcaatttagtggcagatttatctgttgaaatggcgaatccgatttttaaagatgaaacaataatgctattgattttgccctgttaa

SEQ ID NO: 20950 - protein, 116 aa, Unknown
  Obtained from environmental sample
  misc_feature (1)..(116): Xaa is any amino acid
MLINKNKLMKPIYFICLFILAFSCKKTDRTLTKITAKNIAIDTTIMASPEIDSIVNLYKVDLTDEMGKILSFTAKDLSKKNTKMQSDLGNLVADLSVEMANPIFKDETIMLLILPC

SEQ ID NO: 20951 - DNA, 432 bp, Unknown
  Obtained from environmental sample
  misc_feature (1)..(432): n is a, c, g, or t
atggttaaagatgatattaaaatcggcatatttggtttgggtattgaattagaaggtttggtgagcaaaaaaatgtacaaagaaactgcctatttagatcctatagaagttacgcaagaaattacagatcagcttaaaaatgaagaaaattgcgatttgattatctgcttatcgcatttaggatataattacagaagagatgcaaagaaaatatccgatttaaatttagcaaaaaacactaaaaatatcgatttaattattggtggacatacacatacatttttaccaaaaccaacgttagttaaaaatttagatgataaaaatattttggtaaatcaagttggtgcttatggaattaatttaggtagaattgatttttattttgatgaactaaaaaataaatcgagcaaaggcactactattttagtataa

SEQ ID NO: 20952 - protein, 143 aa, Unknown
  Obtained from environmental sample
  misc_feature (1)..(143): Xaa is any amino acid
MVKDDIKIGIFGLGIELEGLVSKKMYKETAYLDPIEVTQEITDQLKNEENCDLIICLSHLGYNYRRDAKKISDLNLAKNTKNIDLIIGGHTHTFLPKPTLVKNLDDKNILVNQVGAYGINLGRIDFYFDELKNKSSKGTTILV

SEQ ID NO: 20953 - DNA, 576 bp, Unknown
  Obtained from environmental sample
  misc_feature (1)..(576): n is a, c, g, or t
atggcacagaaaccaagtataccaaaaggcacaagagattttaatccggagcaagttgctaaaagaaattatatttttagtactataaagtcgcagtttgaacgtttcggatttcaaccaatagaaactcctagttttgagaattcagagaccttaatggggaaatatggtgaagaaggcgaccgactgattttcaaaatattgaattctggggattatttgtctaaagttgaagatgctttatatcaaaaaaaggattccaatgcaacgacttcaaaaatctctgaaaaagccttgcgttacgatttaacggttccttttgcgcgttatgtagtgcagcaccaaaacgagattgaattcccgtttaagcgttaccaaatgcaaccggtttggagagccgatcgtccgcaaaaagggcgttttagagaattctatcaatgtgatgccgatgtcgtgggaagtgattctttatttcaagaagttgaatttattcagttgtacgacaacgtgttttcagctttaaaactagaaggtgttaccattaaaataaataaccgaaaaatactatcgggatag

SEQ ID NO: 20954 - protein, 191 aa, Unknown
  Obtained from environmental sample
  DOMAIN (10)...(178): tRNA synthetase class II core domain (G, H, P, S and T)
  misc_feature (1)..(191): Xaa is any amino acid
MAQKPSIPKGTRDFNPEQVAKRNYIFSTIKSQFERFGFQPIETPSFENSETLMGKYGEEGDRLIFKILNSGDYLSKVEDALYQKKDSNATTSKISEKALRYDLTVPFARYVVQHQNEIEFPFKRYQMQPVWRADRPQKGRFREFYQCDADVVGSDSLFQEVEFIQLYDNVFSALKLEGVTIKINNRKILSG

SEQ ID NO: 20955 - DNA, 1074 bp, Unknown
  Obtained from environmental sample
  misc_feature (1)..(1074): n is a, c, g, or t
ttggggatggcccccaagggggtggaatttttaaacgcttcgtatttttatggacttttttcgggttggctttggaaaagtttccaaggttttgaatccagggatatggcgaaaagagcatattcattccttgagaattatttgtgggatgaagaccatgcagaaatttattggactgttgattacaatgaaaatcctttggatgatagaaaaacatgtatatgcacaatcttttgctatctatggtttaacagagtattacctgcttttaaagagaaaagagcattagaactagcgagaaacatttatgagttattagaagaaaaatgtaccgacaatactaatggcggttatttcgaagctttttctaagaattgggaaatagaaaatgatgcaagattgagtgagaaagatgataacactccaaaaagcatgaatacgcatttacatattttagaggcttacacaaacttgtacagatgtattccttctaaaagaattggtaaatctatttcagatttactagacatttttattgatcacataattgataaagaaagaaaatcgttaaacaattttttcgatgagaaatgggaatcaaagtcagatgtgatttcctatggtcatgatatcgaggcaagttggttactaaatgaagctgaaaaagtgattgagagctatcatagaaaagaagaattaaatgaattattagtttctatttcaaaaaaggtgcttaaagatggaattgacgatgactttggtatactcaatgaaaaagaaataaataaaccacttgataaggataaagactggtggccacaagctgaaggcatcgttggatttttgaatgcttatcagctaacaaataatattgaatttactgaagcttctatcaacgtctgggaatttatcaaaaggaatataattgatgagacatttggagagtggcatgaaaaagtttccagttcgggtgatgtgtatcagttagataaagttagggagtggaagtgtccgtatcataattccagagcagctttacaagttatagagagagtagatcctcagccgatctga

SEQ ID NO: 20956 - protein, 357 aa, Unknown
  Obtained from environmental sample
  DOMAIN (18)...(337): N-acylglucosamine 2-epimerase (GlcNAc 2-epimerase)
  misc_feature (1)..(357): Xaa is any amino acid
MGMAPKGVEFLNASYFYGLFSGWLWKSFQGFESRDMAKRAYSFLENYLWDEDHAEIYWTVDYNENPLDDRKTCICTIFCYLWFNRVLPAFKEKRALELARNIYELLEEKCTDNTNGGYFEAFSKNWEIENDARLSEKDDNTPKSMNTHLHILEAYTNLYRCIPSKRIGKSISDLLDIFIDHIIDKERKSLNNFFDEKWESKSDVISYGHDIEASWLLNEAEKVIESYHRKEELNELLVSISKKVLKDGIDDDFGILNEKEINKPLDKDKDWWPQAEGIVGFLNAYQLTNNIEFTEASINVWEFIKRNIIDETFGEWHEKVSSSGDVYQLDKVREWKCPYHNSRAALQVIERVDPQPI

SEQ ID NO: 20957 - DNA, 726 bp, Unknown
  Obtained from environmental sample
  misc_feature (1)..(726): n is a, c, g, or t
ttgtggtggacattaatatatactataacgatgaaaaacaaaaaaataaacatccactttttgggagcggcaggcaccgtgactggctcaaaatatttggtggatacaggagatagaaagatacttatagactgtggcctcttccaagggttaaaggaattacgccttaaaaactgggagtacccacctgttaatgtaggtgatattgatgctgttttgcttacccacggtcatatggaccatacaggctatttacccagattggtaaaacaaggcttcaatggtcccatttatggtacgaatcctactttggacattgcaaaaatcattttgaatgatagtgcaaaaatacaggagcaagaagccgaacgtgccaataaggaaggctattccaaacatagtcccgcagaaccactttacgatttaaaggatgtagaaaaaactatcccacactttaaaggaattccacaatcacaatggattccgttatttgatggtattagggctcgcttccaatacaacggacatattctgggtgcaacctatattgagttggatgtgcacggaaaacgttttgtcttttcaggagacattggtagaaccaatgatttattgctctatccaccccttaaaccaaaaaaagcggatgtgcttttcatcgaatccacttatggtggaaggtttcatcccgatgaactagaagcacttccacatattgcaaaatag

SEQ ID NO: 20958 - protein, 241 aa, Unknown
  Obtained from environmental sample
  DOMAIN (28)...(241): Metallo-beta-lactamase superfamily
  misc_feature (1)..(241): Xaa is any amino acid
MWWTLIYTITMKNKKINIHFLGAAGTVTGSKYLVDTGDRKILIDCGLFQGLKELRLKNWEYPPVNVGDIDAVLLTHGHMDHTGYLPRLVKQGFNGPIYGTNPTLDIAKIILNDSAKIQEQEAERANKEGYSKHSPAEPLYDLKDVEKTIPHFKGIPQSQWIPLFDGIRARFQYNGHILGATYIELDVHGKRFVFSGDIGRTNDLLLYPPLKPKKADVLFIESTYGGRFHPDELEALPHIAK

SEQ ID NO: 20959 - DNA, 417 bp, Unknown
  Obtained from environmental sample
  misc_feature (1)..(417): n is a, c, g, or t
ttggctaagatttgcctatacgatgccggctacgaatttgaagatacggtggtcaaactggattcgatattagcgttaatggacccgatactaagctttgggaaactacaaatggatatgtattgggtaatgcattcctccaaactaactccaaaggaaattaataggaaaacaacctggacgctacgtaatgtggcatatcaaggacatggacaaggtaagcagggatttactccgaattgggctatggttcgattgattatgttgaattactccccgatcccaaaaaatcgggactggagtactattatttggaacaaggtggaaatttcaaaaccagtcctatgcaaagtgcgncggatagcgccgaatattttaaaaagcacttgcgtcaatatttgtaatccttcctcttga

SEQ ID NO: 20960 - protein, 138 aa, Unknown
  Obtained from environmental sample
  misc_feature (1)..(138): Xaa is any amino acid
MAKICLYDAGYEFEDTVVKLDSILALMDPILSFGKLQMDMYWVMHSSKLTPKEINRKTTWTLRNVAYQGHGQGKQGFTPNWAMVRLIMLNYSPIPKNRDWSTIIWNKVEISKPVLCKVRRIAPNILKSTCVNICNPSS

SEQ ID NO: 20961 - DNA, 435 bp, Unknown
  Obtained from environmental sample
  misc_feature (1)..(435): n is a, c, g, or t
atgtcacttatcaaatattcaagaccaagtaccgatctattctcaaaaggatttaatgatatcgttgacgaaatgttcaacacaaataacggcatgaattatagtcaagatagctttatgcctaacgttgatattgcagaaagtgaatcacaatttgaaatttcagctgagctaccgggtttaaagaaagatgctataagtgtcgatcttgaaaacggacgattgacaatcagcggcgaacgtaaatttgaaaaagaagaagaaggcaagaactatcacagagtggaatcatcctatgggacatttactcgctcttttcatttgccagacagcatcgatgaagaaagcattaatgcctcttataccgatggtgtgttgaacatcattattcagaagcaagaagagaaaatcaaaagaaaaattgatataaaataa

SEQ ID NO: 20962 - protein, 144 aa, Unknown
  Obtained from environmental sample
  DOMAIN (44)...(144): Hsp20/alpha crystallin family
  misc_feature (1)..(144): Xaa is any amino acid
MSLIKYSRPSTDLFSKGFNDIVDEMFNTNNGMNYSQDSFMPNVDIAESESQFEISAELPGLKKDAISVDLENGRLTISGERKFEKEEEGKNYHRVESSYGTFTRSFHLPDSIDEESINASYTDGVLNIIIQKQEEKIKRKIDIK

SEQ ID NO: 20963 - DNA, 612 bp, Unknown
  Obtained from environmental sample
  misc_feature (1)..(612): n is a, c, g, or t
ttgttgaatctttttccgaaccgatatctggaccgcacccagtattataaaattgcgcaattgcagcaaaccaacgccgaagtccaaattataggaaaaattacccacattaaaaccgtagaacaaaaacgcggaaaaagactcgtcgctacttttattgatgaaactggaacaatggaattggtttggtttcgaggtcaaaaatggattcgggaaaatttaaagctgaatgtttcctatgtgattttcggaaaaacgaattatttcaacaacagtttttccatgccgcaccctgaaatggaattgctcgatgcccatgaaaaaagtatccgttctgccatgcaacccgtgtatccttccactgaaaaattagggaatagcggcatcacaaatagggtgataaatggactgatgcaacagctgttcttagagagcaaaaatgccttcgccgagaccctctcaaaaccacttttggaacagctcaaattggcctcaaaaaaggaggcacttttcaacatacattttccaaaaagccaggcacatttagcacgggcacagtaccgattaaagtttgaagaattgttctatatccaactgcaattaattccgtaa

SEQ ID NO: 20964 - protein, 203 aa, Unknown
  Obtained from environmental sample
  DOMAIN (28)...(103): OB-fold nucleic acid binding domain
  misc_feature (1)..(203): Xaa is any amino acid
MLNLFPNRYLDRTQYYKIAQLQQTNAEVQIIGKITHIKTVEQKRGKRLVATFIDETGTMELVWFRGQKWIRENLKLNVSYVIFGKTNYFNNSFSMPHPEMELLDAHEKSIRSAMQPVYPSTEKLGNSGITNRVINGLMQQLFLESKNAFAETLSKPLLEQLKLASKKEALFNIHFPKSQAHLARAQYRLKFEELFYIQLQLIP

SEQ ID NO: 20965 - DNA, 426 bp, Unknown
  Obtained from environmental sample
  misc_feature (1)..(426): n is a, c, g, or t
ttgattatgaaagacttgaaagaattcagcatacagtttgtaggattaaaagaaggtaaacacgagtttaagtactcaattgataataagttctttgaagcttttaattttgatgaatatgtaagttcatctatagaagtttctttaaattttgtaaaaaaaagcacattatttgagctggtttttattgctgaaggttctgtagaagttccttgtgacgtaaccaatgagttatatgaccaagaaatagattcagaattaccattagtagtaaagtttgggccagaatttaatgatgaaaatgaggagattttaatattacctcatgaagcttatgagtttaatgtagctcaatttatttacgaaatgattgttttagcagttcctaacaaaagagtacatccaaaagtattagatgcacaatga

SEQ ID NO: 20966 - protein, 141 aa, Unknown
  Obtained from environmental sample
  misc_feature (1)..(141): Xaa is any amino acid
MIMKDLKEFSIQFVGLKEGKHEFKYSIDNKFFEAFNFDEYVSSSIEVSLNFVKKSTLFELVFIAEGSVEVPCDVTNELYDQEIDSELPLVVKFGPEFNDENEEILILPHEAYEFNVAQFIYEMIVLAVPNKRVHPKVLDAQ

SEQ ID NO: 20967 - DNA, 360 bp, Unknown
  Obtained from environmental sample
  misc_feature (1)..(360): n is a, c, g, or t
gtggatcaagatcggctcgagaaatgcagcagtattcagcaattaatttcttggtctgaaacgattgcaaaaacaggaagagaaacgcaaaaacaatttttagaatactgtttacaattctttanacaagcacttttgttaaactataagtctgatcagttggtttttatggaatctaaatctggttttaacttgtctaaatttgcaccatttgtgcattcaggaaatattttagacatcgaaaaagaaattggtgaagccatgtatcacatagaaagaaatggaaatgcaaaaattattttgttagatttatcaatgaaactaactcgatttttgcataagaaagaggataagatttag

SEQ ID NO: 20968 - protein, 119 aa, Unknown
  Obtained from environmental sample
  misc_feature (1)..(119): Xaa is any amino acid
MDQDRLEKCSSIQQLISWSETIAKTGRETQKQFLEYCLQFFXQALLLNYKSDQLVFMESKSGFNLSKFAPFVHSGNILDIEKEIGEAMYHIERNGNAKIILLDLSMKLTRFLHKKEDKI

SEQ ID NO: 20969 - DNA, 828 bp, Unknown
  Obtained from environmental sample
  misc_feature (1)..(828): n is a, c, g, or t
ttgttggataaagatgatatagatgccttaatattggtaacccaatcttcagatcatataataccgaatacaagtcaaataatccatggccgattagatttaaggaaaggtgttttatgcgacgaaattagtcaagcatgttctgggtatcctataggccttatgcaagcctttatgttgttagagcaagaagaaataaaaaaggtagtggtactgaatgcggatatgtttagccgtaaagtttctaaacaagataggggcagtcgacctttaaccggtgatgcggcatcaattacaatcgttgaaaatgattcgtcgaataaaactatttatggttctgttaataccgacgggacaggggctgacgctttaataattccagccggcggttttaaaatgccttctagtgcaaaaacggctgaactaaagacagacagtcaaggaaacataagggctttagatcatttggtcatgaaaggagacgacgtttttagttttgtccaaaaagaagtgcctcctatgatcgaaaatttattgaataaggccggttgtactaaagatgatgttgattatttcatgtttcatcaacccaataaattcatgctaaaaaaactagctgacaagatggaagttgcttatganaaaatgccccataatatcgttgagaaattcgggaatgcaaatagtgtctcaacacctacgaacatcacgtacaacttagggggaaaactaatgaaggattcattgcttatttgtttggcaggttttggtgctggactaagttggtcctccctcctattagaaatgggaactttagacttttgttaa

SEQ ID NO: 20970 - protein, 275 aa, Unknown
  Obtained from environmental sample
  misc_feature (1)..(275): Xaa is any amino acid
MLDKDDIDALILVTQSSDHIIPNTSQIIHGRLDLRKGVLCDEISQACSGYPIGLMQAFMLLEQEEIKKVVVLNADMFSRKVSKQDRGSRPLTGDAASITIVENDSSNKTIYGSVNTDGTGADALIIPAGGFKMPSSAKTAELKTDSQGNIRALDHLVMKGDDVFSFVQKEVPPMIENLLNKAGCTKDDVDYFMFHQPNKFMLKKLADKMEVAYXKMPHNIVEKFGNANSVSTPTNITYNLGGKLMKDSLLICLAGFGAGLSWSSLLLEMGTLDFC

SEQ ID NO: 20971 - DNA, 678 bp, Unknown
  Obtained from environmental sample
  misc_feature (1)..(678): n is a, c, g, or t
atgatttacattgttagtattgcaattcttctaattgttttatttgtagctttaagaccaaaaaagaagccgaaaattgtttcttttaaagaagttgtaattcctgaacattggcatcaaatcttagtgcaaaacgttttgttttataagaagttaacaaaagaggagcaaagcctctttcaagctaaaatggttcggtttttagaagccacaactattgaagctattcactttgaattggaagaattagacaaattattaattgctgcaagtgctataattcctgtttttcgttttccaaattggcagtatatcaatctttctacggttttaatctatcctgattattttgatgaagatttgcaattcagcagtaaaactgaagggagaaatattggcggtttggttggcacaggaagattcgaaaaccacatgattttatctagaaaagcattgcatcatggttttagcaataaaactgacaaaggaaacactgccattcacgaatttattcatttgttagacaaagcagatggtgttgttgacggaattccagaagcgttgttagacaagcaatataccattccatatttgcaattggtacataaaaaaatggaagaaatcaataatgataaatctgatatcagaaattatggaggcacttctcaaactgannnn

SEQ ID NO: 20972 - protein, 226 aa, Unknown
  Obtained from environmental sample
  DOMAIN (1)...(225): Protein of unknown function (DUF980)
  misc_feature (1)..(226): Xaa is any amino acid
MIYIVSIAILLIVLFVALRPKKKPKIVSFKEVVIPEHWHQILVQNVLFYKKLTKEEQSLFQAKMVRFLEATTIEAIHFELEELDKLLIAASAIIPVFRFPNWQYINLSTVLIYPDYFDEDLQFSSKTEGRNIGGLVGTGRFENHMILSRKALHHGFSNKTDKGNTAIHEFIHLLDKADGVVDGIPEALLDKQYTIPYLQLVHKKMEEINNDKSDIRNYGGTSQTXX

SEQ ID NO: 20973 - DNA, 702 bp, Unknown
  Obtained from environmental sample
  misc_feature (1)..(702): n is a, c, g, or t
atgattcaaaggaatattcgacataaatcaaaattaaaaggagataatcttgaagcatttgaaatagtattaaaaatattattttcaactaataatcataacgtaaacacaagaaagattccttttacttatcgaattagtcacaaagaaaaagattttagagaactagctctggttcatccaatgaatcaactgttattagtgaatttctatgaacaatttaaagaatcaattatctattcttgctcattgagtaattatagcattagaaagcctgataatgttgccaagtttagcttttttaatgataaacttcatcaatctaacaaaggtaattcgtctgattttttagaattaagtggcaaagaatatgaaaacttgaaaacttttttttcttatagtaaatacactaatatttatcagttttttgaagattatagatatcaaagagcagagaaaaagtttaatcatttatataaatttgatatttctaaatgttttgacagcatatacactcattcaatatcttgggctgttttaggtttggatgtggttaaagaaaatgtttccttctcaagaaacacttttcctgggaattttgacgctttcattcaaaatacaaattacggagaaacaaatggaattttaataggacctgaattttctaggatttttgctgaaattattttaccagaaaattga

SEQ ID NO: 20974 - protein, 233 aa, Unknown
  Obtained from environmental sample
  misc_feature (1)..(233): Xaa is any amino acid
MIQRNIRHKSKLKGDNLEAFEIVLKILFSTNNHNVNTRKIPFTYRISHKEKDFRELALVHPMNQLLLVNFYEQFKESIIYSCSLSNYSIRKPDNVAKFSFFNDKLHQSNKGNSSDFLELSGKEYENLKTFFSYSKYTNIYQFFEDYRYQRAEKKFNHLYKFDISKCFDSIYTHSISWAVLGLDVVKENVSFSRNTFPGNFDAFIQNTNYGETNGILIGPEFSRIFAEIILPEN

SEQ ID NO: 20975 - DNA, 633 bp, Unknown
  Obtained from environmental sample
  misc_feature (1)..(633): n is a, c, g, or t
atgattgaaaaagaatattaccgattagatgaattagaaaaacggttcgatttatcctttagtgatgtgctttatttagttgaaaactcaaagctcgacttagcttttagactcgctgataataaattcattatcggtggctgggcgaagggtaatggctttattggatatgcctctgtcaaatatagtggctttgcaaatattactcagaaagatcagctaacactcctctcaaagcataaaactaactgtaaatacttctggttattgaacaaggataagatagttagcgcaaattatgactatccttttgaatcaaaaacacctaatgcctttttacatacatggcaaccaaagcagcctagcgatattagttgggacagaattcctgcaaagctgtttccaaaagagcaagagcacatagcgcataccctcaaaaatgctatgagtagcattaaaacactcagtaataagcaatctaaaccaagcgaatatgaaaaagagtttgatgcaaaaatacctaaggtacaattttactcagtaggaattaattttgaattagccgatatttgcattttacattctgaactagttaaagcgggtattgctgaatcgcagatgaatcaccgatag

SEQ ID NO: 20976 - protein, 210 aa, Unknown
  Obtained from environmental sample
  misc_feature (1)..(210): Xaa is any amino acid
MIEKEYYRLDELEKRFDLSFSDVLYLVENSKLDLAFRLADNKFIIGGWAKGNGFIGYASVKYSGFANITQKDQLTLLSKHKTNCKYFWLLNKDKIVSANYDYPFESKTPNAFLHTWQPKQPSDISWDRIPAKLFPKEQEHIAHTLKNAMSSIKTLSNKQSKPSEYEKEFDAKIPKVQFYSVGINFELADICILHSELVKAGIAESQMNHR

SEQ ID NO: 20977 - DNA, 396 bp, Unknown
  Obtained from environmental sample
  misc_feature (1)..(396): n is a, c, g, or t
atgttgaactttaagaaagcgacgctgagccttcgcaataccattgtaaagctggaaacgattaatattattcctatggatagtaagtatttcaccgaacttaaagagcaagccaacaatttgattgatgaaattgattttgagttgtttgagcttgatagtaaaaccaatctgatattctcaattcagggccatcgtttgaatgaaatcatacgtaccttgaccttagtgtcagtggtatttataccattaacatttttggtaggcgtttacggtatgaattttgactatatgcctgagttaaaatggaatgagggttactttgccttgtggggtgtgatggtaacattgactgtggccatcgttgtgtattttaaaagtaagaaatggttttaa

SEQ ID NO: 20978 - protein, 131 aa, Unknown
  Obtained from environmental sample
  misc_feature (1)..(131): Xaa is any amino acid
MLNFKKATLSLRNTIVKLETINIIPMDSKYFTELKEQANNLIDEIDFELFELDSKTNLIFSIQGHRLNEIIRTLTLVSVVFIPLTFLVGVYGMNFDYMPELKWNEGYFALWGVMVTLTVAIVVYFKSKKWF

SEQ ID NO: 20979 - DNA, 624 bp, Unknown
  Obtained from environmental sample
  misc_feature (1)..(624): n is a, c, g, or t
ttggaccaaatggagctggaaatcaacactaataaatctatcttaggcatattaaaacctatagcaggaagcgtcactatttatgacaaaccctacgacaagcaacgcaaattagttgcttacgtaccacaaaaaggaagtgtagattgggactttccaacaacagctttagatgttgttactatggggacttatggaagtttaggttggataaaacgaccaggacaaaaacaaaaaaaagcagccttagaagctttagaaaaagtaggcatgttaccctttaaaggcagacaaattagtcaattatcaggtggacaacaacaacgtatatttttagctagagcattagtgcaaaacgcatcaatctattttatggacgagccttttcaaggtgttgatgccaccacagaaatagctattattaatattttaaaagaattacgtaaagcgggaaaaacagtcattgtagtgcatcatgatttacaaactgttccagaatattttgattgggttacttttttaaatgtgaagaaaattgcaacaggtccagttaaagacatctttaatgatgataatttaaccaagacttacggtattaactacaaagtaagtattcaggaataa

SEQ ID NO: 20980 - protein, 207 aa, Unknown
  Obtained from environmental sample
  DOMAIN (12)...(177): ABC transporter
  misc_feature (1)..(207): Xaa is any amino acid
MDQMELEINTNKSILGILKPIAGSVTIYDKPYDKQRKLVAYVPQKGSVDWDFPTTALDVVTMGTYGSLGWIKRPGQKQKKAALEALEKVGMLPFKGRQISQLSGGQQQRIFLARALVQNASIYFMDEPFQGVDATTEIAIINILKELRKAGKTVIVVHHDLQTVPEYFDWVTFLNVKKIATGPVKDIFNDDNLTKTYGINYKVSIQE

SEQ ID NO: 20981 - DNA, 642 bp, Unknown
  Obtained from environmental sample
  misc_feature (1)..(642): n is a, c, g, or t
atgacagaattagaaaaacgaatttggacagaatctatcggcagggttttcaaagaaaacactccttgggattcaaagaatcagagtgaaagatatcatgttgtagttgataccattaaaatgccacctaaagtcgttttagcgagggctattgacataattaaaaaggaacatcctgatactataattaaaaaaattggagggggcattccaacgaatcgatttatcgaggaactcggttttaagataactgaggatttgatttataataccactgactttaataagttgcaaggccatattgaaaagcgaatccacaatagaaagctgtttcaggatttcataaacttcggatcctctgtgttaaccgatttggttatagaggtatataaagtaagaatggcaattgaaagtaaaggaatactttcaataatagttggtatgagagcggtctattcctatgaggaagaagaaggggctgccataataggtttgttagtgagcaaaaattttaaaaatgaaaatcaagacaaacttaattttatctcagcatatgactttaagggggaaccatcgcaacaacttgtaaaggtcagagttaataattggtctgaaatgagccaagcacttttagacgaatnt

SEQ ID NO: 20982 - protein, 214 aa, Unknown
  Obtained from environmental sample
  misc_feature (1)..(214): Xaa is any amino acid
MTELEKRIWTESIGRVFKENTPWDSKNQSERYHVVVDTIKMPPKVVLARAIDIIKKEHPDTIIKKIGGGIPTNRFIEELGFKITEDLIYNTTDFNKLQGHIEKRIHNRKLFQDFINFGSSVLTDLVIEVYKVRMAIESKGILSIIVGMRAVYSYEEEEGAAIIGLLVSKNFKNENQDKLNFISAYDFKGEPSQQLVKVRVNNWSEMSQALLDEX

SEQ ID NO: 20983 - DNA, 405 bp, Unknown
  Obtained from environmental sample
  misc_feature (1)..(405): n is a, c, g, or t
ttggttttcggtagatttccctggtggtggctacgcgcgtgttccaaaaaaaatacaaggacctttcaaacatatataacagattattttattacgcgtaaacaattggtcagtgcatttgtattggtggatgttcgncatgaaccccaaaagactgatatggagtttatggaatttctgggtgaaaacatgattccgttcagtatcatatttacgaaagccgataaattgaagcccaaggtcattgaaaaaaatgtggattcttatatacaggaattgcttgagggtatatgggaagaggctccgaattactttattacatcgtcctcaaaaaatatgggaagggatgaagtcctcttttacatagatgatatcaancaaaatttctttcaagaaaacaaatag

SEQ ID NO: 20984 - protein, 134 aa, Unknown
  Obtained from environmental sample
  misc_feature (1)..(134): Xaa is any amino acid
MVFGRFPWWWLRACSKKNTRTFQTYITDYFITRKQLVSAFVLVDVRHEPQKTDMEFMEFLGENMIPFSIIFTKADKLKPKVIEKNVDSYIQELLEGIWEEAPNYFITSSSKNMGRDEVLFYIDDIXQNFFQENK

SEQ ID NO: 20985 - DNA, 384 bp, Unknown
  Obtained from environmental sample
  misc_feature (1)..(384): n is a, c, g, or t
atggaaaaaggatggatagattatttggctccacaagtatattggagcatggatctacccgtggcatcacacaaaactattgttgattggtggtcaaaaaataatttcaatacgaatctttatattggaaacggcgcatataaagttcgaaacaacagtgataaagcttgggacgatataaaagaattaccaatgcaattaaagctggctagagaaacacctcagatttctggtaatataatgttcagtgctaaatctctaatgagcgataatgacgatgttgtagcatacattcataaaaagtattacaaactacctgccttgaaccccgctttcccattatcaaaaaggctacatcaaacccacattctcggccgatcttga

SEQ ID NO: 20986 - protein, 127 aa, Unknown
  Obtained from environmental sample
  misc_feature (1)..(127): Xaa is any amino acid
MEKGWIDYLAPQVYWSMDLPVASHKTIVDWWSKNNFNTNLYIGNGAYKVRNNSDKAWDDIKELPMQLKLARETPQISGNIMFSAKSLMSDNDDVVAYIHKKYYKLPALNPAFPLSKRLHQTHILGRS

SEQ ID NO: 20987 - DNA, 312 bp, Unknown
  Obtained from environmental sample
  misc_feature (1)..(312): n is a, c, g, or t
gtgattatactgcaagtgctatcgcatctattttgctataacgagaaaagcgctgttgtagatggaaacgtgtaccgttttttatcgcgtttttatggtattgatactcctattaatacaggtaaaggttttaagacgtttaaagccatagctcaagaacttattaaaactgtagagccagcgactttgaaccaagcgattatggagtttggggcacgacaatgtaagcctaaaagtcccgagtgtacggtttgtccttttaatatggagtgtttagcgcttcaaaaagatgagattgataattacctgtga

SEQ ID NO: 20988 - protein, 103 aa, Unknown
  Obtained from environmental sample
  misc_feature (1)..(103): Xaa is any amino acid
MIILQVLSHLFCYNEKSAVVDGNVYRFLSRFYGIDTPINTGKGFKTFKAIAQELIKTVEPATLNQAIMEFGARQCKPKSPECTVCPFNMECLALQKDEIDNYL

SEQ ID NO: 20989 - DNA, 474 bp, Unknown
  Obtained from environmental sample
  misc_feature (1)..(474): n is a, c, g, or t
ttgtccattgcaaaaaaattattaaaaaacgacggcacaattgctataagcatagaccataatgaaattggttatatgattagtttattagatgacgaatttggtataactaatagaaagaatataatacacataaaaaggagttctgtttctggagcaaaagttataaatcctggagtagtaaacgtacgtgaatctttagttatatattcaaaagactcttcaaactggaaacctaacaaagttttcacagctaaagacagagatactcgttatagcacattcataacaaattatgacgaccgtccagaacctcgcgactatgacagtgtccttgaatcttttgcaaaacacaaaaatattcagaaccagtcaccttccaaaagaataggtgccgactatgacattgacttagaacaatattatcataaccataccgaaagagtcatacgttttgctggcttaaatgattaa

SEQ ID NO: 20990 - protein, 157 aa, Unknown
  Obtained from environmental sample
  misc_feature (1)..(157): Xaa is any amino acid
MSIAKKLLKNDGTIAISIDHNEIGYMISLLDDEFGITNRKNIIHIKRSSVSGAKVINPGVVNVRESLVIYSKDSSNWKPNKVFTAKDRDTRYSTFITNYDDRPEPRDYDSVLESFAKHKNIQNQSPSKRIGADYDIDLEQYYHNHTERVIRFAGLND

SEQ ID NO: 20991 - DNA, 315 bp, Unknown
  Obtained from environmental sample
  misc_feature (1)..(315): n is a, c, g, or t
ttgtcaccaaaattaggaccaattgcagattggggtttagagatagaaaaaaatgcaatcaaggtggataatagcttggattaccaaactaacattccaggtatttttgctattggagatggtaatacctatccagggaaattaaaattaattttatgtggttttcacgaagcaacattaatgtgtcaatcagcgtatcaaattattaatccaggaaaacgctatgtattaaaatataccacagtcagcggagtagatggttttgatggtacacgtaaagaagcaccaaaagcagtggtaaaatcgattcagtag

SEQ ID NO: 20992 - protein, 104 aa, Unknown
  Obtained from environmental sample
  misc_feature (1)..(104): Xaa is any amino acid
MSPKLGPIADWGLEIEKNAIKVDNSLDYQTNIPGIFAIGDGNTYPGKLKLILCGFHEATLMCQSAYQIINPGKRYVLKYTTVSGVDGFDGTRKEAPKAVVKSIQ

SEQ ID NO: 20993 - DNA, 717 bp, Unknown
  Obtained from environmental sample
  misc_feature (1)..(717): n is a, c, g, or t
ttgatcggtcagatggtgtactgtaatgcactgggcttaataaagaaaacaaatagaaattacaagcacagaaacaaaaaaaatattcatgatctagaggacactcaacatgaagaaaatgaattaaaagatgaggaaaaagtagtaaaacacaccttagatattgaaactgaagatttagtatttgaacatgagaatgattctgagaccattaatgaaattgaggtagaatatgatgagataaatactgaaacaatggatgaatttgtgataaagcaaatagttgccaaagaagaaattattgaagaagaaattgaggatgaagaaaatcaaattacattaacttttgatttgcctatatcttctaaaaagaaagttgagacaaaagaagaggttattacatatcatttatcaacctctaatattgctgatattgaagtcatagatcctttattagtgagaccacttcacatggttgacggtaaaattaaacatgggttagaagatgatactgatgacgcttcttttgaaaatgaacaaaaagctcatgaagaaggtgtggaagatgaagaattaaaatttgacattagaatagaaaataaaattgatgatgaaaaaagttttaaagatagtgacgaagattcgcctttaaatcgtactattgctgaagttgaaggtacagcagatgcaaagaaggcgaaaaatgaaagattttaa

SEQ ID NO: 20994 - protein, 238 aa, Unknown
  Obtained from environmental sample
  misc_feature (1)..(238): Xaa is any amino acid
MIGQMVYCNALGLIKKTNRNYKHRNKKNIHDLEDTQHEENELKDEEKVVKHTLDIETEDLVFEHENDSETINEIEVEYDEINTETMDEFVIKQIVAKEEIIEEEIEDEENQITLTFDLPISSKKKVETKEEVITYHLSTSNIADIEVIDPLLVRPLHMVDGKIKHGLEDDTDDASFENEQKAHEEGVEDEELKFDIRIENKIDDEKSFKDSDEDSPLNRTIAEVEGTADAKKAKNERF

SEQ ID NO: 20995 - DNA, 543 bp, Unknown
  Obtained from environmental sample
  misc_feature (1)..(543): n is a, c, g, or t
atgaactttattaaaaaaatattaaaatctcgcactaaaaaagacgagattttttttgcttctatccaaaaaatgattgggtttaaacctaacaaattaaaatattacaaaaaagcctttacacatagttcaattaataagacaacttcagcaggaaagcctgtaaattatgaacgcctagaatttttaggagacgcgatattaagttcagtaatagccatgtacctattcaaaaaaatccctttaggtacagaaggttatttaactcaaatgcgttctaaaatagtaagtagagaacatcttaatgaaataggaaaagatttaggtttaatacggttggtttttagcaatgtgccaaagaaaaattttggagatgatattcatggaaatatttttgaagcattattaggtgccgtatttttggataaagggtacaggtattgtgaaagatttatttataaaatagttatcgagccttatgttgatgttgaacgcttagaaggtaaaattaccagtataaaagtggtgactgagccaatctga

SEQ ID NO: 20996 - protein, 180 aa, Unknown
  Obtained from environmental sample
  DOMAIN (58)...(144): RNase3 domain
  misc_feature (1)..(180): Xaa is any amino acid
MNFIKKILKSRTKKDEIFFASIQKMIGFKPNKLKYYKKAFTHSSINKTTSAGKPVNYERLEFLGDAILSSVIAMYLFKKIPLGTEGYLTQMRSKIVSREHLNEIGKDLGLIRLVFSNVPKKNFGDDIHGNIFEALLGAVFLDKGYRYCERFIYKIVIEPYVDVERLEGKITSIKVVTEPI

SEQ ID NO: 20997 - DNA, 705 bp, Unknown
  Obtained from environmental sample
  misc_feature (1)..(705): n is a, c, g, or t
atggaacacatcgtcattataggaaacggaatttctggagttactctagcaagacacgtcagaaaattatcagataaaaaaattactatcgtttctgctgaaacggattactttttttcacgtacagccttaatgtatgtttacatgggtcacatgaagtttgaacacactcaaccttacgaaaattggttttgggagaaaaaccgtattgagcttaaaaaaggttatgtcaatgctatagatactgataacaaaacactccactttactgaaggtgatgcaatgtcgtatgataaattagtaattgccacaggaagtaaacctaataaatttggttggccaggacaagatctaaaaggtgtacaaggcttatacagtaaacaagatttagataacatgcagcaaactgcaccagataacaaaacttgtaaacatgctgtaattgttggtggaggattaattggtattgaaatggcagaaatgctaaattcaagagacataccagttacttttttagttagagagactagtttttggaatggtgttttacctgaaggcgaaagtcaaatgattaacagacacattaaaaatcaccacattgatttaagattaaacactaatctaaaagaaatcaaatcggacgaaaacggaaacgtaaaatccataattattgaagaaactggagaagaaatagccttaacctag

SEQ ID NO: 20998 - protein, 234 aa, Unknown
  Obtained from environmental sample
  DOMAIN (3)...(234): Pyridine nucleotide-disulphide oxidoreductase
  misc_feature (1)..(234): Xaa is any amino acid
MEHIVIIGNGISGVTLARHVRKLSDKKITIVSAETDYFFSRTALMYVYMGHMKFEHTQPYENWFWEKNRIELKKGYVNAIDTDNKTLHFTEGDAMSYDKLVIATGSKPNKFGWPGQDLKGVQGLYSKQDLDNMQQTAPDNKTCKHAVIVGGGLIGIEMAEMLNSRDIPVTFLVRETSFWNGVLPEGESQMINRHIKNHHIDLRLNTNLKEIKSDENGNVKSIIIEETGEEIALT

SEQ ID NO: 20999 - DNA, 711 bp, Unknown
  Obtained from environmental sample
  misc_feature (1)..(711): n is a, c, g, or t
gtggaattgaaaagtgatgcttcgcctttgactttggcagataaaaatgcaaatgaggttatcaatagctatttagttaaaacgggtatcccgatcattagtgaagaaaatgcccggatagattacgaaataaggaaaaaatggaatacctgttggatcgtagatcccttagatggaacaaaagaatttatcaaacggaatggcgaatttaccgtaaatatagcgctgattgaaaatagtaaacctgtattaggagtcatttatgtgcctgttgagaaaaaattatattatgcagatgttttaaaaaaggaagcctatttattaagtttgccttctaaagagatatcatttgatgagatgatgaagacttctacaaaaattaatgatcatgtattacaaaatgacatcattagaatagttggcagccgttctcatatgaatcaagaaactattgactttgtagacggcctaaaacataaggacactgaagtagcagtaatatctaaaggaagttctttaaaattttgtttggttgcagaaggattagcagatatttaccccaggtttgcgcctaccatggaatgggatacggcagctgcacatgccatttgtaaggcatcgggtgtatccgtaatatcagtcgataccaaagaagaattgttatataataaagaaaatttattgaacccttggtttatttgtaaacgatga

SEQ ID NO: 21000 - protein, 236 aa, Unknown
  Obtained from environmental sample
  DOMAIN (2)...(235): Inositol monophosphatase family
  misc_feature (1)..(236): Xaa is any amino acid
MELKSDASPLTLADKNANEVINSYLVKTGIPIISEENARIDYEIRKKWNTCWIVDPLDGTKEFIKRNGEFTVNIALIENSKPVLGVIYVPVEKKLYYADVLKKEAYLLSLPSKEISFDEMMKTSTKINDHVLQNDIIRIVGSRSHMNQETIDFVDGLKHKDTEVAVISKGSSLKFCLVAEGLADIYPRFAPTMEWDTAAAHAICKASGVSVISVDTKEELLYNKENLLNPWFICKR

SEQ ID NO: 21001 - DNA, 633 bp, Unknown
  Obtained from environmental sample
  misc_feature (1)..(633): n is a, c, g, or t
atgaagaatatgaatttagccgtattaatagatggagacaatattccgtctgcccacgttaaggaaatgatggaagaaatagctaaatatggaaaccctaccataaaaagaatttatggcgattggactagtccgcatttatcaaaatggaagaatctgcttttagaaaacgctattactcctattcagcaatacgcgtacaccactggcaaaaacgctacagattcagcattaattattgatgcaatggacattctttatactgaaaaagtaagcggattttgtcttgtttcaagcgatagtgattttacaaaattggccactagattacgagaagctggtatgcaagttattggaattggagagaaaaaaacaccaaatccttttattgttgcttgcgataaattcatttatatcgaaattattagaaagacaactgaaaagaaagaaaacacgaatcaaaagagttctccaaaagatagcatagataaagtcactcccaaagtaacaaaactcattgctgctaatatttctgatttatcagacgaagaaagctgggcttttccttggggatgtgggaagtttacttcaaaaaaaaacaacccaatttcgattctagaaatcatggtttga

SEQ ID NO: 21002 - protein, 210 aa, Unknown
  Obtained from environmental sample
  DOMAIN (3)...(144): Protein of unknown function DUF88
  misc_feature (1)..(210): Xaa is any amino acid
MKNMNLAVLIDGDNIPSAHVKEMMEEIAKYGNPTIKRIYGDWTSPHLSKWKNLLLENAITPIQQYAYTTGKNATDSALIIDAMDILYTEKVSGFCLVSSDSDFTKLATRLREAGMQVIGIGEKKTPNPFIVACDKFIYIEIIRKTTEKKENTNQKSSPKDSIDKVTPKVTKLIAANISDLSDEESWAFPWGCGKFTSKKNNPISILEIMV

SEQ ID NO: 21003 - DNA, 717 bp, Unknown
  Obtained from environmental sample
  misc_feature (1)..(717): n is a, c, g, or t
atggtctctcatgaaataaaacttattgaagagcgtattgatcgtgaaaaaaatccaaataagatgtttttcagttttgcaaatactgtggctacaattgattttgcaaaaaaatacaaaggtcatggatgggttggaattaaatatcaaatagatccagctgaagaagagtataatgagattgtattacaccttcgatttaaagaaaatgatgcaagattgcaacaagagactttaggtattttagggacaaaccttatatatggcgctttttacaagtataatgaacctagaaaattattgcgttatttatatgaccatttagataaagaccaaatagaaattgatactattaatttttctggtcctgtatttaaggatgtagataaccgtttaatgagtttacaactagttaaaaacggaatgacagatgctgtcatgtttgctcctgacggaaataacgtgttacctgctagagtcctttacaagaaaaatatattagcgttacgtggtagttttagaccagtaaccaaagtaaacattgacatgtacgaaaagtcattggatatgtttattaaagaaaataaagtagatgaggataatactcaagtaatttttgaaattactttatctaatctaagagctgaaggtgagattgatgagcaagattttatggatcgtgctagacttttatgctcattagtncatacgntttaa

SEQ ID NO: 21004 - protein, 238 aa, Unknown
  Obtained from environmental sample
  misc_feature (1)..(238): Xaa is any amino acid
MVSHEIKLIEERIDREKNPNKMFFSFANTVATIDFAKKYKGHGWVGIKYQIDPAEEEYNEIVLHLRFKENDARLQQETLGILGTNLIYGAFYKYNEPRKLLRYLYDHLDKDQIEIDTINFSGPVFKDVDNRLMSLQLVKNGMTDAVMFAPDGNNVLPARVLYKKNILALRGSFRPVTKVNIDMYEKSLDMFIKENKVDEDNTQVIFEITLSNLRAEGEIDEQDFMDRARLLCSLVHTX

SEQ ID NO: 21005 - DNA, 564 bp, Unknown
  Obtained from environmental sample
  misc_feature (1)..(564): n is a, c, g, or t
ttgggaatatctaagctgctgcaacagatatggcaaaaaattatcgataaaagagtgttgcattatgagaaatatcnacaacttcagcttaccaaaaaaggcgaacaaatggcgctaaatgtggtcagaaagcaccgcctttgggaggcattgttatttaaaatgttcgatatgtctttgcatgacattcatcgtgaagcagaattacttgagcatcaaacgtccgatttattggccaataaaattagcgaatacttaggcaatccaaagtttgaccctcatggtgatcccattcctaatgaacaaggagaaattacaactatcgatacatctgttgcgctttcaaacactaacgaaggtaaaacgtatattatatctcgtttaatgagtgatgataaagaattttttgatttttgcgctcaacatggtctaaagtatggcaacacgcttttagtatcaaaacagtttagcaaaaacaaaatgactcaaatcacaataaataataatacaattttacttaaccacgattttacaaacattatttacgtcaatgaacagcattaa

SEQ ID NO: 21006 - protein, 187 aa, Unknown
  Obtained from environmental sample
  DOMAIN (31)...(101): Iron dependent repressor, metal binding and dimerisation domain
  misc_feature (1)..(187): Xaa is any amino acid
MGISKLLQQIWQKIIDKRVLHYEKYXQLQLTKKGEQMALNVVRKHRLWEALLFKMFDMSLHDIHREAELLEHQTSDLLANKISEYLGNPKFDPHGDPIPNEQGEITTIDTSVALSNTNEGKTYIISRLMSDDKEFFDFCAQHGLKYGNTLLVSKQFSKNKMTQITINNNTILLNHDFTNIIYVNEQH

SEQ ID NO: 21007 - DNA, 810 bp, Unknown
  Obtained from environmental sample
  misc_feature (1)..(810): n is a, c, g, or t
ttgtttaaatcaatttataaagtatttgatagcagtttatttccaaaagtaattgataaatgttttatcctattattaaataaactagatactatagagtcaaaagaattaacaagagatattctatttaaacttgaaacttctagagaagaggctgatattatttattatatgaatgagccaataaaatggagaaagtctgaccattttaatgaatattttaatgtaattaatgaaaaagaatacaacgatatttcctctaaaattattcaaaataaggaggtatcaaccaaggaagtctttcaagcgttaaaatatcaaaaaatcaaaaggcctaatataaatattgaattaattgtactgggattgaaaagtgatgaagtattcgtaagaaatttatctgcttataactatatgacacgtttaacaacaattaatgacaattctatttttgcgaccattattaacgataaccatccatcagttatttttaatggattaaaagcattttttgaaaatttattcaattatgacgttgccacttatgattttcgtttggataaattcaaaacattatttaatgatgataagatattttgtattaggtcgagtagtttaatgacaacattttccactgactatgcgcatgaaagcctaaactggagagaaatagaagaagcaaacgcaaataaaatatggtactcatggggagaattatttccaatatttttgaacagttttccgagtaatgtcgggtttccacatacaccacggttttcaggcactattagagattctgttatcaaacnn

SEQ ID NO: 21008 - protein, 270 aa, Unknown
  Obtained from environmental sample
  misc_feature (1)..(270): Xaa is any amino acid
MFKSIYKVFDSSLFPKVIDKCFILLLNKLDTIESKELTRDILFKLETSREEADIIYYMNEPIKWRKSDHFNEYFNVINEKEYNDISSKIIQNKEVSTKEVFQALKYQKIKRPNINIELIVLGLKSDEVFVRNLSAYNYMTRLTTINDNSIFATIINDNHPSVIFNGLKAFFENLFNYDVATYDFRLDKFKTLFNDDKIFCIRSSSLMTTFSTDYAHESLNWREIEEANANKIWYSWGELFPIFLNSFPSNVGFPHTPRFSGTIRDSVIKX

SEQ ID NO: 21009 - DNA, 753 bp, Unknown
  Obtained from environmental sample
  misc_feature (1)..(753): n is a, c, g, or t
ttgactgaccaaataagagagcggatcattttaaaaaatggagtttattcgacagtcgataatcaattctcatggactaaagaagaaatgctaatgcaccttcaagagaacccggaaagatttagtcctaatgtgattgtgcgtccattatatgaagaagtagtgttaccaaatctctgttatattggcggcggaggtgaattagcctattggttcgaactcaaaagttattttgatgctgaaaaagttcctttccctattttattattgcgtaattcggcattgattatttcgaaaacacaaacacagaaattaagaaaattgaatatttcaccggcagaaatattcttgaaacaacaagatttgattaataaaaagataaaagaagtttctgaaattaaaattgatttttctgagcaacgtcaatttttagagaagcaatttattgaattagaacagttggcaaaattaacggacaaatcatttattggtgctgttaaagcacagcaagcgaaacagctaaagggtttagacaaattacaaaagcggttattaaaagctcaaaaaagaaaattaattgatcttgttgatagaattactgttttacaaaatgagttgttccccaatcaaagtttggaagaaagatctcgtaatttttcagaagtatatgtgaaacatggtaatgagtttatagatacattaaaatcaaancttgacccattagatggggagtttcaaattattcaattataa

SEQ ID NO: 21010 - protein, 250 aa, Unknown
  Obtained from environmental sample
  misc_feature (1)..(250): Xaa is any amino acid
MTDQIRERIILKNGVYSTVDNQFSWTKEEMLMHLQENPERFSPNVIVRPLYEEVVLPNLCYIGGGGELAYWFELKSYFDAEKVPFPILLLRNSALIISKTQTQKLRKLNISPAEIFLKQQDLINKKIKEVSEIKIDFSEQRQFLEKQFIELEQLAKLTDKSFIGAVKAQQAKQLKGLDKLQKRLLKAQKRKLIDLVDRITVLQNELFPNQSLEERSRNFSEVYVKHGNEFIDTLKSXLDPLDGEFQIIQL

SEQ ID NO: 21011 - DNA, 378 bp, Unknown
  Obtained from environmental sample
  misc_feature (1)..(378): n is a, c, g, or t
ttgtgcacaaccaacaaccaatatttacaaatcaaaacaacccttcttggagagaanaaaaaaatattcctccaaaaaaaaaaaaacatttcaaaaaaaaacagtttggacaacagaacacacatcttcttttccacaaaaccaaaannaaaaaaaaatnattacaacccttttataaaattatatattaaacccccnttaatatntttatctttctctttggacacacaatattccaccactccganaactctacaaacactattataccaacagcacaaccaacattacacaatnttttccccccacaattttntcttccacaaaccccggaaggatattcattattttttcngtttagcacaattttctttataa

SEQ ID NO: 21012 - protein, 125 aa, Unknown
  Obtained from environmental sample
  misc_feature (1)..(125): Xaa is any amino acid
MCTTNNQYLQIKTTLLGEXKKIFLQKKKNISKKNSLDNRTHIFFSTKPKXKKNXYNPFIKLYIKPPLIXLSFSLDTQYSTTPXTLQTLLYQQHNQHYTXFSPHNFXFHKPRKDIHYFFXLAQFSL

SEQ ID NO: 21013 - DNA, 738 bp, Unknown
  Obtained from environmental sample
  misc_feature (1)..(738): n is a, c, g, or t
ttgagcagcaatttaagtataaaacgattcgataacttttttagacagcaaaacctttggacacaaagtatagactctaaagccgattttgatgcaaaacaacttaactatcaactgtcacaaaatactttgacattacttaaaaataaatattaccaaactaaaaatcaattaaaaacaagtgtaaaacaagcgcaaaataattaccaaacgtctttaataagtactaaggattttacagtaaaaagtgctgtaaatggtaaagtttacgcgctttataaatcctctggcgagttggttaataccatggaacctgtagcctctattggaagtgctacaacttttattattgaaatgttagtggatgaagtggatattgtgaaaattgtaaaaaatcaagaggtattaattactctagatgcatacacaggaaaagtattagaagggaaggtgtctaaaatatatcctaaaaaggacgaacgtaatcaaacatttaaagtcgaagccatttttgtaaatcctcccgaagtgttatatccaggattatcaggagaagctaatattatcatatctaaaaaagaaaacgtgttaaccattccaagaaactacctgattaatagtaaccaagtaaaaacagcagatggtttaattaccatcaaaacaggtttgcaaaacatggaatttgtggaggttattgacggaattattaaagaaacctacatctataaaccagaataa

SEQ ID NO: 21014 - protein, 245 aa, Unknown
  Obtained from environmental sample
  misc_feature (1)..(245): Xaa is any amino acid
MSSNLSIKRFDNFFRQQNLWTQSIDSKADFDAKQLNYQLSQNTLTLLKNKYYQTKNQLKTSVKQAQNNYQTSLISTKDFTVKSAVNGKVYALYKSSGELVNTMEPVASIGSATTFIIEMLVDEVDIVKIVKNQEVLITLDAYTGKVLEGKVSKIYPKKDERNQTFKVEAIFVNPPEVLYPGLSGEANIIISKKENVLTIPRNYLINSNQVKTADGLITIKTGLQNMEFVEVIDGIIKETYIYKPE

SEQ ID NO: 21015 - DNA, 390 bp, Unknown
  Obtained from environmental sample
  misc_feature (1)..(390): n is a, c, g, or t
ttgaatatgaaaaatgaagatcatacccttaaactattttatcaaaaccttggtaagttgttttatgctattgcttgtatagatggtacaattgaagttgatgaaattaacgccttaaaatttacagtagaaaaggaatggaaattaaccgaagatacatttacaattattgatagttttagttggttacatagggatcaagattacaatgcagacacctgttttaaaagttttttgaattttatgaacactaataaaacgctatttactgaatcacgaaaagcattaatagtaaaaacagcaaatgcagtagcaagtagtttttctaatcgtaataaatcagaattaatgctgttagctaaattagatattgaattaccaaaaatatga

SEQ ID NO: 21016 - protein, 129 aa, Unknown
  Obtained from environmental sample
  misc_feature (1)..(129): Xaa is any amino acid
MNMKNEDHTLKLFYQNLGKLFYAIACIDGTIEVDEINALKFTVEKEWKLTEDTFTIIDSFSWLHRDQDYNADTCFKSFLNFMNTNKTLFTESRKALIVKTANAVASSFSNRNKSELMLLAKLDIELPKI

SEQ ID NO: 21017 - DNA, 447 bp, Unknown
  Obtained from environmental sample
  misc_feature (1)..(447): n is a, c, g, or t
ttgattggtcgaggttggttatatggttttggaaatgaaccaaaagaaactgctcaacttaaaaacacacataatttaaaatctattatttctcaaattcatcatatagaaccaggtgaaactgtaggttacaacagagcttttgttgctaaaaaagcgagtaaatctgctacaattcctgttggtcatgcagatggaatctcaagaaaattgggtaataaaaaaggttttgtactcatcaacaaccaaaaagcaaaaattattggtaatgtttgtatggatatgattatggttgatgttactaaaattgattgcaaagaaggtgatgacgtaattatttttaatagccaagaaatgatacagcatattacagatgtttctgaaacaattgtgtatgaaactttaacaggtatttctccacgtgttaaaaaagtgttaaagacttaa

SEQ ID NO: 21018 - protein, 148 aa, Unknown
  Obtained from environmental sample
  DOMAIN (23)...(147): Alanine racemase, C-terminal domain
  misc_feature (1)..(148): Xaa is any amino acid
MIGRGWLYGFGNEPKETAQLKNTHNLKSIISQIHHIEPGETVGYNRAFVAKKASKSATIPVGHADGISRKLGNKKGFVLINNQKAKIIGNVCMDMIMVDVTKIDCKEGDDVIIFNSQEMIQHITDVSETIVYETLTGISPRVKKVLKT

SEQ ID NO: 21019 - DNA, 354 bp, Unknown
  Obtained from environmental sample
  misc_feature (1)..(354): n is a, c, g, or t
atgtacacagagagcctagaagatctaaaatccaattttttgcctgatgtttttaatcatgcttatcatggtattgcaattgtaggattggatggtaaatggataaaagttaataaaagtatttgtgacctttttggctatactgaatcagacctgttagacttaacgtttcaggatattacccataaagaagatttagatattgatttggataggcttaacaagttaaaaagtggtgagattaatagttatactttgccaaaaagatactttgctaaaaatgggagtattatttgggcacaattatctgtgtctttagttaaaactgaaaaggggagcacccaagttatttaa

SEQ ID NO: 21020 - protein, 117 aa, Unknown
  Obtained from environmental sample
  misc_feature (1)..(117): Xaa is any amino acid
MYTESLEDLKSNFLPDVFNHAYHGIAIVGLDGKWIKVNKSICDLFGYTESDLLDLTFQDITHKEDLDIDLDRLNKLKSGEINSYTLPKRYFAKNGSIIWAQLSVSLVKTEKGSTQVI

SEQ ID NO: 21021 - DNA, 645 bp, Unknown
  Obtained from environmental sample
  misc_feature (1)..(645): n is a, c, g, or t
gtgattgcctgttgtgataccttaccttttcgtttggaaaacggactgagtaaggttgaaggaaaagcccagggatataaagattatagaaaattattggacaacccagatattgatgcagtcttgatttcaacacctttgaatacccattcaaaaattgcaatggatgccttggatgcgggcaaacacgtatactgcgaaaaaaccatggcaaaaggttatgatggcattcaacatttagccggaaaagtcaaatcttctagtaaaattttccagacgggacaccaatatcacagttcacgattatatacgcatgtcgtaagcatgattaaaaatgggacaattgggaagataactgcttttgaatgccaatggaacaggaatggaaactggcgaagacccgttcccagtccagaattggaacgtgccatcaattggcgaatgtataaggaattttcgggaggtctggctgccgagctctgctctcaccaaattgattttgcgaattgggtaaccgaatccactcctgacaaggtaatgggtatgggcggaatcgattattggaaagatggtcgtgaaacgtacgacaacattcatcttctttataactatcccaacggtgtaaaggctaaattcacttgttga

SEQ ID NO: 21022 - protein, 214 aa, Unknown
  Obtained from environmental sample
  DOMAIN (1)...(95): Oxidoreductase family, NAD-binding Rossmann fold
  misc_feature (1)..(214): Xaa is any amino acid
MIACCDTLPFRLENGLSKVEGKAQGYKDYRKLLDNPDIDAVLISTPLNTHSKIAMDALDAGKHVYCEKTMAKGYDGIQHLAGKVKSSSKIFQTGHQYHSSRLYTHVVSMIKNGTIGKITAFECQWNRNGNWRRPVPSPELERAINWRMYKEFSGGLAAELCSHQIDFANWVTESTPDKVMGMGGIDYWKDGRETYDNIHLLYNYPNGVKAKFTC

SEQ ID NO: 21023 - DNA, 378 bp, Unknown
  Obtained from environmental sample
  misc_feature (1)..(378): n is a, c, g, or t
gtgaaagtatattatgattccaaagaggtcgacttttcaacccttgtaaaagtattctttggctcgcatgaccctacaactttaaaccgacaagggcctgaccgtggtgcacaatatcgttctattgcattttatactaatgagaatgagaaaaaaataattgaagactacattgcgcaactaacaaaagacgggggctataacggtcccattattacccaagtagaaaaattcgtcaaattttatgatgcagaggattaccatcaggattatgaaaaattgaatccgaacaatccgtatatcataaatatttcaattcccaggtataaaagatttcagtctaaataccctgatcttatgaaaaaaggaggccattag

SEQ ID NO: 21024 - protein, 125 aa, Unknown
  Obtained from environmental sample
  DOMAIN (1)...(105): Peptide methionine sulfoxide reductase
  misc_feature (1)..(125): Xaa is any amino acid
MKVYYDSKEVDFSTLVKVFFGSHDPTTLNRQGPDRGAQYRSIAFYTNENEKKIIEDYIAQLTKDGGYNGPIITQVEKFVKFYDAEDYHQDYEKLNPNNPYIINISIPRYKRFQSKYPDLMKKGGH

SEQ ID NO: 21025 - DNA, 417 bp, Unknown
  Obtained from environmental sample
  misc_feature (1)..(417): n is a, c, g, or t
atgaccacattatttctgtatatagctctcagcctcggatttatgaccactgaaaaccctaaattaaccataaatgttaccaatattgaatccgtaaagggcaaccttgttattgggatatttaatactcatgaaaattttcttgagaatggttcagccattaaaacctacacttttaaagttgatagcaccacaaaacaaattgtcatttctgatttgcctaaaggagagtatgccatatcaatgtatcatgatgaaaattctgatgatgaatgcaaccgtaactttctcggaattcctaaggagggttacgccttttcaaataatgtcaaacctaaattttccgcaccaacatttaaagaatgtaaattcaccttgtctgaagacacttctttagccataaaaatgttgaattaa

SEQ ID NO: 21026 - protein, 138 aa, Unknown
  Obtained from environmental sample
  misc_feature (1)..(138): Xaa is any amino acid
MTTLFLYIALSLGFMTTENPKLTINVTNIESVKGNLVIGIFNTHENFLENGSAIKTYTFKVDSTTKQIVISDLPKGEYAISMYHDENSDDECNRNFLGIPKEGYAFSNNVKPKFSAPTFKECKFTLSEDTSLAIKMLN

SEQ ID NO: 21027 - DNA, 756 bp, Unknown
  Obtained from environmental sample
  misc_feature (1)..(756): n is a, c, g, or t
ttgtatacgctggcaggtttgtgtgtgcgcaataaagttgaagttcaaattgatggtaatttgctggaatcagataaattagcagatagtctgcttaatgctcgtagccgtgaaaacatggttttagagccacagttagactttacgccctcacagatacgtcacctaaaagagttttatcaaggtttttttgactctcctccaagtaacactgaggcgaaagcattagcggttgaaaccatcgagagcctcaaagaaaagattattaagattgaagacctcttaaaagctatcaatagctatccattccttcgtgagttggaaccagcgatcaatcagcttagagtattaacgaaagagccgtactcatggtttttgacacagctaaatgaagatgttgaggatgaactattcaatgtcaaagaagatacgctagatctgatttttggttttatgaatgggtctcaaaaaaagatatatgacgatgcaaaagcttatttaagccgccatgagtcgaacttgaaatatatcgatagtgctgaagcgaatgtcttgagtaggagcctggaagatactgcaatctttaaaggaaataagattcagcaggtaaaatcgcttctagacactctaaaagatcaagttcaatcagcgtgtgagcaggctcgacaagatgctatcgatgctattaatttgatgcaatcacgtatgcaaaaaacaaaagaatatggcaagttaccagaggttaaggcaagctga

SEQ ID NO: 21028 - protein, 251 aa, Unknown
  Obtained from environmental sample
  misc_feature (1)..(251): Xaa is any amino acid
MYTLAGLCVRNKVEVQIDGNLLESDKLADSLLNARSRENMVLEPQLDFTPSQIRHLKEFYQGFFDSPPSNTEAKALAVETIESLKEKIIKIEDLLKAINSYPFLRELEPAINQLRVLTKEPYSWFLTQLNEDVEDELFNVKEDTLDLIFGFMNGSQKKIYDDAKAYLSRHESNLKYIDSAEANVLSRSLEDTAIFKGNKIQQVKSLLDTLKDQVQSACEQARQDAIDAINLMQSRMQKTKEYGKLPEVKAS

SEQ ID NO: 21029 - DNA, 618 bp, Unknown
  Obtained from environmental sample
  misc_feature (1)..(618): n is a, c, g, or t
atgaccttaccgtaccttttgcaagatatgtggttacaacaccaaaatgaaattgaatttccatttaaacggtaccagacacaattagtttggagagcagacaggccacaaaaaggacgattcagagagttctatcaatgtgacgctgatgtggtaggaagtacgtcgttatggcaagaggtggagtttgtacaattgtacgatgatgtatttaccaatcttggcttatcaaacactacaattaaaattaataatagaaagatcttatctggaattgctgaaattatcggagctaaagataaattaatagattttacggttgctctagacaagttagataaaataggaaaagaaggcgtagtcaaggagatgttatcgaagggaatttctcaagaagcaatcgataaagtagatcccttatttagttttacaggttccaacaaagaaaagttgaatcaattgaaagggatgctgaaaaattccgacgaaggttctcaaggtgtaaatgatttacaatttgtaattgatacgatttcgaatttaggtttacagacatccaacctttcagttgatgttaccttagcgagaggtttgaattatatacgggtgctattttga

SEQ ID NO: 21030 - protein, 205 aa, Unknown
  Obtained from environmental sample
  misc_feature (1)..(205): Xaa is any amino acid
MTLPYLLQDMWLQHQNEIEFPFKRYQTQLVWRADRPQKGRFREFYQCDADVVGSTSLWQEVEFVQLYDDVFTNLGLSNTTIKINNRKILSGIAEIIGAKDKLIDFTVALDKLDKIGKEGVVKEMLSKGISQEAIDKVDPLFSFTGSNKEKLNQLKGMLKNSDEGSQGVNDLQFVIDTISNLGLQTSNLSVDVTLARGLNYIRVLF

SEQ ID NO: 21031 - DNA, 432 bp, Unknown
  Obtained from environmental sample
  misc_feature (1)..(432): n is a, c, g, or t
ttgctatggaatacattaaagctaatgccgatgcaatttggaataaatcctgaagtttttgctaagtacaatgtgcatattcatgtaccagaaggagcaacacctaaagatgggccaagtgcaggtgtaaccatgttaacttctttagtatctttgtttacccagcgtaaagtgaaaaagagcttagcgatgacaggtgaaattacacttagaggtaaagtattacccgtaggaggcattaaagagaaaatcttagcagctaaacgagctcgtatcaaagagattttactttgtgaagataatcgtagagatatagatgaaattaaaccagaatatctaaagggattaacatttcactatgtgaaagatatgagtgatgtcttaaaactagcacttacgaaacaaaaagtacagaatgctaaaaaagtttaa

SEQ ID NO: 21032 - protein, 143 aa, Unknown
  Obtained from environmental sample
  DOMAIN (4)...(134): Lon protease (S16) C-terminal proteolytic domain
  misc_feature (1)..(143): Xaa is any amino acid
MLWNTLKLMPMQFGINPEVFAKYNVHIHVPEGATPKDGPSAGVTMLTSLVSLFTQRKVKKSLAMTGEITLRGKVLPVGGIKEKILAAKRARIKEILLCEDNRRDIDEIKPEYLKGLTFHYVKDMSDVLKLALTKQKVQNAKKV

SEQ ID NO: 21033 - DNA, 435 bp, Unknown
  Obtained from environmental sample
  misc_feature (1)..(435): n is a, c, g, or t
gtgactattatattatcctctttgactttattgtctttatataattatataaacagattacacaatgaaaaagaaaagaagcangctctagttgaatgtatggtttgggcaatagaccactatgaaaaagtagattgtaattttgaattacacccagactatggaacaaaagtagagccatacaacgcatctagaagtaaaatgaaaaagaaggaagtaaatgccgctactaaattcttttcagaagaaaccggccaacctttgatatggtattacaaaactaagaaagaaactttagaatattttaatttaccaggtttccatcctgttaatggagaaacattaaaaaaaataactgaaggaatgattgaaaaatatgtccctgttcacatagctcaaccggattcttttatttcctcagacaccacagattag

SEQ ID NO: 21034 - protein, 144 aa, Unknown
  Obtained from environmental sample
  misc_feature (1)..(144): Xaa is any amino acid
MTIILSSLTLLSLYNYINRLHNEKEKKXALVECMVWAIDHYEKVDCNFELHPDYGTKVEPYNASRSKMKKKEVNAATKFFSEETGQPLIWYYKTKKETLEYFNLPGFHPVNGETLKKITEGMIEKYVPVHIAQPDSFISSDTTD

SEQ ID NO: 21035 - DNA, 393 bp, Unknown
  Obtained from environmental sample
  misc_feature (1)..(393): n is a, c, g, or t
atgcaggacgaaagaaagaacgttaattttgtaatcaatattgaagaatataaactcaacattaatgaggccattccattgggattactatttaatgaattgattacgaattcttttaaatatgcatttaaagaccaggaaaagagaataatacatatagatttatcagctgaaagaaataaaatatcagtgctatatgaggataatggcgtaggttatggctcttctgtaaactttgatgagcccaaaaatttaggtttaaatttaattcatgctcagcttcagcaacttgctgcagaatacaaagtagatactgactcaaagtttagattggagttcagttttataggcaaaatggtaggttcacatggtaatgtttcacatagtagctag

SEQ ID NO: 21036 - protein, 130 aa, Unknown
  Obtained from environmental sample
  DOMAIN (22)...(116): Histidine kinase-, DNA gyrase B-, and HSP90-like ATPase
  misc_feature (1)..(130): Xaa is any amino acid
MQDERKNVNFVINIEEYKLNINEAIPLGLLFNELITNSFKYAFKDQEKRIIHIDLSAERNKISVLYEDNGVGYGSSVNFDEPKNLGLNLIHAQLQQLAAEYKVDTDSKFRLEFSFIGKMVGSHGNVSHSS

SEQ ID NO: 21037 - DNA, 513 bp, Unknown
  Obtained from environmental sample
  misc_feature (1)..(513): n is a, c, g, or t
ttgantcggctcgagtgtgatctggatgcaatttggtttgtggtcacccctcaaagtccctttaaagtaaaagcgagcatgcttaataatcacgatcgtctggaaatggtgtaccgtgctacagaaggttacgataaattacgccccagtgctattgaatttggcttgccacagcctaattacaccatcaatacccttacctatttacaagagaagtatcccaaatacgaatttgccttaattatgggcgaagacaatcttaaaagtctccacaagtggaaaaactacgaattgattttagaaaatcatcacctttatgtgtatccgcgactttcagagggtgtatttgagacacagtttgatcagcacccaaaaattcaccatgtggccgcacccattatggaaatttcctccacttttattagaaagtccatcaaaaagggcaaaaacgtccaacctatgttgcctgcttctgtttggaattatatagatgagatgcatttttacagataa

SEQ ID NO: 21038 - protein, 170 aa, Unknown
  Obtained from environmental sample
  DOMAIN (4)...(144): Cytidylyltransferase
  misc_feature (1)..(170): Xaa is any amino acid
MXRLECDLDAIWFVVTPQSPFKVKASMLNNHDRLEMVYRATEGYDKLRPSAIEFGLPQPNYTINTLTYLQEKYPKYEFALIMGEDNLKSLHKWKNYELILENHHLYVYPRLSEGVFETQFDQHPKIHHVAAPIMEISSTFIRKSIKKGKNVQPMLPASVWNYIDEMHFYR

SEQ ID NO: 21039 - DNA, 366 bp, Unknown
  Obtained from environmental sample
  misc_feature (1)..(366): n is a, c, g, or t
ttgccaatggcccaccataacgaactcggtaaaataggcgaaaaacttgccgtaaactacctactctccaagggttacgagattgtatgcaaaaactatttctatcaaaaagcggagattgatatcattgcaaagcatcaacatatgatggtttgtgtggaagtcaaaacccgaaactcagacttttttggagatcctcaagattttgtaacgcccagtaaaatcaaattattggtcaaagccatggacgcttttattattgagaatgaaattgagctagaatcacgtttcgatattattgccgttttaaaaaacaagagcagagaagaagtaacgcattatgaaaatgcgttttatcatttctaa

SEQ ID NO: 21040 - protein, 121 aa, Unknown
  Obtained from environmental sample
  DOMAIN (12)...(103): Uncharacterised protein family UPF0102
  misc_feature (1)..(121): Xaa is any amino acid
MPMAHHNELGKIGEKLAVNYLLSKGYEIVCKNYFYQKAEIDIIAKHQHMMVCVEVKTRNSDFFGDPQDFVTPSKIKLLVKAMDAFIIENEIELESRFDIIAVLKNKSREEVTHYENAFYHF

SEQ ID NO: 21041 - DNA, 315 bp, Unknown
  Obtained from environmental sample
  misc_feature (1)..(315): n is a, c, g, or t
ttgattagttttgtagctcataaaaaaactaaaaatattgatatggtagatacaaatacgaaatcgatttcgttaaatagtctaggaatcaagaatgctacagttcgttatcagttaacttctaacgaattacatcaagaaacacttcaaaaagaacaaggagtagaatcttctttaggagcaattgcagtaaatactggtgagtttacaggacgatctcctatggatcgttttattgtaaaagacagtattaccgaagatacagtttggtggagcaaaattaattaccttttgaagaagataaattcgataaan

SEQ ID NO: 21042 - protein, 105 aa, Unknown
  Obtained from environmental sample
  misc_feature (1)..(105): Xaa is any amino acid
MISFVAHKKTKNIDMVDTNTKSISLNSLGIKNATVRYQLTSNELHQETLQKEQGVESSLGAIAVNTGEFTGRSPMDRFIVKDSITEDTVWWSKINYLLKKINSIX

SEQ ID NO: 21043 - DNA, 432 bp, Unknown
  Obtained from environmental sample
  misc_feature (1)..(432): n is a, c, g, or t
atgattaggagggattttgaaaacgattcaattgtaacgcaattaagtgaaggtgctttaagagataattattttcaagatgatgataaatatttgatctatgaaaaaggagggaagcacttattaacaattgtgccaaaagaacaattagattctacttctactattaaaagtatagaaattcatgatgagcgttttaaaacagaaggaggaattaacttaaaatctaacttttctgaaataaatgccaccaacagtttaagaccagaatctactttacaatctgtaacgctgtttgttgatgagctaaatgcaaccatgactattgataaggaggaattaggtttaagagattttagaactcagaaagtatctttagcgcaaattccagatttggcaaaaataaaatcttttgtggtttggtttaattaa

SEQ ID NO: 21044 - protein, 143 aa, Unknown
  Obtained from environmental sample
  misc_feature (1)..(143): Xaa is any amino acid
MIRRDFENDSIVTQLSEGALRDNYFQDDDKYLIYEKGGKHLLTIVPKEQLDSTSTIKSIEIHDERFKTEGGINLKSNFSEINATNSLRPESTLQSVTLFVDELNATMTIDKEELGLRDFRTQKVSLAQIPDLAKIKSFVVWFN

SEQ ID NO: 21045 - DNA, 312 bp, Unknown
  Obtained from environmental sample
  misc_feature (1)..(312): n is a, c, g, or t
gtgaaatctaaagagcgtaatgctccaagaatggaagttgatttacacattaatcaacttgtaaaatcccctaaagggatgagcaatcacgaaatcctcgacttgcaaatggagaccgctaaacggcaattggaatttgccatgcgaaaacggatacaaaaagttgtttttatacatggggtaggcgagggtgtcttaaaggaagaattgaactttctttttgggaggtacgatagtataaaatattacgatgccgactatcagaaatatggcattggtgccaccgaagtttatatttatttaagcaaataa

SEQ ID NO: 21046 - protein, 103 aa, Unknown
  Obtained from environmental sample
  misc_feature (1)..(103): Xaa is any amino acid
MKSKERNAPRMEVDLHINQLVKSPKGMSNHEILDLQMETAKRQLEFAMRKRIQKVVFIHGVGEGVLKEELNFLFGRYDSIKYYDADYQKYGIGATEVYIYLSK

SEQ ID NO: 21047 - DNA, 555 bp, Unknown
  Obtained from environmental sample
  misc_feature (1)..(555): n is a, c, g, or t
atgatctcagatcgtagtttagtcttgttagatgaaattggaagaggaacaagtacctatgacggaatctctattgcttgggctattagtgagtatttacacgagcatccagcaaaacctaaaacgttatttgcaacccactatcatgagttaaatgaaatgacagagacctttgagcgtattaaaaactttaatgtctctgtaaaggagttaaaagacaatgtgctatttctgcgtaagcttgttcaaggtggtagcgaacatagttttggtatacatgtagcaaaaatggctggaatgccacaacaagtgctaagacgcgctaatcagatcttgaaaaaactggaaaaaagtcattcaagcgaagaattgacagataaagtaaaatcgatgcaagatgaaatgcaattaagcttctttaatttggacgatccattgcttgaaaatataaaagaagagatcttacatatcgatattgacaccttaacacctgttgaagctttaatgaagctaaatgagatcaaacgtatgttggtgaaaaagaagcaagtataa

SEQ ID NO: 21048 - protein, 184 aa, Unknown
  Obtained from environmental sample
  DOMAIN (1)...(118): MutS domain V
  misc_feature (1)..(184): Xaa is any amino acid
MISDRSLVLLDEIGRGTSTYDGISIAWAISEYLHEHPAKPKTLFATHYHELNEMTETFERIKNFNVSVKELKDNVLFLRKLVQGGSEHSFGIHVAKMAGMPQQVLRRANQILKKLEKSHSSEELTDKVKSMQDEMQLSFFNLDDPLLENIKEEILHIDIDTLTPVEALMKLNEIKRMLVKKKQV

SEQ ID NO: 21049 - DNA, 477 bp, Unknown
  Obtained from environmental sample
  misc_feature (1)..(477): n is a, c, g, or t
atgaagcaaatagctgttttcttactgtgtttgatgttggcctcttgtcaatattttgatgtagagaagacctcttctgaagctattttaaaaaaagaactcaaaacttttaattggaaagaagtagacagttatccaagttttaaaacttgcgatactttacagttaaaattagatgctaaacagtgttttgagacaaccttagctaatcatatctcaagtaaattgcaagaacaaactattattgtgtctcaggatataaatgacacaattttattatccttattaatttcagaaaaaggagaattagttataaatgctatagaaatagatagtattactaccctagaaattccagaaattaaaactataattactaatagcctggatacgctacctacaatttatccagctatcaaacgtggacaacaggtaaagtctcagtttaaattacctatagttttacgggttaattaa

SEQ ID NO: 21050 - protein, 158 aa, Unknown
  Obtained from environmental sample
  misc_feature (1)..(158): Xaa is any amino acid
MKQIAVFLLCLMLASCQYFDVEKTSSEAILKKELKTFNWKEVDSYPSFKTCDTLQLKLDAKQCFETTLANHISSKLQEQTIIVSQDINDTILLSLLISEKGELVINAIEIDSITTLEIPEIKTIITNSLDTLPTIYPAIKRGQQVKSQFKLPIVLRVN

SEQ ID NO: 21051 - DNA, 699 bp, Unknown
  Obtained from environmental sample
  misc_feature (1)..(699): n is a, c, g, or t
ttgtgcaatttctttgcggtcttgaacgctaaaaagcttcgagaagagctgggtttgcctattaaggaaaaggtaattgaaccccttacgttagtcgacttccttaattatatgaagacggatggtctcgatttatgnccgaagatgcagcgcattcaagagctcgttgaaaaactaaaacagcgtaatgtgcttcagtatagagggggggttgatctcaattccggcttctttttcatgagagagcttactgaaagagaaaagaaaggtcgtctttggttaggtaacattcttggaagtgcatatgttggtcatgagatcgaaaaggatatcgtatatatcgaaggcacaacgccaaaaggtgacatatcagttggcactggaacgctaatcacagatggtgtgattcttacctgtgctcatgtagtcgacgatatgaaagtggattatgtgaaaataagaggacagaggtttaatattaaggatgctcgttctcacgagatagttgatgttggtttgatatttcttaatgaaactatagaacctttgtctaaagatatggctttccgggattcaaaactactagagccaattgtcattgcagggtatccaactattcctagaagcttggcacttgtttcacgcttcaaacaggagaatttcagcacaaataaaaatactatggatcatatcccatga

SEQ ID NO: 21052 - protein, 232 aa, Unknown
  Obtained from environmental sample
  misc_feature (1)..(232): Xaa is any amino acid
MCNFFAVLNAKKLREELGLPIKEKVIEPLTLVDFLNYMKTDGLDLXPKMQRIQELVEKLKQRNVLQYRGGVDLNSGFFFMRELTEREKKGRLWLGNILGSAYVGHEIEKDIVYIEGTTPKGDISVGTGTLITDGVILTCAHVVDDMKVDYVKIRGQRFNIKDARSHEIVDVGLIFLNETIEPLSKDMAFRDSKLLEPIVIAGYPTIPRSLALVSRFKQENFSTNKNTMDHIP

SEQ ID NO: 21053 - DNA, 639 bp, Unknown
  Obtained from environmental sample
  misc_feature (1)..(639): n is a, c, g, or t
ttgaaatttgaacaagaccacacggttgaaggtgtttataatgcaattggagcacatttttataaagaaagatctgcagcagaaaaacaaactttagagcttacaacgttaagtaaagctatagaaccagaacagctttttagaatcttgttatctggtagtttagggtatttttctatagatggattaacggttaaacagtctgtgtttggtacaataggtctgtttaataaaagattaaaagtgacagaagatacagatttaatatggaaaatggcattaaaatgtaagttggttgctggagtaatagaccatccagttgccatgaggggtgtacacgataacaatgtgtttgataacgaagcattgtatgaagaatataatattaagttatttgaatctattgccttttggagtactaaaaataatattgaaattgttgaaatagagcgtgttattgaaaaaatttggattttaaaaagcagacaaacccattcagttttaaaaaagattagctattggttttacttaacaataaatatgactagtacattatttacgtatctaactgtaaagtattttccattagtaagatatagaaaaacactgttttcatttatgtacaaacaagataaataa

SEQ ID NO: 21054 - protein, 212 aa, Unknown
  Obtained from environmental sample
  misc_feature (1)..(212): Xaa is any amino acid
MKFEQDHTVEGVYNAIGAHFYKERSAAEKQTLELTTLSKAIEPEQLFRILLSGSLGYFSIDGLTVKQSVFGTIGLFNKRLKVTEDTDLIWKMALKCKLVAGVIDHPVAMRGVHDNNVFDNEALYEEYNIKLFESIAFWSTKNNIEIVEIERVIEKIWILKSRQTHSVLKKISYWFYLTINMTSTLFTYLTVKYFPLVRYRKTLFSFMYKQDK

SEQ ID NO: 21055 - DNA, 675 bp, Unknown
  Obtained from environmental sample
  misc_feature (1)..(675): n is a, c, g, or t
ttggtatttaatggcgaaatatataattatattgagattagagaagaattaataaacaaaggatatgaattccgtaccgaatctgacactgaagttattttgaaatcctacgaagaatggggttatgattgtcaaaataaatttaatggaatgtgggcctttgctttatgggatgaaattaaacaagaattatttttgtcaagagatagaataggtgaaaaaccattacattattctgtttttaaaaattcttttgtttttggatcagaaatgaaatctctctttgcatatggtataccaaaaataccagatttaagtttattagagatatattttgtatctacttatataccagatccttacagtttttataagaatgtatttaaattggaggcaggttattacctagtcgtaaagaatggaaaaataaataaatataaatattgggatctacctgaaatcgatgagtcaaatatgattaaggataaagattatgtgtatgatcaatttgaatacttgttcagggattctgtcaatattagaatgcgttcagatgttccatttggagcatttttgagcggtggattggattcttcctcaatagtttctgttatgtccgaattgaccaatataccgataatacttttacaattgttatccagaaaaagaatttga

SEQ ID NO: 21056 - protein, 224 aa, Unknown
  Obtained from environmental sample
  misc_feature (1)..(224): Xaa is any amino acid
MVFNGEIYNYIEIREELINKGYEFRTESDTEVILKSYEEWGYDCQNKFNGMWAFALWDEIKQELFLSRDRIGEKPLHYSVFKNSFVFGSEMKSLFAYGIPKIPDLSLLEIYFVSTYIPDPYSFYKNVFKLEAGYYLVVKNGKINKYKYWDLPEIDESNMIKDKDYVYDQFEYLFRDSVNIRMRSDVPFGAFLSGGLDSSSIVSVMSELTNIPIILLQLLSRKRI

SEQ ID NO: 21057 - DNA, 504 bp, Unknown
  Obtained from environmental sample
  misc_feature (1)..(504): n is a, c, g, or t
gtgggcgacactggtttgaatgttaccgatgctgaaccaacaaaagacaacttaaaaacattgcataaaaccatcaaaaaggtggaagaagacattgaaaatttttcgttcaacacatccgtctcaacctttatgattgcggttaacgaattgacctcacaaaagtgtacgagtaaggtagcgttagagccgtttttaatactactctcatcttatgcgcctcatataacggaagaactgtggaatcaattaggatataatgaatctattgccacagtgccttttccagaatttgatgccaagcatttggtagaaagtagtaaaaattacccaatctctttcaacggtaaaatgaaattcaccttagaattgccaatggatatgagcaaagacgacatcgaaaaaaccgtcatggctcatgataaaaccattgctcaattagagggcagaacacctaaaaaaataatcatcgttcctgggaaaattgtgaatattgttggttag

SEQ ID NO: 21058 - protein, 167 aa, Unknown
  Obtained from environmental sample
  misc_feature (1)..(167): Xaa is any amino acid
MGDTGLNVTDAEPTKDNLKTLHKTIKKVEEDIENFSFNTSVSTFMIAVNELTSQKCTSKVALEPFLILLSSYAPHITEELWNQLGYNESIATVPFPEFDAKHLVESSKNYPISFNGKMKFTLELPMDMSKDDIEKTVMAHDKTIAQLEGRTPKKIIIVPGKIVNIVG

SEQ ID NO: 21059 - DNA, 639 bp, Unknown
  Obtained from environmental sample
  misc_feature (1)..(639): n is a, c, g, or t
ttgatcggtcgagacctgtttactcttacgaaggaagatagatacgggaaaaatgatggatgcttattacaaaaagtacaatctttangtgtaaaaatattaaataatattactgtcaaagccttttctgaaactttaaattcggtaaaaattgaaacagatcatttcgattttactaccaaaaaactatgtattgctactaacggttttgcaaagcaactcaatatatcaaaagtgaagccagcaagagctcaggtcttaataacaaagccaatagataatttgcatattaaaggaacgtttcacttagatgaagggtattattactttagaaatatcgataatagagttttgttaggaggtggacggaatctcgattttaaaactgaagaaactactgtatttggagaaacagaaattgttcaaaataaactcaaaaaccttttaaaaactacaattttgccaaatactaattttgaaatagatcatcgatggtctggaattatgggtgttggtaaacagaaaaaagctattgtaaatcgggtttcggataatgtgttttgtggagtacgtttgggaggcatgggtattgcaatcggtagttctatagggaaacaattagcggagttattagattaa

SEQ ID NO: 21060 - protein, 212 aa, Unknown
  Obtained from environmental sample
  misc_feature (1)..(212): Xaa is any amino acid
MIGRDLFTLTKEDRYGKNDGCLLQKVQSLXVKILNNITVKAFSETLNSVKIETDHFDFTTKKLCIATNGFAKQLNISKVKPARAQVLITKPIDNLHIKGTFHLDEGYYYFRNIDNRVLLGGGRNLDFKTEETTVFGETEIVQNKLKNLLKTTILPNTNFEIDHRWSGIMGVGKQKKAIVNRVSDNVFCGVRLGGMGIAIGSSIGKQLAELLD

SEQ ID NO: 21061 - DNA, 399 bp, Unknown
  Obtained from environmental sample
  misc_feature (1)..(399): n is a, c, g, or t
gtgtatataaatgaaaccttagtaggtataacaagtcaaaaagagttggattttgagatttttgaaagaggaattttaaaggtaaaaacagccaaagattgtgaaggtatttatgaaaaaaatattggagatttattatcaaccaataatccagaattaaatatatctcttataaagaatcctgtaaaagattttatagaaatttatattcctacaaatgttaaagataagaatgtagatactgtaatttttgatatgacaggcaaaatggtttataaacaaagaaatgatattgtttcagaaaagataaaaataccatttagtaattttgcaaacggaatttatattttaaaattatctatactagatgctaaacctattaaaatattaaaacaataa

SEQ ID NO: 21062 - protein, 132 aa, Unknown
  Obtained from environmental sample
  misc_feature (1)..(132): Xaa is any amino acid
MYINETLVGITSQKELDFEIFERGILKVKTAKDCEGIYEKNIGDLLSTNNPELNISLIKNPVKDFIEIYIPTNVKDKNVDTVIFDMTGKMVYKQRNDIVSEKIKIPFSNFANGIYILKLSILDAKPIKILKQ

SEQ ID NO: 21063 - DNA, 771 bp, Unknown
  Obtained from environmental sample
  misc_feature (1)..(771): n is a, c, g, or t
ttgatcggtcgagaagatggctttgtggacaagctcaacagggtacgtcaggaacaaggggtggtgattggtcgaggtactgaaagtttaattaacaaagatgatcctgactgcgtttggcgccaaagaaaaatcaaatcaaaaggcgctactgatagagtaattattcaaatgtggtccccagtcagggcattggcactcctgataaaactgcatttaccactgagaacctatcaaataagaatgttagactccggagaggatgatacttggaaatatgacaataaatcttggatacaaaatgaaagtaaattaacaaaaacctcaagtcctaaattggttgaaaaaggtgtttttaggagaatatatgatcaatatacttcaacttatacaacaggactattcataaacactaataaaacctctgatgctgaagttgacgctgggtatgtaataccgtggaaccaccaagaagttttatattggcttgaaaaacttagaaactggcagaaaaaatataacccgatacaaagacctatacattgtaaagaactttcaaaaaggcatttaggcactactaaatctaaacttcaactcaatgcaatgggaaatatgtgttttttatttcgagacccaacagctcaaggagatgataagtttaaacctattgatgctgattccttaaagcgtatttggcactctttattattagagctcgaaaataatctatttagtgcgggtgatactcttgataatggagaaaaactcagn

SEQ ID NO: 21064 - protein, 257 aa, Unknown
  Obtained from environmental sample
  misc_feature (1)..(257): Xaa is any amino acid
MIGREDGFVDKLNRVRQEQGVVIGRGTESLINKDDPDCVWRQRKIKSKGATDRVIIQMWSPVRALALLIKLHLPLRTYQIRMLDSGEDDTWKYDNKSWIQNESKLTKTSSPKLVEKGVFRRIYDQYTSTYTTGLFINTNKTSDAEVDAGYVIPWNHQEVLYWLEKLRNWQKKYNPIQRPIHCKELSKRHLGTTKSKLQLNAMGNMCFLFRDPTAQGDDKFKPIDADSLKRIWHSLLLELENNLFSAGDTLDNGEKLX

SEQ ID NO: 21065 - DNA, 702 bp, Unknown
  Obtained from environmental sample
  misc_feature (1)..(702): n is a, c, g, or t
nnctggaatggtggtgaacttctagttaataaagctagagcaatagaccgagtatatggaaaagtaccaaatggtccagagaattgcattaggtgtaggtggttcatcaccgaagctgtttatttaccaaaactaaatgctttatttaatcagttaagctacaaagctcatgaagcgtcaagcttagcattagatttagaaaaaaagttagataaactcaaagacacaaagtttatcgcagagcagaacagcaaaccatttttaaaatttgaagagcttcgatcactacaacgtaggtatgaaaaacaaaaagttgaatctgatgaatacactaaagactggatatcatgttttggcctgatatctaaaattatacagctagaagaaaaccgagaaactgacaataataaaaataaattaattgccttaggaaatacaactgatgtaaatatggctttgaagttcgttgaaactaaatctgaactattacatctatcatgcttatgtgaggatgcggaaatatacccagattttatggatacattacaaaaaactccagcattaaagcaacgtacaattcaattaagtcggatcttactcaagcaaggtaagaaacctattttcttagaaatgggtgataaagaacaattaattgctggaaatgcaatgataagacaaatggctaaaatgccgccccgatga

SEQ ID NO: 21066 - protein, 233 aa, Unknown
  Obtained from environmental sample
  misc_feature (1)..(233): Xaa is any amino acid
MWNGGELLVNKARAIDRVYGKVPNGPENCIRCRWFITEAVYLPKLNALFNQLSYKAHEASSLALDLEKKLDKLKDTKFIAEQNSKPFLKFEELRSLQRRYEKQKVESDEYTKDWISCFGLISKIIQLEENRETDNNKNKLIALGNTTDVNMALKFVETKSELLHLSCLCEDAEIYPDFMDTLQKTPALKQRTIQLSRILLKQGKKPIFLEMGDKEQLIAGNAMIRQMAKMPPR

SEQ ID NO: 21067 - DNA, 519 bp, Unknown
  Obtained from environmental sample
  misc_feature (1)..(519): n is a, c, g, or t
gtgaaggcagttaaaaaatttaaagatagagatggtacaattggtggcgaaattttaaagcgatttaatctaattgtagattattcaaactctaagattactcttaaaaaaaatagtagttttcatgatgcgtttagttataataaaagtggtttgcaagtagagcacgatggtgtaagagtggtcatggagattaatgttgaagaaaacagtgctcatattagaagtgaacagtccaattccattgcagttaatagtgtagtaaagacaaatcgtaatttttcattaaaaccaacatatatagtacataatgttgtcaaaaactctcctgcttattgggctggagtccaaaaaggtgatgttatattaacaataaataataaaattacttttgatttaacattagatcgtattgttaatcacttttataaaaaatcaggtactcaaattaaattgttagtcaatagaaatggttacgaaaaagaaattaaatttagattaaaatctcccatagaatag

SEQ ID NO: 21068 - protein, 172 aa, Unknown
  Obtained from environmental sample
  DOMAIN (81)...(155): PDZ domain (Also known as DHR or GLGF)
  misc_feature (1)..(172): Xaa is any amino acid
MKAVKKFKDRDGTIGGEILKRFNLIVDYSNSKITLKKNSSFHDAFSYNKSGLQVEHDGVRVVMEINVEENSAHIRSEQSNSIAVNSVVKTNRNFSLKPTYIVHNVVKNSPAYWAGVQKGDVILTINNKITFDLTLDRIVNHFYKKSGTQIKLLVNRNGYEKEIKFRLKSPIE

SEQ ID NO: 21069 - DNA, 324 bp, Unknown
  Obtained from environmental sample
  misc_feature (1)..(324): n is a, c, g, or t
atggagttaacagcgnttaaaaatgtaaataagcgtgaaattttagagccgttattggttttattatcaccttatgcacctcatattacagaagaattatatagtaaattagggcatacagaaagtattgcaacagctccttttcctatttttgatgaaaagcatttagaggaaagctctaaagaatatccaatttcttttaacggaaaaatgcgttttacactagaactttctcttgctttatcgaaagatgaaatagaaaaagcagttatggaaaacgaaaaaacaattgcgcaattagaaggtaaactcctaagaaagtaa

SEQ ID NO: 21070 - protein, 107 aa, Unknown
  Obtained from environmental sample
  misc_feature (1)..(107): Xaa is any amino acid
MELTAXKNVNKREILEPLLVLLSPYAPHITEELYSKLGHTESIATAPFPIFDEKHLEESSKEYPISFNGKMRFTLELSLALSKDEIEKAVMENEKTIAQLEGKLLRK

SEQ ID NO: 21071 - DNA, 456 bp, Unknown
  Obtained from environmental sample
  misc_feature (1)..(456): n is a, c, g, or t
ttgctaaaagcgttgttagatggtagaatagatgttatcgccaccgatcacgcacctcatactttagaagaaaaggaaaacgtatatactaaggcaccgtcgggcggaccattagtgcaacacgctatgcctgccttgctagaattatatcatcgcaataaaatatctatcgagaaaatagtagaaaaaacgagtcataatcctgcaattttatttcaagtggaaaaacgcggatacattaaagaaggctattatgccgatttagtatttgtggatttaaacagtccttggacggttaaaaaagataatattctatacaaatgtggttggtctccttttgaaggtacaacttttaaatctagaataacacatacttttgttaatggaggtttagcttataaaaactttaagttttacgatactaaatatgctaaacaacttactttcgatagatag

SEQ ID NO: 21072 - protein, 151 aa, Unknown
  Obtained from environmental sample
  misc_feature (1)..(151): Xaa is any amino acid
MLKALLDGRIDVIATDHAPHTLEEKENVYTKAPSGGPLVQHAMPALLELYHRNKISIEKIVEKTSHNPAILFQVEKRGYIKEGYYADLVFVDLNSPWTVKKDNILYKCGWSPFEGTTFKSRITHTFVNGGLAYKNFKFYDTKYAKQLTFDR

SEQ ID NO: 21073 - DNA, 420 bp, Unknown
  Obtained from environmental sample
  misc_feature (1)..(420): n is a, c, g, or t
ttgttaaagggagatacatataagaccatagcaagatcgtcagacgaggttatatttaaggacagaggtagtaaatttttgggttatgcctatccgttgcaatgtgaagaaaaggttaaagagataattgaccgattaaaaaaaaatcaccataaggcacgccattggtgttacgcctggcaaataggaactgatgccgttcaatttcgagttaatgatgatggtgagcctaataattctgcaggacagcccatttatggtcaaattctttcgaaggaattaacaaatgttttagtggttgtagtgcgctattttggtggcacaaaattaggagttggaggtttggtgaatgcctatagaacagcagctcaattagcattagaatcatctcaaataatacaaaaactgtcgatattctga

SEQ ID NO: 21074 - protein, 139 aa, Unknown
  Obtained from environmental sample
  DOMAIN (21)...(128): Uncharacterized protein family UPF0029
  misc_feature (1)..(139): Xaa is any amino acid
MLKGDTYKTIARSSDEVIFKDRGSKFLGYAYPLQCEEKVKEIIDRLKKNHHKARHWCYAWQIGTDAVQFRVNDDGEPNNSAGQPIYGQILSKELTNVLVVVVRYFGGTKLGVGGLVNAYRTAAQLALESSQIIQKLSIF

SEQ ID NO: 21075 - DNA, 324 bp, Unknown
  Obtained from environmental sample
  misc_feature (1)..(324): n is a, c, g, or t
gtgaagaccattattgttaccgaaaaagtgaatgaaataaagggtgacaatctgttttatgaacaggtagatttttcaaaggatttagcacagcaaatttgtaagattttgtataagcatgaaatacaatcaattattattgagggtggtagacaaacgttgcaaacttttattgatgctaatttatgggatgaggcaagaatttttattggaggaaaaactttttcaatgggagttattgcacctaatattagtggtgaagaaacttgtacgataaaaatccaaaatgatatattaaaaattcttaaaaacaaaaattgttaa

SEQ ID NO: 21076 - protein, 107 aa, Unknown; identical to SEQ ID NO: 20652
  Obtained from environmental sample
  misc_feature (1)..(107): Xaa is any amino acid

SEQ ID NO: 21077 - DNA, 486 bp, Unknown
  Obtained from environmental sample
  misc_feature (1)..(486): n is a, c, g, or t
ttgcaatcaaatagcaagttaccaacaataaaaaaggacatgagtatatttaaaaaaatcgacaaagtattaggtgcatttggaaatataagagcgctagaacgaacccatgtggatacatacacggaaaatctaatacagaatatcgctggacagaaaattgccgaatcggttgatggtcaattatggattgattttcaagaattagctggatttgattttcttgaatctactattctgggtagaacaaacattaaaacttttgacggaggtaaattaatcttgagaggagaaaacgaaagtttgacattaaacaccgatatcacggaaatcgtatctgactattccaatgtatctaattgctggctgactaaaataagctatgttgtttcaaaggataatattaagttcatagaagaaaagaaacccgacgtaataaggtttgaatacaagaaaaagtcaatcgcctttaaagtaataaaataa

SEQ ID NO: 21078 - protein, 161 aa, Unknown
  Obtained from environmental sample
  misc_feature (1)..(161): Xaa is any amino acid
MQSNSKLPTIKKDMSIFKKIDKVLGAFGNIRALERTHVDTYTENLIQNIAGQKIAESVDGQLWIDFQELAGFDFLESTILGRTNIKTFDGGKLILRGENESLTLNTDITEIVSDYSNVSNCWLTKISYVVSKDNIKFIEEKKPDVIRFEYKKKSIAFKVIK

SEQ ID NO: 21079 - DNA, 414 bp, Unknown
  Obtained from environmental sample
  misc_feature (1)..(414): n is a, c, g, or t
ttggttaagatttcagaatccaatacgattcgagttaccaattttgaggttgcccagataaaggctgaaaaagataataacaagagaaagaacaaactgattgtgaaatctaaagagcgtaatgctccaagaatggaagttgatttacacattaatcaacttgtaaaatcccctaaagggatgagcaatcacgaaatcctcgacttgcaaatggagaccgctaaacggcaattggaatttgccatgcgaaaacggatacaaaaagttgtttttatacatggggtaggcgagggtgtcttaaaggaagaattgaactttctttttgggaggtacgatagtataaaatattacgatgccgactatcagaaatatggcattggtgccaccgaagtttatatttatttaagcaaataa

SEQ ID NO: 21080 - protein, 137 aa, Unknown
  Obtained from environmental sample
  misc_feature (1)..(137): Xaa is any amino acid
MVKISESNTIRVTNFEVAQIKAEKDNNKRKNKLIVKSKERNAPRMEVDLHINQLVKSPKGMSNHEILDLQMETAKRQLEFAMRKRIQKVVFIHGVGEGVLKEELNFLFGRYDSIKYYDADYQKYGIGATEVYIYLSK

SEQ ID NO: 21081 - DNA, 618 bp, Unknown
  Obtained from environmental sample
  misc_feature (1)..(618): n is a, c, g, or t
gtgaatctaaatgaaatgataaccacagctcaattgctacaatgtgctattactaagtttactagatttggtagtaagcacgttactttagaggatttggcaactgagcttggtatatctaaaaaaacaatttattctttttttaaaaacaaagaagacttagtaacatcaagtctagaaagtttattaaacgagtataaaaacgatataaatgggattgttaatagcaatggtaaagatcctgttttgtgtgttattttaatttaccgtagagggtttgagtatttaaaatactttaaaccctcttttatttttggattacaaaaatactaccctaaagcaagtttgttacttgataatttctctgaagaattagcacataaaaccatacaagatttatttattgaagcacaattaaaaggcgatataagacccgaaattaatattgaattaataataaaaatctatttttttagaattgacaatcttgtttttaaagaaaataatttatttgaaatttatacaaaagacgtgttgtttaggcatttggtgttgtataatttaaaagggattgtaaattatagttacactaatagatatttagaacttgaattttaa

SEQ ID NO: 21082 - protein, 205 aa, Unknown
  Obtained from environmental sample
  DOMAIN (12)...(58): Bacterial regulatory proteins, tetR family
  misc_feature (1)..(205): Xaa is any amino acid
MNLNEMITTAQLLQCAITKFTRFGSKHVTLEDLATELGISKKTIYSFFKNKEDLVTSSLESLLNEYKNDINGIVNSNGKDPVLCVILIYRRGFEYLKYFKPSFIFGLQKYYPKASLLLDNFSEELAHKTIQDLFIEAQLKGDIRPEINIELIIKIYFFRIDNLVFKENNLFEIYTKDVLFRHLVLYNLKGIVNYSYTNRYLELEF

SEQ ID NO: 21083 - DNA, 456 bp, Unknown
  Obtained from environmental sample
  misc_feature (1)..(456): n is a, c, g, or t
atggagaacataacggaaaacccatacttttcaaaaattgttttgacaattcttgcagttgtaatcaaacttgctattgactcaattacgaaagagaaagaagacgcaaaaggacttataaaactgatttcgtttttcgtgttttaccttttacctgtgacaattattgtttggataaacctcgacaatcaagttgaaaacaataaactaactttcactataattgcattcaatattggtttattagtttttaactatttacaaacaagagtaacagaaaccaataaaatgttggctcaattagcaaaagcggaatttgataaagttgagaaagtaaagcaaataaatgaagttcaggttgagaaagtaaaagcaatcaacgaaaatcagaaatatattttaaacgagttgtcgaaaataaacgatagaataattggatatttcaaagataaatag

SEQ ID NO: 21084 - protein, 151 aa, Unknown
  Obtained from environmental sample
  misc_feature (1)..(151): Xaa is any amino acid
MENITENPYFSKIVLTILAVVIKLAIDSITKEKEDAKGLIKLISFFVFYLLPVTIIVWINLDNQVENNKLTFTIIAFNIGLLVFNYLQTRVTETNKMLAQLAKAEFDKVEKVKQINEVQVEKVKAINENQKYILNELSKINDRIIGYFKDK

SEQ ID NO: 21085 - DNA, 708 bp, Unknown
  Obtained from environmental sample
  misc_feature (1)..(708): n is a, c, g, or t
ttgttatttgtacaacaaactgttgcacaaactaaagttgcagataacttttttagagatttttcttatgaaaaagctgcagagctgtataaggaagcaatcaaaaaagaagatagtacagaacatatattgaaaagaattggtgactgctatttcaatattagtaagcttgaaaaagcagaattttggtataataaagccataaacaaatatccttctatcgatactgaatacatatataaatatgtacaaactttaagaagtcaaaaaaaatacgaattagcaaacgactatttaagaacgtttaataataaaaacaaaaaggataatcgtattaaaaatattgacaactttaatattgaaaactacaatcaattaactaatacagagaaggtatatgtcgaacttgaaaaccttcctattaataccagatattcagattttggaggttatgagtttaaagataagttatactactactctacttgggttaaagattctatcacagatgaaaatgaattatacgattggaataacgaacctttcttaaatatttttgaagctgatataaaaattgaaaatgctattaaatcttttaacgattcaaaaaaactaaacgctacggtaaatacaaaagatgaccatgaagggttagtaactattactaacgatggtaaactatgtactttactagaacaatgtaaataa

SEQ ID NO: 21086 - protein, 235 aa, Unknown
  Obtained from environmental sample
  misc_feature (1)..(235): Xaa is any amino acid
MLFVQQTVAQTKVADNFFRDFSYEKAAELYKEAIKKEDSTEHILKRIGDCYFNISKLEKAEFWYNKAINKYPSIDTEYIYKYVQTLRSQKKYELANDYLRTFNNKNKKDNRIKNIDNFNIENYNQLTNTEKVYVELENLPINTRYSDFGGYEFKDKLYYYSTWVKDSITDENELYDWNNEPFLNIFEADIKIENAIKSFNDSKKLNATVNTKDDHEGLVTITNDGKLCTLLEQCK

SEQ ID NO: 21087 - DNA, 408 bp, Unknown
  Obtained from environmental sample
  misc_feature (1)..(408): n is a, c, g, or t
atgtggttctggattaaacatttatcactggctgcggggctaataattctcgcagtctactttttattaggtgatggtccagtatttgattttaaagaatcaaacaatgcagcggcgcaaggattaagtcggttttactcttcaattcgtaataaagtgagcagcgagcaaggtaagtttgtattgcagcttaaaaagccagaacaaactcttgagcgtgttttagctgagcgcatgcgtattattgaaccgattccaaaaacctggacaggtaaaattgagcctcgacgctttgaaaacgggtcaacactaaaaaaggcgttatcgcaatatgccagtaatgaaggcatagagttatattggtatttaagtaaagattacgtcgttaaagatcattttagagtcgaa

SEQ ID NO: 21088 - protein, 136 aa, Unknown
  Obtained from environmental sample
  misc_feature (1)..(136): Xaa is any amino acid
MWFWIKHLSLAAGLIILAVYFLLGDGPVFDFKESNNAAAQGLSRFYSSIRNKVSSEQGKFVLQLKKPEQTLERVLAERMRIIEPIPKTWTGKIEPRRFENGSTLKKALSQYASNEGIELYWYLSKDYVVKDHFRVE

SEQ ID NO: 21089 - DNA, 501 bp, Unknown
  Obtained from environmental sample
  misc_feature (1)..(501): n is a, c, g, or t
atgccaacaaagatctattcaacagccaaaatacttatagtggaggagcaaccgctcgcccaaagctatatgaaacaatcgctagaaaagcttggctttggacagttacgatttgcagatcatgctaactcggcaaaagagcagtgtataaacgagcaatttgatttaattgtatgctcattcaatctaaataagcatcaagatggttatcagctttatgaggaattgcgaataaagcagttaattaaaagctccactgggtttatttttatttctgcagaaacaagtggctcgcttgtacatagtgttcttgaattacaacccgatgattttttggttaaaccatttacagcacaagagcttaaaatacgtatagagcgtattttaaaacgtaaacgtgatttacaaacagtttacaactttattgatgacggtaatgattccaaagcacttaagtacataagtgcagcattaaataaaaacaacaactacagccctatt

SEQ ID NO: 21090 - protein, 167 aa, Unknown
  Obtained from environmental sample
  DOMAIN (9)...(133): Response regulator receiver domain
  misc_feature (1)..(167): Xaa is any amino acid
MPTKIYSTAKILIVEEQPLAQSYMKQSLEKLGFGQLRFADHANSAKEQCINEQFDLIVCSFNLNKHQDGYQLYEELRIKQLIKSSTGFIFISAETSGSLVHSVLELQPDDFLVKPFTAQELKIRIERILKRKRDLQTVYNFIDDGNDSKALKYISAALNKNNNYSPI

SEQ ID NO: 21091 - DNA, 447 bp, Unknown
  Obtained from environmental sample
  misc_feature (1)..(447): n is a, c, g, or t
ttgattcggtcgaggatgatgaatgtatccagaaacaaaaagcttgttgaaatcaacaaatttagcccgtttatttctggatacaagaatggtgttttagtttggaataaaaaaataaaagatttcaaaaaatttgaaatttggacttctgacataggttatagaatacatgaaaagcacactcacgaaaataaaaacaaaagaattacatataatgagttatcaacaattgagaatatttcaaatgggttctttttattgcaattagcagaaaaaaaatggcctaatatttatgagaataagttgtttgaaacatacattttagactctaaatcaggagaaggtgtgaggataaatgatatgccaaagataatgtcaattaagaaggataagtttgtgactcgtgaggaaactgaaaattccttatataagtattatcagttttaa

SEQ ID NO: 21092 - protein, 148 aa, Unknown
  Obtained from environmental sample
  misc_feature (1)..(148): Xaa is any amino acid
MIRSRMMNVSRNKKLVEINKFSPFISGYKNGVLVWNKKIKDFKKFEIWTSDIGYRIHEKHTHENKNKRITYNELSTIENISNGFFLLQLAEKKWPNIYENKLFETYILDSKSGEGVRINDMPKIMSIKKDKFVTREETENSLYKYYQF

SEQ ID NO: 21093 - DNA, 813 bp, Unknown
  Obtained from environmental sample
  misc_feature (1)..(813): n is a, c, g, or t
gtggaggagcaaccgctcgcccaaagctatatgaaacaatcgctagaaaagcttggctttggacagttacgatttgcagatcatgctaactcggcaaaagagcagtgtataaacgagcaatttgatttaattgtatgctcattcaatctaaataagcatcaagatggttatcagctttatgaggaattgcgaataaagcagttaattaaaagctccactgggtttatttttatttctgcagaaacaagtggctcgcttgtacatagtgttcttgaattacaacccgatgattttttggttaaaccatttacagcacaagagcttaaaatacgtatagagcgtattttaaaacgtaaacgtgatttacaaacagtttacaactttattgatgacggtaatgattccaaagcacttaagtacataagtgcagcattaaataaaaacaacaactacagccctattttactgcgattaaaaggtgatgccctactacgccttaatcgtaaccaagaggccaaagacttttttaagtcggtactcgatatccaaaaatttgcatgggctaaagtaggtttagtagaagcactgatagaaaataatgaacatattttagcccaacgcatgcttaaaaccatgttagagcgcaacgaaactcgtttaatcgcgcttgatttattaggtcgtttagaaataaaacttaatcaatttgagctcgcacaagagtttttaagtcaggcttgggatattgctcctcttaatattatgcgttcaaagtctttgagtaatgtatcgttaatttatcacgattattga

SEQ ID NO: 21094 - protein, 270 aa, Unknown
  Obtained from environmental sample
  DOMAIN (1)...(120): Response regulator receiver domain
  misc_feature (1)..(270): Xaa is any amino acid
MEEQPLAQSYMKQSLEKLGFGQLRFADHANSAKEQCINEQFDLIVCSFNLNKHQDGYQLYEELRIKQLIKSSTGFIFISAETSGSLVHSVLELQPDDFLVKPFTAQELKIRIERILKRKRDLQTVYNFIDDGNDSKALKYISAALNKNNNYSPILLRLKGDALLRLNRNQEAKDFFKSVLDIQKFAWAKVGLVEALIENNEHILAQRMLKTMLERNETRLIALDLLGRLEIKLNQFELAQEFLSQAWDIAPLNIMRSKSLSNVSLIYHDY

SEQ ID NO: 21095 - DNA, 987 bp, Unknown
  Obtained from environmental sample
  misc_feature (1)..(987): n is a, c, g, or t
atgattacttctcacaaagcagaagacagacatccttattttagtcaagatgaaaaaagcatgtattttttaagtgaaagaagtggttctttcaacattcataaaatgaatttagacaataacactactgaaaaattaacggatttcactttgcatcctgttcgttttttaagtgttgcaaatggcgttatttcttttggttatgatggagaattgtacaccatgaaagaaggagaatcgcctaaaaaaatcatcgtaaacattattacgcaagacaaagaaaacacagaaaaatttgtttctgtaaatggtggtatcagtgaaatggctgtttctccaaatggaaaagaaattgcttttattgcaagaggtgaagtttttgtaacatcaatcgataaatcttttacaaaaagaataaccaaaactccagaaaacgaacgttttgtttcttgggatcctaaaggtgatgctgtaatttatagtagtgaaagaaatggaaaatggagcgtttttaaaactgaaaaaacaagaaaagaagaaccatttttctatgcttctacccttttaaaagaaacgccactaatcaataataaagttgataattacttggcagaatattctcctgatggaaaaaaaattgcttttattgaaggtagaagaactttaaaaatcttagatatcgcttctaaaaaagaaaccattttattaactccaaaagatttatttcacatgagtgatggtgataaatatttcacttggagtccagacagcaagtggttgttagttgattggggcaaaactttaagcaatagtgaagtgcttttaatggctgcagatggctctaaaagaatcaatttaaacgaaagtggttattacgattatagtcctaaatggataaatgatgggaaaacaaatgtttgtggtttagccaacagaaaatgggttaaaaatcctaatggctacaagttggggcaatctccaatctga

SEQ ID NO: 21096 - protein, 328 aa, Unknown
  Obtained from environmental sample
  DOMAIN (137)...(172): WD40-like Beta Propeller Repeat
  misc_feature (1)..(328): Xaa is any amino acid
MITSHKAEDRHPYFSQDEKSMYFLSERSGSFNIHKMNLDNNTTEKLTDFTLHPVRFLSVANGVISFGYDGELYTMKEGESPKKIIVNIITQDKENTEKFVSVNGGISEMAVSPNGKEIAFIARGEVFVTSIDKSFTKRITKTPENERFVSWDPKGDAVIYSSERNGKWSVFKTEKTRKEEPFFYASTLLKETPLINNKVDNYLAEYSPDGKKIAFIEGRRTLKILDIASKKETILLTPKDLFHMSDGDKYFTWSPDSKWLLVDWGKTLSNSEVLLMAADGSKRINLNESGYYDYSPKWINDGKTNVCGLANRKWVKNPNGYKLGQSPI

SEQ ID NO: 21097 - DNA, 513 bp, Unknown
  Obtained from environmental sample
  misc_feature (1)..(513): n is a, c, g, or t
ttgcaaaaaattttaaaaataggactacaaaaaatcgaccttcgttgtttcaaaaatatcttattgttaggattaggtgggggaagcgtgattaaaactttgcgtgacgatttcgattatcaacaatacataactgccatagatattgatcctgttataattaatattgcacaagaagagtttaatataaccaaagatgataaactaactattctatgtaaagatgccttaaaattcataatgcaaaatgataaaaagtttgatttgatcattattgatctattttttaacacagaaatacccgattctttttatagccattctttttggcaacatattataaagtcaacaaggcttaaaggaagtattctattcaatgcctctttgcataattctgataacaaaaaacttgcaagtatcattaaattattaaataagaataatttcaaaattgaaaaattagaacgggttaataaaaccaatactttaattatcgcttcctcacctagttga

SEQ ID NO: 21098 - protein, 170 aa, Unknown
  Obtained from environmental sample
  misc_feature (1)..(170): Xaa is any amino acid
MQKILKIGLQKIDLRCFKNILLLGLGGGSVIKTLRDDFDYQQYITAIDIDPVIINIAQEEFNITKDDKLTILCKDALKFIMQNDKKFDLIIIDLFFNTEIPDSFYSHSFWQHIIKSTRLKGSILFNASLHNSDNKKLASIIKLLNKNNFKIEKLERVNKTNTLIIASSPS

SEQ ID NO: 21099 - DNA, 669 bp, Unknown
  Obtained from environmental sample
  misc_feature (1)..(669): n is a, c, g, or t
atgagcattaatttaagtttttctcaggacgcaaacaatactaaagaaaacatatttgataatatagtaggagtagaaaacactggtctttttaacggaaaacggtattacaacgcttacaaaacgacaccagacaataccaactttttcatttttacagattttagtaacggtaatattgtctataataatcagccatattataatgtagatttaaaatacgatttaactacagaccaattaataactaaattaaatggtgataaaagctatattaatatagaactggttaaaaataaagttgctagttttgaaattgataaccatcactttattaatagtaagacagtattaaatgatagtatcccagatttaggttttctagaattagtttacacctctcccctttataaatttcttattaaaaaagagaaaatagcatcaaaaaaaatatcagaaagtaaagtagattatattttttctagtagtaattctttataccttttttacgaaaacaaattgcacaatttaagttcttacagatcattaagaaaaattcttcccgatttaaaaaaagatataaatacttttcataaatccaataaaaaattattaaaggataatgaagaacaattttttgtcaatcttttaaaatatttagaatgttga

SEQ ID NO: 21100 - protein, 222 aa, Unknown
  Obtained from environmental sample
  misc_feature (1)..(222): Xaa is any amino acid
MSINLSFSQDANNTKENIFDNIVGVENTGLFNGKRYYNAYKTTPDNTNFFIFTDFSNGNIVYNNQPYYNVDLKYDLTTDQLITKLNGDKSYINIELVKNKVASFEIDNHHFINSKTVLNDSIPDLGFLELVYTSPLYKFLIKKEKIASKKISESKVDYIFSSSNSLYLFYENKLHNLSSYRSLRKILPDLKKDINTFHKSNKKLLKDNEEQFFVNLLKYLEC

SEQ ID NO: 21101 - DNA, 519 bp, Unknown
  Obtained from environmental sample
  misc_feature (1)..(519): n is a, c, g, or t
atgaaaaaaatattaaaatttaaacattggcatctatttatattaatcgttctgactggagcttggacgtcaccaagtccattaaaagagattattaattccattgctctggtgacatttctgatttggatttatgcaattggaatttatggacaagagaaattggaatctctaaaacttccgactttgaacacgaaactcttcaaaattaatattattctatttccgattttattaattgtttcttttctgctttcgcctgaacaaactgctgagaatactcaagcggaatttaatactcaaacgattttactaatcccgatttcactctatatgttttttgcgctctttcaaacaatagttttttcttgcaaaacacttgcaatgattgaactgaaaagagaagtgaaattttctgactatttagtgaatttaatactaatgctgttttttataattggagtttggattttacaaccgaaaattactaaactaatagctgaaactgaaaataaatga

SEQ ID NO: 21102 - protein, 172 aa, Unknown
  Obtained from environmental sample
  misc_feature (1)..(172): Xaa is any amino acid
MKKILKFKHWHLFILIVLTGAWTSPSPLKEIINSIALVTFLIWIYAIGIYGQEKLESLKLPTLNTKLFKINIILFPILLIVSFLLSPEQTAENTQAEFNTQTILLIPISLYMFFALFQTIVFSCKTLAMIELKREVKFSDYLVNLILMLFFIIGVWILQPKITKLIAETENK

SEQ ID NO: 21103 - DNA, 348 bp, Unknown
  Obtained from environmental sample
  misc_feature (1)..(348): n is a, c, g, or t
atgagccaaaaatttaatgtaaaaacaaatgatcttaatcaatttgaaatagactcagatgttataaaaagcattgattctgttgaagttaaacagaatacatttcatcttttagacaacaacaaaccttttaaagtcgaaatcacagatagtgattttctaaaaaaagcgtactctgtaaaagttaataataacctttatagcgttcaaatcgaagaccaattggatgctttaataaaagcaatgggatttgaggttggtgcttccaaagttattgataatataaaagcgccaatgccaggattaatcttggatatactggttaaaccacgagacgaattactgtag

SEQ ID NO: 21104 - protein, 115 aa, Unknown
  Obtained from environmental sample
  misc_feature (1)..(115): Xaa is any amino acid
MSQKFNVKTNDLNQFEIDSDVIKSIDSVEVKQNTFHLLDNNKPFKVEITDSDFLKKAYSVKVNNNLYSVQIEDQLDALIKAMGFEVGASKVIDNIKAPMPGLILDILVKPRDELL

SEQ ID NO: 21105 - DNA, 687 bp, Unknown
  Obtained from environmental sample
  misc_feature (1)..(687): n is a, c, g, or t
atgcatagtttactttcaaatctaaaaattaatataaacgataaaatttaccttaaagatccagaatcttctgatttaggtaaacgtattgttgaaaacagtatccaactaattgatgagattggatttgacttatttacgtttaaaaaattaggtactaaaattggctctaacgagagtagcatttatcgttattttgaaagcaaacacaaactactaatctaccttacttcttggtattggagctggttagaatatcaattggtttttgctactaacagtattgcaaatccaaaacaaaaaattgaaaaagctattgaggtccttacacaatcagcaactttagactctaatttctctcatatcgatgaggtacttttaaaacgtattgtaattaacgaatactctaaatcatacctaactaaagaggtcgataacgaaaataaggaaggttactttctagtatacaaaagactggttacacgactacatgatatggtattaaccattgataaggattattcgtatgcctttagtttatcaagtactgttattgatggtgcattgcatcaacattttttaaaagaccattttactactatatctgatcttaaaaaatcagacgatcctactaactattttaaagatttagttttcaaaacccttaacatctcaacaaatgagtaa

SEQ ID NO: 21106 - protein, 228 aa, Unknown
  Obtained from environmental sample
  DOMAIN (30)...(76): Bacterial regulatory proteins, tetR family
  misc_feature (1)..(228): Xaa is any amino acid
MHSLLSNLKININDKIYLKDPESSDLGKRIVENSIQLIDEIGFDLFTFKKLGTKIGSNESSIYRYFESKHKLLIYLTSWYWSWLEYQLVFATNSIANPKQKIEKAIEVLTQSATLDSNFSHIDEVLLKRIVINEYSKSYLTKEVDNENKEGYFLVYKRLVTRLHDMVLTIDKDYSYAFSLSSTVIDGALHQHFLKDHFTTISDLKKSDDPTNYFKDLVFKTLNISTNE

SEQ ID NO: 21107 - DNA, 441 bp, Unknown
  Obtained from environmental sample
  misc_feature (1)..(441): n is a, c, g, or t
gtgccagagcatattacaggaagacaattattacgtcaaaaagatagtattgatgcttgggagtatgctttagacagtaacggaaatgttgtaaaagacagtttaggtaatgatgttaaacaagataaaattataaatattaaagctagattttttgaagttaatcaacttaaatctacgcaagttattgctaaagttgtttatacagatttaaagcaaaatcaaataatagataattttttaatagatagtgagtttatttttgaaaacacttttggaactgtaaaaggtgatcgcagagctttaaatactgaagatttacaattactgaaaaaccaacttgtacactttcctagtaatgaacaaatggtttatgacactggagaagacttaaaatacaaattaaaagatattataacaagatatagttttagaggttaa

SEQ ID NO: 21108 - protein, 146 aa, Unknown
  Obtained from environmental sample
  misc_feature (1)..(146): Xaa is any amino acid
MPEHITGRQLLRQKDSIDAWEYALDSNGNVVKDSLGNDVKQDKIINIKARFFEVNQLKSTQVIAKVVYTDLKQNQIIDNFLIDSEFIFENTFGTVKGDRRALNTEDLQLLKNQLVHFPSNEQMVYDTGEDLKYKLKDIITRYSFRG

SEQ ID NO: 21109 - DNA, 549 bp, Unknown
  Obtained from environmental sample
  misc_feature (1)..(549): n is a, c, g, or t
atgaaaaacattttagttcccataggttccaataagagagctgcaaatacgttgcaatatgccatcgattttgccgtgggtacgaatgctaaaatatatgttatacatgtattcggagtatctaaagctgcgagttcaatgaaaaacatagattcaattttagaggaggatagcgagcacgaattagaagaagttttaaataaggttgataggaaaggaattgagatcatatcaaaatctatcaaaggtaacgtgatcaacagcatagaacgtgtggcgaatcaattgcatgtagatttgatcatatcttcagctaaaagtatttctgtagatgataaggtgtatttagggaaaattgcgggaggtttaattaaagatacgcaattgcccgtgcttattatccctaaaaattataagtttaaggaagttactaaaatattgatggctattaaatctggtattatatcttcttcaaatgtggtggctcctttgaataatgtaatcaataggtttaattctaagttagacctgttaagactcattacgccc

SEQ ID NO: 21110 - protein, 183 aa, Unknown
  Obtained from environmental sample
  DOMAIN (1)...(135): Universal stress protein family
  misc_feature (1)..(183): Xaa is any amino acid
MKNILVPIGSNKRAANTLQYAIDFAVGTNAKIYVIHVFGVSKAASSMKNIDSILEEDSEHELEEVLNKVDRKGIEIISKSIKGNVINSIERVANQLHVDLIISSAKSISVDDKVYLGKIAGGLIKDTQLPVLIIPKNYKFKEVTKILMAIKSGIISSSNVVAPLNNVINRFNSKLDLLRLITP

SEQ ID NO: 21111 - DNA, 633 bp, Unknown
  Obtained from environmental sample
  misc_feature (1)..(633): n is a, c, g, or t
atgacgatattaacagaaaatcaagtagctgaactttgtgtttttatagaaaatcgaatagaaaaaatcggttgtgaccactcgttgaaatacacttttgaatgggctgaaaaaaatggaattgataagtctgacctaattgacgttttggaatcgaatggtggattttgtgattgcgaagtgacatttaatttaccagaagattgtgatttagaattagagtccgaaaacaaagaaatggactttaaaaatcctttcaaaataccgctgaattttcaacagaccgaaaataaagtttatacaaaagcattattttcgagttctgaatacgaccataataattacacaaaaaatggagaattattaattccagcaccatttggatttaaaccaaaaaagagagttaggaaaagtatgcacttctttaacggaactgaatcggaattgcctactgaaattggaattgtaaaagaaatagaaccgataaatggaagagagtttgcgaaaaaaattcgtgatttaaaattaggttctctttcgagattttcggaaagagatgctgagtattacttttcgagaattgacaaaattgaccttggaaaaccaatgggaacgcattttatggaaagaaca

SEQ ID NO: 21112 - protein, 211 aa, Unknown
  Obtained from environmental sample
  misc_feature (1)..(211): Xaa is any amino acid
MTILTENQVAELCVFIENRIEKIGCDHSLKYTFEWAEKNGIDKSDLIDVLESNGGFCDCEVTFNLPEDCDLELESENKEMDFKNPFKIPLNFQQTENKVYTKALFSSSEYDHNNYTKNGELLIPAPFGFKPKKRVRKSMHFFNGTESELPTEIGIVKEIEPINGREFAKKIRDLKLGSLSRFSERDAEYYFSRIDKIDLGKPMGTHFMERT

SEQ ID NO: 21113 - DNA, 594 bp, Unknown
  Obtained from environmental sample
  misc_feature (1)..(594): n is a, c, g, or t
atgaattaccaatttaccatcgtcgttcctgtttataatgaggaagataatttacttagagtggaaaaagagttattagcttacacgcaaatagcaacaaaaaccactaaaatattatttgttaatgatggctcaaaagataaaagtcaagaattaattgaagctatttgtagcagacatgatgcttttgactacatattatttaaagacaatcgtggtttaagtgctgctataaaagctggttttgactatactaccacgcctttagtgggatatattgactctgatttacaaactgcaccagaagattttaatttactactagcacatataggcgagtatgatttagttactggtgtacgtgctaaccgtaaagatagttttgtaaaaaatatgtcgtctaaaattgcaaacggaattagacgagcatttactaaagacggaatggatgatactggttgtccattaaaagtaattaaaacggactatgctaaacgtattccaatgtttaaaggcttacatcgttttttaccagctatgataatgttgcaaaacggtaaaacaaagcaaatacctgtacaacattttctctag

SEQ ID NO: 21114 - protein, 197 aa, Unknown
  Obtained from environmental sample
  DOMAIN (6)...(168): Glycosyl transferase
  misc_feature (1)..(197): Xaa is any amino acid
MNYQFTIVVPVYNEEDNLLRVEKELLAYTQIATKTTKILFVNDGSKDKSQELIEAICSRHDAFDYILFKDNRGLSAAIKAGFDYTTTPLVGYIDSDLQTAPEDFNLLLAHIGEYDLVTGVRANRKDSFVKNMSSKIANGIRRAFTKDGMDDTGCPLKVIKTDYAKRIPMFKGLHRFLPAMIMLQNGKTKQIPVQHFL

SEQ ID NO: 21115 - DNA, 384 bp, Unknown
  Obtained from environmental sample
  misc_feature (1)..(384): n is a, c, g, or t
ttgatgaagttatacctgtttgtttttttcttttttattgtggccgctggctatgcgcaggatatttcttcaaattataaagagaaaaaagttgctttaagagataccgtggttttagatagcgcaggtatcaatccaaagcgattcgttattctcgataaagatggaaattcgccgaatcctttcagctatcgaatagatttcaaaaaaggaatcatttttttttccgaagaattgcggcagcaacaggattcccttaccgttcaatatttacaatacccagattttttaacgagggattactttgctcttgacccaaaaatcattgttgaaaataccgggcaaattgaccaagctatattcgctggacgaaagcacgaataa

SEQ ID NO: 21116 - protein, 127 aa, Unknown
  Obtained from environmental sample
  SIGNAL (1)...(19)
  misc_feature (1)..(127): Xaa is any amino acid
MMKLYLFVFFFFIVAAGYAQDISSNYKEKKVALRDTVVLDSAGINPKRFVILDKDGNSPNPFSYRIDFKKGIIFFSEELRQQQDSLTVQYLQYPDFLTRDYFALDPKIIVENTGQIDQAIFAGRKHE

SEQ ID NO: 21117 - DNA, 447 bp, Unknown
  Obtained from environmental sample
  misc_feature (1)..(447): n is a, c, g, or t
gtgactatgggtacttatggaagtttaggatggataaaacgaccaggacaaaaacaaaaaaaagcagctttagaagctttagaaaaagtaggcatgttaccctttaaaggtagacaaattagccagttgtctggtggacaacaacagcgtatatttttagctagagcattagtacaaaatgcatcaatctattttatggatgaaccttttcaaggtgttgatgcaaccacagaaatagctattattaatattttaaaagaattacgtaaagcaggcaaaacagttatcgtagtgcatcatgatttacaaaccgttccagaatattttgattgggttacttttttaaatgtaaagaaaatagcaacaggtcctgttaaagacatctttaatgatgataacttaaccaagacttatggtattaactataaagtaagtattcaagaataa

SEQ ID NO: 21118 - protein, 148 aa, Unknown
  Obtained from environmental sample
  DOMAIN (1)...(118): ABC transporter
  misc_feature (1)..(148): Xaa is any amino acid
MTMGTYGSLGWIKRPGQKQKKAALEALEKVGMLPFKGRQISQLSGGQQQRIFLARALVQNASIYFMDEPFQGVDATTEIAIINILKELRKAGKTVIVVHHDLQTVPEYFDWVTFLNVKKIATGPVKDIFNDDNLTKTYGINYKVSIQE

SEQ ID NO: 21119 - DNA, 375 bp, Unknown
  Obtained from environmental sample
  misc_feature (1)..(375): n is a, c, g, or t
atgggattattcagtgggttaatgggtaacgctagcgaagtagatgatgccgacttagaaaaagtattattaaataccttaatagaaggcgaacaggttgaaaaggcttataaagtaatacgagatatgtttatttttactaacaagcgattgatcttgatagataaacaaggtgttactggttctaaaatggagatgatcagtatagcttattcaaaaataacaaagtttagtaaagaaagcgcagggcattttgatctagatgccgagctgaaaatatgggttggctcagactctacacctattagtaaagactttaagtctggcgataatattaatgatgtttatcgtattattagccaatatgcactgtaa

SEQ ID NO: 21120 - protein, 124 aa, Unknown
  Obtained from environmental sample
  misc_feature (1)..(124): Xaa is any amino acid
MGLFSGLMGNASEVDDADLEKVLLNTLIEGEQVEKAYKVIRDMFIFTNKRLILIDKQGVTGSKMEMISIAYSKITKFSKESAGHFDLDAELKIWVGSDSTPISKDFKSGDNINDVYRIISQYAL

SEQ ID NO: 21121 - DNA, 321 bp, Unknown
  Obtained from environmental sample
  misc_feature (1)..(321): n is a, c, g, or t
atgaaaccaatctatttaatttttagtttactaaccttcattagtttaagttgcacatcaaaagatgacactgatttaaaagaaaatcatgatgcgcaaaacatatatttccctcctttggatagtgatacttgggagactaaaacaccttccgagttacaatggaatacttcagctttagctgaattatcttcatttttagaaaacacaaactccaaatcgtttataattttacataaaggaaaaattgcttttgagcagtattttaatgatcatgctttaactgatncttggtattgggcaagtgcaggaaaaacataa

SEQ ID NO: 21122 - protein, 106 aa, Unknown
  Obtained from environmental sample
  SIGNAL (1)...(17)
  misc_feature (1)..(106): Xaa is any amino acid
MKPIYLIFSLLTFISLSCTSKDDTDLKENHDAQNIYFPPLDSDTWETKTPSELQWNTSALAELSSFLENTNSKSFIILHKGKIAFEQYFNDHALTDXWYWASAGKT

SEQ ID NO: 21123 - DNA, 624 bp, Unknown
  Obtained from environmental sample
  misc_feature (1)..(624): n is a, c, g, or t
atgagtaatccgaacgaacacattgaagagtttttaaaacattattttaagttaccgagcccaccacagtatgctgttttgctaaagggtaagtggggtgttggtaaaacttggtttttgaaagaaataatggcaagtttgcataattctgattatcgagttaaaacacatttatatgtgagtctatatggtgttgctagtttcgaagaaatagaaaatgaattttttagacagcttcacccttttttatcttctaaaggtatggctttagcaggaaagattgggaaaggattacttaaaaccacactaaagattgacctagatggtgatggcaaaagtgacgctagtattgcaactcaaatccctgatattaatctgccagactatttgtctaatacagaaggtctaatattagtattcgatgatttggagagagcttcaatggatctagagaacctattaggctatataaactattttgttgagcatcaaggttataaggtggtgattatagctaatgaagatgagctagttaacaaagagaaaacatctgatgttagttataaacgtataaaagaaaaactaattggtaaacttttgaaattcaacctcgtcttgatttag

SEQ ID NO: 21124 - protein, 207 aa, Unknown
  Obtained from environmental sample
  misc_feature (1)..(207): Xaa is any amino acid
MSNPNEHIEEFLKHYFKLPSPPQYAVLLKGKWGVGKTWFLKEIMASLHNSDYRVKTHLYVSLYGVASFEEIENEFFRQLHPFLSSKGMALAGKIGKGLLKTTLKIDLDGDGKSDASIATQIPDINLPDYLSNTEGLILVFDDLERASMDLENLLGYINYFVEHQGYKVVIIANEDELVNKEKTSDVSYKRIKEKLIGKLLKFNLVLI

SEQ ID NO: 21125 - DNA, 363 bp, Unknown
  Obtained from environmental sample
  misc_feature (1)..(363): n is a, c, g, or t
atgagtgaagtccgaaagattgtcataatattggttattgtattgttacagttgttaagtgcccaccagatgagaatccaacaggtaaatgcgaacataaaaggcaaaccgacaaagttgaaatacactaaagacacttgccaccattttaacggttttcttcttttaccgacaatatgttctttttcaatttgggtattcgaaatatcttcaaaatctaagtttccaccttcaatactggtatcaaaatcggtatcaatatccacatcaaaatcaacgtcgaaatctgctccagaattcatagtaacaatccaatacaaaataagtatcaacattaaaatagttaatgtaatgtttacttga

SEQ ID NO: 21126 - protein, 120 aa, Unknown
  Obtained from environmental sample
  misc_feature (1)..(120): Xaa is any amino acid
MSEVRKIVIILVIVLLQLLSAHQMRIQQVNANIKGKPTKLKYTKDTCHHFNGFLLLPTICSFSIWVFEISSKSKFPPSILVSKSVSISTSKSTSKSAPEFIVTIQYKISINIKIVNVMFT

SEQ ID NO: 21127 - DNA, 465 bp, Unknown
  Obtained from environmental sample
  misc_feature (1)..(465): n is a, c, g, or t
gtgtatatggacgaaagcggttttgaaagccagaccattcgtcctcatggttatgcactgataggcaaaccctgtatcgacagctacaactggcaaggtaaaaagcgaaccaacgtcattggggctctatatgaaaagatgctatttgcactggattactttgaacacaacattaacagcggcatattctacgattggtgcaaacacaccctaatcccaagccttaaaaccaaatgcgtgattgtcatggataacgctcggtttcataaaagtagacgtatccaaaaattactgaacaggcatggtcatcgtatcctatggctgccgccgtacagcccagacgtgaaccctattgagaaaaaatgggctcaagtgaagtttctacgccaagggtggatggaaaacgacttatccaaattattttatgatgtttgtcctagccataacacttttgttgtganctga

SEQ ID NO: 21128 - protein, 154 aa, Unknown
  Obtained from environmental sample
  misc_feature (1)..(154): Xaa is any amino acid
MYMDESGFESQTIRPHGYALIGKPCIDSYNWQGKKRTNVIGALYEKMLFALDYFEHNINSGIFYDWCKHTLIPSLKTKCVIVMDNARFHKSRRIQKLLNRHGHRILWLPPYSPDVNPIEKKWAQVKFLRQGWMENDLSKLFYDVCPSHNTFVVX

SEQ ID NO: 21129 - DNA, 510 bp, Unknown
  Obtained from environmental sample
  misc_feature (1)..(510): n is a, c, g, or t
atgcaaagtttcccagaaaccaaaattccaatggtctgcgatatgagtagcgatattttttcacgccagctcgatttttcaaaatttagtttgatttatgcgggggcacagaaaaatatgggcccagcgggaacaactttggttgtggtaaaagaagatattctcgggaaggtttcgcgcgttattccttctatgctgaactataaaattcatattgacaaagaaagcatgtttaacaccccagcggttttcccagtatatgtttccatgttgacactgcaatggttgaaggatttgggcggtatttcagcaatagaaaaaataaacaaccaaaaagccgaacatctttataatgaaatagatcgaaattcgttatttgaaggcttcgtgaccaaaaaagaagaccgttcaaaaatgaacgccaccttcaacttaaaaaatgaccaattaaaagcaacctttgacgatcacctaaaacaagccggcatcaacggcctgaacggncaccgn

SEQ ID NO: 21130 - protein, 170 aa, Unknown
  Obtained from environmental sample
  misc_feature (1)..(170): Xaa is any amino acid
MQSFPETKIPMVCDMSSDIFSRQLDFSKFSLIYAGAQKNMGPAGTTLVVVKEDILGKVSRVIPSMLNYKIHIDKESMFNTPAVFPVYVSMLTLQWLKDLGGISAIEKINNQKAEHLYNEIDRNSLFEGFVTKKEDRSKMNATFNLKNDQLKATFDDHLKQAGINGLNGHR

SEQ ID NO: 21131 - DNA, 378 bp, Unknown
  Obtained from environmental sample
  misc_feature (1)..(378): n is a, c, g, or t
atggcgagaataaacacaaaattcttgaaccaacaagagatcgatctgattcatgatcagagtatccaatgtctgtgggaaattggcatcaaagttcacagcaagccggttctcgaaattctcgaaaagaacggcgcaagtgtggatttcgatgacctcattgcaaaaattcctgaaaaaatggtgaatcaagctctcgaaaccgtgcaaaaagagtttaccctttgtgcccgagacccggggcgtgatctgaaaattcccaccgaatctgtcccatggatgaccacgagcggacttgcagtttttgtcaatgattacgaagtaggagagtaccgttattccaccaagaaattacatcgcctggagccgattctgtga

SEQ ID NO: 21132 - protein, 125 aa, Unknown
  Obtained from environmental sample
  misc_feature (1)..(125): Xaa is any amino acid
MARINTKFLNQQEIDLIHDQSIQCLWEIGIKVHSKPVLEILEKNGASVDFDDLIAKIPEKMVNQALETVQKEFTLCARDPGRDLKIPTESVPWMTTSGLAVFVNDYEVGEYRYSTKKLHRLEPIL

SEQ ID NO: 21133 - DNA, 525 bp, Unknown
  Obtained from environmental sample
  misc_feature (1)..(525): n is a, c, g, or t
atgaagagaaccctagtaatcatggtctttttaatgactatttcccaaattcaggcacaaatactgctagacccaagctctagaaaagttggtagtattgatgctattattaatgaactgtaccatgttaattctggtaaaaaaggatacgaccgcaattgggcagatttcaagtacttgttttatccaggtgcaaaaattatccccacaggccctagtttagacgggaatcatttagcgaaatttatgacacctgatgagtataaaaaaagctcggaagaatggctaaaagaaaatggctattttgaaaaagaaattaaccggaaaatggaagtttttggtaatatagctcatgtttttagcacgtttgaagcctaccatagtcctacagatccttatccggcacttcgtggaattaagagtattcagttattaaatgatggattacgttggtggattgttaacgtttattggatgcaggaaacccgaatcaaaacaattcctcgagattatttaccagattaa

SEQ ID NO: 21134 - protein, 174 aa, Unknown
  Obtained from environmental sample
  SIGNAL (1)...(19)
  misc_feature (1)..(174): Xaa is any amino acid
MKRTLVIMVFLMTISQIQAQILLDPSSRKVGSIDAIINELYHVNSGKKGYDRNWADFKYLFYPGAKIIPTGPSLDGNHLAKFMTPDEYKKSSEEWLKENGYFEKEINRKMEVFGNIAHVFSTFEAYHSPTDPYPALRGIKSIQLLNDGLRWWIVNVYWMQETRIKTIPRDYLPD

SEQ ID NO: 21135 - DNA, 498 bp, Unknown
  Obtained from environmental sample
  misc_feature (1)..(498): n is a, c, g, or t
ttgaaaatgagtttgcaattaaagcgaaacatcgcatatagtatttttttagttctttttttacaatcggtttttgggcagactgttactgttttagaagaagggagtcttacaccaattcctggagttgcactctataactttaagaaaaacaaaacgcaagtaactgatttaaatggtaaagcgtctttggggattttcgacttaaatgaaatcatcttttttcaaaattttttatacgaaaaacaaaaactcacaaaagctgaaattgctaaaaataacaatatcatttatctcgttccaaaggtcgaaggtttaaaacaaattgtcatttcggcttccaaatttgagcagaataaacgcgatataccacaaaccattgtaagcatagatgccaaagatattgcattggtaaatcctcaaaccagtgcagatttattagaaaatacgggtaatatttatattcagaaaagtcaattgggaggaggagtccaatga

SEQ ID NO: 21136 - protein, 165 aa, Unknown
  Obtained from environmental sample
  misc_feature (1)..(165): Xaa is any amino acid
MKMSLQLKRNIAYSIFLVLFLQSVFGQTVTVLEEGSLTPIPGVALYNFKKNKTQVTDLNGKASLGIFDLNEIIFFQNFLYEKQKLTKAEIAKNNNIIYLVPKVEGLKQIVISASKFEQNKRDIPQTIVSIDAKDIALVNPQTSADLLENTGNIYIQKSQLGGGVQ

SEQ ID NO: 21137 - DNA, 660 bp, Unknown
  Obtained from environmental sample
  misc_feature (1)..(660): n is a, c, g, or t
ttgtatagaaactataaaaatggtaaaagttcaataaatgcctatttagaagattatgcaactgttatagatgcttttattaatttatacgaggttaccttggatgaaaaatggttacaaaatgccaagctattaacagattactgctttgatcattttttcgatgataagagtaatatgttctattttacttcaaatattgataaaggtttgattgcaagaaaaattgaaacagatgataatgtcattccctcctctaattcaattatggcgaataatttatttaaactaggtcactactatgccaactcaacctatcttaaagacgctaaacaaatgttgcataatgtaaaagataaagttcttaagtatggtgctggtgcttcaaactggtcgttattatatacaaatttattaggagatttttatgaaatagcaattgttggcagtaatgctaagcaactacttaaagaaattaataaaacttatattcccaacaagttgatagttggcagtatcaaagaaagtaatttaccattacttacttataaatacgtcgaaaattcaattacaatttatgtgtgtattgatggagcttgccaactgccagtaactgaaactccaaaagggctacaacaaattattattaatctagaatga

SEQ ID NO: 21138 - protein, 219 aa, Unknown
  Obtained from environmental sample
  misc_feature (1)..(219): Xaa is any amino acid
MYRNYKNGKSSINAYLEDYATVIDAFINLYEVTLDEKWLQNAKLLTDYCFDHFFDDKSNMFYFTSNIDKGLIARKIETDDNVIPSSNSIMANNLFKLGHYYANSTYLKDAKQMLHNVKDKVLKYGAGASNWSLLYTNLLGDFYEIAIVGSNAKQLLKEINKTYIPNKLIVGSIKESNLPLLTYKYVENSITIYVCIDGACQLPVTETPKGLQQIIINLE

SEQ ID NO: 21139 - DNA, 384 bp, Unknown
  Obtained from environmental sample
  misc_feature (1)..(384): n is a, c, g, or t
atgaaaatattacacagaattggttactatttaggtggattctctattggtttagttttattagcttttttcttaaacggaagaggtgtatcttgcgagtataattatggtccagaaggaagagtcttaaagaatatacgtacaaaaacactacacttctctgcagacagtcaagcacttttagacacaaaagctattgacacctctgcaataagttacatccttaaaaaaggagatgtagatttttctaaaagtgaacctagaaaagaaccttgtggtatgtattttatttatggtgaaactaaagacagtaaaaactacgaattttatatagaaaactgtgatagcattgcaaccttgcaaactataaaagttctagattaa

SEQ ID NO: 21140 - protein, 127 aa, Unknown
  Obtained from environmental sample
  misc_feature (1)..(127): Xaa is any amino acid
MKILHRIGYYLGGFSIGLVLLAFFLNGRGVSCEYNYGPEGRVLKNIRTKTLHFSADSQALLDTKAIDTSAISYILKKGDVDFSKSEPRKEPCGMYFIYGETKDSKNYEFYIENCDSIATLQTIKVLD

SEQ ID NO: 21141 - DNA, 396 bp, Unknown
  Obtained from environmental sample
  misc_feature (1)..(396): n is a, c, g, or t
ttggctaaaaataatgcttgccagattaaaaatttagttaccgacaatgttaaggtggttgctgttgaagcgtatttggatagtataatccttaatttgttgaccaatgccataaagtatagagatgctaataaacaatctgaagtagttttaagcacttatgttcaagacgactttattgttttgagtgttaaagacaatggtttaggtttggatatgaataagtatggtgataaaatgttttcgttgtatcaaacatttcataataataaaaaggcaagaggtttaggtttgtttattacaaaaagtcaagtggaatccataggaggtaagatagaatttaaaagtcaagttaatataggaagtcagtttttagtttattttaaaacagcttaa

SEQ ID NO: 21142 - protein, 131 aa, Unknown
  Obtained from environmental sample
  DOMAIN (21)...(131): Histidine kinase-, DNA gyrase B-, and HSP90-like ATPase
  misc_feature (1)..(131): Xaa is any amino acid
MAKNNACQIKNLVTDNVKVVAVEAYLDSIILNLLTNAIKYRDANKQSEVVLSTYVQDDFIVLSVKDNGLGLDMNKYGDKMFSLYQTFHNNKKARGLGLFITKSQVESIGGKIEFKSQVNIGSQFLVYFKTA

SEQ ID NO: 21143 - DNA, 405 bp, Unknown
  Obtained from environmental sample
  misc_feature (1)..(405): n is a, c, g, or t
atggccgaagaaaaaattattttaggtatcgatccgggaacgactataatgggtttcggactcataaaagtggtgaataaaaaaatgaaattccttcaacttaacgaattggatttaaaaaaatacgacgatcattatttaaaattgaaactcattttcgagcgtactattgagttaatcgatacacatcatccagatgaaattgcaatcgaagcgcctttttttggtaaaaatgtgcaaagtatgctaaagttaggtcgcgctcaaggggttgctatggcggctgggttatccagagaagtgcctattaccgagtacgcacctaagaaaataaaaatggcgattacgggtaatgaaatgcgagtaaagagcaagtggctaaatgtgcaaagtatgttggattaa

SEQ ID NO: 21144 - protein, 134 aa, Unknown
  Obtained from environmental sample
  DOMAIN (7)...(134): Crossover junction endodeoxyribonuclease RuvC
  misc_feature (1)..(134): Xaa is any amino acid
MAEEKIILGIDPGTTIMGFGLIKVVNKKMKFLQLNELDLKKYDDHYLKLKLIFERTIELIDTHHPDEIAIEAPFFGKNVQSMLKLGRAQGVAMAAGLSREVPITEYAPKKIKMAITGNEMRVKSKWLNVQSMLD

SEQ ID NO: 21145 - DNA, 300 bp, Unknown
  Obtained from environmental sample
  misc_feature (1)..(300): n is a, c, g, or t
atggattttgataccgtagttaacttcggaagaaaagttgacgtactcacttttgaaattgaaggagtaaatattaaagccttaaagcaattagctcaggaaggcattaaaacctatccctcggctgagactttagagaaaatacagaataaaggaattcagaagaatttctataaaaaacatcaaatcccaaccgctgattttgaagttttttcctctaagcaagatttaatttccgctctggaaaacaacaaaatcaagtttcccttttgtttggaaaagcaccaccggtggttatga

SEQ ID NO: 21146 - protein, 99 aa, Unknown
  Obtained from environmental sample
  misc_feature (1)..(99): Xaa is any amino acid
MDFDTVVNFGRKVDVLTFEIEGVNIKALKQLAQEGIKTYPSAETLEKIQNKGIQKNFYKKHQIPTADFEVFSSKQDLISALENNKIKFPFCLEKHHRWL

SEQ ID NO: 21147 - DNA, 624 bp, Unknown
  Obtained from environmental sample
  misc_feature (1)..(624): n is a, c, g, or t
gtgttattgtcattttacaaggagaaaatcataattattataggaataacaggaaaaatatcatcggggaaaagtaccgtggcatctattatggaaaaggctaaagacaggacatgggttcttgatgcagatgatattgcaaaagatatatataataaaaacactgctattaaagctgatctgaaaaaaacttttggtccggatattattgatgataataaaaacattctttacgggaaacttgccgaaatagtattttcaagtcaaattgaattaagcaagctaaatagattgatgttcccccttatcaggagggagatcaaaagtatgatcaagtcagatgcggtgaatgattatatcataatagacgcagctgtattgtttgatgctaaattagatctactttgtgattttattattctggtagatgcagatgagagcttaagaaaaacttttttaaaaaataaaaatttaaatgataatgagatagaattaaggatacagggacagcacataaaaataaatgaaagtagagtagatttcaggatcattaatgacggtaagatagaaaatgtgagaaagaaaacactgaatatttttgaagcggtcgaaaaaaagaatatt

SEQ ID NO: 21148 - protein, 208 aa, Unknown
  Obtained from environmental sample
  DOMAIN (12)...(191): Dephospho-CoA kinase
  misc_feature (1)..(208): Xaa is any amino acid
MLLSFYKEKIIIIIGITGKISSGKSTVASIMEKAKDRTWVLDADDIAKDIYNKNTAIKADLKKTFGPDIIDDNKNILYGKLAEIVFSSQIELSKLNRLMFPLIRREIKSMIKSDAVNDYIIIDAAVLFDAKLDLLCDFIILVDADESLRKTFLKNKNLNDNEIELRIQGQHIKINESRVDFRIINDGKIENVRKKTLNIFEAVEKKNI

SEQ ID NO: 21149 - DNA, 366 bp, Unknown
  Obtained from environmental sample
  misc_feature (1)..(366): n is a, c, g, or t
ttgataatttctttaaaaaacaagcacatggaaacaccaaatgaggaattgaatgaccctatacattcagagaatttagagtttacaaatagaatcaatttatctgaattacaagagagtgttttcagtataaaaaagcaattacagaaagtaattgttgggcaaaaagacatgatggatttgctattagtggcattgttggcagatggccatgtgttaattgaaggcgttcctggagtggcaaaaaccatcactgcaaaactattgtctaaaaccattgatgttggctttagtagaattcagtttacgccagatttaatgccttcagatattttaggaacttctgtttttaatgtcaaaacctcn

SEQ ID NO: 21150 - protein, 122 aa, Unknown
  Obtained from environmental sample
  misc_feature (1)..(122): Xaa is any amino acid
MIISLKNKHMETPNEELNDPIHSENLEFTNRINLSELQESVFSIKKQLQKVIVGQKDMMDLLLVALLADGHVLIEGVPGVAKTITAKLLSKTIDVGFSRIQFTPDLMPSDILGTSVFNVKTS

SEQ ID NO: 21151 - DNA, 663 bp, Unknown
  Obtained from environmental sample
  misc_feature (1)..(663): n is a, c, g, or t
ttgaacattctccaaccgctcttcgacatcgactttcacccatcaagttatgggtacaggccgaaacgaagttgtcatgacgccatcagcaaagccacggtatttattcgtaaatatcaccgtgagtgggtggttgatatggatctgtcgaagtgttttgacctactcgatcacgacttgatcataagcagcgtcaaacgcaaagtgacagacggtagcatcttaaaactgctcaaacagtttttaaaaagcggagtaatgataggcaataattgggaagcgagtgagctaggaagtccacaaggtggtgttatcagtccattgttggcgaatatctacctagatgcatttgctcaagaactgaaaaagcgaaatcacagaatagtgaggtacgccgacgacatattgatcttatgctgcacagaaaaagcagccaagaatgcactcacagtagcgactcagatactcgaaaaaggcttaaagttaacagtcaaccaaaagaaaacgcacatagcgcatagtagtgaaggcgtaaaatttttgggagtgaagataggcagtaattggacgcgtatccaagccacaaaactcaaaggctttaaacaaagagttaaacgattaacaaagcgaaatagtggcatgaacttaattgaagtaataana

SEQ ID NO: 21152 - protein, 221 aa, Unknown
  Obtained from environmental sample
  DOMAIN (4)...(185): Reverse transcriptase (RNA-dependent DNA polymerase)
  misc_feature (1)..(221): Xaa is any amino acid
MNILQPLFDIDFHPSSYGYRPKRSCHDAISKATVFIRKYHREWVVDMDLSKCFDLLDHDLIISSVKRKVTDGSILKLLKQFLKSGVMIGNNWEASELGSPQGGVISPLLANIYLDAFAQELKKRNHRIVRYADDILILCCTEKAAKNALTVATQILEKGLKLTVNQKKTHIAHSSEGVKFLGVKIGSNWTRIQATKLKGFKQRVKRLTKRNSGMNLIEVIX

SEQ ID NO: 21153 - DNA, 564 bp, Unknown
  Obtained from environmental sample
  misc_feature (1)..(564): n is a, c, g, or t
atgcgaagtgtacgtgctattgagcattctgacgtttgtcttttagtagtcgatgctaccagaggatttgatggacaagtacaaaatatattttggttagcacaacgtaacagaaaaggtattgtagtgttaattaataaatgggatttagtagaaaaagaccacaagtcaactattgaatttgaaaaatatattaaaacgcaattagagccttttacagatgtgccaattgtatttatttcggtattaactaagcaacgtatttataaagctattgaaaccgctgttgaggtgtaccaaaaccgatctaaacgtatcaaaactagcgagcttaatgagactttattacctatcatagataattatccaccaccagcttataaaggtaaatttgttaaaattaaatacgtaatgcaattgccaacaccacaaccgcaatttgcttttttctgtaacttaccacaatatgtgcgtgaaggatacaagcgttatttagaaaacaaattacgtgagttgtatgactttaaaggtgtgccaattagcgtttacatgcgtaacaaataa

SEQ ID NO: 21154 - protein, 187 aa, Unknown
  Obtained from environmental sample
  misc_feature (1)..(187): Xaa is any amino acid
MRSVRAIEHSDVCLLVVDATRGFDGQVQNIFWLAQRNRKGIVVLINKWDLVEKDHKSTIEFEKYIKTQLEPFTDVPIVFISVLTKQRIYKAIETAVEVYQNRSKRIKTSELNETLLPIIDNYPPPAYKGKFVKIKYVMQLPTPQPQFAFFCNLPQYVREGYKRYLENKLRELYDFKGVPISVYMRNK

SEQ ID NO: 21155 - DNA, 351 bp, Unknown
  Obtained from environmental sample
  misc_feature (1)..(351): n is a, c, g, or t
ttggaagcaatggtagtggacaataaaatagtaattgacagtaccgccacaatttctttagtacccggaaaactaccctatcccaatggcgattttaaagtatcaattttggacaaacagggaaaacagatttcggaatatttcatgcaggaccccttacttgcccgctcctgtgaaggggagaacaataacataacccccttggagaaaggacgtgtatttatatctcttccgaaaaacaacactataggcacgctcatttttactcgtggcaaagagcgggtaggcacagtggatataggtgatctgattgtaagaacacaacgtgatcctactaagggaggacagtag

SEQ ID NO: 21156 - protein, 116 aa, Unknown
  Obtained from environmental sample
  misc_feature (1)..(116): Xaa is any amino acid
MEAMVVDNKIVIDSTATISLVPGKLPYPNGDFKVSILDKQGKQISEYFMQDPLLARSCEGENNNITPLEKGRVFISLPKNNTIGTLIFTRGKERVGTVDIGDLIVRTQRDPTKGGQ

SEQ ID NO: 21157 - DNA, 696 bp, Unknown
  Obtained from environmental sample
  misc_feature (1)..(696): n is a, c, g, or t
atgaaaactaaactacatatatttaaaatcgttgctaaacacttaagttttactaaggctgcagagcaactatatttatcccaacctgcaatttcaaaagccataaaaaacttagagcaagactataaaaccactctatttattagaaaaagaaattcgattgaacttactgctgaaggtaaatcctttttaatttacactaataaaatattgactatttattccgaaatggatgaacggtttcttcttaaaaaagaaaacattccagattttatccattttggagttagcaccacaatttctaattacattatacctaaaacaatagctaaatttagggcacaatacccagaaaccaaatttaatatcatcagtaataattctgaaaccatagaaaatttgattctaaatgaagatatcgactttggaatcaccgaaggaagtagcgctaatcccaaattacattttgaaaagtttataaaagatgaaattgtactagttacaaatgctaaaaactacagtttcccgaaaggtagtattgatataaatacgttacaagacttacctatgattgagcgtgaaactggatcaggaacaaaagaaattatcgatgcttcattatccaaaactaatattagcaagctaaatagcgtcgtatcttttaatagcactgaatctattcacgttatttattaa

SEQ ID NO: 21158 - protein, 231 aa, Unknown
  Obtained from environmental sample
  DOMAIN (7)...(61): Bacterial regulatory helix-turn-helix protein, lysR family
  misc_feature (1)..(231): Xaa is any amino acid
MKTKLHIFKIVAKHLSFTKAAEQLYLSQPAISKAIKNLEQDYKTTLFIRKRNSIELTAEGKSFLIYTNKILTIYSEMDERFLLKKENIPDFIHFGVSTTISNYIIPKTIAKFRAQYPETKFNIISNNSETIENLILNEDIDFGITEGSSANPKLHFEKFIKDEIVLVTNAKNYSFPKGSIDINTLQDLPMIERETGSGTKEIIDASLSKTNISKLNSVVSFNSTESIHVIY

SEQ ID NO: 21159 - DNA, 303 bp, Unknown
  Obtained from environmental sample
  misc_feature (1)..(303): n is a, c, g, or t
atgggatttattgttgttgaaaaagttaaatatctgctcagaattatcatcaggcctgcggatgtaaccgtcgtttacatattttccgatattaactccataattaccataaagattaaactttccattgcggtagttcaaatctatggaattggtaaattttgcttcttctgcgacggtaagtccagtgcttatggttccattgaatccgatatttgcattcttgtgaagcacaatatttataattccgctcattccttcagggttatatttggcagatggattggtaataagttcaattga

SEQ ID NO: 21160 - protein, 100 aa, Unknown
  Obtained from environmental sample
  misc_feature (1)..(100): Xaa is any amino acid
MGFIVVEKVKYLLRIIIRPADVTVVYIFSDINSIITIKIKLSIAVVQIYGIGKFCFFCDGKSSAYGSIESDICILVKHNIYNSAHSFRVIFGRWIGNKFN

SEQ ID NO: 21161 - DNA, 750 bp, Unknown
  Obtained from environmental sample
  misc_feature (1)..(750): n is a, c, g, or t
ttgataaactcatttttagattacattttacttgaaaaaaaatattctgtaaataccattacagcttataaaaacgatctaatatcttttcgtgattttttaatagtagaatataaccaagagaatttattagaagtacattacacacaaataagaaattggattgtatcattagtagatgcagatatttctaacagaacaattaatagaaaggtaagttctttaaaatctttctataaatatttacaaaaaagtgaacagataaagataaatcctctcacaaaacataaagcattaaaagttgctaaaaaaatacaaattccttttacagcaaaagaaattaattctgttatagaaaatataaacaaagaaaataattttacatctattagaaataaacttattgtagaattattttactctacaggaataagaagaacggagcttatcaatattaaagaaaagaatataagcttttcgaatggaacaattaaagtattggggaaaagaaacaaagaacgttttgttcctcttttaaaatcagtcgcagttactttaaaaagttatttagaaattacaaaagagtactctaaaaatttagatcaactttttataacgcgaaatggaactaaaatttatgaaacacttgtatacagaattataaattcatattttagtccagtctcttcaaacgttaacaagagncctcatatattgagcgcttcattgtgcaacacacctattaactga

SEQ ID NO: 21162 - protein, 249 aa, Unknown
  Obtained from environmental sample
  DOMAIN (109)...(245): Phage integrase family
  misc_feature (1)..(249): Xaa is any amino acid
MINSFLDYILLEKKYSVNTITAYKNDLISFRDFLIVEYNQENLLEVHYTQIRNWIVSLVDADISNRTINRKVSSLKSFYKYLQKSEQIKINPLTKHKALKVAKKIQIPFTAKEINSVIENINKENNFTSIRNKLIVELFYSTGIRRTELINIKEKNISFSNGTIKVLGKRNKERFVPLLKSVAVTLKSYLEITKEYSKNLDQLFITRNGTKIYETLVYRIINSYFSPVSSNVNKXPHILSASLCNTPIN

SEQ ID NO: 21163 - DNA, 630 bp, Unknown
  Obtained from environmental sample
  misc_feature (1)..(630): n is a, c, g, or t
atggtgcggaaaaacacatcgttctatatgatcgttgggcttataaaacctaatagtggcaatatttatctggatgacatggaaattacaaaattccccatgtataaacgtgcccaaaatgggattggttatctggcccaagaagcttctgttttccgaaaattaagtatcgaaaaaaatattctaagtgtattacaattgaccagtttgagtaaaaaagagcaactcatgaaaatggaatcgctcttagaagagtttggtctagggcatattcgaaaaaataggggtgatttacttgcaggtggggagcgtcgtagaactgaaattgcccgtgcacttgctacagatccaaaattcatactattggatgagccttttgcaggggtagatccagttgcggttgaagatattcagcgcattgtcgcccatttgaaggacaaaaatattggtattcttataacagaccacaacgtacaggaaaccttggcaattaccgagcgatcatatttaatgttcgaaggtggtatcttaaaatcaggggtgcctgaagatcttgcagcagacgaaatggttcgtaaggtatatctgggtcaaaactttgaacttcgcaaaaagaagctggatttttaa

SEQ ID NO: 21164 - protein, 209 aa, Unknown
  Obtained from environmental sample
  DOMAIN (4)...(174): ABC transporter
  misc_feature (1)..(209): Xaa is any amino acid
MVRKNTSFYMIVGLIKPNSGNIYLDDMEITKFPMYKRAQNGIGYLAQEASVFRKLSIEKNILSVLQLTSLSKKEQLMKMESLLEEFGLGHIRKNRGDLLAGGERRRTEIARALATDPKFILLDEPFAGVDPVAVEDIQRIVAHLKDKNIGILITDHNVQETLAITERSYLMFEGGILKSGVPEDLAADEMVRKVYLGQNFELRKKKLDF

SEQ ID NO: 21165 - DNA, 633 bp, Unknown
  Obtained from environmental sample
  misc_feature (1)..(633): n is a, c, g, or t
ttgttatttatggaagctttaaatatagaatttaacgacgatttaacacttgccattcaaatttttaaaggagactatcacaggacctttatgttgcaattaatctctagtcaaattgatatggatcgcgcagattacttaaaacgtgatagtttttatactggtgtgtccgaaggtaatattaatagtgagcgtttaataacaatgcttaatgttaaagatgatcaattagttattgaagataaaggtatatatagtgtagaaaaatttttagtagctagacgcttaatgtattggcaagtttatttacataaaaccagcttagtcgcagagcagttattaatacgagtgctaaaacgtgctaaagaattggtagcaaagggtgtgcatctagaagcaagtaaaccgttatccttttttttaaaaaatgaaattactattgacaaatttgatgcagattgtctagaaacatttgctaaattagatgattatgatattgttgcagcaatgaaaaattggcaatatcatgatgactttgttttaaaaaatctttgcgagatgattataaatagacatcttttaaaagtaaaaataaagaaaaagcctattttaaagacgttttatagcacataa

SEQ ID NO: 21166 - protein, 210 aa, Unknown
  Obtained from environmental sample
  misc_feature (1)..(210): Xaa is any amino acid
MLFMEALNIEFNDDLTLAIQIFKGDYHRTFMLQLISSQIDMDRADYLKRDSFYTGVSEGNINSERLITMLNVKDDQLVIEDKGIYSVEKFLVARRLMYWQVYLHKTSLVAEQLLIRVLKRAKELVAKGVHLEASKPLSFFLKNEITIDKFDADCLETFAKLDDYDIVAAMKNWQYHDDFVLKNLCEMIINRHLLKVKIKKKPILKTFYST

SEQ ID NO: 21167 - DNA, 486 bp, Unknown
  Obtained from environmental sample
  misc_feature (1)..(486): n is a, c, g, or t
ttgactaaacaaatatctctttttattttttgcctcttttcgacatcagttttattttctcaaatggcaatgccagtaaaagaaatttctattacaggaaaagtagtagatgcaaactctaaccaacctttagagtacgcaactattgtgttaaaaaacacagatactcaaaaaatttctggaggaattacagatatggaagggaaatttgatattaaaactcctacaggaaattatgaaattagtgtagagtttatttctttcaactcaaaaaaatatccaaaacaaaatattacaagtgatttagatttaggaactataaaattatctgaagattcaaaatctttagatgaagtcgtaattatcgcagaaaaaacaactgtagatattcgcttagataaaaaagtattaaatatcggtaaagatttatctattagaggtggtaatgcaagtgacgtanaaggaaatgtaccttctgtccagtag

SEQ ID NO: 21168 - protein, 161 aa, Unknown
  Obtained from environmental sample
  misc_feature (1)..(161): Xaa is any amino acid
MTKQISLFIFCLFSTSVLFSQMAMPVKEISITGKVVDANSNQPLEYATIVLKNTDTQKISGGITDMEGKFDIKTPTGNYEISVEFISFNSKKYPKQNITSDLDLGTIKLSEDSKSLDEVVIIAEKTTVDIRLDKKVLNIGKDLSIRGGNASDVXGNVPSVQ

SEQ ID NO: 21169 - DNA, 585 bp, Unknown
  Obtained from environmental sample
  misc_feature (1)..(585): n is a, c, g, or t
ttgggtggttttttattgatgattttggtattgtattttatgtctaaaaccaacaaacaacaaaaattagctaataatttgctggctttaaaatcgatgcgttcgcaaatgaatccgcattttatttttaatgcattgaactccgtaaatagttttattgctgtaaatgacgaacgaaatgcaaatagatatttaagtgaattttcagctttaatgcgtgcagttttagaaaattctgatgaagattttattccgctaacaaaagaaattgagttgttagaattgtacgtaaaattagagcataatagatttaaagacaagttcgattatcaaataaacatcgataaaaatatcgatttggagcaattttcaattccgccaatgttgttgcaaccttatattgaaaatgctatttggcatggtttgcgttacagaaaggaaaaagggaatttagaaatttccatcaacaaaaaagataacaaaaccatttcaattttaattattgataatggaattggacgaaaaaaatcgcaggaactaaagactaaaaatcaactgaaacaaaagtctaaaggaatgagtacn

SEQ ID NO: 21170 - protein, 195 aa, Unknown
  Obtained from environmental sample
  DOMAIN (29)...(113): Histidine kinase
  misc_feature (1)..(195): Xaa is any amino acid
MGGFLLMILVLYFMSKTNKQQKLANNLLALKSMRSQMNPHFIFNALNSVNSFIAVNDERNANRYLSEFSALMRAVLENSDEDFIPLTKEIELLELYVKLEHNRFKDKFDYQINIDKNIDLEQFSIPPMLLQPYIENAIWHGLRYRKEKGNLEISINKKDNKTISILIIDNGIGRKKSQELKTKNQLKQKSKGMST

SEQ ID NO: 21171 - DNA, 375 bp, Unknown
  Obtained from environmental sample
  misc_feature (1)..(375): n is a, c, g, or t
atgagtgaattttcacatataggaaaaaagaatcaaccaacaatggtaaatgttggtaacaaagaaattaccaaacgggttgctacagctaaggcacttatgtttctaggggaagaaatcatttcacattttataaatgatgatatcattaccaaaaaaggaccagtgtttcaaacggcaattattgcgggcattcaagctgttaaaaagacatcagatatcattccaatgtgtcaccctttaatgattaacgcagttgatattgatatagaggttatcaataaggaacatatcgaaattttatgtactgttgaaattgatggtaaaccggtgttgaaatggaagcacttacgggagcgtcagtggccgggttaa

SEQ ID NO: 21172 - protein, 124 aa, Unknown
  Obtained from environmental sample
  DOMAIN (15)...(116): MoaC family
  misc_feature (1)..(124): Xaa is any amino acid
MSEFSHIGKKNQPTMVNVGNKEITKRVATAKALMFLGEEIISHFINDDIITKKGPVFQTAIIAGIQAVKKTSDIIPMCHPLMINAVDIDIEVINKEHIEILCTVEIDGKPVLKWKHLRERQWPG

SEQ ID NO: 21173 - DNA, 654 bp, Unknown
  Obtained from environmental sample
  misc_feature (1)..(654): n is a, c, g, or t
atgagtcagatgagtaaaataaaatacattctgggttttctcttattcatctttttaattggatcttgtaatagtagtaaagtttttaaggaaaaatggacaataaaagaagctcctgaaatttttaaagcacgctttgaaacaaccaaaggcaacttcgatatagaagcacatcatgattggtctccgaaggcagttgacagattatatcaattaattatgagtgatttttattctgatgtagcactttttagagttgtacctgattttgttgtacaatttggcatacataatgattctgttttaaataattcatggcgtaattataaagttgtggatgaaccagcaattaaacctaatgaagaaggagcaatatcttttgcgagaggtgggatagaatcgcgtacgactcaaatatttatcaatttaaagagtaattcaccaagattagacactattttttatagtggtgttaaaggatttccggtagttgctaaagttaccaatggaatggaagttgttaaatcattttataacggttatgctgagcaaccttcttctaagcaagattctattcaattaaaaggaaatagctacttaaagaataattttccaaaactagactatattaaaaaggcatatataattaaataa

SEQ ID NO: 21174 - protein, 217 aa, Unknown
  Obtained from environmental sample
  DOMAIN (43)...(194): Cyclophilin type peptidyl-prolyl cis-trans isomerase
  misc_feature (1)..(217): Xaa is any amino acid
MSQMSKIKYILGFLLFIFLIGSCNSSKVFKEKWTIKEAPEIFKARFETTKGNFDIEAHHDWSPKAVDRLYQLIMSDFYSDVALFRVVPDFVVQFGIHNDSVLNNSWRNYKVVDEPAIKPNEEGAISFARGGIESRTTQIFINLKSNSPRLDTIFYSGVKGFPVVAKVTNGMEVVKSFYNGYAEQPSSKQDSIQLKGNSYLKNNFPKLDYIKKAYIIK

SEQ ID NO: 21175 - DNA, 435 bp, Unknown
  Obtained from environmental sample
  misc_feature (1)..(435): n is a, c, g, or t
atgagtgatttttattctgatgtagcactttttagagttgtacctgattttgttgtacaatttggcatacataatgattctgttttaaataattcatggcgtaattataaagttgtggatgaaccagcaattaaacctaatgaagaaggagcaatatcttttgcgagaggtgggatagaatcgcgtacgactcaaatatttatcaatttaaagagtaattcaccaagattagacactattttttatagtggtgttaaaggatttccggtagttgctaaagttaccaatggaatggaagttgttaaatcattttataacggttatgctgagcaaccttcttctaagcaagattctattcaattaaaaggaaatagctacttaaagaataattttccaaaactagactatattaaaaaggcatatataattaaataa

SEQ ID NO: 21176 - protein, 144 aa, Unknown
  Obtained from environmental sample
  misc_feature (1)..(144): Xaa is any amino acid
MSDFYSDVALFRVVPDFVVQFGIHNDSVLNNSWRNYKVVDEPAIKPNEEGAISFARGGIESRTTQIFINLKSNSPRLDTIFYSGVKGFPVVAKVTNGMEVVKSFYNGYAEQPSSKQDSIQLKGNSYLKNNFPKLDYIKKAYIIK

SEQ ID NO: 21177 - DNA, 492 bp, Unknown
  Obtained from environmental sample
  misc_feature (1)..(492): n is a, c, g, or t
gtgaatctgcagcttttgattcggctcagaggactaaagcaatcagaaagggcacagatatatttttcaacagcttctcgtccagatgaactgcttaaagcaaccgttcggtctgtgggcaaaaccttcaacaccgacccaaaagctttggaagttctggcagacattgaaaacaaggataaaaacctattgccgggtatgtacgtacaaggacgaatagtgcagggcgaaaaaaagggtttcgccgtcccggaagctgccattataaaagaaggcgagcaatcctttatttttattttggatgaagatgaagaaatggaagcgaacaaaatgaaatttaaaatgatacccgtaacggttggtattactgatttaggctttgttgaagtcaacctgcctgccgaagtttcaaaggatgtcaaagttgtcataaacggagcttataacctgtcttcggaaatggtcaagggcgaactggaacacggacattaa

SEQ ID NO: 21178 - protein, 163 aa, Unknown
  Obtained from environmental sample
  misc_feature (1)..(163): Xaa is any amino acid
MNLQLLIRLRGLKQSERAQIYFSTASRPDELLKATVRSVGKTFNTDPKALEVLADIENKDKNLLPGMYVQGRIVQGEKKGFAVPEAAIIKEGEQSFIFILDEDEEMEANKMKFKMIPVTVGITDLGFVEVNLPAEVSKDVKVVINGAYNLSSEMVKGELEHGH

SEQ ID NO: 21179 - DNA, 351 bp, Unknown
  Obtained from environmental sample
  misc_feature (1)..(351): n is a, c, g, or t
atgaaatttactagcgattttcaaataaaagaagttagagaaaataaacttattgcttctgaaaaatatcgattaaaatacccttcaactcaattaagaccctttgaatttgaaggtagaaatcaatatagaattgatcatggaatgagacctacagatggattgacattaaaacttgtagatagtttatacaaagcagatatgttaacagcctcagaaaccgaaatttttaaagaataccaagatgctttaaatcctttgattgaaatagcagataaagatcctaaaggttggataacgctcatgcagatagtttatgtaaacatcgtcaattttatcaatatcaaatga

SEQ ID NO: 21180 - protein, 116 aa, Unknown
  Obtained from environmental sample
  misc_feature (1)..(116): Xaa is any amino acid
MKFTSDFQIKEVRENKLIASEKYRLKYPSTQLRPFEFEGRNQYRIDHGMRPTDGLTLKLVDSLYKADMLTASETEIFKEYQDALNPLIEIADKDPKGWITLMQIVYVNIVNFINIK

SEQ ID NO: 21181 - DNA, 309 bp, Unknown
  Obtained from environmental sample
  misc_feature (1)..(309): n is a, c, g, or t
gtgttccaaaatccaattccaattagactcaaacaagcccgcgctaagtcaggtattactcaaaagcaactgggtatacttatcggtatggatgaaaactcagcgagtggtcgcatgaaccactatgaaaaaggccgtcatattccagatttaacgactctaaaaaagatcgctaatgaactaaatgttccattgaattattttttctgtgaagatgagacaacagcagaactagcaattgaaatatcaaagttagatacagagaaaaagcttttattaattcaagagcttaaaggaccatctaaatag

SEQ ID NO: 21182 - protein, 102 aa, Unknown
  Obtained from environmental sample
  DOMAIN (10)...(68): Helix-turn-helix
  misc_feature (1)..(102): Xaa is any amino acid
MFQNPIPIRLKQARAKSGITQKQLGILIGMDENSASGRMNHYEKGRHIPDLTTLKKIANELNVPLNYFFCEDETTAELAIEISKLDTEKKLLLIQELKGPSK

SEQ ID NO: 21183 - DNA, 774 bp, Unknown
  Obtained from environmental sample
  misc_feature (1)..(774): n is a, c, g, or t
atgttaagtcacatacacagaggtgatatttacgaaactaatttttgtcaagagttttatgcagaggacaccgttgaaaatccgttagagatttataataaacttaacgccatatcagaaccaccatttgcgacgtttttaaagcttaatgataaatatttattgtctgcgtctccagagcgttacattaaagaagaaggcactaaaattatatcccaacctattaaagggaccgcaaaacgtgaggctgattttatattagattctattttaaaaaacaacttagtatcggatcaaaaggaacgtagcgaaaacgtaatgattgtagatttggtgcgtaatgatttatcgcaaaccgcaacaaaagggagcgtaaaagttgaagaattatgtaaaatttatacctttgatcaagtacatcaaatgatatctacagtaacctctcaggtagataaaaagacacatccaatagatattattaaaagtacgtttcctatgggaagtatgactggagcaccaaaaatttcggcaatgaaaattattgaaactttagaagaaaccaaacgcggtttatactctggtgcagtcggctatatttcgccaacaggcgactttgactttaatgtcgtaatccgtagtattttatataatgctattaataagtacgtgtcatactcggttggaggtgccattaccgcaaaatcagatcctttaaacgaatatgaagagtgtttacttaaagctaaagcgatgagaacggttttagagagttaa

SEQ ID NO: 21184 - protein, 257 aa, Unknown
  Obtained from environmental sample
  DOMAIN (1)...(255): chorismate binding enzyme
  misc_feature (1)..(257): Xaa is any amino acid
MLSHIHRGDIYETNFCQEFYAEDTVENPLEIYNKLNAISEPPFATFLKLNDKYLLSASPERYIKEEGTKIISQPIKGTAKREADFILDSILKNNLVSDQKERSENVMIVDLVRNDLSQTATKGSVKVEELCKIYTFDQVHQMISTVTSQVDKKTHPIDIIKSTFPMGSMTGAPKISAMKIIETLEETKRGLYSGAVGYISPTGDFDFNVVIRSILYNAINKYVSYSVGGAITAKSDPLNEYEECLLKAKAMRTVLES

SEQ ID NO: 21185 - DNA, 570 bp, Unknown
  Obtained from environmental sample
  misc_feature (1)..(570): n is a, c, g, or t
ttgtctgcgtctccagagcgttacattaaaaaagaaggcactaaaattatatcccaacctattaaagggaccgcaaaacgtgaggctgattttatattagattctattttaaaaaacaacttagtatcggatcaaaaggaacgtagcgaaaacgtaatgattgtagatttggtgcgtaatgatttatcgcaaaccgcaacaaaagggagcgtaaaagttgaagaattatgtaaaatttatacctttgatcaagtacatcaaatgatatctacagtaacctctcaggtagataaaaagacacatccaatagatattattaaaagtacgtttcctatgggaagtatgactggagcaccaaaaatttcggcaatgaaaattattgaaactttagaagaaaccaaacgcggtttatactctggtgcagtcggctatatttcgccaacaggcgactttgactttaatgtcgtaatccgtagtattttatataatgctattaataagtacgtgtcatactcggttggaggtgccattaccgcaaaaatcaagattcactttaaacnngaattatga

SEQ ID NO: 21186 - protein, 189 aa, Unknown
  Obtained from environmental sample
  DOMAIN (1)...(183): chorismate binding enzyme
  misc_feature (1)..(189): Xaa is any amino acid
MSASPERYIKKEGTKIISQPIKGTAKREADFILDSILKNNLVSDQKERSENVMIVDLVRNDLSQTATKGSVKVEELCKIYTFDQVHQMISTVTSQVDKKTHPIDIIKSTFPMGSMTGAPKISAMKIIETLEETKRGLYSGAVGYISPTGDFDFNVVIRSILYNAINKYVSYSVGGAITAKIKIHFKXEL

SEQ ID NO: 21187 - DNA, 603 bp, Unknown
  Obtained from environmental sample
  misc_feature (1)..(603): n is a, c, g, or t
atgttctttaccaagaaaaaaagtattccgttaaataatttctttcctaaaaattttgtcgacattcattcccacttattgccagggatagatgacggagcaaaaaacatggatgattctatagcactcatttcaaaaatggccacttatggcattaaaaattttataacaacaccacatgttctgggtactgtatacccgaatagtagtgctactattaaaagtaaattacaagaggttaaagatgaacttcagaacagaggaattaatgatatttctattgaagcagcagcagaatatatgctagacgaagaattttctgcactattaaaaaaagatgatatcttagtcttaaaaggaaagtatattctggtagagatgtcttacttcagtgcgccaataaacttatacgacgttttatttcaaatacagcttaaagggtataaacctattttagcacatccagagagatatactttttatcacaacgattttgaaagtttttataaacttaaaaaagcaggctgtttatttcaactcaatttattgtcactcacagagcaatatggaaacagtgtacaaacagttcagaaaaattattaa

SEQ ID NO: 21188 - protein, 200 aa, Unknown
  Obtained from environmental sample
  misc_feature (1)..(200): Xaa is any amino acid
MFFTKKKSIPLNNFFPKNFVDIHSHLLPGIDDGAKNMDDSIALISKMATYGIKNFITTPHVLGTVYPNSSATIKSKLQEVKDELQNRGINDISIEAAAEYMLDEEFSALLKKDDILVLKGKYILVEMSYFSAPINLYDVLFQIQLKGYKPILAHPERYTFYHNDFESFYKLKKAGCLFQLNLLSLTEQYGNSVQTVQKNY

SEQ ID NO: 21189 - DNA, 672 bp, Unknown
  Obtained from environmental sample
  misc_feature (1)..(672): n is a, c, g, or t
atgttctttaccaagaaaaaaagtattccgttaaataatttctttcctaaaaattttgtcgacattcattcccacttattgccagggatagatgacggagcaaaaaacatggatgattctatagcactcatttcaaaaatggccacttatggcattaaaaattttataacaacaccacatgttctgggtactgtatacccgaatagtagtgctactattaaaagtaaattacaagaggttaaagatgaacttcagaacagaggaattaatgatatttctattgaagcagcagcagaatatatgctagacgaagaattttctgcactattaaaaaaagatgatatcttagtcttaaaaggaaagtatattctggtagagatgtcttacttcagtgcgccaataaacttatacgacgttttatttcaaatacagcttaaagggtataaacctattttagcacatccagagagatatactttttatcacaacgattttgaaagtttttataaacttaaaaaagcaggctgtttatttcaactcaatttattgtcactcacagagcaatatggaaaaagtgtacaaaaagtttcagaaaaattattaaaagaaaacatgtacgatttcgtggggactgatacccatcatcgcaaccatttagaattgctgcnnnnt

SEQ ID NO: 21190 - protein, 224 aa, Unknown
  Obtained from environmental sample
  misc_feature (1)..(224): Xaa is any amino acid
MFFTKKKSIPLNNFFPKNFVDIHSHLLPGIDDGAKNMDDSIALISKMATYGIKNFITTPHVLGTVYPNSSATIKSKLQEVKDELQNRGINDISIEAAAEYMLDEEFSALLKKDDILVLKGKYILVEMSYFSAPINLYDVLFQIQLKGYKPILAHPERYTFYHNDFESFYKLKKAGCLFQLNLLSLTEQYGKSVQKVSEKLLKENMYDFVGTDTHHRNHLELLXX

SEQ ID NO: 21191 - DNA, 735 bp, Unknown
  Obtained from environmental sample
  misc_feature (1)..(735): n is a, c, g, or t
atggaagaaaaaaaactagacgttaagtcgataataggatttgtattaattttcggaatcttattattcatgatgtggcaaaaccagccatctcctgaagagcttaaagcgcaagaggtagaaaagcaagctcaaattgaggctcagaaaaaagtaaatgctacagctccatcagagactaaagttactactgcattagatttttctaaaccaaaggactctactcaagtagcagcattacaatcaaaaatcggtgattttgcttattctttagcgactacaactgctacagatagtgaggtattggttgaaagtgatttgttagcattaaagtttaatacaaaaggtggtcatttatcagaggttaaacttaaaaactttgtaaactttgattctattccaatttacttagtaaaggatggtaattcggtatttaatatcaatttccaaacaacagataatcgtactttaaatactaaagatttatattttcagcctacagtaactaaaagtggagaaaacacagtagtgtccatgaagttaaaaactgcagaagataaatttttagagtataattatgtagttaagccaaacgattatatggtagattttaccattaaatctcaaggtttagagtctgctataaatacgtcaaatcctattaatttagattggacacaaaaaacaataagacatgaccaaagtattagtacgagaatagctcagccgatctga

SEQ ID NO: 21192 - protein, 244 aa, Unknown
  Obtained from environmental sample
  misc_feature (1)..(244): Xaa is any amino acid
MEEKKLDVKSIIGFVLIFGILLFMMWQNQPSPEELKAQEVEKQAQIEAQKKVNATAPSETKVTTALDFSKPKDSTQVAALQSKIGDFAYSLATTTATDSEVLVESDLLALKFNTKGGHLSEVKLKNFVNFDSIPIYLVKDGNSVFNINFQTTDNRTLNTKDLYFQPTVTKSGENTVVSMKLKTAEDKFLEYNYVVKPNDYMVDFTIKSQGLESAINTSNPINLDWTQKTIRHDQSISTRIAQPI

SEQ ID NO: 21193 - DNA, 468 bp, Unknown
  Obtained from environmental sample
  misc_feature (1)..(468): n is a, c, g, or t
ttgcttttaaaaattaagaataatcttattaaaaacgaacatattatctcaaaatataagaatgaacttattaataagccacatataaaaataaaaaaatctcaagacgaaatttttctagaaaatttaaatacaattgttaataattgtttgagtaactctcaatttaaagttgatgagttggcagataaattaaatatgagtcattctagtttgtatagaaaatgttctgcattaacaggtttaagccttgtagattatataagacaattacgtcttaaaaaagctgcaatcttattagtcaaatatggttataatatttctgaagtagcttatatggtaggttttaataatccaaaatacttttctaaaagttttaaaaatcaatttaatataactccaaaacaatttaaaataaggcaaaatcatcaacaaatattaatatatatctacaagaaaataatgtag

SEQ ID NO: 21194 - protein, 155 aa, Unknown
  Obtained from environmental sample
  DOMAIN (46)...(89): Bacterial regulatory helix-turn-helix proteins, AraC family
  misc_feature (1)..(155): Xaa is any amino acid
MLLKIKNNLIKNEHIISKYKNELINKPHIKIKKSQDEIFLENLNTIVNNCLSNSQFKVDELADKLNMSHSSLYRKCSALTGLSLVDYIRQLRLKKAAILLVKYGYNISEVAYMVGFNNPKYFSKSFKNQFNITPKQFKIRQNHQQILIYIYKKIM

SEQ ID NO: 21195 - DNA, 489 bp, Unknown
  Obtained from environmental sample
  misc_feature (1)..(489): n is a, c, g, or t
ttgcttttaaaaattaagaataatcttattaaaaacgaacatattatctcaaaatataagaatgaacttattaataagccacatataaaaataaaaaaatctcaagacgaaatttttctagaaaatttaaatacaattgttaataattgtttgagtaactctcaatttaaagttgatgagttggcagataaattaaatatgagtcattctagtttgtatagaaaatgttctgcattaacaggtttaagccttgtagattatataagacaattacgtcttaaaaaagctgcaatcttattagtcaaatatggttataatatttctgaagtagcttatatggtaggttttaataatccaaaatacttttctaaaagttttaaaaatcaatttaatataactccaaaacaatttaaaaataaggcaaaatcatcaacaaatattaatatatatctacaagaaaataatgtagatgttatggatattgagtag

SEQ ID NO: 21196 - protein, 162 aa, Unknown
  Obtained from environmental sample
  DOMAIN (46)...(89): Bacterial regulatory helix-turn-helix proteins, AraC family
  misc_feature (1)..(162): Xaa is any amino acid
MLLKIKNNLIKNEHIISKYKNELINKPHIKIKKSQDEIFLENLNTIVNNCLSNSQFKVDELADKLNMSHSSLYRKCSALTGLSLVDYIRQLRLKKAAILLVKYGYNISEVAYMVGFNNPKYFSKSFKNQFNITPKQFKNKAKSSTNINIYLQENNVDVMDIE

SEQ ID NO: 21197 - DNA, 723 bp, Unknown
  Obtained from environmental sample
  misc_feature (1)..(723): n is a, c, g, or t
gtggaccagatagacagtagttatgtgggcttcaataaatggcttcaaaaatctggagatgcacccgtaattataagcgagcagcgcattgaaaaatctgtggaacgtttgaagcgttggtacgcgagctatggttattttaacgatgaagttgattataaaatagctccaagcgaaaagaagaaaaaaagagcgacaatcacttattccgttaaaaagcacaaaccctattttgtgggcgattccattggcgaaaagataagttcgcccgtggttgattcgctgtttcaaattacaaaggctaactcgtttattattcccgggaagcaatatgcggccaatgattttgtgaacgaacgtgaccgacttactattttatttagaaattctggattatatcattttgaacaagattacgttggttttgaggcggacaccgtcaatacggatcataaagctgatataacctacattatccccgaccgaaaaattaccgaaggagacagcacccgtacagttccatttaaggttcacaccattaatgaagttcggattgttacagattattcatacgaaaatcgaaataaaagcttccaagactcattgagctatatgggttacaaactttacagttatggcaaaatgcgttttcgccccaaggccattacatctgccgtctcaatcaatcctgggaaaattttaaagatattgacagaactttaa

SEQ ID NO: 21198 - protein, 240 aa, Unknown
  Obtained from environmental sample
  DOMAIN (16)...(79): Surface antigen variable number repeat
  misc_feature (1)..(240): Xaa is any amino acid
MDQIDSSYVGFNKWLQKSGDAPVIISEQRIEKSVERLKRWYASYGYFNDEVDYKIAPSEKKKKRATITYSVKKHKPYFVGDSIGEKISSPVVDSLFQITKANSFIIPGKQYAANDFVNERDRLTILFRNSGLYHFEQDYVGFEADTVNTDHKADITYIIPDRKITEGDSTRTVPFKVHTINEVRIVTDYSYENRNKSFQDSLSYMGYKLYSYGKMRFRPKAITSAVSINPGKILKILTEL

SEQ ID NO: 21199 - DNA, 726 bp, Unknown
  Obtained from environmental sample
  misc_feature (1)..(726): n is a, c, g, or t
ttggtttttaggcgatttacagacgatagagatgttttagtagttactcctgaaggtggttttataaaaagaactactatttatgatgatgaaacaaatctacaaactacacttggtaaaattgaacttactccaaaaggagatgtaattgcgtctataaatagagtttctaaggggttgcaatatgatgataaatcttacctagatacatttacagaagaagagttgataaaaaactataaatctagaacttggagttataataacaatttagagattaatgctcatcacctaaaaaatgataaaaaaaatgttgtttttacagaagatttagaggtttcaatagcaaattatgcttctgtaaatgatactgaatatttatttagagtaaacatttttaatactgaaaatgaaatacctaaaagatatagagatagaaatttacctttaaaaattagcagtggttataaagatgtagatgaatatgaaattaaatttccagaaaattataaattaaattatacgcctcaaaacaaagaattggttaccaaatttggtacatataaaatcagctttaaaattatagatgaacaaactttatcttataaaaaagaaattattatcaaagaaggtgtgtacccaaaagaagattataataaatatagaagctttagaagaagcatctcaaaattagaacatttaagaatagcactcacaaaaatttaa

SEQ ID NO: 21200 - protein, 241 aa, Unknown
  Obtained from environmental sample
  misc_feature (1)..(241): Xaa is any amino acid
MVFRRFTDDRDVLVVTPEGGFIKRTTIYDDETNLQTTLGKIELTPKGDVIASINRVSKGLQYDDKSYLDTFTEEELIKNYKSRTWSYNNNLEINAHHLKNDKKNVVFTEDLEVSIANYASVNDTEYLFRVNIFNTENEIPKRYRDRNLPLKISSGYKDVDEYEIKFPENYKLNYTPQNKELVTKFGTYKISFKIIDEQTLSYKKEIIIKEGVYPKEDYNKYRSFRRSISKLEHLRIALTKI

SEQ ID NO: 21201 - DNA, 369 bp, Unknown
  Obtained from environmental sample
  misc_feature (1)..(369): n is a, c, g, or t
ttgtctgtaactgctgtttatgaacgtatcaaaaagttagaaaaccataatattattgagaaatacgttgctatcatcaacaaatataaaattgaaaaatcttttttagttttttgtcatattaaattagtgcaacattctagagaatatgtcaccacttttgagcgtgaaatattaaaattaaccgaagtttcagaatgttttcatgtaagtggagattatgattacatcttaaaaatctacgtaaaaaatatggatgaatatagaaactttatggtaactaaattaactgccataaaatatattggcagcacacatagtatttttgctattgagcaagttaaaaacaccactgttataaatttataa

SEQ ID NO: 21202 - protein, 122 aa, Unknown
  Obtained from environmental sample
  DOMAIN (1)...(100): AsnC family
  misc_feature (1)..(122): Xaa is any amino acid
MSVTAVYERIKKLENHNIIEKYVAIINKYKIEKSFLVFCHIKLVQHSREYVTTFEREILKLTEVSECFHVSGDYDYILKIYVKNMDEYRNFMVTKLTAIKYIGSTHSIFAIEQVKNTTVINL

SEQ ID NO: 21203 - DNA, 303 bp, Unknown
  Obtained from environmental sample
  misc_feature (1)..(303): n is a, c, g, or t
ttggcagaaagaaaatatcctgtagattttgcaactgcttggagagatgttaatagggtttctatagatattcctgaaggttattcagttgaaaaactacctgagcccttagcaattgctttaccaaataatttaggggtttttaaataccaagtttctcaaaatggaaataaagtaaaatcagtttcaatattagaatttaattcaggtatgattccatctgaatattatgcttatctaaaagacttttacagcaagttagtaaagaaagaatcagaaaaaatagtctttataaaaagctaa

SEQ ID NO: 21204 - protein, 100 aa, Unknown
  Obtained from environmental sample
  misc_feature (1)..(100): Xaa is any amino acid
MAERKYPVDFATAWRDVNRVSIDIPEGYSVEKLPEPLAIALPNNLGVFKYQVSQNGNKVKSVSILEFNSGMIPSEYYAYLKDFYSKLVKKESEKIVFIKS

SEQ ID NO: 21205 - DNA, 519 bp, Unknown
  Obtained from environmental sample
  misc_feature (1)..(519): n is a, c, g, or t
ttgcatccaaaagcaagccttattttaactatgactaagacaaatcttaattgtgatattgatagctttttgagtaagtattattcttttaaggaagtggatagtcctaaacctggttatttggcccttaaagggaaaattagtgtcctcgataagaaaggcaaactttggggtcaatttgaaattctcattttaattaataaaattgaatacccatacactattcctattgtcatcgaaaaaactcaaataattgatagagattgggatttccatatctcaaaagaaggcgtttgctgtttggatattccacatcaacttttaaaaagaaaaaggcgaggaatcacatttgaagagttttacaggaatgtcatatatcccttttttgccaattaccattacaaggaatcaactggtgagtatgcaaatggggaatacaaacatcattttgaaggaatagctcaattttatcaagaggaattcgacctcgaaattctcgagccgattcttgatccatag

SEQ ID NO: 21206 - protein, 172 aa, Unknown
  Obtained from environmental sample
  misc_feature (1)..(172): Xaa is any amino acid
MHPKASLILTMTKTNLNCDIDSFLSKYYSFKEVDSPKPGYLALKGKISVLDKKGKLWGQFEILILINKIEYPYTIPIVIEKTQIIDRDWDFHISKEGVCCLDIPHQLLKRKRRGITFEEFYRNVIYPFFANYHYKESTGEYANGEYKHHFEGIAQFYQEEFDLEILEPILDP

SEQ ID NO: 21207 - DNA, 750 bp, Unknown
  Obtained from environmental sample
  misc_feature (1)..(750): n is a, c, g, or t
ttgaaattaggagcgcaagtaatgtttatcaaaaatgattcatcacaagaaaaaagatattttaacggaaaaataggaattattacaaaaattgctaaagattctgtgacagtaaaatgtccaaatgataatgatgaaattgtaacagaaagagaaacgtggtctaatattaactactccataaatgaggatacaaaagctattaaagaacaattaattggtgcttttacgcaaattcctttgcgtttggcttgggcaattaccattcataaaagtcaaggtttaacattcgaaaaagccattatagatgctgaggcttcttttgctcatgggcaaacgtatgtggctttgagtagatgtacctctttagaaggtttggtgttaaaaacgaagattacaagcaatgctattatcaacgatagaacagtaagtatttttaatgaaagtgtagaggaaaaccatcctgatgaatcgattttaaacgaatctgaaaaacattttcaattaaatttaattatagaattgttagattatcagccttttttatatccaataactcgtttaattgatattttttacaaaaatcaaactagtataaaaggcgatgttatagatcatttacaaaccataaaagatgatggaattgtagctttaatgaaagtttctaacggatttaaaaatccacttttacagatttctgaaggtaatatttaccagaaaatagtctcaaatccaaaaacgtttacannc

SEQ ID NO: 21208 - protein, 250 aa, Unknown
  Obtained from environmental sample
  misc_feature (1)..(250): Xaa is any amino acid
MKLGAQVMFIKNDSSQEKRYFNGKIGIITKIAKDSVTVKCPNDNDEIVTERETWSNINYSINEDTKAIKEQLIGAFTQIPLRLAWAITIHKSQGLTFEKAIIDAEASFAHGQTYVALSRCTSLEGLVLKTKITSNAIINDRTVSIFNESVEENHPDESILNESEKHFQLNLIIELLDYQPFLYPITRLIDIFYKNQTSIKGDVIDHLQTIKDDGIVALMKVSNGFKNPLLQISEGNIYQKIVSNPKTFTX

SEQ ID NO: 21209 - DNA, 882 bp, Unknown
  Obtained from environmental sample
  misc_feature (1)..(882): n is a, c, g, or t
gtgagggcagatacgacgaatgatattattgcactccaagaatcaaattcagatcttaaatatattagtcctgctgttgaaaatttactgggttacaaacaagatgaattgcttaaaaaacaatttatagatgtaattcatgaagaggatatgatcaacattaaagaagctgttaaaaataagcttttaaaagggatcacaatcaatgctataatttatagagttcgccataaaaaaggacattttatatggttagaaaccttaatttctccgataattaaacgcaataaaataatttctatcatatcaacaagtagagacattacacaatggatgtcagcaaaaaaagaaatagaagaataccaaacttctcttcaaaaattgactagtgaaatttctatgattgaagaaaagcaaaaaaaggaaattgcagcaaacattcacgatcatttaagtcaatctttggtaatttcaaagatgagaatatcagatttagaaaaaaaacctgagttaaatagtatttacaaagacctcgactttataaaatcgcatgtttctaatgctttagaaaatagtcgtaaaattacatacgaactctcaccacctgtattatatcaattaggaatcgtagatgccttagattggtatgcagaagaaactgaagacaaatacgacattaaatttcaatttattagcaatgtagatactgttaaacttaccgatattaaatcaatcttaatatttagatgtgttcaagaagcagttacaaacactattaaatatgcagaagctactgcaataactttaaaattaactaaagataaacatgcgagtgatattttaattaccgataatggaaaaggcttcgacactgcagtataa

SEQ ID NO: 21210 - protein, 293 aa, Unknown
  Obtained from environmental sample
  DOMAIN (70)...(111): PAC motif
  misc_feature (1)..(293): Xaa is any amino acid
MRADTTNDIIALQESNSDLKYISPAVENLLGYKQDELLKKQFIDVIHEEDMINIKEAVKNKLLKGITINAIIYRVRHKKGHFIWLETLISPIIKRNKIISIISTSRDITQWMSAKKEIEEYQTSLQKLTSEISMIEEKQKKEIAANIHDHLSQSLVISKMRISDLEKKPELNSIYKDLDFIKSHVSNALENSRKITYELSPPVLYQLGIVDALDWYAEETEDKYDIKFQFISNVDTVKLTDIKSILIFRCVQEAVTNTIKYAEATAITLKLTKDKHASDILITDNGKGFDTAV

SEQ ID NO: 21211 - DNA, 330 bp, Unknown
  Obtained from environmental sample
  misc_feature (1)..(330): n is a, c, g, or t
ttgaggatgatttcttataggagaaaaatattcaatacagcaaaagacttacagaacattaatttaattaatttatcagtaaatttagaagaagcaaaagcagaattaatgcttactgaatacgattttattgttcttgatttaaatttacctgatggcaatggaatagaattgctaaagtggcttagagctcaaaacaagactgtaaaagtttttatattttctattaatatagagctaaaaagaatttgtttaaaaaatggtgcagcagctttttttgataaatctcaagattttgatctactaattgacactcttaaaaaactataa

SEQ ID NO: 21212 - protein, 109 aa, Unknown
  Obtained from environmental sample
  DOMAIN (1)...(109): Response regulator receiver domain
  misc_feature (1)..(109): Xaa is any amino acid
MRMISYRRKIFNTAKDLQNINLINLSVNLEEAKAELMLTEYDFIVLDLNLPDGNGIELLKWLRAQNKTVKVFIFSINIELKRICLKNGAAAFFDKSQDFDLLIDTLKKL

SEQ ID NO: 21213 - DNA, 684 bp, Unknown
  Obtained from environmental sample
  misc_feature (1)..(684): n is a, c, g, or t
atgtacattttttcaatcttatttgctcaaataagttggtcatttgtacgcttttttaaattggacagaaaatcaacaattatccgatttaacaaccattggcattattattttaaaggtgaaattagtgattttaaagagtttaaaaaatctttgaatggaaaggtattagctacatatgctgatatcatgacatccacaaatgacggggtaagtcgcttatattctgggatattaacacaatacactatttcaagaaaagataatcaactcgaaaatatgtatttaactgatgtctcgatatacaagaaagataaaaatggaaagagagcacctaaagatattattggagattgcatgattattccttattcgaatgtaattaatattaatctgcgatatatttataaaaataaaacgaatcgaaaatatgacaatttatttagcatcttactcctatctggtattgttttagttataacagatttcttatatctcattaatttgacatcaatctttaagtctattcttataaaagtgttagcaattttaaattggggtcttattattgtcctaatacaatctttcgtagattataacattaaagcaaaaaaattgacctttaccttgataatactaattatagtgatttcactatcaatttatagattagtaatatattaa

SEQ ID NO: 21214 - protein, 227 aa, Unknown
  Obtained from environmental sample
  misc_feature (1)..(227): Xaa is any amino acid
MYIFSILFAQISWSFVRFFKLDRKSTIIRFNNHWHYYFKGEISDFKEFKKSLNGKVLATYADIMTSTNDGVSRLYSGILTQYTISRKDNQLENMYLTDVSIYKKDKNGKRAPKDIIGDCMIIPYSNVININLRYIYKNKTNRKYDNLFSILLLSGIVLVITDFLYLINLTSIFKSILIKVLAILNWGLIIVLIQSFVDYNIKAKKLTFTLIILIIVISLSIYRLVIY

SEQ ID NO: 21215 - DNA, 879 bp, Unknown
  Obtained from environmental sample
  misc_feature (1)..(879): n is a, c, g, or t
ttgcaaacacgattgcgagacgatttcctcaataaaaattggaacaacaccaacgatgcgtctcagctatttgtaaaggtgacttcaaatgccgacttatcagccatacaaaatcgtttggatgatttagcaaaggagcaccaagatgaggagtctaaaaaatatggtgatgaacaaaagtttacactacaaccattaggtgatattcacttcaacgaaaagtatggtatttacgattggtctaaaggtcaggccagtaaatcgctacttataaatctcgctttagtggcgatatttctattgcttttaggttgtatcaattttatcaatctaaatacagcgcaagcttctcagcgtgctaaagaaataggaatccgtaaaacattaggaagctctagaaaacagctgataggtcaatttatgggtgaaacctttttattggttttagtgtctgcagtattatcgctattactttctagatggttgattaatgtattttccgattttgtgccagaaggtttaagttatgagttgatgaaatcacctataatcattcttggtattgctattctattactattagtgacatttttatctggcttttatccagcattagtactttcaaaatttaacacggttgccgttttaaaaaatcatttagctgtcggaaataaaaaggtgaaacttcgtaaattcttaacggtttttcagttttccattgctcaagtatttgtaattgctacgttgttggttggtcaacaaattaattttcttttagaaacagatatgggttttaaaacggatgctattgtgtctggttatagccctagagcggaacgcgaaatctctaaaaaaagagctttatgcccaaaaatttag

SEQ ID NO: 21216 - protein, 292 aa, Unknown
  Obtained from environmental sample
  DOMAIN (20)...(212): Predicted permease
  misc_feature (1)..(292): Xaa is any amino acid
MQTRLRDDFLNKNWNNTNDASQLFVKVTSNADLSAIQNRLDDLAKEHQDEESKKYGDEQKFTLQPLGDIHFNEKYGIYDWSKGQASKSLLINLALVAIFLLLLGCINFINLNTAQASQRAKEIGIRKTLGSSRKQLIGQFMGETFLLVLVSAVLSLLLSRWLINVFSDFVPEGLSYELMKSPIIILGIAILLLLVTFLSGFYPALVLSKFNTVAVLKNHLAVGNKKVKLRKFLTVFQFSIAQVFVIATLLVGQQINFLLETDMGFKTDAIVSGYSPRAEREISKKRALCPKI

SEQ ID NO: 21217 - DNA, 606 bp, Unknown
  Obtained from environmental sample
  misc_feature (1)..(606): n is a, c, g, or t
ttgcttaaactctatatttatggctatttaaataaattacgttcttcccgagatttagaaaaggcctgcaagcgaaacattgaagttttatggcttttaaaaagccttcaacccgaccataatacaatttcaaatttccgtaaagacaatcctaaagcgataaaaaaggtatttagagcaactgtacaaattgcgaagcattttaatttgattggaggtaaactgattgctggagacagcaccaagatgcgagctcagaatagtaaaaaaaataattttaacccaaagaaaatagatcgccatattgcttacatagaccgaaagttagaagtgcatagtaaagaattagcaattgctgatgatgattctaaaaagaaaataaatcaagaaatagaaaaacatactaagcgaagagaaaattacaaacaaatcgataaacagctcgaagagagtggaactactcaggtatcaacatctgatccagaaagtcgccaaatgaccatccgcaataacattaccgaggtcgcctataatattcaaacctccgtagatcacaaacactgcattcctatagatttcaaagtcaccaanaccaacgacagttaa

SEQ ID NO: 21218 - protein, 201 aa, Unknown
  Obtained from environmental sample
  misc_feature (1)..(201): Xaa is any amino acid
MLKLYIYGYLNKLRSSRDLEKACKRNIEVLWLLKSLQPDHNTISNFRKDNPKAIKKVFRATVQIAKHFNLIGGKLIAGDSTKMRAQNSKKNNFNPKKIDRHIAYIDRKLEVHSKELAIADDDSKKKINQEIEKHTKRRENYKQIDKQLEESGTTQVSTSDPESRQMTIRNNITEVAYNIQTSVDHKHCIPIDFKVTXTNDS

SEQ ID NO: 21219 - DNA, 720 bp, Unknown
  Obtained from environmental sample
  misc_feature (1)..(720): n is a, c, g, or t
ttgcttaaactctatatttatggctatttaaataaattacgttcttcccgagatttagaaaaggcctgcaagcgaaacattgaagttttatggcttttaaaaagccttcaacccgaccataatacaatttcaaatttccgtaaagacaatcctaaagcgataaaaaaggtatttagagcaactgtacaaattgcgaagcattttaatttgattggaggtaaactgattgctggagacagcaccaagatgcgagctcagaatagtaaaaaaaataattttaacccaaagaaaatagatcgccatattgcttacatagaccgaaagttagaagtgcatagtaaagaattagcaattgctgatgatgattctaaaaagaaaataaatcaagaaatagaaaaacatactaagcgaagagaaaattacaaacaaatcgataaacagctcgaagagagtggaactactcaggtatcaacatctgatccagaaagtcgccaaatgaccatccgcaataacattaccgaggtcgcctataatattcaaacctccgtagatcacaaacactgcattcctatagatttcaaagtcaccaacaccaacgacagtaaagctatgggtgctatgctaaggcgttccaaaactatcttgcgcagtaatgaatttacagcactttacgacaaaggctaccatacgggaagtgagtttaaaccagcggatgattaa

SEQ ID NO: 21220 - protein, 239 aa, Unknown
  Obtained from environmental sample
  misc_feature (1)..(239): Xaa is any amino acid
MLKLYIYGYLNKLRSSRDLEKACKRNIEVLWLLKSLQPDHNTISNFRKDNPKAIKKVFRATVQIAKHFNLIGGKLIAGDSTKMRAQNSKKNNFNPKKIDRHIAYIDRKLEVHSKELAIADDDSKKKINQEIEKHTKRRENYKQIDKQLEESGTTQVSTSDPESRQMTIRNNITEVAYNIQTSVDHKHCIPIDFKVTNTNDSKAMGAMLRRSKTILRSNEFTALYDKGYHTGSEFKPADD

SEQ ID NO: 21221 - DNA, 486 bp, Unknown
  Obtained from environmental sample
  misc_feature (1)..(486): n is a, c, g, or t
ttggcaaataccaataccgttactcctaaaaagaaatctaagagcaaatctaaaaagcaaaaagccccagtaaaaactgccgtagtacaatctaaaaataaaatagaaagcaaagcagaaaacaagacagaaatcagggacagttttgacggtagaaaaatttcatacactaaagaattcgagttcgattccgagaatattattatcaagatttgggatcatggcagacaagatggcgatattgtttccatatatcttaatggtgtgcaagtgattaaaaagtactatttaacttactggaaaaaagaatttaaaataaaactagaccctacaaaatctaacgatttattcctctacgctcataatttaggtgattctccgccaaatacagtttccgttgaaatatctgacggtaaaaaatctgaaaacattgtactaaactcagaccttcaaagttgtgaagcagtattgatcagtgtaaagtaa

SEQ ID NO: 21222 - protein, 161 aa, Unknown
  Obtained from environmental sample
  misc_feature (1)..(161): Xaa is any amino acid
MANTNTVTPKKKSKSKSKKQKAPVKTAVVQSKNKIESKAENKTEIRDSFDGRKISYTKEFEFDSENIIIKIWDHGRQDGDIVSIYLNGVQVIKKYYLTYWKKEFKIKLDPTKSNDLFLYAHNLGDSPPNTVSVEISDGKKSENIVLNSDLQSCEAVLISVK

SEQ ID NO: 21223 - DNA, 579 bp, Unknown
  Obtained from environmental sample
  misc_feature (1)..(579): n is a, c, g, or t
atgaaaacgaaatacatagatttgattaatcaaaattttatttttcctcaaaaagaatttaatttaaataaagatcaattattatttcatggggttaacttaatggaattagtagaagaatatggttcaccattaaaatatacatatttaccaaaaatttcagaaaatataaataaaaccaagaaatggtttgaaaatgctattgaaaaacatcaatataaaggaaaatataattactgttattgtaccaaaagctcccatttcaaatatgttttagatgaagctttaaaaaacgaaatatatttagaaacatcctctgcatttgatattaacataattgagaaattaaaatcagaaggcaaattagataagaatgactacataatttgtaatggttttaaagatgaagcgtatatcacaaatatagcaagattaataaataatggtcatctaaattgtttgccaataattgacaattcggaagaaattaatttgttagaaaataaggtcacttcaaaagttaaaatcggtattagaattgcgactgaagaacaactaaattcccatttatacaagtag

SEQ ID NO: 21224 - protein, 192 aa, Unknown
  Obtained from environmental sample
  misc_feature (1)..(192): Xaa is any amino acid
MKTKYIDLINQNFIFPQKEFNLNKDQLLFHGVNLMELVEEYGSPLKYTYLPKISENINKTKKWFENAIEKHQYKGKYNYCYCTKSSHFKYVLDEALKNEIYLETSSAFDINIIEKLKSEGKLDKNDYIICNGFKDEAYITNIARLINNGHLNCLPIIDNSEEINLLENKVTSKVKIGIRIATEEQLNSHLYK

SEQ ID NO: 21225 - DNA, 552 bp, Unknown
  Obtained from environmental sample
  misc_feature (1)..(552): n is a, c, g, or t
atgaaaacgaaatacatagatttgattaatcaaaattttatttttcctcaaaaagaatttaatttaaataaagatcaattattatttcatggggttaacttaatggaattagtagaagaatatggttcaccattaaaatatacatatttaccaaaaatttcagaaaatataaataaaaccaagaaatggtttgaaaatgctattgaaaaacatcaatataaaggaaaatataattactgttattgtaccaaaagctcccatttcaaatatgttttagatgaagctttaaaaaacgaaatatatttagaaacatcctctgcatttgatattaacataattgagaaattaaaatcagaaggcaaattagataagaatgactacataatttgtaatggttttaaagatgaagcgtatatcacaaatatagcaagattaataaataatggtcatctaaattgtttgccaataattgacaattcggaagaaattaatttgttagaaaataaggtcaattcaaaagttaaaatcggtattagaattgcgactgaagnn

SEQ ID NO: 21226 - protein, 184 aa, Unknown
  Obtained from environmental sample
  misc_feature (1)..(184): Xaa is any amino acid
MKTKYIDLINQNFIFPQKEFNLNKDQLLFHGVNLMELVEEYGSPLKYTYLPKISENINKTKKWFENAIEKHQYKGKYNYCYCTKSSHFKYVLDEALKNEIYLETSSAFDINIIEKLKSEGKLDKNDYIICNGFKDEAYITNIARLINNGHLNCLPIIDNSEEINLLENKVNSKVKIGIRIATEX

SEQ ID NO: 21227 - DNA, 426 bp, Unknown
  Obtained from environmental sample
  misc_feature (1)..(426): n is a, c, g, or t
atgcataaacagcatattttattaatgtatacaaagagatacgatgactttagtttacctggtggcggtgttgatgagcacgaaagtatagagcaagggttaatacgtgagctacaagaggaaaccggcgcacaaaatatagtaataaaaaaagagttcggcctatatgaagagtaccgcccttggtacaaagacgactttgacattattcatataaagtcttattgctatgtatgtaatattgaccaaaagttaggccaagcgcagcttgaacactacgagcaacaaaatggtatggttgccaagtgggtagatataaatgaagcaattgagcataacgagcgaacacttgccaccagcgataagcaggggctgtcgattattcgcgaaacctatttactcaaagaaatagctaaacagttatag

SEQ ID NO: 21228 - protein, 141 aa, Unknown
  Obtained from environmental sample
  DOMAIN (1)...(123): NUDIX domain
  misc_feature (1)..(141): Xaa is any amino acid
MHKQHILLMYTKRYDDFSLPGGGVDEHESIEQGLIRELQEETGAQNIVIKKEFGLYEEYRPWYKDDFDIIHIKSYCYVCNIDQKLGQAQLEHYEQQNGMVAKWVDINEAIEHNERTLATSDKQGLSIIRETYLLKEIAKQL

SEQ ID NO: 21229 - DNA, 918 bp, Unknown
  Obtained from environmental sample
  misc_feature (1)..(918): n is a, c, g, or t
ttgaaagtgtatatagtatctttgcatttcaaaaataataacatgagcacactcgtttctggattttctaaattatcaaaagctgaaaagattaattggctaattaaaaatcatctgtcagcctatatagatgctgagaccatcctaaagcaatattggaatagcgatcaaaagctacaacagttgcatgacgagtttatagaaaacacaataactaattattttttaccctttggaattgcaccaaattttgttattaatgacaagatttacaccataccaatgacaattgaagaaagctctgtagttgctgctgctagtaaatctgcaaaattctggcaaaccagaggtggatttaaagctaccattttatctactactaaaattggtcaagtccactttacatattccggaagttatagtgatttaaaaaactattttgacactataaaacagcaacttataactgacacaaaatccattactaaaaacatggaaaaacgtggtggtggtattttagatattgaattaagagataaaaccagcgatttagataattactatcagctgcatgctacttttgaaactttagatgcaatgggagcaaattttataaactcgtgtttagaacaatttgctaaaacatttaaaaatgaagctgatcatcacttacaagagcctataaatattgtcatgagtattttatctaattacgtacctgagtgcttagttagagctgaagtaagttgtaaagttgaagctttagctgaaaaagacatagacccaaatacattggctgaaaaatttgtacaagcagttaatatagcagaaatcgaacttacagactgttaccacaacaaggttcctcatgggatgatgtgttgtttgccaccggtaagatttaaccgtaaactgtga

SEQ ID NO: 21230 - protein, 305 aa, Unknown
  Obtained from environmental sample
  DOMAIN (35)...(303): Hydroxymethylglutaryl-coenzyme A reductase
  misc_feature (1)..(305): Xaa is any amino acid
MKVYIVSLHFKNNNMSTLVSGFSKLSKAEKINWLIKNHLSAYIDAETILKQYWNSDQKLQQLHDEFIENTITNYFLPFGIAPNFVINDKIYTIPMTIEESSVVAAASKSAKFWQTRGGFKATILSTTKIGQVHFTYSGSYSDLKNYFDTIKQQLITDTKSITKNMEKRGGGILDIELRDKTSDLDNYYQLHATFETLDAMGANFINSCLEQFAKTFKNEADHHLQEPINIVMSILSNYVPECLVRAEVSCKVEALAEKDIDPNTLAEKFVQAVNIAEIELTDCYHNKVPHGMMCCLPPVRFNRKL

SEQ ID NO: 21231 - DNA, 555 bp, Unknown
  Obtained from environmental sample
  misc_feature (1)..(555): n is a, c, g, or t
atggaatttttaaaaggttttactagaaattttgggggagtgcccaaaccaagtcttcaattattactaaacttatctaagatcgtttccttaaaaaaaggagataatataagcaacgttggtaaagttgctaaaaacttttatattataaaaagtggtgttgtaagatcttattatgaagatgaaaaaggaaaacaatatacaagaacaattttcacaactcataaaacaacaggctgtttaagttctttaatttctagccaaccttgtaaacttacctatgaatgcttaacagattgcgagttttatcaatttaattttaaggaatttaaaaagttggtaaagaaagatatttatatttcaatgttttatagtaatatgctagaatcaatctttttagttatggaatctagaatttttgactcgtcgcttttaaatgctacagaaaggtatttaaaactaaaaaagggaatttctaatatcgaagatctgattcctcaatatcacatagcttcttatttaaaaatttctcctgttccattaagtagaaattag

SEQ ID NO: 21232 - protein, 184 aa, Unknown
  Obtained from environmental sample
  DOMAIN (25)...(119): Cyclic nucleotide-binding domain
  misc_feature (1)..(184): Xaa is any amino acid
MEFLKGFTRNFGGVPKPSLQLLLNLSKIVSLKKGDNISNVGKVAKNFYIIKSGVVRSYYEDEKGKQYTRTIFTTHKTTGCLSSLISSQPCKLTYECLTDCEFYQFNFKEFKKLVKKDIYISMFYSNMLESIFLVMESRIFDSSLLNATERYLKLKKGISNIEDLIPQYHIASYLKISPVPLSRN

SEQ ID NO: 21233 - DNA, 846 bp, Unknown
  Obtained from environmental sample
  misc_feature (1)..(846): n is a, c, g, or t
ttgatcactgcctatggcgatatcgatttagccattaggtcacttaaagaaggtgcatccgattttattgttaaaccgtgggagaacgagaaaattctggaaacaattagggaacatgttgaaaaacagaaaaaaaagcaatcaaaatatctcaatttagatacagacactaagatcattggcgaaagtgttccaatgcaggacgtgttcgttaaacttaaaaaagtagcaccaacagatgccaatattcttattcttggtgaaaatggaacaggtaaggatcttattgccaaagcaattcatgacaattcccttcgtaagaacaaaccttttgttaaagtagatgtaggttctttaactgatacactttttgaaagtgaactttttggatacaaaaaaggtgcctttaccgatgctcgtgaagaccgtaagggacgtttcgaaattgccaatggcggtactctttttttggatgaaataggcaatataacgttgaggcaacaggcacgtttattatcagttttacagaacaggcaagttacgccattgggcgccaaccaacctacacctattgatattcgtctaatctgcgctaccaacgtatctataagagatttggccgatgaagaacgttttagaaaggatctcatctaccgcattaacacggtagatattttgattccgccgttacgggaacgcggcacagacatcaccttgctggctcattattttttggattattatgctaaaaagtacggaaagcgggcatttagcatgtcactggattttattcagaaactaaaaaacatcattttagtgcaacgtgcgaggtctcagccagcctga

SEQ ID NO: 21234 - protein, 281 aa, Unknown
  Obtained from environmental sample
  DOMAIN (59)...(273): Sigma-54 interaction domain
  misc_feature (1)..(281): Xaa is any amino acid
MITAYGDIDLAIRSLKEGASDFIVKPWENEKILETIREHVEKQKKKQSKYLNLDTDTKIIGESVPMQDVFVKLKKVAPTDANILILGENGTGKDLIAKAIHDNSLRKNKPFVKVDVGSLTDTLFESELFGYKKGAFTDAREDRKGRFEIANGGTLFLDEIGNITLRQQARLLSVLQNRQVTPLGANQPTPIDIRLICATNVSIRDLADEERFRKDLIYRINTVDILIPPLRERGTDITLLAHYFLDYYAKKYGKRAFSMSLDFIQKLKNIILVQRARSQPA

SEQ ID NO: 21235 - DNA, 381 bp, Unknown
  Obtained from environmental sample
  misc_feature (1)..(381): n is a, c, g, or t
ttgttaccaaatgctgtaaccgacttttttgacaatactaatgacactttaaactttaacttatctaccgttaaagcatctagtttaggaaacgtacgtgttaatattaaaaatggtgtttaccctttgattgtgcaattagtagatgacaaaaacgaggttaaatacgaaaagtatatcaccaaaccagaacccttagatttctttttagttaaacctaacaagtattatataagagctatttttgactccaacaaaaataaaatatatgatacaggagtctatttaacttctaaaaacccagagcgtgtaagctattctgaaaaacctattgaggttagagttggctgggatttaattgaagaatttattctaaaataa

SEQ ID NO: 21236 - protein, 126 aa, Unknown
  Obtained from environmental sample
  misc_feature (1)..(126): Xaa is any amino acid
MLPNAVTDFFDNTNDTLNFNLSTVKASSLGNVRVNIKNGVYPLIVQLVDDKNEVKYEKYITKPEPLDFFLVKPNKYYIRAIFDSNKNKIYDTGVYLTSKNPERVSYSEKPIEVRVGWDLIEEFILK

SEQ ID NO: 21237 - DNA, 759 bp, Unknown
  Obtained from environmental sample
  misc_feature (1)..(759): n is a, c, g, or t
atgaccaaaataattattaaaattttaaagaaagcctttttacaccttcttttttgggttgtggtttggtttttcttttctagtttttttagtgtaggctctacaaacgagaactttattttttggttttctacaatattaagtctaattgcaattgtttcttcttacgcatttgtatatcatttaattcctaattttttaattgttaaaaaacagaagctttttgttttatacaccttttatgcatctgtttttattgtttgtgctgtattaatgactgtagtttttggttttgtgtttttctataatttggagtatcaaaaaatgccaggattaaccaagaattttggtgtaattttagtgtgtgttttgttaattattgttttggcaagtgcattcaaaatcctaaagcataatttaaaatcgttagaagaaaaaaagaccttagagaacaagtttttacaaaccaaattgcaactaaaagagcaggaattacaatttttaaagatgcaaattcatccgcattttttgtttaatacactaaataccttgtatggttttgccttgaaaaaatctgatgaagcaccagaaatgattttaaaattatctagcttgttagattatattttatatcaagttgataagcctttggtacatttacaagatgaaattacccatattgaagattatatttctttagaaaaatcgcgttttcaagaaggtttggaaatcactttaaataagaatatacaggtttga

SEQ ID NO: 21238 - protein, 252 aa, Unknown
  Obtained from environmental sample
  DOMAIN (164)...(247): Histidine kinase
  misc_feature (1)..(252): Xaa is any amino acid
MTKIIIKILKKAFLHLLFWVVVWFFFSSFFSVGSTNENFIFWFSTILSLIAIVSSYAFVYHLIPNFLIVKKQKLFVLYTFYASVFIVCAVLMTVVFGFVFFYNLEYQKMPGLTKNFGVILVCVLLIIVLASAFKILKHNLKSLEEKKTLENKFLQTKLQLKEQELQFLKMQIHPHFLFNTLNTLYGFALKKSDEAPEMILKLSSLLDYILYQVDKPLVHLQDEITHIEDYISLEKSRFQEGLEITLNKNIQV

SEQ ID NO: 21239 - DNA, 594 bp, Unknown
  Obtained from environmental sample
  misc_feature (1)..(594): n is a, c, g, or t
ttgttaaaaagttgtaaaaatgctgctgatgcaattttgtttctgcaagatcaaaaggctgatttgttttttttagacatcaatatgccagaaattaatggtataagtttggctaaaatcattaataataaagggcaaataatttttactacagcttatagagattatgctgtagatggttttaatttaaatgtggtagattatttgttgaaacccatttcttttgatcgatttttacaagccgttcaaaaagttacaatccacgaaactttagaaaatgataacgattttatgtttgtaagagcagatagaaaaatggttaaaattgattttcaaagtattttatacattgaaagtttaagcgattatgttaaaatatttaccatagaaaaaacaattgtaattagagaaactatcagtaatttagaagaaaaattacccgctaaaaagtttataagaattcatagatcgtttattatatcgtttaaaaaaatagattcttacaccaatgaatttatagaaattaaccagaaagcattgccaattagcagaagttataaagaatccgttttgcaaaaattagcagaagtatag

SEQ ID NO: 21240 - protein, 197 aa, Unknown
  Obtained from environmental sample
  DOMAIN (1)...(90): Response regulator receiver domain
  misc_feature (1)..(197): Xaa is any amino acid
MLKSCKNAADAILFLQDQKADLFFLDINMPEINGISLAKIINNKGQIIFTTAYRDYAVDGFNLNVVDYLLKPISFDRFLQAVQKVTIHETLENDNDFMFVRADRKMVKIDFQSILYIESLSDYVKIFTIEKTIVIRETISNLEEKLPAKKFIRIHRSFIISFKKIDSYTNEFIEINQKALPISRSYKESVLQKLAEV

SEQ ID NO: 21241 - DNA, 645 bp, Unknown
  Obtained from environmental sample
  misc_feature (1)..(645): n is a, c, g, or t
ttgaatcggctcgagacacggacgatgaattattttgaaactttaaattttttaagtctaattggcgctaccattggtggttttggcatcaataaaccatttttatgtaatggcgcaaatttagcttatcaaaaacagtttttcaaacaactaaatggttttgaaggcaatacaaatattgccagtggtgatgatatttttttaatggaaaaagctttaaaaactgataatcaaagcattctatatttaaaaaacaatcaagctatagttaccacaaaaccgcaaagtaatcttaaaaacttaatatcacagcgtgtacgttgggctagcaaaactagcaattataagaataattttgccaaaattgttgggctactagtattactaatgaatgctagtcttgtaattggattactattagtgactttaggactatttgcattaaaaccttttgcttatctgttttttataaaagtagctatagactttatactaatttataaagcttgccaattatttaataaagaagaattgcttaagcattatttgtggagctgttttatttacccattttttagtgtttatattgcctttatatctatgtttacaacctataaatggaaaaaccgaacatttaagaaatag

SEQ ID NO: 21242 - protein, 214 aa, Unknown
  Obtained from environmental sample
  misc_feature (1)..(214): Xaa is any amino acid
MNRLETRTMNYFETLNFLSLIGATIGGFGINKPFLCNGANLAYQKQFFKQLNGFEGNTNIASGDDIFLMEKALKTDNQSILYLKNNQAIVTTKPQSNLKNLISQRVRWASKTSNYKNNFAKIVGLLVLLMNASLVIGLLLVTLGLFALKPFAYLFFIKVAIDFILIYKACQLFNKEELLKHYLWSCFIYPFFSVYIAFISMFTTYKWKNRTFKK

SEQ ID NO: 21243 - DNA, 891 bp, Unknown
  Obtained from environmental sample
  misc_feature (1)..(891): n is a, c, g, or t
ttgggaccgctaacgacaggaaaccccggcaagtacgaaacgaaagaaagttataaatggcaacgctcgtcggaagaaatgagtacccgatttgcagatgtcatggacaatatcataagcgtttgtgatcgagaatctgatatgtttgagtatattgattataaaacaataaataatcaacggtttgtagtgagggccaagcatgagcgggtcgtgaatgcagacggcgataaactaagtccctacattgaaaatcaatctagcgaagcttcatattcggttaagatacagcaaaaaggaggccgaaaagcacgtattgcgaaagtagctgtacgttatgcttgcattactatttatccgcctaaaaaacacaagaaacttggtggtatgaatttaacagtaataagttgcaacgagattgatccaccaagtggaacaagtcctttgtcgtggaaattgtatacaggcgaaccgataaatagtgcttctgatgcactaaagatagttagattttatgaactaagatggcgagttgaagagttccataaagcgtggaagtcagcgggcactcaagttgagtcgtttcgcatgcaaacgcgaaataatctagaaaagatcattgtaataacagcatttattgcggtgagacttctccagttacgcgagtttgttgtcgataaagataatgcaaaatcaattagttgcgacaattttttcaatcttcttgaatggaaactgttgtggtcaaagactgaaactaaaaaagcacctaacacaacaccttcattacattgggcttattatgcacttgccaaattaggcgggtggcacaacagcaagcaaacaggtgttgttggttgggaagctttatggaaaggttgttttcactga

SEQ ID NO: 21244 - protein, 296 aa, Unknown
  Obtained from environmental sample
  misc_feature (1)..(296): Xaa is any amino acid
MGPLTTGNPGKYETKESYKWQRSSEEMSTRFADVMDNIISVCDRESDMFEYIDYKTINNQRFVVRAKHERVVNADGDKLSPYIENQSSEASYSVKIQQKGGRKARIAKVAVRYACITIYPPKKHKKLGGMNLTVISCNEIDPPSGTSPLSWKLYTGEPINSASDALKIVRFYELRWRVEEFHKAWKSAGTQVESFRMQTRNNLEKIIVITAFIAVRLLQLREFVVDKDNAKSISCDNFFNLLEWKLLWSKTETKKAPNTTPSLHWAYYALAKLGGWHNSKQTGVVGWEALWKGCFH

SEQ ID NO: 21245 - DNA, 576 bp, Unknown
  Obtained from environmental sample
  misc_feature (1)..(576): n is a, c, g, or t
ttgacgccccgagccaggactagtggtgtatacgcctactttaattttccggccccgttaatgcgctcattacccgtcttattaaaccaagttaagcaagtcactattgtagtggccgataaaacggctaacgacttttatgtaccgcctagcgacccatttagtaaaataggcgcgttgccgtatttatacgaaactattttgcataaatttgttaaaacacaaaaacgccatattgataacggtaatttaaacgtttatctatggaagcacgacagtaattcgtttcatttaaaaggcatttgttcagacagaaaagtacatttactcagtggtcataaccttaacccgcgggcgtggggactagatgttgaaaatggtattttaattgaagatccacaacaaacaataatgcaagatattgacaacgaaaagcaagaaattctgcagcactgtcgccgtttaactggcccagatgatttagaaaccatggacgattatccgcaagcggttaaaaagttacttggccaagcaaaacgtgtaaaagtagattttataattaaacgttttatataa

SEQ ID NO: 21246 - protein, 191 aa, Unknown
  Obtained from environmental sample
  misc_feature (1)..(191): Xaa is any amino acid
MTPRARTSGVYAYFNFPAPLMRSLPVLLNQVKQVTIVVADKTANDFYVPPSDPFSKIGALPYLYETILHKFVKTQKRHIDNGNLNVYLWKHDSNSFHLKGICSDRKVHLLSGHNLNPRAWGLDVENGILIEDPQQTIMQDIDNEKQEILQHCRRLTGPDDLETMDDYPQAVKKLLGQAKRVKVDFIIKRFI

SEQ ID NO: 21247 - DNA, 582 bp, Unknown
  Obtained from environmental sample
  misc_feature (1)..(582): n is a, c, g, or t
atgtttgacgccaccgagcaagagctagtgttgtatacgccttactttaattttccggcgccgttaatgcgctcattacgccgcttattaaaacaaggtaagcaagtcactattgtagtgggcgataaaacggctaacgacttttatgtaccgcctagcgagccatttagtaaaataggcgcgttgccgtatttatacgaaactattttgcataaatttgttaaaacacaaaaacgccatattgataacggtaatttaaacgtttatctatggaagcacgacagtaattcgtttcatttaaaaggcatttgttcagacagaaaagtacatttactcagtggtcataaccttaacccgcgggcgtggggactagatgttgaaaatggtattttaattgaagatccacaacaaacaataatgcaagatattgacaacgaaaagcaagaaattctgcagcactgtcgccgtttaactggcccagatgatttagaaaccatggacgattatccgcaagcggttaaaaagttacttggccaagcaaaacgtgtaaaagtagattttataattaaacgttttatataa

SEQ ID NO: 21248 - protein, 193 aa, Unknown
  Obtained from environmental sample
  misc_feature (1)..(193): Xaa is any amino acid
MFDATEQELVLYTPYFNFPAPLMRSLRRLLKQGKQVTIVVGDKTANDFYVPPSEPFSKIGALPYLYETILHKFVKTQKRHIDNGNLNVYLWKHDSNSFHLKGICSDRKVHLLSGHNLNPRAWGLDVENGILIEDPQQTIMQDIDNEKQEILQHCRRLTGPDDLETMDDYPQAVKKLLGQAKRVKVDFIIKRFI

SEQ ID NO: 21249 - DNA, 807 bp, Unknown
  Obtained from environmental sample
  misc_feature (1)..(807): n is a, c, g, or t
atgggtagaacatctgttacaagcaatgacccgtatgtaacaacagatttttcgacagactatttaagtttgtattatatgtttgataacgaaaaaagtgctgaaactaatctcgcagaaattttaaatgaatctattgaattagaagatttaaaagatttcttttttgatagaagatttgctcttaaaaacaaggagttttttaatagattggaaaacgagttttgtaatttcttaacttatcaatctaaagagaatcacacaacagcttttatatttctttatagaatattagaggtgatttctttctcatttcctcttatctacgcttctaaaacttatgattttaaacatacatatgggaagttaaaagaaattttctcgaataattcaggaaattcaaaaggaaaacttggtttttttaaaactgcaattaaagtaatgtttgaagattccgatttacttgaaacatcaattgatattgagttaaacgatgaatttgaaaaaaatgaaaaaatttacaaagcattaaaaagtgtttgcgatgataaaatttttcatactgatacaacagaaaatagtaaaatatcaatttgttttggagaagtaagttcttttataataacacttatgaacaggttttttcatttatttaatagaggagataaaaatttagaatcaattgaaatcattgacccagactatttattctctaaactgaatgaacctttgtttacctggatttgtgtaatttatgtagaaataaataagtttcttttggaagaacacgaaaagtacgtacgctaa

SEQ ID NO: 21250 - protein, 268 aa, Unknown
  Obtained from environmental sample
  misc_feature (1)..(268): Xaa is any amino acid
MGRTSVTSNDPYVTTDFSTDYLSLYYMFDNEKSAETNLAEILNESIELEDLKDFFFDRRFALKNKEFFNRLENEFCNFLTYQSKENHTTAFIFLYRILEVISFSFPLIYASKTYDFKHTYGKLKEIFSNNSGNSKGKLGFFKTAIKVMFEDSDLLETSIDIELNDEFEKNEKIYKALKSVCDDKIFHTDTTENSKISICFGEVSSFIITLMNRFFHLFNRGDKNLESIEIIDPDYLFSKLNEPLFTWICVIYVEINKFLLEEHEKYVR

SEQ ID NO: 21251 - DNA, 750 bp, Unknown
  Obtained from environmental sample
  misc_feature (1)..(750): n is a, c, g, or t
atgggtagtacatctgttacaaacaatgacacgtatgtaacaacagatttttctacaaactatttaagtttgtattatatgtttgataacgaaaaaagtgctgaaactaatcttgcagaaattttaaatgaatctattgaattagaagatttaaaagatttcttttttgatagaagatttgctcttaaaaacaaggagttttttaatagattggaaaacgagttttgtaatttcttaacttatcaatctaaagagaatcacacaacagcttttatatttctttatagaatattagaggtgatttctttctcatttcctcttatctacgcttctaaaacttatgattttaaacatacatatgggaagttaaaagaaattttctcgaataattcaggaaattcaaaaggaaaacttggtttttttaaaactgcaattaaagtaatgtttgaagattccgatttacttgaaacatcaattgatattgagttaaacgatgaatttgaaaaaaatgaaaaaatttacaaagcattaaaaagtgtttgcgatgataaaatttttcatactgatacaacagaaaatagtaaaatatcaatttgttttggagaagtaagttcttttataataacacttatgaacaggttttttcatttatttaatagaggagataaaaatttagaatcaattgaaatcattgacccagactatttattctctaaactgaatgacctttgtttacctggatttgtgtaa

SEQ ID NO: 21252 - protein, 249 aa, Unknown
  Obtained from environmental sample
  misc_feature (1)..(249): Xaa is any amino acid
MGSTSVTNNDTYVTTDFSTNYLSLYYMFDNEKSAETNLAEILNESIELEDLKDFFFDRRFALKNKEFFNRLENEFCNFLTYQSKENHTTAFIFLYRILEVISFSFPLIYASKTYDFKHTYGKLKEIFSNNSGNSKGKLGFFKTAIKVMFEDSDLLETSIDIELNDEFEKNEKIYKALKSVCDDKIFHTDTTENSKISICFGEVSSFIITLMNRFFHLFNRGDKNLESIEIIDPDYLFSKLNDLCLPGFV

SEQ ID NO: 21253 - DNA, 912 bp, Unknown
  Obtained from environmental sample
  misc_feature (1)..(912): n is a, c, g, or t
ttgacttggntgagaaacacgcgcagtcaaaaaaagacgaagctactttacgagtcggataaaatatataagcataaactaggtcaaaatagtgttgatgacactgtcgtttttcatgaagaggatgacacctttaatacatttgtgtataaaaccaagtctaaaaagtatttagtaattggaagttcaagtacgcaaacaaccgaatatagatttttagatgccaatacacctgatggtgaatttaaaatttttcaagagcgcgaaagaaaccttgaatattcaatagctcactatcaagataatttttacatcattacaaataaggatgaagcaaccaattttaaacttcaaaaagtagccgaaaccaatacagataaggttaattgggaggatgttattccgcatcgtaaagatgtattattagaagatattgagatttttaaagattatttaattgtaaacgaacgtgaaaatggtttaaatcaattaagaattattagttgggatggtaaagaagactattatttagattttgaaagtgaaacctacacagcagacataggtaataatccagattttgatagcaactatttaagatactcttttaattctttaacaacaccaagctcgataatcgattatgatttaaagactaaaacaaaaacggtaaaaaaagagcagcaagtattagatgattcatttaataaagacaattatatatcacaaagggtttgggcaacagctaaagatggngtaaaaataccaatgtctgtagtgtatagaaaaggaataaaacttgacggacctagtccgttattacaatatgcatatggctcatatggagcaacaatagacacttattcttcttcaatacgacttaaattgttagacagaggtttatctatgtaa

SEQ ID NO: 21254 - protein, 303 aa, Unknown
  Obtained from environmental sample
  DOMAIN (1)...(228): Prolyl oligopeptidase, N-terminal beta-propeller domain
  misc_feature (1)..(303): Xaa is any amino acid
MTWXRNTRSQKKTKLLYESDKIYKHKLGQNSVDDTVVFHEEDDTFNTFVYKTKSKKYLVIGSSSTQTTEYRFLDANTPDGEFKIFQERERNLEYSIAHYQDNFYIITNKDEATNFKLQKVAETNTDKVNWEDVIPHRKDVLLEDIEIFKDYLIVNERENGLNQLRIISWDGKEDYYLDFESETYTADIGNNPDFDSNYLRYSFNSLTTPSSIIDYDLKTKTKTVKKEQQVLDDSFNKDNYISQRVWATAKDGVKIPMSVVYRKGIKLDGPSPLLQYAYGSYGATIDTYSSSIRLKLLDRGLSM

SEQ ID NO: 21255 - DNA, 504 bp, Unknown
  Obtained from environmental sample
  misc_feature (1)..(504): n is a, c, g, or t
atggaacaaaataaacaagtttttgatagtgtattagacctaataggtaatacaccaatgataaaactaaaaaaaattacttcaggttttaaagggaattatctagcaaaggttgaagcctttaatccaggtcattcatcaaaagatagaatcgctttatacattttagagcaagcagaaaagcaaggtatacttaaaccaggagacacaataattgaaactacatcaggtaatacaggatttagtattgcaatggttagtgtaattaaaggttatgattgcatcttggcagttagttcaaaatcttcagcagataagattgacatgttaaaaaacatgggagctaaagtatatgtttgtccagcaaacgttagtgcagatgatccaagaagttattatcaagtagcaaaacgattacacgaagaaattaaaggatctgtttatattaatcaatactttaatcaactaaatattgatgcacatacacctcagcccgattcttga

SEQ ID NO: 21256 - protein, 167 aa, Unknown
  Obtained from environmental sample
  DOMAIN (11)...(167): Pyridoxal-phosphate dependent enzyme
  misc_feature (1)..(167): Xaa is any amino acid
MEQNKQVFDSVLDLIGNTPMIKLKKITSGFKGNYLAKVEAFNPGHSSKDRIALYILEQAEKQGILKPGDTIIETTSGNTGFSIAMVSVIKGYDCILAVSSKSSADKIDMLKNMGAKVYVCPANVSADDPRSYYQVAKRLHEEIKGSVYINQYFNQLNIDAHTPQPDS

SEQ ID NO: 21257 - DNA, 468 bp, Unknown
  Obtained from environmental sample
  misc_feature (1)..(468): n is a, c, g, or t
atggaacaaaataaacaagtttttgatagtgtattagacctaataggtaatacaccaatgataaaactaaaaaaaattacttcaggttttaaagggaattatctagcaaaggttgaagcctttaatccaggtcattcatcaaaagatagaatcgctttatacattttagagcaagcagaaaagcaaggtatacttaaaccaggagacacaataattgaaactacatcaggtaatacaggatttagtattgcaatggttagtgtaattaaaggttatgattgcatcttggcagttagttcaaaatcttcagcagataagattgacatgttaaaaaacatgggagctaaagtatatgtttgtccagcaaacgttagtgcagatgatccaagaagttattatcaagtagcaaaacgattacacgaagaaattaaaggatctgtttatattaatcatactttatcaacataa
